United States Patent 9,675,668 (MODIFIED POLYNUCLEOTIDES ENCODING HEPATITIS A VIRUS CELLULAR RECEPTOR 2) - sequence listing, part 21

SEQ ID NO: 44414 - DNA, 933 bp, Artificial Sequence
  Description of Artificial Sequence: Synthetic coding sequence
atgcagctgaacaacaacgtgaccgagttcatcctgctgggcctgacccaggaccctttttggaagaagattgtcttcgtgatcttcctgagactgtatctcgggaccttattgggaaacttgttgatcatcatctccgttaagacttctcaggctctaaagaatcccatgtttttttttctgttctatttgtctcttagcgatacatgtctgagcacctctattactccaagaatgattgttgatgcactcctaaagaagaccactatctcgttttcagagtgtatgatccaagtcttctccagtcacgtgtttggatgtttagaaatcttcattctgattctaactgctgtggatcggtatgtcgatatctgcaagccccttcactacatgactatcatctcccagtgggtctgcggggtgttgatggccgttgcctgggtagggtcgtgtgtgcatagcttagtgcagatcttcctggctttgagcctgcctttttgcgggcccaacgtgattaaccattgcttttgtgaccttcaaccccttcttaaacaggcgtgcagcgaaacttacgtggtaaacctgctgttggtgtctaatagcggggctatttgcgccgtgtcttacgttatgctgatcttctcgtatgtcatattcttacactcgttacggaaccatagcgccgaggtcataaagaaggctctgtctacgtgtgtatcgcatatcatcgtcgtcatccttttctttggcccctgcatcttcatgtacacttgtctggctactgtcttccctatggacaagatgatcgccgtgttctacacagtaggcacgagttttcttaatccagtgatctacacactgaagaacacagaggtgaaatctgccatgaggaagctgtggtccaagaaattgataaccgatgataagcggtag

SEQ ID NO: 44415 - DNA, 990 bp, Artificial Sequence
  Description of Artificial Sequence: Synthetic coding sequence
atgcagctggtgctgctgctgatgttcctgctggtgttcatcggcaatactgctccagcgttctcagtgacactcgaatctatggacatcccgcagaacattactgaatttttcatgttagggctgtctcagaactctgaggtgcaaagggtgctgttcgtggtttttctccttatctacgtagtcacagtgtgcggcaatatgctaattgtggtgacaatcaccagctccccgacgctcgcatcacctgtctactttttcctggctaacttaagtttcatagacaccttctactcttcgtctatggcacctaaattgatagcggattccctgtatgaaggccgaacaatttcctatgagtgctgtatggctcagctcttcggcgcccattttcttggcggggtagagattatcctcttgaccgtcatggcttatgacaggtatgtcgccatttgcaaaccactacacaacaccacaataatgacgcgccacctgtgcgcaatgctagtgggagtggcctggcttgggggcttcctgcactccctagtccagctgctgttggtgctctggctgccgttttgcgggcccaatgtaatcaatcattttgcgtgtgacctgtacccattgctcgaggttgcctgcactaatacatacgtcatcggtctactggtggtcgcgaattctggcctgatctgtctgctcaacttcctgatgttggccgcgtcttatatagtcatactttactccctgcgctctcatagcgcagacggccggtgcaaggcactgtccacatgcggcgcacactttattgtggttgccctgttctttgtcccatgcatttttacgtatgtccacccattctcaactctacctattgacaagaacatggctctgttttatggtatcctgactccaatgctgaaccctctcatttacactctgagaaacgaagaagtcaagaacgccatgaggaagctgttcacgtggtag

SEQ ID NO: 44416 - DNA, 603 bp, Artificial Sequence
  Description of Artificial Sequence: Synthetic coding sequence
atcctgctgaccgtgatggcctacgaccggtacgtggccatctgcaagccactgcacaatacgaccattatgacccggcacttgtgcgcaatgcttgttggcgtggcatggctgggagggttcctgcactcccttgtacagcttctgctcgtgctgtggctgcctttctgcggtccaaacgttatcaatcactttgcttgcgatttatacccactgctcgaagtcgcctgcaccaacacctacgtgatcggcctgctagttgtggccaattccgggttaatatgcttgctgaacttcctcatgttggctgcgagttatatcgtcattctgtactccctgaggtcccatagtgccgacgggcggtgtaaagccctctccacctgtggggcgcactttatcgtggtggcactcttcttcgtcccttgcatttttacctatgtgcacccattctcaactcttcccatcgacaaaaatatggcgctgttttatggaatactgaccccaatgcttaaccccttgatttacacattgcggaatgaggaggtgaaaaacaataccattaagcatttttggaagcacatcttggaagaagacaagacctag

SEQ ID NO: 44417 - DNA, 981 bp, Artificial Sequence
  Description of Artificial Sequence: Synthetic coding sequence
atgtacgtgagcaactgcaacccctgcgccatccaccggaagatcaactacccaaacaccaaacttgactttgagcaagtgaacaatatcactgaattcattttgctgggactgactcagaatgccgaggcacagaagctccttttcgccgtctttactcttatctatttcctgacaatggtagacaacctcatcatcgtggttacaatcacgacctcacctgccctagattctccagtgtacttttttttatccttcttttcatttatcgacggctgttccagtagcaccatggcacctaaaatgattttcgacctcctcaccgaaaaaaaaaccatcagttttagcggatgcatgacccagctcttcgttgagcacttctttggtggagtggagatcatcctattggtcgtcatggcatacgactgttacgttgccatttgcaaaccactttactatctgatcacaatgaacagacaggtgtgcggattactggtcgccatggcttgggtcggaggattcctgcacgctctgattcagatgttgctcattgtctggctacccttctgtgggccaaacgtgatcgaccattttatttgtgatttatttccattactgaaactgtcttgtacagacacacatgtattcggcttgttcgttgcagctaactctggcctgatgtgcatgcttatcttcagcatattgattacaagttatgtcctgattctatgctcccagagaaaggctctgagcacctgtgcattccatatcacagtggtcgtgctctttttcgtgccgtgcatcctagtctatctgagacccatgattacatttcccatcgacaaagctgtttccgtgttctatactgtagtgacacccatgctaaatcctctgatctatacactacgcaatacagaagtaaagaatgccatgaagcaactgtggtcacagatcatttggggaaacaatctatgcgattag

SEQ ID NO: 44418 - DNA, 930 bp, Artificial Sequence
  Description of Artificial Sequence: Synthetic coding sequence
atggagaaccagaacaacgtgaccgagttcatcctgctgggcctgactgagaacctggaactgtggaaaatatttagtgcggtatttctggttatgtatgtggccacagtgctggagaacttgttgatcgtcgtgaccatcataacctcccaaagcctaaggtcaccgatgtacttttttctgacatttctcagcctgctggacgtgatgttttcttctgtggttgcccctaaggtgattgtcgacacactgtccaaatcgaccactatttctcttaagggttgccttacacagttgttcgttgaacatttcttcggcggggttggcatcatactgttgacagttatggcctatgaccgctacgtggctatctgcaaacccctgcattatacaatcatcatgtcccccagggtctgctgcctcatggtggggggggcctgggtgggcgggttcatgcatgcaatgattcagttattgtttatgtatcagatcccgttttgtggacctaatatcatcgaccactttatttgcgatctcttccagcttttaacgctcgcctgcaccgatacacacatactggggctcctggtgacactgaattctggaatgatgtgtgtcgccattttcctgatcctgattgcttcatacacggtaatattgtgttcattgaaaagttatagcagcaaggggagacataaagccctctccacctgctcttcacacctgaccgtggtggtcctgtttttcgtgccgtgtatctttctgtatatgaggccagtggtaacacatcccattgataaggcaatggccgtgtctgattccattatcacacccatgctgaatccacttatctatacattgcgaaacgccgaggtaaaatccgctatgaagaaactgtggatgaagtgggaggcactagctgggaaatag

SEQ ID NO: 44419 - DNA, 933 bp, Artificial Sequence
  Description of Artificial Sequence: Synthetic coding sequence
atggagccccagaacaccacccaggtgagcatgttcgtgctgctggggttctcccaaacccaagagctgcagaagttccttttcctactttttctcctggtttatgtgacgacaattgtgggcaacctgctcatcatggttacagttactttcgactgtcgtctgcacacgccaatgtactttcttcttagaaatctcgccctgatcgacttgtgctattccaccgttacaagccctaagatgctcgtcgatttcttgcatgaaacgaaaacgatctcataccagggctgcatggcacagatatttttttttcatctgctgggtggaggaaccgtgttttttctgagtgtgatggcctacgatagatatattgcaatatcacagccccttcgctacgtgaccattatgaatactcagttatgtgtgggcttagttgtggcagcctgggtaggcggattcgtgcactctatagtacaactagccctgatcttgccactgccgttttgcggacccaacattctggataatttctattgcgacgtccctcaggtgctgagattggcttgcactgatacctcacttttagagttccttatgatttcaaattcgggattactggtgattatctggtttctgctgctcctgatcagttacacagtgattctggtgatgctccgctctcacagtggcaaggcacgtagaaaagccgcctccacatgcaccactcatatcattgtcgtgtccatgatctttattccgtgcatctacatttatacatggcccttcacaccatttctgatggacaaagctgtctccatcagctatactgtgatgacgcccatgctcaatcctatgatttataccctcaggaaccaggatatgaaggccgcaatgcgaaggctaggcaaatgtctggtgatttgcagagagtag

SEQ ID NO: 44420 - DNA, 936 bp, Artificial Sequence
  Description of Artificial Sequence: Synthetic coding sequence
atggagatggagaactgcacccgggtgaaggagttcatcttcctgggcctcactcagaacagggaagtgtcgctggtcctgtttctcttcctgctgctggtttatgtaaccactctgttgggcaacctgttgattatggtgactgttacttgtgagtcaagacttcacacaccgatgtactttttactgcataacctgagtatagctgacatctgtttcagctcaattactgtacctaaggtgttagtcgatctcctttcagagcgtaagaccatctcttttaaccattgtttcacccagatgtttcttttccatctgatcggcggagtcgatgtcttttccctgtccgttatggcattggacagatatgtcgcaatttcaaagcccctgcactacgccactattatgtcacgggatcactgcatcgggttaactgtggccgcatggctcggcggattcgtgcattctatagtgcagatctctcttctgctccccctgcccttctgcggccccaacgttctcgatacattttattgtgatgtacacagggtgctcaaactggctcacactgatattttcatcttggagcttctgatgatctccaacaatggtctcctgaccacactgtggttctttcttcttctcgtctcttacatcgtgattctgagtctccccaagagccaggctggggagggccgtcggaaagccattagtacatgcacctctcacattacagtggtcactctacactttgtaccttgtatttacgtgtatgccaggcctttcacggcgctacctatggataaggcaataagcgtgacctttaccgtcatctctccactgttaaatcccctgatttacacactgcgaaatcacgagatgaagagcgcgatgcgacggcttaaaaggcgattagtgccctctgatcggaaatag

SEQ ID NO: 44421 - DNA, 936 bp, Artificial Sequence
  Description of Artificial Sequence: Synthetic coding sequence
atggagctgggcaacgtgacccgggtgaaggagttcatcttcctggggttgacacagtcccaagaccaatctctggtgctgtttctctttctctgcctcgtctacatgactaccctgctgggtaatctactgattatggttacagtaacatgcgagtcccgcctacacactcccatgtatttcctcttgagaaacctggctatcctggatatctgcttcagcagtactactgcacccaaagtgctccttgatttgctaagcaaaaaaaagaccatctcatatacaagctgcatgacccagatttttctcttccacttgctggggggggcagatatattttctctgagcgtgatggctttcgattgctacatggccataagcaaacccctccattatgttactattatgtctcgcggacagtgcacagcccttatttcagcctcatggatgggtggatttgtgcattcgatcgttcagatctcgctgctgctgcctcttcccttttgtggaccaaatgtcctcgacaccttctactgtgatgtcccacaagtgctgaaactcacctgcactgatactttcgctctagaattcctgatgatctcaaataacggactggtcaccacattatggttcattttccttctcgtctcttacacagtgatcttaatgacactgaggagtcaagcaggtggagggcgaagaaaagcgatcagcacttgcacctcccacatcaccgtggtgactctgcactttgtgccatgtatttacgtttatgccaggcctttcactgcactccccactgagaaggcgatttccgtgaccttcaccgtcattagtcctttactaaacccactgatatatacgctcaggaatcaggaaatgaagagcgctatgcgccgcctgaaacgtcgcttagtgccctccgagagggagtag

SEQ ID NO: 44422 - DNA, 924 bp, Artificial Sequence
  Description of Artificial Sequence: Synthetic coding sequence
atggagaccggcaacctgacctgggtgagcgacttcgtgttcctggggctttctcagactcgggaactccagcgctttttgttccttatgtttctctttgtgtacattacaactgtcatgggcaacatactgatcatcataaccgtcacatctgacagtcaattgcataccccaatgtacttcttgctgcggaacttggctgtgctggacttgtgttttagtagtgtgacagccccaaagatgctggtggatcttctgtccgaaaaaaagacgatttcttatcagggatgcatgggacaaatctttttcttccactttctcggtggcgccatggtgtttttccttagcgtaatggcttttgaccgcctgatagccataagccgccctctgcggtatgtgactgtgatgaacactcagttgtgggtgggactggtagtggccacatgggtagggggatttgtacattctatcgtgcaattggccctgatgctcccactccctttctgtggccccaatattctcgacaatttctactgtgacgtgccacaggttttacggctggcctgcactgacacgtccctcctcgagttcctcaagatctccaactctggactactggatgtagtttggtttttcctgctcctgatgtcttacctctttatcttagtcatgctgcgaagtcacccgggcgaagctcggcgcaaagccgccagtacttgcaccacacatatcatcgtcgtatctatgatttttgtcccctctatttacctgtacgccagaccattcacacccttccccatggacaaactggtgagtatcgggcacaccgtcatgacacctatgctcaaccccatgatctatacactgagaaatcaagacatgcaagctgctgtacgcagactggggaggcaccgcctggtgtag

SEQ ID NO: 44423 - DNA, 957 bp, Artificial Sequence
  Description of Artificial Sequence: Synthetic coding sequence
atgaaccccgccaaccacagccaggtggccggcttcgtgctgctggggctctcacaagtttgggagctccgcttcgtattttttaccgtgttttctgcggtctattttatgaccgtcgtcgggaacttactgattgtggttatcgtgacgagcgacccccacctgcataccacaatgtatttcctgctggggaatctgtcattcttggacttctgctattcctcgatcaccgctccccggatgctcgttgacctgctctcagggaaccccaccatctccttcggcggctgcctgacccagctgtttttctttcattttattggcggaatcaaaattttcttgttaacagtaatggcctacgatcgctacatcgctatctctcaaccccttcattacacactgataatgaaccagacagtttgcgctttactgatggccgctagttgggtcggcggatttattcattccatagtccagatcgccctgactatccagctgccgttctgcgggccggataaactcgacaacttctactgcgatgtgccacaacttatcaagctcgcatgcaccgacacgttcgtgctggaactcctcatggtctctaacaacggcctcgtcaccttgatgtgttttcttgtgctcctgggctcatacaccgctttactggtgatgctccgttcacactcacgagagggcagatcaaaggccctttcgacttgcgccagtcacattgccgtggtgaccttaatcttcgtgccttgcatttacgtgtacacgcgcccattcaggacattcccgatggacaaggcagtaagtgtgttgtatacgatcgtgaccccaatgctgaatcctgcaatctataccctcaggaacaaagaggtcatcatggcgatgaagaagctgtggcgcagaaagaaggatccaattggacctctcgagcaccgtcctctgcactag

SEQ ID NO: 44424 - DNA, 945 bp, Artificial Sequence
  Description of Artificial Sequence: Synthetic coding sequence
atggaccagatcaaccacaccaacgtgaaggagttcttcttcctggagctcacacgcagtagagagttagagttcttcttatttgtggtgttctttgcggtatatgttgcaactgtgctgggaaacgctctaattgtggtcacaattacatgcgagagtcgactgcatacacccatgtatttccttctacgaaataagtcagttttagacattgtgttcagtagcatcaccgtcccaaagtttctggtagacctgttaagcgatcgcaagactatttcctataacgactgcatggcccagattttcttcttccattttgcaggtggggccgatatattttttttgtccgtgatggcctatgaccgctacttggccattgccaagccactgcactacgtgaccatgatgcggaaagaagtgtgggtagctctcgtagtggcatcatgggtcagtgggggacttcacagtataatccaggtgattttgatgcttccattccctttttgtggaccaaatactttggacgccttctactgctatgtgctgcaggtggtgaagttagcctgtaccgatactttcgctctggagcttttcatgatttctaataacgggttggtaacccttctctggtttctgctcctgcttggatcttataccgtgatcttggtgatgctgagaagccatagcggagagggaaggaacaaagcgctgtcgacttgcacttctcacatgttagtagtaacacttcacttcgtgccctgcgtgtatatctactgtagaccgtttatgacgttacctatggatacaacgattagtattaacaatactgtgatcacacctatgctgaatcctataatatacagtctgagaaaccaagagatgaagtccgccatgcagcgtctccagcggaggttgggccccagcgagagtagaaaatggggatag

SEQ ID NO: 44425 - DNA, 945 bp, Artificial Sequence
  Description of Artificial Sequence: Synthetic coding sequence
atggaccagcggaactacacccgggtgaaggagttcaccttcctgggaatcacccagtctcgcgagctatctcaagtactcttcacatttctgttcctggtctacatgaccactctgatgggtaactttctgattatggtaactgttacttgtgaaagtcacctccatacccctatgtatttcttgttgcggaatctcagcattttagacatctgcttctctagcatcaccgcaccgaaggtgttgattgacctgcttagcgagaccaagaccattagctttagcggctgtgtcacacaaatgttcttttttcaccttctgggcggtgcagacgttttctcactgtccgtgatggccttcgatcgatatatcgccatctcaaaacctcttcattacatgacaataatgagtagggggagatgcactggcctgattgtcgcttcctgggtgggaggtttcgttcatagtattgctcagataagcttgttgttgccccttccattctgtgggcccaacgtgcttgatacattttattgtgatgtcccccaagtcttgaaactggcctgtaccgacacttttactcttgagctcctgatgataagtaacaacggcctggttagctggtttgtctttttcttccttctgatctcttacactgttattctcatgatgctacggagtcatactggggagggtaggcgaaaagctatctccacgtgtacatcccacatcacagtcgtcactctccattttgtgccctgtatctacgtgtatgctcgccctttcacagctcttccaaccgacactgccatcagtgtaacttttactgtcatctccccgttgctgaatcctattatctatacacttagaaatcaggagatgaagctcgcaatgaggaaactgaaacgcaggttaggccagtcagaacggatcctgattcagtag

SEQ ID NO: 44426 - DNA, 942 bp, Artificial Sequence
  Description of Artificial Sequence: Synthetic coding sequence
atggacagcctgaaccagacccgggtgaccgagttcgtgttcctgggactgactgacaatcgggtattagagatgctctttttcatggccttttcagctatttacatgctaacactgagcggaaacatcctcattattattgccaccgtgttcacacccagcctgcacacccctatgtatttctttctttcaaacctttcctttatagatatctgtcacagtagtgtaaccgtgccaaaaatgctagagggattgctcctggagagaaagaccatttcatttgataactgcatcacacagctgttttttctgcatttgtttgcctgtgcagaaatctttctgcttataattgtcgcatatgatcgctacgtagctatttgcacccccctgcattatccaaacgtcatgaacatgcgggtgtgcatacagctggtctttgcgctgtggttaggggggaccgtccacagcctgggccaaaccttccttacaatacggctgccctactgtggaccaaatatcattgactcctatttctgcgatgtgccgttagtcatcaagcttgcatgtacagatacgtaccttaccggtatcctaattgtcacaaatagtggaactatcagcctttcatgcttcctcgcagttgtgaccagttatatggttatcctggtttcgctaagaaagcacagcgctgagggaaggcagaaagcccttagtacatgtagtgcccatttcatggtcgtggccctgttcttcgggccatgcatctttatctatactcggcccgatacatctttctccatcgataaagtggtgtcggtattctacactgtcgttacaccgttgctcaacccctttatctacaccctcaggaacgaggaagtaaaatcagctatgaagcagctcaggcagagacaggtcttcttcactaaaagttacacctag

SEQ ID NO: 44427 - DNA, 939 bp, Artificial Sequence
  Description of Artificial Sequence: Synthetic coding sequence
atgaacggcatgaaccacagcgtggtgagcgagttcgtgttcatggggttgaccaactcccgggaaatccagctcctgctgtttgtgttttctttgctgttctatttcgctagtatgatggggaaccttgtgattgtgttcacagtgactatggatgcccacttgcacagtcctatgtattttctgctagctaatctgtccataattgatatggctttctgctctataaccgcgccaaaaatgatttgtgacatcttcaaaaagcataaggcaattagttttcgcggctgcataacacagattttcttctcacatgccctgggaggcactgaaatggtattgctgatcgccatggcttttgataggtatatggccatttgcaagccactccactatctcacaataatgtctccgcgaatgtgtctgtatttcttagccacgtcaagcatcataggcctgattcactccctcgtacagctggtcttcgtcgtcgatctgcccttctgtgggcccaacattttcgactcattttactgcgatttgcccagacttctgcgccttgcttgtacaaacacccaggaactcgagtttatggttaccgttaactctggtctgataagcgtggggtcattcgtgctcctggtcatctcctatattttcatcctttttactgtgtggaaacactcttctggtggcttggctaaggctctctccactctttctgcacatgtgacggtagtgatcctgttctttggcccacttatgttcttctacacctggccatcaccaacctcacatttagacaagtatctggcgatctttgacgccttcatcactccattcctgaatcccgtgatttatacctttcggaataaggacatgaaggtcgctatgagacggttgtgcagccggttggctcactttactaagatactgtag

SEQ ID NO: 44428 - DNA, 939 bp, Artificial Sequence
  Description of Artificial Sequence: Synthetic coding sequence
atggacggcgagaaccacagcgtggtgagcgagttcctgttcctgggactcacccacagctgggaaattcaactcttacttctggtgttctcttctgtcctttatgtggcgtccattactggcaacattctcattgttttttctgtgacaactgacccccacttacatagccccatgtacttcctgctggcaagtctgtcttttattgacctgggcgcctgctctgtgacaagtcccaaaatgatctatgacctgtttcgaaagcggaaagtgatctcctttgggggatgcatagcacagatattcttcattcacgtggttggcggcgtggaaatggtattgctcattgccatggccttcgatcgttacgtggctctttgcaagcctttgcattacctgacaataatgtcccccaggatgtgtctctccttcttggctgtggcctggacgctgggagttagccatagtctgttccagctggcattcctagtcaatctggcattctgtggaccaaatgtactggattccttctactgtgacctcccgcgtttgctgcgacttgcctgcacagatacatatagacttcagtttatggttacagtgaacagcgggttcatctgcgtgggaaccttttttatcttgcttatcagctatgtgttcattctcttcaccgtttggaagcattcatcgggtggcagcagcaaggccctctcgactctgtccgcccactctacagtcgtgctgttgttcttcgggccccccatgtttgtctacactcgcccgcacccaaacagccagatggataagttccttgctatttttgatgccgtgttaactccctttttgaaccctgtcgtttatacatttaggaacaaggaaatgaaagctgccattaagagagtgtgtaaacagctcgtgatatataagaggatttcctag

SEQ ID NO: 44429 - DNA, 918 bp, Artificial Sequence
  Description of Artificial Sequence: Synthetic coding sequence
atggtgaccgagttcatcttcctgggcctgagcgacagccagggcttgcagactttcctcttcatgctgttcttcgtcttctatggcggaattgtctttgggaatctgcttattgtgatcacagttgtttccgacagccatttgcactccccaatgtattttctactcgccaatctttccttgattgacctctccctgtcatcagtaaccgcccctaaaatgatcaccgattttttctcacagcgcaaagtaatctcattcaaaggatgcctcgttcaaatctttttgttgcacttcttcggtggatcagagatggtcatcctcatcgcgatgggctttgatagatatatcgccatatgcaagcccctgcattacacaactattatgtgtggaaacgcctgcgtgggcattatggccgtcgcgtgggggattggctttctgcactccgttagccagttagcatttgcagttcatctgcctttttgtggcccaaacgaggtggattccttctattgcgacctcccacgtgtgattaagttggcctgcacggacacgtataggctggacatcatggtgatcgctaattccggtgtccttaccgtttgctcattcgtcctcctcattataagctacaccattatactgatgaccattcagcatcgacccctggacaaaagctcaaaagcactgtcgactctgactgcacacatcactgtagtgctgctcttcttcggcccatgtgttttcatctacgcctggccttttcccatcaaatcactggacaaattcttggccgttttttacagtgttattaccccactgctgaatccgatcatttacacattgcgaaataaggatatgaagactgcaattcgacaactgcgtaagtgggacgcccatagcagtgtcaaattctag

SEQ ID NO: 44430 - DNA, 885 bp, Artificial Sequence
  Description of Artificial Sequence: Synthetic coding sequence
agccccggccccgtgttcagctaccccccccccagcctgctgttcatcatccccgtgaagctgggccttgagcacttttttcatattaaagtgactgctgaggccatctcttggaatgagagcacctctgagaccaacaatagtatggtaaccgagttcattttcctggggttgtccgattcccaagggctccaaacctttctttttatgctgttcttcgtcttttacggaggcatcgtctttggtaatttactgatcgtaatcaccgtcgtttccgactcccatctgcattccccaatgtattttctcctcgcaaacttatccctcattgacctgtccctgtcgagcgtcacagcccccaaaatgattaccgatttcttttctcagagaaaggtgataagttttaaagggtgtctcgtgcaaatcttccttctacatttttttggcggatcagagatggtaattctgattgccatgggctttgatcgctatatagcaatctgtaagcccttgcattacaccactatcatgtgcggcaatgcctgtgtgggaatcatggcagtggcctggggtatcggattcctgcactcagtctctcagctcgctttcgccgtccacctcccattttgcggcccaaatgaggtggacagtttctactgtgacctccctcgcgttatcaagctggcttgtacagacacctatcggcttgatattatggtaatcgctaactctggggtgcttacagtgtgtagcttcgtgctgcttatcatcagctatactattatcttgatgacaattcagcaccgcccccttgacaagagtagcaaagctctcagcaccttgacagcccatatcaccgtggtcctgcttttcttcggcccctag

SEQ ID NO: 44431 - DNA, 939 bp, Artificial Sequence
  Description of Artificial Sequence: Synthetic coding sequence
atggacggcgagaaccacagcgtggtgagcgagttcctgttcctgggactgactcactcctgggagattcaactgctcctcctggtcttctcctccgttctgtatgtggctagcattacaggtaacatttttatagtgttcagcgtgacaaccgacccacatctccattctccaatgtatttcctactggcctctctgtcgttcatcgacttgggagcgtgctctgtgacatccccaaaaatgatatatgatctctttcgtaaaagaaaagtgattagcttcggcggatgcattgcacaaatcttctttatccacgtgatcggcggtgttgagatggtgctgctgattgcaatggccttcgatcgctacgtcgcactgtgcaaaccgcttcattatctgacaattatgagccctcgaatgtgcctgtcatttctggccgtggcgtggactctcggcgtaagccattcactctttcagctcgccttccttgtcaacctggctttctgcgggccaaatgtcctcgacagcttctattgcgatctgccccgcctgttaaggttggcttgcacagatacctatagactccaattcatggtgaccgtgaactctggctttatctgcgttgggacgttcttcatcctgctaatcagttatgtatttattttattcactgtctggaagcattcaagcgggggctcatccaaagccctatccaccctatcagcccatagtaccgtggtgttgctgtttttcggtcctcctatgttcgtatatacaaggcctcaccctaactctcagatggacaaatttctggctatattcgatgcagttctgacaccatttctgaatcctgtagtgtatactttcagaaacaaagagatgaaagctgccattaagagggtctgcaagcagctggtgatttacaagaagatctcctag

SEQ ID NO: 44432 - DNA, 939 bp, Artificial Sequence
  Description of Artificial Sequence: Synthetic coding sequence
atggacggcgagaaccacagcgtggtgagcgagttcctgttcctggggttaacgcactcatgggagattcagctgctgctactggtattttctagcgtcctctacgtggccagcattactggaaacattcttatcgtgtttagtgtgaccactgacccccaccttcatagccccatgtacttcctactggctagcctgagctttatagacctcggggcttgctctgtgacatctcctaaaatgatctatgaccttttcagaaaaagaaaagtgatttctttcggcggttgtatcgcccagatctttttcatccacgtcgtgggaggggtcgaaatggttctgctgatcgccatggctttcgaccggtatgtcgcactatgcaaaccactccactatttgaccatcatgtcccctcgaatgtgcctgagtttccttgcagtggcttggactcttggcgtgagtcatagcctgttccagctggcattcctcgttaatcttgcattctgcgggcctaacgttctggattctttctactgtgatctgccacgcctgctgagactggcatgcaccgatacatacagactccagtttatggtgacggtcaatagcggattcatttgtgtgggcaccttctttattcttctgattagctatgtcttcattctctttaccgtgtggaaacactccagtggcggaagcagtaaggctttaagtactctgagtgcacatagcaccgtggttctgcttttcttcggccctcctatgttcgtgtacactcgtccccatcctaattctcagatggataagtttctggccatctttgacgcggtgcttaccccttttctgaacccagtggtgtacacctttcggaataaggagatgaaagccgcgattaagagagtgtgcaagcagttagtgatttacaaacgcatctcttag

SEQ ID NO: 44433 - DNA, 939 bp, Artificial Sequence
  Description of Artificial Sequence: Synthetic coding sequence
atggacggcgagaaccacagcgtggtgagcgagttcctgttcctgggcctgactcactcttgggaaatccaactgctattactggtgttttcttccgtcctttacgtagcctccatcaccgggaacattctcatagtttttagcgtcaccacagatccccatctgcatagtcccatgtactttctgttagccagcctgtccttcattgatctgggggcttgctctgttacaagccccaagatgatttacgacttgtttcgcaagagaaaagttatctccttcggcggttgtattgcacagatattctttattcatgttgttggaggcgtcgagatggttcttctcattgccatggcatttgatagatacgtagccctttgcaagcccttgcattatctcaccattatgagtccacgcatgtgcctctccttcttagcggtggcctggaccttaggagtctcacactccctgtttcaactagcgtttcttgtgaatctggccttttgcggcccaaatgtgctggactccttctattgcgacttgccccgattgttgcgtctggcgtgtactgacacgtatcggctccaattcatggtcactgtcaattctggttttatctgcgtggggacattctttattctgttgatatcctatgtctttattctgttcaccgtgtggaaacattcatccggggggtccagcaaagcgctgtctaccctcagcgcccacagcaccgtggtgttactcttcttcggacccccgatgttcgtttataccaggccacacccaaactctcagatggacaagtttcttgccatttttgatgccgtgctcacccctttcctgaaccctgtcgtttacaccttcaggaataaggagatgaaggctgccataaagagagtatgcaaacagttagtgatctacaagcgcatcagctag

SEQ ID NO: 44434 - DNA, 918 bp, Artificial Sequence
  Description of Artificial Sequence: Synthetic coding sequence
atggtgaccgagttcatcttcctgggcctgagcgacagccaggagcttcaaacttttctgttcatgctatttttcgtgttttacgggggtatcgtcttcggtaatttgcttatcgtgatcaccgtggtgtctgacagccacctccacagtcctatgtactttctcttggctaacctcagtcttatcgatctgagcctctcaagcgtaacagcccctaaaatgatcacggacttcttctcacaacgtaaggttatctcattcaagggctgccttgtacagatttttttgttgcacttctttggaggcagtgaaatggtgattctcatcgccatgggctttgatcggtacatcgcaatctgcaagcctctgcactatacaactattatgtgtggcaacgcctgcgtgggtatcatggcagtcgcttggggaattggcttcctgcacagcgtttcccagctggccttcgccgtacacctgcccttctgtggtcctaacgaggtcgattcattctattgtgatttaccacgggtcatcaaacttgcctgcacagacacgtatcggctcgacatcatggtgatcgcaaatagcggcgtgctgactgtctgttctttcgtgctgttaatcatcagctacactatcatcctgatgacaatccagcattgcccccttgacaagagctctaaggccctgtctactctgacggcacacattactgtggtcctcttgtttttcggaccctgcgtattcatatatgcctggccgtttcccattaagagcctggataaatttctcgcagtgttttattccgtaattacaccactacttaaccctattatttataccctgcggaataaagacatgaagaccgccattcgaaggttacgaaaatgggatgcgcacagctcagtgaaattctag

SEQ ID NO: 44435 - DNA, 918 bp, Artificial Sequence
  Description of Artificial Sequence: Synthetic coding sequence
atggtgaccgagttcatcttcctgggcctgagcgacagccaggagttgcagacctttctcttcatgttgtttttcgtgttttacggtgggatagtatttggaaacctgttgatcgtgattactgttgtcagcgattctcacctccatagtccaatgtactttttactcgccaatctgtctcttatcgatctgagtttgagcagtgtgaccgcacccaaaatgatcacagactttttctcgcagagaaaggtcatctccttcaaggggtgtctggtccagattttcctcctccatttttttggcggaagcgagatggtgatcctgatagccatgggattcgaccgctacattgctatatgtaaacccctgcattacactacaattatgtgcggcaacgcttgcgtgggaataatggcagtgacctggggcatcggatttctacattccgtttcccagctcgccttcgcagtccacttacttttctgcggaccgaacgaagtcgattctttctactgcgatcttccccgggtgattaaactggcctgtaccgacacctatcgcctggatatcatggtgatcgcaaattctggcgtgctaacggtgtgcagcttcgtcctgctcatcatctcatacactatcattctcatgacaatacagcaccggcctcttgacaagtcaagtaaggccctgagtacactgaccgcccatatcaccgtcgtcctgttattttttggaccctgtgtcttcatttacgcttggcccttccccattaagtccctggacaaattcctggcggtgttttacagcgtcatcacccctctgctcaacccaatcatttacactctccgtaacaaggatatgaagacagcaatacgccagcttaggaagtgggatgctcacagcagcgtaaagttttag

SEQ ID NO: 44436 - DNA, 939 bp, Artificial Sequence
  Description of Artificial Sequence: Synthetic coding sequence
atggacgaggccaaccacagcgtggtgagcgagttcgtgttcctggggctttcagatagccgcaaaattcaactcctgctgttcctcttcttctccgtcttctatgtgagctctctgatgggcaatttgttaatcgttctcacagtcactagcgatcccaggctgcaatcccctatgtatttcctgctggctaatctttccatcattaatctcgtgttctgttcatctaccgccccaaaaatgatttacgacctgtttcggaaacacaaaactataagtttcggcggatgtgttgtgcaaatcttctttatacatgctgtggggggaacagaaatggtgctcctgattgccatggcatttgaccgttacgtggcgatctgtaagccactgcactacctcacaattatgaacccccagcgatgcatcttgttcctggtaattagttggatcatcggaattattcattctgttatccagctggcctttgttgtggatttattattttgtggccctaacgaactagactcgttcttctgcgacttgcctcgtttcatcaaactagcctgtatcgagacgtatacgttgggtttcatggtgacagctaactccggttttatctccctggcctcatttctcatccttatcatttcctacatctttattctggttactgtccaaaagaaatcgtcaggcggcatatttaaggccttttcaatgctctctgcacatgttattgtggtggtactcgtgttcggcccactcattttcttttacattttcccattccctacttcacacctggacaaatttcttgccatatttgatgctgttatcactcccgtcctgaacccagtcatctatacgtttcggaacaaagaaatgatggtggcaatgagaagaagatgctctcagtttgttaattatagcaaaattttttag

SEQ ID NO: 44437 - DNA, 936 bp, Artificial Sequence
  Description of Artificial Sequence: Synthetic coding sequence
atggcccacaccaacgagagcatggtgagcgagttcgtgctgctgggactgtcgaattcatggggacttcagttatttttctttgcaattttctctatcgtatatgtgacatcggtgctcggcaatgtcctcattatagtgattatttctttcgacagccatctgaactcgcccatgtattttttgcttagcaacctgagcttcatcgatatttgccagtcaaattttgccactccaaagatgttggtcgatttttttattgagagaaaaacaatttcattcgagggctgcatggctcagattttcgtgctccattcctttgtcggtagcgagatgatgcttcttgtggcaatggcatatgatcggttcatagccatctgcaagcccttgcactacagcaccatcatgaatcgccgactctgtgtaatcttcgtcagtatcagctgggccgtgggcgtcttgcactccgtgagtcatctggcttttaccgtggatcttccattttgtggccccaatgaggtcgatagctttttctgcgacttgcctctggtgattgaattagcctgtatggacacatacgagatggagatcatgacccttacaaactctgggctgatttctttaagctgctttctggcactgatcatttcttatacaattattttgatcggagtccggtgtcggtcatctagtgggtcatccaaggcactttccaccctcactgctcacatcaccgtggtgatcctgttttttggtccatgtatttatttctatatttggccgttctcaagactccctgtcgacaagttcctcagcgtgttctatacagtgtgcactccgctcttgaatcctattatctattcacttagaaatgaagacgtaaaagcagcaatgtggaaactgcggaatagacacgtcaactcctggaaaaactag

SEQ ID NO: 44438 - DNA, 915 bp, Artificial Sequence
  Description of Artificial Sequence: Synthetic coding sequence
atggagcgggccaaccacagcgtggtgagcgagttcatcctgctgggtctctcgaaatcccaaaacctgcagatactgttttttttggggttttccgtcgtttttgtgggaattgtcctcgggaacctgctcattcttgtgaccgttaccttcgactccttgctgcacaccccgatgtactttctcttgagcaatctgtcctgcattgatatgatcctggcaagcttcgctacaccgaagatgatcgtcgacttcctccgcgaaagaaagacgatctcttggtggggttgctactcccagatgttttttatgcatcttttgggaggatctgaaatgatgctgctcgtggcaatggcaattgacagatacgtggccatctgcaaacccttgcactacatgaccatcatgtctcccagggttctgaccggattgcttttatccagttacgctgtgggcttcgtgcacagttcctcccagatggccttcatgctcacactgccattctgcggtcctaatgttatcgacagcttcttctgtgaccttcctctcgtgatcaagctggcatgcaaagacacttatatactgcagctgttagtcatcgctgatagcggactgttatcactggtgtgttttctgcttctcttagtcagctatggagttattatcttctctgtgcgataccgggctgccagtagatcaagtaaagcattttctaccctgtcagcccatatcactgtggttaccctcttctttgcaccatgtgtctttatctacgtgtggcccttttcccgttatagcgtcgacaagatactctcagttttctacaccatctttacccctctcttgaacccgatcatctacactcttcggaatcaggaggttaaagctgcgatcaaaaagcggctgtgcatctag

SEQ ID NO: 44439 - DNA, 933 bp, Artificial Sequence
  Description of Artificial Sequence: Synthetic coding sequence
atggacccccagaactacagcctggtgagcgagttcgtgctgcacggcctgtgcacctcacgacatctccagaactttttctttatctttttttttggcgtgtatgtagccatcatgttagggaatttgttgatactcgtgaccgtgatttccgatccatgtctgcacagctcccccatgtactttctcttagggaacctggcatttctggatatgtggctggcctctttcgctactccgaagatgatacgtgactttctttctgatcaaaaattgataagctttggtggatgcatggctcagatcttcttcctgcacttcaccggcggagccgaaatggttctgcttgtttcaatggcctacgatcgctacgttgccatctgcaaacctttgcactacatgactcttatgtcctggcagacctgcatccgactagtgctcgcatcttgggtggtcggctttgttcattccatatcacaggtggcgttcaccgtgaacctgccatattgtggacctaatgaagtggactcttttttttgcgacctgccattagtcattaagctggcatgcatggacacttatgtactagggatcattatgatctctgactccggtctcctgtcactgtcgtgctttctgctactcctcatttcttacactgttatactgttagctattcgccagagagcagccggcagcacatctaaagccctctctacgtgctcagctcatatcatggtggtaacccttttcttcggcccatgtatcttcgtctatgtgcgccccttctctcgattcagcgtcgacaagctgttaagtgtgttctatacaatttttactccgttgctgaatcccattatttatacacttagaaacgaagaaatgaaagcggccatgaagaagctgcagaacagacgggtaacgttccagtag

SEQ ID NO: 44440 - DNA, 1047 bp, Artificial Sequence
  Description of Artificial Sequence: Synthetic coding sequence
atgctgaccagcctgaccgacctgtgcttcagccccatccaggtggcggaaattaaaagcctgccaaagagcatgaacgagaccaatcacagtcgggtcactgagttcgtactgctagggttgtcaagttcgcgagagttgcagccatttttattcctcactttctctctcctttacctggcaatcttacttggcaacttcctgataatcctaacagttacatctgactctcgactgcacacgcccatgtactttctgctcgcaaacctgagttttatcgacgtctgcgtggcttccttcgctactcccaagatgatagcagacttccttgttgagagaaagacaatcagcttcgatgcctgtcttgcacagatattttttgtccatctctttacaggctctgaaatggttctccttgtatccatggcatatgatcggtatgtcgcaatttgcaagccgttgcattatatgacagtcatgagccgtcgcgtgtgcgtcgtgctggtgctcattagctggtttgtgggattcatccacaccacttcacagctggcttttaccgtgaacctccccttttgcggacctaacaaagtcgacagcttcttctgcgacctcccactggtgactaagctggcctgtatcgatacatatgtggtttcactgctgatagttgccgactccgggttccttagccttagctcctttttactgctagtggtgtcatacaccgtgattctggtaactgttcgtaacagatctagcgcttccatggccaaggcacggtcaacgctcactgcccacatcactgttgtgaccctcttcttcggaccctgtatcttcatttacgtgtggccctttagcagttacagcgtggacaaggtcctggccgttttttatactattttcacgctcatactgaatcctgtgatctacaccctgcgcaacaaagaggtaaaggctgcgatgagcaagctgaagagtaggtatctgaagcctagccaagtctctgtcgtgatccgcaacgtgctgttcctagagaccaaatag

SEQ ID NO: 44441 - DNA, 1032 bp, Artificial Sequence
  Description of Artificial Sequence: Synthetic coding sequence
atggccctgtacttcagcctgatcctgcacggcatgagcgacctgttcttcctgagcacgggtcaccctcgcgcttcttgtcgtatggaggctatgaagcttcttaatcagagtcaggtttcagagttcattctattgggtctgaccagttcccaagacgtggaatttcttttatttgctctgttctccgtcatctacgtggtgacggtgctcgggaatctgcttatcatagtgactgtttttaacacacctaatctcaacacacccatgtattttctcctcgggaacctctcattcgttgatatgactttggccagcttcgcgacccctaaagtaatcttaaacttactgaagaagcagaaggtgatttctttcgccggttgtttcacccagatcttcctgttacatctgttggggggggtcgagatggtgctcctcgtgtccatggcattcgatagatacgtggccatttgtaagccgctgcattatatgaccatcatgaacaaaaaggtttgtgttctgctggtcgtgactagctggcttctcgggctgttgcatagcgggttccagatcccattcgccgtgaatctgccattctgcggtcccaacgtggtcgatagcattttctgtgacctgcctctagtgacgaagctggcctgcatcgacatttatttcgtgcaggttgtgattgtcgcgaactcaggaattatcagcctgagctgttttattattttattgatttcttattctctgatcctgatcacaattaagaaccacagcccaaccgggcagtccaaggcgcggtccactttaaccgctcatattactgtggtgatcctttttttcggcccttgcatttttatttacatttggccattcggcaatcatagcgttgataaatttcttgccgtgttctatactattatcactcccatccttaaccccattatatataccctgcggaacaaggagatgaagattagcatgaagaaattgtggagggctttcgttaattctagagaggatacttag

SEQ ID NO: 44442 - DNA, 945 bp, Artificial Sequence
  Description of Artificial Sequence: Synthetic coding sequence
atggacgtgggcaacaagagcaccatgagcgagttcgtgctgctgggattgtcaaattcctgggaactgcagatgtttttctttatggtgttctcgcttctctacgtggctacgatggtggggaactcgctcattgtaatcactgtgattgttgaccctcacctgcactccccaatgtatttccttttgaccaatctcagtatcatcgatatgagtctagcttcatttgccacccctaaaatgatcacagattacttgacaggacacaagacaattagcttcgatggctgcctgacacaaattttcttccttcatctcttcaccgggacagagatcatcctcctgatggctatgagcttcgatcgctacatcgccatatgcaagcctctgcattatgcctctgtcatctccccccaggtgtgtgtggcgctggtggtggcctcttggatcatgggcgtcatgcacagcatgtcccaggtgatatttgccctgacactcccattttgcgggccctacgaggtggactcgttcttctgtgatctgcccgtcgtgtttcagctcgcatgtgtcgatacctatgtcctaggcctattcatgatctcaaccagcggcatcattgccctgagctgctttatcgtgcttttcaatagttacgtgattgtgctagttaccgtgaaacaccattcctcaagaggatcgtccaaggctctcagtacatgcaccgctcacttcattgtagttttcctgttctttggcccttgcatctttatctacatgtggccgttgagttccttcctcaccgataaaattctttctgtgttctatacaatatttactcccactcttaaccctatcatctacacactacgaaatcaggaagtgaaaattgctatgcgcaagctaaaaaaccgctttctgaactttaacaaagctatgccatcatag

SEQ ID NO: 44443 - DNA, 972 bp, Artificial Sequence
  Description of Artificial Sequence: Synthetic coding sequence
atggacaagagcaacagcagcgtggtgagcgagttcgtgctgctggggctttgtagctcacaaaaacttcagttgttttacttttgcttcttcagcgtgctgtatactgtcattgttttgggcaacctgctgatcattctgaccgttactagcgataccagtcttcattctcccatgtacttcctcttggggaatctttcttttgtcgatatctgccaggctagttttgccacccccaaaatgatcgccgattttctcagcgcccatgaaacaatttctttcagcggatgtattgcacagatcttcttcattcaccttttcactggtggggagatggtattattggtgtccatggcctatgatcggtacgtggccatatgtaagccactgtactatgtggtgattatgagtagaagaacctgcacagtactggtaatgatttcctgggccgtgtccctcgtccacactctgtcacaactgtcttttaccgtgaacctgcctttttgcgggccgaatgtggtcgactcctttttttgtgatctcccccgcgtaaccaagctggcctgtttggattcctacattatcgaaatccttatcgtagtcaatagtggaatcctcagcctgtccaccttctccctgctggtcagctcatacatcataatacttgtgaccgtctggcttaagtcatctgcagcaatggcaaaggccttttcgacactcgcctcacacatagcagtggtgatactgtttttcggtccctgcatcttcatttacgtgtggccattcactatctctcctctggataagtttctagcaatattttatacggtgtttaccccggtattaaatcctattatttatacgcttagaaaccgggatatgaaggcagcagttaggaaaattgttaatcattaccttcgccctcgcaggatatccgagatgtcattggtggtgcgtaccagcttccattag

SEQ ID NO: 44444 - DNA, 939 bp, Artificial Sequence
  Description of Artificial Sequence: Synthetic coding sequence
atggacctgaagaacggcagcctggtgaccgagttcatcctgctgggcttctttggtcgatgggaacttcagatcttcttcttcgttactttctccctcatatatggtgccacagtgatgggaaatattctcattatggtgacagtcacttgccgatcaacactacattcccctctgtattttcttcttggcaatctaagttttctggatatgtgcctgtctacagcaactactcccaaaatgatcatcgacctactcactgaccacaagacaatcagcgtgtggggctgtgtgacacaaatgtttttcatgcactttttcggaggcgctgagatgactttactcatcatcatggctttcgataggtatgtggccatctgcaagcctctgcactaccgaaccatcatgtcccataagctgctgaaaggctttgcaattctcagttggattattggcttcttgcatagcatctcccagatcgtcctgaccatgaatttgccattctgtggtcacaacgtgatcaataatatcttttgcgatctccccctcgtaatcaaactagcatgtattgaaacctacactctcgagctgtttgtgatagcagacagcggccttctgtcatttacatgtttcatacttctgctcgtttcatatatcgttattctcgtttccgtgcccaagaaaagctctcatggcctgtctaaagctctctccacgctgtcggcacatatcatagttgtaacgttgttcttcgggccctgcatattcatttacgtgtggccgttcagctcactagcctccaataaaaccctcgcggtgttctataccgtgattactccactgctcaacccctccatttacaccctgcggaataagaagatgcaggaagccataaggaagctcaggtttcaatacgtgtcaagcgcacagaatttttag

SEQ ID NO: 44445 - DNA, 942 bp, Artificial Sequence
  Description of Artificial Sequence: Synthetic coding sequence
atggagaccgccaactacaccaaggtgaccgagttcgtgctgaccgggctgtcgcagacaagggaggtacagttggtactgttcgtgattttcctttcattctacttgttcatcctgcctgggaacattctgattatctgcaccatccggctcgatccacacctgacctcacccatgtattttctcttagctaatttggcactgttggatatctggtacagcagcattacagctccaaaaatgctcattgacttcttcgtagaaaggaaaatcatttcattcggcggttgcattgcccagctcttctttctgcactttgtaggcgcatcagaaatgttcctgttaacagtaatggcatatgatcgatacgccgccatatgcaggccacttcactacgcgacaataatgaatcggaggctttgttgcatcctcgtggcgctgagttggatgggtggatttattcactctatcattcaagtcgcgctcattgtgcgtctcccgttctgcggccccaatgagctcgacagctatttttgtgatattacgcaagtcgtgcgaattgcttgcgcaaatacctttcccgaggagcttgtaatgatctgttcctcgggtctgatatcagtggtctgcttcattgccttgctgatgtcctatgcctttctgctggcactgctgaaaaaacactcagggtccggagagaacaccaaccgagctatgagcacctgttatagtcatatcaccatcgttgtgctaatgttcggtcctagtatctacatctacgcccggccatttgacagcttttctctggataaggttgtttccgtatttcacaccgttatctttcctctactgaacccgatcatttacactctgaggaataaagaagtgaaggccgcaatgcgtaaagtcgttactaagtacattctgtgcgaggaaaagtag

SEQ ID NO: 44446 - DNA, 942 bp, Artificial Sequence
  Description of Artificial Sequence: Synthetic coding sequence
atggagaccgccaactacaccaaggtgaccgagttcgtgctgaccggactttcccagacgccagaggtccagctggtcttgtttgtgatctttctgtcattttatttatttatccttcctggcaacatcttgattatttgtacgatatcccttgacccacacctgacttcccccatgtacttcctcctcgcaaacctggcattcctcgatatatggtacagttcaatcacagctcccgaaatgttgatcgacttcttcgtagagaggaaaataattagtttcgatggatgtatcgcgcaactcttctttctgcatttcgccggagcaagcgaaatgtttcttctcacagttatggcctttgatctgtataccgcaatttgtagaccccttcattatgctaccatcatgaaccagagactgtgctgcatcctagtggcactctcatggaggggtgggttcattcatagtattatacaggtcgctctcatcgtgcggcttccattttgtgggcccaacgaacttgatagctatttctgtgatattacacaggtcgttagaattgcatgtgcgaacacctttccggaagaactggtcatgatatgttcctctgggctgattagcgtggtctgtttgatcgctcttctgatgagctacgcgtttctcctggccttattcaaaaaacttagtggcagcggggagaataccaaccgcgcaatgtccacttgctacagtcacataactatcgtggtgttaatgtttggaccatctatttacatctacgcccgcccttttgattctttctctctggacaaagtcgtgagtgttttcaacacgctgatctttcccctgcggaacccgattatctacactttacgaaacaaagaggttaaggctgccatgcgcaaattagtgaccaaatatatactgtgtaaggaaaaatag

SEQ ID NO: 44447 - DNA, 924 bp, Artificial Sequence
  Description of Artificial Sequence: Synthetic coding sequence
atggagagcgagaaccggaccgtgatccgggagttcatcctgctgggcctgacacagtctcaagatatccagctgctcgttttcgtgttggtgctgattttttactttataatcctgccggggaacttccttatcatctttactatcaaatctgacccagggctgacagctccactgtacttcttccttggtaaccttgcatttctggatgcctcctattcttttatcgttgcacctaggatgttagtagattttctgtcagccaaaaaaatcatcagttacaggggctgcattactcaactcttcttccttcacttcctggggggtggggagggcttgctgcttgttgtaatggcctttgatcggtacattgcgatttgccggccactacactatcccacagtaatgaatcccaggacctgttacgccatgatgctagccttatggctcggaggctttgtgcatagcatcatccaagtggtactcatccttcgccttccgttttgcggcccaaatcagctggataatttcttttgtgatgtgccacaggtaatcaagctcgcgtgtactgataccttcgttgtggagttgctgatggtctttaatagcggactcatgacactgctctgctttcttgggctcctggcatcttatgctgttatcctttgccgtattagaggcagctctagcgaggcaaagaacaaagcaatgtcgacctgcattacgcatatcatcgtgatattctttatgtttgggcctgggatcttcatctatacaaggcctttccgggccttcccggctgataaggtggtcagcctattccacactgtgatcttccccctgctcaaccccgtcatctacacccttaggaatcaggaggtgaaggcatctatgaagaaggtgttcaataagcatattgcctag

SEQ ID NO: 44448 - DNA, 66 bp, Artificial Sequence
  Description of Artificial Sequence: Synthetic coding sequence
atggagagcgagaaccggaccgtgatccgggagttcatcctgctgggattgacacagtctcagtag

SEQ ID NO: 44449 - DNA, 441 bp, Artificial Sequence
  Description of Artificial Sequence: Synthetic coding sequence
atggagagcgagaaccggaccgtgatccgggagttcatcctgctggggctaacacagtctcaagacatacaactgctggtatttgtgctcgtgctaatcttctactttattatcctgcccggaaatttcttaatcatattcaccatcaagtccgaccccggacttactgctcccctgtacttctttctgggaaacctagcattcttggacgcatcttattctttcatagttgcacctcgtatgctggtcgatttcctcagtgcaaaaaagattatcagttatagaggttgtattacccaactgttttttctgcactttctaggcggtggggaagggctgctgttggtagtcatggccttcgaccggtatattgctatctgcaggccactgcactacccaacggtgatgaacccgcgcacatgctacgccatgatgctgtag

SEQ ID NO: 44450 - DNA, 951 bp, Artificial Sequence
  Description of Artificial Sequence: Synthetic coding sequence
atgaagatcgccaacaacaccgtggtgaccgagttcatcctgctgggtcttactcaatcacaagatatacagctacttgtcttcgttcttatcctgatcttctatctcataatccttccaggcaactttctgatcatctttaccattaggagcgaccctgggctgacggcaccactttacctttttctgggaaatctggcctttctggatgccagttattcatttatagtggcacctcgtatgctggtggatttcttaagtgaaaaaaaggtaatctcttatcgggggtgcatcacccagttgttttttctgcactttctgggagggggggagggacttttgctggtggtgatggcgttcgaccggtatattgctatctgtcgccccctccactgctctaccgtaatgaaccctcgcgcttgttacgccatgatgctggccctgtggttaggaggattcgtccatagcatcatccaagtggtgttaattctgcgcctgccattttgcgggccaaatcagctggataacttcttttgcgacgtgcgacaagttattaagctcgcctgtacggatatgttcgttgtcgagctgctgatggtcttcaattccggcctgatgaccctactatgctttctcgggctgttagcaagttacgctgtcattctttgtcatgtcaggcgcgctgcatctgaagggaaaaataaagccatgtctacatgtactacaagagtcatcatcattctcttgatgttcggaccagctatctttatttatatgtgcccgttccgcgctcttcccgccgacaaaatggtttctctgttccatactgtaatctttccactcatgaatcccatgatctatacactgagaaaccaggaagtgaagacttccatgaaacgtctccttagtaggcacgtggtctgccaagtggacttcatcatccggaattag

SEQ ID NO: 44451 - DNA, 927 bp, Artificial Sequence
  Description of Artificial Sequence: Synthetic coding sequence
atggagacccagaacctgaccgtggtgaccgagttcatcctgctgggcttgacacagtcacaggacgcccaactcctggttttcgtgctggtcttaattttctatttgattattctacctgggaacttcctgatcattttcaccataaaaagcgaccctggactgaccgcaccactttacttctttctcggtaacttggccttactggacgctagttattccttcattgtggtccctcgcatgctggtggatttcctttcagagaagaaggtgatttcataccgaagctgcatcacccagctcttcttcctacactttcttggggcaggcgagatgttcctgttggtcgttatggctttcgacaggtacatcgccatatgtcggccacttcattattcaacgatcatgaacccaagagcttgctatgcacttagtctggtgttatggctcgggggtttcatccacagcatcgtccaggtcgccctgatcctgcacttacccttctgtggacctaaccagctagacaacttcttttgtgacgtgccccaggtgattaagctggcttgcactaacacgttcgtggtcgagctgttaatggttagtaacagcggcttgctcagcctgctgtgttttttggggctgctcgcaagctatgctgtaatcctttgtagaattagagaacactcctctgaagggaagtctaaggcaatctcaacttgcaccactcatattatcatcatctttctgatgtttgggcctgctatcttcatatacacctgcccatttcaggcgtttcccgctgataaggtagtaagcctttttcacaccgttatatttcctttgatgaacccagttatttatacactccggaaccaggaagtgaaagcttctatgcgcaagctgctgtcacagcatatgttctgttag

SEQ ID NO: 44452 - DNA, 939 bp, Artificial Sequence
  Description of Artificial Sequence: Synthetic coding sequence
atggagaagagcaacaacagcaccctgttcatcctgctgggcttcagccaaaacaaaaacatcgaggtgttgtgtttcgtgctgtttttattttgctatattgctatatggatgggaaacctgttaatcatgatctcaattacttgtacgcaactgatccatcaaccgatgtatttcttcctgaactatttatctctcagtgacctgtgctatacaagcaccgtgacccccaagcttatggtcgacctcctcgccgagcgtaaaaccatttcctacaataactgcatgattcagctatttacaactcacttttttggtggaattgaaatctttattctgacaggaatggcctatgatagatacgtggccatctgtaaacccttacattataccattattatgtcacgccaaaaatgtaacactattattattgtgtgttgcacggggggtttcatacattccgctagtcagttccttttgacaattttcgttccattctgtggtccaaatgagatcgaccactacttttgtgacgtttatccactcctgaaacttgcctgtagtaacatacacatgataggactgctcgtcattgcgaactccggcctcatagccctggttaccttcgtcgtactcttacttagctacgtgttcattttatatactattcgagcctacagcgctgaaagacgctccaaagcactggccacatgctcctctcacgtgatcgtcgtggttcttttcttcgcaccagccctgttcatttacatcagaccagttacaaccttctccgaagacaaggtattcgccttgttttacacaataatagcgccgatgttcaatccactgatatatacactccgaaataccgagatgaagaacgcaatgcgaaaggtctggtgctgccagatactgctgaagcggaaccagctcttctag

SEQ ID NO: 44453 - DNA, 942 bp, Artificial Sequence
  Description of Artificial Sequence: Synthetic coding sequence
atgaagaaggagcaggacagcaacgtgaccgagttcgtgctgctggggctctctagtagttgggaattgcaactcttcctcttcttgttgtttctattcttttatatcgcaatagtgctcgggaacctgctgatcgtcgtaaccgtgcaggcacatgcccatcttcttcagagtccgatgtattactttcttggccacttaagctttattgatctttgcctgtcctgtgttacagttccaaagatgctgggggattttctccagcagggtaaaagcatatccttcagcggttgcctggctcaaatttacttcttgcatttcctgggggcttccgagatgttcctgctaaccgttatggcttacgatagatatgtagccatctgtaatccccttcggtacctcacagtcatgaatccccagctgtgtctctggctagtgcttgcctgttggtgcgggggcttcatccactcaatcatgcaggtcatactggtcatccagctccccttttgcggtcccaatgagcttgataatttttactgcgatgtccctcaggtgatcaagctggcatgtatggacacctatgttgtagaggtactcgtgattgcgaattctggcctactgtccctggtgtgcttcttggtgttgctgttcagctatgccatcattctcatcactttacgcacgcatttttgtcaagggcagaataaggtgttttctacttgtgccagccacttgaccgttgtgagcctgattttcgtgccctgcgtttttatctatttgcgacctttctgcagttttagtgtggataagatattttctctgttctacacggttattacccctatgttaaatccactcatctatacattgcggaacaccgatatgaagacagctatgaagaaactgaggatcaaaccatgcggtatccctctcccctgctag

SEQ ID NO: 44454 - DNA, 930 bp, Artificial Sequence
  Description of Artificial Sequence: Synthetic coding sequence
atgggcgccaagaacaacgtgaccgagttcgtgctgttcggcctgttcgaatctagagaaatgcagcacacctgcttcgtggtgttttttctgttccacgtgctgacagtactcggcaatctgcttgtaattattactattaatgctaggaaaacattaaagagtcccatgtatttctttctgtcgcaactgtcttttgcagatatttgttacccgtccaccacaatccccaagatgattgcggacacttttgtggaacacaaaataatttccttcaatggatgtatgacgcaactattttcagcacatttcttcggcggaaccgaaattttcctgctgacggccatggcctacgatcgatatgttgccatttgccgaccattacactacactgcgatcatggattgcagaaagtgcgggctgctggcaggcgcaagctggttggccggattcctccactccattctgcagactctgctcacggtccaactccccttttgtggcccaaacgaaattgacaatttcttttgtgacgtgcacccattgctgaagctagcctgcgccgacacctacatggtcggccttatcgtggtagccaactccggtatgatatctctggccagcttctttattcttattatttcctacgtgattatcttgctcaacctacggtcacagagcagcgaagatcgcagaaaagccgtcagcacatgcggctcccatgtgatcaccgtcctcctagttttaatgcctcccatgtttatgtacataaggcccagcacaacccttgcagcagacaaactgatcatcctgtttaacatcgtgatgcctccgctgcttaaccccctgatttacacgctgcgtaacaacgacgtcaagaacgccatgagaaagctgttccgagtgaagcgtagtctgggagagaagtag

SEQ ID NO: 44455 - DNA, 936 bp, Artificial Sequence
  Description of Artificial Sequence: Synthetic coding sequence
atggagaagatcaacaacgtgaccgagttcatcttctggggcctgagtcaatcacctgagatagagaaggtgtgctttgttgtgttctcctttttctacattattatcctcttgggcaatctgctgatcatgctgaccgtgtgtcttagcaacttgttcaaatcgccaatgtatttctttctgtcttttctgtcattcgtagatatttgttactcaagcgttactgcaccgaagatgattgtcgacctcctagccaaggacaagaccatttcatacgtcgggtgtatgcttcagttatttggagttcatttttttggctgtacggaaatcttcatactgaccgtgatggcctatgatagatatgtggccatatgcaagcctttgcactatatgaccattatgaatagagagacatgtaataaaatgctgctcggaacgtgggtcggaggatttctccattctatcatccaggtagccttagtggtccagctgccattttgtggccccaacgaaattgatcactacttctgtgatgtacaccctgtgttaaagttagcctgtaccgagacgtacattgttggtgtcgtcgttaccgctaactcaggaacaatagcacttgggtcttttgtcattctcttaatctcatactccataatactggtaagcttgcggaaacagtctgcagagggccgtcgcaaagccctcagcacctgtgggagtcacatcgccatggttgtgatatttttcggcccttgtactttcatgtatatgaggccagacaccactttcagcgaagataagatggtggccgtgttttataccattatcacccctatgttgaatcccctcatctatacactgagaaacgctgaagttaagaatgccatgaaaaagctgtggggccgcaacgttttcctggaagctaaaggtaagtag

SEQ ID NO: 44456 - DNA, 918 bp, Artificial Sequence
  Description of Artificial Sequence: Synthetic coding sequence
atggtggccaccaacaacgtgaccgagatcatcttcgtgggcttctctcagaattggagtgagcaacgcgtgatatccgttatgttcctcttgatgtacactgcagtggtgctgggcaatggcctgattgtggttactatcctggcctcaaaggtattaactagtccaatgtatttttttctttcttaccttagtttcgtggaaatttgctattgttccgtcatggcaccaaaattaattttcgattcttttattaaaaggaaagtcatctctctgaaagggtgtctgacccaaatgttttcgcttcactttttcggtggcacagaggcatttctcctgatggtcatggcctacgaccggtacgtggctatttgcaaacctctgcattacatggctattatgaatcagcggatgtgtgggctccttgtgcgaatcgcttggggcggcgggctgcttcactcggtcggacagacttttctcatctttcagctccccttctgtggacctaatattatggatcattatttttgtgacgtgcatccggtactggaactcgcttgtgccgacacttttttcataagcttgctcatcataaccaacggagggagtatcagcgtggtgtcattcttcgtgttaatggccagctacctcattatactccattttctgaggtcacataacctggaaggccagcataaggctttaagcacttgcgcctcacacgtgacagtagtcgacctgttctttatcccatgcagcctcgtgtatatcaggccctgtgtcacattacccgcggacaagatcgttgccgtgttttataccgtcgtcacaccactattgaacccagtaatttacagctttaggaatgccgaggtgaagaacgccatgagacggttcattggaggcaaagtgatttag

SEQ ID NO: 44457 - DNA, 912 bp, Artificial Sequence
  Description of Artificial Sequence: Synthetic coding sequence
atgaccgagttcatcttcctggtgctgagccccaaccaggaggtgcagcgtgtgtgcttcgtgatctttttgtttctctatacagcaatagtgctgggcaatttcttaattgtgctcaccgtgatgacttctagatcgcttggctccccaatgtacttctttctgtcgtatctctcattcatggaaatctgctatagcagcgctaccgcgcccaagcttatatctgatttgctggcagagcgaaaggtcattagttggtgggggtgcatggcacagctcttttttcttcattttttcgggggcaccgagatctttctcctcactgtgatggcctacgatcattacgttgcgatatgtaaacctctttcttacaccactatcatgaattggcaagtgtgcacggtgcttgtgggtatcgcatgggtcggaggttttatgcattcgtttgctcagatcctgctaattttccatctcttgttctgtggccctaacgttattaatcattatttctgcgatctggtgccactgttgaagctggcctgctcggatactttcttgatcggcttactgattgtggcgaacggcggcactcttagcgtgatctcttttggtgtgctgctggcgagctacatggtgattctcctgcatctgcgaacgtggtcctccgaaggctggtgcaaggctttgtcgacatgcggttcacattttgcagttgtcatcctgttcttcggaccttgtgtctttaatagcctgagaccctccacgactcttccaatagacaaaatggtagcagtcttctatactgtcatcaccgctatactgaatccagttatatacagtcttagaaatgcggagatgcgaaaggctatgaaacggctgtggatccgcaccttgcggcttaacgaaaagtag

SEQ ID NO: 44458 - DNA, 948 bp, Artificial Sequence
  Description of Artificial Sequence: Synthetic coding sequence
atgagcatcaccaaggcctggaacagcagcagcgtgaccatgttcatcctgctgggctttactgaccacccggaactccaggcactgctcttcgtcacgtttctcggtatttacctaacgactcttgcctggaacctcgcattgatcttccttatcaggggggacacccacctccacacgcctatgtatttctttctaagcaacctctccttcatcgatatttgttattcctccgcagtcgcacccaacatgctgaccgatttcttctgggaacagaaaacgatctctttcgtcgggtgcgctgcccagttttttttttttgtgggtatgggcttgtctgagtgtttactgttgactgccatggcctacgatagatatgccgcaatttcaagccctttattgtaccctaccatcatgacccagggcctgtgcactcggatggtggtaggtgcctatgttggcggattcctcagttccctgattcaggcatcatccatcttccggttacacttctgcgggccgaatattataaatcacttcttctgcgatttgcctcccgttcttgcccttagttgttccgatacattcctgagccaggtcgtgaattttttggttgtggtgacggttggcggcaccagttttttgcagctgttgatctcttacggctatatcgtgagtgctgtgttgaaaatcccatctgctgaaggaagatggaaagcttgtaacacctgcgctagtcacctgatggtagtgaccctcctgtttggaactgctctgtttgtatacctcagaccaagcagctcgtacctgctcggtcgcgacaaagttgtgtcagtgttctatagcttagtaattccgatgctcaacccactaatatacagccttcgcaacaaagagatcaaagatgccctttggaaggtgctcgagagaaagaaagtgttttcctag

SEQ ID NO: 44459 - DNA, 975 bp, Artificial Sequence
  Description of Artificial Sequence: Synthetic coding sequence
atggccgtgggccggaacaacaccatcgtgaccaagttcatcctgctcggcctgtcggaccacccgcagatgaaaatcttcctgttcatgcttttcttgggcctgtatcttttgacactagcctggaacctgagtctgatagccctcattaaaatggactcgcaccttcatatgccgatgtacttctttcttagtaacctgtcctttctagatatttgctatgtgagctcgacagcacccaaaatgttatccgacattattaccgagcagaaaacaatttctttcgtgggatgcgcaacccagtacttcgtgttctgtggaatgggactgactgaatgttttctcctggctgcaatggcttacgaccggtacgccgcaatctgtaaccccctgctgtatacggtgcttatctctcacaccttgtgcctgaaaatggtggtaggagcctacgtggggggattcctgtctagcttcatagagacatactctgtttaccagcacgacttttgtgggccatacatgattaatcatttcttttgtgatcttccgcccgtcctggccctgagttgcagcgacacttttacgtcagaggttgtgacctttatcgtgtcggtcgtggtgggcatcgtgagcgttttggtcgtcttgatctcctatgggtatatagttgccgctgtggtaaaaatcagctccgctaccgggagaaccaaagcgttttccacctgtgcgagccatctgaccgcggttaccctgttctacggtagcggcttctttatgtatatgcggccttcatcgtcctacagcttaaatcgtgataaggtggtgagcatcttttatgcccttgtgatcccagttgtgaaccctattatctatagctttcgaaacaaggagatcaaaaatgctatgcgcaaggccatggagagggaccccggaatcagccatggcggtccgttcattttcatgacactcggatag

SEQ ID NO: 44460 - DNA, 930 bp, Artificial Sequence
  Description of Artificial Sequence: Synthetic coding sequence
atggacatcagcgagggcaacaagaccctggtgaccgagttcgtgctcactgggttaacagatagaccctggctacacgtgctctttttcgtggtgttcctggtggtgtaccttatcacaatggtgggaaatctagggctcattgtgctgatttggaatgaccctcatctgcacatgcccatgtacctattcttgggaggcttggcgttctctgacgcatgtacctccacctctattacaccacgcatgctggtcaattttctggataagaccgccatgatttcattggcggaatgcataacgcagttttattttttcgccagctccgctaccactgagtgctttctgttggttatgatggcctatgatcgatacgtcgccatttgcaacccgctgctgtatcctgtgatgatgtccaacaaactgagcgcacagctcctaagcatctcttatgtcattggttttttgcatccattggtgcacgtgtccctcctgttaagactgaccttttgccgctttaatatcatacattacttctattgtgagatcctgcagcttttcaagatttcctgtaatggaccttctatcaacgctctgatgatctttatatttggggccttcattcagattccgactttgatgacaatcatcatctcatataccagagtcctgtttgacatcctgaaaaaaaagagcgaaaaggggcgtagcaaggccttttcaacctgtggcgcacatctgctctcggtctccctctactatggaactctcattttcatgtatgtccggcctgccagtggactcgctgaagatcaagataaggtttattccttattctatacgatcatcattccacttcttaacccgtttatatatagcctccgcaacaagaaagtgatgcacgctcttcggagagtgataaggaaatag

SEQ ID NO: 44461 - DNA, 930 bp, Artificial Sequence
  Description of Artificial Sequence: Synthetic coding sequence
atgaccctgggcaacagcaccgaggtgaccgagttctacctgctgggcttcggggcgcagcatgagttctggtgcatcctctttattgtgtttcttctgatatacgtgacaagcataatgggaaattccgggataatcctactgataaacaccgattctaggttccagactttaacctactttttcttgcaacatctggcctttgttgacatctgttacacatctgccatcacaccgaagatgttacagtcattcaccgaggagaagaacctaatgctctttcaggggtgcgttattcagttcctggtctacgcaacctttgccacatctgactgctacctgttggcaatgatggcagtggatccttatgtcgcgatctgcaagccgctgcattacactgtaattatgagcaggaccgtttgcattagactggtggccggcagctatattatgggctctatcaatgcatctgttcaaaccggtttcacttgtagtctgtccttttgcaagtcaaattcaatcaatcacttcttctgtgacgtcccccctatcctggccctgtcttgctcgaacgttgacatcaacatcatgctgctggttgtctttgtcgggtctaatctcatttttactggactagtggtcattttttcctacatttacatcatggctacaattctgaaaatgagctcttccgccggacgcaagaaaagtttctctacctgtgcctcacacctgacagcagtgacaatattctacggcaccctgtcctacatgtacctgcaatcgcactctaacaatagccaggagaacatgaaggtggcctttattttctacggaaccgtcatacctatgttgaatccactgatttatagccttcgaaacaaggaggtaaaggaggcccttaaagtaatcggcaaaaagctgttctag

SEQ ID NO: 44462 - DNA, 936 bp, Artificial Sequence
  Description of Artificial Sequence: Synthetic coding sequence
atgaccggcggcggcaacatcaccgagatcacctacttcatcctgctcggcttctctgatttcccccgcataatcaaagtgctctttaccatatttctggtgatttatatcacctccttagcatggaatctcagcttaattgttcttattcgcatggactctcatctacatactcccatgtacttttttctgtcaaacttgagctttattgacgtctgttacatcagctcaacagtccccaagatgctgtcaaacttactccaggaacagcagacgattacctttgtaggttgcatcatacaatactttatcttctcaacgatgggattaagtgaatcgtgcctgatgaccgcaatggcatatgaccggtatgcggccatctgcaacccgcttctatactcctccattatgtcgcctaccctgtgcgtgtggatggtcctgggcgcctatatgaccggactgaccgcctcgctgtttcagattggagccctcttgcagctgcatttttgcgggtcaaacgtcattcgtcatttcttttgtgacatgccacagctgctgatcctgagctgtacagatactttcttcgttcaggtgatgactgcgattctgaccatgttttttggcatcgcctcagcgttagtaatcatgatctcatatgggtatattggaatatcaatcatgaagatcactagtgccaaggggaggtccaaagctttcaacacctgtgccagccacttgacagctgtgagtcttttttacacctccggcatctttgtgtatctgtctagctcgtcagggggttcaagctcctttgatagatttgcctcggtgttttatactgttgtgatacccatgctgaaccctttgatctattccctgcgtaacaaggaaataaaagatgccctgaagaggctacagaagcgtaaatgttgctag

SEQ ID NO: 44463 - DNA, 951 bp, Artificial Sequence
  Description of Artificial Sequence: Synthetic coding sequence
atgcggctgatgaaggaggtgcggggccggaaccagaccgaggtgaccgaattcctgctgcttggtctgtctgacaaccctgatctgcaaggagttctgttcgcgctgttcctgttgatctacatggccaacatggtggggaacttagggatgattgtgcttatcaagatcgatctttgcctacacaccccaatgtactttttcctatcaagtctgagcttcgtggacgcttcctattctagttccgtgacacccaaaatgttggtgaacctcatggctgaaaacaaagccatcagcttccatggctgcgccgctcaattttattttttcggcagctttttgggaacggaatgcttcctgttagcaatgatggcctacgacagatacgcagcgatatggaaccccctcctttaccccgtcttggtctcggggcggatttgcttcctactaattgccacttcattcctggccggctgcggaaatgctgcaattcatacaggaatgactttccgcctttctttttgcggctccaataggattaatcacttctattgcgacaccccccccttactgaaactgtcgtgcagcgatactcatttcaatggaatagtcattatggcattctcctcatttatcgtcatatcctgcgtgatgattgtgttaatcagctatctatgtatctttatcgctgttttgaagatgccctccctggagggtcgccacaaggctttttccacttgtgcctcctacctgatggccgtaaccattttcttcggcacaatcctcttcatgtacttgcgccctacctctagctacagcatggagcaggataaagtggtttccgtattctacaccgtgatcattccagtcctgaatccgctgatttactcccttaagaataaggatgtgaagaaagcactgaaaaagattctctggaagcacatcctgtag

SEQ ID NO: 44464 - DNA, 954 bp, Artificial Sequence
  Description of Artificial Sequence: Synthetic coding sequence
atgatgcggctgatgaaggaggtgcggggccggaaccagaccgaggtgaccgaatttcttctgctagggctaagcgataatcctgatctgcaaggggtgctgtttgcgctcttcttactcatctacatggccaatatggtgggcaaccttgggatgatcgtgttaattaaaatcgacctgtgtcttcatactcccatgtatttttttctctccagtctgtcctttgttgacgcttcatacagttcgtccgtcacccccaagatgctcgttaacctcatggccgaaaataaagccattagttttcacggttgcgccgctcaattctatttctttggctcctttctggggactgagtgttttttactcgccatgatggcttatgataggtatgccgccatttggaacccacttttgtatcctgtccttgtgtccggtcgtatttgctttctcctcatcgccacctctttcctagccggctgcggcaacgctgcgattcacacgggaatgacatttagattaagcttttgcggtagtaatagaatcaaccacttctactgcgatacaccccctctgctgaagctcagttgcagtgacactcatttcaatggaattgttattatggcctttagttcctttattgtaatctcctgcgtaatgatagttctgattagctacctgtgtatcttcatagccgtgctcaaaatgccatcattggaaggccgacataaggccttctccacctgtgcctcatatctaatggccgtcacaatctttttcggtacaatcttgttcatgtatctgaggcctaccagcagctattccatggagcaggataaagtcgtttcagtattttacacagtaattattccagtgttgaatccccttatatactcccttaagaacaaggatgtaaagaaggcactgaagaagatcctctggaaacacatcctgtag

SEQ ID NO: 44465 - DNA, 933 bp, Artificial Sequence
  Description of Artificial Sequence: Synthetic coding sequence
atggacaaggagaacagcagcatggtgaccgagttcatcttcatgggaatcacccaagacccacagatggagatcatttttttcgttgtttttctgatcgtctacctggtaaacgtggtgggaaatatcggaatgatcatcctgattactacagacacgcaattgcatacccccatgtactttttcctctgcaacctctcgtttgtggatctcggatattcctcagcaattgcacctaggatgttggcggactttctgaccaatcacaaggtaatttcgttctcaagctgtgccacacaatttgcctttttcgtggggttcgtggacgccgaatgctacgtactggccgctatggcttatggtagattcgtcgcaatttgccgtccacttcattatagtactttcatgtcaaagcaagtgtgtctcgcgctgatgctcggatcctacctcgccggattggtctccctggtcgcacataccaccctgacattcagcctctcttactgcggcagcaatatcataaatcacttcttctgcgaaattccacccctcctggcattgtcctgcagcgatacatacatatctgaaattctactcttctcgttgtgtggattcattgagttctctaccattctgatcatttttatcagctatacgttcatcctcgtcgccatcatcaggatgcgctctgcggagggccgccttaaggcgttcagcacgtgtggctctcacctgaccgggataactctgttctatggcaccgtaatgtttatgtacctgcggcccacctcatcatattcgctggaccaggataaatgggccagcgtgttttacaccgtgattatccctatgctcaatcccctgatctattccctcagaaataaagacgtaaaagcggcctttaagaaattgattggtaaaaaatctcagtag

SEQ ID NO: 44466 - DNA, 975 bp, Artificial Sequence
  Description of Artificial Sequence: Synthetic coding sequence
atgctggagagcaactacaccatgcccaccgagttcctgttcgtggggttcactgattaccttcccctccgcgtgactctcttcctagtattcctgttggtatacaccttaactatggtggggaatattctcctcattatcttggttaatatcaattctagcctgcaaatccctatgtactactttttgtccaacctgagttttttggatatttcctgtagtacggcaataacaccaaagatgcttgccaacttcctggcttctagaaagagcatcagtccatatggttgtgcgcttcagatgttcttctttgcatcgttcgccgacgccgagtgtctgatcctggctgcaatggcttacgataggtatgctgcaatttgcaatcctctattgtacacaactctgatgagtcggagagtctgcgtgtgcttcatcgtgctcgcctactttagcggctccaccacttctttggtccatgtctgtttgacttttaggctttcattctgcggctcaaatattgttaatcactttttctgtgatataccgcccctcctagccctgtcctgcactgatacccagataaatcagcttttgctgtttgctctgtgctcattcattcaaacttcgacgttcgtggtgatcttcatatcatacttttgtatcctcataaccgttctgtctattaaatcctcaggaggacgaagcaagacattttccacatgtgcgagccacctcatcgctgttacgctgttctacggtgctttattattcatgtatcttcagccaaccacttcttatagcctggacacagacaaggttgtcgcggtgttctacactgtggtgtttcccatgttcaaccctatcatctactcattccgaaataaagatgtaaagaacgctctgaagaaactgctggaaagaatagggtattccaacgagtggtacctgaatcgtctaagaattgtgaacatttag

SEQ ID NO: 44467 - DNA, 1089 bp, Artificial Sequence
  Description of Artificial Sequence: Synthetic coding sequence
atgaccgagttccacctgcagagccagatgcccagcatccggctgatatttcggcgtctaagcctgggtaggatcaaaccaagccagtctccacgctgctcaacatcttttatggtcgtgcctagcttttccatcgcggaacattggcgtaggatgaaaggggccaacctctctcaggggatggaatttgagttactaggcctgactactgaccctcagctgcagaggttactgttcgtcgtgttcttgggcatgtacactgcaacccttctcggaaatctggttatgttcctccttattcacgtctccgctacattgcacactcctatgtacagtctcctgaagagcctgtcattcttggatttctgctattcttctactgtcgtcccacagacactggtcaatttcctggcaaagcgcaaggtgattagttactttggctgcatgacacagatgtttttttacgccggcttcgcgacctctgaatgctacctgatagccgcaatggcctatgaccggtatgctgcaatctgtaacccgctgctttattccaccatcatgagtcctgaggtttgtgcctcactcattgtgggctcttattcggccggtttcttaaattcactgatccataccggctgcatttttagcctcaaattctgtggtgcacatgttgtgacccattttttttgcgacggtccccctatcctgagccttagctgtgtggacacatctctttgtgagatcctgctgttcatctttgccgggttcaacctgctgtcatgcacactaacaatccttatttcatactttctaattctgaataccatccttaaaatgagttcggcccagggaaggttcaaggccttctccacctgcgcatctcacctcactgcaatctgtctgttcttcggcacaactttgtttatgtacctgcgaccacggtccagctacagtctgactcaggaccgcactgttgcggtcatctatacggtggtgataccagttttaaaccccctcatgtattcccttaggaataaggatgtaaagaaggcattaataaaagtgtgggggcgcaagacaatggaatag

SEQ ID NO: 44468 - DNA, 945 bp, Artificial Sequence
  Description of Artificial Sequence: Synthetic coding sequence
atggagaacaacaccgaggtgaccgagttcatcctggtgggcctgacagatgacccagaactgcagattccactgttcatcgtattcctttttatttatctgatcaccctggttggcaacctgggcatgattgagctgattctgctggactcatgcctgcacacacctatgtactttttcctttccaatctgagccttgtggacttcgggtacagctctgccgtgacacccaaggttatggtcgggttcttgaccggcgacaaatttattctgtataacgcttgcgcaactcaatttttcttttttgtggcatttattaccgccgaatcctttttgcttgcttctatggcttacgacagatacgccgccctatgcaagccactgcattacaccacgacaatgactactaacgtctgcgcttgtctggcaatcggatcctacatctgtgggttcctcaatgctagcatccacaccgggaatacgtttagattatctttctgtaggagcaatgtggtggaacacttcttctgcgacgccccccctctcttgaccctaagttgctcagataactatataagtgagatggtaattttcttcgtggtggggttcaatgacctgttcagcatcctcgtcatcttgatcagctacctctttatcttcatcacaatcatgaagatgcgctcacccgaaggtagacaaaaggcattctctacttgtgcatcgcaccttaccgcagtgagcatattttatggtaccggcatcttcatgtatctccgcccaaactcatcgcattttatgggtacggacaaaatggcaagcgtcttctacgcaatcgtgatcccaatgctgaaccctttagtctacagtcttaggaataaagaggtgaagtctgcatttaaaaaaacggtgggaaaggctaaggctagcataggatttatcttttag

SEQ ID NO: 44469 - DNA, 945 bp, Artificial Sequence
  Description of Artificial Sequence: Synthetic coding sequence
atggagaacaacaccgaggtgagcgagttcatcctgctgggcctgaccaatgcccccgagttacaagtgcccctctttataatgttcacattgatttatctgataaccctcaccggaaacctggggatgatcatattaatattgctagactcacaccttcatactcccatgtatttctttctgagtaatctgtctctggcaggaatcgggtactcatctgctgtgacccctaaagtccttactgggctacttatcgaggataaggcgatctcctatagcgcttgtgcggcccagatgtttttttgcgctgtgtttgccaccgtcgaaaattacctgctgtcctctatggcttatgatcgatacgccgccgtctgcaatcccttacattatacaactactatgactacacgggtatgcgcatgcctcgcaattgggtgctacgtgattggcttcttgaacgcctctattcaaatcggagataccttccgcttaagcttttgtatgagcaacgttattcaccatttcttctgcgataagcctgcagtcattactctgacctgcagtgagaagcatattagcgagctgatcctggtgctaatttcaagttttaacgtattctttgctttgctggtgaccctgatcagctacttgttcatccttataactatcttgaagaggcacaccggaaaaggctaccagaaacctctgagcacatgcgggagccaccttatcgccatcttcctgttttatataaccgtgattattatgtacattcgtccttcctccagccatagcatggataccgacaaaatagcctcggtcttttacacaatgattatacccatgctgtcgcctattgtctacacattgcgtaacaaggacgttaaaaatgctttcatgaaggttgtcgagaaagcaaagtattccctcgactctgtcttttag

SEQ ID NO: 44470 - DNA, 930 bp, Artificial Sequence
  Description of Artificial Sequence: Synthetic coding sequence
atggagaactgcaccgaggtgaccaagttcatcctgctgggcctgacttctgtccccgaattacaaatccctctgtttatcctcttcaccttcatttacctgctaactctttgcggaaacttaggtatgatgctgttgatactgatggactcctgtcttcatactcctatgtacttcttcctttctaacttgtccctggtggactttgggtattcaagtgccgtgacgcccaaggtgatggccggattcctgcgaggcgacaaggtgatcagctataacgcttgtgccgttcagatgttcttcttcgtggcattagccacagtggagaattatctgctggcctccatggcctatgacaggtacgccgccgtgtgtaagccgctgcattacaccactaccatgacggcctctgtcggcgcgtgcctggccttaggaagctacgtgtgcggttttctgaacgcgtcatttcacatagggggaatcttttcactgtctttttgcaaaagtaacctggtccaccattttttttgcgatgtccctgctgtgatggctctgtcctgctcggataagcatacaagtgaagttatacttgtcttcatgtcaagttttaatatttttttcgtgctcttggtcatctttatatcttacctatttatatttatcacaattctgaagatgcattccgccaagggccatcaaaaagcactgagtacatgcgcatctcatttcaccgctgtgagtgtgttctatggaaccgttatctttatttacctgcagcccagtagtagtcactccatggacactgataaaatggctagtgtcttctatgccatgataatcccaatgctaaatccggtcgtgtacagccttagaaaccgggaggtccagaacgcctttaaaaaggtgctgcgccgccagaagttcctgtag

SEQ ID NO: 44471 - DNA, 945 bp, Artificial Sequence
  Description of Artificial Sequence: Synthetic coding sequence
atggagaacaagaccgaggtgacccagttcatcctgctgggcctgaccaacgatagcgagctgcaggtccccttattcatcaccttccctttcatctacatcattactctggtgggaaacctaggaattattgtccttatcttttgggactcatgcctgcataatcctatgtacttctttctatccaatctgtcactggtggacttttgctattcaagcgctgttacccccatagtgatggccggatttcttatcgaagataaagtcatctcatataacgcctgcgccgcacagatgtacatctttgtggcatttgccacggtggaaaactacctgctcgccagtatggcgtatgatagatatgccgccgtttgtaagcctctgcattacactaccacgatgacaacaactgtttgcgcacgtctggccatcggctcatatctgtgtggcttccttaacgcatccattcacaccggggacacctttagcctgtccttttgtaagtccaacgaagttcatcacttcttctgtgacatacccgctgttatggtgctcagttgtagtgatagacacatctcagagctggtgctgatttacgttgtttcttttaatatttttattgccctcctggtcattctgatctcttatactttcatcttcattactatactgaagatgcacagtgcgtcagtataccagaagcctctttctacatgtgcctcgcactttatagcagtcggcattttttatggtaccattattttcatgtatctgcagcccagcagcagccacagcatggacaccgacaaaatggctcctgttttttacaccatggtgattccaatgctgaacccactggtgtactctctgagaaacaaagaagtgaagtctgctttcaagaaggtggtagagaaggccaaattgtcagtcgggtggtccgtgtag

SEQ ID NO: 44472 - DNA, 963 bp, Artificial Sequence
  Description of Artificial Sequence: Synthetic coding sequence
atgaacagcgagaacctgacccgggccgccgtggcccccgccgagtttgtacttctgggcatcaccaaccgctgggacctgcgagttgccttgttcttaacctgcttgccagtgtaccttgttagtctgctcggaaatatggggatggcactgctgatcagaatggacgcccggctgcacacccccatgtacttttttctagccaacctttccctgctcgatgcatgctattctagcgctatcgggcccaagatgcttgttgatctgttgttgcctcgagcaaccataccctatacagcctgtgcccttcagatgtttgtgtttgctgggctggccgacaccgagtgctgcctgctggctgctatggcttacgatagatacgtggctatcagaaatcccctgttgtacaccaccgccatgtcccagcgactctgcttggctcttctaggagctagcggtttaggcggggctgtctccgcatttgtccacactaccctcacatttagactctctttttgcaggagccgcaaaatcaacagtttcttctgcgacatacctcctttgttggccatctcatgcagcgatacatctctgaacgagttgttgctgtttgccatctgtggattcattcaaactgctacagtgctggccatcactgtctcatacggatttattgcaggcgccgttatccacatgcgtagcgtggaggggagcaggcgtgctgccagcacagggggcagccacctgactgctgtggcaatgatgtacgggacattaatctttatgtacctcagaccctcctccagctatgccctagataccgacaaaatggcatccgtgttctatactcttgtcataccgtcactgaaccccttgatatacagcctgcggaacaaggaggtgaaagaagccctgcggcagacctggtccaggtttcactgccctggccagggctcccagtag

SEQ ID NO: 44473 - DNA, 945 bp, Artificial Sequence
  Description of Artificial Sequence: Synthetic coding sequence
atgatggccagcgagcggaaccagagcagcacccccaccttcatcctactgggcttttctgagtacccagaaatccaggtgcccttatttctggtctttctctttgtgtacacagtgaccgtagttggcaacctgggaatgattatcatcattagactcaactcaaagctgcatactatcatgtgctttttcctcagccatttgagcctgacagatttttgcttcagcaccgtcgtgacccctaaactcttggaaaaccttgtcgtggagtaccgcaccatatccttttccgggtgtattatgcaattttgttttgcctgcattttcggcgtgaccgagaccttcatgctcgcggccatggcttacgatcgattcgtcgctgtctgcaaaccgctgctgtatactactatcatgtcccagaagctgtgtgcattgttagttgctggatcgtatacctggggaattgtttgctcgttgatcctgacctattttctcctggatctctccttctgcgaatccaccttcattaataactttatctgcgatcatagtgtgattgtctccgcttcctactccgacccatacatcagccagcggctgtgttttattatcgccatcttcaacgaggtctccagtttgatcatcattctgactagttatatgctgattttcaccacaattatgaagatgaggtcagccagtggacgtcaaaagactttttcaacatgcgcatctcatttaactgccatcacaatctttcatggaaccattcttttcctctattgtgtgcctaaccctaagacaagctccttgatcgtcacagtagccagtgtattttatacagtggcgatcccaatgttgaacccgctcatatactcactgagaaataaggacatcaataacatgttcgaaaagctcgttgtgaccaagctgatttatcactag

SEQ ID NO: 44474 - DNA, 945 bp, Artificial Sequence
  Description of Artificial Sequence: Synthetic coding sequence
atgatgatggtgctgcggaacctgagcatggagcccaccttcgccctgctggggttcaccgactatcccaagctccaaatccctctgtttctcgtcttccttttaatgtacgtcatcacagtggtggggaacctgggcatgatcatcattatcaagattaacccaaaattccatacaccaatgtactttttcctgtcacacctttccttcgttgacttttgctattcttcaatcgtgaccccgaagcttctggagaatttagtgatggccgacaaatctatcttctacttcagctgcatgatgcagtattttctgagctgcactgctgtggtaacagagtctttccttctcgccgtcatggcgtacgacagattcgtggctatctgtaaccccttgctgtacaccgtagctatgtcgcaacggctgtgcgctctgctcgttgcaggctcctacctgtggggcatgttcgggccactggtgttattgtgttatgccttgcgattgaacttctctggtcccaacgtcataaatcattttttttgtgagtataccgccctcatctccgtgagcggctctgatatcctgatccctcaccttctcctattttcctttgctacgtttaatgagatgtgcaccctcctgattatcctaacaagctatgtatttatctttgtgactgtccttaagatcaggtctgtgagcgggcggcataaggctttctcaacgtgggcttcccaccttacatcaatcacaatcttccacggaactatactcttcctgtattgtgtccctaacagcaaaaactcccgccagacagtaaaggttgccagcgtattttacacggtcgtgaatccaatgctgaatcctctgatctacagtctgaggaataaagacgtgaaggatgctttttggaaactgatccatacacaggtccctttccactag

SEQ ID NO: 44475 - DNA, 987 bp, Artificial Sequence
  Description of Artificial Sequence: Synthetic coding sequence
atgttcctgaccgagcggaacaccaccagcgaggccaccttcaccctgctggggttctctgattacctcgagctgcagatccctctattcttcgtgtttctggccgtttatggctttagcgtggttgggaacctggggatgatcgtgatcatcaagatcaaccctaaacttcatacgcctatgtatttcttcttgaatcacctgagcttcgtcgatttttgctactcgagtattatagccccgatgatgctagttaacctggtggtggaggataggaccatctcgttttctggctgccttgtgcagttcttctttttctgtacctttgtggttacagaactaatactgttcgccgttatggcttacgaccacttcgtggccatctgtaaccccttattgtacaccgtagctatctcgcagaaactgtgtgccatgctggtcgtagtgctgtatgcctggggtgtggcttgttcacttactctggcctgtagcgctttaaaactgtccttccacggtttcaacaccataaatcactttttttgtgaactatcatctcttataagcctttcctaccccgactcttatctgagccagctgctgcttttcactgtcgcgacattcaacgagatcagtacactgctcataattcttacatcatatgcttttattattgttacgaccctgaaaatgccctctgcgtccgggcatcggaaagtgttcagcacttgcgcctctcacctcactgcaataactatcttccatgggacaatcctcttcctgtactgcgtaccaaattcgaagaattccaggcacaccgtgaaagtcgcctcagtattctacactgtagtgatccccctgctcaaccccctcatttactccctgcgcaacaaggacgttaaggacgccatcagaaagattatcaacaccaagtacttccatattaagcacaggcactggtatccattcaatttcgtgattgaacagtag

SEQ ID NO: 44476 - DNA, 942 bp, Artificial Sequence
  Description of Artificial Sequence: Synthetic coding sequence
atgctgctgaccgaccggaacaccagcggcaccaccttcaccctgctggggtttagtgactatcctgagctgcaggtccctttgttcttggtatttctggctatctataatgtaacagttctggggaatatcggccttattgttatcatcaagattaaccccaaattgcacactcccatgtacttcttcctgtcccagctaagtttcgtcgacttctgctactcctcaatcatcgcccctaaaatgcttgtgaatcttgtagttaaggatcggacgatatcttttttgggttgtgtggttcagttcttcttcttctgtacctttgtggttaccgaaagctttttgttggccgtgatggcatatgaccgtttcgtggccatctgtaaccctcttctttacactgtgaatatgtcacagaaattgtgcgtcctgctagtagtgggaagctacgcctggggggtctcatgttcactcgaactgacctgctctgcccttaagctctgttttcacgggttcaatacaatcaatcatttcttctgcgaattttcttcactcctaagcctcagttgctctgatacatacataaaccagtggctactcttcttccttgctacctttaatgagatatcaaccctgctcatcgttctgacaagctatgctttcatagtggtcacgattctcaagatgcggtccgtttccggaagacgaaaggcattcagcacatgcgccagccatctcaccgctattaccatctttcatgggaccatcctttttctgtattgcgtgcccaatagcaaaaactctagacacactgtgaaggtagccagcgtgttctataccgtggtcatacctatgctgaatcccctcatttattctctcaggaacaaggacgttaaggacaccgtgaccgagatcctcgacaccaaagtcttctcctactag

SEQ ID NO: 44477 - DNA, 945 bp, Artificial Sequence
  Description of Artificial Sequence: Synthetic coding sequence
atgacccggaagaactacaccagcctgaccgagttcgtgctgctggggctggccgatactcttgaactgcagataatcctgttccttttttttcttgttatctacacattaactgtgctggggaacctgggcatgattctgctgattcggattgactctcagctccacactcctatgtatttttttctagccaacctgagttttgtagatgtgtgtaactctacaaccattacacccaaaatgctagccgatcttctttcagagaagaaaactatatcttttgctggatgttttctgcaaatgtacttctttatctctctggccactacggaatgtatcctgttcgggctgatggcctatgatagatatgcggctatttgtagaccactcttatacagtttgatcatgagtaggactgtgtatctgaaaatggctgccggcgctttcgcagctggactcctgaattttatggtgaacacaagccacgtcagtagcctgtctttttgtgacagcaatgtgatccatcacttcttttgtgactctccacccctttttaaactgtcatgttccgatacaattttgaaagaatccatcagtagtatcctcgccggagtcaacattgtggggaccctcttggtgatattgagcagttacagctacgttctgttcagcattttcagcatgcacagcggagagggcagacaccgggcgtttagcacatgtgcttcacaccttacggccatcattctgttctatgcaacctgtatatatacttacctgcggccgtcttcatcttacagtctgaaccaggacaaagtggccagtgtattctacacagttgttattccaatgcttaatcccctaatttatagcctacggagcaaggaggtcaagaaggcactcgctaatgtgatttctcggaagcgcactagctccttcctatag

SEQ ID NO: 44478 - DNA, 933 bp, Artificial Sequence
  Description of Artificial Sequence: Synthetic coding sequence
atggaggaggagaacgccaccctgctgaccgagttcgtgctgaccggctttctgtaccaaccccaatggaagatcccactgtttcttgccttcctggtaatatacctgattaccataatgggcaacctgggtttaattgcggtaatttggaaggatccgcatttacacataccaatgtatctgctgctgggcaacctggcttttgttgatgctttgctgagcagctcggtgacgcttaagatgttaattaattttctggccaagagcaagatgatctcgctgagcgaatgtaagatccaacttttttcctttgccataagcgtgacgactgagtgttttctgctcgcaaccatggcttacgacaggtacgttgctatatgcaagcctctgctgtaccccgccatcatgaccaatggcctatgcatccggctacttattcttagttatgtaggaggtttgctccacgccctcatacacgaggggtttcttttcaggttgactttctgtaattctaacattatacagcatttctattgcgatatcatccctctgcttaagatttcttataccgatagctccattaattttttgatggtttttatattcgccggcagcattcaggtattcacaatcggcactgttctcatcagctacatatttgtcttgtacaccattttgaagaagaagagtgtcaagggaatgaggaaagcctttagcacctgtggagcccatctgctgtccgtttcgctctattacggacctctagcttttatgtacatgggatctgcctcaccacaagctgatgaccaggatatgatggagtccctattctacacagtcattgtgcccctcctaaatcccatgatctatagtttgagaaacaaacaggtgattgctagttttacaaagatgttcaagcgaaacgacgtctag

SEQ ID NO: 44479 - DNA, 945 bp, Artificial Sequence
  Description of Artificial Sequence: Synthetic coding sequence
atgagcaacgaggacatggagcaggacaacaccaccctgctgaccgaattcgtgctcaccgggctgacatatcagcctgagtggaaaatgccgctctttctcgtctttctagtgatttaccttattactatagtctggaacctgggtctgatcgcactgatttggaatgatccccagctccatattccgatgtatttctttctcggctccttagccttcgtagatgcctggatttcctccacagtgacccctaagatgctcgtgaacttcctggcaaaaaacagaatgataagccttagcgagtgcatgatccagtttttctcatttgcctttgggggaacaactgaatgcttcttattggcaactatggcttatgatagatatgtggcaatatgtaagccactgctgtaccccgtgatcatgaataactccctgtgtattaggctgctagccttcagttttctgggaggcttcctgcatgcactgatacacgaagttctgattttccgattgacattttgcaactccaacatcatacaccacttctattgtgatataatccctctttttatgattagctgcactgatccctccataaatttcctaatggtgttcattttgagtgggtccatccaggtgtttaccattgtgaccgtgctgaactcttacaccttcgccctcttcaccatcctgaagaaaaaatccgtgagaggagttagaaaagcgtttagcacttgcggtgcccatttactctctgtttctctctactatggtcccctgatattcatgtacttgcgaccggcctctccccaggcagacgaccaagacatgatcgattctgtcttctacactataattatcccgctacttaatcctatcatatattctctccggaacaaacaggtgatcgacagcttcacaaagatggttaagaggaatgtgtag

SEQ ID NO: 44480 - DNA, 945 bp, Artificial Sequence
  Description of Artificial Sequence: Synthetic coding sequence
atggagttcaccgaccggaactacaccctggtgaccgagttcatcttgctcggtttcccaacacgacctgaactccaaatcgtactgttccttatgttcctgaccctgtatgcgatcatcttaatcggaaacattgggctgatgctcttgatccgtattgacccacacctgcagacaccaatgtacttctttttaagtaacttatcttttgtggatctgtgctacttctctgatatcgtgccaaagatgctcgtgaatttcctttctgaaaataaaagcatctcctactatggctgtgccctgcaattttactttttctgcacgtttgcggacacagagagcttcatactggccgccatggcttatgaccgatacgtcgctatttgcaatcctctcctgtacactgttgtaatgtccaggggtatttgtatgcggctcatagtgctgtcatacctcggtggaaatatgagtagcctcgtccacaccagcttcgcctttatcctgaaatactgcgataagaacgtgataaatcacttcttctgcgacctccccccgcttctgaaactcagttgcacggacaccacaataaatgaatggctgctgagtacgtacggttcttccgtggagattatctgtttcattatcatcattattagttacttcttcattctgttgagcgttctcaaaattcgttctttttcagggcgcaaaaaaactttttctacgtgcgcctcgcatctcacgagtgtcactatctaccagggtacactgctatttatttattctaggccatcctacttgtattccccaaatacggacaaaatcatctccgtcttttacaccattttcatccccgtgcttaaccccctcatttatagcttaagaaataaggatgtgaaagatgccgctgaaaaggttttgcgatcaaaagttgactcttcctag

SEQ ID NO: 44481 - DNA, 939 bp, Artificial Sequence
  Description of Artificial Sequence: Synthetic coding sequence
atggccgacgacaacttcaccgtggtgaccgagttcatcctgctgggcctgacagaccacgccgagttaaaagctgtgttgtttgtagtatttctggtcatttacgcgattactttgttaaggaatttaggaatgatcctgctgattcaaatcactagtaagctccacactcccatgtatttcctcctgtcctgcctgagctttgtggatgcctgttacagctccgcgatagcaccgaaaatgctggttaacctgttggtcgtgaaagcaaccatcagcttcagcgcatgcatggtgcaacacctgtgctttggagtgttcattacgaccgagggatttcttctgtccgttatggcttatgacaggtacgtggcgatcgtcagtccactgctgtataccgttgccatgtctgaccgtaaatgcgtggagctagtgaccggatcctggattggtgggatcgtcaacaccttgattcacaccatcagcctgagacgcctaagcttctgtcgactcaatgctgtgtcacacttcttttgtgatattccttccctcctcaaactaagctgttcggacacaagtatgaacgagctgctgctactgacattcagtggtgttatcgccatggccaccttcctgacagtgattatatcctacattttcatcgcctttgcatctctgcgcatccattccgccagtggacggcaacaagcattttcaacatgtgcttctcacttgacagcagttacaattttttacgggaccctgattttcagctatatccagccaagttctcagtactttgtggaacaggaaaaggtggtctccatgttttatacattaggcatccccatgctgaaccttctcatccatagcctgagaaataaggacgtgaaggaggctgtgaaacgggcgattgaaatgaagcactttctgtgttag

SEQ ID NO: 44482 - DNA, 927 bp, Artificial Sequence
  Description of Artificial Sequence: Synthetic coding sequence
atggccgaggagaaccacaccatgaagaacgagttcatcctgaccgggtttacggatcacccggagttaaagactctcctgttcgttgtgttctttgcaatttatctgattacagtggtcgggaacatcagtctcgtcgccctaatatttactcaccgccgccttcatacccccatgtacatttttctcggtaatttggccctggtagacagctgttgcgcatgtgccatcacccccaaaatgctggagaatttctttagcgagaataaacgcataagtttatacgagtgtgcagtgcagttttatttcctatgtacggtggagaccgctgactgtttcctcctcgctgctatggcttatgatcggtacgttgccatctgtaatcccctacagtaccacataatgatgtcaaaaaagctgtgtatccagatgacaactggcgcctttattgccgggaaccttcactcaatgatccatgtgggcttagttttcaggctggtcttctgtggttccaatcacatcaaccatttctattgtgacatactgccgctgtacagactttcctgcgtagatccctatatcaacgagttggtgctgtttatctttagcggcagcgtccaggtgttcacaatagggagtgtcctcatctcttacctctacatactgttgacaatttttaagatgaaatcaaaggaggggagggctaaggcttttagtacttgcgcatctcattttctgagtgtttctttgttctatggttcgctgttcttcatgtacgttcggccaaatctcctggaggaaggagacaaagacatccctgcagcgatactgttcacaatcgtggtgcccctccttaatcctttcatttattccctgagaaatcgggaagtgatcagcgtgctgaggaaaattctcatgaaaaaatag

SEQ ID NO: 44483 - DNA, 951 bp, Artificial Sequence
  Description of Artificial Sequence: Synthetic coding sequence
atggtggaggagaaccacaccatgaagaacgagttcatcctgaccggttttaccgaccatccagaactgaaaacactcctctttgtagtcttcttcgccatctacctcatcactgtcgtgggcaatatttccttggtggccctcatttttacccactgcaggctccacacccctatgtacatctttctcggtaatttagcactagtcgattcgtgttgcgcttgcgcaatcacgccaaagatgctggaaaacttcttttccgaaggcaaaaggatctccctgtacgaatgtgccgtgcagttctattttctgtgtactgtcgaaaccgctgactgcttcttactagccgctgtggcgtatgatagatacgtcgctatatgtaaccccctccagtaccacatcatgatgagtaagaagttatgcatccagatgacaactggggcgtttatcgctggtaatcttcattctatgatacatgtgggattagtctttagactcgtcttctgcggcctcaatcacataaatcacttctactgcgatacccttcccctgtatagactctcttgtgttgatccctttattaacgaactggtactgtttatctttagcggtagcgtccaggtgttcacaataggatccgttctgatttcgtatctgtacatcctactgacaatctttaggatgaaaagcaaagagggacgcgccaaggccttcagtacatgtgcaagccacttttctagcgtatcattattttatgggtcgatattcttcttgtacatccggcctaacctcttggaggagggtggaaacgatattccagccgcaatcctgttcaccattgtagtgccactgctgaatcccttcatttactccttaaggaataaagaggtcattagtgtgcttcgtaagatacttctcaaaatcaagagccaggggtctgtgaataagtag

SEQ ID NO: 44484 - DNA, 966 bp, Artificial Sequence
  Description of Artificial Sequence: Synthetic coding sequence
atggcccgggagaaccacagcctggccgccgagttcatcctgatcggttttaccaactatcctgagcttaagacactcctgtttgtggtgttctcggctatttacctggttactatggttggcaacctgggcttggtggccctgatctacgtggagcgacggctgctgacccctatgtatattttcctaggtaatctagctctgatggatagctgttgttcttgcgccgtgacccccaagatgctggagaactttttttcagaggaccgcattatctccctgtacgaatgcatggctcagttttactttctttgccttgctgaaaccacagactgcttcctactggctacaatggcttacgaccgatacgtcgccatttgtcatcccctgcagtaccatactatgatgtctaagacactctgtatacgcatgacgaccggcgccttcaaggccgggaatctccactcgatgattcatgtcggacttctcttgaggttaacattctgtagaagtaacaaaattcatcactttttctgcgacatattgcctctctacagattaagctgtacggaccccagcatcaacgaactgatgatttatattttcagcatccctattcagatcttcaccattgccactgttctcatcagctatttatgtatcttgttaactgtgtttaagatgaaatccaaggagggcaggggcaaagcctttagcacttgcgcgagccattttctttcagtgtcgattttttatatctgcctgttaatgtatatcggcccatcagaagagggggataaagatacacccgtagcgattttttatgccatagttatccctctgctgaatccctttatatactcgcttcgtaataaagaggtgatcaacgtgcttaagaagattatgcggaactataatatcctgaagcagacatgttcaattgcgaatctatttctgatttactag

SEQ ID NO: 44485 - DNA, 936 bp, Artificial Sequence
  Description of Artificial Sequence: Synthetic coding sequence
atgggcaaggagaactgcaccaccgtggccgagttcatcctgctggggctgtcggacgtgcctgagctcagagtgtgcttatttctcctcttcttgcttatatacggggtaacactgctggctaatttggggatgatcgccctaatccaggtgtccagccggctccatacacctatgtacttctttttgagtcacctgtcttctgtagatttttgctactctagcattattgtgcccaagatgctcgccaacattttcaataaggacaaagccatatcatttctgggatgcatggtgcagttttatctgttttgcacatgcgttgtcacggaagtgtttcttttagccgtgatggcttatgacagattcgtggcaatctgcaacccattgctgtatacagttacaatgtcctggaaagtgcgcgtcgaactcgccagttgctgctacttctgtgggacggtatgcagtctaatccacctctgcctggcactccggattcccttttaccgcagcaatgtgatcaatcacttcttctgtgatctgccgccagtcctgagccttgcctgctctgatatcacagtcaatgaaacgctgctgtttctggtggctaccttgaacgagagtgtgaccatcatgatcatactgacctcataccttctgattctgactactattctgaagatggggagtgctgaaggccgccacaaggcattctctacctgtgcgtcacacttaacagcaattaccgtgttccatggcaccgtgctgagtatatactgccggcctagctcagggaattcaggagacgccgataaagtggctacagttttctatacagttgtgattccaatgttgaacagcgtgatatattcactgagaaacaaggacgttaaggaagctcttaggaaggtgatgggatctaagatacactcctag

SEQ ID NO: 44486 - DNA, 936 bp, Artificial Sequence
  Description of Artificial Sequence: Synthetic coding sequence
atgggcaaggagaactgcaccaccgtggccgagttcatcctgctggggctttccgacgtgcccgaattgcgggtgtgcctcttccttctgtttttacttatttacggcgttacactgctggccaatttggggatgaccgccttgatccaagttagctcgcgcctgcatacccccgtatatttctttctgtctcatctcagttttgtggatttctgttactcctccattattgtcccaaaaatgcttgcaaacatttttaataaggacaaagcaatttcttttctggggtgtatggtgcagttttatcttttctgtacttgcggagtcactgaagtcttcttgttggccgtgatggcttatgacagattcgtcgcaatctgtaaccctctgctttacatggttacgatgtcccagaagttgagggtcgagctcacctcttgttgctatttttgtggcactgtttgttcattgatacattctagcctagcccttagaatcctgttttaccgcagcaatgtcattaaccactttttttgcgacttgccgccacttctgtcactggcatgctctgacgtcacggtcaacgagaccctgctgtttttagttgctacgcttaatgaaagtgttaccataatgatcatcctgaccagttatctgctgattctaaccactatcctgaagatccactccgccgaatccaggcacaaggccttcagcacatgcgcatctcatcttacggctatcaccgtgagtcacggcacgattttgtatatctactgtcgcccttcatccggaaatagcggtgatgttgacaaagtagccaccgtgttctacaccgttgtcattccaatgctgaatccactcatctattcactgcgcaacaaagacgtaaacaaggcactacgcaaagtgatgggatcgaagatacactcctag

SEQ ID NO: 44487 - DNA, 948 bp, Artificial Sequence
  Description of Artificial Sequence: Synthetic coding sequence
atgttcagccccaaccacaccatcgtgaccgagttcatcctgctgggacttactgacgatcctgtgctcgagaaaatactgtttggcgtgttcctggccatttatctgatcacccttgccggtaatctctgtatgatccttctcatacgaaccaactcgcacttgcaaacacctatgtacttctttctgggacacctgagctttgtggatatctgctacagttccaatgtgacacctaatatgctgcacaactttctcagcgagcagaaaacaatatcgtatgcgggatgctttacccagtgcttgctttttatcgcgcttgttattaccgagttctacatactggcttctatggctcttgaccgttacgtggctatatgctcccccttacattacagctcacggatgtccaaaaacatatgcgtgtgtctcgttacgattccatatatgtatggattcctaagcgggttttcccagtcccttctgacctttcacctgtccttttgcggcagcctagagatcaatcatttctattgcgcggatccccccctaattatgctcgcctgcagtgatacccgtgtcaaaaagatggcaatgtttgtggtcgcagggtttaatctgtctagcagcttattcatcatcctgctgtcttaccttttcattttcgcggccatttttcggatcagatccgccgaaggccgccataaagcctttagtacttgcgcatcccatctaaccatcgtcacactcttctatggcactctgttctgtatgtatgtgagaccccccagcgaaaagtcagttgaggagtccaaaatcactgccgtgttttacacattcttgtcccccatgctcaatcccctcatttattcattaaggaatactgatgtcatattggccatgcaacagatgatcagagggaagtcatttcacaaaatcgcggtctag

SEQ ID NO: 44488 - DNA, 948 bp, Artificial Sequence
  Description of Artificial Sequence: Synthetic coding sequence
atgctgagccccaaccacaccatcgtgaccgagttcatcctgctgggtctcaccgacgacccggtgctcgaaaaaattctgttcggggtgttcctggccatttatctcataacgctggctggcaacctgtgtatgatcttgttgatcaggacgaattcccagctccagacacctatgtatttcttcttgggtcacctgagtttcgttgatatctgctactcttccaatgtgacccccaacatgctacacaactttctgtccgagcagaaaacgattagttacgctggctgttttactcagtgcctcctctttattgctctggtgatcaccgagttctactttttagcctccatggcactggaccggtatgtggctatctgttctcccctccattactctagccgcatgagcaaaaatatctgtatcagtctggtgactgtgccctacatgtacgggtttctcaacggcctcagccagacactgcttacttttcatctgagtttttgcggcagcctagagatcaaccacttttactgcgccgatcctccactcataatgctggcttgttccgacaccagagtcaaaaaaatggcaatgtttgtggtcgccgggttcacacttagcagttctctgttcattatactgctgtcatacctttttatttttgccgcaatttttcggatcagaagcgccgagggccggcataaagcattttcaacgtgcgcgtcccacctgacaatcgttacactgttctacggcaccctcttttgcatgtatgttaggcctccatccgagaagtcagtggaagagagcaagatcatcgccgtgttctacacattcctgtcacccatgctgaacccactgatttatagccttcgcaaccgagacgtcattcttgcaatccaacagatgatcaggggaaagtccttctgcaaaattgccgtctag

SEQ ID NO: 44489 - DNA, 918 bp, Artificial Sequence
  Description of Artificial Sequence: Synthetic coding sequence
atgagcaacaccaacggcagcgccatcaccgagttcatcctgctgggcctgaccgactgtccagagctccagtcgctgctgttcgttttgttcctggttgtgtatctggtgaccctgttggggaacctgggcatgatcatgcttatgcggctcgacagtcggttgcatacacccatgtacttctttttgaccaacctggcctttgtcgatctttgctatacttctaacgcaactccgcagatgtcaactaacatcgtgtccgaaaaaaccatttcctttgctggttgcttcactcagtgctacatcttcattgcactactgctcaccgaattttacatgcttgctgcgatggcttatgatcgctatgtggcgatttacgatccactccgctacagcgtgaagacatcaagacgagtttgcatctgtttggctaccttcccatacgtctacggcttttcagatggcctattccaggccatattgaccttcagactaactttttgtcgctcttctgtcatcaatcatttctattgcgccgaccccccactgatcaagctgtcatgttctgacacgtatgtaaaggaacatgcgatgtttatttctgctggtttcaatctctcgagtagtttaacaatcgtcttggtgtcttacgcctttattttagcagcaatattaagaatcaaaagcgcagagggcagacataaggcctttagcacatgtggctcccacatgatggccgttactctgttctacggcactctgttctgtatgtatatccggcctccaacagataagactgtggaagagagtaaaatcattgccgtgttttacaccttcgtgtcccccgttctgaacccccttatctactctctgcgtaacaaggatgtgaaacaggcattgaaaaatgtcttgcggtag

SEQ ID NO: 44490 - DNA, 924 bp, Artificial Sequence
  Description of Artificial Sequence: Synthetic coding sequence
atgctgaacttcaccgacgtgaccgagttcatcctgctgggcctgacttccagacgggagtggcaggtcctgttcttcatcattttcctcgtggtatatatcatcacaatggtggggaatatcggcatgatggtgctcatcaaagtgtccccccagctgaacaaccccatgtatttcttcctgtcccacctgagtttcgtggatgtatggttctcaagcaatgtcacgcccaaaatgcttgaaaacctgctgagcgataagaaaactatcacctacgcggggtgtctcgtccagtgctttttttttatcgcacttgtccacgtagaaatcttcattctggccgccatggccttcgaccggtacatggccatcggtaacccattgctttatggaagtaagatgtctagagtcgtctgtatccgattgatcacgttcccttatatatacgggttcctgacctccctcgccgctaccctgtggacctacggcctatatttctgcggtaagatcgagatcaaccatttctattgcgccgaccctcctttaattaagatggcctgtgctgggactttcgtgaaagaatacacgatgatcatcttagccgggataaatttcacatacagtcttacagtgatcataatttcatacctgttcatcttaattgcgattctgcgaatgagatccgctgaaggccggcaaaaagcattctcaacgtgcggctcccatctgacggctgtaattatattctatgggaccctgatcttcatgtacctcagaagaccaaccgaggagtccgtggaacagggtaaaatggtggcagttttctacacaaccgtgatccctatgctcaatccgatgatatactcgctcaggaataaggacgttaagaaagcgatgatgaaagtgatctctcggtcttgctag

SEQ ID NO: 44491 - DNA, 936 bp, Artificial Sequence
  Description of Artificial Sequence: Synthetic coding sequence
atgcggcggaactgcaccctggtgaccgagttcatcctgctgggcctgaccagccggcgggaactgcagattcttctttttaccctgtttctggccatttatatggtcactgtcgctgggaacctcgggatgatcgtactcatccaggcgaacgcatggctacatatgccaatgtactttttcctgtcgcacctatcgtttgtggacctgtgcttctcctccaatgtgaccccaaagatgttggagatttttctaagtgaaaagaagagcatttcctaccctgcttgtctcgtgcagtgttatttgtttatagcactggtacatgtcgaaatttacattcttgctgtcatggcttttgatcgctatatggccatttgcaatccattgttgtacgggtcacgcatgtcaaagagcgtatgttcctttttgattaccgtaccttatgtctatggggcactcaccggcctcatggaaaccatgtggacttacaatctagccttctgcgggcctaatgaaatcaaccacttctattgtgctgatcctcccttaattaagctcgcatgtagcgacacttacaacaaagagttgagtatgtttattgtggccggctggaacctgtcattttccctcttcattatttgtatcagctatctctatatatttcccgctattttgaagattcggtccacagaggggagacagaaagccttcagcacatgtgggtctcacctgacagcggtgacaattttctatgctacacttttctttatgtacctcagaccaccatccaaagagtctgttgaacaagggaagatggtagccgttttctataccactgtgatcccaatgctgaacctcattatctacagtcttcgaaacaaaaacgtgaaggaggcactgatcaaagagttgtctatgaagatatacttcagctag

SEQ ID NO: 44492 - DNA, 933 bp, Artificial Sequence
  Description of Artificial Sequence: Synthetic coding sequence
atgcccaacttcaccgacgtgaccgagttcaccctgctgggcctgacctgtcgacaggaactccaagtgctgttcttcgttgtgttcctggccgtgtacatgatcacactcctgggaaatatcggcatgataattctaattagcatctccccccagcttcaaagtcctatgtatttcttcctcagtcacctgagcttcgccgatgtgtgcttcagctctaatgtaacacccaagatgcttgagaacctgttgtcagagaccaaaaccattagctatgtggggtgcctagtccaatgctatttctttatcgcagttgtgcacgttgaagtgtatatcttggccgtgatggctttcgatagatacatggccggctgcaatccgctgctgtacggaagcaaaatgagccgcacagtgtgcgtgagattgattagtgtgccgtacgtgtacgggttttcagtgtctctcatttgcacactgtggacatatggactgtacttctgtgggaacttcgaaataaatcacttttattgcgccgatccccctctaattcagatagcgtgcggcagggtgcacataaaagagattacgatgatcgtcattgcgggcataaatttcacctacagcttatcagtcgttcttatatcatacacgctgattgttgtggcggtgttacgtatgcggtcggcggacggccgaaggaaagcttttagcacatgtgggagccacctgactgctgtgtctatgttttatggaacccctatcttcatgtatttacgtagaccaactgaagaaagtgtggagcagggaaaaatggtggctgtcttctacaccaccgtcattccaatgctgaatcccatgatctactcacttcggaataaggatgtgaaagaggctgtaaacaaggccataacaaaaacatacgtccgccagtag

SEQ ID NO: 44493 - DNA, 969 bp, Artificial Sequence
  Description of Artificial Sequence: Synthetic coding sequence
atgaacagcctgaaggacggcaaccacaccgccctgaccggcttcatcctactggggctgactgatgaccccatactccgcgtaatactgttcatgatcatccttagcgggaacctgagcataattatcctcatccgcatttcgtctcaactccaccaccccatgtattttttcttaagtcacctcgcctttgccgacatggcatattcttcctctgtgaccccgaacatgctcgtaaattttctcgtggaacggaacaccgtttcctatctggggtgcgctattcagctgggctccgcagctttcttcgccactgtggagtgtgtgctcttagcggccatggcttatgacagattcgtcgcaatttgtagccccttgctgtactcaactaagatgtctactcaggtgtctgttcaattgcttcttgtcgtttatatcgcgggattcttgatcgctgttagctataccacttccttttatttcctgctgttctgtggccccaatcaggtaaaccatttcttttgtgacttcgcccccttacttgaactcagctgtagcgacatcagtgtcagtacggtggtgctttcattcagcagtggaagtatcatagttgtaacagtgtgtgtcatagccgtatgctacatttatatcctcatcaccatcttaaagatgcgcagcactgagggtcaccacaaggcatttagtacgtgcacgagccacctgactgtggtaaccctgttctacgggactattacgttcatctatgtaatgcccaacttctcgtacagtacagatcagaacaaggtggtgtccgttctttacacggtcgtgatacccatgctcaatcctctgatctatagtttaagaaacaaagaaatcaagggcgctcttaaacgggagcttgtgcgtaagatcctgagccatgacgcttgctatttttctcggacttcaaataatgacataacctag

SEQ ID NO: 44494 - DNA, 936 bp, Artificial Sequence
  Description of Artificial Sequence: Synthetic coding sequence
atgggcaccggcaacgacaccaccgtggtggagttcaccctgctgggcctgtccgaagataccacggtgtgcgccatactctttctcgtcttcctgggaatctacgttgtgacattgatgggtaacatctccataatcgttctcatccgccggagccaccatctccatactccgatgtacatattcctgtgccacctggccttcgtcgatattggttacagttcttccgtgacaccagtcatgctaatgagctttctccgaaaggagactagccttccagtcgccgggtgcgtcgcacagttgtgcagcgtggtgacctttgggaccgctgaatgtttcttactggcggccatggcttacgaccgctacgtcgccatttgttcgccattgctgtacagcacttgcatgtcaccaggcgtttgtatcatcttggtagggatgtcttacttaggcgggtgcgtcaacgcctggacttttataggttgcttgctcaggttatccttctgtggaccaaataaagttaaccattttttttgcgattacagcccgctgcttaaactggcctgttctcacgatttcacattcgaaatcatcccagctatctcctcaggctccattattgtggcgacggtatgcgtgatcgccatcagttacatctatatactgattaccatccttaagatgcattccaccaaaggaagacacaaggcatttagtacctgcaccagtcatcttactgccgtcaccctattctacggtacaatcactttcatttacgtgatgcccaagagctcatattccacagatcaaaataaggtcgtgtccgtgttttatacagtggtgattcctatgctgaatccactcatttactccctgaggaacaaggaaattaagggagctcttaagagagaactccgcataaagattttcagctag

SEQ ID NO: 44495 - DNA, 975 bp, Artificial Sequence
  Description of Artificial Sequence: Synthetic coding sequence
atggccgaggtgaacatcatctacgtgaccgtgttcatcctgaagggaataacaaaccggccggagctccaagccccctgctttggtgtcttcctcgttatctacctggtcacagtattaggcaatctcggactaattacattaatcaaaatcgatacgcggttacacaccccaatgtattattttcttagccacttggctttcgtcgacctgtgctacagctctgccatcacacctaaaatgatggtcaactttgttgtcgaaagaaatacaatccctttccatgcttgcgccactcaactgggatgctttctaacctttatgatcactgaatgctttctcctggccagtatggcctacgattgctacgtcgccatatgcagtcctctgcattatagtacactgatgtccagacgggtatgcattcagcttgtggcagtcccatacatctacagctttctggtggccttgtttcataccgtgatcaccttccgtcttacatactgcggccctaacctcattaaccatttctactgtgacgatctgccatttctggctctctcatgcagtgatacacatatgaaagaaattttaattttcgcctttgcgggctttgacatgatctcttcttcttccatagttctgacaagctatatttttatcattgccgctattctgagaatcagatcgacacaaggtcagcacaaagccattagcacatgcggatctcacatggttacggtaaccattttctacggtactctgatttttatgtacctccagccaaagtccaatcactccctggataccgacaagatggcgagcgtgttctatactgtggtgatccctatgttaaaccctctgatctatagtctcagaaataaggaggtcaaagacgccagcaaaaaagccctcgacaaggggtgcgaaaatttacagattctgacctttctgaagataagaaaactgtattag

SEQ ID NO: 44496 - DNA, 981 bp, Artificial Sequence
  Description of Artificial Sequence: Synthetic coding sequence
atgagcggcctgcccagcgacatggacctgtacaagctgcagctgaacaactttactgaagttactatgtttatccttatctcctttactgaggaattcgacgttcaggtcttcctcttcctgttgttcttagccatttacctgtttaccctgatcggaaatctgggacttgtcgtgccaataatcggagatttctggctgcacagcccaatgtactatttcttgggcgtgctgtcgtttcttgacgtgtgttattctacggttgtgactccgaagatgttggtcaactttctagctaagaataagtccatttcattccttggatgcgcgacccagatgtttttagcatgtacgttcggcaccactgaatgctttctcttggctgccatggcatacgacagatacgtcgccatctataatcctctgctgtactctgtcagtatgtcccctagggtgtatgtaccgctcatcaccgcttcctatgtagcctccatcctgcatgcaaccatacacaccgtggctactttctcactatcattttgtgggtccaacgaaattcggcacgttttctgcaatatgccaccactgctagccatttcatgcagcgacacccatgtgattcaactgctgttcttctacttcgtgggatccattgaaattgttacaatcttgatcgttctgatctcctacgggtttatcctgctggccattctaaagatgcagtccgctgaaggacgccgaaaggtattttcaacctgtggggcccacctgaccggggtgaccatataccacggtaccatacttttcatgtacgtccgcccaagtagctcctatactagtgacaacgacatgatcgtctcgatcttctacactatcgtgatcccaatgttgaatcctatcatctatagcctgcggaacaaggatgtcaaggaggccatcaagagattattagtgagaaattggttcatcaacaaactctag

SEQ ID NO: 44497 - DNA, 1080 bp, Artificial Sequence
  Description of Artificial Sequence: Synthetic coding sequence
atgagctacagcatctacaagagcaccgtgaacatccccctgagccacggcgttgttcatagcttctgtcacaatatgaattgcaactttatgcatatattcaaattcgtcctggatttcaatatgaagaatgttacagaagttactctctttgtgctgaaaggctttaccgataacctggagcttcaaacaattttcttcttcctgttcctggccatctatctctttacactgatgggcaaccttgggctcatcctggtggttattcgtgattcacagctccataaaccgatgtattactttctttcaatgctgtcatcagtggatgcatgctactcttccgttataactccaaacatgttagtagactttaccactaagaataaggtaatctcttttttaggatgtgtagcccaagtgtttctggcatgcagctttgggaccacagaatgcttcctgctggcagccatggcttacgatcgttacgttgcaatttataaccctctgctgtactcagtttctatgagccccagggtctatatgcccctgataaacgcctcctacgtggccggcattctccacgcaaccattcacacagttgcgacattcagcctttccttctgtggcgcaaacgagattcggagggtgttttgcgatattccgccattgttggccatcagttattcagatacccatactaaccagcttcttctgttttattttgtggggtctattgaactggtcaccattctcattgtactgatatcctacgggttaattctgttggctatcttgaaaatgtactccgcagagggtagaagaaaggtgttttcaacatgcggcgcccacctgactggtgtgtcaatctactacggaacgattcttttcatgtatgtgagaccgtcttcctcatacgccagtgatcatgacatgatagtatccatcttctacactatagtgatcccactcctgaaccctgtgatatactcactgagaaacaaggacgttaaggacagtatgaaaaaaatgtttgggaagaatcaagtcatcaacaaggtgtacttccacacgaaaaaatag

SEQ ID NO: 44498 - DNA, 1023 bp, Artificial Sequence
  Description of Artificial Sequence: Synthetic coding sequence
atggacagcaccttcaccggctacaacctgtacaacctgcaggtgaagaccgaaatggacaaactaagctcaggcctggacatctatcgaaaccccttgaaaaacaagactgaggtaaccatgtttatactcacaggctttacagatgacttcgagctgcaggtgttcctgttcctgctgttttttgcgatatacttatttactctgatcgggaatctgggtctggttgtcctggtaatcgaggattcatggctccacaacccgatgtactattttctgtcggtccttagcttcctcgacgcctgctattccaccgtggtgacacccaagatgctggtgaacttcctggccaagaacaaatccatctccttcatcgggtgtgcaacacagatgctcttgttcgtgaccttcggcactactgagtgtttcctgttggctgcaatggcgtatgaccactacgttgccatttataaccctttactgtactccgtgtccatgagcccaagggtttatgtcccactgattacggccagctacgttgccggcattctgcatgctactattcacattgtcgccacattcagtctttctttttgtggctccaacgaaatccggcacgtcttttgcgacatgcctcctctgctagcaatctcctgcagcgatacacataccaaccagttgctgttgttttactttgtggggtctatcgaaatcgttacgattcttatcgtgttgatctcctgcgattttattctcctgtccatattgaagatgcacagcgccaaaggccgccagaaagccttcagcacatgcggatcacatctgaccggggtgaccatctatcacggtacaattctcgtcagctacatgaggcctagtagttcttacgcctctgaccacgatattatagtctccattttctacactatagtgatcccaaagctcaaccccatcatttacagtctgagaaataaggaggtaaagaaagcagtcaaaaagatgcttaaactggtatataagtag

SEQ ID NO: 44499 - DNA, 966 bp, Artificial Sequence
  Description of Artificial Sequence: Synthetic coding sequence
atggagcggaagaaccagaccgccatcaccgagttcatcatcctgggattctccaatctgaacgagctgcagttcctgctgttcacaatctttttcttgacctacttctgcacactcggcggaaatatactaatcattctgaccacagtgaccgacccacatctgcacactccgatgtactactttctcggcaacctcgcattcatcgacatctgctataccaccagcaatgtcccccaaatgatggtgcatctgctgtccaaaaagaaaagcatcagttatgttgggtgcgtggtccagttgtttgccttcgtgtttttcgtgggatctgagtgcctcctactggccgctatggcctatgataggtatatcgccatctgcaaccctctacggtactctgtgattctatcgaaagttttgtgcaaccaactggccgcctcttgctgggccgcaggcttcctcaacagtgttgtgcacacagtgctgactttttgtctccctttctgcggtaataatcagatcaattatttcttctgtgatataccaccgctgttgatcctgtcttgcggtaatacctccgtgaacgaacttgcactcctgtccactggtgtgtttatcggatggacccctttcctttgcatcgtgttgtcttacatatgtattatttccacaatcctcagaatccagagcagtgaggggcgaagaaaagcattcagtacctgcgcctcccatctggccatcgtttttttgttctacggttctgctatttttacatacgtaagacccatttctacatactcactgaaaaaagatcggctggtatctgtgctttacagcgttgttacccctatgctaaaccctattatttacactctgcgcaataaggacataaaagaggcggtaaagacaatcggaagcaagtggcagccccccatatcttcactagatagcaagctgacctactag

SEQ ID NO: 44500 - DNA, 966 bp, Artificial Sequence
  Description of Artificial Sequence: Synthetic coding sequence
atggagcggaagaaccagaccgccatcaccgagttcatcatcctgggattctcaaacttgaacgagctgcagtttttgttgttcaccattttttttcttacttacttctgtaccctcgggggaaacatcttaatcattctgacaaccgtgacggaccctcaccttcacactcccatgtactattttctcgggaatctggcgtttatagatatttgctacaccacttctaacgttcctcagatgatggtgcatctcctcagtaagaagaagagtatatcatacgtcggctgcgttgtgcagctctttgcatttgtgttctttgtggggagcgaatgcctgctgttagcagccatggcctatgatcggtatatcgccatttgcaatccactccgctattcagttatcctgtctaaagttctatgtaaccaactggcggcctcctgctgggccgccggctttttaaattcagtcgtgcatacagtgctcacattttgtctgcccttttgtggcaataaccaaattaattacttcttttgtgacattcctcccctcctcattctgtcctgcggaaacacgagtgttaacgagctcgccctcctcagcacgggcgtgttcattgggtggaccccattcctttgcatcgtcctgtcctatatttgtattatcagcaccatcttgcgcatccagagcagcgagggaaggagaaaggcgttcagtacgtgcgcctctcatctagccatcgtgttcttgttttacggaagtgcaatcttcacatacgtgaggcccatttctacatactccctcaagaaggaccggctggtatccgtgctgtatagcgtggtgacacccatgctgaatcccatcatctacactctccggaataaggacattaaagaggcggttaaaacgataggcagcaagtggcagcctcccatatccagcctagactcaaagctaacttattag

SEQ ID NO: 44501 - DNA, 966 bp, Artificial Sequence
  Description of Artificial Sequence: Synthetic coding sequence
atggagcggaagaaccagaccgccatcaccgagttcatcatcctgggcttcagtaaccttaacgaactccagtttctgctttttaccattttttttctgacatacttttgtacattgggaggaaatatcttaattatcctcactacagtgacagacccccacctacataccccaatgtactatttcctggggaacttggcattcatcgatatctgttatacaacttctaatgtgccccagatgatggtgcacctgctgtccaagaaaaaaagtatttcgtatgtgggatgcgtggtgcagctttttgcattcgttttctttgttggctccgaatgcctgctactggccgctatggcatacgacaggtacatcgccatttgtaaccccctacgctattccgtcattctgagtaaggtgttgtgcaaccaactcgccgccagttgttgggctgccggattcctgaattccgtcgttcacaccgtactgacattttgccttcctttttgtgggaacaatcagattaattactttttctgcgacatcccgcccttgctgatcctcagctgtggcaatacatctgtcaacgaactcgcccttctatcaacgggcgtgttcattgggtggactccgttcctttgcatcgtactgagttatatttgtatcatttctactatactgaggattcagagcagcgaaggaaggcgtaaagcattttcaacatgcgctagtcatctcgctatcgtgttcttgttttatggtagcgccatattcacatacgtgcggccgatctctacctacagcctcaagaaagatcgcctggtgagtgttctgtactcagttgtgactccgatgctcaacccaattatctatacgcttaggaacaaagacatcaaggaagcagtgaagactataggctccaaatggcagccaccaatcagttccctcgactccaaactcacttattag

SEQ ID NO: 44502 - DNA, 966 bp, Artificial Sequence
  Description of Artificial Sequence: Synthetic coding sequence
atggagcggaagaaccagaccgccatcaccgagttcatcatcctgggattttccaacctcaacgagctgcagtttctgttgtttactatttttttcctgacttacttctgtaccttaggcggcaatatcttgatcattctgacgaccgtgaccgacccacacctgcacactcctatgtactacttcctgggcaatctagcttttatagatatttgttatactactagtaacgtccctcagatgatggtgcatctgctgtccaagaaaaaaagtatctcctatgtggggtgtgtcgtgcagttattcgcctttgtattttttgtgggatccgagtgcctccttctcgcagccatggcatatgacaggtatatcgcaatctgcaaccctctcaggtatagtgtaatcttgtcgaaagtgttgtgcaatcagttggctgcgagctgttgggccgcaggctttctcaacagcgtcgtccacaccgttcttactttctgtctcccattttgcggcaacaaccagataaattacttcttctgtgatatacctcctttgctgatcctgtcctgcggaaacacatctgtaaatgaacttgctttactgtcaactggagtgtttattgggtggactcctttcctatgcattgtcctgtcctacatatgcatcatcagcaccatactcagaatccagagtagtgagggtcgccggaaggccttctctacatgcgcctctcaccttgcgattgtcttcctgttttatgggtccgcgattttcacgtacgttcggcctatcagcacatacagtttgaaaaaggacaggttagtttcagtcctttattcagtggttacccccatgctgaaccccataatctacaccttacggaacaaagacataaaagaagcggtcaaaacaattgggagcaaatggcagccgcctattagcagcctggactccaagctcacctattag

SEQ ID NO: 44503 - DNA, 966 bp, Artificial Sequence
  Description of Artificial Sequence: Synthetic coding sequence
atggagcggaagaaccagaccgccatcaccgagttcatcatcctggggttttcaaatctgaatgaactgcaatttctgttgtttaccatctttttcttaacatacttttgtaccctggggggcaatattcttataattcttactacagtcactgacccacacttgcatacaccgatgtattacttcctaggtaacctggctttcattgatatttgctacaccacctccaatgtacctcagatgatggtgcatctcctatccaagaaaaagtccatctcctatgttgggtgcgtggtgcagttgttcgcttttgtgtttttcgtgggttccgaatgcttgctgctggccgccatggcctatgacagatacattgcaatctgcaatccactgcgttactccgtgattttaagtaaggtcctgtgcaaccagctcgccgcatcttgttgggcagcaggatttctcaatagcgtcgtgcatacagtcttgaccttttgtctccctttctgtgggaacaatcaaattaattattttttctgtgacattcctcccctcctcattttaagttgtgggaatactagcgtgaacgaactggcactgctgagtaccggcgtgtttattggctggacccccttcttatgcattgtgcttagctacatatgcattatatccaccatcctgaggatacaatctagtgagggacgccgaaaagcatttagcacatgcgcaagccatctcgccattgtatttctgttctatggtagcgccatattcacctacgtgcgaccaatttccacttactccctgaaaaaagaccgcctagtctctgtattgtactcggtggtcacccctatgttgaatccaatcatttacactctgcggaacaaggacattaaagaggcagtgaagaccatcgggagcaagtggcagcctccgatttcttcactcgacagtaagctgacgtactag

SEQ ID NO: 44504 - DNA, 966 bp, Artificial Sequence
  Description of Artificial Sequence: Synthetic coding sequence
atggagcggaagaaccagaccgccatcaccgagttcatcatcctggggttctcgaacctgaacgaactccaattcctgctgtttaccatcttttttcttacctatttctgcaccctgggcgggaatattctgattatactgacaactgtgaccgatccgcatctgcacacacccatgtactattttctggggaacctagcctttattgatatctgttacaccacctccaatgtacctcagatgatggtgcacctgttgagcaaaaagaaaagcatctcttacgtggggtgtgtagtacagctcttcgcctttgtcttctttgtgggctccgaatgtttgcttctcgctgccatggcctatgataggtacatcgcgatctgtaaccccctgagatatagcgtgatcctgtcgaaggtcctgtgtaatcagctggccgcaagctgttgggccgctgggtttcttaacagtgtggtgcacacagtgcttaccttttgtttgcctttttgcggtaataaccagattaattattttttttgcgatattccccccctactgattctgagttgtggcaatacatccgtcaatgaattggctctgctttctacgggcgtcttcatcggatggacaccttttctttgcatcgtgttatcatacatctgcatcatatctactatcctgcgaattcagtccagcgagggcaggcggaaagcattcagcacttgcgctagtcatcttgccatcgtatttttgttttacggtagtgctatttttacatatgtccgaccaatcagcacatactccctgaaaaaggaccgccttgtgagcgtactttattcagtggttacgcccatgttaaaccctattatctacacattgaggaataaagacatcaaagaggccgtgaagactattggctccaagtggcagccccccatctcaagcctagattcaaagcttacttactag

SEQ ID NO: 44505 - DNA, 966 bp, Artificial Sequence
  Description of Artificial Sequence: Synthetic coding sequence
atggagcggaagaaccagaccgccatcaccgagttcatcatcctggggttttccaatctgaatgagctccagttccttctgttcacaattttcttcctgacctatttttgcaccttgggcggcaacatcttaatcattctgacaaccgttacagatcctcatctgcatacgcccatgtactacttcttaggaaacctcgcttttattgatatttgctacaccaccagtaacgtgccacagatgatggtccacctcttatccaagaagaaatctatatcctatgtggggtgtgtcgttcagcttttcgccttcgtctttttcgttggttccgagtgcttgttgttggctgctatggcatacgatagatatattgcgatctgcaatcctctgcggtatagcgtgatcctgagtaaggtgttatgcaatcagcttgcggcaagttgttgggctgccgggtttcttaacagcgtagtgcataccgttcttacattttgtctgcctttttgcggaaacaaccagattaattacttcttctgtgatatcccgccattgttaatactgtcatgcggcaatactagcgtaaacgaactcgccttactgtctaccggggtgtttattggatggaccccattcctgtgcattgtgctgtcttacatctgtatcatttctactattctccggatacagtctagtgaaggaaggagaaaggccttctctacatgtgcttcacacctggcaatcgtgttcctcttctacggatcagccatctttacctacgtccgcccaattagcacctatagcttaaaaaaggacagactggtgtccgtgctgtattcagttgtgactccaatgctgaaccccattatctacaccctgcgcaataaagatatcaaggaagcagttaagacaatcgggagcaaatggcagccccccatcagttcactggattccaaattgacatattag

SEQ ID NO: 44506 - DNA, 966 bp, Artificial Sequence
  Description of Artificial Sequence: Synthetic coding sequence
atggagcggaagaaccagaccgccatcaccgagttcatcatcctgggcttcagtaacctaaacgagctccagtttctgctgttcacaatctttttcctcacatacttttgcaccctgggaggtaacatcctaataattttaactaccgtaaccgatccccacttacatacacccatgtactactttctggggaacctggcattcatagacatatgctacaccacttcaaatgtgccccagatgatggtgcacctgctgtcaaaaaagaagtccatctcttatgtcggctgcgtcgtacagttattcgcgtttgtctttttcgtaggctccgagtgcttgctgctggccgcaatggcttacgatcggtatattgcaatctgcaatccactccgatactctgtgattctgtcaaaagtactgtgcaatcagctggcggcatcctgttgggctgcaggattcctcaattcggtagtccatacagtactgactttttgtctgccgttttgtggtaataaccaaatcaactacttcttctgtgacatcccccctctgctgatcttgtcctgtggaaacacatctgtgaatgagcttgcactgcttagcacaggtgttttcattggttggaccccttttctctgcatcgtattgtcttacatctgtatcatcagtacgatcctgcgcatccagtctagcgaaggacgcaggaaagcattctccacctgtgcgagccatctggcgattgtgtttctcttctacggcagcgccatcttcacctatgtaaggcccatcagtacctatagccttaagaaagaccgactggtttcggtgctgtactcggtcgtcacgcctatgctgaatccgattatatacacattgcgtaacaaagatatcaaggaagccgtcaagaccattggtagcaaatggcagcctcccatttccagtcttgatagtaaactgacctactag

SEQ ID NO: 44507 - DNA, 966 bp, Artificial Sequence
  Description of Artificial Sequence: Synthetic coding sequence
atggagcggaagaaccagaccgccatcaccgagttcatcatcctgggcttttcgaaccttaacgagcttcagtttcttttgttcacaattttctttctcacatacttctgcacacttgggggaaatatcctcattatcctgactacggtcaccgaccctcatttgcatacacccatgtattacttcctggggaacctggcttttatcgatatatgctacactacgtccaatgtcccccagatgatggtccatttactctctaagaagaagagcatctcctatgtgggctgcgtggttcagctgttcgctttcgttttttttgtgggctccgaatgcttgctactcgcagccatggcctacgatcggtacatcgctatctgcaatcccttacgctatagcgtgattctctctaaggtactgtgtaaccagttggcggcctcatgctgggccgcgggattccttaatagtgttgtccacacggttctgactttctgcttgccattctgcggcaacaaccagatcaactattttttttgcgacatccctcccctcctgatcctatcttgcgggaacacgtctgtgaatgagttagccctgctttcaacaggtgtgttcattggatggactccctttctttgtattgtgctgtcgtacatctgcataatctcaactatcctcaggattcagagctctgaaggtaggcggaaagcctttagtacctgcgcaagccatctcgcaatagtgtttttgttctacggaagcgcaatatttacttacgtacgccccatttctacctatagccttaagaaggaccgcctggtgtcagtcctctatagtgttgttacgccgatgctgaatcctattatttacaccttgcggaataaggatatcaaagaagcagtcaaaacgatcggatctaaatggcagccccccatttctagtctggatagcaaactgacatattag

SEQ ID NO: 44508 - DNA, 933 bp, Artificial Sequence
  Description of Artificial Sequence: Synthetic coding sequence
atggactgggagaactgcagcagcctgaccgacttcttcctgctgggaataacgaacaaccctgaaatgaaagtgactctatttgccgtgtttctggccgtctacatcatcaactttagcgccaacctcggcatgatcgtactcattcgaatggattaccaactgcacacaccaatgtacttctttctcagccatctgtctttctgtgatctatgctacagcactgcaactggcccaaaaatgttagtagacctattggcaaaaaacaagagtattccattctatggttgtgctctccagttccttgtgttttgcatttttgccgatagcgagtgtttgctgctctccgtgatggcgttcgatcgctataaagcaatcatcaatcctctgctttacacagtcaacatgtcctcgagagtctgttacctgctattaaccggtgtgtacctggtgggaatagctgacgctttaattcacatgactcttgcattcaggctgtgtttctgtggttccaacgaaattaatcactttttctgcgatattccaccactactcttgctctccagatcagacacccaagttaacgaacttgttctgtttacagtttttgggtttatcgaactctccacaatttcaggcgtattcatatcctactgctatattattttgagcgttctcgaaattcacagcgcagaggggagatttaaggccctgtctacttgcacgtctcatctgtcggccgtggccattttccagggtacgctgctgttcatgtactttaggccttcttcttcttatagtttagatcaggataagatgacaagtcttttctatacactcgtggtcccaatgctaaacccccttatttacagcctgcggaacaaggacgtgaaggaggcgctcaagaagctcaaaaacaaaatcctcttttag

SEQ ID NO: 44509 - DNA, 942 bp, Artificial Sequence
  Description of Artificial Sequence: Synthetic coding sequence
atgagcatcatcaacaccagctacgtggagatcaccaccttcttcctcgtgggtatgcccgggttagagtacgctcacatttggatatcaattccaatctgctctatgtacctcattgctatccttggtaacggtacaatcttgttcattatcaagactgagccatccctgcatggccccatgtactattttctatcgatgttggcaatgagtgacctgggcctctcgcttagcagcctccctaccgttttaagcatcttcctgtttaatgcaccagagacctcctcttctgcctgctttgcgcaggagttttttatacacgggtttagtgttttggaaagctcagtgctgctcattatgtcgttcgatagatttctcgctattcataaccctctgcgatatactagcatattaactaccgtgcgggtcgctcaaatcggaatcgtgttttcgttcaaatcaatgcttttggtcctacccttcccttttactctccgcagtcttaggtattgcaagaagaatcaactgtctcatagctactgtcttcaccaggatgtgatgaaactggcctgtagcgacaaccgcatcgacgtcatctacgggttcttcggcgcgctctgtctgatggtcgatttcatcctcatcgctgtaagttatacactaatcctaaagactgtgccgggcattgccagtaaaaaggaagagctcaaggcattgaacacgtgcgtgagccacatctgcgctgtgattatcttttacctcccgatcattaacctggccgtggtacatcgcttcgccgggcatgtctctccattgatcaacgtgctgatggccaatgtcttgttactcgtgccacccctgatgaaacctattgtgtactgtgtgaaaacgaagcagatccgcgtgagggtcgtggcaaagctctgtcagtggaagatctag

SEQ ID NO: 44510 - DNA, 942 bp, Artificial Sequence
  Description of Artificial Sequence: Synthetic coding sequence
atgagcatcatcaacaccagctacgtggagatcaccaccttcttcttggtcggtatgccagggttggaatatgcccacatctggatctccataccaatttgcagcatgtacctcattgcaatcctgggaaatgggaccattctgtttatcatcaagacagagccttccctgcacgaacccatgtactactttctgtcaatgctagcaatgtccgacctgggcctgagcctcagctccctccccacagttctcagcatattcctgtttaacgccccagaaatcagtagcaacgcctgcttcgcacaggagtttttcattcatgggtttagtgtgctggaatcatccgtgctgcttatcatgtccttcgatcggttccttgcaatccacaaccccctcagatatacctctatcctcaccacagtgcgcgtggcacagattggaattgtgttctcatttaagagcatgctgttggtcctaccctttccatttacactaagaaacctgcgctattgtaaaaagaaccagttaagccactcttactgtttgcaccaggacgtgatgaagctcgcctgcagcgacaatcggattgacgtcatttatggcttttttggcgctctgtgcctgatggtcgattttatcctgatagcagtctcctatacactaattctaaagactgtgctcggtatcgcatccaagaaggaacagctgaaggcactgaacacttgcgtgtcccacatctgtgcagtgatcatcttctatcttccaatcattaacctagctgtcgtccatcgcttcgctcgacatgtctccccgctgatcaacgtgctcatggctaacgtcctcctgcttgtgccccctctgacgaacccaatcgtttactgcgtaaaaacaaagcagatccgtgtacgcgtggtcgcgaagctctgccaaagaaagatctag

SEQ ID NO: 44511 - DNA, 939 bp, Artificial Sequence
  Description of Artificial Sequence: Synthetic coding sequence
atgagcgtgctgaacaacagcgaggtgaagctgttcctgctgatcggaatccccggacttgagcacgcccacatttggttctccatcccaatctgcctgatgtaccttctggcgatcatggggaattgcacgatccttttcatcattaagacagagccgtccctgcacgaacccatgtattattttctcgcaatgcttgctgtcagcgacatgggcctgagtctgtcttccctgcccaccatgctcagagtatttcttttcaacgccatgggcataagtcccaacgcatgcttcgcacaggaatttttcatacacgggtttaccgtgatggaatcaagcgtcttgctgatcatgtctttagatcgcttcctcgccatccataaccccctcaggtactcaagcatcctgacaagcaatagagtggccaaaatggggttgattttagcaattagatctatcttattagtcatccccttcccatttacgctcagacgactaaagtactgtcaaaagaatttgctctctcatagttactgtcttcatcaggatacaatgaaactcgcttgttcagataacaaaacgaatgtgatctatgggttttttatagcactttgcaccatgttggatctagccctgatcgtcctcagctacgtgttgattctaaaaacaatcttgtctatcgcttctctagcagaacgactgaaggcgcttaacacctgcgtcagccacatctgcgccgtactcacgttctacgtccctattattactcttgccgcaatgcatcatttcgccaagcataaatccccccttgttgtgatcctgattgcagatatgttcctgctagtgcccccactgatgaacccaatcgtgtattgtgttaaaacccgacagatatgggaaaaaattctgggaaaactcttaaatgtgtgcggcaggtag

SEQ ID NO: 44512 - DNA, 894 bp, Artificial Sequence
  Description of Artificial Sequence: Synthetic coding sequence
ttcctgctgatcggcatccccggcctggagcacgcccacatctggttttctatccccatctgcctcatgtacttgctcgctatcatgggtaactgcaccatactgttcatcattaaaactgagccaagccttcacgagcctatgtattactttcttgccatgttagcagtgagcgacatgggactgagcctctccagcctcccgaccatgctgcgggtgttcctgtttaatgcgatggggatcagccccaacgcatgcttcgcccaggagttttttattcacggcttcaccgtgatggaaagttccgtgctgttgatcatgagtctggacaggttcctggccatccacaatccattgagatatagcagcatcttaacatccaatagggtggcaaaaatgggattgatcttggcgatccggagtatactgctagtcatcccattcccattcactctgcgccgtctgaaatactgtcagaagaatttactatcccactcctactgcctgcaccaggacaccatgaaactggcttgttccgacaacaaaacgaatgtgatttatggattcttcatagccctgtgcaccatgcttgacctggccctaatagtactctcatacgtactgatcctgaaaaccattctgtcaatagcttccttggcagagcggctgaaggccttaaacacttgcgtgtcacacatttgcgccgttttgacattttacgtgcctatcatcaccctggccgcaatgcatcattttgccaagcacaagtcaccattggtggtaattctaatcgctgacatgttcctcttagtacccccacttatgaatcccatcgtctactgtgttaaaacccggcagatttgggagaaaatcctggggatttattgtcactag

SEQ ID NO: 44513 - DNA, 957 bp, Artificial Sequence
  Description of Artificial Sequence: Synthetic coding sequence
atgagcgtgctgaacaacagcgaggtgaagctgttcctgctgatcggtattccaggtctggagcacgcccacatctggtttagcattcctatctgcctcatgtaccttctagccatcatgggtaactgcactatcctgtttattattaagactgaaccctccctacacgagccaatgtattattttctggcaatgttagcagtgtcggatatgggtctgtccctttctagcttacccacgatgctgcgtgtgtttctgttcaacgccatgggcatttcgcctaacgcatgcttcgcgcaggagtttttcatccacggatttaccgtaatggagtccagcgtgctgctcattatgagccttgatcgattcctggccatacataatcccttacgctactcatccatactgacctctaacagagtggctaagatggggttgattctggccattaggtcaatcctcctcgtaattccatttccatttaccctccggagattgaaatattgtcagaaaaatctgctatctcatagttactgtcttcaccaagatacgatgaaactagcctgctcagataacaagactaacgtgatttatggctttttcatcgctctttgcaccatgctggacctggcactaatcgtcttatcgtatgttctgatcctgaagactattttgagcattgcttctctggccgagagactgaaagcgctgaatacttgcgtatcacatatctgtgccgtacttactttttatgtgcctataatcaccctggccgcgatgcatcactttgccaaacacaagtcaccgctggtagtgattttaattgctgacatgttcttgctggtgccgccactgatgaatcctattgtctattgcgtgaaaactagacagatctgggagaaaatccttgtcacctttcggtttatcaaaactgtgaagaagttttggaagcgctag

SEQ ID NO: 44514 - DNA, 939 bp, Artificial Sequence
  Description of Artificial Sequence: Synthetic coding sequence
atgtggcccaacatcaccgccgcccccttcctgctgaccggcttccccggcctggaggcggctcatcactggatctccatcccgttcttcgcagtgtacgtgtgtattctgctgggtaacgggatgctgctctatttaattaagcatgatcactccctccacgaaccgatgtactacttcctcaccatgttagcaggcaccgacctgatggtgacattgacaactatgcccacagtgatgggcattctctgggtcaatcacagagagatcagctcggtgggttgtttcttacaagcttactttatccattcccttagcgtggttgagagtggctctctcttggctatggcatatgattgtttcatcgcaatccgaaaccccttacgttatgcctctattcttaccaacactagagtcatcgccctcggggtcggagttttccttcggggctttgtgagcatcctacctgtgatcctgcgactgttctctttttcctactgtaagagtcacgtgatcacacgggcattttgcttgcaccaggaaattatgcgcctcgcatgcgccgatatcacgttcaataggctttacccagtcatactcatctctctgacaatttttctggactgtctaattattcttttcagttacatcctgatcctcaacacagtgatcggcatcgcttctggggaggaaagggctaaggcacttaacacatgcatcagccacatttcatgtgtactgattttctacgtcaccgtgatgggactaacatttatctacaggttcggtaaaaatgttcctgaggtggttcacattataatgtcatatatctactttctgttccccccgctgatgaacccagtcatctactctataaagactaaacagatacagtacgggatcattaggctattgtcgaaacatagattctcttcatag

SEQ ID NO: 44515 - DNA, 933 bp, Artificial Sequence
  Description of Artificial Sequence: Synthetic coding sequence
atgtggtacaacaacagcgccggccccttcctgctgaccggcttcctggggagtgaggccgtccattacaggatttctatgtctttctttgtgatatatttttcggttttgttcggaaatgggactttgctcgtgctcatttggaatgatcactccctgcacgagcctatgtattattttctagccatgttggctgatacggacttgggtatgacttttaccaccatgcccacagtcttaggcgtactactgctggatcagagagaaatcgcccatgctgcctgcttcactcagagctttatccactccctagccatagtggagtctggtatactactcgtgctggcctatgactgcttcattgcaattcgtaccccactgcggtataactgcatactgactaacagcagggtcatgaacattggactcggagttctgatgcgtggctttatgtccattttgcccatcatcctcagtctttactgctatccttactgcggcagtagggccctcttgcatacattttgcctccatcaagatgtgattaaactcgcatgtgcagatatcacattcaaccatatttaccctataattcaaaccagtttgaccgtttttttggatgccctcataattatctttagctacatactgatactgaagacggttatggggatcgcgtctggccaggaagaagccaaaagtcttaacacttgcgtgtctcatatatcttgcgtgctggtctttcacattactgtgatgggactcagtttcattcaccgatttgggaaacacgcaccccatgtagtccccattactatgtcctacgtgcacttcttattcccccccttcgttaacccgattatctatagcataaagacaaaacagattcagagatctattatcaggctattctcagggcagtccagggcctag

SEQ ID NO: 44516 - DNA, 939 bp, Artificial Sequence
  Description of Artificial Sequence: Synthetic coding sequence
atgagcagcagcggcagcagccaccccttcctgctgaccggcttccccggcctcgaggaagcccatcattggatctcagtcttttttttgtttatgtatatctctattttgttcggcaatggcactctactccttctgataaaggaagatcataatcttcatgagccgatgtattttttcctggccatgttagctgcgaccgatctcggcctggccctcacaactatgcccacagtcctaggtgtactctggctagatcaccgggaaattggctctgctgcttgtttttcccaggcctatttcattcacagcctgtctttccttgagtccggaatcctgcttgcaatggcgtatgatcggtttatcgcgatctgcaacccgctgaggtacactagcgtgctcactaacactagggtggtaaaaatcggactgggagtgctaatgcgcggctttgtcagcgtggtgccccctatccggccattgtattttttcctgtactgccactctcacgtactcagccacgccttttgccttcaccaggatgtgattaaactggcctgtgcggacactacgtttaaccgcctctatccagcggttctggtggtttttatctttgtcttggactatctaatcatcttcattagttatgtgctgatacttaagaccgtcctttcgattgcttctagagaggagcgagccaaggcccttatcacatgtgtgtcacacatctgctgtgtgttagtattctacgtcactgtgatcggcctgtcgctgatccaccggttcggcaaacaggtcccacacattgttcacctgataatgagctacgcctactttctcttccctccccttatgaatcccattacctattcagtgaaaacgaagcagatccagaatgctatcctgcacctgtttaccacacatagaatcgggacctag

SEQ ID NO: 44517 - DNA, 939 bp, Artificial Sequence
  Description of Artificial Sequence: Synthetic coding sequence
atgggcctgaacaagagcgccagcaccttccagctgaccggcttccccggcatggaaaaggctcatcattggatctttattccgctgctggccgcctacatcagcattctgctgggaaatggaacacttctgtttctaatcagaaatgatcacaacctgcatgaacccatgtattactttctggccatgctcgccgccaccgatctgggcgtcacgctcaccacaatgccgactgttttgggggtgctctggctcgaccatagagaaataggacacggggcctgtttctcccaggcttattttattcacaccctgtccgtcatggaatctggggtactgcttgccatggcatacgactgtttcatcacgattcggtctccgctgagatatacatcaatcctgactaatactcaggttatgaaaatcggtgtgcgtgtcctgacccgggcaggacttagcatcatgcctatcgtggttcgcctgcactggtttccgtattgtcgatcacatgtgcttagccatgccttctgcctgcatcaagacgtgataaaactcgcgtgtgctgatatcacctttaacaggttgtaccctgtggtggtgcttttcgcgatggtgctgctggacttcctgatcatctttttctcgtacatccttattcttaaaactgtgatggggatcgggtctggcggcgagagagccaaagcccttaacacttgcgtaagccatatatgctgtatcttggtcttctacgtaaccgtggtgtgcttaacattcatccacagatttgggaaacatgtcccccacgttgtccacattacaatgtcctacattcacttcctatttccaccttttatgaatccttttatttattcaataaagacaaaacagatccaaagcggcatcttacggcttttcagcctcccccacagtcgtgcatag

SEQ ID NO: 44518 - DNA, 918 bp, Artificial Sequence
  Description of Artificial Sequence: Synthetic coding sequence
gtgagcaccagccagagccacgacttcctgctgaccggcttccccggaatggagaaggcacaccactggatttttatccccctgctggccgcgtacatctctattctcctgggcaacggaaccttgctcttcctaatacgaaatgaccacaacctgcatgagcccatgtattacttcttggcaatgctggctgccactgatctgggtgtgacgctgactactatgccgaccgtcctgggtgtattatggctggaccaccgggagatcggacacggtgcatgtttttctcaggcgtacttcatccatactctcagtgtgatggaatctggcgttttgcttgctatggcatatgattgttttattacgatccgctcccccctgaggtatacctcgatattaacgaatactcaagtcatgaaaataggcgtgcgagttcttacccgagctggtctgagcattatgcccatagtggtaaggctacattggtttccatactgccgcagtcatgtgttgtcacacgccttttgcttgcaccaggatgtgattaaattagcatgcgccgacataactttcaaccggctttatccggtagtagtgttgttcgcaatggtcttactcgattttctaattatctttttttcttacattctaattttgaagacagtgatgggtataggctctggcggggagcgcgctaaggcactgaacacatgtgtgtcccacatttgctgtattctagtgttctacgtgaccgtggtgtgccttacctttatacacagatttggtaagcacgtgccacatgtggtgcacataacgatgtcctacattcacttcttgttcccccccttcatgaaccccttcatttacagtatcaaaacaaagcaaattcagtcagggatcctgagattattctcctag

SEQ ID NO: 44519 - DNA, 939 bp, Artificial Sequence
  Description of Artificial Sequence: Synthetic coding sequence
atgaccaacaacatcaccagcaccagcatcatcttcctgctgaccggggtgcccggtctagaagcgttccacacctggatctctataccattttgtttcctgagtgtgacggccttactaggaaactctctcatcttattcgcgacaattacccagccttcacttcatgaacctatgtattacttcttatcgatgctgagcgcgacagacttgggactgtcaatatctactttagtcacaatgctgtctatcttttggttcaacgttagagagatctcatttaacgcttgtttatcacacatgttcttcattaaattctttaccgtcatggagtctagcgtcctgctggcaatggcttttgacaggttcgtcgccgtgtctaatcccctcagatatgccatgatcctgaccgacagccggatcgcccagatcggtgtggcatctgttattagaggtctgctcatgttgacccctatggtcgcactgctgatccgactgtcttattgtcactcacaggttcttcaccactcctactgttatcaccccgatgttatgaagttgtcttgtactgatacccggatcaactccgcagtgggcctcaccgcaatgttttctacggtgggagtggacctgttactcatcctcctgtcctacgttctaatcattaggacagtactgagcgttgcttctcctgaagaaagaaaggagaccttcagtacttgtgtgtcccacatcgtggcgtttgcaatctactatatacccttgatatcactctccatcgtgcatagatttggtaagcaggccccagcctatgtgcatacaatgatcgcaaacacatacctactgatcagtccattgatgaatcccgtgatatacagcgtcaagactaaacagatacgaagagccgtcatcaaaatcctacattctaaggagacctag

SEQ ID NO: 44520 - DNA, 975 bp, Artificial Sequence
  Description of Artificial Sequence: Synthetic coding sequence
atgcagaagccccagctgctggtgcccatcatcgccaccagcaacggaaacctcgtgcatgctgcctacttcttgctggtgggcatccctggactgggaccaacaatccacttttggttggctttccctctctgctttatgtacgcactggctaccttagggaacctgacaatcgtcctgatcattagggttgagcgacgcctgcacgaaccaatgtacctgtttctggctatgttgtccaccatcgacttggtgcttagcagtatcactatgccaaagatggcatccttgtttttgatggggattcaggaaattgaatttaacatttgcctggctcaaatgttcctgattcacgccctgtccgccgtagagagtgccgtcttactggcaatggcctttgaccggttcgtggccatctgccatcctctgcgacatgcatctgtattgacagggtgtactgtggcgaagatcgggttgtccgcgctgactcggggattcgtgttcttttttcctctacctttcatactcaagtggctgtcttattgtcagactcacactgtgacccactcattctgtttacaccaggatatcatgaagctcagttgtactgatacccgggtgaacgtcgtctacgggcttttcatcatcctgtccgtgatgggggtcgatagcctgttcatcggtttctcatatatcctgatcctgtgggcagtgctggagctgtcttcacgcagagccgcactcaaggcgttcaatacttgtatcagtcacctttgcgctgtgttagtgttctacgtccctttaattgggttgagtgtagtccaccggcttggaggtccaacatcactgctccatgtagtcatggccaatacttacctgctgctcccaccagtggtgaatccactcgtgtatggcgccaagacaaaggaaatctgtagccgcgtgctttgcatgtttagccagggaggcaaatag

SEQ ID NO: 44521 - DNA, 957 bp, Artificial Sequence
  Description of Artificial Sequence: Synthetic coding sequence
atgatggtggaccccaacggcaacgagagcagcgccacctacttcattctgattggtctcccaggactggaagaggcccagttctggttggcattccccctatgctctctgtacctgatagcagtgctggggaacttaaccatcatctatatcgtaaggaccgaacatagccttcatgagccgatgtacatttttctgtgtatgttgtctggaatcgacattctcatctctacctcttcaatgccaaagatgcttgccatcttttggtttaacagtacaacaatccagtttgacgcctgcctcctgcagatgtttgcaatccatagcctgtccggaatggaatctacagtcttactggcaatggcctttgatagatacgtagccatttgtcatccactgaggcacgccaccgtcctgactttaccccgtgtgactaaaatcggtgtggccgcggttgtgcggggcgccgctcttatggctccattgccagtctttataaagcaactccctttttgcaggtctaatattctgtcccactcttactgcctgcaccaggatgtaatgaagttagcatgtgatgatatacgtgtgaacgtagtttacgggctcatcgtgatcatttccgcaatcggattagactcactgctgatctcgtttagttatctgctgattcttaaaactgtcctcggcctgacacgagaggctcaagcgaaagccttcgggacatgcgttagccacgtctgcgctgtgttcattttttacgtgccctttatagggttgtccatggtgcaccgattttcaaaaaggagagacagcccactccccgtgattctggccaatatttacctgctcgtgccccctgtgctcaaccctatcgtgtacggagtcaagactaaagaaatcaggcagagaatcctcaggctctttcatgtggcgactcacgcctctgagccgtag

SEQ ID NO: 44522 - DNA, 963 bp, Artificial Sequence
  Description of Artificial Sequence: Synthetic coding sequence
atgagcagctgcaacttcacccacgccaccttcgtgctgatcggcatccctgggctcgagaaagcccatttctgggtgggctttccacttttgtcaatgtatgttgttgcgatgtttggaaattgtatcgtcgtcttcatagtgcgaaccgaaagatccttgcacgcccccatgtacctattcttatgtatgctcgccgccattgatctggccctctcgacttctactatgccaaaaatactggccctattctggtttgacagccgggagatttcgttcgaggcttgtctcacccaaatgtttttcatccacgccttgtcggcaatagaatctaccattctgcttgcaatggcgtttgaccgatacgttgcgatctgtcatcctcttcgtcacgcagctgtcctgaacaatacagtgactgctcagattggcattgtagccgtggtgcgggggagcctgttcttcttccccctgcccctgctcataaagcgcctcgctttttgccactcaaatgtgctgtcccattcctactgcgtccatcaagacgtgatgaagctagcctatgcagataccctccccaacgtggtatacggattaaccgcaatactcttggtcatgggggtggatgttatgttcattagtctttcttactttctcataatcaggactgtgttgcagctgcctagcaaaagcgagcgagccaaggcttttgggacatgcgtatcccatatcggagttgtgctggcattttacgtccccttgattggactgagtgtggtgcataggttcgggaactctctccaccctatcgtcagagtggtcatgggcgatatctacctcctattgcctccagtgataaaccctatcatctatggcgcaaagactaagcaaatcagaacgagggtcttagccatgtttaagatctcatgcgataaggatctgcaggccgtcggcggcaaatag

SEQ ID NO: 44523 - DNA, 252 bp, Artificial Sequence
  Description of Artificial Sequence: Synthetic coding sequence
atgagcagctgcaacttcacccacgccaccttcgtgctgatcggcatccctggtcttgagaaagcccatttctgggttggctttccactgctgagcatgtacgttgtggccatgtttggcaactgcattgtagtgtttatcgttaggactgaacggtccctgcatgcccccatgtacttgtttctgtgcatgctagcggctatcgacctcgctttaagcacttctaccatgcccaaaatcctcgccctgtag

SEQ ID NO: 44524 - DNA, 1029 bp, Artificial Sequence
  Description of Artificial Sequence: Synthetic coding sequence
atgaccgagaccagcctgagcagccagtgcttccccatgagcgtgttgaacaatactatcgctgaaccccttatctttctcttgatggggatccccggtctgaaggctactcagtattggatctcaattcctttctgcctcctctatgttgtggccgtctctggcaacagcatgatcctcttcgtagtgctctgcgaaagatctctgcacaagcctatgtattatttcctgtcaatgttgtcagcaaccgacctgtcgctctccctgtgcacgctcagcactacactgggagtgttttggtttgaggcccgggagatcaacctgaacgcatgcatcgcacagatgttcttcctgcacggcttcacattcatggagagcggggtgttgctggcaatggcttttgataggttcgtggccatttgctatccattgcgttacactacaatcctgactaatgcacggatagcaaagatcggcatgtctatgctgattcgcaatgtggccgtgatgttgcccgttatgctgttcgtcaaaaggctgtctttttgctcttctatggttctttcccattcctattgttaccacgtcgatttgatccagctttcctgtacagacaacagaatcaacagtattttgggacttttcgctttgctgtcgacaactggttttgactgcccttgcatcctgctgagctacatcctgataatccgatctgttctgtccattgcaagcagtgaggagagaagaaaggcctttaatacctgcaccagtcacatttctgctgtctcgatcttctatcttcccttgatcagcctctctctggtccatcggtacggccacagcgccccaccttttgtgcacattataatggctaacgtctttttactgatcccgcctgtcctcaaccccataatttattccgtaaagataaaacagatccagaaggcaatcatcaaggttctgattcaaaaacactctaaatccaaccatcagttgttcctgatccgggataaggcgatttacgagtag

SEQ ID NO: 44525 - DNA, 966 bp, Artificial Sequence
  Description of Artificial Sequence: Synthetic coding sequence
atgaccatcctgctgaacagcagcctgcagcgggccaccttcttcttgactggtttccagggccttgaaggtcttcacggatggatcagcatccccttttgttttatttatctcacggtcatcttaggcaatcttacaattctgcacgttatatgcacggacgccactttgcacggccccatgtattactttctgggcatgctggcagtgacagacctgggactgtgtctttccactctacccacagtcctgggaattttctggttcgacacacgcgaaatcgggatccccgcctgctttactcagcttttcttcattcacactctcagcagcatggaatcgagcgttctgctgtctatgagtattgatcgatacgtggctgtgtgtaaccctctccatgatagtaccgtgcttaccccggcatgcatcgtgaagatggggctgagcagtgttcttcggtctgcgctgttaatcctgcctctcccgttcctccttaagcgattccagtactgtcacagccacgtgctcgctcacgcctactgtctgcaccttgagatcatgaaattggcatgttcatcaatcattgtgaaccacatctatgggttattcgtcgtcgcatgtacggtgggagttgacagtctcctaatattcctgagctatgcacttatcctcaggacagtccttagtattgctagccaccaagaaagactgagggcactgaacacctgtgtgtcccatatctgtgcagtcctgcttttctacatacctatgataggcttatcactagtccaccggttcggggagcacctcccacgggtggtccatctgtttatgtcctacgtctatctgttggtgccacccctcatgaatcctattatttattcgatcaaaacaaaacagattcgccagagaatcattaagaagtttcagttcattaagtccctcagatgcttctggaaagattag

SEQ ID NO: 44526 - DNA, 945 bp, Artificial Sequence
  Description of Artificial Sequence: Synthetic coding sequence
atgaccctgggcagcctgggcaacagcagcagcagcgtgagcgccacatttctgttgagcggcatccctggtctagaacggatgcatatctggatttccatccctttatgctttatgtacttggtgtctatcccaggtaactgcactatactgtttattatcaagactgagcgatctctacacgagccaatgtacttgtttctgagtatgttggcacttatcgacctgggcctgtcactatgtaccttacccactgtattgggcatcttctgggtcggcgcgcgggaaatcagccacgacgcttgttttgcacagttgttctttattcactgcttcagctttctggaatcgtcagttctgttgtctatggccttcgataggttcgtggcaatctgtcaccctctgcactacgtcagcatcctgactaacactgtgataggacgcatcgggctcgtgagcctgggccggtccgtggcactgatcttcccactgccttttatgctgaaacgcttcccttactgtggttctccagtgctgtcacactcctactgcctgcatcaggaggtgatgaaactcgcctgtgctgacatgaaagccaactctatatacggcatgtttgtgatcgtaagtaccgtgggtatcgattccctgttgattctgttttcttacgccctgattctgaggacggtgctgagcattgcttcacgcgccgagagattcaaggccttgaatacctgcgtgtcccacatttgcgctgtgctgttattctacacaccaatgataggcttgtccgtcatccaccgctttggaaagcaggcacctcacctagtccaggtcgttatgggatttatgtatctgctttttcccccagtcatgaatcctatcgtgtacagtgttaaaaccaagcagataagagatcgggtgacccacgccttttgctattag

SEQ ID NO: 44527 - DNA, 909 bp, Artificial Sequence
  Description of Artificial Sequence: Synthetic coding sequence
atgaccaacctgaacgccagccaggccaaccaccggaacttcatcttaaccggaataccaggcacgcctgacaagaacccatggctagccttccccctcgggtttctttacaccttgacgcttctcggcaacgggactatactagccgtgataaaggtagagccttccctgcacgaacccacatattactttctgagcatactggccctgacagacgtgagcttgtccatgagtactttaccctccatgctttcaatctattggttcaacgcaccacagatcgtgttcgacgcttgcattatgcagatgttctttattcacgtcttcggcatagtggagagcggcgtgctggtttctatggcattcgaccgttttgttgctattcggaatccgttgcactatgtatctattctgacgcacgatgtaattcgtaaaactggaatcgctgttctaacacgcgccgtttgtgtagtgtttccggtgcccttcctgatcaaatgcctccctttctgccacagtaacgttctttcccactcttactgcttgcaccagaatatgatgaggctggcttgcgcttcaacccgaatcaactctctgtatgggctaattgtggtcatttttacgttgggtctggacgtactgttaacattacttagctatgtgctgaccctcaagactgttctcggaattgtgtcacggggggagagattaaagaccctaagtacatgcctgtcacacatgagtacagttcttttgttctacgtccccttcatgggcgccgcaagcatgatacacaggttttgggaacacctatcgccagtggtgcacatggttatggccgacatctacctgcttctcccacccgtgttaaatccgatagtgtactcagttaagacgaagcagatttag

SEQ ID NO: 44528 - DNA, 894 bp, Artificial Sequence
  Description of Artificial Sequence: Synthetic coding sequence
ctgaccggcatccccggcatccagaccggcctgacctgggtggccctcattttttgcattttgtacatgatatccatagtcggaaatctgagcatcctcactttggtcttctgggagcctgccttgcaccagcctatgtactatttcctgtctatgctggctctcaacgatttgggcgtgtccttttctaccttacccacagtcatttctactttctgcttcaactataatcacgttgcatttaacgcctgcctggtgcagatgttcttcattcatactttttccttcatggagtcagggatcctcttggcaatgtccctggatagattcgtcgcgatctgctatcccttaaggtacgtcacggtgcttacccataataggatactggctatgggcctcggcatcctgactaaatcatttaccacattgttccccttcccctttgtcgtaaaaagacttcccttctgcaaaggaaacgtactgcatcactcctactgtctgcacccggaccttatgaagttgccttgtgccgacaccaaactcaacagtatactaggtctggcaattgtgctcgcaaacttcgggctagattcccttctgatagtggtttcctatgttctgattctatatactgtgatggggattgccagcggggagggacgctggaaagccctgaatacatgtgtttcccacatctgtgctgtcctgatctattatgtcccgatgatcggagtgtctgtgatgcaccgggctgcgaagcatgctagccccatcgtccatacactcatgtcaagcatctgcctgctggtacctcccgtgttgaaccccatcatatattccgtcaaaactcaaactataaggcaggggattctaacgctgttcagttgcaaatag

SEQ ID NO: 44529 - DNA, 936 bp, Artificial Sequence
  Description of Artificial Sequence: Synthetic coding sequence
ggcctgcggcacagcacccaccccgccaccctgcagctgaccggcatccccgggattcagactgggctgacctgggtggctctaatcttctgcatcctctacatgatttccattgttgggaacctgtctattctcacactggtgttctgggagcccgccttacaccagcctatgtactacttcctcagtatgctagcactgaatgacttaggagtcagcttcagtactctgccaactgtaatttctacattctgcttcaattacaaccacgtagcattcaatgcgtgcctcgtgcagatgttcttcatccataccttctcatttatggaatccggcatcctgctagcaatgtcactggatagatttgtggcgatctgctatcctcttcgctacgtgaccgtcttaacacacaacagaattctggccatggggttggggattcttactaagtcctttactacactgtttccttttccattcgtagttaagaggctccctttttgtaagggcaatgtgttgcaccactcttactgtctccacccagatctgatgaaagttgcttgcggggacattcatgtgaataacatttacggattactggttatcatttttacgtatggcatggacagcacatttatcctattatcgtacgccctgatcctgagggccatgctcgtgattatcagtcaggagcagcgcctgaaggccttaaatacgtgcatgagtcatatttgtgctgtcctagccttttacgttccgattatagcagtctcgatgatccatagattctggaagagtgctccacctgtggtgcacgttatgatgagtaacgtgtatctgtttgtacccccaatgctgaatcctatcatctacagtgtcaagactaaggagattaggaagggaatcctgaagttctttcacaagtctcaggcctag

SEQ ID NO: 44530 - DNA, 945 bp, Artificial Sequence
  Description of Artificial Sequence: Synthetic coding sequence
atgctgggcctgaacggcacccccttccagcccgccaccctgcagctaacaggaatccctgggattcagacaggactgacatgggtcgcactaatcttctgcattctctacatgattagcatcgtggggaatctgtctatcctgaccctcgtcttttgggagcctgcactgcatcagcctatgtattattttctgagcatgctcgccctgaatgacctgggcgtcagcttctctaccctgccgacagtgattagtactttttgcttcaattataatcatgtcgccttcaacgcatgtctggtccagatgttctttatacatactttctccttcatggagtcaggtatcctcctggccatgtctctggaccggttcgtggccatctgttatcctctgaggtacgtaactgtgcttactcacaacagaattctcgccatgggcctcggaatccttaccaagagctttacaacgctcttcccttttccctttgtggtcaaacgcctgcctttttgcaagggtaatgtactgcaccattcgtactgcctgcatcctgacctcatgaaggtggcttgcggcgatatacatgtgaacaacatatatggtcttctggtaattattttcacctatggcatggatagcacttttatcctattatcgtacgccctgatccttagggctatgctggtgattataagccaggagcaacgcctgaaagcattgaatacttgcatgtcccatatttgcgccgtgctggccttctacgttccgattatcgcagtgagcatgatccatcggttctggaaaagtgctcctcctgtggtgcatgtaatgatgtctaatgtttacctgttcgttcccccaatgctcaatccaatcatttatagtgtgaagactaaagaaatcaggaaagggattctgaaattctttcacaaatcccaggcttag

SEQ ID NO: 44531 - DNA, 939 bp, Artificial Sequence
  Description of Artificial Sequence: Synthetic coding sequence
atgggcctgttcaacgtgacccaccccgccttcttcctgctgaccggaattcctggcttggaatcctcacactcatggctgagcggtcccctgtgtgttatgtatgctgtggctcttggaggtaacaccgtaattcttcaagccgtccgcgttgaacctagccttcacgagcctatgtactattttttgtcgatgctgagctttagcgacgtagctatctctatggcaactctacccaccgtgctccggacattctgtctaaatgcccgaaacattacattcgacgcttgcctaatccagatgttcttaatacacttcttttcaatgatggaatctggaattcttcttgctatgtcgtttgacagatatgtcgccatatgtgacccacttaggtatgcgacagtcctgacaaccgaggtgatcgccgcgatgggactgggagcggccgcccgctcttttataaccctgtttcctcttccattcctgatcaagcgcctccctatctgtcgaagtaacgtgctgtctcacagctattgcctgcaccctgatatgatgagactcgcctgtgctgatatctctataaattccatctacggtctgttcgtccttgtgtcgacgttcgggatggatctattcttcatttttctcagctacgtattaattctaaggtctgtgatggccaccgcctccagggaagaaagactgaaggccttgaatacctgcgtttcacacattctcgccgttctggccttttatgtgcccatgatcggagtgtctaccgtgcatagattcggcaagcatgtcccatgctatatccacgtcctgatgagcaatgtgtacttgttcgtacctccggtcctgaatcccctaatctatagtgcaaaaaccaaggagattaggcgggcaatttttcgcatgtttcaccacatcaagatctag

SEQ ID NO: 44532 - DNA, 951 bp, Artificial Sequence
  Description of Artificial Sequence: Synthetic coding sequence
atgaagatcagcaacaacagcctgggcttcctgcccaccaccttcattctggtgggtattcccggactggaatccgaacacttatggatctcggtacctttctctctcatctacatcatcatattcctggggaatggaattatcctccacgttattaggacggatatagcgcttcatcagcccatgtacctgttcttggctatgctggccctggcagaggtccgggtttccgccagtaccctgcctaccgtcctggggatttttctgttcggaaatacagaaatttccttagaggcctgcctgtttccagacgtgctgcaccctttcttcattcatgacggtgcatcttgtgccgccggacacgtctttgggccgctctattctcacctgcagccaactgaattgcactcgtatccggatacagcgcaaggcttgtggcacaggagttattaccgtacagagaaacactatgcgcatggctcagtggctcatagccttatggcaagcgctctcctatggcctcagtgccccctcaccttcctgctgtccgccccgcagtcatatctgtcctgcggcaatattagcgtgaataacatctatggcatctttatcgtgacctccaccttcggcttagattcattactgattgtgatttcatacggcctaatcctgcacaccgtactaggcatcgccaccggagaaggcagaaaaaaggccctgaacacttgtggttctcacgtgtgcgccgtgctcgcctactacgtgcctatgattgggctcagtatagtgcatagactagggcatcgcgtgtcccctctgctccaagctatgatggctaatgcatacttgttttttccaccagtggtaaaccccatagtgtattctataaagactaaagaaattcatggcgcaatagtccggatgttgctggaaaaaagacgccgggtgtag

SEQ ID NO: 44533 - DNA, 948 bp, Artificial Sequence
  Description of Artificial Sequence: Synthetic coding sequence
atgggcgactggaacaacagcgacgccgtggagcccatcttcatcctgcgcggctttcccggcttggagtacgtgcattcttggctaagcatcctgttctgcctggcctacctggtcgcattcatgggaaatgtaaccattttaagcgtcatttggatcgagagcagcctgcaccaacctatgtattacttcatcagcatcctggctgtcaatgacctaggcatgtcactgagcactcttcccacaatgttggcggtactatggcttgacgcacctgagatacaggccagtgcctgttacgcccagctcttctttatccatacctttaccttcctggagtcttccgtgttactcgcaatggccttcgatcggtttgtggccatctgccaccctcttcactacccaaccatcttgactaattcagtgatcggaaaaatcggattagcctgtctgctgagatccctaggggtggtgctgccaacgcctttgctgctgaggcactatcactactgtcacggaaatgcactgtctcacgccttttgtttacaccaggacgtgctgcgactgtcctgtactgacgcaagaacaaacagcatttacgggctgtgcgtcgtaatcgcaaccctgggtgtggattcaatttttattttactgagttacgtactgattctgaataccgtgctggatattgcctctagagaggaacagctgaaggcgttgaacacatgtgtctcgcacatctgcgttgtgctaatattcttcgtgccagtgattggcgtttcaatggtgcaccggttcggaaaacatttgagcccaatagtgcatatcctgatggccgatatttatctgttgttacctcctgtccttaatccgatcgtatactcagttcggaccaagcagattcgcctgggtattcttcacaagttcgtactgcgtaggcgtttttag

SEQ ID NO: 44534 - DNA, 954 bp, Artificial Sequence
  Description of Artificial Sequence: Synthetic coding sequence
atgagccaggtgaccaacaccacccaggagggcatctacttcatcctgaccgatattcctggatttgaagcgagtcacatctggatcagtatcccagtctgttgtctgtacacaatctctattatgggcaatacaacaattttgacggtcatcaggactgagccgtctgtccaccagcgaatgtacctttttctttcaatgcttgcactgacggacctcggtctcaccctaactacactgccaaccgttatgcagctgctgtggttcaacgtgaggagaatttctagcgaagcctgcttcgcacaatttttctttctccatggcttctcttttatggagagcagtgtcctgctcgcaatgtcagtggactgctatgtggcaatatgctgtccactccactacgccagcatactcaccaatgaggttattggccgaacaggcctggctattatctgctgttgtgttctggccgtcctgccttctctatttttattgaaacgactgcccttttgtcactcgcatctcctttcgaggagttactgtttgcaccaggacatgatcaggcttgtatgtgctgacatcaggctgaactcatggtatggattcgctctcgcactgctgataatcattgtggaccctctgttgatagttatctcttacacactgatactcaagaatatcttgggaactgctacatgggcagagcgtcttagggccctgaataactgtctgtcccacattcttgcagtgctggtcctttatatcccaatggtgggtgtatctatgacccacagattcgccaaacatgcaagtcctctcgttcacgttatcatggccaatatctatttgttggcccctccagtgatgaaccctattatttatagcgtgaagaacaaacaaattcagtggggcatgttaaattttttgtctctcaaaaacatgcattcccgctag

SEQ ID NO: 44535 - DNA, 972 bp, Artificial Sequence
  Description of Artificial Sequence: Synthetic coding sequence
atgagcaccctgcccacccagatcgcccccaacagcagcaccagcatggctcccacctttttactagtaggcatgcctggtctcagcggagctccttcctggtggacccttccactgattgcagtgtatctgttgagtgccctgggcaacggaacaatcctctggataatcgcactgcagcctgccctccacaggcccatgcacttctttctgttcctcttaagcgtctctgacatcgggctggtgaccgctctgatgccaaccctcctgggtattgctctggcaggggcccatactgtacccgcctctgcctgcctcctgcagatggtgtttatccacgtgtttagcgtgatggagtcatcggtcctgctcgcaatgtctattgatcgtgccctggccatttgtaggccgttacactaccccgcgcttttgacaaacggtgtcattagtaaaatatcccttgccatctccttccgctgtctagggctgcatctaccactcccgtttcttctggcctatatgccatattgtttgccacaggttctcacacactcctactgccttcatccagacgtggctagactggcatgtccagaagcgtggggtgctgcatactccctatttgttgtgctgtccgccatgggactcgacccactccttatcttcttttcctacggcctgatcggcaaggtgcttcagggggtggagtcaagagaggatcggtggaaggccgggcaaacctgcgcagcacacctgtcagcggtgttacttttttacattccaatgatcctgctggccctcatcaaccatcctgaactgcccatcacccagcacactcatactctgctgtcctacgtgcatttcttgctccccccgctcattaacccaatcctatattctgtaaagatgaaggagatcaggaagaggattttgaaccgcctccagccccgcaaagttgggggtgctcagtag

SEQ ID NO: 44536 - DNA, 984 bp, Artificial Sequence
  Description of Artificial Sequence: Synthetic coding sequence
atggccatcttcaacaacaccaccagcagcagcagcaacttcctgttgaccgcctttccgggcctggaatgcgcacacgtctggatttccatcccagtgtgttgcctgtacaccatcgcccttttagggaacagcatgatatttctcgtaattatcactaaacgccggcttcataagccaatgtattactttttatccatgctggcggccgttgacctgtgtctcacaataactacattgccaacagtgctcggtgtactgtggttccatgcaagggagatatcttttaaggcctgttttatccaaatgttcttcgtccatgctttttctctgcttgagagtagcgtgctcgttgcaatggcttttgatagattcgttgccatctgtaacccattaaattatgccaccatcctgacagatagaatggtgctcgtgataggcctggtcatctgcatacggcctgccgtgtttctgctaccgctgctggtcgctatcaacaccgtgagctttcatggcggccatgaactgtcacaccccttttgctatcacccagaagttataaagtatacttatagcaaaccctggatcagtagtttctggggactgttcctccagctgtacttaaacgggacagacgtgctcttcatactctttagctatgtgctgattcttcggaccgtgctcggcatcgtggcccgcaagaagcagcagaaagctctgtcaacatgcgtctgccatatttgcgctgtgaccattttctacgtccctctgatcagcctctctctagcccatcgactgttccatagcactccacgcgttctttgttcaaccctggccaacatttatctgctcctgcctcctgttttaaaccccatcatctactccttaaaaactaagacgattcggcaggccatgtttcaactcctacaaagcaagggttcatggggcttcaacgtgagaggcctgaggggaaggtgggattag

SEQ ID NO: 44537 - DNA, 1065 bp, Artificial Sequence
  Description of Artificial Sequence: Synthetic coding sequence
atgaccaacaagatgtacgccatctacatcaagaacctgaactacttcagcttcctgattgtccagtgcctccagcccaccatggcaatcttcaacaatactacaagctcatcatcaaattttctgctcaccgccttccctgggctggaatgcgcacacgtctggatctcaattcctgtgtgctgcttatacacaattgctctactggggaattctatgatctttctggtgatcattaccaaaaggaggctgcataagcctatgtattacttcctctcaatgctcgcagccgtcgacctctgccttactataactactctgcctacagtgctgggcgttctgtggttccatgccagggagatttcattcaaagcgtgttttatacagatgttttttgtgcatgcatttagccttcttgagtcctcggttctggtggcgatggcctttgacagattcgtggcaatatgcaatcccctcaactacgctacgattttaaccgaccggatggtgctggttatcgggttagttatttgcattaggccggcggtattcctgctgccgctcctggtggcaatcaacactgtttccttccatggaggccacgagttgtcacatccattttgctatcaccccgaggtcatcaagtatacctattcgaagccttggatcagttccttttgggggctctttttgcagctgtaccttaatggtacagatgtgctattcattctgttcagttatgttctcatcctgcggactgttctggggatagtggcccgtaaaaagcagcagaaggccttatcgacctgcgtctgtcatatatgcgccgtgacaatcttctacgtgcccctcatctcactcagtctcgcgcataggttatttcatagtacgcctcgggtgttatgttcgaccttggccaacatctacctcttgctgcccccagtgctcaatcctatcatttacagtctaaagaccaagacgattcgccaggccatgttccagctgctacagtccaaggggtcctggggctttaacgtccgaggccttcgcggcagatgggactag

SEQ ID NO: 44538 - DNA, 966 bp, Artificial Sequence
  Description of Artificial Sequence: Synthetic coding sequence
atgttcctgagcagccggatgatcaccagcgtgagccccagcacctctacgaattcatcattcctgctgactgggtttagcggcatggaacaacagtatccttggctgagtatcccattcagctccatatacgcgatggtcctcctaggcaattgcatggtcttgcacgtgatctggaccgagccatccttgcaccaacccatgttctattttctctccatgttagcgttaacagacctgtgtatgggactcagcaccgtttacaccgtactgggtatcctgtggggcataatccgtgagatctctctggacagttgtatagctcaatcctattttatccacggcttgagcttcatggagtcaagcgtgttgttgactatggcattcgatcggtacatcgcgatttgcaatcctctccggtactcctctatcctgacaaactcgcgtataatcaaaattgggcttaccattattggaaggtctttcttcttcataacacctcccattatttgcctgaagttttttaactactgccacttccacattctgagtcacagcttttgtcttcaccaggatctcctgaggttagcatgctccgacatcagattcaactcctattacgccctgatgctggtcatctgcatactgctcctggacgccattctcatattgtttagttatatcctgattttgaaatcggtgttagccgtggcctcccaggaggaaagacacaagctgtttcaaacttgtattagccacatctgtgctgtgctggtcttttatatcccaattatttcgctgactatggttcataggtttggcaaacatctgtcacctgtcgctcatgtacttatcggaaatatctacattctcttcccaccactgatgaacccgatcatctacagcgtcaagacccaacagatccatacaaggatgttgaggctgttcagcctcaagagatactag

SEQ ID NO: 44539 - DNA, 939 bp, Artificial Sequence
  Description of Artificial Sequence: Synthetic coding sequence
atgagcatcagcaacatcaccgtgtacatgcccagcgtgctgaccttagtcggcatcccaggcttggagtcagtccaatgctggatcggaattcctttttgcgcaatatatttgatcgccatgattgggaattctcttctgctgtctattattaaatcagagcggtctcttcacgagccactgtacatatttctgggcatgttgggggcaactgatatcgcactggcaagttccattatgccgaaaatgttggggatcttttggtttaacgtgccggaaatctacttcgactcttgtttgttgcaaatgtggtttatccatactctccaagggattgaatccggaattctggtcgcaatggccctggacagatatgttgctatatgttacccgctccgacatgcaaacatattcactcaccagctcgtgatccagatcggaactatggtggtgctgcgtgccgccatactggtcgcaccctgtctggttctgatcaagtgccggttccagttttatcacacaactgtgatctcccacagctactgcgaacacatggccatcgtaaagctggcagcagccaatgttcaggtgaacaaaatctacggactgttcgttgccttcaccgtggccgggtttgatctcaccttcattactctttcctacattcagatctttatcaccgtttttagactgccgcaaaaagaggcgcgctttaaggcattcaacacctgcatcgctcatatttgtgtgttcctccagttttatcttctggcttttttttctttttttactcatcggtttggctcccacatctctccctatatccacattttgttcagcagcatctacctgctggttccgccgttcctgaacccacttgtgtacggggccaaaaccacccaaatccgtattcacgttgtgaagatgttctgctcatag

SEQ ID NO: 44540 - DNA, 939 bp, Artificial Sequence
  Description of Artificial Sequence: Synthetic coding sequence
atgagcatcagcaacatcaccgtgtacatgcccagcgtgctgaccttggtgggtattccaggcctcgagagcgtgcaatgttggatcgggattcccttctgtgcaatatacctcatcgcgatgattgggaacagtctgctattaagtataatcaaatccgaacgctcacttcacgaacccctgtatatctttctggggatgctcggagccacggatattgccctggccagcagtatcatgccaaaaatgcttgggatcttctggtttaacgtgccggaaatttattttgatagctgtcttttacagatgtggtttatccacaccctccagggcattgagagtggtatcctcgtagctatggccctggataggtatgtagccatttgttatcctcttagacatgctaacatattcacacatcaactcgttatccagatcggcactatggtggtcctgcgcgcagcaattcttgtggcaccctgtttggtgttgatcaagtgtcggtttcagttctatcatacgacagtgatttctcacagttactgcgagcacatggctatagtgaaactggctgccgccaatgtgcaggtgaataagatatatggcctgttcgtcgccttcaccgtggccggcttcgaccttacattcattaccctgtcctatatccagattttcattacagttttcaggctgccccagaaggaggcgagattcaaggcttttaatacctgtatagcccatatctgcgtgtttctccagttctatttattggctttctttagttttttcacccatcgttttggatcacacatctccccttacatccacattctgttcagctcgatctacctgctggtgccaccatttttgaaccccttagtttatggagcaaagaccacacagatcaggatacatgtggtgaagatgttttgttcgtag

SEQ ID NO: 44541 - DNA, 951 bp, Artificial Sequence
  Description of Artificial Sequence: Synthetic coding sequence
atgcccaccttcaacggcagcgtgttcatgcccagcgccttcatcctcattggtatccccggcctcgaatccgttcaatgctggataggaatccctttctctgccatgtacctcataggcgtcatcgggaatagcctgattctggtgattattaagtacgaaaacagtctccacattcccatgtacatttttctggctatgctagccgccaccgacatagctctcaatacctgtatcctgccgaaaatgcttggcatcttctggtttcatctccctgagataagcttcgacgcctgtctgtttcaaatgtggttgatccactcattccaggccatcgaatctggcattctgctcgctatggccctggatagatatgtggcaatatgtatcccactcaggcacgccaccatctttagccagcagttccttacccatattggcctgggggtgactcttcgcgccgccatcctgatcattccttctctggggctcatcaaatgttgtctgaaacactacaggaccactgtgatcagccactcttattgcgagcacatggctatcgtgaaactggcgaccgaggacattcgtgtcaacaaaatttacggattgttcgtggccttcgcaattttgggttttgatatcattttcattactctctcctatgtccagatcttcatcactgtctttcagctgccccaaaaagaggcccgctttaaggcatttaatacatgcatcgcacatatttgcgtcttcttgcaattctatctgctggcctttttttcattcttcacccatagatttggaagccatatcccgccctacatccatatactgctgtccaatctatacctgctggtgcccccattccttaatcctatagtctatggggtgaagactaaacagattagagaccacatcgtgaaggtgttctttttcaaaaaagtaacttag

SEQ ID NO: 44542 - DNA, 972 bp, Artificial Sequence
  Description of Artificial Sequence: Synthetic coding sequence
atgagccacaccaacgtgaccatcttccaccccgccgtgttcgtgctgccgggtattccaggcttagaagcgtatcacatttggctgtccattccattatgcttgatctatattactgccgtgctggggaacagcattctgatcgtagttattgtcatggagcggaaccttcacgtccccatgtatttcttcctctcgatgcttgccgtgatggatatcctcctgagcactactacagtaccaaaggccctcgcaatcttctggcttcaggcacacaacatcgcgtttgacgcctgtgtcacccaaggcttttttgtccatatgatgtttgtcggcgagtcggccatcttgctcgcaatggcattcgaccgcttcgtcgccatctgcgcccctttgcggtacacaactgtattgacatggccagtagtaggtaggatcgcgctggccgtgatcacacggagtttttgtatcatctttccagtgattttcctgttaaagaggctccctttctgtctcacgaatatagtcccgcatagctactgcgagcacattggtgtggccagactggcctgtgccgacataaccgtcaatatctggtatggatttagtgtcccaatagtgatggtgattttggatgtgattctgatcgccgtgtcatactcgctgatcttacgggcagttttcaggctgccatcccaggatgcccgccacaaagccctctccacctgtggaagtcatctctgtgttatcctgatgttttacgtgcctagcttctttacactgctgacacaccacttcgggcggaacatcccacagcacgttcacatcctgctggctaatctgtacgtggccgtgccacccatgctgaaccccatagtgtacggtgtgaagacgaagcaaatacgagagggcgtggctcaccgcttcttcgatattaaaacctggtgttgtacctctccactgggaagctag

SEQ ID NO: 44543 - DNA, 945 bp, Artificial Sequence
  Description of Artificial Sequence: Synthetic coding sequence
atgcccaccgtgaaccacagcggcaccagccacaccgtgttccacctcttgggcattccaggcttgcaggatcagcacatgtggatttctatcccctttttcatctcctacgtgaccgccctcttgggtaactccctgctcattttcatcattttaacaaaaagatctttgcatgagcccatgtacctgttcctctgcatgctggctggtgccgacattgtcctgtctacttgtaccattccacaagcgcttgcaatattttggttccgagccggtgacatctcactggatcgatgcatcacccagttgttcttcatacattccactttcatctctgaaagtggtatcttactagtcatggctttcgatcactatattgctatttgctacccattgcggtacacaaccatcctcaccaatgcccttattaaaaaaatctgtgtgactgttagtctgagaagctatggaaccatctttcccataatcttccttctgaaacggctgaccttctgtcagaataatatcataccacacacattctgtgagcatattgggctggcgaaatatgcctgtaacgacattaggatcaacatatggtacggtttctcaattctcatgtccaccgtggtccttgacgtggtactgatctttattagttatatgctgattttgcacgctgtttttcacatgccctcccccgatgcttgccacaaagccctaaacacctttggatcacacgtgtgtatcatcatcttattttatggaagcggcatttttaccattttaacccagcgtttcgggagacatattcccccatgtatacatattcccctggccaatgtttgtattctcgcgcctcctatgctgaaccccattatctacggtataaaaaccaaacaaattcaagagcaggttgtgcaattcctcttcattaagcaaaaatag

SEQ ID NO: 44544 - DNA, 1008 bp, Artificial Sequence
  Description of Artificial Sequence: Synthetic coding sequence
atggcccaggtgcgggccctgcacaagatcatggccctgttcagcgcgaatagcataggtgcgatgaacaacagcgacactaggatagcaggttgctttctaactgggatccctgggcttgaacaactgcacatttggctttctatacccttctgcatcatgtatattacagccctggagggtaacggaatcctgatttgcgtaattctgtcccaggctatcctgcacgaaccgatgtacatattcttgtccatgctagcctccgctgacgtactgctttcgaccacaactatgccaaaggcattggccaacttgtggctgggatatagcctgatttcattcgacgggtgtctgacacagatgttcttcattcacttcttgtttatccattccgctgtactgttggctatggccttcgatcggtacgttgccatatgttcacccttgagatacgtgaccatcctgacctccaaggtgatcggtaaaatcgtgaccgccgcgctttctcactccttcattatcatgtttccatccattttcctattggagcatttgcactattgccagattaatatcatcgcccacacgttttgcgaacacatgggtatagctcacttaagctgctcggacatctctatcaacgtgtggtacggccttgcagcagccctgctttccactggcttagacataatgctaatcaccgtctcttacatccatatactccaggcggtgttccgcctcctgagtcaggatgcaagatcaaaagcactctcaacttgcggtagccacatttgcgtgatactcctcttctacgtgcctgccttattttctgtcttcgcttatcgcttcggaggccgctcagtaccctgttatgttcatatacttctggcatcactgtatgtggtgatacccccaatgttgaatcccgttatctacggagtgcgtaccaagccaattcttgaaggagccaagcagatgttttcaaacttggcaaaaggcagcaagtag

SEQ ID NO: 44545 - DNA, 957 bp, Artificial Sequence
  Description of Artificial Sequence: Synthetic coding sequence
atgagcgacagcaacctgagcgacaaccacctgcccgacaccttcttcctcacaggtatacccgggttagaggctgctcatttctggatagccattccgttttgcgccatgtatttagttgcacttgtgggcaacgccgctctgattctggtgattgccatggacaacgcgcttcacgcgccaatgtacctcttcctatgcctccttagtctgacagatttagctctgtcatctacaacagtcccaaagatgttggccatactgtggcttcacgccggtgagatcagttttgggggctgtctggctcaaatgttctgcgtgcatagcatctacgcactagaatccagtatcctgttggctatggctttcgatcgttatgttgccatctgtaaccctctgcggtacaccacgattctgaatcacgccgtgatcggtcggatcggattcgttggcttgtttcgcagcgttgcaattgtgagcccattcattttcctgctgagacgcctgccctattgtggtcacagggtgatgacacatacttactgcgagcacatgggaattgcccgattggcatgcgcaaatatcaccgtgaacatagtttacgggttgaccgtcgcccttctcgcaatgggcctcgattcaattttgatcgctatttcatacgggttcatcctgcacgcggtttttcacttgccctctcacgatgcacagcacaaggcgctaagcacgtgtgggagccatatcggtatcatcctggttttttacattcctgcgtttttttctttcctaactcaccgatttggacaccacgaggtgcccaaacatgtacatatcttcctggcaaacctgtatgtactcgtgccgccagttttgaaccccatcctgtatggggctcgcacaaaggagatccgaagccgcctgcttaaactgctgcacttaggaaaaacctcaatatag

SEQ ID NO: 44546 - DNA, 978 bp, Artificial Sequence
  Description of Artificial Sequence: Synthetic coding sequence
atgttcctgcccaacgacacccagttccaccccagcagcttcctgttgctgggcatccctggattggagactctgcatatctggatcggattcccattttgtgctgtgtacatgattgctttgattggcaacttcactattttgttagtcatcaaaactgatagcagcctccatcagcccatgttctacttcctggcgatgttagcaaccactgatgtcgggttatccacagctaccattcccaaaatgctcggaattttttggatcaacctgcgcggcatcatcttcgaagcctgcctgacccagatgtttttcatccataacttcaccctgatggagtctgctgtgttggtggctatggcctacgacagctacgtggctatctgcaatccacttcagtactctgccatcctgacaaacaaggtggtgtctgtaatcggcctaggcgtgtttgtgagggctcttattttcgtcattccttccattctgctcattttgaggcttcccttctgtgggaaccacgttattccacatacatattgtgaacatatgggacttgctcatttgagttgtgccagcattaagattaatatcatttacggcctgtgcgcaatttgtaaccttgtattcgatattaccgttatagcactttcatacgtgcatatattgtgcgccgtgttccggttgcctacacatgaggcccgcctgaagagcctgtcaacatgtggcagtcacgtttgcgttatcctcgcattttatacgcctgccctattcagctttatgacgcatcgatttggtcggaacgtaccgcggtacatccacatactgctcgcaaacctatacgtggttgttcctcctatgttaaatcctgtgatttatggggtgcgcactaagcagatctacaagtgtgtgaaaaagatccttttgcaggagcaggggatggaaaaagaggagtacctgatccacactaggttctag

SEQ ID NO: 44547 - DNA, 939 bp, Artificial Sequence
  Description of Artificial Sequence: Synthetic coding sequence
atgcccagcatcaacgacacccacttctacccccccttcttcctgttactgggcatacccggcttagatacgctccatatttggattagctttcccttttgtatagtctatttgattgcgattgtgggcaacatgaccatcctgttcgttataaagactgaacatagcttgcaccagcccatgttttacttccttgctatgctgtctatgattgacctcgggctttccactagcacaatccctaaaatgctcggtattttctggttcaacctccaggagatctctttcggtgggtgcctgctgcaaatgttcttcatacacatgttcacaggcatggagaccgtgctgctggttgtgatggcttacgacagatttgtcgctatctgtaatcctctgcaatatactatgattctcaccaacaaaacgatcagcatcctggccagcgtagtggttggccgcaacctggtgctcgtgacccctttcgtgttcctcatcctgcgcctccccttctgcggccataacatcgtaccccatacttattgcgaacatagaggcctcgccggattggcatgtgctcccataaaaattaacatcatatatggtcttatggtgatcagttatattattgtcgatgtcatcttgatcgcctctagctacgtgctgatactgagagctgtctttcggctgccgtcccaggatgtgaggctgaaggcctttaatacatgcgggagtcatgtgtgcgtaatgctgtgcttttatactcccgcctttttctctttcatgacgcaccgtttcggacaaaacatcccccactatattcacatcttgctcgctaacctatatgtggtggtgccccccgccctcaatcccgtgatctatggcgtgcggactaagcagataagggagcaaattgtcaaaatattcgttcagaaagagtag

SEQ ID NO: 44548 - DNA, 942 bp, Artificial Sequence
  Description of Artificial Sequence: Synthetic coding sequence
atgcccatcgccaacgacacccagttccacaccagcagcttcctgctgctggggattccgggacttgaagacgtgcatatatggattggatttcctttctttagcgtgtatctgatagctctgctcggaaacgcggcgatttttttcgtcattcagaccgagcagagtctgcacgagcctatgtattattgcctagccatgcttgactccatcgatctaagtctgtcaacagccacaataccaaagatgttgggtatcttctggttcaacattaaagagatatcattcggcggatacctgtcccagatgttttttatccattttttcacagtcatggaaagtatcgtcctagttgccatggctttcgacagatacattgctatctgcaagcccctttggtatacaatgatcctgaccagcaaaataatctccttaatcgcaggtatcgcggtgttgaggtctctgtacatggtgattcctcttgtgttcctcttgctcagactccccttttgtggtcacaggatcatcccccatacctattgtgaacacatgggtatcgccagacttgcatgtgcttccatcaaggtcaacattatgtttggactcggttcgatatctttacttttgttagacgtgctgctgataatcttatcccatattaggatcctatacgcggtcttctgcctgccttcatgggaagccagattgaaggccttaaatacatgcggatcgcatatcggtgtcatactggcattttctaccccagcctttttttctttctttacgcattgctttggtcacgatattccacagtatattcacatttttctcgctaatctttatgttgtagtcccaccaaccttgaatcctgttatttacggtgtgagaaccaaacatatcagggagaccgtcctgaggattttctttaagacggatcattag

SEQ ID NO: 44549 - DNA, 954 bp, Artificial Sequence
  Description of Artificial Sequence: Synthetic coding sequence
atggagaagcggatgcccatcgccaacgacacccagttccacacctcatcattcttgcttctgggcatcccagggctggaggacgtacatatctggattggttttcccttcttctctgtgtacctgattgctctgttgggaaatgcggccatctttttcgtgatccagacagagcagtccttacatgagcccatgtattactgtcttgccatgctggattcgatcgacctgagcctgtcaaccgcaactatcccgaagatgctagggatattttggtttaacatcaaagagatctcattcggagggtatctgtcgcaaatgttctttatccactttttcaccgtgatggaatctattgtgctcgtggcaatggcatttgatagatacattgctatatgcaagcccctttggtatactatgattctgacaagtaaaattatcagcctcatcgctggcattgctgttttaaggtctctgtatatggttatccctctggtcttcctgcttctgagattgcctttctgcggccacagaattattccccatacctattgcgaacacatgggtatcgctagattagcctgcgcaagcatcaaggtgaatatcatgtttggcctgggcagtatcagcttactactgctcgatgtcttattgattattctctctcatatccggatcctgtacgcggttttctgcctacctagttgggaggccagactaaaagctttgaacacatgcggctcacatataggggtcatattggcgttctcaacgccagcattcttcagtttttttacacactgcttcggacatgatatccctcaatacatccatatatttcttgcaaatctctacgtagtcgtaccccccactctgaatcccgtcatctatggggtgcgtacgaagcacatcagggagacggtcctccgcatatttttcaaaacagatcactag

SEQ ID NO: 44550 - DNA, 954 bp, Artificial Sequence
  Description of Artificial Sequence: Synthetic coding sequence
atggccggccggatgagcaccagcaaccacacccagttccacccctcttccttcctcctgctgggaataccgggccttgaagatgtgcacatttggattggcgtgccttttttctttgtttatttagtggcgctgctaggcaacacggcacttctatttgtcattcagacggaacagtctctgcacgaacccatgtattacttcctggccatgctcgatagtatcgaccttggactgagcaccgctactattcctaagatgctgggaatattttggttcaataccaaggagatctccttcggaggctgtctgtctcatatgttcttcattcacttcttcacagccatggagtctattgtgctggtcgctatggcatttgatagatacatcgctatctgcaaaccactccgctacacaatgatcctgacctcaaagatcatcagcctaattgcagggatcgcagtgctgcgatccttgtacatggttgttccactggtattcctgctcctgagacttccgttctgcggccaccgcattattccccatacatactgcgagcacatgggcatagcaagactcgcttgcgcctccattaaggttaatattcgctttggattgggcaatatcagtttgctactattggatgtgattctaattatcctctcctatgttaggattctgtacgccgtattttgtctccccagctgggaagcccgcctcaaagcccttaacacatgtgggtcgcacataggggtgatccttgcatttttcacccccgcgttcttttcatttctgacccatcggttcggccataacattccccagtacattcacatcatccttgccaacctgtacgttgtggtcccccccgcgctgaacccagtgatctacggcgtccgaaccaaacagatccgggagcgagtactgcgaatctttctgaagactaatcactag

SEQ ID NO: 44551 - DNA, 963 bp, Artificial Sequence
  Description of Artificial Sequence: Synthetic coding sequence
atgcccagcgccagcgccatgatcatcttcaacctgagcagctacaacccgggtccgttcatcctagtgggcattcctggcttggaacaattccacgtgtggattgggataccattttgtattatctatattgtcgcggttgtgggaaactgtatccttctctacctcatcgtggtggaacacagcctgcatgagccaatgttcttcttcctgagcatgcttgcaatgacggacctcattctctcaactgcgggggtacccaaggctttgagtatcttctggcttggcgcccgagagatcacgttcccaggttgtctgactcagatgttcttcctgcactacaattttgtactcgactccgctattctgatggctatggccttcgatcactatgtggccatctgctcacccctgaggtataccactatcttaacgcccaagactatcatcaagagcgccatggggatctcattccgcagcttctgtattattttgcctgacgtgtttctgctgacctgcctccctttctgtcggaccagaataattccccacacctactgcgaacacattggggtcgcacagctcgcctgcgctgacatcagcatcaacttctggtacggtttctgtgttcctataatgacagtgatctccgatgtgatcctgatagcggtgtcttatgctcacattctttgcgcagtgttcggacttccttcgcaggacgcatgtcagaaggctctggggacgtgcggatcccacgtctgcgtgattctgatgttttatacccccgcatttttttctatactagcccatagattcggtcacaacgtgtctcggaccttccacatcatgttcgccaacctgtatatcgtgatccctcccgctctgaatcctatggtgtacggggtgaaaacaaagcagattagggacaaagtgatcttgctgttctcaaagggcactggctag

SEQ ID NO: 44552 - DNA, 1047 bp, Artificial Sequence
  Description of Artificial Sequence: Synthetic coding sequence
acccaggtgcccaaggactgcaccatcctgctgcaccacctgtacatcaatcggcaggaagtgtctcctgtgatgttgggaccggcctataaccacaccatggagactcctgcatccttccttctggttggcatcccagggctccaatctagtcatctttggctcgccattagtttgtcagcgatgtatattaccgctcttctggggaataccctgattgtaaccgctatctggatggacagcacccgccatgaaccgatgtactgttttctgtgtgttctggctgccgtagatatcgtgatggcatcttctgtggtgccaaaaatggtgtccattttctgctccggagactcctccataagcttttctgcatgctttacacagatgtttttcgtccacttggccacggccgtcgagaccggactattgctgaccatggcgttcgatcgctatgttgcaatctgtaaaccacttcactataagaggatcctaaccccacaggtgatgctgggcatgtcaatggctgtgactatacgggccgtaacttttatgacccctttatcctggatgatgaaccatctccccttctgtggcagcaacgtagttgtacattcatactgtaagcacatcgcgcttgctcggctcgcctgtgccgaccctgtgcccagcagcttgtactcccttattggctcttccctgatggtgggatcagatgtggccttcatcgcagcttcatatattctcatcctgagagccgtcttcgatctatcatcaaagactgcccaacttaaggccttgagcacctgtgggtcgcatgtgggggtgatggcgttgtactacctgccaggcatggcctccatttacgccgcatggcttggccaggatatagttcctctgcacactcaagtgcttttagcagacctttatgtaattatcccagctactcttaaccctatcatctatgggatgaggaccaaacagctgttggagggaatctggtcctacctgatgcactttctcttcgatcactctaacctcgggagctag

SEQ ID NO: 44553 - DNA, 975 bp, Artificial Sequence
  Description of Artificial Sequence: Synthetic coding sequence
atgctgggccccgcctacaaccacaccatggagacccccgccagctttcttctggtgggcatccccggcttacagtcaagccacctgtggctggccatttccctgagcgctatgtacattaccgcgttgttagggaacaccctgatcgtgaccgccatctggatggatagcacgcgtcacgagccaatgtattgtttcctgtgtgtgctggcagccgttgacattgtgatggctagcagcgtggtacccaagatggtgtctatcttttgtagcggggattcctctatctcattcagtgcatgttttactcagatgttcttcgttcacttggccaccgctgtcgaaactggcttacttttgactatggctttcgaccgatacgttgccatctgcaaaccacttcattacaagcggatcttaacccctcaggtgatgctgggaatgagcatggcagtaacaattcgtgcagtaacctttatgacgcccttgagctggatgatgaaccatctccctttttgtggcagcaacgttgtggtgcactcctattgcaagcacattgcactggctagactggcctgtgcagatccagtcccatcctccttgtattcactgattggaagctcgctcatggtgggatctgacgtggcttttattgctgcctcctacattctgatcctgcgcgcagtgttcgacctttcatccaagacagctcagctgaaggctctgtctacctgtggcagtcatgtcggcgtgatggctttgtactacctaccgggtatggccagcatctatgctgcctggcttggtcaggatatagtacccctacatacccaggtcctgctcgccgatctttacgttattatcccagccactctgaatccaatcatctacggtatgcggaccaaacaactgctagagggaatttggagttacctgatgcacttcctctttgaccattcaaaccttggtagctag

SEQ ID NO: 44554 - DNA, 1053 bp, Artificial Sequence
  Description of Artificial Sequence: Synthetic coding sequence
atgtgccagcagatcctgcgggactgcatcctgctgatccaccacctctgtatcaatcgcaagaaggtatctctggttatgttgggacccgcgtacaatcacacaatggagacaccggctagtttcctgctcgttggcattccaggactgcagtcgtctcacctgtggctcgcaatatctctgagtgctatgtatatcatcgctctgctcggaaacaccatcatcgtaactgctatctggatggattcaactaggcacgaacccatgtattgttttttgtgtgtgctggccgctgtagacattgttatggcgtcaagcgtggtgccgaagatggtttccatcttttgctctggggactcaagcataagcttttccgcctgtttcacgcagatgttcttcgtgcacctcgccacagctgtggagacgggcctactgctgacaatggcatttgaccggtatgtagctatttgtaagcctctccattacaagcgcatacttacaccgcaggtgatgctggggatgagtatggcaattaccatccgggctattatcgccatcactcctctttcttggatggtgtctcacctgcctttctgtgggtccaacgtagtcgtgcacagctactgcgaacatatcgcactcgccaggctggcttgtgccgatcctgttccaagctctttgtactctctgatcggatcctccctcatggtcgggagcgatgttgcgtttatcgcggcttcttatatcctgatcctgaaggctgtattcggcctttcctcaaagactgctcagcttaaggcattaagcacgtgtgggagccatgtgggagtgatggccttgtactatctgccaggcatggccagcatctacgccgcatggctcggacaagatgtggtgcctctacacacccaggttctgctggccgatctgtacgtgatcatacctgcaacactcaatcccataatctatggcatgcgcactaaacaacttagagagcgcatctggtcatatctaatgcacgtgctgttcgatcattcaaatcttggatcctag

SEQ ID NO: 44555 - DNA, 936 bp, Artificial Sequence
  Description of Artificial Sequence: Synthetic coding sequence
atgttctaccacaacaagagcatcttccaccccgtgaccttcttcctcataggaattccaggactggaagatttccatatgtggatcagcggccccttctgcagcgtgtacctggtggccctcctaggcaacgctacaattctccttgtcataaaggttgaacagaccctcagggaaccgatgttctattttcttgccatcctgtctacgatcgacttggccctcagcaccacttcggtgcctaggatgctggggatcttttggttcgatgcacacgagatcaactatggagcatgcgtggcacagatgttcttgatccatgcctttaccggtatggaagccgaggtgctcctcgccatggctttcgacagatacgtggcagtttgcgcccctcttcactacgccacaattctaacctcccaggttttggttggcatttctatgtgcattgttatccggccggtgctgttaaccctaccaatggtgtatttgatttacagacttccattctgtcaggcacacatcatcgcccattcttattgtgagcatatgggaatagccaagttgtcatgcgggaatatcagaattaacggcatttatggcctgttcgtggtatctttttttgttctgaaccttgtcctgatcggcatttcttatgtgtatattctgagggccgtctttcggctcccgagtcatgatgcacagcttaaggcactgtcaacctgcggcgcccatgttggcgtgatttgcgttttctatattccctctgtcttctcgtttctgacccatcggtttggacaccagataccgggctacattcacatccttgtggccaacctttacttgattatccctccttcccttaaccctataatatatggcgtgcggacaaaacaaattcgcgagagagttttgtatgtgtttaccaaaaaatag

SEQ ID NO: 44556 - DNA, 945 bp, Artificial Sequence
  Description of Artificial Sequence: Synthetic coding sequence
atgctgcccagcaacatcaccagcacccaccccgccgtgttcctgctggtgggcataccaggtttagagcatttacacgcctggatttccatccccttttgctttgcctacacccttgctctgctcgggaactgcacgctgctgttcataattcaggcagatgctgccctccacgagcccatgtatctttttttagctatgctcgccaccatcgacttggttttgtccagtaccaccctccctaagatgctggccatcttctggttccgggaccaggagatcaatttcttcgcctgtctggtgcagatgttttttctccattcttttagcatcatggaatcggcggtgcttctggccatggcgtttgatcgatacgtggctatctgcaaacctttgcactatacaacggtcctaactggatccctgattactaagattgggatggcggctgttgccagagccgtgacactgatgacaccactccccttcttattgcgccggttccattactgtaggggccccgtgatcgctcactgctactgtgagcacatggcagtggtgcggctcgcttgcggcgacaccagcttcaacaatatttacggcatagccgtggcaatgttcatcgtggtgctggatctgctgtttgtgattctgtcatatgttttcatcctacaggcagtgctgcagctggcatcccaggaagctaggtataaggcattcggcacctgcgtgtctcatatcggcgctatcttgagtacatacacacccgtggtcatcagttcagtcatgcacagggtggcccggcatgcagctccccgcgttcacatcctgctggctatattctacctactcttccctcctatggtgaatccgatcatttacggtgttaagactaagcagattagggaatacgttctatctctcttccagagaaagaatatgtag

SEQ ID NO: 44557 - DNA, 945 bp, Artificial Sequence
  Description of Artificial Sequence: Synthetic coding sequence
atgagcgccagcaacatcaccctgacccaccccaccgccttcctgctggtgggcattcccggtctcgagcacctgcatatatggattagtattccattttgtctggcctatacgttagcattactgggcaattgcaccttattgcttatcattcaggccgatgccgctttacatgaacctatgtatctgttcttagcaatgctagcagcaatagatctggtgttgtcgtcttcagcactccccaaaatgctcgccatattctggttcagagaccgggagataaatttcttcgcttgtctggctcagatgttctttctgcattctttctcaattatggaaagcgccgtcttgttggctatggcattcgacagatacgtcgctatctgcaagcctttgcattacacaaaggtgctcaccggctcgctgatcaccaagatcggcatggccgctgtggctcgcgctgtcactttaatgacaccgctcccattccttttgagatgtttccactattgtcgggggccagtgattgcccactgctactgcgagcatatggctgtagtgcggctggcctgtggtgacacctcgttcaataacatttacggaatcgctgtggccatgtttatcgtcgtcctcgatcttctactcgtgattctctcatatatatttatcctgcaggccgtgctgctcctggctagccaggaagcaaggtataaagcatttggtacttgcgtctcccacataggtgccatactggccttctacacgaccgtggtaattagcagtgttatgcacagggtggcccggcacgctgccccccatgtgcacatcttactggcaaatttttaccttctgtttccaccaatggttaaccccatcatttatggagtaaagaccaaacaaatacgggagtctatcctgggcgttttcccacggaaggatatgtag

SEQ ID NO: 44558 - DNA, 990 bp, Artificial Sequence
  Description of Artificial Sequence: Synthetic coding sequence
atgaccctggtgagcttcttcagcttcctgagcaagcccctgatcatgttgctcagcaatagttcctggaggttaagccaacctagcttccttcttgtcggtatccccggactcgaggaaagccaacactggattgccctccccctcggcattttataccttctcgccctggtgggtaatgtcacaattctgtttatcatctggatggatcccagtctccatcaatctatgtatctcttcctatccatgctcgccgccattgatcttgtccttgcaagctcaactgcaccaaaggccctggcagtgctgctagttcacgctcatgaaattggctatatcgtgtgccttatacagatgtttttcattcatgcattttccagcatggaatcaggggtattggtcgccatggccttagattgctacgtagctatctgccatcctctgcaccacagcaccattctgcaccccggggttattggctgtataggcatggtcgtgctcgttagaggcctgctcctgctgattcccttcccaatcctgttgggcaaattaatcttctgccaggccaccatcatcggccacgcctattgcgagcacatggccgtggtgaagttggcatgtagtgaaaccactgtgaatagagcctatggccttaccatggccctcctggtgataggcctggacgtgttagccattggcgtgtcgtacgcgcacattctgcaggcagtgctaaaagtccctggaagtgaagcgaggctaaaagcgttttcaacttgcggttcacacatctgcgtcatcctggttttctacgtcccggggatttttagcttcttaacccatagatttgggcatcacgtgccccaccatgtccatgttttgctggccacttggtacctgctgatgcctccggctttaaaccccctcgtgtatggagtaaagacacagcaaatcaggcagagagtcctacgagtgtttactcagaaggattag

SEQ ID NO: 44559 - DNA, 954 bp, Artificial Sequence
  Description of Artificial Sequence: Synthetic coding sequence
atgctgaccttccacaacgtgtgcagcgtgcccagcagcttctggctgacaggtatcccaggattggagtctctacatgtgtggctgagcattccctttggatctatgtatttggtagccgtcgttggaaatgtaactattttagcagttgtgaaaatcgaacgctccctgcatcagcctatgtattttttcctgtgcatgctggccgctattgacttggtactctctacctctaccattcctaagctgcttggcattttttggttcggtgcatgcgacattggtctggatgcatgcctcggacagatgtttctaattcactgcttcgccacagtagagagcggcattttcctggccatggcatttgatagatacgtggccatctgcaatcctcttcggcacagcatggtgctgacttacactgtcgtaggacgacttgggctggtttccctgctgagaggcgtcctctatattggtccactgcctctgatgatcaggctaagactaccactctataaaacacatgttatatcacactcctattgcgagcacatggccgtggtggccctaacttgcggcgactcccgtgttaataacgtgtacgggctatctatcggatttctggtgctgattttagattccgtagccattgccgctagctatgttatgattttccgggcggtgatgggactcgctacacccgaggcgcggctgaagacacttggcacttgtgcatcacacttatgtgcaatcctgattttctacgtgcctatcgctgtctcctctctgattcatagatttgggcagtgtgtgccacctcccgtccataccctcctagccaacttctatctgttgatccccccaatcctgaacccaattgtctacgcagtgagaactaagcagattagagaatccctgctccagatcccccgcatagagatgaagattcggtag

SEQ ID NO: 44560 - DNA, 963 bp, Artificial Sequence
  Description of Artificial Sequence: Synthetic coding sequence
atgagcttcctgaacggcaccagcctgacccccgccagcttcatcctgaatggcatacccggcctcgaggacgtgcatctctggatttctttcccactgtgcacaatgtacagcatcgccattacaggtaacttcggcctgatgtaccttatatattgtgacgaggcgctacacaggccaatgtatgtgtttctcgcgctcctttccttcacggatgttctgatgtgcactagcacactgccaaacaccctcttcattctttggttcaaccttaaggagatcgactttaaggcgtgtctggcacagatgttcttcgtccatacttttactggaatggaaagtggtgtgttaatgctcatggccctggatcactgtgtcgccatttgttttcccctcagatatgcaaccatccttactaactctgtgatcgccaaggccggtttcttgacattcctgaggggcgtgatgctggttatccctagcactttcctaacaaagcgtttgccctattgcaaaggaaacgtgatcccccacacctattgtgaccatatgtctgtcgctaagatctcatgcgggaacgtcagagtgaatgccatatacggactcattgtggccctgttaatcgggggattcgatatcttgtgtattaccatttcatacacaatgatccttcaggccgtcgtgtcactttcaagcgccgacgctagacaaaaagcattcagcacatgcacagcccacttttgtgcgatagtgttgacatacgtgccggcctttttcactttttttacccatcactttgggggacataccattccactgcacatccacatcatcatggctaatttgtaccttctaatgcctccaactatgaacccgatagtgtatggggtaaaaacgcgccaagtcagggagtccgtgataagatttttcctgaagggtaaggataactctcacaacttctag

SEQ ID NO: 44561 - DNA, 966 bp, Artificial Sequence
  Description of Artificial Sequence: Synthetic coding sequence
atgagcggcgacaacagcagcagcctgacccccggcttcttcatcctgaacggcgtgcctggcctggaagccacccacatttggatttcactgcccttctgtttcatgtatatcattgcagttgtggggaattgtgggttgatctgcttgattagccatgaggaagcactccacagacccatgtattacttcctggctctcctaagctttaccgatgtcacgctgtgcacaaccatggtccctaacatgctttgtatcttttggtttaacctcaaggagatcgacttcaatgcctgtctggctcaaatgtttttcgttcatatgctgaccgggatggagagcggggtgctgatgctgatggctttagataggtacgttgctatctgctatcccctcaggtatgccaccattcttacgaacccagtgattgccaaggctggactagcaaccttcttaaggaatgttatgttgattataccctttacgctactcacgaagaggctcccctactgtagaggcaatttcatacctcatacctactgtgaccatatgtccgttgccaaggtttcttgcgggaactttaaggtgaatgctatctatggactgatggtcgccttgttaatcggcgtgttcgacatatgctgcatcagtgtttcttacaccatgattctgcaggcagttatgagcctctccagcgcagatgccaggcataaggctttttccacatgcacctcacatatgtgctcaattgtgattacttatgtagccgcctttttcactttttttacccatagatttgtagggcataacatcccaaaccatatacatatcatagtggccaatctgtacctcctcctgccgccaaccatgaatcccatagtctatggcgtgaagactaaacaaatccaggagggggtgattaagtttctccttggagacaaagtgtccttcacatatgataaatag

SEQ ID NO: 44562 - DNA, 966 bp, Artificial Sequence
  Description of Artificial Sequence: Synthetic coding sequence
atgctgaccctgaacaagaccgacctgatccccgccagcttcatcctgaatggagttcctggactagaggacacccaactgtggatatcttttcctttctgctcgatgtatgttgtggccatggttggcaactgcggactgctgtatctgatccactacgaagatgctcttcataagcccatgtactacttcctggcaatgctgtccttcaccgacctggtgatgtgtagctcgacaattccaaaggcattgtgtattttctggtttcacttaaaggatattggcttcgatgaatgtctagtgcaaatgttctttacccacacctttacaggaatggagtcaggggttctaatgctgatggctctcgacagatacgtggcaatctgctaccccctacgttatagtactattttgaccaaccctgtcattgctaaagtggggaccgcaactttcctgcgaggggtgttgctgatcattccattcacgtttttgacaaaactgcttccgtactgccgcggaaacattcttccccatacttattgtgatcatatgagcgtggccaagctttcctgcggtaatgtgaaggttaacgcaatctacgggctgatggtggcacttctgatttggggctttgacatcctttgtatcacgaattcttacacaatgatcctacgcgcagttgtgagcctgtccagtgccgacgctagacaaaaggcatttaacacctgtactgctcacatttgtgccatcgtgtttagctacacacctgccttcttcagcttcttttcacataggttcggtgagcacatcataccaccgagttgtcacattatcgtggccaacatctatcttctactgccgcccactatgaatcctattgtctatggggtgaagactaagcagattagggactgtgttatccgcattctctcaggaagtaaggacaccaaatcatactccatgtag

SEQ ID NO: 44563 - DNA, 975 bp, Artificial Sequence
  Description of Artificial Sequence: Synthetic coding sequence
atgcccctgttcaacagcctgtgctggttccccaccatccacgtgacaccgcccagtttcatacttaatggaattcccggcctggagagagtacatgtctggatctctctcccactgtgcacaatgtatataatttttctggtggggaacctaggactggtgtatctcatctactacgaggaatcactgcaccaccccatgtatttcttttttggtcacgctttgtcactgatcgatctcttaacatgtacgaccaccctgcccaacgctttgtgtatcttttggttctcactcaaggagataaactttaatgcctgtctggcccagatgttttttgtacacggattcacgggtgtggagtcaggggtcctaatgctaatggccttggaccgatacgtcgcaatttgctacccactccggtacgcaacaaccctgaccaacccgattatcgctaaagctgagctggccacctttttgaggggcgttttacttatgataccgttcccatttctcgttaagcgactgccgttttgccagagcaacatcatctctcacacatattgtgatcacatgtctgtggtgaagctgtcgtgcgcctcaattaaggtgaacgttatctatggtctgatggtggccctgctgattggtgtcttcgacatctgttgcatctccctgtcatacacgcttatcctgaaagctgccattagcctgtcatcttccgacgccagacagaaggccttctcaacttgtacagcccacatctcagcgatcattattacatatgttcctgcatttttcaccttctttgcacaccgtttcgggggtcataccatccctccaagtctgcatattatagtggccaacctgtatctcctcctcccccccaccttgaaccccattgtttatggggtgaagaccaaacaaattaggaagtcagtcattaagttcttccagggcgacaagggcgccggctag

SEQ ID NO: 44564 - DNA, 948 bp, Artificial Sequence
  Description of Artificial Sequence: Synthetic coding sequence
atggtgctggccagcggcaacagcagcagccaccccgtgagcttcattcttcttggcatccctgggctggaaagcttccagctatggatcgcctttcccttctgtgctacctacgccgttgcggttgtggggaacataacactgctccacgttatccgcatagatcacacattgcatgagccaatgtatctatttctggcaatgctggcaatcactgatctggtgctgtcttcgtctactcagccaaaaatgctagctattttttggttccacgcacacgaaatccagtatcacgcttgtctcatccaggtgttctttatccatgccttcagctctgtggagagcggggtccttatggccatggcactcgattgttacgttgccatctgcttcccgctgagacatagcagcatcctcaccccttcggtggtcatcaagctgggtactattgtaatgctgagggggctgctgtgggtcagccccttctgttttatggtgagtagaatgccattctgccagcatcaggccataccacaaagttattgcgagcacatggcagtcttaaaactggtatgcgccgacacctctatcagcaggggtaacggactgttcgtggccttctcagtggctgggttcgatatgatcgtgattggcatgagctacgtgatgatccttagagccgtccttcagctcccaagcggcgaggcacgcttgaaagctttctctacaaggagctctcatatctgtgtgatcctggccttgtatattccggcactgtttagttttctgacctaccggttcggacacgacgtgccccgagtggtgcacatcctctttgctaatttatacctgctgattccacctatgttgaatcccattatctacggggtccgcactaaacaaatcggagatagagtgatccaggggtgctgtgggaatatcccatag

SEQ ID NO: 44565 - DNA, 1185 bp, Artificial Sequence
  Description of Artificial Sequence: Synthetic coding sequence
atgttctaccccatcctgaacgacatcagcaccaagaacaacagcaacattatgtcgtgctgtaacatcctcttcatcaaaaccgttgagatcattctcgtttataatcagacgcagagcccttggtatccgatcgttccatcgaagtccctcgtctacaacaacaatacctgtttcgattgttatcacctgcaacgggtggactgcgtgccctctcgcgaccacatcaatcagagcatggttctggcttctgggaattctagctcccatcccgtgtctttcatccttctcggcatcccaggattggagtcctttcagctctggattgcctttccattttgcgcaacctatgctgttgccgtggtcggaaacataactttgttacacgttatccgaattgatcacaccctgcacgaaccgatgtatctctttcttgccatgctcgcgatcacggacctagttctaagctcctctacccagccaaagatgctggctattttctggttccatgcccacgagatccaataccacgcctgccttatccaggtctttttcatccatgccttctcttctgtggaatccggcgtgctgatggcgatggcccttgattgctatgtggccatttgttttcccttgcgccattccagtatcctgactcctagtgtggtgattaagctggggactatagtgatgctgagaggactcctatgggtatcacctttttgctttatggtgtccagaatgcccttctgtcagcatcaagctatcccccagagctattgtgaacacatggctgtcctgaaactggtgtgcgccgacaccagtattagccggggtaatggtctttttgttgccttctctgtggccggctttgacatgatcgttatcggcatgagctatgtaatgatcttacgtgctgtgctccagctccctagcggagaagccagactcaaagcattcagcactcgaagctcccacatctgcgtgatcctcgccttgtatatccccgcgttatttagctttttgacctatcggtttgggcatgacgtgccaagagtggtccatatactgttcgccaatctgtatttgcttatcccacctatgctgaacccaataatttatggagtgaggaccaaacagattggagatcgggtaatacaggggtgctgcggcaatattccatag

SEQ ID NO: 44566 - DNA, 963 bp, Artificial Sequence
  Description of Artificial Sequence: Synthetic coding sequence
atggccgagaccctgcagctgaacagcaccttcctgcaccccaacttctttatactaacaggctttcctggactcgggagtgcccagacatggctcacccttgtctttggcccaatatacctgctcgctcttctcgggaatggcgcacttccagcggtggtgtggatagacagcaccctgcatcaacccatgtttctcctgttagctattttggccgccactgatttaggccttgctacctcaatcgccccaggcctattagctgtgctttggctggggccccgatctgtcccctacgcggtctgcctggtccagatgtttttcgtgcatgccctgactgctatggagtcgggagtgttacttgccatggcttgtgatcgcgccgcagcaatcggaagacctctgcactacccagtcttagttaccaaagcttgtgttgggtacgcagcattggccctggcgttgaaggcagtggcgatcgtagtcccatttccattgttggtggcaaagtttgagcactttcaggccaaaaccatcggccatacttattgtgcgcatatggcagtggtcgagttagtcgtgggaaatactcaggctacgaacctctacgggctcgcgctcagtcttgctatttccggaatggacattctcggcatcacggggtcctacggccttatagcccacgcagtgttgcagttgcccacaagagaggcccacgccaaggcattcggaacgtgttcgtcacacatatgtgtgatcttagccttctatattcccggactgttctcctacctaacgcatcgcttcgggcatcacaccgtcccaaaaccagtgcatatcctcctaagcaatatatatcttttgctgcctcctgccctgaatcctctgatctacggcgcaagaaccaagcaaatccgcgatcgccttctggagacattcacatttcgcaagtcacccctatag

SEQ ID NO: 44567 - DNA, 957 bp, Artificial Sequence
  Description of Artificial Sequence: Synthetic coding sequence
atgatccagcccatggccagccccagcaacagcagcaccgtgcccgtgtcagagttcttgctaatttgctttcctaattttcagtcttggcaacattggctgagccttccgctatccctcctctttcttctcgccatgggagccaatactacattgctcataaccattcagcttgaggcctctctccatcaaccactctattacctgctgtctcttttgtcgctgctagacatcgtgctgtgcttgactgtgatccctaaagtcttggctatattctggtatgacttacgaagcattagctttccggcctgctttctgcagatgtttattatgaatagtttcctacctatggagagttgcactttcatggtcatggcatacgaccgctacgtggccatctgtcacccgctgagatacccctccattatcactaatcaattcgtcgcaaaagccagcgtctttattgtcgttagaaacgctctcctaacagccccaattccaattttaacaagcctcctgcactactgcggggagaacgttatcgagaactgcatttgtgcaaatctttctgtgtcacgcctgagctgcgataatttcacactcaacagaatttatcaattcgtggcgggatggactttactggggagcgacctgttcctgatttttttatcctataccttcatcctgagagctgttcttaggtttaaagcggagggcgccgctgtcaaggctctgagcacctgtggaagccactttatattaattctgtttttcagcacaatcttactcgttgtggtgctgacaaacgtggccaggaagaaggtgcctatggacattctcattctgttaaacgttctccaccatctgataccccccgcactgaatcctatagtatacggcgtccgcacaaaagaaatcaagcaggggattcagaagctgctccagaggggccgctag

SEQ ID NO: 44568 - DNA, 948 bp, Artificial Sequence
  Description of Artificial Sequence: Synthetic coding sequence
atgaccacccaccggaacgacaccctgagcaccgaggccagcgacttcctgctgaattgctttgtcagatcaccatcttggcaacactggctctccttacccctgtcccttctgtttctgctagctgtcggggcgaatactactctattgatgacaatctggctggaggccagcctccatcagccattatattaccttctgtccttgctctcactcctggatattgtgctgtgtctgacggttattcctaaggtcctgactatcttctggttcgatctgaggcctatatcctttccagcttgtttcttacagatgtacatcatgaattgcttcttggctatggaaagctgcacctttatggtcatggcctacgaccgctatgtggcaatctgccatccactgagatacccttcgatcatcaccgatcattttgtggtgaaggccgccatgtttatcttaactaggaacgtcctgatgacactgccaatccctatcttgagcgcccagttacgatattgtgggagaaacgtcattgagaactgcatctgtgccaatatgtccgtgtccagactgagctgcgatgacgtcacaattaatcacttatatcagtttgcaggcggctggacattgctgggcagcgatctgatcttaatatttctctcctacacttttatcctgagagctgttttacggctgaaagccgagggagccgtcgcaaaagccctgtccacgtgcggatctcactttatgctcattctattcttctccacaatcctcctcgtctttgtgctgacacatgtcgccaagaagaaggttagccctgatgtgccagtcttattgaacgtcctacaccatgtcattccggctgctctgaacccaatcatatacggagtgagaacgcaggagataaagcagggtatgcagaggttattgaaaaaagggtgttag

SEQ ID NO: 44569 - DNA, 1098 bp, Artificial Sequence
  Description of Artificial Sequence: Synthetic coding sequence
atgatgaccgtgatcctgaagaccctgctgggccagatccagggcctcagcggcaacccccactctactacaagcagaatgtacttcctttgcttctgcacttctctgctgcgattcaaggttcactgggtctctcggctgatacgaaaactgtatatggcatcaccaagcaacgactcaacggcacctgtttcagaattcctgctcatctgtttccccaatttccagagctggcaacactggttatccctgcccttgagcttgctgttcttgctggcaatgggagccaacaccacccttctgataactatacaactggaggcaagtctacaccagcctctctactacctcttgagcttactgagtctgctggacatcgtgctctgcctgaccgttatacctaaggtactggccattttttggttcgacctgcgctctatatcctttcccgcatgttttcttcagatgtttattatgaattccttcttgactatggaaagctgtacttttatggttatggcctacgatagatacgtggcaatatgccaccctctccggtatcccagcattattacagaccagtttgtagcaagggccgtagtttttgtgatcgcccggaacgcgttcgtatcattgcctgttccgatgctgtcagccaggctccggtattgcgcgggaaacatcatcaagaactgcatatgttccaacctctccgtttcgaagctaagttgcgatgatatcactttcaatcaactttatcagtttgtagccggttggaccctgctcggtagcgatttgattctcatagttataagctattcattcattctgaaggttgtgttaagaatcaaagctgaaggggccgtggcgaaagcactctcaacttgcggttctcactttattctgattttgttcttttcaactgtgctgttggttctggtgattactaacctggcccgcaagcgcatccctccagatgttccgattttgctgaatatcttacaccacctgatccctccagctctgaatccgatagtatatggggttcggaccaaagaaattaagcaaggcatccaaaacctcttaaagcgactctag

SEQ ID NO: 44570 - DNA, 975 bp, Artificial Sequence
  Description of Artificial Sequence: Synthetic coding sequence
atgaaccacatgagcgccagcctgaagatcagcaacagcagcaagttccaagtgagcgaattcatactgctggggttccctggcatccacagttggcaacattggctaagtcttccactcgcattactctacctctccgccctggctgctaataccctcatcttgatcattatctggcagaaccctagcttacagcagcccatgtatattttcctcggcattctttgtatggtcgacatggggctggctaccaccattattcctaaaattttggcaatattttggttcgacgcaaaggtcatttctttgcccgaatgcttcgctcagatatatgcaatccacttttttgtgggcatggagagtgggatacttctgtgtatggccttcgataggtacgtagccatttgccatcccctccgttacccatcaatcgtcacaagtagtttaatcctgaaggccaccctattcatggtcctgaggaatggactgttcgtcacgccggttcctgttctggccgctcaaagggactattgcagcaaaaatgagatcgagcattgtctctgctcgaatctgggagtaaccagcctagcatgcgacgacaggcgcccaaatagcatctgccagttggtactcgcgtggttgggcatgggcagcgacctgagcctgatcatactgtcatatatccttatcctgtacagtgtgttaagattaaactccgccgaagctgccgccaaggccctcagcacttgctcaagccacttgacgttaatactgttcttctacactattgttgtggttattagtgttacacatttgacagaaatgaaggctactcttattcccgtgctattgaacgtgttgcacaacattatcccacccagtttaaaccccaccgtgtacgcgcttcagaccaaagaactgagagcggccttccagaaggttctgttcgccctgaccaaagaaattagatcctag

SEQ ID NO: 44571 - DNA, 960 bp, Artificial Sequence
  Description of Artificial Sequence: Synthetic coding sequence
atggacaccagcaccagcgtgacctacgacagcagcctgcagatctctcagttcattctcatggggttacctggaatacatgaatggcagcactggctctctctgccactgacgttgctatacctgctggccctcggcgccaatctgctgataattattacgattcagcacgagacggtgctgcacgaacccatgtatcatttgctgggtatcctagccgtggtggatatcgggctggccacaacaatcatgccaaaaatccttgccatattctggtttgatgcaaaggccatctcattgcctatgtgttttgcccagatatacgccattcattgctttttttgtatagagtctggcatttttctgtgcatggccgtggatcggtatattgccatctgtaggcctctgcaatacccttccatcgtgactaaggcattcgtgttcaaggctacaggatttataatgctaagaaacggcctgctgacaatccctgtacccatcctcgccgcgcaacggcattattgctccagaaatgagatcgagcattgtctctgctccaatcttggtgttatttcacttgcatgtgacgatattaccgtgaacaaattttatcagttgatgttagcttgggtgctagtggggagcgacatggcactggtgttcagctcctatgcagtcattctgcactctgtgcttaggttaaattctgccgaggctatgtcaaaagctttgagtacatgtagttctcacttaattttgatcctgttccatacgggaattatcgtgctgtcagtaacacacctcgccgagaagaaaatacccctaatcccagtgttcttgaatgtcctgcacaacgtgatccccccggccctgaaccccctagcttgcgcgctgcgtatgcacaagctcaggctggggtttcaacgcttgttgggcctcggccaggacgtgtctaagtag

SEQ ID NO: 44572 - DNA, 984 bp, Artificial Sequence
  Description of Artificial Sequence: Synthetic coding sequence
atggagtggcggaaccacagcggccgggtgagcgagttcgtgctgttaggatttccagctccagctcctctgcaagtgctcctgttcgccctgcttctgttagcctatgtactggtgctgacagaaaatactcttattattatggccattcgaaaccattccacccttcataaacccatgtacttctttctggcgaacatgtctttcctggagatctggtatgtgactgtaacgattcctaaaatgctagccggcttcgtcggatctaagcaggaccacgggcagctgatttcctttgagggatgcatgacacagctgtattttttcctcgggcttggatgcaccgagtgcgtgttgttggcagtgatggcttacgatagatatatggcaatatgctatccactgcattacccggttattgtttcgggtaggctgtgtgtgcagatggccgccggaagctgggccggtggattcggtatatctatggtaaaggtttttctgatctctggtctttcatattgcggccccaatatcataaatcactttttttgcgacgtgagtccgctcctgaacctatcctgcacagacatgagcaccgcggagctgacagactttatcctagcaattttcattctgctgggccctttatcagtgaccggagcaagctacgttgcaatcactggagcagtgatgcatatcccatctgccgcaggccgttataaagcattttcgacatgtgcatcccacctgaccgtggtgatcatattttatgccgcgagcattttcatttatgccaggccgaaggccctgagtgcctttgacacaaacaagctggttagtgtgttgtacgcggttattgtgcccctgctgaaccccatcatatactgcctgagaaatcaggaagtgaagcgggccctatgttgcaccctacatctctatcaacaccaggatccagacccaaagaaagcctcaaggaatgtgtag

SEQ ID NO: 44573 - DNA, 936 bp, Artificial Sequence
  Description of Artificial Sequence: Synthetic coding sequence
atggagctggagaaccagacccgggtgaccaagttcatcctggtgggatttccgggaagcctttccatgagggcagccatgttcctgattttcctggtcgcctatatcctcactgtcgcagagaacgtgatcatcatcctgcttgtactgcagaatagacctttacataagcctatgtacttctttcttgctaatttgtcattcctggagacctggtatattagcgtgacagtgccaaagctgttattcagcttctggtcagttaacaattctatctcattcacattgtgcatgatacagctgtacttttttattgcacttatgtgcaccgagtgcgtgctcctggcagccatggcctatgatcgctatgtcgctatttgtaggcccttacattaccctacgatcatgtcccacggtctgtgtttcaggctcgccttgggctcctgggctataggattcggaatctctctcgccaagatatactttatttcttgtttatctttctgcggcccaaatgtgatcaatcacttcttttgcgatattagtcccgttctcaacctatcgtgcaccgacatgagcattaccgagctcgtagatttcattctcgccctggtaatttttcttttccccttgttcattaccgtgctgtcatatggatgcattttggcaacaattctttgcatgcccacaggaaagcaaaaggcattctcgacttgtgctagccacctggtagtagtcacaatattctactccgccattatctttatgtacgcccggccccgtgttattcatgctttcaatatgaacaagattatatcaatcttttacgcgattgtaacgccaagtctgaatcccttcatatattgtctgagaaatcgggaagttaaggaagccctgaaaaagctggcatactgtcaggcatcccgttccgactag

SEQ ID NO: 44574 - DNA, 939 bp, Artificial Sequence
  Description of Artificial Sequence: Synthetic coding sequence
atgagcggcgagaacgtgaccaaggtgagcaccttcatcctggtgggtttgccaactgcacccggactgcagtaccttctattccttctgtttctgctgacatacttgttcgtcctcgttgaaaatctggctattatcttgatcgtttggagctcaacatcacttcaccgcccaatgtactactttctttcctctatgtcttttttagagatttggtatgtgagtgatataaccccgaagatgcttgaaggttttctgcttcagcagaagcgtatctccttcgtgggttgcatgacccagctttattttttctccagcctcgtctgtaccgagtgcgtgctcttagcgagcatggcttacgataggtatgtggccatttgccacccattacgatatcacgtgttagttacccccgggctatgcctccagctcgtgggattcagcttcgtctcagggtttactatcagcatgattaaggtctgctttattagctcagtgaccttctgcggcagcaacgtcctgaatcacttcttctgtgacatctcgcccatactaaagctggcatgcacggattttagcaccgccgagctggttgactttattttggcctttataatcctggtctttcccctgctggccaccatcctgtcatactggcatataaccctcgctgtcctgcgcattccgtctgccacaggatgctggcgggctttttcaacctgtgccagccatctcactgtggtgacagtcttctacaccgccctgctattcatgtacgtgcggccgcaggcaattgatagccagtcatctaacaaactcattagcgcagtgtataccgtggtgactcccataatcaacccgctgatctactgcttgcggaataaagagttcaaagacgctctgaagaaagctctcggtttgggccagacgagtcactag

SEQ ID NO: 44575 - DNA, 996 bp, Artificial Sequence
  Description of Artificial Sequence: Synthetic coding sequence
atgagcggcgagaacgtgacccgggtgggcaccttcatcctggtggggttccccacggccccggggctgcagtatctccttttcctgctgtttttactgacttatctgttcgtgttggtggagaacctggccatcattctaactgtctggagcagcacctccctgcaccgaccaatgtactatttcttgagttcgatgagcttcttggaaatctggtatgtgtccgacattacccccaaaatgctcgaaggctttttgctgcagcaaaagaggatttccttcgtcggttgcatgacacagctttattttttctcttctttagtttgtacagagtgcgtactgctggcttccatggcatacgataggtatgtcgctatctgccacccccttcggtaccacgtcctggtgaccccaggcctgtgtctgcagctcgttggtttcagcttcgtgtcaggcttcactatctccatgatcaaggtgtgcttcatcagctcggttacattctgcggaagcaatgtgctgaatcactttttctgcgacatctctccaattctcaagttggcctgcaccgacttttccacagcagaactcgtcgacttcatccttgcctttatcatactggtgttccctctactggcaacgatgcttagctacgcacatattactctggcagtcctgcggataccttctgccaccggatgttggcgggcatttttcacttgtgccagccatctgacggttgtaaccgtgttctatacagccctactcttcatgtacgtacgtccccaagccattgacagcagatctagcaataaattaatatcagtgctctacacagttattactccaattctcaacccattaatttattgtctgaggaataaagagttcaagaatgctctcaaaaaggctttcgggttgacatcctgtgccgtggagggacgtctgtctagcctgctagaactgcaccttcagatccactcccagccactctag

SEQ ID NO: 44576 - DNA, 939 bp, Artificial Sequence
  Description of Artificial Sequence: Synthetic coding sequence
atgcggaaccacaccgagatcaccgagttcatcctgctgggcctgacagatgaccccaactttcaagtggttatattcgtatttctgcttatcacctacatgctgtcaattactgggaacttgacccttatcacaattactctgctggatagccatctgcagaccccgatgtacttctttctgaggaattttagtatcctggaaatctcattcacaacagtgtcgattccaaaattcctagggaacattataagtggggataaaacgatcagctttaacaactgtatcgtgcagctttttttcttcattctgctgggcgtaacagaattctaccttttggccgccatgagctatgaccggtacgtggctatctgtaagcccttgcactgcttatctatcatgaatcgaagggtgtgcacgctcctcgtgttcaccagttggctagtttctttcctgatcatctttcccgcccttatgctcttactcaagctccattactgccgctccaacatcatcgatcactttacgtgcgactactttcccctactccagctggcctgcagcgatactaaatttctggaagtgatgggctttagctgcgccgccttcacactaatgtttactctcgctctaatcttcctttcctacatttacatcatccggaccatcctgcgcatcccaagcacctcacagcgaactaaagcattctcgacttgcagctcacacatggtggttgtcagcataagttatggaagttgtatattcatgtacatcaagccatctgccaaagaccgtgtgtcgctgtccaaaggcgtggctatcctgaacacctctgtcgctcccatgatgaatcctttcatttactcgctgcggaaccaacaagttaagcaggcctttatcaacatggcgcgtaagaccgtatttttcactagcacctag

SEQ ID NO: 44577 - DNA, 939 bp, Artificial Sequence
  Description of Artificial Sequence: Synthetic coding sequence
atgaagaaccacaccgtgatccggaccttcatcctgctgggcctgactggggacccacaccttcaggttctcctgtttatatttctatttcttacatacatgttgtcagtcaccggaaacctaaccatcattactctaacactggtggatcaccatctgaagaccccaatgtacttctttttgcggaacttcagttttctcgaggtgtcattcaccacagtgtgtattccccgctttctctacaatatatctatgggcgataacaccattacgtataacgcatgcgcctctcaaatttttttcgtgattctgtttggtgcaacagaattctttttgctggctgcaatgagctacgaccgatacgtcgccatatgcaaaccacttcactatgtcgtgattatgaacaatcgagtttgtaccctgctagtgttgtgctgctgggtagcggggttgatgataatcgtcccacccctctcactcggactacagctggagttctgtgactccaatgccatcgaccatttcagttgcgatgccgggcctctgcttaagatcagctgctctgatacttgggtcatcgaacagatggtaatcttgatggcagtattcgcactgattatcacacttgtatgtgtcattcttagctacctgtacattgtgcggacgatcctaaagttcccaagcgtgcagcagcgcaagaaggccttcagcacgtgctcgtcacatatgatagtggtgtcaattgcttatggaagttgtattttcatctatattaaaccaagcgccaaagatgaggtggcgattaataaaggagtttccgttctcaccacatccgttgcaccccttcttaacccttttatctacacactgcggaacaagcaggtgaagcaggcattcagtgattcaatcaaaaggattgcattcctatctaagaagtag

SEQ ID NO: 44578 - DNA, 936 bp, Artificial Sequence
  Description of Artificial Sequence: Synthetic coding sequence
atgaaccacaccatggtgaccgagttcgtgctgctgggcctgagcgacgatccggatctgcaaatcgtcatatttctcttcctcttcatcacttacattctaagtgtgacaggaaatctgaccattatcactcttacgttcgtggacagccacctccagacccccatgtatttttttctgcgcaacttctcgttcctggaaatctcattcacaaccgtgtgcattcccaggttcctgggggccatcatcacacggaacaaaaccatatcatataacaattgtgctgcccagttatttttctttatctttatgggcgtcactgaattttatatccttactgctatgagctatgatcggtacgtcgccatctgcaaaccgcttcactatacatccatcatgaaccgcaagctgtgtactctgctggttctctgcgcttggctgagcggcttcctgacaatctttccccccttaatgctgttgttacaattggactattgcgccagtaatgtcatcgaccacttcgcatgcgactacttccccctactgcaacttagctgctccgacacatggctcttagaagtcattgggttttatttcgcactggtcacccttctattcacactggccttggttatactatcctatatgtatatcataaggaccatcctgcgcattccttctgcaagtcagaggaaaaaagccttctccacttgttcgtctcatatgatcgtgattagtatatcctatggcagctgcatcttcatgtacgccaacccttccgctaaggaaaaggcttcactcacaaaggggatcgcaattctgaatacgagtgtagccccaatgcttaatccttttatttacacactccggaatcagcaggttaagcaggcattcaagaacgtagtacacaaggttgttttctatgcaaatcagtag

SEQ ID NO: 44579 - DNA, 930 bp, Artificial Sequence
  Description of Artificial Sequence: Synthetic coding sequence
atgaagaaccggaccatgttcggcgagttcatcctgctgggcctgacgaaccagccagaattgcaggtgatgatttttattttcctgtttttgacatatatgctgagcatcctcgggaatctcaccatcatcaccctgacactgctcgaccctcatcttcagacccctatgtatttttttctgcggaatttctcttttctggagatttcctttacgagtatcttcattcctaggttcctcacctctatgaccacaggtaacaaggtgatcagtttcgctggttgtctcacccaatacttctttgctatctttctgggagctacagagttttacctgctggcgtctatgagctacgacagatacgttgccatctgtaagcctctccactaccttacaatcatgtctagtcgcgtgtgcatccagctcgtgttctgtagttggctcggcgggttcctagctatcctcccccccatcatactgatgacccaggtcgatttttgcgtgtctaacatcttaaaccactactattgtgattatgggccacttgtggagctggcctgttctgacacctcgctgctggagctaatggttatattactggcagttgttacactcatggttacgttggtgctggtcacgttgtcttatacgtacatcattaggacaatactgcgtatcccgtccgcacaacagcgtactaaagccttttcaacttgctcatcccacatgatcgttatcagcctctcttatgggagttgtatgttcatgtatattaaccctagcgcaaaggagggcggcgccttcaacaaggggatcgccgtactgattacgtcagtgactccccttctaaacccatttatctacaccctgaggaatcagcaggtcaagcaggccttcaaggattccgtcaagaaaattgtgaagctgtag

SEQ ID NO: 44580 - DNA, 939 bp, Artificial Sequence
  Description of Artificial Sequence: Synthetic coding sequence
atgcccaacatgaccagcatccgggagttcatcctgctgggcttcactgataatcccgaactgcaggtggtcatatttttttttatgctgattacctacctgctgtctgtgagtggaaacatgattattatcatgttgactctcagcaacatccaccttaaaactcctatgtacttcttcctgaggaacttctcttttttagagatctccttcaccactgttttcatacccagatttcttatcaacatcgccacaggcgacacgacgatctcctacaatgccagcatggcccaagttttctttctgattctgcttgggtccacggagttctttttactggcggtaatgagctacgaccggtacgtcgccatctgcaagcccctgcactataccaccataatgtccaataaggtctgtaactggctcgtgatctccagttggctcgccggctttctgattatttttccacctgttatcatgggactccagcttgatttttgtgactctagcaccatcgaccattttatttgcgactcttccccgatgctgctgattgcatgtactgacacacagttcctggaactgatggccttccttctcgctgtgtttacgctgatggtcactctggctttagtggtcctgtcctacaccctcattcttaagacaatccttaagattccatctgctcaacagaggaagaaggccttcagcacctgctccagccatatgattgtggtttctgtttcttacggtagttgcatttttatgtgtgtaaaaacctccgcgaaagagggcatggcactgagcaaaggcgtcgctgtgctgaacacatctgtcgctccaatgctaaacccattcatttataccttacgcaaccagcaagttaaacaagcccttagagaattcacaaaaaaaatcctctccttgaacaaacaatag

SEQ ID NO: 44581 - DNA, 954 bp, Artificial Sequence
  Description of Artificial Sequence: Synthetic coding sequence
atgcagaagagcgtgatgcggaagcacaccgccatcaccaccttcatcctgctgggcttgaccgaagacccacagctgcaggtacttctcttcatgttcttatttatcacatacatgctctcggtgactgggaaattgacaattatagctctgactatgcttgacccccatcttaagacgccaatgtacttttttctgcagaacttgagtttccttgagatttcttttaccgccacctgcgtcccacgcttcttgtacagcatatccaccgggaataagatcatcacctataatgcttgcgtgatccagctcttcttcgctgatctgttcggggtaaccgaatttttcctgctggcaacaatgagctacgatcgttatgtggcgatttgcaagcccctgcattatatggccataatgagtaacaaggtttgcaagacaatggttatctgttgctggatggcagctctgatgataatactgcctccactgtcgctaggtttccacctcgagttttgcgactccaatgtaatcaaccatttcgggtgcgatgctctgccaatactgaaaatcccatgttccgacaccagcctcatcgaacaaatggtggtggcctccgccgtcctcacctttatcataacacttgtttgtgttgtgctgtcctacacatatattatcagaacaattctcaaatttccctccgtgcagcagaaaaaaaaagccttctccacttgtagcagccacataactgtcgtgagcattacctacgggagctgcatcttcatatacattaagccttcagcgaaagaggaagtcaacatcaacaagggcgtcagtgtcctcataagctctatctctcctatgcttaacagctttatctacacacttaggaatgagcaggtgaagcaggcatttcacgatagcctgaagaaaattgcctttcgactgaagaaatag

SEQ ID NO: 44582 - DNA, 939 bp, Artificial Sequence
  Description of Artificial Sequence: Synthetic coding sequence
atgcggaagcacaccgccatcaccaccttcatcctgctgggcctgaccgaggaccctcaactgcaagttttactgtttatgttcctctttattacatatatgctgtctgttactggaaaattgactatcatcgcgctgactatgctggacccccacctgaaaaccccaatgtatttcttccttcagaatcttagcttcctggaaattagcttcaccgctacttgcgtacctaggttcctgtacagcatctcaactggtaacaagattattacctataatgcctgtgtcatccagctgtttttcgctgatttattcggagtaacggagttttttcttctggcgaccatgagttacgatcggtacgtcgccatctgcaagcccctgcattacatggcaataatgagcaataaggtttgcaagaccatggttatttgttgctggatggccgcgctgatgatcatcttgccgccgctgtcactgggattccatttggagttctgcgactccaatgttataaatcacttcggatgtgacgctcttcctatcctgaagatcccatgtagtgacacaagcctcatcgagcagatggtagtggcttctgcggtactcacattcatcatcaccctggtgtgtgtggtgttatcttacacatatatcatcagaaccatattaaaattcccgtccgtgcagcaaaaaaagaaagccttcagcacctgctccagtcatatcacagtcgttagcattacctacggatcgtgcatcttcatctacataaaaccgtcagccaaagaagaagtcaacatcaataagggcgtgagcgttctgataagcagcattagcccaatgctgaatagtttcatctatactcttaggaatgaacaggtgaagcaagcctttcatgatagcctgaaaaagattgcgttccgactgaaaaagtag

SEQ ID NO: 44583 - DNA, 939 bp, Artificial Sequence
  Description of Artificial Sequence: Synthetic coding sequence
atgaagaaccacacccggcagatcgagttcatcctgctgggcctgaccgacaatagccagctacagatcgtcatctttctgttcctgctgcttaattgcgtgctgagtatgatcggcaattttaccatcattgcgctaatccttctcgattcacagcttaaaactccaatgtactttttcttaagaaactttagcttcttggaaatcagtttcaccactgcttgtattccgagattcctaattacgatagtgactcgcgagaagactatcagttgcaatgggtgtatttctcagctgttcttttatatcttcctgggagtgacggaattcttcctgctcgctgctttatcttatgatagatatgtggccatctgcaagcccctccgctacatgtcaattatgtctaataaggtgtgttatcaacttgtgttctcgagttgggtgactggatttctgatcatcttcactcccctgattcttggtttgaacttggatttctgtgcatctaacattatcgatcattttatctgtgatataagcttgatattacagctctcttgctctgatacgcacctcctggagctgattgcatttctgctggctgtcatgactctcattgtaacactgtttctagtgatccttagttacagttatataatcaaaaccattctgaagttccctagtgcccaacagaaaaaaaaagcgttctctacttgtagttctcatatgatcgtcgtctccattacctacgggtcatgcatgtttatctacatcaaaccaagcgctaacgaacgggtggctctcagcaagggtgtgacagttctgaacacaagcgtagctcctctcctgaatccattcatctatacactgaggaatcagcaggtgaagcaggcgttcaaagcagtctttagaaaaattttcagtgcctccgacaagtag

SEQ ID NO: 44584 - DNA, 939 bp, Artificial Sequence
  Description of Artificial Sequence: Synthetic coding sequence
atgcggaaccacaccaccgtggccaacttcatcctgctgggcctgactgatgacccccaattgcaagttattatctttctgttactgttctttacctacatgctctcaataactgggaacttaacaataatcaccctgaccttgcttgatctccatttaaagaccccaatgtacttcttcctcagaaatttctcatttttggaggtatcgttcacgacggtgtacattcccaaatttttagtcagcatggccaccggcgacaagacaatcagttacaacgactgcgccgcacagctgttcttcacaatcctgctcggcgccactgaattcttccttctcgcagccatgtcctacgagcgctacgtcgccatctgcaaaccactccactataccactattatgtcatcccgtgtgtgcagccttctggtgtttgcgagttggatggcagggttccttattatttttccaccactgcttatgggactgcagcttgatttctgtgcagctaacaccgttgaccattttttctgcgacgtctccccaatccttcagctttcctgcactgacactgacatcatcgagcttatgatgttgctgtcagccatcctcacacttctcgtgacactggtactggtgatcttgtcgtataccaacatcataagaaccattctgaaaatacccagttcccagcaaaggaagaaggcctttagcacctgctcttcgcacatggttgtggtgtccatctcttacggatcatgtatcttcatgtatgtaaagcccagcgcaaaagagagggtgagtttgaataagggtatcgccctcctgtccacatcagtggcaccaatgctgaatccgttcatatataccctgcgcaataaacaggtgaaggacgtcttcaaacatactgtaaaaaaaatcgagctgtttagtatgaagtag

SEQ ID NO: 44585 - DNA, 939 bp, Artificial Sequence
  Description of Artificial Sequence: Synthetic coding sequence
atgcggaacagcaccgccgtgaccgacttcatcctgctgggcctgacttcagatcctcagtggcaagtcgtgctctttatttttctactggtgacgtacatgctgtccgttacaggtaatttgattatcataaccttgacgctctctgatccacaccttcagacaccgatgtacttcttcctgcggaatttctctttcctggagatttcttttactagcgtatgcattccccgctttctggtgaccgtggtgactgggaatagaacaatttcatacaatggatgtgtggcccaattattctttttcattttcctcggcgttaccgaattctatctgctggcggcgatgagttatgatagatgcatggccatttgcaagcctttacattacacaataattatgagcactcgggtttgtactctgctggtgttctcatcttggttggctggatttctgattatctttccccccgtgatgcttctgctgcaactggatttttgcgcaagcaacgttatcgatcactttatctgtgactcttcaccaatgttacaactgagctgcacaaatacacattttttggagttgatggccttcttcctcgccgtggtgacactgatggtgactctgacacttgtcatcctgagctataccaacataattaggactatcctcaagatcccaagtatgagtcagcgcaaaaaagcttttagcacatgcagttctcatatgatagtagtcagcatctcctacagcagctgcatcttcatgtatatcaagacttcagccagggagcgcgtgactctgagtaagggcgtggcggtgctgaatacttccgtggctcctcttcttaacccctttatttatactctgcgtaataaacaagtcaaacaggcctttaagtctatggtccagaagatgatattcagcctgaacaagtag

SEQ ID NO: 44586 - DNA, 927 bp, Artificial Sequence
  Description of Artificial Sequence: Synthetic coding sequence
atggacaccggcaacaagaccctgccccaggacttcctgctgctgggctttcccggcagtcagacactgcagttatctcttttcatgcttttccttgtgatgtatattctgacagtgagtggaaacgtggccatcctgatgctcgtgagtaccagccaccagctgcatacccccatgtatttcttcctttctaatttatcctttctggagatctggtatacaacagccgccgtccccaaggcccttgcgatcctgctgggaagaagccagacaatttcgtttacgagctgcctgctgcaaatgtacttcgtgttctcactcggttgcacggagtacttcctgttggccgcaatggcttacgatcgctgtttagccatttgctatccacttcattacggagctataatgtcaagcctacttagtgcccagctggccctcggcagttgggtgtgtggcttcgtcgccatcgctgtgcctaccgccctgatttctggcctgtcattttgcgggccacgggccatcaaccactttttctgcgacatcgctccctggatcgcattagcttgtacgaatacccaggcagtcgagcttgtggcctttgtcatcgctgtcgtcgtaattctttctagctgccttatcactttcgtgagctacgtatacatcattagtactattcttaggatccccagtgcgagcggacgcagcaaggctttcagcacgtgcagctcacatctcacagtggtgcttatctggtatggttctaccgtgtttctgcacgtgaggacaagcatcaaagatgccctcgacctgataaaagcagtccacgtgctcaatactgtggtgacccctgtgcttaatccattcatctacacgcttcgcaataaagaagtgcgcgagacattattgaagaagtggaagggtaagtag

SEQ ID NO: 44587 - DNA, 1044 bp, Artificial Sequence
  Description of Artificial Sequence: Synthetic coding sequence
atgggcaactggaccgccgccgtgaccgagttcgtgctgctgggcttctccttgagccgcgaggttgagctgctgctcctggtactgctgctccctacttttctgctgacacttctgggaaatttgctgataatctccacagtgctaagttgcagccggctgcacacaccaatgtatttctttctgtgtaatttgagtatcctcgatatactattcacttctgtgattagtccaaaggtgcttgccaacctcggcagccgtgataagaccatatcatttgctggctgtataacccagtgttatttttactttttcctgggcaccgttgagtttcttttgcttaccgtaatgtcatatgataggtacgctacaatctgttgccctctccgctatactactattatgagaccttccgtttgcattggcaccgtggtgttcagctgggtggggggcttcctctcagtgctgtttccgacgattctgatatcacagcttcctttctgtggtagtaatatcattaatcactttttctgtgactctggtcctctgctggcactagcatgcgctgatactaccgccatcgaactgatggacttcatgctctctagcatggttattctctgttgtatcgtccttgttgcttattcttacacctacattatcctcaccatcgtgagaataccctcagcctctggccgaaaaaaggcctttaatacttgtgcatcccatttgactatcgtgatcattcccagcggtatcactgtttttatctacgttacccctagccaaaaggagtatctcgaaataaacaaaattccacttgtgttatcctccgtcgtgaccccatttcttaacccatttatatatacgcttcggaatgacacagtgcagggagtgctacgagatgtgtgggtcagggtgaggggagtttttgagaagcggatgagggctgttctgaggagccgactgagcagtaacaaggaccatcagggacgcgcttgttccagtcccccttgtgtgtactcagtgaagctgcagtgttag

SEQ ID NO: 44588 - DNA, 975 bp, Artificial Sequence
  Description of Artificial Sequence: Synthetic coding sequence
atggagagccccaaccggaccaccatccaggagttcatcttcagcgccttcccatactcatgggttaagtccgtggtgtgcttcgtgcctctactgtttatctacgctttcatcgtggttggaaacctagtcattatcacggtggtccagctgaacacccatctacatacacccatgtacacattcatctctgccctgagttttctggaaatttggtacaccactgctactatacctaaaatgctgagcagtttactgtctgagcgaagcatttccttcaacggctgcttacttcagatgtatttcttccatagtaccggaatatgcgaggtgtgcttgctgactgttatggcctttgaccattacctcgcaatttgttcccccctccactatcccagcatcatgacacctaaactctgcacccagcttactctgtcctgctgcgtgtgcggattcatcacgccacttcccgagattgcatggatatctacactgcccttctgtgggtccaatcacctggagcacattttctgtgactttctgccggtcctccgcctggcttgcacggacacaagagcaatcgtgatgattcaggtggtggatgtcatccacgccgttgagatcatcacagccgttatgcttatcttcatgagttatgacggcattgtggcagtcatactccgtatccattccgccggtgggcggagaactgcgtttagcacctgtgtctcgcactttatcgttttcagcttatttttcgggagcgtgaccttgatgtacttaaggttttctgccacctacagccttttctgggacatcgccatcgccctggccttcgctgtcctttccccattctttaaccccatcatttactcacttaggaacaaggagatcaaggaagccattaagaagcatatcggccaggccaagatctttttctccgtcaggcctggaacgagtagtaaaatcttctag

SEQ ID NO: 44589 - DNA, 948 bp, Artificial Sequence
  Description of Artificial Sequence: Synthetic coding sequence
atggagagcggcaaccagagcaccgtgaccgagttcatcttcaccggattcccccaacttcaggatggctcactgctctacttttttccccttctgttcatatacaccttcatcataatagataacctactcatattttccgccgtgaggctggacactcacctgcataatccgatgtacaatttcatctcgatcttttctttcctggagatttggtacactacagcaaccatcccaaagatgttgtcaaacctcatttctgaaaaaaaggcgatttctatgactgggtgtattttgcagatgtacttcttccactccttagaaaatagtgagggcattttgctgactaccatggctattgatcgttacgtcgccatctgtaaccccctgagataccaaatgatcatgacgcctaggttgtgcgcccagctgtccgctgggtcatgcctttttggcttcctgatcctgttgccggaaatagtcatgatctcaactttgccattttgcgggcccaaccagatacaccagattttctgcgacctggtacccgtcctgtcactagcgtgcaccgatacatctatgatcctgattgaagatgtaatccatgctgtgacgataatcatcacctttctcataatcgccttatcctatgtaagaatagtcactgtgatactgaggatcccgtcaagtgaaggacgacagaaagcgttctccacctgcgcggggcatctaatggtgttccctatttttttcgggtcagtgtcactgatgtacctcagatttagtgacacgtatccacccgtattagacaccgctattgcgctgatgttcacagtcctcgctcccttcttcaacccaatcatttacagcctgcgtaataaggacatgaataatgcgatcaaaaaactgttctgccttcagaaggtcctgaacaagcccggaggctag

SEQ ID NO: 44590 - DNA, 996 bp, Artificial Sequence
  Description of Artificial Sequence: Synthetic coding sequence
atgtgctggaccatgcccagccccttcaccggcagcagcacccggaacatggagagtgggaaccagtccaccgtgaccgaattcatctttaccggatttccccagctccaagatggctctctgctatatttcttcccactgcttttcatttatacattcatcattatcgataacctgctgatcttcagcgccgtccgcctcgatacccaccttcataacccaatgtacaactttatctcgattttctccttcctcgagatctggtacaccactgctactattcccaagatgctgtccaacctaatctcagagaaaaaggccatctctatgaccgggtgcattctgcagatgtacttcttccactctttggagaattctgaggggatactgctcactaccatggccattgatagatatgttgccatctgtaacccactcaggtaccagatgattatgaccccccggttgtgtgcccagctcagcgctggtagctgtctttttgggttcctgatcctccttcctgaaatcgtgatgatctccacgttgccattctgcgggccaaaccaaatccatcagatcttttgcgacctcgtaccagttctgtctctcgcgtgcaccgatacttctatgatactgattgaagatgtgattcacgctgtgacaattatcattaccttcctgatcattgcgctgtcttacgttagaatcgtcacagtgattctccgaatcccctcgagcgaaggccgccagaaagctttttctacctgcgcgggccatctaatggtgttccctatcttctttggaagtgtttccctgatgtatctgagatttagtgatacttatcctccagtccttgacacagctatcgccctgatgtttactgttctggcccctttctttaatcccatcatctactctctaagaaataaagacatgaacaacgctatcaaaaagctgttctgcttgcagaaagtcctgaataaacctggtggctag

SEQ ID NO: 44591 - DNA, 1032 bp, Artificial Sequence
  Description of Artificial Sequence: Synthetic coding sequence
atgaagcagtacagcgtgggcaaccagcacagcaactaccggagcttactgtttccgttcctctgctctcaaatgacccagctcaccgccagcggcaaccagaccatggtgaccgaattcctattcagtatgttcccccatgctcatcgcggcggcttgctgttttttatccctcttctgttgatctatgggtttatcctgacaggtaaccttataatgttcatcgtgatacaggtcggaatggcgctgcacacgccactctactttttcatcagtgtgctgagcttcctggaaatttgctacacaaccacaaccatccctaagatgctcagttgcctgatttccgagcagaaatctatcagtgtggcaggttgcttgctccagatgtattttttccatagcctcggcattaccgagagttgtgtcttaactgccatggcaattgatcgatacattgccatctgtaatccgctgcgctaccccacaattatgataccaaagctctgtatccaactcacagtaggcagttgcttctgtggatttctgctagtgttgccggagatcgcctggatttccacactgccattttgtggatcaaatcagattcatcaaattttctgtgacttcacccccgtgttgagcttggcttgcaccgataccttcctggtcgtgatcgttgacgctatccatgcggctgagatcgttgcttcttttcttgttatcgcactctcctatatacgaatcataattgtcattctggggatgcatagcgcagaaggacaccacaaggctttttcaacctgcgccgcacacctggccgtattcctactattctttggttccgtggctgtgatgtacctaaggttctccgccacatactccgtgttctgggacaccgctattgcagttacatttgtgattcttgcccctttctttaaccccatcatatactcgcttaaaaataaagatatgaaagaagcgattggcagactattccactatcaaaagagggccggctgggccggcaaatag

SEQ ID NO: 44592 - DNA, 942 bp, Artificial Sequence
  Description of Artificial Sequence: Synthetic coding sequence
atgggcaactggagcaccgtgaccgagatcaccctgatcgccttccctgctctcctcgaaattaggatctccctttttgtggtactcgttgtgacctatactctgacggcaacaggcaacatcaccatcatttctcttatttggatagatcatagactgcaaacccctatgtactttttcctctcgaatttaagctttctggacattttatacacaactgtgatcacaccaaagctgctggcctgcctgcttggcgaagaaaaaactatcagtttcgctgggtgcatgatacagacttatttttacttctttcttgggaccgtcgaattcattctgctggcagtgatgtccttcgatagatatatggcaatctgtgacccgctgcactatactgttattatgaacagccgcgcctgtttgctattggtgctggggtgctgggttggggcctttctttcggtgctgttccctaccatcgtggtgactagactcccatactgtcgcaaggaaatcaatcattttttttgcgacatcgctccgctgctccaagtggcctgcatcaatactcacctcatcgaaaagatcaattttctgctcagcgccctggtgatcctgtctagcctagctttcaccactggatcatacgtttacattataagtactattctgaggataccgtctactcagggacggcagaaagctttctcaacttgcgcaagtcatatcacagtagtgtcaatcgcacatggtagcaacattttcgtgtatgtccgacctaatcagaacagttcgttagactatgacaaggtggccgctgtgcttataactgtggtcacaccccttcttaacccattcatatactccctcagaaatgaaaaagtgcaagaagtgctgagagagactgtaaataggataatgactttgatccagcgcaagacttag

SEQ ID NO: 44593 - DNA, 939 bp, Artificial Sequence
  Description of Artificial Sequence: Synthetic coding sequence
atggacaccggcaactggagccaggtggccgagttcatcatcctggggtttccccatttacaaggagttcagatctacctgttcctgctcttgctgctgatctacctgatgactgtcttaggcaacctactcattttcttggtggtgtgcctggacagccgattacatactccgatgtaccacttcgtgtctattctgtccttctctgagttggggtacacagcagctacaattccaaaaatgttagcaaacctcctctcagagaaaaaaacgatctctttttcaggatgcctgctccagatatacttttttcactcgctcggcgcaacagaatgttatttactcacagccatggcgtacgatcgttacttagccatctgtcgccccctccactaccctacactgatgacccctacactgtgtgccgaaattgctatagggtgttggttggggggcctggccggccctgtcgttgaaatttcactgatcagtaggctgcccttttgcgggccaaaccggatccaacacgtgttctgcgacttccccccagtcctgtctctcgcctgcacagatacaagtatcaatgtactagtggacttcgttatcaactcatgcaaaatcctggcgacttttctgcttattctctgcagctacgtccaaattatatgcacggtactgaggatcccctccgccgcaggtaagaggaaggcgatctccacttgcgcaagccactttacagtggtactgatcttttacggcagtattctttcaatgtacgttcagctgaaaaaaagctacagcctggattatgaccaagctctcgcggtcgtgtactcagttttaacaccattcttgaaccccttcatttactctctgcgtaataaagaaatcaaggaagcagtgagaaggcagttgaaacggatcggcatccttgcttag

SEQ ID NO: 44594 - DNA, 954 bp, Artificial Sequence
  Description of Artificial Sequence: Synthetic coding sequence
atggaccagtacaaccacagcagcctggccgagttcgtgttcctgggattcgcatccgtcgggtacgtgaggggatggttgttcgttctgctgttgctggcatacctgttcaccatctgcggcaatatgctgatattcagcgtcatccgtctggatgccgccttacatacacccatgtaccacttcgtttccgttctgtcctttctcgaattatggtacacggcaacaactattcctaaaatgctgtctaacattctgtcggaaaagaagacgatctcttttgccggatgcctgttgcagacctatttcttccactccctaggggcaagtgaatgctacctgcttactgcaatggcttatgaccgatatctggcaatttgcagacccctccactatcccatcatcatgactacgaccctctgtgctaagatggctgctgcatgctggacttgtggcttcctgtgtccaatatcagaggtcatcttagccagtcagctgccgttttgtgcttataatgagattcagcacatcttctgtgacttcccaccgttgctcagcctagcctgtaaggatactagtgccaacattctggttgacttcgcaattaacgcatttattatcctgattacatttttcttcatcatgatttcatatgctcgaatcatcggcgcagtgctcaagatcaagacagcaagtggccgtaagaaggctttcagcacttgcgccagccacctggcggttgtgttaattttcttcggcagcatcatcttcatgtacgtccgcctgaagaaatcatactcacttacgctggaccgaactctggctatcgtgtattctgttctaacacctatggtgaatccgataatctactcactacggaataaagagattatcaaagctatcaaacgtaccatttttcagaaaggagacaaagcgagcttggcccatctgtag

SEQ ID NO: 44595 - DNA, 954 bp, Artificial Sequence
  Description of Artificial Sequence: Synthetic coding sequence
atgcggaacctgagcggcggccacgtggaggagttcgtgctggtgggcttcccaaccacgccccccctccagctgctgctgtttgtgcttttctttgcaatttatctactgactcttctggaaaatgcgctcatcgtttttacaatctggctggccccttctctacaccgccctatgtacttcttcctcggccacctgagtttccttgagctgtggtacataaatgtaaccataccacgcctcctggccgcctttttaactcaggatgggagagtgtcatatgtgggatgcatgacgcagctgtactttttcatagccttagcttgtaccgagtgcgtactcctggccgtgatggcatatgatcgctatcttgcaatttgtggacctctgctgtatccatctctgatgccttccagcctcgcaactcggctggcagccgccagctgggggagcggcttctttagctccatgatgaagttattgtttattagtcagctgagttactgtggtcccaacattatcaatcacttcttctgcgacataagcccactgctcaacctgacctgctcagacaaggaacaggccgaactcgtggactttcttctggcactggtcatgattttgctcccactgttggccgtggtcagcagttatactgctatcatcgccgccattctgcgaattccgaccagccgaggacgccacaaggcattttcaacttgcgctgctcacctggcggtggtagtgatctactattcttccacactcttcacgtacgcgcgccctcgggccatgtacaccttcaatcacaacaaaatcatcagtgtgttgtacaccataatcgtaccattttttaaccctgcgatctattgccttcgaaataaagaagtgaaagaggctttccgcaaaaccgttatgggccgctgccattaccctagagatgtccaggattag

SEQ ID NO: 44596 - DNA, 954 bp, Artificial Sequence
  Description of Artificial Sequence: Synthetic coding sequence
atgcagccctacaccaagaactggacccaggtgaccgagttcgtgatgatgggtttcgcaggcatccatgaggcacatctgctctttttcatactgttcctgacaatgtacctattcactctggtcgaaaatctggcaattatcctagtggtcggactggatcaccgtctgagaaggccaatgtacttctttctgactcatctctcatgcctggaaatttggtatacttcagtgactgtacccaaaatgctggctggctttattggtgtagacggagggaagaatatctcatacgcagattgtttaagccagctttttatcttcacttttctcggtgcaaccgagtgctttttgctcgctgctatggcatacgataggtatgttgccatctgcatgcctctccattatggcgctttcgtgtcatggggcacatgtataagactcgccgcagcatgttggttggtgggcttcctgacaccaatcctgcctatatatctcctgtcacagttaactttttacggaccaaatgtgatagatcacttcagttgtgacgccagcccactgttggcactgtcctgcagcgacgtgacgtggaaagaaactgtagactttttggtttccctcgctgttttgctggcttcctccatggtcattgcagtgtcatacgggaatattgtctggacgctgctccatattcggagcgcggcggaaagatggaaggcgtttagcacttgcgccgcacaccttacagtggtgtcactcttctacggtaccctcttcttcatgtatgtacagactaaggtcaccagttcaataaactttaataaagtggtgagcgtgttttattcagttgtgactcccatgttaaaccctctcatttatagcctgaggaacaaggaggttaaaggcgcactgggccgggtattcagcctgaacttctggaagggccagtag

SEQ ID NO: 44597 - DNA, 996 bp, Artificial Sequence
  Description of Artificial Sequence: Synthetic coding sequence
atgagccccgacggcaaccacagcagcgaccccaccgagttcgtgctggcaggattgcctaatctcaatagtgccagagtggagctgttttctgtttttctgctcgtgtacctgcttaatctgaccggcaacgtgctgattgttggagttgtcagagcagacaccagacttcagacccctatgtatttctttttagggaacttgagctgtctggagattctgttgactagcgtgatcatccccaaaatgctgtccaattttctgagtaggcagcatacaatatcgtttgcggcctgtattacacaattttatttttacttttttctgggcgctagcgaatttctcctgttagctgtgatgagtgccgaccggtacctcgccatctgccacccacttcggtatccgctgttgatgtctggagctgtttgctttagagtggctctggcctgctgggtggggggattggtgcccgtacttggcccgaccgtggcggtggccttgctgccattctgtaaacagggcgctgtagtgcagcacttcttctgtgacagcggccctttgctgcggctggcatgtacgaatacaaagaagctggaggagacagattttgtcttggcctccctggtcattgtctcttccctcctcattaccgctgtgagttatgggttaatcgtgctggcagtcctctcgataccgagcgcctctgggagacagaaggcttttagcacttgtacttctcatttaatcgtggtgacattattttatggctccgccatttttctctacgttcggccttcacagagtggatctgtagacactaactgggcagtgactgtgatcaccactttcgtgacgcccctcctcaatccattcatctacgctctgaggaacgagcaggtgaaagaggcgcttaaggacatgttcagaaaggttgtggccggtgtgctgggcaatttgttgctggataagtgtctgtctgagaaggctgttaagtag

SEQ ID NO: 44598 - DNA, 972 bp, Artificial Sequence
  Description of Artificial Sequence: Synthetic coding sequence
atgaaccccgagaactggacccaggtgaccagcttcgtgctgctgggttttcctagcagtcacctgatccagtttcttgtattcttaggtcttatggtgacttacatcgtgacagctaccggaaagctgcttatcatcgtgctctcatggattgaccagagattgcacattcagatgtatttcttcctccggaatttcagctttttagagctcctgctagtgacagtggtagtccctaagatgttagtcgtgatcctcacaggcgaccatacaattagcttcgtatcatgcattatacaaagctatctctacttttttctgggaacaacggatttcttcctgcttgccgtgatgtctttggataggtatttggccatatgccgacctttgaggtacgagactctgatgaatggccacgtgtgttcacagcttgttcttgcgtcatggctcgcgggattcttgtgggtgctttgcccaacagtgctgatggcctccctgccattctgcgggccaaatggcatcgatcactttttccgggattcttggcctttattgagactgtcctgcggcgatacacaccttcttaagctcgtcgccttcatgttgtcaaccttagttctcctggggtcgctggctctgaccagcgtgtcttacgcctgcatcctcgctactgtgctccgagcaccaaccgccgcagagcgacgcaaagcattttccacatgcgcgtctcacctgacagtggtcgtgatcatttatggaagctctatctttctatacatccgtatgagcgaggcacaatcaaagctcctgaacaagggagcctccgtcctgagctgcatcattactcctctgctgaacccttttatcttcaccttgcggaacgacaaagtgcagcaggccctgcgcgaagcattagggtggccccgactcactgctgtgatgaagctgcgcgtgacctcacagcggaaatag

SEQ ID NO: 44599 - DNA, 942 bp, Artificial Sequence
  Description of Artificial Sequence: Synthetic coding sequence
atggccaacctgagccagcccagcgagttcgtgctgctgggcttctcaagcttcggcgaactccaggccctgctgtatggtcctttcctcatgctgtacttgctggccttcatgggaaacacgatcatcatcgtgatggtgattgctgacacacatctgcacacccctatgtattttttcttagggaacttttccctcctcgagatactcgtcactatgaccgccgttccaagaatgctttccgacctgttggtgccacataaagtaattacctttaccggatgtatggtgcagttttacttccactttagtctcgggagtacctcttttctcatactgaccgacatggccctggatcgctttgtcgctatttgccacccccttagatacggaaccctaatgagtagagctatgtgcgtgcagttggccggggccgcttgggccgctccttttctggccatggttcccacagtgctcagtagagcacatctggattactgccatggcgacgttatcaatcacttcttttgtgataacgaaccgttattacagctctcctgttccgacacccgccttctcgagttctgggattttctgatggccctgactttcgttctcagcagttttctcgtcacccttatttcctacgggtatattgtgactaccgtgcttcggatcccgtccgcatcctcttgtcagaaggctttttccacatgcgggtcccacttaacccttgtcttcattgggtattctagcacgatattcctttatgtgcgacctggcaaagcacacagcgttcaggtgcgcaaggtggttgctctcgtcacgagcgttcttaccccctttctaaatccctttattttaacattttgtaaccaaactgtcaaaaccgtactgcagggccagatgcagagactgaagggcctctgcaaggcgcagtag

SEQ ID NO: 44600 - DNA, 939 bp, Artificial Sequence
  Description of Artificial Sequence: Synthetic coding sequence
atgcggaacggcaccgtgatcaccgagttcatcctgctgggcttcccagttattcaggggctgcagacaccactgttcatcgctatatttctaacctatatactgacactcgccggaaacgggcttattatagcaacagtgtgggccgagcccagactgcagatacccatgtacttcttcctctgcaatcttagtttccttgaaatttggtacactaccacagttattccaaagcttctggggactttcgtggtggcaaggactgttatctgtatgagctgctgcttacttcaggccttttttcacttctttgtggggacaacagaatttctcatcctgaccattatgagtttcgaccgctatttgaccatctgcaatcccctccatcacccgacaataatgaccagtaagctgtgcctgcagctggctctgtccagttgggtggtgggattcacgatcgtgttctgtcagactatgctgctgattcagctgccattctgcggcaacaacgtgatcagtcacttttactgtgacgtcgggccaagtctgaaggccgcgtgtatagatacctccatcctcgaattgctaggagtcatagccacaatcttggtgatccccggatcactactgttcaatatgatctcatacatctacatcctgagcgcaatcctgcgcattccgagcgccaccggacatcagaaaactttctcgacctgcgcatcacatcttaccgtcgtgagcctactatacggcgccgtgctgtttatgtatctcagacccacagcacactccagctttaaaatcaataaagtggttagcgtcctgaataccatcttaaccccgctgctgaacccttttatttataccatccgcaacaaggaagtgaaaggtgccttgcgcaaagccatgacgtgtccgaagactggtcacgccaagtag

SEQ ID NO: 44601 - DNA, 978 bp, Artificial Sequence
  Description of Artificial Sequence: Synthetic coding sequence
atgaccaccatcatcctggaggtggacaaccacaccgtgaccacccggtttatcctgctaggctttcctacacgccctgcttttcagcttctctttttttcaattttcttggcaacatacctcctcaccctgttggagaacctgttgattatcctggccattcattctgatggtcagttacataaaccaatgtacttcttcctgtcgcacttgtccttccttgagatgtggtacgtcacagttatctctcctaaaatgctggtggatttcctgtcacatgacaaatccatttcttttaatggttgcatgactcaactgtatttcttcgttacttttgtctgtaccgaatatatcttgttggcgattatggcctttgaccgatatgtggcgatctgtaatccactgcgttatccagttattatgacgaaccagttatgcggtactctggcaggagggtgctggttttgcggcctcatgactgccatgatcaaaatggtgtttatcgcccagttacactactgcggcatgccacagattaaccattacttttgcgatatttcccctctccttaacgtgtcctgcgaggacgcaagtcaagccgaaatggtagattttttcttggccctgatggtgatcgctatcccgttgtgtgttgtggtggcgagctacgctgccattctcgcgacaattttgcgcattccgagtgcccagggcagacaaaaggctttttccacctgcgcgagtcacttaaccgtcgtgatcttgttctattccatgactctttttacctatgcaagaccaaagctcatgtatgcctacaattccaacaaagttgttagcgtgctttatacggtcatcgtccccctcctgaatccgattatctactgccttcggaatcacgaggtcaaggccgctctccgaaagacgattcactgcagaggttctggccctcagggtaatggcgctttctcgtcctag

SEQ ID NO: 44602 - DNA, 930 bp, Artificial Sequence
  Description of Artificial Sequence: Synthetic coding sequence
atgaagagctggaacaacaccatcatcctggagttcctgctgctgggaatctcagaggaacccgagctccaggcctttctttttgggctatttctgtcaatgtacttagtgacagtgctcgggaacctcttaattattctggctacgattagcgactcccacttgcatacaccaatgtacttcttcctgagcaatctaagtttcgtcgacatatgcttcgtttcaaccacagtccccaaaatgcttgtgaatattcagactcacaacaaagtgattacatacgcggggtgcattacacagatgtgctttttcctcctctttgtaggcttagacaatttcctgctcaccgttatggcctacgaccggtttgtcgcgatctgtcaccccctgcactacatggtcattatgaaccctcagttgtgcggtctccttgtgctggcctcgtggatcatgtctgtgctaaactctatgctgcaatccctaatggtgctgccactgcccttctgtactcatatggagatccctcatttcttctgcgagatcaaccaggtggtgcatctggcctgttctgataccttcttgaatgacattgtcatgtactttgctgtggccctcttggggggcgggccacttactgggattctgtactcgtacagtaagatcgtgagctctatcagagcgattagctcagctcagggcaagtacaaagctttttccacctgcgccagtcacctctcagttgtgtcactgttttacggaacatgtctgggagtttatctcagctccgcggctacacataacagtcataccggcgctgcagccagcgtaatgtacactgtggtcactcccatgttaaaccctttcatttactcactgagaaacaaacacatcaagggggcaatgaaaacgttcttccgcgggaaacagtag

SEQ ID NO: 44603 - DNA, 930 bp, Artificial Sequence
  Description of Artificial Sequence: Synthetic coding sequence
atggagcccgagaacgacaccggcatcagcgagttcgtgctgctgggtctcagcgaagagccagaacttcagccctttctctttggcctgttcctgagtatgtacttagtgacagtactgggcaatctcctgatcattctggccacaatcagcgatagccacctccacacaccaatgtacttcttcctgagcaacctatcctttgctgacatctgctttatctctacgacaattccgaagatgctaatcaacatccagactcagtccagggtgatcacgtatgctggatgtataacccagatgtgttttttcgtgctgtttgggggtctggacagccttctgctggcagttatggcctacgatcggtttgtggctatttgtcaccccctccactacactgtgatcatgaacccccgtctgtgtggcctgctcgtgttggctagttggatgatcgctgcactgaactctctgagccagtccctcatggtcctgtggcttagcttctgtaccgacctcgaaattccacacttcttctgcgaattgaaccaggtgattcatctggcttgtagcgatacatttttgaatgacatgggcatgtacttcgccgcaggtctactggctggtggacctctggtgggtatcctgtgttcgtactctaagatcgtttcctccattcgcgctatcagctccgcccagggtaagtacaaagcattcagcacatgcgcaagccatctgtcagtggtctctcttttttgttgcaccggactcggtgtttacttgacttccgcagctacacacaactcccacacgagcgccacagcttcagttatgtatactgtcgccactccaatgttgaaccctttcatctacagtctgagaaacaaggacattaaaagggctttgaaaatgtcattccggggaaaacagtag

SEQ ID NO: 44604 - DNA, 930 bp, Artificial Sequence
  Description of Artificial Sequence: Synthetic coding sequence
gtgaaggccggcaacgagacccagatcagcgagttcctgctgctgggttttagcgagaagcaggagctgcagccatttctgttcggcctctttctgtcaatgtacttagtcacagtgctgggcaaccttttgataattcttgctgcaatttctgactcatgtctgcacacccccatgtatttcttccttagcaacctctcttttgtggacatctgtttcgcatcaaccatggtgcccaaaatgctcgtgaacattcagacgcagtcaaaagtgatcacatatgcgggttgcatcacccagatgtgctttttcgtgctatttattgttctcgactcactgctgttaactgtgatggcgtatgaccagttcgtggccatatgccacccgctccattatacagtgataatgtcccctcaattgtgcggcctgctggtgttggtgtcttggattatgtccgtcctcaattcaatgttacagtctctcgtgacgctgcagttatcattctgcactgacctcgagataccacattttttctgcgagctgaatgagatgatccacctggcctgttccgatacctttgttaacaacatggtgatgcactttgctgctgtgttgctggacggcggacccctggttggaatactatactcttattgccgcatagtcagctcgatacgggccatatcaagcacccagggtaagtataaagccttgtccacctgcgccagccatcttagtgttgtgtctatattttatggtacaggacttggagtgtacctcagctctactatgacacagaacttgcactctaccgccgtagcatcggttatgtacactgtggttaccccaatgttgaatccattcatttactctctgcgaaacaaagatatcaaaggagcactgacacaattcttccgcggcaagcaatag

SEQ ID NO: 44605 - DNA, 960 bp, Artificial Sequence
  Description of Artificial Sequence: Synthetic coding sequence
atggagcccggcaacgacacccagatcagcgagttcctgctgctggggttctcccaggagccaggccttcaaccatttctgtttggcctgtttctgagtatgtatctggtaacagtcctgggtaatctcttgattatcctggccacaatttctgatagccatttgcacaccccaatgtatttctttttgtctaacctatcatttgctgacatttgtgttacgagcaccacaattccaaagatgcttatgaatattcagacccagaacaaggtgataacctacattgcctgtcttatgcaaatgtatttcttcatcttgtttgcaggatttgaaaatttcttactctcggtgatggcatatgatagatttgtggcaatttgtcaccccctgcactatatggtgattatgaatccacacttgtgcggtcttctggtactggccagctggacgatgagcgcactctattccctgctgcagatcctgatggtcgtgcgcctgagcttttgcacagcactggagattcctcactttttttgtgaattgaaccaagtgatccaactggcatgctccgactcctttttgaaccacatggtgatctatttcactgtggccctgcttggaggtggacccctgacgggcatcctgtatagctactcgaagatcatcagctcaattcacgctatcagcagcgcacagggaaaatataaagcgttcagtacttgtgcttcacatctctcagtagtctctttgttctatggcgcaattctgggcgtctacttgagctcagccgccacccggaactctcattcgtcggccaccgctagcgtaatgtacacagtggtcactcccatgctgaatccatttatatacagtttgagaaacaaagacattaaacgggccctcggaatccatcttctttggggcaccatgaaagggcaatttttcaaaaaatgcccttag

SEQ ID NO: 44606 - DNA, 939 bp, Artificial Sequence
  Description of Artificial Sequence: Synthetic coding sequence
atggaggccggcaaccagaccggcttcctggagttcatcctgctgggactgtcggaagatccagagctccagccatttatctttggtcttttcttgtctatgtacctcgttactgttctgggaaacctgctgattatcttggccatttcgtctgacagccaccttcacacccctatgtactttttcctgtcgaacctatcctgggtcgacatctgcttttctacatgcatcgttccaaagatgctggttaatatacagaccgagaataaagcaatctcgtacatggactgtctgacacaggtgtacttttcaatgttctttcccattctggacacgctgctcctcactgtgatggcctatgacaggtttgtggcagtatgtcatcccttgcactacatgattatcatgaacccccacttatgcggtctgctggtcttcgttacgtggcttatcggcgttatgacctctctcctccacatttctctaatgatgcatctcatcttctgcaaggatttcgaaatacctcattttttttgtgagctgacctatatactccagctcgcgtgttccgatacattccttaactccaccttgatttactttatgacaggcgtgttgggagtctttcccctgctgggaatcatattcagctattcaaggatcgctagttcaatcagaaagatgtccagtagcgggggcaagcagaaagctctttccacgtgcgggtcccatctttcggtcgtgtccctgttctacggaaccggtattggtgtacactttacctctgccgtaactcatagctcacagaagataagcgtggcgagcgtaatgtacacagtggtaacacccatgctgaacccctttatttattcactgcgcaacaaagacgttaaaggagccctaggctccttactcagccgtgccgctagttgcctctag

SEQ ID NO: 44607 - DNA, 1020 bp, Artificial Sequence
  Description of Artificial Sequence: Synthetic coding sequence
atgagctacttccccatcctgttcttcttcttcctgaagcggtgcccatcatacacagagcctcagaaccttacaggggtctcagaatttttgctcctaggcctgtccgaggaccccgagttgcagcccgtgctcgccggcctgttcttgtctatgtacctggtcactgtgctaggaaatcttctcatcatcctggctgtgtcatccgactctcacttacatacaccgatgtatttctttttgtccaacttgtccctcgctgacatcggctttacctcgacaactgttcccaagatgatcgttgatatgcagacacacagcagagtgattagctatgaggggtgtctcacacagatgtccttctttgtactgtttgcatgcatggacgacatgctgctgagcgtgatggcgtacgatagattcgtggctatctgccatccccttcactaccgtattattatgaaccctcggctatgcgggtttcttattctgctgagtttttttatctcactgctggattcacagctgcataatttgataatgctacagctcacatgcttcaaggatgttgatataagcaatttcttttgcgacccttcccaattgctacatttgcggtgtagcgatacgttcatcaatgaaatggtgatatattttatgggcgctattttcgggtgtctcccaatatcggggattctgtttagttattacaagatcgtaagccctatactccgggtgcccacttcagacggaaaatataaggccttcagcacatgtggctcacacctcgctgttgtctgtctcttttatggtacgggcttggtcggctacctgagttccgccgttttgccctccccccgtaaatctatggtggcaagtgtgatgtatacagttgtgacccctatgctaaacccgtttatctatagtctccggaataaggacattcagtccgccctttgtcgtctgcacggacggattattaaatctcaccatcttcaccctttctgttatatgggctag

SEQ ID NO: 44608 - DNA, 1002 bp, Artificial Sequence
  Description of Artificial Sequence: Synthetic coding sequence
atgggcccccggaaccagaccgccgtgagcgagttcctgctgatgaaggtgaccgaagaccctgagcttaagttaattccattctccctgttcctgtccatgtacttagtgacaatccttggcaatctgctcattctgctcgccgtgatcagtgactctcacctccacaccccaatgtattttcttctgtttaatctcagctttaccgacatatgcctcaccacgaccacagttccaaaaatcctggtcaacatccaggctcagaaccaatccatcacatacaccgggtgtcttacacaaatctgtctggtcctggtctttgcaggtctggagtcttgctttcttgccgtcatggcctacgatcgatacgttgcaatctgtcaccctttgcggtacactgtgctcatgaatgtgcacttctggggacttctcatcctgcttagcatgttcatgagcaccatggatgctctggtgcagagcctgatggtgctccaactatcattctgtaagaatgttgaaatccctctcttcttctgtgaggttgtacaggtcataaagctggcctgtagcgacacattgattaacaatatcttaatttactttgcatcttctgtgttcggagccatcccgctgtcaggcattatctttagctactcccagatcgttacgtctgttctgcgaatgccttctgcaaggggcaagtataaggccttcagcacttgtgggtgtcatctcagcgtgttcagcctgttttacggaaccgcgtttggcgtttacatttcctccgctgttgcagaaagtagcaggattactgctgtggcgtccgtaatgtatacagtcgttccgcagatgatgaatcccttcatatattcgcttaggaataaggaaatgaaaaaggctcttagaaaactgattgggtggtcgactgtggccagatcacgtctgacagctaactccgcgtctcgagtccatgcaatccttcttcccaggcctccggaatag

SEQ ID NO: 44609 - DNA, 936 bp, Artificial Sequence
  Description of Artificial Sequence: Synthetic coding sequence
atgggcccccggaaccagaccgccgtgagcgagttcctgctgatgaaggtgactgaggaccctgagctcaagctgatacctttttccctgtttctttccatgtatctggtcaccattttgggtaacctcctcattctcctcgcggtaatcagcgattctcatctacacactcccatgtatttcctgctcttcaatctgtctttcaccgatatctgtctcactactaccaccgttcccaagatcctggtgaacattcaggcacaaaatcagtctatcacctatacaggctgtcttacacagatttgtctggtgctggtctttgctgggttagagagctgtttcttagctgtgatggcgtatgaccgctacgtagcgatctgccatcctctgaggtacactgtgctgatgaatgtgcatttctgggggctcctgatcctgttgtcaatgtttatgtctaccatggacgcgctggtccagagccttatggtgctgcagcttagtttctgcaagaatgtcgagatccccctgttcttctgcgaggtggtgcaagtaatcaaactggcttgctccgatacactcatcaacaatatccttatctactttgcctcaagcgtcttcggggccattccccttagcggcatcattttctcttactctcaaattgtcactagcgtgctgcgaatgccttcagctcggggtaagtacaaggccttctcgacctgcgggtgccacctgagcgtgttttccttgttctatggtaccgcttttggcgtatacattagctcagcggtggctgaatctagccggatcaccgccgtggcttccgtaatgtacaccgtggtgcctcaaatgatgaacccattcatatactctctgagaaataaagagatgaagaaagcacttagaaagctgatcggtcgcctcttccccttctag

SEQ ID NO: 44610 - DNA, 1038 bp, Artificial Sequence
  Description of Artificial Sequence: Synthetic coding sequence
atgcccatgcagctgctgctgaccgacttcatcatcttcagcatccggtttataatcaactccatggaggctagaaaccagacagccatttcaaagttcctgttactaggtcttatcgaggaccctgaactgcaacctgtgctgttctcgctgtttctgtccatgtacttagtcactatcctcgggaacttgttgattttgttagccgttatctctgactcccatttacatacacctatgtacttctttctaagtaacttgtctttcctcgacatatgtctgtctaccacgacaatccccaagatgctggttaatatccaggcacaaaaccgaagcattacgtatagtggctgcctaacccagatctgcttcgttctcttcttcgccggactagagaattgcttattagcagctatggcttacgatcggtacgtggcaatttgccatccactgaggtatactgtcatcatgaaccctcggttatgcgggttactgatcctgctgtctctacttactagcgttgttaacgccctgcttttgagcctgatggtgctgagactctccttttgcacggacctggagatcccacttttcttttgtgagttggcacaggtgattcagctgacgtgctccgacacgctgatcaacaatatacttatttacttcgcagcttgtatcttcgggggcgtgcctctgtctggcatcatactcagctatacccaaatcacctcatgtgtgttacgcatgccgagcgcttcggggaagcacaaggctgtgagcacatgtggatcgcaccttagcattgtgcttctcttttatggagcaggacttggagtctacatctcttctgttgtaaccgatagccctaggaaaactgctgtggcttctgtaatgtattccgtcttcccccagatggtgaatccttttatttactcgctcagaaataaggacatgaagggcaccctgaggaagttcatcggacggatcccctctctcctgtggtgtgctatctgctttggtttcagattcctagaatag

SEQ ID NO: 44611 - DNA, 939 bp, Artificial Sequence
  Description of Artificial Sequence: Synthetic coding sequence
atgaaggccggcaacttcagcgacacccccgagttcttcctgctgggtctgagcggtgatcctgagttgcagccaattctcttcatgctgttcctaagcatgtacctagccactatgctcgggaacctgctgatcatactcgcagtgaactccgacagccacttacacactcccatgtattttctgctttctatcctcagcttagtcgatatatgctttacaagcacaacaatgcccaaaatgctggtgaacatccaagcacaggcccaatctattaattatactgggtgtctgactcagatatgtttcgttctcgtgttcgtcggattggaaaatggaattctggtgatgatggcttatgataggtttgtagctatttgccatcccctgaggtacaacgtaattatgaatccaaagctgtgcgggttactcctgctcctgtcatttatcgttagtgtactggacgccctcttacacacattaatggtgcttcagcttaccttttgcatcgatctcgagattccccatttcttctgtgaattggcgcatatccttaaactggcatgctcagatgttctgatcaacaatattctggtttatctggtgacctccctgctgggggtggtcccactctccggcatcattttttcctatacacggattgtgagctcagtcatgaagatcccctccgccgggggcaaatacaaggcgttttcaatatgcggaagccacctgatcgtggtgtctctgttttatggtaccggcttcggagtatacttatctagcggcgcaacccattcatctcgcaaaggggctatagcttccgtgatgtataccgtagtcactcccatgctcaatccactcatctatagtctgcggaataaagatatgctgaaagccttgaggaagctgatctcaagaataccatctttccactag

SEQ ID NO: 44612 - DNA, 981 bp, Artificial Sequence
  Description of Artificial Sequence: Synthetic coding sequence
atgggcttcctgagccccatgcacccctgccggccccccacccagagaaggatggccgcagggaaccacagcacagtgaccgagtttattcttaagggcctgacaaagagagcagatctgcagctacctctctttctgctgtttttgggcatatacctggtgactatcgtgggcaatctcgggatgatcacattgatatgcctgaacagccaacttcatacccccatgtattatttcctgtcaaatcttagcctaatggatctgtgttacagtagcgtcatcacacccaaaatgcttgtgaattttgtcagcgagaaaaatatcatatcctatgctggatgcatgtcccagctctactttttcctcgttttcgttatcgccgagtgctacatgctgactgtgatggcctatgaccgatacgtggctatctgccatccgcttctgtataatattattatgtcccatcacacatgtctgttactggtcgccgtagtatacgctatcgggctgatcgggagcaccattgagaccgggctgatgttaaagctgccctattgtgagcatctgatcagtcactatttctgtgacattctgccgctgatgaagctgtcctgttcttctacatacgatgtggaaatgactgtgttcttttctgctggtttcaacattattgtcacctctttaactgtgctggtttcatacacctttatcctttcttccattctgggcatctccaccactgaagggagatcgaaggccttttcaacctgttcctcacatctggctgcagtcggaatgttttatggctcaaccgctttcatgtatctgaaaccatccaccatctcttcactgactcaggaaaatgtggcttcagttttctatactacggttatcccaatgctgaatccactcatctacagcctccgtaacaaagaagtaaaggccgctgtccaaaaaactttgagggggaagctgttttag

SEQ ID NO: 44613 - DNA, 933 bp, Artificial Sequence
  Description of Artificial Sequence: Synthetic coding sequence
atggccgccaagaacagcagcgtgaccgagttcatcctggagggcttgacccatcagcctggtcttaggataccattgttctttctgttcttggggttctacacagtaaccgtggtgggcaatctcggactgataactctcataggcctgaattcgcatcttcacactcccatgtactttttcctatttaacctttccctaatcgatttttgcttcagcacaaccattacgcccaagatgctgatgtcttttgtaagtaggaagaacattatatctttcacagggtgtatgacccaactattctttttctgtttttttgtggtgagtgagtcctttatactgagcgccatggcatacgatagatacgtagccatctgcaatccactgctttataccgtcactatgagctgccaagtctgcttgctattactcctaggcgcctacggcatgggcttcgctggggcaatggctcacacgggatcaataatgaacctgactttctgtgccgataatctcgtgaatcactttatgtgcgatatattaccgctcctcgagttgagctgcaacagctcctacatgaatgaactggttgtgtttattgtggtggccgtcgacgtcggcatgcctatcgtaacagtctttatctcctatgccttgattctgagcagcatcctgcataactccagcactgagggacgatctaaagcattcagcacctgttcttcccacatcatcgtggtgagcctattttttggtagcggcgcctttatgtacctcaagcctctctcgatcctgcctttggaacagggcaaggtgagctccctgttttatactatcattgtcccagttctgaatccactcatttacagcctccggaacaaagacgtcaaggtggcactgcggcggactttaggtcggaaaatcttttcttag

SEQ ID NO: 44614 - DNA, 942 bp, Artificial Sequence
  Description of Artificial Sequence: Synthetic coding sequence
atgctggcccggaacaacagcctggtgaccgagttcatcctggccggcttgacggatcatcccgagttccgacagccccttttctttctcttcctcgtgatctacattgtgacaatggtgggcaatctgggtcttatcaccctcttcggcctgaacagtcacttacacacacctatgtattatttcctgttcaacttatcattcatcgacctatgctacagtagtgtgttcactcctaagatgctgatgaatttcgtgagcaaaaaaaacatcatctctaacgtagggtgtatgacccgcctattctttttcttattcttcgttatcagtgagtgttacatgttgacgagcatggcctatgaccgatatgtggccatctgtaatccccttctgtataaggttactatgtctcatcaggtctgctccatgttgacgtttgcagcctatatcatgggtctcgccggcgccacagctcataccggctgcatgctgaggttgaccttctgcagtgcaaacatcatcaatcattatttgtgcgacatactgccactgttacagctgagttgcacatctacctatgtaaacgaagtggtggttctcattgttgttgggaccaatattacagttcctagctgtactatcttgatctcttatgtattcatagtgactagtatcctgcatatcaaatcaactcagggccgatccaaggcgttttccacgtgcagcagtcatgttatcgcactctccttgttcttcggctccgcggcgttcatgtacattaagtactcctccgggagtatggagcagggtaaggtgagctctgtgttttatactaatgtggtccctatgctaaacccccttatctattcgctcagaaacaaggatgttaaggtagcattacgtaaagccttgattaagatccaaaggaggaacatattttag

SEQ ID NO: 44615 - DNA, 942 bp, Artificial Sequence
  Description of Artificial Sequence: Synthetic coding sequence
atgctggcccggaacaacagcctggtgaccgagttcatcctggccggattgacagaccacccagaattccagcaacccttgtttttcctgttcctggtggtctatatcgtgacaatggtgggaaatctgggactcattatcttatttggcttaaactctcaccttcatactccaatgtactactttcttttcaaccttagctttattgacctgtgttactcaagtgtctttacccctaaaatgctgatgaacttcgtgtctaagaagaacataataagttatgtgggttgcatgacccagctgttctttttcctgttttttgtgatttccgaatgttacatgctgacatccatggcttacgataggtatgttgccatttgcaaccccctgctgtacaaagtgactatgtcccaccaggtgtgtagcatgctgacttttgctgcctacattatgggtctagccggggcgactgctcacactggctgcatgctgaggttgacattttgctccgccaacataatcaaccattacttgtgcgacatcttgccactcctgcaactttcttgtactagcacatatgttaacgaggtcgtcgtgctaattgtggtcgggatcaatattatggtgccgtcctgcacaatcctcatttcctacgtgttcatcgtgacgagcatactacatatcaaatcaacccagggacggagcaaggccttctcgacctgttcatctcacgttatcgcgctctctctgtttttcggatcagccgcttttatgtatataaagtatagctcggggagcatggagcaaggcaaggtttcatcggttttctacactaacgttgtacccatgctcaatcccctgatctattcactaagaaacaaagatgttaaagtggccttgcgtaaagcccttatcaagattcaaaggaggaatatattctag

SEQ ID NO: 44616 - DNA, 930 bp, Artificial Sequence
  Description of Artificial Sequence: Synthetic coding sequence
atgaccctgcggaacagcagcagcgtgaccgagttcatcctggtgggcttgagcgagcaacctgagctgcaactgcccctgtttctactattcctgggcatctacgtctttacagtcgtcggaaatctggggttgattacactgatcggcataaacccctcacttcatactccaatgtactttttcctttttaatctatcattcatcgacttgtgctatagttgtgtatttacgcctaaaatgctgaacgatttcgtttcagaatcaatcatctcctatgtggggtgtatgacccaactctttttcttttgtttttttgtgaacagtgaatgctatgttctggtttccatggcctacgataggtacgtggcgatctgtaaccccctgctgtatatggtgaccatgagtccccgcgtttgcttcctgcttatgtttggcagctatgtggtaggctttgctggagccatggcacacacaggctccatgctcagattaacattttgtgattctaacgtaatcgatcactacttgtgcgacgtgctaccgctcctgcagctgagctgtacgtccacgcacgttagtgagttagtgttttttattgtggtgggcgtcattaccatgctctcgagcatatcaattgtgatctcgtacgcactgattctttctaatattctttgcatccctagcgccgagggccggtctaaggccttttctacgtggggatcacacattatcgccgtggctctgttcttcggcagtggaacctttacctacctgactaccagctttcccggttcaatgaaccacggcaggttcgcttccgtcttctacacaaatgtagtccctatgctcaaccctagcatatatagcttacggaacaaagacgataaacttgccctcgggaaaacccttaaacgtgtgctgttttag

SEQ ID NO: 44617 - DNA, 936 bp, Artificial Sequence
  Description of Artificial Sequence: Synthetic coding sequence
atggccgccgagaacagcagcttcgtgacccagttcatcctggccggcctgacagatcaaccaggcgttcagatccccttgtttttcttattcttaggcttctacgtggtgaccgtcgtgggcaacctggggttgatcactctgattaggctaaactcacacctccatactcctatgtacttcttcttatacaatttgtcatttattgacttctgctactcaagtgtgattactccaaagatgcttatgtccttcgtacttaaaaagaacagtatcagttacgcagggtgtatgacacagctcttctttttcttgtttttcgtggtgtcggaaagcttcattctaagtgccatggcttatgatcggtacgtggccatatgcaatcccctgctctacatggtgaccatgagccctcaggtgtgtttcctgttgttactgggggtatatggaatgggctttgccggcgccatggcacacactgcatgcatgatgggtgttactttctgcgccaacaacctcgtaaaccactacatgtgcgacattctgccattgctggagtgtgcctgtacaagtacttatgttaatgaactggtggtgttcgtggtggtggggatcgacattggcgtccctaccgtgacgatcttcattagctacgccttgattctgtctagtatcttccacatcgattctaccgagggccgttctaaggctttctccacttgttcctcccacatcatagccgtgagcctgtttttcgggtccggcgcattcatgtatctgaaaccttttagtttgttagctatgaatcagggaaaggtttccagtctcttctatacgacagtggtgcctatgctgaaccctttgatttactctttgcgcaacaaagatgttaaagtggcactcaagaaaatcttaaacaagaatgcattcagttag

SEQ ID NO: 44618 - DNA, 927 bp, Artificial Sequence
  Description of Artificial Sequence: Synthetic coding sequence
atgaccatggagaactacagcatggccgcccagttcgtgctggacggactcacacaacaggctgaactgcagctgccactgttcctgctgtttttggggatctatgttgtcacggtcgtaggcaatctgggtatgatcctgctgattgcggtctctcccctccttcatacgcctatgtattacttcctttcttccctatcttttgtcgacttctgctactccagcgtgattactcccaagatgttagtgaactttcttggtaaaaaaaacaccatcctatactccgagtgcatggtgcagttatttttcttcgttgttttcgtagtggccgaagggtatctgcttacggccatggcgtacgatagatacgttgctatctgtagtcctcttctctacaatgccattatgtccagctgggtgtgttccctcctggttttggcggccttctttctgggattcctgagcgccctgacccacaccagcgctatgatgaagctgtcattttgtaagtcacatataattaaccattatttttgcgatgtcttaccactacttaatctctcatgcagcaacacccaccttaacgaactcctgttgtttattatcgccgggttcaatacacttgtaccaacactagccgtcgcagtttcctacgcatttatcttatacagcatactgcacatacgcagttcagagggccgctctaaagctttcggaacatgctcctctcacctaatggccgtcgtgattttcttcggcagtatcaccttcatgtatttcaagcctcctagtagtaattcattagatcaagagaaggtgagcagcgtgttctacactaccgtgatacctatgctcaaccctctgatctactctttgcgcaacaaagacgtcaaaaaggcattacgcaaggtgctggtcgggaagtag

SEQ ID NO: 44619 - DNA, 936 bp, Artificial Sequence
  Description of Artificial Sequence: Synthetic coding sequence
atggccaccagcaaccacagcagcggcgccgagttcatcctggccggtctaacgcaacggccagagctccagctgccattgtttcttttatttctcggaatctatgttgtgaccgtcgtaggcaatctcggtatgatttttcttattgcactgagtagtcagctgtatccccctgtgtactacttcttaagtcacctttcctttatagacctctgctactcatcggtcattacgccaaagatgcttgtgaactttgtccccgaagagaatatcatatcattcctggagtgtataacacagttgtactttttcctcatctttgtcatcgctgaagggtatctcctgaccgctatggagtatgacaggtacgtcgccatttgtcgtccattgctgtataatatcgtgatgtctcacagagtctgctccattatgatggctgtcgtctactcgctggggttcctgtgggccactgtgcacaccacacggatgtcagtgttgtctttttgccgatcgcacaccgtttcccattacttttgcgatattctgccactgcttactctctcttgcagttcaactcacattaatgagattctgctgtttatcattggaggcgtgaacacgctggccactacgttagctgtgttaatctcttacgcatttattttcagctcgattctgggaatccactcaacggaagggcagagcaaggcctttggaacctgttcctcacatctacttgctgtcggcatcttttttggatctatcaccttcatgtatttcaaaccaccttcttctaccactatggaaaaagaaaaagtaagcagtgtcttttatatcactataatccctatgttgaaccccctgatctactctctgaggaataaagacgtgaaaaacgccctgaagaaaatgactaggggcagacaaagcagctag

SEQ ID NO: 44620 - DNA, 945 bp, Artificial Sequence
  Description of Artificial Sequence: Synthetic coding sequence
atgggcgtgaagaaccacagcaccgtgaccgagttcctgctgagcggactgacagagcaggcagaactacagctgccactgttctgcctgttcctaggcatttataccgtcactgtggtcgggaatcttagcatgatctcgatcataagactcaatcgccagctgcacactccgatgtattatttcctctcttccctttcattcttggatttttgttactcatccgtgatcaccccaaagatgctgagcggattcctgtgcagagatagatctattagctacagtggttgcatgattcagctgttcttcttttgcgtctgtgttatctccgaatgctacatgctggccgcaatggcatgtgatcggtacgtagcaatctgtagcccccttttataccgcgtcatcatgtcgccaagagtgtgcagtttgctggtggccgccgtattcagtgttggctttacggatgctgtcattcatggcggctgtattctgcgccttagcttctgtggaagcaacatcatcaagcattatttttgtgatatagtccctctgatcaaactttcatgttcgagcacatatatcgacgagcttcttatctttgttatcggggggtttaacatggtcgccacatccctgaccatcatcatatcttatgccttcatcttaacaagcattttgcgcatccactcaaaaaaaggacggtgtaaagctttttcgacatgttcgtcccacctgacagcggtgctgatgttctatggcagcctgatgagtatgtacctcaagccagcgtcgtccagctctcttacgcaggagaaggtaagctcagtgttctacaccacagtgatcctaatgttgaaccctctgatatactcactgagaaataacgaagtgaggaacgcactcatgaaattgctgaggcgcaaaatttccttgtccccaggttag

SEQ ID NO: 44621 - DNA, 936 bp, Artificial Sequence
  Description of Artificial Sequence: Synthetic coding sequence
atgggccggcggaacaacaccaacgtgcccgacttcatcctgaccgggttgagcgattccgaagaggtccagatggccctcttcatcctgtttctgctgatctacctcatcaccatgctgggtaacgtaggcatgattcttatcatacggctcgatctgcagctccatactcccatgtatttctttctgactcacttatcttttattgatctgagttactcgactgtaattactccgaaaacgctggctaacctactcacaagtaattatatctcgttcatgggatgttttgcccagatgtttttttttgtatttctgggtgccgccgagtgctttcttctcagtagtatggcgtacgaccgctacgttgcaatctgcagcccacttagatatccggttattatgtccaaacgcctgtgttgtgcactcgtcacagggccctatgtcatcagtttcattaacagctttgtgaatgtggtctggatgagccgcctccatttttgcgatagcaatgttgtccggcacttcttctgcgatacatctcctattctggccctctcatgtatggacacttacgacattgaaataatgattcacattctggcggggagtacccttatggtgtcactgattactatctctgccagctatgtgtcgattttatccaccatcttaaagatcaactccacctcaggcaagcagaaggccctctctacatgcgcttcccacctcttgggtgtaactattttctatggaaccatgatcttcacttatctgaagccaaggaaaagctactccctagggcgggatcaggttgcgtccgtgttttatacgattgtgatacctatgctgaatcccttgatctattctctgagaaacaaggaggtgaaaaatgctcttatccgagtgatgcagcgccgccaggacagcaggtag

SEQ ID NO: 44622 - DNA, 930 bp, Artificial Sequence
  Description of Artificial Sequence: Synthetic coding sequence
aacaacaccaacgtgcccgacttcatcctgaccggcctgagcgacagcgaggaggtacagatggctctgtttatcttgttcctccttatctatctgataactatgttagggaacgtgggtatgatattgataatcagactagacttgcaactgcacacccccatgtacttcttccttacacacctttcgtttatagatctgtcttattccactgtgattacaccgaagacgctggcgaacctcctgaccagcaactacatttcattcatggggtgcttcgcccagatgttcttttttgtcttcctgggcgccgccgaatgttttttactgtccagcatggcctacgaccgctatgtcgcgatttgttcccccttaaggtaccccgtgatcatgtccaagcgcttatgctgtgccttggtaactggtccatatgtcatatcctttatcaacagttttgtcaatgtggtgtggatgagcagattacatttctgcgacagcaatgttgtgaggcactttttctgcgatacaagcccaatactggcactctcgtgcatggatacctacgacatagagatcatgatccatattctggcaggaagcacgctgatggtgtcactaatcacgatttcagcgagttacgtgtctatcttgtccaccattctgaagattaacagcacttcgggaaaacaaaaagccctcagcacctgtgccagccacctgctgggtgtaactatcttctacggaaccatgatcttcacgtacctcaagcctaggaaaagctattccttgggtcgcgaccaggttgctagtgtgttttatactatcgtgatacccatgctgaatcccctgatctacagtctgcgaaataaagaggtaaagaatgcgctgatccgggtcatgcagcggatttggtatgtgctgggtctctag

SEQ ID NO: 44623 - DNA, 939 bp, Artificial Sequence
  Description of Artificial Sequence: Synthetic coding sequence
atgatgggccggcggaacaacaccaacgtggccgacttcatcctgatgggcctcacactgagtgaggagatccagatggccctgttcatgttattccttctgatctacctgatcaccatgttaggaaatgttgggatgatcctgattataagactcgatttacaactccatactcctatgtatttttttctgactcatctcagcttcatagatctgtcctattcaacagtagtcactcctaaaactctggcaaacctactcacttccaattacatatcattcaccgggtgcttcgcacagatgttttttttcgcttttctcgggacagccgagtgttacctcctgtcctctatggcccatgatagatacgcagccatctgtagcccgctgcactatacagttatcatgagcaagcgcctctgcctggcccttattacaggaccctatgttatcggatttatcgactcttttgttaacgtggtctctatgagtcgcctgcatttttacgattccaacgtcatccaccacttcttctgtgacacatccccgatcctggcgctctcctgtaccgatacttataacacagaaatactgattttcatcattgtggggtcaaccctcatggtgagcttgttcaccatatctgcgagttacgtattcatactgtttaccatcctgaaaataaactccacctctggaaaacagaaagccttctccacctgcgtcagtcacctgctcggggtgactatcttttattccacgctgatatttacatatctcaaaccacgcaagagttactccctgggacgcgatcaggttgcctctgtgttctacactattgtgatacctgtcctcaatccactgatatacagtttacgcaataaagaggtgaagaacgctgtgattcgggtgatgcagcgccgacaggacagtcgctag

SEQ ID NO: 44624 - DNA, 939 bp, Artificial Sequence
  Description of Artificial Sequence: Synthetic coding sequence
atgatgggccggcggaacgacaccaacgtggccgacttcatcctgactgggttgagcgattctgaggaggtgcagatggccctgttcatgctgtttttgctgatctatctgattactatgcttggtaatgtgggcatgctcctcattattcgacttgaccttcaactgcacacccctatgtacttctttctgacacacttgtcatttatcgacctatcatacagcaccgttgtgacaccgaaaactctcgcgaatctcctgacctctaactatatcagcttcaccgggtgcttcgctcagatgttctgtttcgtgttccttggaaccgcggagtgctacctcctgtcttccatggcctatgaccgctacgcagctatttgtagtcccctccattataccgtaattatgccgaaacgactgtgcctggctcttatcaccggcccatatgttattgggttcatggatagttttgttaatgtcgtgagcatgtcacgtctgcatttctgtgattcaaacattattcaccactttttttgtgatactagtcccattctggccctctcttgcactgatactgataataccgaaatgctgatctttatcatcgctggttcaaccctgatggtgtctctgatcactattagtgcgtcttatgtctccattttgtccactatcctgaagataaactcaaccagtggcaaacagaaggcattcagcacctgcgtgagtcatcttttgggcgtgaccatattctacggtacaatgattttcacttacctgaaaccgcgcaagtcttacagcctgggccgagaccaagtggcgccagtattctacaccatcgtgatccctatgctcaacccactgatctattcacttaggaatagggaagtgaaaaacgctctgattagagtcatgcaacgacggcaggactcccggtag

SEQ ID NO: 44625 - DNA, 933 bp, Artificial Sequence
  Description of Artificial Sequence: Synthetic coding sequence
atggccggcaacaacttcaccgaggtgaccgtgttcatcctgagcggtttcgccaatcacccagagctacaggtatcactgtttctaatgtttttgtttatttatctttttacagtgctcggaaacctcggccttatcaccctaatcagaatggactcacaactccacactcctatgtacttctttcttagcaatctggcattcatagacatcttttactcttccacagtgacacctaaggcactcgtgaacttccagtctaaccggcgctctattagcttcgtgggctgtttcgtacagatgtacttcttcgtcggattagtgtgttgcgagtgcttcttgctgggaagcatggcttataatcgatatattgccatatgcaatcctttgctatacagcgtggtaatgtcccagaaagtttctaactggctgggagtcatgccttacgtcatcggcttcacatccagcctgatctccgtgtgggtaatatcctccctcgctttctgcgacagctctatcaatcatttcttctgcgataccaccgccttattggccctaagctgcgttgacaccttcgggaccgagatggtaagctttgttctcgctggctttacccttctgtctagcctgctgataatcaccgtgacttatatcataatcatctcagcaatcctgcggatccagagtgcagcaggacggcagaaagcattcagcacatgcgctagccacctaatggcagtgaccatcttctacgggtccctgatttttacctacttgcagcctgataacactagcagcctcacccaggcccaggtcgcctctgtcttttacaccatcgtgatccctatgctgaatcccctgatttacagtttgagaaataaggacgtcaagaacgctcttcttagggtgatacaccggaaactatttccctag

SEQ ID NO: 44626 - DNA, 951 bp, Artificial Sequence
  Description of Artificial Sequence: Synthetic coding sequence
atggcccccgagaacttcacccgggtgaccgagttcatcctgaccggggtgtcctcttgccccgagcttcaaattcctctgttcctcgtgtttctcgtgttgtacgggttgaccatggctggaaatttgggaataataactctgacctcagtggactcccgtctccagacccctatgtatttttttttacagcaccttgcactaattaatctggggaacagtactgtgattgcccccaagatgcttatcaacttcctggtaaaaaaaaagactacttccttttacgaatgcgccacacagctgggcggattcctgttctttatcgtgtcagaagtgattatgcttgccttgatggcttatgataggtacgtcgccatttgtaaccccctcctgtacatggtggtcgtctccaggcgactgtgcttactgttagtaagccttacgtatctgtacggatttagtacggcgatagtcgtatctagctatgtcttcagtgtgagctattgttcgtccaatatcattaatcatttttattgcgataatgtgcccctgcttgcactcagctgcagtgatacttaccttcccgaaaccgtcgtgtttataagcgccgccaccaatgtggtgggcagcctgatcatcgtgctcgtgagttacttcaatattgtcctgagcattctcaaaatttgtagtagcgaggggcgcaaaaaagccttcagcacatgtgctagccacatgatggccgtaactatattttatggcaccctcctcttcatgtatgtgcagccccggtccaatcatagcctggatacggatgacaagatggccagcgtcttctatacactggtgatacccatgctgaatccgctaatatatagcctgcgcaataaagatgttaagaccgcactgcagcgctttatgacaaacctgtgttattcctttaagactatgtag

SEQ ID NO: 44627 - DNA, 948 bp, Artificial Sequence
  Description of Artificial Sequence: Synthetic coding sequence
atggcccccgagaacttcacccgggtgaccgagttcatcctgaccggtgtgtcatcctgcccggaactgcagatccccctttttctggtgttcctggtgttgtacgtgctaaccatggctgggaatcttggcattataacactaacttctgtggacagcagactacagaatccaatgtatttcttcttgagacacctggccatcatcaaccttgggaatagtactgtcattgccccaaagatgctgatgaactttcttgtgaagaagaaaacaacctccttttacgaatgtgcgactcagctcggtggcttcctttttttcattgtcagcgaagtcatgatgttagcagttatggcttacgacagatatgtggctatctgcaacccattgctctatatggttgtcgtgtctcgacggctgtgtctactccttgtgagcctcacctatctgtacggtttcagcacagctattgtagtctccccctgtatcttctctgtaagttattgcagcagtaatatcataaaccacttctattgtgatattgccccgctccttgctttgtcatgctccgatacctacattccagaaactatagtttttatctcggcagccactaacctggtcttcagcatgataacagtcctggtttcctatttcaatatcgttctgagtatcctgcgcatcagatcacccgagggtagaaagaaggccttcagcacctgtgccagtcacatgattgctgtaacggtgttttatggaaccatgctctttatgtatttacaaccccagaccaaccattcactggatacagacaagatggcctccgttttctatacactggtgattcccatgctgaaccctttgatttactccctgaggaataatgacgtcaatgtggccttaaagaagtttatggagaatccgtgttactcatttaagtcgatgtag

SEQ ID NO: 44628 - DNA, 960 bp, Artificial Sequence
  Description of Artificial Sequence: Synthetic coding sequence
atgaaccacgtggtgaagcacaaccacaccgccgtgaccaaggtgactgagttcatccttatgggcattaccgataaccccggactccaggcgccgctgttcgggctgttcttaattatatatctggttacagtcattggcaaccttggaatggtgatcctcacatacctagatagcaagctgcacaccccaatgtacttcttcctccgccatcttagcatcactgacttggggtactctacagtaattgcccctaagatgctggtaaatttcatcgtccataagaataccatcagttacaattggtacgctactcaactggcgtttttcgagatctttataataagcgaactatttatactgtctgcgatggcgtacgataggtacgtcgccatctgtaagccccttttatatgttattatcatggcggaaaaagtcttgtgggttctggtaattgtaccatacctgtacagtacctttgttagcttattcctcaccattaagctgtttaaactgtcattctgcggctccaatatcatcagttacttctactgtgactgcatcccacttatgtctattttgtgcagtgatacaaatgaattggaactaatcattcttatcttctccgggtgcaaccttctgttctcactttctatcgtcttaatctcgtacatgttcattctggtggccatccttagaatgaatagtagaaaaggccggtacaaagctttctcgacatgttcatctcacctgactgttgtgatcatgttttatgggactcttctgtttatttatctgcagccaaagtcttcccacacgctggcaatcgacaagatggcgtccgtcttctacaccctacttatcccaatgttgaacccgttgatatatagcctccggaacaaagaagtgaaagatgcacttaaaaggacgcttaccaataggttcaaaatcccaatttag

SEQ ID NO: 44629 - DNA, 939 bp, Artificial Sequence
  Description of Artificial Sequence: Synthetic coding sequence
atggagcagcacaacctgaccaccgtgaacgagttcatcctgaccggcatcactgacatagctgagcttcaggcgccgctcttcgccttgttcctaatgatctacgtaatctccgtgatggggaacttgggaatgattgtgctaacaaaactggatagtcgccttcaaacacctatgtacttcttcctgagacatctggcctttatggacttgggatattctacaacggtgggaccaaaaatgcttgtgaatttcgtggtggataagaatataatctcctactacttctgtgctacacaattggctttcttcctggtgttcattggctccgagctgtttattctgtctgctatgtcctacgatctgtacgtggccatttgtaatccgctgctttacaccgtcattatgtcgaggagagtatgtcaagtactggtggccattccatacctgtactgcaccttcatatccctgttggttaccataaaaatctttacactgtcattttgcggttataatgttattagccacttctattgcgattctctcccactcctgcccctgttatgttcgaatacccatgaaatagagctcattatacttatcttcgccgcgatcgatctgatctcctcacttcttatagtgctactgtcatacctcttaatacttgtggccattctccgaatgaactcagcgggccggcagaaggcattctccacgtgtggggcccatctgaccgtcgttattgtcttctatggcacactactgtttatgtacgttcagcccaagtcttcacactcattcgataccgacaaggtggccagtatcttttacacactggttattcctatgctcaatcccctcatatactccttaaggaataaagacgtgaagtacgcactcaggcggacttggaacaacttgtgcaacatctttgtatag

SEQ ID NO: 44630 - DNA, 924 bp, Artificial Sequence
  Description of Artificial Sequence: Synthetic coding sequence
atgggccagcacaacctgaccgtgctgaccgagttcatcctgatggaattgacccgacgaccggagctccaaattccactgtttggtgtgttcttggtgatctatcttatcacagtggtgggaaacttgacaatgatcatactgaccaagctcgattcccacctgcataccccaatgtatttcagcattagacaccttgctttcgttgatttggggaattctacagtcatctgcccgaaagtcctggcaaattttgtggtcgatcggaatactatctcctactatgcttgtgctgcccagctggcgttcttcctgatgtttatcatctccgaattctttatactcagtgcaatggcttacgaccgatatgtggctatctgcaatcccctgctgtattacgtgatcatgagccaacggctgtgccacgtgctggttggtatccagtatttatattccacgtttcaggcgttgatgtttaccatcaagatctttactctgacattttgtggttctaacgttatttcccacttctactgtgatgacgtgccactcctgccaatgctgtgtagcaacgcacaggagatagagctgttatcaatcttgttcagcgtgtttaacctgatcagttcttttctgatcgtgctggtgtcctacatgttgattctgctggccatctgccaaatgcatagcgccgaagggcgaaagaaagccttctcaacatgcgggtcacacctgaccgttgtggtagtattctacgggagcctcctgttcatgtatatgcagcctaacagcactcacttctttgataccgataaaatggccagcgtattctatacactggtcattccgatgctcaatcctttaatctacagcttacgcaatgaggaggtcaagaacgcattttataaattgttcgagaattag

SEQ ID NO: 44631 - DNA, 1080 bp, Artificial Sequence
  Description of Artificial Sequence: Synthetic coding sequence
atggccctgggcaaccacagcaccatcaccgagttcctgctgctgggactgagcgctgacccaaacatcagggccctgctgtttgttctgttccttggcatctacctgctgactattatggagaatctgatgcttctcctgatgataagggccgacagttgccttcataaaccaatgtatttcttcttgtctcatctttcatttgtggacctttgtttctcaagtgtcatcgtcccgaaaatgctggagaaccttctaagccagcgaaagactatttcggttgaggggtgcttagcccaggttttttttgtcttcgtaactgcgggaacagaggcttgtctgctgtcaggaatggcttatgacaggcacgccgccatctgcaggcctctgctgtacggccagattatgggcaagcagctctatatgcacttagtttggggaagctggggacttggttttctggacgccctgattaatgttctgctggcagtgaatatggttttttgtgaggcaaagatcatccatcactattcctacgaaatgccctcactgctgccactgagctgcagtgatatctcgcggagcctgatagcattgctatgctctaccctcctccatggcctgggcaactttctgctggtcttcctatcgtatacgcgaatcataagtacaatcctcagcatctctagtacatccggccggagcaaagcattctcgacttgttctgcacacctgaccgctgtcacactgtactacggaagcggcctcctccgccacctcatgcccaatagcggttcccctattgagttgattttttccgtccagtatacagtagtaaccccgatgctcaatagcttgatttatagtctcaagaataaggaagtcaagggtgagcggagtttaagagattctagtcacctgccacaactgcacaaaggccaggccaggtggaagaggccagccttcactgaaggcagaagggagcccggccatcccgagttgtcgattccagtcaccccccagccccagggagcctgtgcctgttccgctctaagagctgccccaaccgcactcccatag

SEQ ID NO: 44632 - DNA, 930 bp, Artificial Sequence
  Description of Artificial Sequence: Synthetic coding sequence
atggcccacatcaactgcacccaggccaccgagttcatcctggtgggacttacagatcatcaggaactcaaaatgccactgtttgtgctgttcctaagcatttatctgttcacagtagtgggcaatctcggtctgatattgctgattcgcgccgatacatctctgaacacaccaatgtactttttccttagtaacttagcatttgtggacttttgctactccagcgtaataacacctaagatgctcgggaattttctttataagcagaatgtgattagttttgatgcttgcgccacgcagctgggttgctttcttactttcatgattagcgagtcccttcttctggccagtatggcatatgataggtacgttgcgatctgcaaccccctcctttacatggttgtgatgacacctggcatctgtatccagctcgtggccgtaccctattcttattcctttttaatggcgctttttcacaccattctcactttccggctgagctattgccactcgaacattgtgaaccacttttattgtgacgacatgcctttactcaggcttacttgttcagacactaggttcaagcagctttggatttttgcatgcgcaggcattatgtttatctccagtctgcttattgtcttcgtcagctatatgttcattatctctgctatcctgcgaatgcattctgcagaagggcggcaaaaagccttttccacttgcggttctcatatgctcgcggtaactattttctatgggactctcatatttatgtatctccaaccaagttcctctcatgcgctggacaccgacaaaatggcctctgttttttatactgtgataatccccatgctcaatccccttatttacagcttgcaaaataaggaggtaaaggaggcgctgaaaaagataatcataaacaagaactag

SEQ ID NO: 44633 - DNA, 933 bp, Artificial Sequence
  Description of Artificial Sequence: Synthetic coding sequence
atgatggacaaccacagcagcgccaccgagttccacctgctgggcttcccgggttcccagggcttgcaccatatcctgtttgccattttcttttttttttacttggtgaccctgatggggaacaccgtgattattgtgatcgtctgcgtcgataagcgcttacagagccccatgtactttttcctgtcccatctttccacacttgaaattcttgtcacgacaattatagtgcctatgatgctctggggacttctgttcttgggttgccgccagtatctgtcattgcacgtgtcgttgaacttttcgtgtggaactatggagtttgctctcttaggagtgatggctgtggatcgctatgtggccgtgtgcaatcccctgcgatataacataattatgaatagttccacctgtatatgggtagtaatcgtctcttgggtatttggcttcctaagcgaaatttggcccatttatgccactttccagtttacgtttcgaaagtctaactcgttagatcacttttattgcgaccgaggacagcttctcaagctctcttgtgataacactctcctcaccgagttcatcctgttcctaatggctgttttcattctgattggcagcctcattccaaccatagtgagttacacatacataatttcaaccatcctgaagattcctagtgccagtggaaggcgcaaggctttttccaccttcgcaagccacttcacttgtgtcgtgatagggtatggatcgtgccttttcttatatgttaagcccaagcaaacacagggcgtcgaatacaacaaaattgtgtcactcctggtaagcgtcttaacacctttcctgaaccctttcattttcactttgagaaatgataaggtgaaagaggctctccgcgacgggatgaaaagatgttgtcaactgttgaaagattag

SEQ ID NO: 44634 - DNA, 945 bp, Artificial Sequence
  Description of Artificial Sequence: Synthetic coding sequence
atgctgatgaactacagcagcgccaccgagttctacctgctgggctttcctggcagcgaggagcttcaccacatccttttcgctatcttcttctttttttatttagtgaccctgatggggaatactgtcatcattatgatcgtctgtgtggataagagactacagagcccgatgtactttttcctcgggcatttgtccgccctggaaattctggtgactacaatcattgttccagtgatgctctggggcctgctgctgcctgggatgcagacaatttacctgtctgcatgcgtcgtgcagctttttctgtatttggccgtggggactaccgagttcgctctactcggagccatggccgtggaccggtacgtagctgtgtgcaatccgctgaggtacaacatcatcatgaaccgacatacgtgcaatttcgtcgtgttagtcagttgggtgtttggtttcctgtttcaaatctggccagtgtacgtaatgtttcaactgacgtattgcaaaagtaacgtagttaataatttcttctgtgaccgaggccagctcctgaaactgtcttgtaacaacactctgttcacagaatttatattgtttctgatggccgtttttgtcttgttcgggtctctgatcccaaccatcgttagtaatgcatacattatcagtaccatcctaaaaataccgtcatcttcaggaagaaggaagagcttcagtacatgtgcgagccactttacttgtgtggtgattggctacgggtcctgcctatttctgtatgtcaaaccaaagcagacacaggcagctgattacaattgggtcgtaagccttatggtctctgtggtcacccccttcctcaatccgtttatttttacactgagaaacgataaggtcatcgaggccttgagggacggagtaaaacggtgttgtcagctgttccggaactag

SEQ ID NO: 44635 - DNA, 918 bp, Artificial Sequence
  Description of Artificial Sequence: Synthetic coding sequence
atgcagcggagcaaccacaccgtgaccgagttcatcctgctgggctttacgactgaccctggcatgcagcttgggctgtttgtggtgtttctcggagtctactcactgacagtcgtcggaaattctacactgatcgtcctcatatgtaacgatagctgtctccacaccccaatgtacttcttcaccggcaatctctccttcttagatctgtggtactcttctgtgtatacacctaagattctcgtgacctgtatttccgaagacaaaagtatttcgtttgctggatgcctttgccagttctttttttctgccggacttgcttatagcgagtgttacttgttagctgcagttgcctacgatcgctatgtcgctatctccaaaccgctgttgtatgcgcaggccatgagtattaaactgtgtgcgcttttggtagccgtgtcttactgtggggggttcattaacagttctattatcaccaaaaaaaccttttcattcaacttttgcagagaaaatattatcgatgacttcttttgtgatcttttaccactggtcgagctggcatgcggcgaaaagggtggatataaaattatgatgtactttcttctggcttctaatgttatctgcccagcagttcttatccttgcttcctacttgtttattataacctccgtcctgcggatctctagttccaagggatatctaaaagcatttagtacctgctccagtcacctgactagcgtcactctttactacgggtccatcctgtatatttatgctctgccgaggtcttcttattcgttcgacatggataagatcgtttccaccttctatacggtcgtgttccccatgcttaacctgatgatctactcactgagaaacaaggatgtgaaagaagcattgaaaaagctgctgccatag

SEQ ID NO: 44636 - DNA, 984 bp, Artificial Sequence
  Description of Artificial Sequence: Synthetic coding sequence
atgatcttccccagccacgacagccaggccttcaccagcgtggacatggaggtggggaattgcaccatcctgacggaattcatcctgctgggattcagcgctgatagccaatggcaaccgattctcttcggcgtgtttttaatgctctacctgattacccttagcggcaacatgacgttggttatattaatcagaactgactcacacctccatacgcctatgtatttctttattggcaacctgtctttcctcgatttttggtacacatcggtgtatactcccaagattctcgcttcatgtgtttctgaagacaagaggatttccctcgcgggatgcggagcacagttgtttttctcctgtgttgttgcgtatacagaatgttatctcctggctgccatggcttacgatcgacacgctgccatctgcaatccactgctgtatagcgggaccatgtcaacagctctgtgtactgggttggtcgccggatcttatattggcggctttttgaatgccatcgcacacactgcaaacacttttcgcctgcatttctgtggaaagaacatcatcgatcacttcttctgcgatgccccacctcttgtgaagatgtcgtgtactaacacaagggtgtacgagaaggtgctacttggggttgtgggatttacagttctgtcctctatcctcgctatcctgatctcctacgtgaacatcctgcttgccatcctgagaatccacagtgcaagcggcaggcacaaggccttcagcacctgcgcgtcccatcttatcagtgtgatgctattttatggttcactgctgttcatgtactccaggccctcttcaacttactccctggagcgtgacaaagtggccgctttgttctacacggttattaaccccctcctgaacccactgatttacagccttaggaataaggatatcaaggaggcctttcgcaaggccacgcagaccatccaaccacagacatag

SEQ ID NO: 44637 - DNA, 945 bp, Artificial Sequence
  Description of Artificial Sequence: Synthetic coding sequence
atggccaagaacaacctgacccgggtgaccgagttcatcctgatgggctttatggaccacccgaaattggagattcctttgtttttggtcttcctgtcattctatctggtgacactgctgggaaacgtagggatgattatgctgatccaggtcgatgttaagctgtacacccctatgtacttttttctttctcatctctctctgcttgacgcttgctatacttccgtcatcactcctcagattctggctactcttgcaaccggcaagaccgtgatctcatacggccactgtgcagcacagttctttctgttcaccatatgtgccggcactgagtgtttcttactcgccgtaatggcatatgatagatacgctgcaattaggaacccacttctgtatactgtggcgatgaatcctcgcctctgctggtctctcgtggtcggggcctatgtgtgcggagtgtcgggcgctatactccgaacaacttgtacgtttactctcagtttttgtaaggataaccagattaatttctttttttgtgacctgcccccactgcttaagctagcctgttctgacacagcgaacatcgagattgtaatcatcttttttggcaatttcgtgatactagccaacgctagcgtcatactgatatcctacttgctaatcatcaagacgatactcaaagtaaaatcgagcgggggtagagccaaaactttctcaacatgcgcatcccatattaccgctgttgccctattttttggagccctgatcttcatgtacctgcaatcgggcagtggtaagtcgctcgaggaggataaggtcgtgtccgtgttttatacggtcgtgatcccgatgcttaaccccctcatttatagcctaaggaataaagacgtgaaggacgcattccgcaaagtcgcgagacgcctgcaggtatccctgagcatgtag

SEQ ID NO: 44638 - DNA, 1008 bp, Artificial Sequence
  Description of Artificial Sequence: Synthetic coding sequence
atgctgggcagcaagccccgggtgcacctgtacatcctgccctgcgccagtcaacaggtctcaaccatgggagacaggggtacctccaatcattctgagatgaccgattttattctggccggcttccgcgtgcgacccgaattgcacatcctgctcttcttgttatttcttttcgtctacgccatgattctcctgggcaacgtcgggatgatgaccatcatcatgaccgatcctcgtctgaacacacctatgtactttttcctcggcaacctgagctttatcgacctgttttactcctcagtcatcgagcccaaagccatgatcaatttctggagtgagaataagagtatttccttcgcagggtgcgtagcacagttgttcctattcgcactgctaattgtgacagaaggtttcctactcgctgcaatggcgtacgatcgatttatcgctatatgtaatcccttgctgtacagtgtccagatgtcgaccagactgtgcacccagttggtcgccgggagctatttttgcggttgtatttctagcgtgattcagacatccatgacttttacgctcagcttctgtgcctcaagggccgtcgatcatttttactgtgacagtcgtcctttacagagactctcatgttccgatctcttcatccataggatgatctcctttagcctgagttgtattataatcctgcctacaatcatagttatcatcgtgtcctatatgtacatagtgtccacagtcctcaagattcattcaactgaggggcataagaaagctttcagtacttgttcaagtcacctgggggtggtttccgttctgtacggcgctgtgttcttcatgtatctgaccccagacaggttccccgaattatcaaaggtggctagcctttgttatagcctggtgaccccaatgctgaacccactcatctatagtcttaggaacaaggatgtccaggaggcccttaagaagtttctggaaaaaaaaaacatcatcttgtag

SEQ ID NO: 44639 - DNA, 933 bp, Artificial Sequence
  Description of Artificial Sequence: Synthetic coding sequence
atggccgagatgaacctgaccctggtgaccgagttcctgctgatcgcattcactgaataccccgagtgggcccttccattattcttgttgttcctcttcatgtacctgatcactgtgctgggcaatctggagatgattatcttgatactgatggaccaccagctccacgccccgatgtacttccttttaagccacctggcatttatggatgtgtgttactccagcatcaccgtgccgcaaatgcttgcggtgctgctcgaacatggagcagctctgtcctacaccagatgcgctgctcagttctttctcttcaccttttttggcagcatcgactgctacctgctggcactgatggcctatgatcgctacttagctgtctgccaacccttgctgtacgttactatattgactcagcaggcacgcctttccttagttgccggcgcatacgtcgcgggtttgatttccgcactggtcaggactgtgtcagcttttaccctgtctttctgcggtacatctgagattgacttcattttctgcgacctgccccctcttctcaaactaacgtgcggggagagctacacacaggaggttttgataattatgtttgccatctttgttatccccgcctcaatggtcgttatcctggtcagttacctgtttattattgtggccatcatggggatccctgctgggtcccaggcaaagaccttctccacctgtacatctcatctcaccgctgtaagcctatttttcggaaccctgatcttcatgtatctgcggggaaatagcgatcaatcctctgagaagaaccgtgttgtatcagttctgtacaccgaggtgatacccatgttaaaccctctaatttattctttacgtaacaaagaagtgaaagaagcgcttaggaagatattgaatcgggccaagctgagttag

SEQ ID NO: 44640 - DNA, 945 bp, Artificial Sequence
  Description of Artificial Sequence: Synthetic coding sequence
atggccgagcggaactacaccgtggtgaccgagttcttcctgaccgcctttactgagcacctgcagtggcgtgttcctctgtttctaatctttttgagtttttacctggcaacaatgctggggaatactggcatgattttgttgatcagaggggaccgcagactgcacacccctatgtatttcttcctcagtcacttgtcactggtggacatctgttacagcagcgccattataccacagatgctggcagtcctgtgggaacacggcacgacgatcagtcaggcgaggtgcgctgcgcagttttttctttttacgttcttcgcctctatcgactgctacctgcttgccatcatggcctatgaccggtatacagctgtctgccagcctttgctatacgtgacgatcatcactgagaaagcacgatggggattagtgaccggggcatacgttgccgggtttttctcagccttcgtgaggaccgtcacggcattcacactttcattttgtgggaacaacgagattaatttcatcttttgcgaccttccacctctgttgaagttgagttgcggcgactcttacacccaggaagtagtgataatcgtctttgctctgttcgtgatgccagcttgtatactcgtgattctggtgagctatctgttcattatcgtcgcaattctgcagatacactcagccggcggaagagccaaaactttttctacctgcgcaagccacctaacagcagtggctctgttctttgggaccttgatttttatgtacctgcgcgataataccgggcaatcctccgagggcgaccgggttgtatctgtcctatataccgtggtaacaccaatgttaaacccgctgatctactcacttcggaacaaggaagttaaggaagccactcgaaaagccttatctaaatccaaaccagccagaagaccatag

SEQ ID NO: 44641 - DNA, 426 bp, Artificial Sequence
  Description of Artificial Sequence: Synthetic coding sequence
atgagcttcagcctgaacttcaccctgcccgccaacaccaccagctcccctgtaaccggtggcaaggaaacagattgcgggcccagtctaggattggcagccggcattcctttactggttgctaccgcgctgctggtggccttactatttacccttatccaccgtcgacgttcctcaattgaggccatggaggagagcgatcgaccatgtgagatcagcgaaattgacgataaccctaagatctccgagaatcccaggaggagccccactcacgagaaaaacacaatgggcgcgcaggaggctcacatttacgtaaagacagttgcagggtccgaggagcccgtccacgaccggtatagaccaactattgaaatggagagaaggcgcggtttatggtggctggtgccccggctgagtctcgagtag

SEQ ID NO: 44642 - DNA, 393 bp, Artificial Sequence
  Description of Artificial Sequence: Synthetic coding sequence
atgagcttcagcctgaacttcaccctgcccgccaacaccgactgcggcccctctctcgggcttgccgcaggcattcccctcctagtggcaacagcgttactggttgccctgctttttacactgatacatcgacgcaggtcaagcatcgaggccatggaggaaagcgataggccatgtgagatttcagagatagatgacaatcccaagatatccgagaacccccgacgcagcccaactcacgaaaaaaatacgatgggcgcgcaggaagcacacatctatgtcaaaactgtggccgggagcgaagagccagtgcacgatcggtatcgaccaacaatcgaaatggaaaggcggagaggcctgtggtggctagtgcctcgcctgtccctggaatag

SEQ ID NO: 44643 - DNA, 357 bp, Artificial Sequence
  Description of Artificial Sequence: Synthetic coding sequence
atggactgcggccccagcctgggcctggccgccggcatccccctgctggtggctacggccttgctggtggccctacttttcacgctaatacacagacgaaggagcagtatagaagcaatggaggaaagcgaccgaccctgcgagatcagtgaaatagacgacaatccaaagatttcggagaatcctagacgtagtcccactcatgagaagaataccatgggagcccaggaagcccatatctacgtcaaaactgttgccggatctgaggaacccgtacacgaccggtatcggccaaccatcgaaatggagcgccggagaggcctctggtggctggtgccccgcttgtctttagaatag

SEQ ID NO: 44644 - DNA, 396 bp, Artificial Sequence
  Description of Artificial Sequence: Synthetic coding sequence
atgcggatgaccagcagccccgtgaccggcggcaaggagaccgactgcggaccatcattggggcttgcggccggcattcctctgctggttgccacagcgctacttgttgccctgttattcactctgatccacaggagacggtcatccatagaagcaatggaggagtctgacagaccctgtgagattagcgaaattgacgataatccaaaaatttctgaaaacccacgtagatctcctacacatgaaaagaatacaatgggggcgcaggaagcccatatatatgtcaagactgtcgctggaagcgaagagccggtgcacgaccgctacaggcctaccattgagatggagcgacggcgcgggctctggtggcttgtgccgcggctctcattggaatag

SEQ ID NO: 44645 - DNA, 396 bp, Artificial Sequence
  Description of Artificial Sequence: Synthetic coding sequence
atgcggatgaccagcagccccgtgaccggcggcaaggagaccgactgcggcccatccttgggcctggcagcagggattcctctcctggtggccaccgccctgttagtggctctcttgttcactctgatccacagacgcaggtcctctatcgaagccatggaggagtctgatcggccatgtgagattagtgaaattgacgacaatcctaagataagtgagaacccacggcgcagccccacacacgaaaagaataccatgggggctcaagaagcgcacatttacgtgaaaacagtggctggcagcgaagagcccgttcacgaccgctatcgccccaccattgaaatggagcgtaggaggggtctttggtggctggtgccaagactctccttagagtag

SEQ ID NO: 44646 - DNA, 450 bp, Artificial Sequence
  Description of Artificial Sequence: Synthetic coding sequence
atggagaccctgtaccgggtgcccttcctggtgctggagtgccccaacttaaagctgaagaagccaccctggttgcacatgccaagcgcgatgacagtttatgcactggtggtggtatcatactttctcatcactggggggatcatctacgatgttatcgtggagccccccagcgtgggctcaatgaccgacgagcatggtcaccagcggcctgtggcattcctcgcctatagagtgaatggacagtatataatggaaggtctggctagcagcttcctgttcacaatggggggactgggattcatcatactcgatcgatccaacgccccaaacataccaaagcttaaccgctttctgttgctgtttatcgggtttgtctgcgtgctgctgtccttctttatggcccgagtcttcatgagaatgaaactccctggctaccttatgggttag

SEQ ID NO: 44647 - DNA, 516 bp, Artificial Sequence
  Description of Artificial Sequence: Synthetic coding sequence
atggagaccctgtaccgggtgcccttcctggtgctggagtgccccaatctgaaactaaagaagcccccgtggctccacatgccctctgctatgacagtctatgctttggtggtggtgagctatttcctgattaccggcggcatcatctacgatgtgatcgtggagcccccgtcagtaggaagtatgacagacgaacatggacaccagcgccccgtagctttcctggcgtaccgagtgaacggccagtacattatggagggtctggctagcagctttctcttcaccatgggtggactcggtttcatcattctggaccgttctaacgcacccaacattccaaagctaaaccgcttcttactccttttcattggcttcgtctgcgtactgttatctttttttatggcaagggtatttatgagaatgaagctgccaaggtccctggctctcttaccgaggttagaatgctcaggcgtaatatccgctcactacaagctctgtctgcctggggccatctag

SEQ ID NO: 44648 - DNA, 1461 bp, Artificial Sequence
  Description of Artificial Sequence: Synthetic coding sequence
atgagcttcatctgcggcctgcagagcgccgcccggaaccacgtgttttttagatttaattctctatccaattggagaaaatgcaacacccttgcgtcaacgtccaggggctgtcaccaggtccaggtgaaccacatagtgaacaagtaccagggactcggagtgaatcaatgcgatagatggagcttcctgcccgggaatttccacttctactcaactttcaataacaaacggacggggggcctgtcctccacaaaaagcaaagaaatttggagaatcacctctaagtgtacagtatggaacgacgcctttagccggcagctgctgatcaaggaggtgacagctgtgcctagtctgagcgtgcttcatccactatcgcctgcttcaattcgtgccataaggaactttcacacatcaccgaggttccaggccgcgcctgtgcccctgttgctgatgattctgaagcctgttcagaagctattcgccattatcgtggggcgcggtatcaggaaatggtggcaggccttaccacctaataaaaaagaagtggttaaggaaaatatccggaagaataagtggaagctgttcttagggttgagttcctttgggctgttgttcgtggtgttctatttcacacacctggaagtgtcaccgatcacagggcgaagtaaattactcctcctgggcaaagaacagttcagactgctgtccgagctcgaatatgaagcttggatggaagaattcaaaaacgatatgctcacagaaaaagacgctcgttacctggcagtgaaagaggttctgtgtcatcttatcgagtgcaataaggatgttccgggcatctcacagattaattgggtgatccacgttgtggattcacctatcatcaacgcctttgtcctaccgaacggtcagatgttcgtgtttaccggctttctaaatagcgtcacggacattcaccagctctcttttctattgggccacgaaatcgctcacgcagtgttggggcatgcagcggagaaagccgggatggtccacctgttagactttctaggaatgatcttcctcaccatgatatgggctatttgcccaagagattccctcgcccttctctgccagtggatccagtctaaactccaagagtacatgttcaatagaccctattcacggaagctggaggccgaggccgataagatcggcctgctgctggctgccaaggcctgcgctgatattagggcgtcatctgtgttttggcagcagatggaatttgtggacagtcttcatgggcaacctaagatgcctgagtggctgagcacccacccctcccatggcaatcgggtcgagtatctagaccggctaattccacagctggtcagagaagagaaatttatcgagcaacctgagcaaattgcggaactcaccctcaattctttcatacaaaacacagagatttgccgatcttag

SEQ ID NO: 44649 - DNA, 1575 bp, Artificial Sequence
  Description of Artificial Sequence: Synthetic coding sequence
atgagcttcatctgcggcctgcagagcgccgcccggaaccacgtgttctttaggttcaattccctgagcaattggcgcaagtgtaacaccctggcctcaactagcagaggttgccaccaagtacaggttaaccacattgtgaacaagtaccaaggcttaggtgttaaccaatgcgatcggtggtctttcctgcctgggaacttccatttctattctacttttaacaacaagaggacagggggcctgagtagtacgaagtctaaagaaatttggcggatcacttccaagtgcacagtgtggaatgatgcatttagcaggcagctgctgatcaaggaagtgaccgcggttccctccttatctgtgctacatcccctgtctccagcatccatcagggccatacggaatttccacacctcaccaaggtttcaggcagcccccgtacccctgttgctgatgattttaaaaccggtccagaagctgttcgcgattattgtgggccgaggcattcgcaagtggtggcaggcgttgccccctaataaaaaagaggtggtcaaggagaacattcgcaaaaacaaatggaaactgtttctcgggctgtcctccttcggtcttctttttgtggtgttctatttcacacacttggaggtgagccctatcacaggaaggagtaaactactgcttctgggcaaggaacaattcaggcttctctccgagctggaatacgaagcctggatggaagagtttaaaaatgatatgctgactgaaaaagatgctcgatatctagccgtaaaagaagtgctgtgtcatcttatcgagtgcaacaaagatgtccctggcatttctcagatcaactgggtaatccacgttgtggattcaccaattatcaacgcctttgtcctaccgaatggccagatgttcgtgtttactggattcctcaacagcgtaaccgatatccaccagctaagctttctgctgggccatgaaatagctcacgccgtactggggcatgccgcggaaaaggcaggaatggtgcacctgctggactttcttggaatgatattcctgaccatgatttgggctatctgcccacgagactcgctcgctctgctgtgccaatggatccagagcaagctgcaagaatatatgttcaaccggccatactccagaaaattggaagctgaggccgacaaaattggtcttcttcttgctgcaaaggcttgtgccgatatcagagcaagctccgtattctggcagcagatggagttcgtggacagccttcacggacagcccaaaatgcctgaatggctgagcacacaccctagccacgggaacagggtggaatatttggaccgcctcatcccacaggccctcaagatccgagagatgtgcaactgtccacccctgtccaatccggatccgcggctgctgttcaaactcagcaccaagcatttcctcgaagagtctgagaaagaagatctgaatataaccaaaaagcagaagatggatacattacccatccagaaacaagagcagattccactgacctatattgtggaaaagagaacaggctcatag

SEQ ID NO: 44650 - DNA, 768 bp, Artificial Sequence
  Description of Artificial Sequence: Synthetic coding sequence
atgagcttcatctgcggcctgcagagcgccgcccggaaccacgtgttctttcggttcaattccctctcgaattggcgaaaatgcaacacactcgcgagtacatcccgggggtgccaccaagtacaggtcaatcacattgtaaataagtaccaaggtcttggggttaatcagtgtgataggtggagttttctacctgggaacttccatttctacagtactttcaacaataagcgtaccggtggcttgtcatcgactaagtccaaagagatttggcggattacgtccaaatgcaccgtgtggaacgacgccttttctcgtcagctgttaataaaggaggtgacagcggtaccaagtttgtcagtccttcaccccctaagcccagcatccatcagggccatccgtaacttccataccagtccaaggttccaagccgcgccagtgcccctgctgttaatgattctaaaacctgtgcagaagctctttgcaattattgtgggtaggggcattcggaagtggtggcaggctttgccccctaacaaaaaggaggtggttaaagaaaatattagaaaaaacaaatggaaattatttctgggacttagctccttcggactgttgtttgtggtattctattttacacatctggaagtttctccaattacaggccgttctaagttgctgctcctgggaaaggaacagttcaggctgctgtcagagctcgagtatgaggcatggatggaggagttcaaaaatgacatgctgacagagtag

SEQ ID NO: 44651 - DNA, 987 bp, Artificial Sequence
  Description of Artificial Sequence: Synthetic coding sequence
tgactgttcgccatcatcgtgggccggggcatccggaagtggtggcaagctctcccaccgaataagaaggaagtggtcaaagaaaatattagaaaaaataaatggaaactgtttctcggcctctccagtttcggattgttattcgtggtgttttacttcactcacctcgaggtttctcctatcaccggccgttctaaactcctgttacttggtaaggaacagttccgcctgttatccgagctggagtacgaggcttggatggaggaatttaagaacgatatgcttaccgagaaagatgcccgatacctggcggtcaaggaagttctatgccatctgattgagtgcaataaggatgtgcccggaatctcacaaattaactgggtcattcacgtggttgactctcccatcatcaacgccttcgttctgccgaacggccagatgttcgtttttacggggtttctcaatagcgtgaccgatattcaccagctgagttttctgcttggacatgagattgctcacgccgtgctcggtcacgcagccgagaaagcaggcatggtacatctgctggattttctagggatgatctttctgactatgatttgggctatctgccctagagattcgttggcacttttgtgccaatggatccaaagcaagctgcaggagtacatgttcaataggccatacagcaggaagctggaagccgaggccgacaaaatcggtctgcttctggcagccaaggcatgcgccgatataagagcatccagcgtattttggcagcaaatggaatttgtcgattcactgcatgggcaaccaaagatgcccgaatggttgagcacccatccatcacacggcaatcgggtggagtatctcgaccggctgattcctcagctggtgcgggaagagaaatttattgagcaacctgagcagattgccgaactcacgctgaacagtttcatccagaacacagagatatgcaggtcctag

SEQ ID NO: 44652 - DNA, 762 bp, Artificial Sequence
  Description of Artificial Sequence: Synthetic coding sequence
atgagcttcatctgcggcctgcagagcgccgcccggaaccacgtgttctttcggttcaactctctgagcaattggcgtaaatgtaatactcttgcaagcacatctcgaggctgccaccaggtgcaagtgaatcatattgtcaataagtatcaagggttgggcgtgaatcagtgtgacaggtggtcttttttgcctgggaattttcacttttattccacatttaataataagcgcacgggcggcctaagcagcacaaaatccaaggagatttggcgcataacatctaagtgcacggtgtggaatgatgccttttcacgccaattgctcattaaggaagtcaccgctgtcccatctcttagtgtgctgcatcccctgagccctgcttctataagagccatcagaaattttcacacgtcaccgcgcttccaggccgcccctgtccctcttcttcttatgatcctgaagccagtgcagaagcttttcgcgatcattgttggacggggcattaggaaatggtggcaggctctgcccccaaacaagaaagaggtcgtcaaggagaatattagaaaaaataagtggaaactgtttttgggcctgtctagcttcgggctgctatttgtggtgttctatttcacacatctggaggtgagcccaattacaggacgatcaaagcttcttctgttgggcaaggaacagttcaggctcctctctgagctggagtatgaggcctggatggaggagttcaagaatgacatgctgtag

SEQ ID NO: 44653 - DNA, 555 bp, Artificial Sequence
  Description of Artificial Sequence: Synthetic coding sequence
atgagcttcatctgcggcctgcagagcgccgcccggaaccacgtgttttttcggttcaattcgctcagcaattggaggaagtgcaacactttggcaagcaccagcaggggttgtcaccaggtgcaggtgaaccacatcgtcaacaagtaccaaggcttgggggtgaatcagtgcgataggtggtctttcttgcctggcaatttccatttttactcaactttcaacaacaagaggacgggcggtttatctagtactaaaagtaaggagatctggagaatcacatcaaagtgcactgtgtggaacgacgcgttttctaggcagctcctaatcaaggaggtgacagcagtgccatctctgtccgtgttgcatccactctcccctgcaagcatccgggctattcgcaacttccatacttctcccaggttccaggccgcacctgtgcccctcctcctcatgattctgaagccggtgcagaaactcttcgccattattgttggtcggggtattagaaaatggtggcaggcgctgcctcccaataagaaagaggttgtttag

SEQ ID NO: 44654 - DNA, 981 bp, Artificial Sequence
  Description of Artificial Sequence: Synthetic coding sequence
atgagcttcatctgcggcctgcagagcgccgcccggaaccacgtgttcttcagattcaactccctctccaactggaggaagtgtaacacactggcctcaacttcgcgaggttgtcatcaggttcaggttaatcacatcgttaacaaatatcaggggctgggcgtcaaccaatgtgatcgttggagcttcctgcctgggaacttccacttctactctaccttcaataacaaaaggacagggggtctgtccagcaccaagagtaaggagatatggagaatcacctcaaagtgtaccgtctggaacgatgccttttcccgtcaactactgataaaggaggtgactgcggtgccgagtttatctgtcttgcatccattaagtcccgcaagcatacgcgctattcgtaattttcatacgtctccacggtttcaggccgcacccgtgccccttctgctgatgatcctgaaaccagtgcagaaactattcgcgattattgtaggacggggtattcggaagtggtggcaggctttgccgccgaataagaaggaagtggtgaaggagaacatccggaagaacaaatggaagttgtttctagggctgtcgtctttcggcctgttattcgtggtcttctactttacacacctggaggtctctcctatcactggcagatccaagctcctactgctgggcaaggagcagttcagactgctgtcagagctggaatacgaagcctggatggaggaatttaagaacgatatgctgaccgagaaagacgcaaggtaccttgctgtgaaagaggtgttatgtcacctgatcgaatgtaataaagacgttcccggtatctcccagatcaattgggtaatacacgtggtggacagcccaatcataaacgcattcgtactccccaatggacaaatgtttgtgttcactggcttcttgaacagcgtcaccgacattcatcaacttagtttcctgctgggctag

SEQ ID NO: 44655 - DNA, 1086 bp, Artificial Sequence
  Description of Artificial Sequence: Synthetic coding sequence
atgagccccgagtgcgcccgggccgccggcgacgcccccctgcggtctctggagcaggccaacagaactaggtttccattttttagcgatgttaagggagaccaccggctggtcctggccgccgtggagaccactgtcttggtgttaattttcgctgtgtcgctgctgggtaacgtctgcgcccttgtattagtggcacgccggaggcggcggggggctaccgcctgtttggtgctgaatctgttctgtgccgacctgcttttcataagcgctatacccctggtgttggctgttcggtggacggaggcttggctgcttggtccagtcgcctgtcacctcctgttctacgttatgacactcagcggatcagtgactattctaaccttagcggccgtttcgcttgagcggatggtctgtatcgtgcatcttcagagaggcgtgaggggtcccggcagacgtgcacgtgccgttttgctggcactgatctggggatacagtgccgttgctgcactgcctctgtgcgtattttttagggtggtgccacagcggctacctggtgccgatcaagagatatcaatatgcacattgatttggcccactatacccggtgaaatctcttgggacgtgtcgttcgtcactctgaactttctggttcccggtctcgtgatcgtcataagttattccaagattcttcaaatcactaaggccagccgtaagagacttacagtgagcctggcgtatagcgagtcccatcagattcgcgtgtcgcagcaagactttcggctgttcaggaccctgtttctgctgatggtctcattttttatcatgtggtctccgataatcattacaattctcttgattctgatacagaatttcaaacaggacctggtcatctggccgtcgctgtttttctgggtggtggcgtttacttttgcaaatagcgccctcaacccgatcctctataatatgaccctgtgccgcaacgagtggaagaagatcttttgttgcttctggtttccggagaagggcgctatcctgaccgatacctccgtgaagcggaacgacctgtcaatcatttcgggctag

SEQ ID NO: 44656 - DNA, 1134 bp, Artificial Sequence
  Description of Artificial Sequence: Synthetic coding sequence
atgagccccgagtgcgcccgggccgccggcgacgcccccctgcggtccctggaacaggccaacagaacgcgttttcctttcttttccgacgtgaagggagaccacagattagtgctggcggctgtggagactaccgtgttggtcctcatatttgcagtttcgttgcttgggaatgtctgcgccttggtcttggtggcccggaggagaagaaggggggccacagcttgcctggtacttaatctcttctgtgccgatttgttgtttattagtgctattccgctggttctcgccgtgcgctggacggaggcctggctcttgggccctgtagcgtgtcacctattattttatgtgatgacattatccggctctgtgacaattcttaccctggccgccgtgagtcttgagcgcatggtgtgtattgttcatctgcagaggggtgttcggggccctggccgccgcgcccgcgcagtgctcctggcattaatctggggttattcggccgtcgcagccttgcccttatgtgtgttttttcgcgtcgtgcctcaaaggctgcctggcgcggaccaggaaataagtatctgcaccctcatctggccaacaatccccggggaaatcagttgggacgttagctttgtgaccttgaacttcctggtgccagggctcgtgatagttatctcttacagcaagattctgcaaacctccgaacacctgctcgatgcccgagccgtagtaacacactccgaaatcaccaaggctagtcgtaaaaggctgacagtatcactggcgtacagtgaatcccaccagatcagagttagccagcaggacttccggctgttcagaaccctctttctgctgatggtctcatttttcataatgtggtcacccattatcataactattctgctaatcctgatccagaacttcaagcaggacctcgtgatttggccttctctctttttctgggtagtcgcctttaccttcgccaattccgcactgaaccctatcctatataatatgacactctgtaggaacgaatggaagaagatcttctgttgcttttggttcccagagaagggcgcgatcctaaccgacacctcagtcaagaggaatgatctgtcaatcattagtggctag

SEQ ID NO: 44657 - DNA, 1113 bp, Artificial Sequence
  Description of Artificial Sequence: Synthetic coding sequence
atggagcccctgttccccgcccccttctgggaggtgatctacggctcccacctgcaaggaaatctatcactgctctcaccgaatcacagcctactcccaccccacctcctacttaatgcctcccacggggcttttctgccacttggtttaaaagtgaccattgtgggtctctaccttgccgtttgcgtggggggccttctcggaaactgcttagtcatgtatgtgatcctgagacacacgaaaatgaagaccgccaccaatatctacatttttaacctcgcactggccgacacactcgttttgttgaccttaccttttcaggggaccgacattctgctcgggttttggccttttggaaatgctctctgcaaaacagttatagccatagattactataacatgttcaccagcacttttacgctcacagcaatgtcagttgacaggtacgtggcaatctgccatcctattcgagctctggatgttcgaacgagcagcaaggcacaagccgtgaatgtggccatttgggcgttggctagcgttgtgggggtgccagtcgcgatcatgggctcagcgcaggtggaagacgaggaaattgagtgccttgtcgaaataccgacaccccaggactactgggggccagtgtttgctatttgtattttcctgttttccttcatcgtaccagtgctcgtcatttctgtctgctatagcctgatgatccggcgccttcggggtgtgagattgctgagcgggtcccgtgaaaaagaccggaatcttcgcaggatcactcgtctggtgctagtggtggtcgcggtgtttgtcggatgttggacacctgtgcaagtatttgtgttggcgcagggcctaggcgtacagccctcaagtgaaacagctgtcgcaattctgaggttctgtactgctctgggttacgtgaacagttgcctcaaccccatcctgtacgccttccttgatgagaattttaaggcttgctttaggaagttttgctgcgcgtccgcgttgaggcgtgatgtgcaggtgtccgatcgcgtgcggagcatagccaaagacgttgcgttggcatgtaaaactagcgagacagtgcccaggccagcttag

SEQ ID NO: 44658 - DNA, 1113 bp, Artificial Sequence
  Description of Artificial Sequence: Synthetic coding sequence
atggagcccctgttccccgcccccttctgggaggtgatctacggcagccacctgcagggaaacctctctctactgagtcctaaccacagcctccttccgccccatttgttgttgaacgcaagtcacggcgccttcttacccttgggactgaaagtgactatcgtagggctgtaccttgccgtttgcgttggagggctgctgggtaactgcctcgtgatgtacgtaatcctcaggcacacgaagatgaaaacagcaacaaacatctacatcttcaatcttgccttagcagacaccctcgttctcttgacactgcccttccagggcaccgatatcttgttggggttttggccttttggtaacgctttatgcaagacagtgattgccattgactactacaatatgttcaccagcacattcaccttgaccgcaatgagcgtcgaccgctacgtggctatctgccacccaattagggccctcgacgttaggacaagttctaaggctcaagcagtgaatgtagccatttgggctttagcctctgtggttggggtgccggtggccataatgggtagcgcccaggtcgaagacgaggagatcgagtgccttgtcgaaatccccacccctcaggactactggggaccagttttcgccatatgcatattcctgttctcgttcatcgtaccggttctggtaatcagcgtctgctacagcctgatgattcggagactgagaggcgtcagattattatcaggatcccgagagaaagaccgcaaccttcgacggataacccgactggtactcgtcgtggttgccgtctttgtggggtgctggactccagtgcaggtgtttgtgctggcccagggcctgggagtgcagccgtcgtcagagacagcagtcgccattctacggttctgcaccgctttggggtacgtgaactcctgcctgaatccaatcttatacgcctttctggatgagaatttcaaggcctgcttccggaagttttgttgcgcaagcgctttaaggagagatgtccaagtatccgaccgcgttcgaagcatcgccaaggatgtggccttagcctgcaaaacgagtgaaaccgtacctaggccggcttag

SEQ ID NO: 44659 - DNA, 1113 bp, Artificial Sequence
  Description of Artificial Sequence: Synthetic coding sequence
atggagcccctgttccccgcccccttctgggaggtgatctacggcagtcacctgcagggaaacctgagcctgctcagccctaaccattctctcctgccacctcaccttttgctgaacgccagtcacggcgcctttctgccccttggtttgaaggtcacaattgtggggctatacctggccgtgtgtgttgggggtcttctgggaaattgcctagtcatgtacgttatcttgaggcataccaaaatgaagacagcaaccaacatatacatctttaatcttgccctcgcagatacattagtactgttaactttaccattccagggaacagacatcctgctgggattctggcctttcgggaacgcgctttgcaaaaccgtgattgcaatagattattacaacatgtttacctcgacctttaccctgacagccatgtctgtggaccgttatgtggcaatttgtcatcctattagagccctggacgtgaggaccagctccaaagctcaggcagtcaacgtggcgatctgggcgctggcttctgtagtgggcgttcctgtggctataatgggatcagcacaagtagaggatgaggaaattgaatgtctcgtggagattcctactcctcaggactactgggggccagtgttcgccatatgtatatttcttttttcttttatcgtccctgtcctggtcatttcagtctgttacagtctgatgatcagacgcctgcgtggcgtccggctgctgtcaggaagcagggagaaagacagaaatttgcggagaattacccgactcgtgctggtcgtcgtcgctgtgtttgtcggctgttggacacctgtgcaggttttcgttttggctcagggactgggagttcagcctagcagcgagacagccgtggccatcctgagattttgcacagcacttggctacgtcaattcctgtctgaacccgatactgtatgccttcctggatgagaatttcaaagcctgttttcgtaaattttgctgcgccagcgctttgaggagagatgtgcaagtgtctgatcgggtgcggtccatcgcaaaggacgtagctttagcatgtaagacctctgagaccgtcccgcgccccgcctag

SEQ ID NO: 44660 - DNA, 495 bp, Artificial Sequence
  Description of Artificial Sequence: Synthetic coding sequence
atcaccggcctgtggagcctggccatcatcagctgggagcggtggctggtcgtgtgcaagcccttcggtaacgtgaggtttgacgcgaaactggctattgttggcatcgctttttcatggatctggtccgccgtctggacagcacctcctattttcgggtggtctagatattggcctcacgggctgaagacttcttgcggccccgacgtgttttccggctctagttacccaggcgttcaatcgtacatgattgttctgatggttacctgttgtatcatcccactggccattattatgctttgttatctgcaagtttggctcgccatccgggccgtcgctaagcagcaaaaggaatccgaatcaacacagaaagctgaaaaggagtttcgcaactgtattctgcaactcttcggtaaaaaggtcgacgatgggtctgagctgagcagtgcctcaaaaacagaagtgtcctctgtcagcagcgtgagtccagcctag

SEQ ID NO: 44661 - DNA, 1095 bp, Artificial Sequence
  Description of Artificial Sequence: Synthetic coding sequence
atggcccagcagtggagcctgcagcggctggccggccggcacccccaggattcctatgaggattcaacccagagcagtatctttacctacacaaattccaattccactcggggaccttttgaggggccaaactaccatattgcaccccgatgggtttaccacctaacaagtgtatggatgatttttgtggttatcgcaagcgtgttcactaacggtttggtgctggcagctaccatgaagtttaagaagcttcgccatccactcaattggattttggttaatctagccgtcgcagaccttgcagaaacagtgatcgcttctaccatcagcgtagtgaaccaggtatatgggtatttcgtcctgggtcatccgatgtgtgtgctggaggggtacacagtgagcctctgtgggatcacggggctgtggagcctggctattatttcctgggagaggtggatggttgtctgcaaacctttcggtaacgttagatttgatgccaaactggctatcgttggcatcgcattcagttggatatgggccgccgtgtggaccgccccccccatcttcggctggtcccgttactggcctcatggcctcaaaacaagctgtggacccgatgtattcagcggctcctcctaccccggtgtacagtcctacatgatagtattgatggtgacctgttgcatcactcctttgtcaatcatcgtgctatgctacctgcaggtatggcttgctatcagagcagtggctaagcagcaaaaagagagcgagagcactcagaaagccgagaaggaagtcacacgaatggtagtggtcatggtgctcgcattctgcttctgctggggtccctacgcattctttgcttgctttgcggcagccaacccaggttaccccttccaccccttgatggccgcacttcctgcattctttgcaaagagtgctacaatctacaaccccgtgatttatgtgtttatgaatcgacaatttcggaactgtattctgcagctttttgggaagaaggtcgatgacggaagcgagttaagttctgcctctaagactgaagtgagctctgtgagctccgtgagcccggcctag

SEQ ID NO: 44662 - DNA, 1437 bp, Artificial Sequence
  Description of Artificial Sequence: Synthetic coding sequence
atgaacccccccagcggcccccgggtgccccccagccccacccaggaaccatcctgcatggctactcctgcccctcctagctggtgggattcctcccaatcaagcatcagcagcctgggccgcctcccatccatcagcccaaccgcccccggcacgtgggcagctgcatgggtccccctccccaccgtagacgtgccggaccatgcacactacactctcggaacagttatcttgctggtgggtctgacgggaatgttgggaaacctgacagtgatctatactttttgcagatcacgatctctgcggacccccgccaatatgtttatcattaatcttgccgtctctgactttctgatgagcttcacacaggcccctgtgttttttacgtccagcctgtacaaacagtggctgtttggggagactgggtgcgaattctacgctttttgtggggcactgtttggcatcagctcaatgattacactaactgccatcgccttagataggtatctggtcataacgcgacctctagccaccttcggcgtggcttccaaacgccgggccgccttcgtgctcctgggcgtttggctgtatgctctagcctggtcactgcctccattctttgggtggagcgcttatgtcccagagggtctgctgacttcttgttcttgggactacatgtctttcacaccggcagtccgggcttatacgatgctgctgtgctgcttcgtcttctttctgccactccttataattatttattgttacatcttcattttccgagccattagagagacaggacgcgctctgcagacatttggcgcctgtaagggcaacggtgagagcctgtggcagcgccaaaggcttcagagcgaatgtaagatggctaagatcatgctgctcgtgattttgctgtttgtcctctcctgggctccatatagcgccgtggcattggtggcattcgccggatacgcccacgtgctgacaccgtatatgtctagtgtgcccgccgtaatcgccaaagcatcggccatccacaatcccataatatacgccataacgcatcccaaatatcgggttgctattgcgcagcatctgccctgcttgggagtcctactgggggtctctagaaggcatagcagaccctacccgtcgtaccggtcaacacatcgcagtactttaaccagccacacatccaatttgtcatggatttccatcagacggaggcaggaatctttaggatccgaaagcgaggttgggtggacgcacatggaggccgcagcggtctggggagctgctcagcaggctaacggaagatccctgtatggccagggactggaagacttggaagccaaggcccccccccgtccacagggccacgaggcagaaacgcccggcaagacgaagggactgataccttcacaagatccccgcatgtag

SEQ ID NO: 44663 - DNA, 1470 bp, Artificial Sequence
  Description of Artificial Sequence: Synthetic coding sequence
atgaacccccccagcggcccccgggtgccccccagccccacccaggaacctagctgtatggccaccccagccccgccaagctggtgggattccagtcaatcgtccatttcctcccttggtcggttgcccagcatctctcctactgcccctggtacgtgggccgctgcctgggtcccacttcctactgttgatgtgcctgatcatgcacattacactctggggacagtgatcctgcttgttggtcttacaggcatgctggggaacttgactgtcatctataccttctgccgtgccgttctcagaggggtcactgtgatgatgcagtctcggtcgttaagaacaccggctaatatgttcatcattaatttggccgtcagcgacttccttatgtcctttacccaggctcctgtattctttacgtcaagcctctacaagcagtggctctttggagagacaggttgcgaattttatgccttctgtggagcactgtttggtatttcttcgatgataactctgactgcgatcgctttagacagatacctcgtgatcacccgacccttagccactttcggtgtcgcatcaaaacgccgcgccgccttcgtcctcctcggggtgtggctgtacgccttggcctggtcactgcctcctttctttgggtggagcgcctacgtgcccgagggactgcttaccagttgttcttgggactatatgagtttcacgcccgccgtaagggcttataccatgttgctttgctgcttcgtgtttttcctgcccctgttgataataatttactgctatatattcatattcagagcaatcagggagactggccgcgccttgcaaacctttggagcatgcaagggcaacggtgagagtctatggcagcgtcaacggttgcagtccgagtgcaagatggccaagatcatgctacttgtgatcctactgttcgtgctctcttgggctccctatagcgcagttgctctggtcgcattcgccggttacgcccatgtcctgacaccttatatgtcatctgtccccgccgtgatagcaaaggcctcagcaattcataacccaatcatatacgctattactcatccgaagtatagagtagctatcgcccaacacctgccttgtctgggtgttctgttgggcgtcagccgtcggcactctagaccctatccttcctacaggagcactcaccgcagcacgctgacgagccacacctccaatctgagttggatttcaatcagacggcgccaagagagtctgggatcggaatcagaagtgggttggacccacatggaagcagcagccgtgtggggagctgctcagcaggccaacggacgatccctttatggacagggtttggaagatttggaggcaaaagccccaccccgtccccaaggacacgaggcagaaacccccggaaagaccaaaggacttatcccgtctcaagatccaaggatgtag

SEQ ID NO: 44664 - DNA, 1488 bp, Artificial Sequence
  Description of Artificial Sequence: Synthetic coding sequence
atgaacccccccagcggcccccgggtgccccccagccccacccaggagccctcctgtatggccacacccgccccacccagctggtgggacagctcccagtcctctattagctcactgggcaggctgccaagtataagtcctaccgctcccgggacttgggcggcggcctgggtaccccttccgacagtggatgtgccagaccacgcgcactacaccctgggcactgttattctgctcgtgggcctgaccggcatgctgggcaacctgactgtcatatacaccttctgcagagctgtactgaggggcgtcaccgtaatgatgcaatctcggtcactgcggaccccagcaaatatgttcattatcaacctggccgtttcggacttcctgatgtctttcactcaggcccccgtctttttcacaagcagtctgtataaacagtggctattcggggaaacaggttgcgaattttatgcattttgcggagctctgtttggtatctcatcaatgatcacactcactgccatcgccttggataggtatttggttatcactaggccactagcgacctttggagtcgcttctaagcggagagccgcctttgtgctgctgggcgtttggttgtatgccctggcttggtctctgccaccattctttggatggtcagcttacgtgcctgagggacttctaacctcatgtagctgggattatatgtcctttacgccagccgtcagagcctatactatgttgctgtgttgctttgtcttcttccttcctctgttaattattatctactgctacatcttcatttttcgcgctatccgtgaaacagggcgagctctgcagacctttggggcatgcaaaggcaacggcgaatcattgtggcagaggcagcgtctgcagtctgaatgtaaaatggcaaaaataatgctgctcgtaatactgctgttcgtgcttagctgggcaccttactctgctgtagcactggtagcattcgctggttacgcccatgtgctcacaccctacatgtctagcgtgccagccgtgattgccaaagcgtcggccatacataaccctataatctatgctatcactcacccaaagtacagagtggcgatagcccagcacttgccctgtttgggtgtactgttaggcgtttctagaaggcacagccgcccctacccttcctaccgctcaacccaccgctctacccttacctcacacacctctaacctatcctggatctccataagaagacggcaggaatcattgggtagcgaatctgaggttgggtggacgcatatggaggcagccgccgtttggggagctgcccagcaagctaatgggagaagcctgtatggccagggactggaagacctagaggccaaggcgcccccacgaccacagggccatgaggcagaaacgcctgggaaacgaagggcgtccagtggccggagtcagaggccggagagacagcgcgctgccccgtag

SEQ ID NO: 44665 - DNA, 1065 bp, Artificial Sequence
  Description of Artificial Sequence: Synthetic coding sequence
atggccctgaaccacaccgccctgccccaggacgagcggctgccccactacttacgagatggggacccatttgcctcgaaactctcttgggaggccgacttagtggctggattctatctgactataattgggatattgagcaccttcggaaatggatacgttctttacatgtcaagcagaagaaagaagaaacttagaccagcggaaattatgacaatcaacctagctgtctgtgacctaggcatcagcgtggtgggcaagcccttcaccattataagctgcttttgtcataggtgggtgtttgggtggatagggtgtcggtggtacgggtgggcgggcttcttcttcgggtgcgggagtctcatcacaatgactgctgtgagtctggatcggtacttgaaaatctgctacctgtcctatggggtctggttaaagcgaaaacatgcatatatttgcctggcagctatatgggcttatgcctctttctggaccacaatgcctctggtcgggctgggagactacgtgccagagccatttgggacctcctgcactttggattggtggctagcgcaagcctccgttggcggacaagtcttcatactcaacattctctttttctgtttgctgctgccaaccgcagtgatcgtgttcagttatgtgaaaataatcgctaaggtcaagtcttctagcaaagaggtcgcccattttgactcaaggattcatagcagccatgtactggaaatgaagctgacaaaggtcgcaatgctaatctgtgctggatttttaattgcatggattccctacgccgtggtaagtgtttggtccgcctttggcaggccagacagcataccaattcaactctcagtggtccctacattgctcgccaaaagcgctgcaatgtataacccgatcatttatcaggttatcgactacaaattcgcatgctgccagactggggggttgaaagccactaagaaaaagagcctggagggattccgactgcatacggtcaccacagttcgtaaaagctcagcagtcctggaaatccacgaggagtgggagtag

SEQ ID NO: 44666 - DNA, 1140 bp, Artificial Sequence
  Description of Artificial Sequence: Synthetic coding sequence
atgagcgtgcggaccctgcccctgctgttcctgaacctgggcggcgaaatgctgtacatacttgatcagcgactccgggcccagaacatccccggggataaagccagaaaagtgctcaacgatattataagcaccatgttcaacagaaagtttatggaagagctattcaaaccacaggagctatacagcaagaaggcgctgcgtacagtgtacgaacgactggcacatgcttcgataatgaagctcaaccaggcctcaatggacaagctgtacgatctcatgacaatggccttcaaatatcaggtgctgctttgccccagaccaaaggacgtgctgcttgtaacttttaatcacttagatacaattaagggattcattagagattctcctaccattcttcagcaggtcgacgagaccttaagacagctgactgaaatatacggcggcctctcggcaggtgagtttcagctgatcaggcagacactgctaatcttctttcaggacctccatattagggtcagcatgtttttgaaggataaggtgcagaataataacggacgattcgtgcttcctgtgagcgggcctgttccatgggggactgaagtgccaggtttgatccgcatgtttaataacaagggtgaggaagtgaagaggatcgaatttaagcacggcggaaattacgtgcccgcgcctaaagagggttccttcgagctgtatggggacagagtgctgaagctcgggaccaacatgtacagtgttaatcaaccggtggaaacacacgtgtccggaagtagcaagaatcttgccagttggactcaggagtccattgcacccaatcccctggctaaagaagaactgaattttttagcccgactgatgggggggatggagatcaaaaagccaagtggccccgaacccggttttcgtctgaacctcttcacaacagatgaggaggaagagcaggcagcgcttacacggcctgaggaactgtcgtacgaggtcatcaacatccaggccacccaggatcagcagcgttccgaagagctggccaggatcatgggcgagttcgaaatcactgaacagccacgattgagcaccagcaaaggtgatgacctgctggctatgatggacgaactgtag

SEQ ID NO: 44667 - DNA, 1020 bp, Artificial Sequence
  Description of Artificial Sequence: Synthetic coding sequence
atgagcgtgcggaccctgcccctgctgttcctgaacctgggcggcgagatgctttacattttagaccagcggcttcgggctcaaaatatccctggcgataaggcaagaaaagacgaatggacagaagtggatcgcaaacgggtgcttaacgacatcattagcaccatgtttaaccgaaaattcatggaggaactgttcaagccccaagagctgtactcaaagaaagccttgcgaacagtgtatgaacgcttggcccacgccagcataatgaaattgaaccaggcttctatggacaagctgtacgatctcatgaccatggctttcaagtaccaagtcctcctgtgcccgcggccgaaggacgtgctgctggtgactttcaaccacctggatactattaagggtttcataagagacagccctaccattttgcagcaggtcgacgagacactccgtcagctgacagagatttacggcgggcttagtgctggagaattccaactgattcgacaaacccttctgatattttttcaggatctgcatatcagagtttccatgtttttaaaggacaaggttcagaataataacgggaggttcgtgttgcctgtgtccggccccgtcccatggggtacggaggtaccagggcttatcagaatgttcaacaataaaggagaggaggtgaagaggatagaattcaagcacggcggaaactacgttcccgcccctaaggaggggagctttgaattgtatggggaccgcgtcttgaaactaggcaccaatatgtactccgtgaaccagccggtcgagactcacgtctctggcagctctaaaaatcttgccagctggacccaggaatctattgcccccaacccactcgcaaaagaagagcttaattttttagctagactgatgggggggatggagattaagaaaccatctgggccagagccaggctttcggcttaacctattcacaaccgatgaagagggcgatgacctcttagctatgatggatgagctgtag

SEQ ID NO: 44668 - DNA, 672 bp, Artificial Sequence
  Description of Artificial Sequence: Synthetic coding sequence
atgagcgtgcggaccctgcccctgctgttcctgaacctgggcggcgagatgctttatattctggatcagagactgcgcgctcagaacattcctggagacaaggcaagaaaagtcctgaacgatataatatcaaccatgttcaatcgcaaattcatggaggaactcttcaaacctcaggaattgtatagtaagaaagcactgcgcacagtgtacgagcggcttgcacacgcgtcaataatgaagctcaaccaagccagcatggacaaactctacgatctgatgaccatggccttcaagtaccaggttctcttgtgtcccagaccgaaagacgtgctcctcgttacattcaatcatctggacacgattaagggtttcatcagagacagccccacgatcctccaacaagtggacgagacacttcgacagctaacagagatatatggcggcctgtctgccggcgagttccagctgatacggcagaccttgctcatctttttccaggacctccacatacggcgggaatgcttttggaaacacatgcaggagacagtacattcagcccaatgctgcttaccgggagtcggaaactacatggaggaccgcaggcgacggcttaccttccattacgtttacccctttgagaatttcgagttttgcacctgggccaagtag

SEQ ID NO: 44669 - DNA, 1170 bp, Artificial Sequence
  Description of Artificial Sequence: Synthetic coding sequence
atgagcgtgcggaccctgcccctgctgttcctgaacctgggcggcgagatgctttacatcctggatcagaggttgcgcgcacagaacatccccggcgacaaagcccggaaagacgaatggacagaggttgacaggaaaagagtgttaaatgatatcatctcaactatgtttaatcggaaatttatggaagagcttttcaaaccgcaggagctgtattcaaaaaaggcgctgcgtaccgtgtatgagcggctcgcccacgccagcattatgaagctgaaccaggcctctatggataagctgtatgacttgatgacaatggccttcaaataccaggtcctcctttgtccaaggccaaaggacgtgcttctcgtgactttcaaccatttagacactatcaaaggttttattcgcgactccccaaccatcctccagcaggtcgatgagactctcaggcagcttacagaaatatacgggggattgagtgcaggcgaattccagttaatacggcaaactctattaattttctttcaggacctccatatccgcgtctccatgttcctgaaggataaagtccagaataataacggacggttcgtgctccccgtgtcaggaccagttccctggggtaccgaggtccccggcctcatccgcatgttcaacaacaaaggagaggaagtcaaacggatcgaatttaagcacggagggaactatgtccccgctcccaaggagggaagcttcgagttgtatggggacagagtgctgaagttgggcacgaacatgtattctgtcaatcagccagtagagacccatgttagcggcagttccaagaacctggcttcctggactcaggagtctatcgcccctaatcccctggctaaagaagagttgaatttcctggctcgactgatgggcggcatggaaatcaagaaacctagcggccctgagcccggcttcagacttaacttatttactacagatgaagaggaggagcaagcagctctgacccgccctgaagagttgtcatacgaagtgatcaatatccaggctacccaggatcagcagcgatcggaggagttagcacgtatcatgggcgagttcgaaattaccgagcagccacggctctctaccagcaagggggacgacctgctggcgatgatggacgaactgtag

SEQ ID NO: 44670 - DNA, 1023 bp, Artificial Sequence
  Description of Artificial Sequence: Synthetic coding sequence
atggagcccggccggacccagatcaagctggacccccggtacaccgccgatctgctggaggtgcttaagacgaactatgggatcccttcagcatgcttcagccagccgcccacagcagcacagcttctacgggccctcggccccgttgagctcgccttaactagtatcctgacactgctggccttagggtctatcgctatcttcctggaggacgcggtgtacctctacaaaaataccttatgcccgatcaagcgccgtaccttactctggaagtcaagcgcgcccactgtggtctccgtgctgtgctgctttggactctggataccccgatccctggtgctggtggagatgaccataacatccttttatgcagtttgcttttatcttctaatgctcgtgatggtggagggtttcgggggcaaagaggctgtgctgcgaactctgagagataccccgatgatggtgcacaccggaccatgctgttgttgttgtccttgctgtcctcggctcctgctgacaaggaaaaagttacaacttctcatgctcggaccctttcagtatgctttcttgaagatcaccctgaccctggtcgggctctttttggtgccagatggaatttatgaccctgccgacattagcgagggttccaccgcgctgtggatcaacacatttctcggggtcagtaccctcctggcattatggacgctgggtattatttcacgtcaggcccgcctgcatctgggcgagcaaaacatgggagccaagttcgcactattccaagtgctgctcatccttacagctttacagccctccatttttagtgttttggcgaatggcgggcagatcgcgtgtagccccccatacagctctaagactaggtctcaggtgatgaattgtcatcttctcatcctggaaacctttctgatgacagtgttgacccgaatgtattaccggaggaaggatcacaaagtgggatatgagacattttcttcacctgatctggatttgaacctgaaggcatag

SEQ ID NO: 44671 - DNA, 387 bp, Artificial Sequence
  Description of Artificial Sequence: Synthetic coding sequence
atggagcacagcgagggcgcccccggcgaccccgccggcaccgtggtccctcaggagctcttggaggagatgctctggttttttagagtcgaagatgcttccccatggaatcacagtattttggctttggccgccgtcgtggtgatcattagcatggtgctccttggccggtccatccaagcttctcgaaaggagaagatgcagccacctgaaaaggagacaccggaagtcctgcacctcgatgaggctaaggatcacaatagtctgaacaacctccgagaaaccctactgagtgaaaaaccaaacctggcccaggtggagctggagctgaaagaacgcgatgttcttagcgtatttttacctgatgtgcctgagaccgagtcttag

SEQ ID NO: 44672 - DNA, 1245 bp, Artificial Sequence
  Description of Artificial Sequence: Synthetic coding sequence
atgctgatcctgaccaagaccgccggcgtgttcttcaagcccagcaagagaaaagtctacgagttcctgagaagttttaacttccacccaggtaccctgttcctccacaaaattgtgcttggcatcgagacctcatgcgacgataccgctgccgcagtggttgacgaaaccggaaacgtgttgggggaggccatccatagccagacagaagtgcatctgaagactggaggcattgtgccacctgctgctcagcaactgcacagggagaacattcaacggattgtgcaagaagccttatcagcttctggcgtgtctccaagcgacttgtccgcaattgccaccacaatcaagcccggcttggcactttctctgggtgtaggactgagtttctcactccagttggtgggacagttaaagaagccgtttattccaatccaccacatggaggcccacgccctaaccatcagactaaccaataaagtggaatttccttttctggtgctattgatctccgggggacactgcttgttggcgctggtccagggggtatcagattttttgcttttgggaaaatctttagacatcgcccctggtgatatgttagacaaagttgctaggcgccttagcctgattaaacatcctgagtgttctacaatgtccggaggtaaagcaatagagcatctggccaaacaggggaatcggtttcatttcgatattaaaccccccctgcaccatgcaaagaactgcgacttctcatttaccggtctccagcacgtgacggacaagatcatcatgaaaaaagagaaggaagagggtatcgagaaaggccagatactttctagcgctgctgatattgccgccaccgtacagcacacaatggcctgccatctggtgaagagaacgcatcgtgcgatcctgttctgcaagcaaagggatctccttccccagaacaatgctgtgttggtggctagtgggggtgtcgcctccaatttttatattagaagagctctcgaaatccttacgaatgccacgcagtgtactttactatgccctcctcctcgcttgtgcacggacaacgggattatgatcgcttggaacgggattgaacggttgcgcgcagggctgggaattctgcacgacattgagggaatacgatacgagccaaaatgcccattgggagtcgatatttcgaaggaggtcggcgaggcttctataaaagtgccacagttaaagatggagatttag

SEQ ID NO: 44673 - DNA, 669 bp, Artificial Sequence
  Description of Artificial Sequence: Synthetic coding sequence
atgctgatcctgaccaagaccgccggcgtgttcttcaagcccagcaagagaaaggtgtacgaatttctgcggagtttcaacttccatcctgggactttattcctgcacaagattgtcctggggattgagacaagctgtgatgataccgcagcagcagtcgttgatgagacgggcaacgttctcggggaggctattcattcacagaccgaagtacatctgaaaacaggcgggatcgtcccgccggctgcccagcagctgcacagagaaaatatccagcggatcgttcaagaagcactttcagcatctggtgttagcccatcggacctgtcggccatcgcaaccacaataaagccagggcttgcactgtccttgggcgtgggcttgagcttctccctccagttggtgggtcagctgaaaaagcccttcattccgattcatcatatggaggcgcatgccctcacgatcagactgaccaacaaggtagagtttccatttctggtgctcttgatttcagggggacattgcctattagctttagttcagggagtgtctgatttcctgctcctaggtaaatctttggacattgcgcctggtgacatgttggacaaggtcgctagaagactgtccctgatcaaacaccccgaatgtagcactatgtcaggtggttag

SEQ ID NO: 44674 - DNA, 612 bp, Artificial Sequence
  Description of Artificial Sequence: Synthetic coding sequence
atgctgatcctgaccaagaccgccggcgtgttcttcaagcccagcaagcggaaagtgtatgaattcctgaggagcttcaacttccaccctgggaccctgtttctccataagattgtgctgggaatcgagacttcatgcgacgacactgcagcagctgttgtggatgaaacaggtaatgttctcggtgaggcgatccattctcagactgaggtgcacctgaagacaggaggcatcgtcccacctgcagcccagcagttgcatcgtgaaaacatccaaagaatcgtccaagaagctctatctgctagcggggtgtctcccagcgacctcagcgctatcgccacgactatcaagcctggactggccctgtctcttggcgtcgggctcagtttctcactccagctggtggggcagctaaaaaagccctttataccaatccatcatatggaggctcatgcactgaccatccgactaaccaacaaggtcgaatttcctttccttgtgcttttgattagtggcgggcattgcctactagctctggttcaaggcgtgtccgactttttactgctggggaaaagtctagatatcgctccaggggacatgcttgataaatag

SEQ ID NO: 44675 - DNA, 1245 bp, Artificial Sequence
  Description of Artificial Sequence: Synthetic coding sequence
atgctgatcctgaccaagaccgccggcgtgttcttcaagcccagcaagagaaaggtgtatgagttcttaagaagcttcaattttcacccaggcaccttgttcttacacaagatagtacttggcattgagacaagctgcgacgataccgctgctgctgtggtggatgagaccggaaatgtgctgggagaagctatacactcccagaccgaggttcacttgaagaccgggggtatcgttcctcctgcagctcagcaactgcatagagagaatatacaacgcatagtgcaggaggctcttagcgcatctggcgtgtctcccagtgatctttccgcgatcgctaccacaattaaacccggtctggctctgagcctcggcgtgggcctgtctttcagcctgcagttggttgggcagctcaagaaacctttcataccaatccatcacatggaggctcacgctctgaccatcagactcaccaataaggttgaatttcctttcctggtgttattgatcagcggagggcactgcctcctcgctttggtgcagggcgtgtccgactttctattattaggcaagtctctggatattgcgcctggggacatgctggataaggtcgcaagaagactgagcctcattaagcaccctgagtgctcaaccatgtctggtggcaaggccattgagcacttagcaaagcaggggaatcgctttcacttcgacatcaagccaccactgcatcacgctaaaaactgcgatttctcttttacaggtctacagcacgttacagataagatcatcatgaagaaagagaaggaggaaggtatcgagaagggccaaattctcagttccgctgctgatattgctgccacggtacaacacacaatggcttgccatttggtgaaacggacgcatcgtgccattcttttctgcaaacagagagatttgctccctcagaataatgctgtcctcgtggcatcgggcggggtcgccagtaacttttacatacggcgcgccttagaaatcttgaccaacgccacacagtgcactctgttatgccctcctccgcgactgtgcactgacaatggaatcatgattgcctggaacgggattgagaggctcagagccggcctgggaatcctgcacgacatcgaaggcattaggtacgagcccaagtgtcctttgggtgtcgatatatctaaggaagtgggagaagccagtatcaaggtacctcagttaaaaatggaaatttag

SEQ ID NO: 44676 - DNA, 1689 bp, Artificial Sequence
  Description of Artificial Sequence: Synthetic coding sequence
atgagcgaggagctggcccagggccccaaggagagcccccccgccccaagggctggtcctagagaagtctggaagaaaggagggaggctgctctctgtgcttcttgctgtgaacgtcctcctccttgcctgtacccttatatccggcggcgcatttaacaaggtggctgtgtacgatacagacgtgtttgcactcctcaccgccatgatgctgctggcaactctctggatcttgttttacttgctccgcaccgtcaggtgtccgtgtgctgtcccctaccgagacgcccacgctggcccaatttggctgagaggagggcttgtgctgttcgggatttgtacattaataatggatgtcttcaagaccggctattacagtagcttcttcgaatgtcaatccgctatcaagatactacacccactcattcaggctgtgttcgtcataatacaaacctacttcctctgggtctccgccaaggactgtgtgcatgtgcacctcgatctgacttggtgtgggttgatgtttactttgaccacaaatttagccatttggatggcagcagtcgtagacgagagtgtgcaccagtcacattcttacagcagttctcatagtaacgccagccacgccagactgattagcgatcagcacgctgacaacccagtcgggggggacagttgcttgtgttcaactgccgtttgccaaatatttcagcaaggctatttttacctgtaccctttcaacatcgagtactccttattcgcgtctacaatgttatatgtgatgtggaaaaacgtgggaaggttcctggccagtaccccgggccacagccatacacctacacccgtttccctgtttcgggaaactttcttcgccggacccgttctcgggttacttttatttgttgtcggcctagccgtattcattatttacgaggtgcaggtatccggtgacggcagtcgcacccgccaggcccttgtcatctactattcattcaatatcgtctgtctgggcctcacgacccttgtgagtctgtctgggagtatcatttatagatttgaccgccgcgccatggaccatcataagaacccgacccgaacattggatgtcgcgctcttgatgggcgcagcgctcggtcaatacgccatttcatactattctatcgtggctgtggtagctggaacaccacaggatcttctggctggcttgaacctgacacacgccctgctcatgattgcacagcatacgtttcagaatatgtttattattgaatccctgcatcggggtccccccggcgcagagccacactcaactcaccctaaagagccttgtcaggatctcaccttcacaaatctcgacgctcttcatacactgtcagcctgccctccgaaccccggccttgtttccccctctccatctgaccagagggaagcggtggcgatagtttcaacccctcggagccagtggcggcgtcagtgcctcaaagacatctctctgtttcttctgctgtgcaacgtcatcttgtggattatgcccgcatttggagcacggccccattttagcaatacggtagaggtggatttttatggctacagcttgtgggcggttattgttaacatctgcctgccttttggtattttttacaggatgcacgctgtttcctcacttctggaggtgtatgtcctatcctag

SEQ ID NO: 44677 - DNA, 1791 bp, Artificial Sequence
  Description of Artificial Sequence: Synthetic coding sequence
atgggccggggcgcccgggccgccgccgcccagagccggtggggcagggcttctagagcttcggttagcccaggtaggaccataaggtctgcacctgccgttggtgaggcccaggagacagaggctgcgcccgagaaagagaacagggtggacgttggtgccgaggaacgggcagcggctacccggcccagacagaagtcctggctggtgcgccacttttctctgttgctccggcgtgatcgccaggcccagaaagcgggccagttgttcagtgggctgcttgctctcaacgtagtctttctagggggggcgtttatttgctcaatgattttcaacaaggtcgccgtaacccttggagacgtctggatccttcttgcaactctgaaggtgctaagccttctgtggctgctttattacgttgcctccacaacaaggcgcccccacgccgtgctataccaagaccctcatgctggcccactctgggtgagagggtccttagtgcttttcggatcttgtactttctgtctgaatatttttcgcgtcggctatgacgtgtcgcacatacgctgtaaatcacaacttgatctagtcttttcagtgatagaaatggtgttcataggggtgcagacgtgggtgctgtggaagcactgcaaagactgtgtgcgagtgcagactaacttcactcgctgcggcctgatgctaacactggctacaaacctgctcctctgggtcctcgccgttaccaacgacagtatgcatcgggagatcgaagctgaacttgggatcttgatggagaagtccactggcaatgaaactaacacgtgcctctgcctaaacgccaccgcctgtgaggcctttagaagaggcttcctgatgctataccctttctcgactgagtactgcctcatctgctgcgcagtgttgtttgtaatgtggaaaaatgtggggagacacgtggcacctcatatgggagcgcatcctgccactgcaccgttccacctgcatggggcgatcttcggcccattgctcgggctcctggtgttattggcaggggtatgtgtgttcgtattgttccagattgaggcttcgggacccgcgattgcatgccagtattttactctttattacgccttctacgtcgcggtgctcccaaccatgtcattggcatgcctggccggcactgctatacacggactggaggagagggagctggataccgtcaagaaccctactcggagtctggatgtggttctgctgatgggcgccgccttggggcagatgggcattgcatatttttcgattgtcgccatagtagctaaacggccacacgaattgctcaatcgtctcattttagcgtactctctcctgctaatcctgcagcatatcgcccagaatctgttcataatcgagggactccatagacgccccctgtgggagacagtgcccgagggacttgccggaaagcaggaggcagagccacctagaaggggaagcctgctggaactggggcaagggcttcagcgtgcatccctggcatatattcactcatactcacatctcaactggaagcgcagagcactcaaggagatctccctcttccttattctttgtaatataacactctggatgatgcctgccttcggaatccatcccgaattcgagaatggactcgaaaaggacttctatggttaccagatctggttcgccatcgtgaacttcggactccccctgggtgttttctatcgaatgcattcagtgggggggctggtggaagtttacttgggcgcttag

SEQ ID NO: 44678 - DNA, 939 bp, Artificial Sequence
  Description of Artificial Sequence: Synthetic coding sequence
atggcctgcgccgccgtgatgatccccggcctgctgcggtgcagcgtcggggccattagaatcgaagcagcgtctctaaggttgaccctgagtactctgagacacctgactctcacatcgatcatgaagtcgaagagaaagacagaccacatggagagaacggctagtgtgctccgaagagagattgtgagcgccgccaaggtgtgcggagccgcgtccgagagcccgagcgtcaaatcactgagactgctggtggcagaccaggacttctcctttaaggcgggtcaatgggtggatttcttcatccccggtgtgtccgttgtggggggtttcagcatctgctctagtccaaggctgttagagcaggagcgcgtgattgagctggcagtgaaatacacaaaccatcccccggccctgtgggttcataacacgtgcaccctggactgcgaagtcgccgtgcgcgtcggaggagagttcttctttgaccctcaaccagccgacgcctccaggaatttggtcctcattgctggaggtgtcggcatcaatcctctcttgtcgatccttcgccatgccgcagacctgctcagggaacaggccaacaagcgcaatgggtacgaaattggtaccattaagcttttctattcggccaagaatacttccgagctactgttcaagaagaatatcctcgaccttgtcaacgaatttcctgaaaagattgcatgcagcctccatgttaccaaacaaaccacacagataaatgccgaactcaagccttatataactgaggggcgtattacagaaaaggagatccgggatcatatttccaaggagaccctgttttacatatgcgggccaccccctatgacggacttctttagtaagcaacttgaaaataaccacgtgccgaaagagcatatttgtttcgagaaatggtggtag

SEQ ID NO: 44679 - DNA, 486 bp, Artificial Sequence
  Description of Artificial Sequence: Synthetic coding sequence
atggcctgcgccgccgtgatgatccccggcctgctgcggtgcagcgtgggcgccattagaatagaggccgctagcctgagattgactctgagcacgttaaggcacctcaccctgacctcgattatgaaaagcaagcgtaagaccgaccacatggaacggactgcctcagtgctgagacgcgaaatcgtgtccgctgcaaaggtttgtggcgcggcttctgagtctccctctgttaaatctctccgcctgctcgtggccgaccaggacttctcctttaaagcaggtcagtgggtggacttcttcattcctggtgtgagcgtggtgggcgggttttctatatgctcttctccacgactgctggagcaggaacgggtgatcgagcttgcagtgaagtacacaaaccatcctcctgcgttatgggtgcacaatacttgtacacttgattgtgaggtggctgtgcgcgttggtggcgagtttttcttttag

SEQ ID NO: 44680 - DNA, 993 bp, Artificial Sequence
  Description of Artificial Sequence: Synthetic coding sequence
atgacccccaagatcagctggaccagcaagttcagcgtgtgccccgaaagcgctatggcttgtgccgctgtgatgatcccgggccttcttagatgttcagtcggcgccattcggatagaggctgcgtcactgcgactgactttaagcactctcagacaccttacgctgacatcaattatgaaatccaagagaaaaaccgatcacatggagcgtacagccagtgttttgagacgggaaatcgtcagcgctgctaaggtgtgtggggcggctagcgaatctcccagcgtaaagagtttaaggctgctggtggctgatcaggatttttctttcaaggccggacagtgggtggatttcttcatcccaggcgtatctgttgtgggaggattctcaatctgttcatctcccagactgctcgagcaggagagagtgattgagctcgctgtaaagtacacgaaccaccctccagcgctctgggtacacaatacatgtactcttgattgcgaagtggcagtgagagtaggaggcgagttcttctttgacccacagcccgccgatgcgagtagaaatctcgtgctcatagccgggggtgttgggattaacccgcttttgtctatccttaggcatgcagctgaccttctgcgggaacaggccaacaagaggaacggctatgaaatcggcaccatcaagttgttttacagcgccaaaaacacgtctgaattattgtttaagaagaacatactggacctcgtgaacgaatttcctgaaaagatcgcatgttcactccacgtcaccaagcaaaccacccagatcaacgcagagctgaaaccatacatcactgagggacgaattaccgagaaagagatccgagatcacattagtaaagagaccctgttctacatctgcggccctcctcccatgacagactttttttcaaaacagctggaaaacaatcacgtccctaaggaacatatctgcttcgagaagtggtggtag

SEQ ID NO: 44681 - DNA, 1272 bp, Artificial Sequence
  Description of Artificial Sequence: Synthetic coding sequence
atgctgtgccaccggggcggccagctgatcgtgcccatcatccccctgtgtcccgaacatagttgtagaggtaggcgcttgcagaatctactgtccggcccatggccaaagcagccgatggaactgcacaatctgtctagtccctctccatctttgtcaagtagtgtcctccccccttcttttagtccctctccaagctctgcgcctagcgcgttcacaaccgtcggaggttccagcggcgggccatgtcaccctacaagctcgtcgctcgtcagcgcattcttggctcccattctcgctctagagttcgtactcggactggtgggtaattcactagctttattcattttttgtattcacacccggccctggacttccaataccgttttcctcgtctccctcgttgccgctgacttcctactcattagtaacttgcccctgcgtgttgactactatttacttcacgagacctggagattcggtgctgccgcctgcaaggtgaatctgtttatgctatcaactaacagaacagcctctgtagtgttcctcaccgccattgctctcaacaggtacctgaaagtggtacagccacaccacgtgctgagccgagcctcagtgggagctgctgcacgcgttgcgggtggcctctgggttggaatcctgctgttgaatggacatcttttactctctactttttcggggccatcctgtctgagttatcgcgtgggcaccaaaccgtcagcctccttgcggtggcaccaggctttataccttctcgaattttttctgccactggcccttatcctgtttgccatcgtcagtatcggactgacgatcaggaatcgcggattgggggggcaggcaggtccacaacgtgccatgagggtgctggccatggtagtggctgtgtatactatctgctttttgcctagtattattttcggaatggcctcaatggtcgctttttggctgagcgcttgtcgcagcctggatttatgtacccaactgttccacggctccctcgcatttacctacttaaattcagtcttagatcccgtcttatactgtttctcgagcccaaacttcctgcaccagtctagggcacttctgggactaacacgcggaaggcagggcccagtaagtgacgagtcctcgtatcagcctagtcgccagtggcggtaccgcgaggcttcaagaaaggccgaggcaatagggaagctcaaggtccaaggcgaggtgtctctggagaaggaggggtcttcacagggctag

SEQ ID NO: 44682 - DNA, 1014 bp, Artificial Sequence
  Description of Artificial Sequence: Synthetic coding sequence
atgaacgagcccctggactacctggccaacgccagcgacttccccgactacgccgcggccttcgggaactgcaccgacgagaatatcccgttaaagatgcattatctgcccgtcatctatggtatcattttccttgtggggttccctggaaacgctgtggtgatctccacttatatatttaagatgcggccctggaagtccagcaccattataatgctcaatctggcctgcactgatctgttatatttgacatcgctgcccttcctgattcactattacgcttccggtgagaactggatttttggtgactttatgtgcaagttcatcaggttctcatttcacttcaatctgtatagttccatcctattcttaacatgttttagtatctttcggtattgcgttatcatccaccctatgtcatgcttctcaatccacaaaacccgttgcgctgtcgtcgcttgtgctgttgtatggataattagtttagttgccgttataccaatgactttcctgattacaagcaccaatcgcacaaaccggagcgcttgcctggaccttacctcgtctgatgagctgaacactataaaatggtacaacctcatactcactgccaccacgttttgtctgccgctagtgattgttactctctgttacacgacaattattcacacactgacccatgggctgcagaccgattcctgcttgaagcaaaaagccaggcgcttaactattctactactcctcgctttctacgtttgttttctgccgtttcacatcctgagggtgatcagaattgagtcgcgactgctaagcatttcttgttcgattgagaatcagatacatgaagcttatatagtatccaggcctcttgcagctttaaacacgttcgggaatttactgctgtacgtagtggtgtctgacaacttccaacaagcggtatgttccacagtcaggtgcaaggtcagtggcaatctcgagcaggccaagaagatctcttactcgaacaacccatag

SEQ ID NO: 44683 - DNA, 189 bp, Artificial Sequence
  Description of Artificial Sequence: Synthetic coding sequence
atgaacgagcccctggactacctggccaacgccagcgacttccccgactatgccgccgcatttgggaattgtaccgacgagaacattccactgaaaatgcattacttgcccgtcatttacgggatcatttttttggtgggatttcctggcaatgccgttgtgatctcaacatatatttttaaaatgtag

SEQ ID NO: 44684 - DNA, 210 bp, Artificial Sequence
  Description of Artificial Sequence: Synthetic coding sequence
atgaacgagcccctggactacctggccaacgccagcgacttccccgattatgccgctgctttcggtaactgcactgacgaaaacatccctctaaagatgcactacctacccgtaatttatggaatcatctttctagtcggttttccagggaacgccgtggtgatcagtacttatatctttaaaatgcggccctggaagagcagcacttag

SEQ ID NO: 44685 - DNA, 1014 bp, Artificial Sequence
  Description of Artificial Sequence: Synthetic coding sequence
atgaacgagcccctggactacctggccaacgccagcgacttccccgattacgctgctgcgttcggtaattgcaccgacgagaatattcctttaaaaatgcactacttaccagtgatctatgggatcattttcctggtgggattccctgggaacgccgtggtcatatccacatacatattcaagatgcgcccctggaagtcctccaccatcataatgctcaatcttgcctgtaccgatcttctctacctaacttccctcccttttctgattcactattatgcaagcggagaaaattggattttcggcgacttcatgtgtaagtttatcaggttctcatttcatttcaacctgtacagctcgattttatttctcacctgtttttcaatcttccgatactgtgtcatcatccaccccatgtcttgcttcagtatacataagacaaggtgtgctgtagttgcctgtgcagttgtgtggattatctctcttgttgctgtgatcccaatgacttttctaattacaagcactaaccgtactaacaggtcagcatgccttgatcttacaagctccgatgagctaaacaccatcaagtggtacaatttgatattgacagccaccaccttctgcttgccacttgtgattgtgactctttgctatacgaccatcatccacactctaacccacggcttgcaaacagatagctgcctgaagcaaaaagcaagacggttgacaattctactgctccttgccttctatgtttgcttcttgccatttcacattctgagagtcatacgcattgaatcgagactgttgtccattagctgctccatcgaaaatcagattcacgaggcatacattgtctccaggcctttggccgccctcaacacttttgggaacctgctcctgtacgtggttgtgagcgacaattttcagcaggctgtgtgctccactgtaaggtgcaaagtgagcggcaacttggagcaggctaagaagattagctactctaacaatccttag

SEQ ID NO: 44686 - DNA, 3033 bp, Artificial Sequence
  Description of Artificial Sequence: Synthetic coding sequence
atgagccagctgcggctgctgcccagccggctgggcgtgcaggccgcgcgcctgctggcggcacacgacgtgccagtgtttggctggcggtctagaagtagcggtccacctgccacctttccctccagtaaaggaggcggaggatccagttacatggaggagatgtactttgcctggctcgaaaatccccagtccgttcacaaatcatgggatagtttttttagggaggccagtgaggaagccttttcgggcagcgcccaaccccgcccacctagcgtggttcatgagtcaaggagcgcggtgtccagccggaccaaaacatccaaattggtagaagatcacttggctgtgcagagtttgattagagcataccagatcagggggcatcatgtcgcacagctggatccactgggaatcctcgatgccgatctcgactccttcgtgccgtctgacttaatcaccaccattgacaagctggcattttacgacctgcaggaagccgatttagacaaggagttccagctccccaccactactttcattggcggatctgaaaacacactaagtcttcgcgaaattatacgcagactggagaacacatactgccagcacattggcctggagtttatgtttattaacgatgtggagcagtgtcagtggatccggcagaagtttgaaacccccggcgtaatgcagttctcatccgaagagaaaaggacattgcttgctcggctagtgcggtccatgcggtttgaggatttcctggcacgtaagtggtcctccgagaagcggttcggactggagggatgcgaggtgatgatacccgcactgaagacaattatagataaatcgagcgaaatgggaatcgaaaatgtgattctcggcatgccacatagggggcgactgaatgtgctggcaaatgtcattagaaaagatcttgaacaaatcttctgtcaattcgacccgaagcttgaggcagcagatgagggtagtggggacgtcaagtaccacctgggtatgtaccacgagcggattaaccgagttacgaaccgcaacatcaccctctctctcgtggccaacccttctcaccttgaagcagtagatcccgtcgtgcagggcaagactaaagcagaacaattttacagaggcgacgcccaaggcaaaaaagtcatgtccattttggtgcatggggatgccgcctttgcgggccagggcgttgtctatgagacatttcacctgagtgatctaccctcttatactactaacggaacagtacatgtggtggtaaacaatcaaatcggctttacgaccgacccacgaatggcccgatcctctccctaccccaccgatgtggcgagagttgtaaacgcccctatttttcatgtcaatgccgatgatccagaagcagtgatttatgtctgctctgtcgctgcagagtggaggaataccttcaacaaggacgtggtggtggatctagtctgctatcgccggcgcggccataacgaaatggacgagcccatgtttacccagccactgatgtataagcagatccatcggcaggtgcccgtcctcaagaagtacgccgataagctgatcgctgaaggaaccgtgacactgcaagagtttgaagaggaaatcgcaaagtacgatcgcatctgcgaggaagcctatgggagatccaaagacaagaaaatcctgcatattaagcattggctggactccccctggccagggttctttaatgtggacggagaaccaaaatcaatgacatgtcctgccacagggattcctgaagatatgctgactcatattgggtccgtcgccagctcagtccccctggaagatttcaaaatacacaccggacttagccgaatactcagaggtcgggcggatatgaccaaaaatcggacagtggattgggctctcgcggaatacatggcatttggctcattactcaaagaaggaattcatgtccgattgtctgggcaggatgttgagcgcggcacctttagccaccggcaccatgtcttacatgatcaggaagtggatcggcgcacctgcgtaccaatgaatcatctctggcccgaccaggcaccttacactgtgtgcaatagctctctgagcgagtacggcgtgttggggttcgagctggggtatgcgatggccagccccaacgctctcgtgctgtgggaggctcaatttggggactttcataatacggcccaatgtattatcgaccagtttattagcactggtcaagccaagtgggtaaggcacaacggaatcgttcttctcttaccgcatggcatggaggggatggggcccgaacactcttcggccagacctgagcgttttctgcagatgtctaacgacgactccgacgcctacccagctttcaccaaggatttcgaggtgagccagttgtacgactgtaattggatcgtggttaactgttctactccggctaactattttcacgtgcttcgacgccagatactgcttccatttaggaaaccgttgattattttcactccaaaaagcctgttgcgccaccctgaagcaaagagcagtttcgaccaaatggtgtctggtacaagcttccaaagggtcatacccgaggacggcgctgccgcacgcgcacctgagcaggtgcagaggcttattttctgcactggaaaagtgtattacgacctcgtgaaagagaggagttcgcaggatctggaagagaaggtggctatcacaaggctggagcagataagtccatttccctttgacttgatcaagcaagaggcggagaagtaccctggcgcagaacttgcatggtgtcaggaagaacataaaaatatgggctattatgattatatttctccacggttcatgactatcctgcgccgcgctaggcctatttggtatgtgggtcgcgatcctgcggccgccccggccacaggcaacagaaacactcacctagtgagcctgaaaaagtttttggatactgcctttaacctccaagcttttgaaggaaaaactttctag

SEQ ID NO: 44687 - DNA, 2862 bp, Artificial Sequence
  Description of Artificial Sequence: Synthetic coding sequence
atgagccagctgcggctgctgcccagccggctgggcgtgcaggccgctcggcttctagccgcacacgatgtgccagtgtttgggtggcgtagtcgatcctctggtcctcccgccacattcccatcttcaaagggaggcgggggctcttcatacatggaggaaatgtacttcgcctggctggaaaatccgcagtctgtccacaaaattaggggtcatcatgtagctcagctggaccccctggggatcctcgacgcagacctggactcatttgtgccatctgacctgattactaccatcgacaagctggctttttatgaccttcaggaagctgatctcgataaggagttccagctccccactacaacattcataggcgggagcgagaacacactcagtctacgcgagatcattcggaggctcgagaacacctattgccagcacattggtctggaatttatgtttataaacgatgttgagcaatgccagtggattcggcagaaatttgagacaccaggagttatgcagttcagttccgaggagaagagaaccctactggctagactggtgagatctatgcggtttgaggacttccttgcccgcaaatggtcctctgaaaagagatttggtctggaaggatgtgaggtgatgatccccgctctgaagacaatcatcgacaaaagtagtgaaatgggtattgagaacgttatcttgggcatgccacaccgggggaggctgaacgttctggccaatgtgatccgcaaggacttggaacagattttctgccagttcgatcctaaactggaggcggccgacgagggaagcggcgatgtgaagtatcacctcgggatgtatcacgaaagaataaaccgcgttaccaatcgaaatataaccctgagtttagtggccaacccctcacacctggaagccgtcgaccccgttgtacaaggcaaaactaaggcggaacagttttacaggggagatgcccaggggaagaaagtgatgtctatcctggtccacggagacgccgcgtttgccggacagggcgtagtgtacgaaacatttcatttaagcgacctgccaagttacactaccaatgggacagtacatgtggttgtcaacaaccagattggattcaccactgatccacgaatggccagatcatccccttatccaaccgacgtggcccgcgtcgtcaatgcacctattttccacgtgaacgccgatgatcccgaagccgtcatctacgtttgctccgtagccgctgaatggcgcaatacgtttaataaggacgtcgttgtggacctggtgtgctacaggaggcgagggcacaacgagatggacgagcccatgttcactcagcctctcatgtacaagcaaatccaccggcaggtgcccgtactgaagaaatacgcagacaagctgatagccgagggtacggtcacgctccaagaattcgaagaggagatcgctaaatatgataggatctgtgaggaggcatatggccgaagtaaggacaagaagattctgcacattaagcattggctggattccccttggccaggattcttcaatgttgacggagaacccaaaagcatgacatgcccagcaacaggcatccctgaagacatgctgacacatatcggctcagttgccagttcggtccctctggaggattttaagatacatacaggtttgtctcggattctgaggggtcgggcggatatgacaaagaaccggacagtggattgggcccttgccgaatacatggccttcggcagcctcctcaaagaaggaatacacgtgaggcttagcggccaggacgtagagagagggaccttcagtcataggcaccacgttctgcatgaccaggaagtagacaggcgcacttgtgtgcctatgaatcacctatggcctgatcaagccccatatacagtgtgtaacagcagccttagcgagtacggagtgctgggctttgaattgggctatgcgatggcaagtcctaatgctttagtcctgtgggaagcccagttcggcgatttccacaacactgcgcagtgtattatcgaccaatttatcagtaccggacaggcaaagtgggttcggcacaatgggatcgtccttctgcttcctcacgggatggaaggaatggggccagaacactcatcggcaagaccagagcggttcttacagatgtccaacgatgacagcgacgcctatcctgctttcaccaaggacttcgaggtgtcccagctctatgactgcaactggatcgtagtgaactgcagcacacccgcgaattacttccacgtgctcaggcgacagatcctgctcccgttcaggaagcccttgataatcttcacccccaagagtctcctacgccatccagaagctaagagctcttttgatcagatggtctctggcaccagcttccagcgagttattccagaggacggtgccgccgctcgcgcccccgagcaggttcaaaggttaatcttttgcactggcaaggtatactatgacctcgtcaaagaacgaagctcccaggacttggaagagaaagtcgctattacacgactggaacagatctcaccattccccttcgatttgataaagcaggaagcggaaaagtatccaggagctgaactggcatggtgtcaggaggagcacaagaatatggggtactacgattatatctccccacgatttatgacaatattacgacgggcccgccccatctggtacgtgggtcgagatcctgcagctgcccccgccactgggaatcggaatacccacctggtatccctcaaaaagttcctggacacggcttttaacctgcaggctttcgagggcaagacattttag

SEQ ID NO: 44688 - DNA, 2406 bp, Artificial Sequence
  Description of Artificial Sequence: Synthetic coding sequence
atgttcatcaacgacgtggagcagtgccagtggatccggcagaagttcgagactccaggagtgatgcagttctcttctgaggaaaaacggactttgctagccagactcgtgcgctcaatgcgttttgaggatttccttgcacgcaaatggtcgtccgagaagcgctttggcctcgagggttgtgaggtaatgatacccgctttaaagaccattatcgacaagagctccgagatggggatcgagaatgtgatcctgggaatgccccataggggccgactgaatgtcctggctaacgttatccgaaaagatctggaacagattttttgccagttcgatcctaagctggaggctgctgacgagggctctggcgatgtgaaataccacctcgggatgtaccatgaaagaatcaaccgagtgactaacagaaacattactttgagcctggtcgcaaacccatctcatctggaagctgtggaccctgtcgtgcagggaaagacaaaggctgagcagttctatcggggtgatgctcaggggaaaaaggtcatgtccatactagtccatggggacgctgccttcgctggacagggagtggtgtacgagacctttcacctcagtgatctgccctcctacaccacaaatggaaccgttcacgttgtggttaacaaccagatcggtttcactaccgatccacggatggccaggtcttccccatacccaacagatgttgccagagtcgttaatgctcctatctttcatgtgaatgctgatgatcccgaggctgttatttacgtgtgttcagttgccgcggaatggcggaatacatttaataaggacgttgtcgtagaccttgtatgttacagaagaagaggtcacaacgagatggacgagcccatgttcacccagccgctgatgtacaagcagattcatagacaggtcccagtattgaaaaagtatgcagacaagctgatcgccgagggaacagtaacattgcaagagtttgaggaggagattgctaagtacgaccgaatttgcgaggaagcatacggccgatctaaagacaaaaagattctccacattaaacattggctggactcaccatggcccggatttttcaatgttgacggtgaacccaaatcaatgacctgcccagcaaccggcattcccgaggacatgttgacacatataggatctgtggcctcctcagtgcctttggaagacttcaaaattcacactggcctgagccgaatcctacgcgggagagccgatatgactaaaaatcggacagtggattgggccttagccgagtatatggcctttggaagcttgctgaaggaaggaatccatgtcaggctgagcggccaggacgtcgagcgcggcaccttttcccatcggcatcacgtattgcatgaccaagaggtggacaggaggacgtgcgtccctatgaatcatttatggccagaccaggccccttatacggtctgtaacagctcactttccgagtatggagtgctcgggttcgaattgggctacgcgatggcctcccccaatgccctggtgctctgggaggctcagttcggagactttcacaacaccgcccagtgcatcatcgatcaatttattagcaccgggcaggcaaagtgggtacgccacaatggaatcgtgctgctgttgccacatggaatggagggaatggggccggagcacagcagcgcgcgccccgagaggttcctgcagatgtctaatgatgatagcgacgcctaccccgcatttacgaaggacttcgaagtgtcacagttatatgactgcaactggatcgttgtcaactgcagcacgcccgcaaattattttcatgtcctgcgccggcagattctcttgccctttcgcaaaccactcataatcttcaccccaaagtctctcctgaggcaccccgaagccaaatcgtcttttgatcaaatggtctccggcacatcatttcagcgcgtgattcccgaagacggcgctgcggcccgtgctccagagcaggtgcagcgactcattttctgtacaggaaaggtgtattacgacttggtgaaggagcgttcctcgcaggacctcgaagagaaagtcgctataactaggctcgaacagatttctcccttccccttcgatctgataaagcaggaggctgaaaaatacccaggtgccgagctggcatggtgtcaggaagagcacaagaacatgggatattacgactacatctccccgaggtttatgactattcttcgcagggccaggccgatctggtacgtgggccgggatcccgccgcagcaccggctactggaaaccgaaatacccaccttgtatccttaaaaaaattcctcgatactgcctttaatctccaagctttcgagggcaaaacattctag

SEQ ID NO: 44689 - DNA, 2160 bp, Artificial Sequence
  Description of Artificial Sequence: Synthetic coding sequence
atgttcggcaagaagaagaagaagatcgagatcagcggccccagcaacttcgagcaccgggtgcacacagggtttgacccacaagaacagaaatttaccggattaccacagcagtggcattctcttctcgccgacaccgccaatcggccaaagcccatggtcgatcctagctgtatcaccccaatacagctggcacccatgaagactatcgtccgcgggaataagccgtgcaaagaaacttccataaacggactccttgaagatttcgataatatcagcgtaaccagaagcaatagcttacgtaaagagtctccgccaacacccgatcagggcgccagctcccacgggcccgggcacgccgaggagaatgggtttatcaccttctctcaatacagttccgaatccgatacaacagctgactacaccaccgagaagtatcgggagaaatcactctacggggatgaccttgacccctattaccgcggaagtcatgccgctaagcagaatggtcatgtgatgaagatgaagcatggcgaagcatattattccgaagttaagcccctgaaaagtgattttgcaaggttttcagccgactatcacagccatctggatagcttgagcaagccttccgaatatagcgatctaaaatgggagtaccaaagagcgtccagttcatcccctctggactacagttttcagttcactccatcccggaccgctggcacctcaggctgtagtaaggaatccctggcctactctgagtccgagtggggcccctccctggacgactatgatcgaaggccgaaaagttcctacctgaatcagactagcccacagccaacaatgcgccagcgcagccggtccggatctggtctccaggaaccaatgatgccgttcggggctagcgctttcaagacccacccacagggtcactcatacaacagctacacctatccaagactgagcgagcccacgatgtgtatccccaaggtggactacgatagggcccagatggtgctttctccccctctttccggcagtgacacctacccccggggtcctgccaaattaccacagagccagagcaagtctggatactcctccagctcacaccagtacccctctggctatcacaaggccacgctttatcaccatccttccctacaatcaagcagccagtatattagtaccgctagctatctttcctccttgtcattgtcctctagcacttacccccctccttcttggggatcaagtagcgaccagcagccgtctagagtgagccacgagcagtttcgagccgcattacagctggtagtgtccccaggtgacccccgggaataccttgccaatttcatcaaaataggggaagggagcaccggcatcgtgtgcatcgccacggagaagcacacgggcaaacaggtagcagtgaaaaaaatggaccttcgcaaacagcagagaagagagctgctcttcaacgaagtggtcatcatgcgggattatcatcacgataacgtcgtcgacatgtacagctcttacctcgtcggggacgagttgtgggtggtcatggaattcctggagggaggtgcactgaccgatatcgtaacacacaccagaatgaacgaggagcaaattgccaccgtatgtctgtccgtactgcgggcgctgtcttacctgcacaaccagggggtcatccaccgcgatatcaaaagtgatagtatcctgctgacatccgatggccgcattaagctgtccgatttcgggttttgcgcccaggtttcaaaggaagttcccaagcggaaatccctagtggggactccgtactggatggctccagaagtgattagccgccttccctatgggacggaggttgacatttggtccttgggcatcatggtcattgagatgattgatggggagcccccatacttcaatgagccacctcttcaggctatgagacggattcgggactccctgccccccagggtgaaggatctccacaaagtatcatctgtattgagggggtttttagatttgatgctggtgagggaaccatctcaaagagccaccgctcaggagctcctgggtcacccctttctaaagctggctgggcccccgtcgtgtatagtgcctttgatgagacagtatcgccaccattag

SEQ ID NO: 44690 - DNA, 2160 bp, Artificial Sequence
  Description of Artificial Sequence: Synthetic coding sequence
atgttcggcaagaagaagaagaagatcgagatcagcggccccagcaatttcgaacaccgagtgcacaccggatttgacccacaggagcagaagtttaccgggctccctcagcagtggcactccctcctggcggacactgcaaacagacccaaacccatggtggatccatcctgtatcacacccatacagctggctccgatgaagactatcgtgcgaggaaacaaaccttgtaaggaaacgtctatcaatggtctcttagaggacttcgacaacatttcagtcacgcgcagcaattcactgagaaaggaatcccctcctacaccagaccagggggcttcgagccatgggcccggacacgccgaggaaaatggttttatcactttcagtcagtattcctcagagagcgacacgactgccgactacacgactgagaagtaccgagagaaatccctgtatggtgatgatttggatccgtattaccgcgggagtcatgccgctaagcagaacggtcacgtgatgaaaatgaaacacggcgaggcctattatagtgaggttaagcccctgaagtcagacttcgcaagattctccgctgattatcacagccatcttgactccctgtccaaaccatctgaatactccgacctgaagtgggaataccagcgtgcaagctctagtagtcccctggactactcctttcagtttacaccttctaggactgctggtactagtggatgtagcaaagaatctctagcctattctgagtccgaatgggggccaagtcttgacgactacgacagaaggcctaaaagcagttatctcaatcagaccagtcctcagcctacaatgcgtcaacgttctcgtagtggctccggactccaggagcccatgatgcccttcggagcatctgcattcaaaacgcaccctcaaggccactcatataactcctatacgtacccccgacttagcgagcctactatgtgtattcctaaggtggactacgacagggcccaaatggtcttgagcccccccctctctggatccgacacttacccgaggggaccagctaaactgccccaatctcagtcaaagtcaggttacagttcaagttcacaccagtacccttccggttaccataaagccacactttaccaccatccctctctgcagtcgtcctcacagtacattagcacagcatcatatctcagcagcctcagtctgtcctccagtacatatccccccccttcatggggtagctcttctgaccagcagccaagccgcgtctcacacgagcaatttcgggccgcgctgcagctggtggtatcaccgggtgacccaagggagtatctcgcaaatttcattaaaatcggcgagggctccaccggaattgtttgtatcgcaaccgagaagcacaccggaaagcaggtggctgtgaaaaagatggatctgagaaagcagcagcgcagagaactgttatttaacgaagtggttattatgcgcgactatcaccatgacaacgttgtggatatgtattcttcttacctagtaggcgacgaactgtgggtggtcatggaatttttagaggggggcgccttaacagatattgttacgcacacaaggatgaacgaggagcagatcgctactgtttgcctttcagtgctgagagccctgtcttatcttcacaatcagggagtgattcatagagacataaaaagcgattccatattgctgacctctgacggtcgtataaagctgtcagacttcggcttttgtgctcaagtgtcaaaagaggtgcctaagaggaaatcgctggtaggtactccgtactggatggcccccgaagttatttcgcggctaccctacgggaccgaggtggatatctggagtctcggcataatggtaatcgagatgatcgacggggagcccccttattttaatgagccaccgcttcaggccatgcgtcgaatccgcgattcccttccacccagagtgaaggacttgcacaaggtgagcagcgtgctgagaggatttctcgatctgatgctggtacgcgaaccttcccaacgcgcaacggcccaggaactactcggccacccctttctgaagcttgctggacccccttcctgtatagtgccattgatgaggcagtataggcaccattag

SEQ ID NO: 44691 - DNA, 2160 bp, Artificial Sequence
  Description of Artificial Sequence: Synthetic coding sequence
atgttcggcaagaagaagaagaagatcgagatcagcggccccagcaactttgaacatcgcgtccacactgggtttgatccacaagagcagaagtttactgggttgccccagcaatggcacagcttgttagctgatactgccaatcgacctaagcccatggttgaccctagctgtatcactccaatccagttggcacccatgaaaaccatcgttagaggcaataagccctgtaaggagacctccattaatggccttctggaggatttcgacaatatatcagtgacccgtagcaacagccttcggaaggagtctccccctacgccagaccagggcgcctctagccacggccctgggcacgccgaggagaatgggttcatcacattctcgcaatatagcagcgagagtgataccactgcagactataccacagagaagtaccgggagaaaagtctttacggcgacgacctggatccttactacagaggctcccatgcagcaaaacagaacggtcatgtgatgaagatgaaacatggcgaggcctactactccgaagtcaaacctctcaagagtgactttgcccggttttcggcagactatcatagccacttggattccttatctaaacctagtgagtactcagatctgaaatgggagtatcagcgcgcatcatctagcagtccattggactattctttccaatttaccccttctcgcacagctggcacctccggatgttcaaaggagagcttggcgtattctgagtccgaatggggtccctcactggacgattatgatcgtaggcctaagtcgagctacctgaatcagacatctccccaacccactatgcgccaacggagcaggtctggctcaggtttgcaggagccaatgatgccattcggcgccagcgcgttcaagacccacccacagggccattcttacaattcctacacgtaccctcgcctgtctgagccaacaatgtgtatcccaaaggtagactacgaccgagcccaaatggtgctgtctcccccgctctctggatcagacacctacccccgggggcccgcgaaattgcctcagagccagtctaaaagtggctactcctcaagcagccaccagtacccttccgggtatcataaagctacactgtatcaccatcctagcttacagagtagctcacagtacatctcaacagcatcatatcttagttcactcagtcttagtagttcaacctacccaccgcccagctgggggtcatctagcgatcaacagccttctagggtgtctcacgagcaatttagggcagccctgcagctcgtcgtatctcctggcgacccccgggagtacctcgccaattttataaagatcggcgaaggctccactggaatagtttgtatagccaccgaaaagcatactgggaaacaagtcgcagtaaaaaaaatggacttaagaaagcaacagcggcgggaactgctcttcaatgaggtggttattatgagagattatcatcacgataacgtggtagatatgtactcatcctatctggtcggagatgagctgtgggtggttatggagtttttggaaggtggcgccctgacagatatcgtgacccacacacgcatgaacgaggaacaaattgccactgtttgcctctcagtgctgcgggctctgtcttacctccacaaccagggggtgatccacagggacattaaatccgattcaatcttgttaacctcggacggcagaatcaagctgtccgactttggattttgtgcccaagtctccaaggaggtgcccaagagaaaatctttggtcggcacaccttactggatggcccccgaagtgatttcccgccttccctacgggaccgaggttgacatctggtctctgggaattatggtaatcgagatgattgatggagagcccccatatttcaacgagcctccccttcaggccatgcggcgcatccgcgattctttgccccctcgggtaaaagatttgcacaaggtaagttctgtgctgaggggattcctagacttaatgttggtgcgcgagccttcacagcgggccacagctcaagagttgttgggccacccattcttaaaactggccggaccaccctcttgcatcgtgcccctgatgaggcagtatcgtcatcactag

SEQ ID NO: 44692 - DNA, 1743 bp, Artificial Sequence
  Description of Artificial Sequence: Synthetic coding sequence
atggtggaccccagctgcatcacccccatccagctggcccccatgaagacaattgtacgtggaaataaaccttgtaaagagacgtccattaatgggctcctcgaagacttcgataatatcagcgtgacacggagcaattctcttcgcaaggagtcccctcctacgcctgaccaaggagcttcttcgcacgggcccggccacgctgaagaaaatggattcatcacgttttctcagtatagctcagaatctgatactacagcagattacaccactgagaaataccgcgagaaatccttgtacggagacgatctggatccatactatagagggagccacgccgcaaaacaaaacgggcatgtgatgaaaatgaaacatggggaggcgtactatagcgaggtcaaacctcttaagtcggacttcgcgagattcagcgccgactaccactctcaccttgactctctgtccaaaccatccgagtacagcgacctgaagtgggagtaccagcgggcttcctcttcaagccctctagattactctttccagtttacaccatctagaactgcaggtacgagtgggtgttcaaaagagtcattggcctattcggagagtgagtggggtccgagcctcgatgactatgataggcgtcctaaatcctcgtacctcaaccagactagcccccagcctacaatgcggcagcggagcagatcaggttctggcttgcaggagcctatgatgcctttcggggcttccgccttcaaaacacatccgcaaggacacagctataactcatacacctacccaagactgtcggaacctaccatgtgcattcccaaggtcgactacgacagagcccaaatggtgttgtctccacctttatctggaagtgatacataccccaggggccctgcaaagctgccccagtcacaaagcaaaagcggatattcctcctccagtcatcagtatccaagcggataccataaggcaactctgtaccaccacccttctctgcagagttccagccagtacatctcaacggcctcttacctgagctcccttagtctctcctcatccacatatcctcccccttcctgggggagctcaagcgaccagcagccatctcgggtgagccatgagcagttcagggccgctctgcagcttgttgtttctcctggcgatccccgtgagtacctggccaactttatcaaaattggggagggatccaccggaatcgtgtgtattgctacagaaaaacatacggggaaacaagtggctgtaaaaaaaatggacttgagaaaacaacagcgccgcgaacttctgtttaacgaagtcgtaataatgcgggattaccatcatgacaacgtggtcgacatgtatagttcgtacctggtgggagatgagctctgggtggttatggagttcctcgagggcggcgctttaacagatatcgtgacccacacccgtatgaatgaggaacagatcgccaccgtgtgtctctccgtcttaagggccctctcatacctgcataatcagggcgttattcatcgcgatattaaaagcgactctatacttcttacgtctgacggacgtgtgtctagcgtgctgagaggcttcctcgacttgatgctcgtccgagagcccagtcagcgcgctactgctcaggaactgcttggacatccctttcttaaacttgccgggccccccagctgtattgtaccactgatgcggcagtaccgccaccattag

SEQ ID NO: 44693 - DNA, 366 bp, Artificial Sequence
  Description of Artificial Sequence: Synthetic coding sequence
atgagcaccctgttccccagcctgttcccccgggtgaccgagaccttgtggtttaatctcgacagaccctgcgtagaggaaactgaattgcaacaacaggagcagcaacaccaagcttggctgcaatccattgctgaaaaggataacaacctggtgcccattggcaagccagcatcagagcactatgatgacgaagaagaagaggacgatgaagacgatgaagacagcgaagaggatagcgaggacgatgaggacatgcaagatatggacgaaatgaacgactacaacgaaagcccagacgatggcgaagtgaatgaagtggacatggaggggaatgaacaggaccaggaccagtggatgatctag

SEQ ID NO: 44694 - DNA, 1269 bp, Artificial Sequence
  Description of Artificial Sequence: Synthetic coding sequence
atggccatcgcccagctggccaccgagtacgtgttcagcgacttcctcttgaaagagcctaccgaacctaagtttaaggggctcagattggaattggctgtggataaaatggtgacttgtatcgccgtagggctaccactcctgctgatcagccttgcttttgcccaggagatctccataggaacacagattagctgtttttctcctagctcattcagctggcgtcaggcagcctttgtggactcttattgttgggcagctgtccagcagaagaattctctacagagtgagtcagggaacctgcctttgtggctacataagttcttcccttatatccttctgttatttgcaatcctactatatctgccaccgctgttttggaggttcgcggcagcaccccacatctgcagtgacctgaagtttatcatggaagaactcgataaggtgtacaatcgcgccatcaaagccgcaaaaagtgctcgtgatctggacatgcgcgatggtgcatgctctgtgcccggtgttactgagaacctgggacagtctctatgggaagtgagcgaatctcacttcaagtatcccattgtggagcagtatctaaaaacaaagaaaaacagcaataaccttatcattaaatacataagctgccgcctcctgaccctgatcatcatcctccttgcatgcatctacctggggtactactttagtttgtctagcctctctgatgagttcgtgtgttccataaaatcgggcattctgaggaacgactcaacagttcccgatcagtttcagtgcaaacttatagctgttggaattttccagctgctctccgtgatcaacttggtggtttatgttctccttgcccctgttgtggtgtataccctgttcgtgccttttagacagaaaactgacgtactgaaagtctatgaaatcctgccaacctttgacgtcctgcatttcaagtccgaggggtataacgacctgtctctgtataaccttttcctcgaagaaaacatcagcgaagttaaatcttacaagtgtctcaaagtgctcgaaaatataaagtcaagcggtcagggcatcgatcccatgctgcttttaacaaatctcggcatgattaagatggatgtggtggatggcaagactcctatgagtgccgaaatgcgagaagaacaggggaaccagacagctgaattacaagactctgaaaccaaggctaacaatggtgagaagaatgctagacaaagactgctcgactctagttgttag

SEQ ID NO: 44695 - DNA, 2034 bp, Artificial Sequence
  Description of Artificial Sequence: Synthetic coding sequence
atgcaccacctgctggagcagagcgccgacatggccaccgccctgctcgccggcgaaaagctaagggagttaatcttgcccggggctcaggatgacaaggccggagcgctggccgctcttttacttcaattgaaactcgagttgccattcgacagggtcgtgaccattggaactgtcttggttcctattttactcgtgacactggtttttacaaaaaatttcgcagaggagcccatttactgctacacccctcacaactttaccagagaccaggcgttgtacgcacgcggctattgctggacagagctgcgggacgcgcttcccggcgtcgatgcctccttgtggccatcactgtttgagcacaagttcctgccatacgccctcctggcgtttgcagctattatgtatgtgcccgcgctgggttgggaattcctggcttctacccggctcaccagtgaactaaatttcctgttgcaggaaattgacaactgctaccatcgcgccgcagaaggcagagccccgaagatagaaaaacaaatccagtccaaaggaccaggaatcaccgagagagagaagagagaaattatagagaatgctgagaaagaaaaatctccagaacagaacctgttcgaaaagtacctagagcgtcgcggaaggtctaactttctcgctaagctgtatctcgcccgacacgtacttatcctcctgctgagtgccgttcctatttcctatttatgtacttactatgctacacaaaaacaaaacgagttcacatgcgccctgggtgcatctccagatggagcggctggagcaggccctgccgttcgggtgtcatgcaaactcccgagtgtgcaattgcagcggatcatcgctggggtggatattgttttgctctgcgtgatgaacttaattatcttagtcaacttgatccatttgttcatcttcaggaaaagcaattttatctttgacaaattgcacaaagtgggaatcaaaacaagacgacagtggaggaggtcccagttctgtgatatcaatattctggccatgttttgcaacgagaacagggaccatatcaaatctctgaatcgtctggactttattactaatgagtccgatttgatgtatgacaatgtggtgagacagctcctggcggccttggcccagagcaaccacgacgcgacaccaacagtgagggatagtggagtgcagaccgtagacccatctgcgaaccccgctgagcccgatggtgcagcagagcccccggttgtcaaacgcccaagaaaaaaaatgaaatggattcccacctccaacccacttccacagcctttcaaagaacctctagccatcatgcgtgtggagaattcaaaggctgagaagccgaagcccgcccgcaggaagaccgcaactgacactcttattgctccacttctggaccgaagtgcccaccactataaaggcggcggcggagatcccggccccggtcccgcgcccgcaccagcccccccccctgccccggacaaaaaacatgcacgccactttagtctcgacgtccatccttatatcttgggtacaaagaaagcgaaggcagaggctgtgccggcggcactgccggcaagtaggtcccaggaaggcgggtttcttagccaggccgaggattgtggccttgggcttgcgccagcgcccatcaaggacgcccctctgcctgagaaagagattccttatccaacagagccggccagagctggcctgcccagtggagggcccttccacgttcggtctccaccagcagccccggccgtggctccattaacgccggcctctttaggcaaagctgagccattaaccatcctgtctcggaatgccacccatcccctactccacatcaacaccctgtatgaagcccgtgaagaggaggacggggggcctcgcctgcctcaggatgtgggggatctcatcgccattcccgcaccacagcaaattctaattgccactttcgacgaaccgcgtaccgtggtgtcaactgtagaattctag

SEQ ID NO: 44696 - DNA, 1065 bp, Artificial Sequence
  Description of Artificial Sequence: Synthetic coding sequence
atgaacctgatcatcctggtgaacctgatccacctgttcatcttccggaagtccaacttcatttttgataagctgcataaggtcgggatcaaaactcgcaggcagtggagacggtcacaattttgtgacatcaatatcctggcaatgttttgcaacgaaaaccgggaccatattaagtctctaaacaggttggactttatcacaaacgaatcagatctgatgtacgacaacgttgtgagacagctcctggcagctctggcacagtctaaccacgacgcaacccctaccgttagagactctggcgtgcagaccgttgatccatccgccaacccggccgaacctgacggggcagcagaaccgccggtcgtgaagaggccacgtaagaagatgaaatggatccctacatccaatccattgcctcaaccttttaaggaaccactggcgattatgcgagttgagaatagcaaagcagagaaacctaaaccagcacgccgcaagactgccacagacacactcatcgcaccactcctggaccggagcgctcccgataaaaaacacgctagacacttctccctagacgtacacccttacatcctagggactaaaaaggcaaaggccgaggctgtgcctgccgcactcccagctagcagatcccaggagggtggctttctgagccaggcggaggattgcggactgggcttagcccccgccccaattaaagacgcgcccctacccgaaaaagagataccttatcctactgaacccgcccgggccggcctcccatctggggggccctttcacgtaagaagtccaccagcagcaccagctgttgctccacttacgccagcaagtctggggaaggccgaacctctgaccattctgagccgtaacgcaacccatcctttactacatatcaacaccttatatgaggctagggaggaggaagacggaggaccaagactgcctcaagacgttggggatctgatagcaatacccgcaccacagcagatcttaatcgctacgttcgatgagccaagaacggtggtctctactgtggaattttag

SEQ ID NO: 44697 - DNA, 1179 bp, Artificial Sequence
  Description of Artificial Sequence: Synthetic coding sequence
atgagcctggcccacaccgccgccgagtacatgctgagcgacgccctcctaccagaccggcggggaccacgcctcaaaggcctccggctcgaactaccattggatcggatcgtcaagttcgtagctgtggggtccccattgctgctcatgagtctcgccttcgcacaagaattctcttccggatcaccaatcagctgcttttccccctctaacttcagcatccggcaggccgcatacgtggactctagctgctgggacagcctgctgcaccacaaacaggacggccctgggcaggataagatgaaatcattgtggcctcacaaggccctgccttactcgttgcttgccttggcgttgctgatgtacctcccggtgctactttggcagtacgccgctgtgcccgctctgtcctccgatttgctgtttatcatctccgagctggataaaagttacaaccgttcaatacgactggtgcagcacatgctcaagatacgccagaaatcctctgatccttacgttttctggaacgagctggaaaaagcaaggaaggaaagatacttcgaattccctctgctggagcgctacctcgcctgtaagcagagatcccatagccttgtggcaacctatctgctcagaaactccctcctgctcatctttacttccgccacatacctgtatctggggcactttcatcttgacgtcttttttcaggaggagtttagctgtagcatcaagacgggactgctctcagatgagacacatgttcctaacctgataacttgtcgtctgactagtctgagtatctttcagatcgtgagtctttccagtgtggctatttacaccatcttagttcctgtgatcatctacaatttgaccaggctgtgtagatgggacaagaggctgctcagcgtttatgagatgctccctgcctttgacctgctgtccagaaaaatgctgggctgtcccataaacgatctaaacgtcatcctcttattcctcagagctaacatttcagagttaatctcttttagctggctctcagtattgtgcgtgttgaaggatactactacccagaaacacaacattgacaccgtcgtggatttcatgactctgctcgccggcttagagccctccaagcctaaacatctgacaaactccgcatgcgacgaacacccatag

SEQ ID NO: 44698 - DNA, 309 bp, Artificial Sequence
  Description of Artificial Sequence: Synthetic coding sequence
atgcggtacggcttcgtgcggaagaagcaccggggcctgttcctgactaccgtagctgccctacctatctggaaccccataagcgaattcgtgaagtggtacaaatctcacaagttgagtcagcattgcattagaatttgcgggcatctctgccaaaagcacctcgacatgtttctctccgttataggtcaacggtggccaatcgatgtgttctccagtgtgtttgatcaccaggtctctgctatcggatcagacatcatttggtggttcttgaagctgtttttagtgagctttttttttttcttttag

SEQ ID NO: 44699 - DNA, 3315 bp, Artificial Sequence
  Description of Artificial Sequence: Synthetic coding sequence
atgaaggtgaccgtgtgcttcggccggaccggcatcgtggtgccctgcaaggagggccaattacgagtaggggagcttacacagcaagcactgcagaggtacctgaagacacgtgagaagggcccgggatactgggttaaaatacatcacctggagtataccgacggcggaattctcgatccagatgatgttctggctgacgtggtggaagacaaagataagctgattgcagtgtttgaggaacaggagccattgcacaagatcgagtcgccctctgggaatccagccgacaggcagagccctgacgctttcgagaccgaagtcgccgcccaactcgccgcctttaagccaatcgggggagagattgaagtgacaccctccgctctgaagctcgggacacccctgcttgtccgcagatcaagcgacccggtccccggcccgcctgccgacacacagcccagtgcctctcatccaggcggtcagtccctgaaactggttgttccggattcaacacagaatttagaggacagggaggtgctgaacggtgtccagacagagcttctgacatcccccaggacaaaagatacactgagcgatatgacaagaactgtcgaaatttccggtgagggcgggccactcgggatacatgtggtcccctttttctcttccctgagcgggaggatcctcggattatttattcggggaattgaagataattctcgatcaaaaagagaggggctgtttcatgaaaatgagtgcatagtgaaaatcaataatgtggacttggttgacaagaccttcgcccaagctcaagatgtttttcggcaggctatgaagtctcctagcgtgctactccacgtcctgccacctcagaaccgtgagcaatatgagaagagcgtaattggttccctgaacatatttggcaataacgatggcgttctgaaaacaaaagtcccccctccggtccacggcaagtctggcctcaaaacagcgaatctgactggaacagactctccagaaacggacgcatccgcatctctacagcagaacaagtcgccacgggttcctcggctcggaggcaagccctctagtccaagcctcagccccttgatggggttcggcagcaataaaaatgccaagaagatcaagatcgatctcaagaaaggccctgaaggattagggttcaccgtggtcacacgggactcgtctattcacggacccgggccaatcttcgtcaagaatatattgccaaaaggtgcagccataaaagatgggcgactacagagcggcgataggatcctggaggtaaacggcagggacgtgacaggccgtactcaggaggaactggttgcgatgctgaggtctacgaagcagggggagaccgctagcctggtgatagccaggcaggagggccacttcctccctcgcgagctaaagggagaacctgactgttgtgcattgtctcttgagacaagcgaacagcttaccttcgaaattccccttaatgattctggcagtgccggccttggcgtcagtttgaagggaaacaaaagcagggaaaccggtaccgatctcggtattttcataaagtcaatcatacatgggggagctgctttcaaggacggcaggcttaggatgaacgaccaactgattgccgtcaacggtgagtctctgcttgggaaatctaatcatgaggcgatggaaacccttcggcgctccatgagcatggaagggaacatcagagggatgatacagctggtcattctcagaaggccagaacgcccaatggaagatcctgctgagtgtggagcgttttctaagccatgcttcgagaattgtcagaatgccgttactacatcaagacgtaatgataattccattctgcatccactcgggacgtgttcacctcaagacaaacagaaaggacttttgctgccgaatgatggatgggcggagtctgaggtgccaccctcgcctactccgcatagcgcactgggccttggcttggaggattacagccacagcagtggcgtggactccgcagtctactttcctgaccagcatatcaacttccggtctgtgaccccagcgaggcagccggaatcgatcaatctgaaggccagcaagagcatggacttggtccccgatgaaagcaaagtgcacagcctggcagggcaaaaatccgagtctccctctaaagatttcggacccaccctgggcctcaagaaaagcagctctctagaatccctgcaaactgctgtggccgaggtgagaaaaaacgatctgccgttccaccgcccgagacctcacatggtgaggggtcgtgggtgtaacgaatccttccgcgcggctattgataagtcatacgacgggccagaagaaatcgaggccgacggcctgtctgacaaatcctcccactccgggcaaggggccctcaactgtgaaagcgctccacagggtaacagcgagctggaagacatggaaaacaaggcccggaaggttaagaaaacaaaggagaaggaaaagaagaaggagaagggcaaattaaaggtgaaggaaaaaaagcgaaaagaggagaacgaagaccctgagaggaaaatcaaaaagaagggtttcggagctatgctgcggttcggtaaaaagaaggaggacaagggcggaaaggcggaacaaaaaggaacccttaaacatggagggttgagagaagaagagttagagaaaatgaaggaagagagggagagtgggagacctacaggtggttccactgaccggattcagaaactcaggaaagagtactaccaggctcgacgggaaggctttccgctgtacgaggacgatgagggccgcgcacgtccgtctgagtacgatctgctgtgggttcccggaagaggaccagacggcaatgctcataacctcaggttcgaaggcatggaacggcagtatgcctcactgcctaggggaggacctgccgacccagtagactatctgccagccgctccgcgagggttatacaaggagagagagctgccatattatcccggagcccatcctatgcacccccccaaggggtcctatcctaggccgaccgagctacgcgtcgcagatttgagatacccacagcattaccctcccccccccgcccctcagcataaggggccatttagacaggatgtccctccaagccccccccagcaccagcggatgccagcttatcaagaaaccgggcgccctgggcccagaggagggtctcccgaccagtacccttaccgaacgcaggattctcggcagaagaatcccatgactgctgcagtgtag

SEQ ID NO: 44700 - DNA, 3411 bp, Artificial Sequence
  Description of Artificial Sequence: Synthetic coding sequence
atgaaggtgaccgtgtgcttcggccggaccggcatcgtggtgccctgtaaggagggtcagctcagggtgggggagttgacccagcaggctctccagcgctaccttaaaacgcgggagaaggggccagggtactgggttaagatccatcatctggagtacacggatggaggaatactggatccggatgacgtgttagcggacgtggtcgaagacaaggacaagctcatcgctgtctttgaggagcaagaacctcttcataagatcgaaagtccctcagggaatccagctgatcgtcaaagcccggacgcgtttgaaacagaagtggccgcacaactggctgcgtttaagcctattgggggcgagattgaagtgactccttctgctttaaaactgggtacacctctgctggtaaggaggagctctgatcctgtcccagggcccccagccgatacacagccaagtgcctcacaccctggaggacagtctttaaagttggtggtccccgactcaacacagaatttggaagatcgagaggtattgaatggcgtgcaaacagagctgctgaccagccctcgcaccaaggataccctctccgatatgacgagaacggtcgaaatcagtggcgagggcgggcctctaggcattcacgtggtgcctttcttttcctctctgtccggacggatcttgggtctattcattagaggtattgaagacaactcccgtagcaagcgcgagggtttgtttcatgagaatgagtgcatcgtgaagataaacaacgttgacctggtcgataagaccttcgctcaggcacaggacgttttcagacaggctatgaaatcccccagcgtgttgctgcatgtgttgcctcctcagaaccgggaacagtacgagaaatccgtgattggttcgctgaacattttcggcaataacgatggggtgctcaaaactaaagtgccaccccccgtgcacgggaagtcggggctcaaaacggctaacttgacaggaaccgacagtcccgagaccgatgcatcagcctcccttcaacagaataagagcccacgcgtgccccgcctcggcgggaaacccagctcaccatccctgtcgccgctaatgggattcggctccaataagaatgcgaaaaagatcaagatcgacttgaaaaagggacccgaggggctcgggtttactgtggtgacccgggactcatccatccatggcccaggtcctattttcgtgaaaaatatcctgccgaaaggagccgccattaaagacggtagactgcagtctggtgaccgcattcttgaggtgaacggaagagacgtcaccggaagaacgcaagaagagctggttgccatgttgcgctctacaaaacagggtgagactgctagcctagttattgctagacaggagggccacttccttccacgagagctcaaaggagagcctgattgctgtgctttaagcctggagacatctgaacaactgacgttcgagatccctctgaacgattcaggatccgctgggttgggggtgtctttaaaaggcaataagtctagagagactggtaccgatcttggcatcttcatcaaaagcatcatccacggaggggccgcgttcaaagatggtaggctgcggatgaacgaccagttaattgccgttaatggtgagagcctcttgggaaagtcaaaccatgaggcaatggaaacactgaggcggagcatgtccatggaaggtaacattagagggatgatccagctggtcattctacgccggccggagcgcccaatggaggaccccgctgagtgcggagcctttagcaagccttgttttgagaactgtcagaacgccgtaacaaccagcaggcggaacgacaattccatactccaccccctcggtacttgctccccacaagacaaacagaagggacttctgctgcctaatgatggctgggcggaaagcgaagtgcctccaagccctacaccacactccgccctcggtctcggactcgaagattactcgcattcctcaggagtcgatagcgccgtgtactttcccgaccagcacatcaattttcggagcgtgacaccggctcggcaaccagagagcatcaacctaaaggcttctaaaagcatggatctcgtccccgacgagtccaaggtacacagcctggctggccagaaaagcgacgggctgagcgataaaagctcccactcgggtcaaggggctctcaattgtgagagcgcacctcagggtaattccgaactggaggatatggaaaacaaagctcgaaaggttaaaaaaacaaaggagaaggagaaaaagaaagagaaaggcaaactgaaagtgaaagagaagaaacggaaagaagaaaacgaggaccctgagcggaagattaaaaagaaagggtttggcgcaatgctcagattcggcaagaaaaaggaggacaaaggagggaaggccgagcagaaaggaactcttaaacacggaggattgcgcgaggaggagctggaaaaaatgaaggaggaaagagagaggatcggagcaaaacatcaagagcttcgagaaaaacaagctcgcggactcctagattacgccacaggagccattggctctgtgtacgatatggatgatgacgagatggatcccaactatgcccgggtcaaccacttcagggagccttgtacctcagctaacgttttccgttctccgtctccacctagagctggccctttcggttacccaagagatggacaccctctctcccccgagcgcgaccatctcgaaggcctgtatgctaaggtgaacaaaccttaccatccgctcgttccagccgactctggacggcctactgggggaagtaccgaccgtatccagaagctgaggaaggaatactatcaggctagacgggaaggcttccccctttacgaggacgatgagggaagagctcggccctctgagtacgacctcctgtgggtgcccggacgtgggccagacggaaacgcacataacctcaggttcgagggcatggaacgacagtatgcaagtctgccaaggggcggccctgccgaccccgtggactatttgccggccgcccctcgggggctgtataaagagcgagaattaccatattatccaggggcccacccaatgcaccctcccaaggggagttacccaaggcctactgaattgcgggttgctgacttgagatatccccagcattacccgcccccaccagcccctcagcacaagggtccctttcgccaggatgtacccccctcgcccccacagcaccagcggatgccagcctatcaggagactggaagacccggaccacggggcggcagccctgaccagtacccctaccggactcaggacagcaggcagaagaatcccatgaccgcagcagtgtag

SEQ ID NO: 44701 - DNA, 3432 bp, Artificial Sequence
  Description of Artificial Sequence: Synthetic coding sequence
atgaaggtgaccgtgtgcttcggccggaccggcatcgtggtgccctgcaaggaaggacagctccgagtgggagagctgacacagcaggctctgcagcggtacctgaaaactcgcgagaaggggcccggatattgggtgaagattcaccacctcgaatatactgacgggggtatcctagaccctgatgacgttctcgcagatgtggtcgaagataaagacaagctaatcgccgtcttcgaagaacaagagcctctccataagatagaatcaccctcgggcaatcccgctgatagacagtcccctgacgcatttgaaaccgaagtagctgctcagctggccgcattcaagcccatcggcggggaaatcgaggtgacacccagtgcccttaagctgggaaccccattactagtgagacggtcttctgacccagtccccggcccacctgctgacacgcagccatcagcttcacatcccggtgggcagtccctgaaacttgttgtccctgattcgacccagaatcttgaagatagggaggtgctgaacggggtacagacagagctcttgacgagcccccgcaccaaggatactctgagtgacatgacgcgcaccgtcgaaatcagcggagagggcgggccactgggaatccatgttgtgccattcttctcgtccttatctggacgaattcttggcctttttataagaggcatcgaggataactcgaggtctaaacgcgaaggtttgttccatgagaacgaatgcatcgtgaagattaacaacgtagacctcgttgacaagacgtttgctcaggcccaggatgtattccgtcaggccatgaaatctccaagcgtgctgctgcacgtcttgcccccccagaacagggaacaatacgaaaaatctgtcattggatcactgaatattttcggtaataatgacggcgtcctgaagacgaaggttcccccacccgtgcatggaaagtcaggattaaagacggccaatcttacagggacagacagccctgagaccgacgcttccgcctcactgcagcagaacaagtccccgagagtgccccgcctaggtggaaagccaagtagccctagcctttctcccctgatggggttcggcagcaacaagaacgcaaaaaagatcaaaatcgatcttaagaaaggccctgaaggtctgggtttcaccgtggtgactcgagacagttctattcacggaccgggacccatcttcgttaagaacattttgcccaagggggcggcaattaaggacggtcgactgcagagtggtgatcggattctggaggtgaacggacgggacgtgaccggaaggacccaggaagagctggttgcaatgctgcgcagcacaaaacaaggtgagaccgcctccctcgtcatagctcggcaggagggacacttccttcccagggaactggacgggaggttacggatgaatgatcaactgattgccgtgaatggagaatctctgttaggcaagtcgaaccacgaggcgatggagaccctacggcggtctatgagtatggaaggaaacataaggggcatgatccaattagtcatcctacggaggcctgagcgacccatggaagatcccgcagaatgcggagccttttctaaaccatgtttcgagaattgccagaatgccgtcacaacctctaggagaaatgataactccatccttcaccccctgggcacttgctccccacaggacaagcagaagggcctccttctcccaaatgacggttgggccgagtctgaggttccccctagccctacaccgcattcggctctggggctcggcctggaagattactctcatagcagcggggtggactccgccgtgtacttccccgaccagcacatcaatttccgcagcgtaacccccgcccgccagcccgaaagtattaatctgaaggcctccaagagcatggacttggttcccgacgagtccaaggtacactcactagccggacagaagagcgaatccccctcgaaggattttggccctaccttagggctgaagaaaagctcctctctggaatccctccaaaccgctgttgccgaggtgcggaaaaatgatcttcccttccaccgcccccgtccccacatggtgcgcgggcggggatgcaacgaatctttcagagcggccattgacaagagttacgacggtccagaagagatcgaggcagacggtttatccgataaaagctcacatagtggccaaggcgcccttaactgtgagtcagctcctcaggggaacagcgagctggaggatatggaaaataaagcccgcaaggttaagaaaactaaagagaaggagaagaagaaggagaaagggaagcttaaagtaaaggaaaagaaacgtaaggaggagaacgaggacccagaacgaaaaattaaaaaaaagggtttcggagccatgctcaggttcggaaagaaaaaagaggataaaggagggaaagccgagcagaagggcactttgaaacacgggggcttgagggaggaggagctagagaagatgaaagaggagcgcgaaagaatcggcgcgaagcaccaggaactccgggaaaaacaggcaagaggcctgctggattatgcgactggagcgattggcagtgtctacgacatggacgacgatgaaatggatcccaattatgcccgagtaaatcattttcgtgaaccatgcacatcagctaatgtcttcagatcaccctcccccccacgtgcaggcccgtttgggtacccgagggatggccacccacttagcccggagcgcgatcacctagaggggctatacgctaaggtgaacaagccataccaccctctggtcccagctgactccggacgccctactgggggtagcactgataggatccaaaaattaagaaaagaatactatcaggcaaggcgggagggatttccactttatgaggacgatgaaggacgggcgcggccctccgagtatgatctgctgtgggttccaggacggggacccgatggcaatgctcataatttgaggttcgagggcatggaaagacagtacgcaagtcttccacggggaggcccagcagacccagtggattacctcccagcagcgccccggggtctgtataaggagagagaactgccatattatcccggagcccatcctatgcacccccctaagggttcctaccccagacccacagagcttcgtgtggctgacctccgatacccccaacactaccccccccctccagcacctcaacacaagggccccttcagacaggatgttccacccagcccgcctcagcatcaaaggatgccagcctaccaggaaacgggccgaccagggcctagaggcgggagtccagaccagtacccttacaggactcaggattcccgacagaagaaccctatgacggcagcagtttag

SEQ ID NO: 44702 - DNA, 3618 bp, Artificial Sequence
  Description of Artificial Sequence: Synthetic coding sequence
atgaaggtgaccgtgtgcttcggccggaccggcatcgtggtgccctgcaaggagggacagctgcgcgtgggggagctcactcagcaggctctgcaacggtacttaaaaacgagggagaaggggccagggtactgggttaaaatacaccacctggaatacaccgacggaggtatactcgatcccgacgacgtgctggcagacgtcgtggaagacaaggacaagctgatcgccgtttttgaggaacaggaacccctccataaaatagagagcccatcaggaaatcccgcagatagacagagcccggacgccttcgaaacagaggtggccgcccaactagctgcttttaaaccaattggcggggagatcgaggtaacgccatccgctttgaagctcggaaccccgctgcttgtgaggagatccagcgacccagtgcccggaccccccgcggatacccaacctagtgcatcccaccctggcggccaatcgctcaagttggtcgtgccagatagtacgcagaacctggaagatagagaggtcttgaatggagtgcagacagagctgcttacatcccccaggaccaaggacacactgtcagatatgaccaggactgtggagatctcaggggaaggagggccattaggaatccatgtggttcccttcttctccagtctgtccggtcggatactgggattattcatccgaggaatagaagataatagccggagtaagcgtgagggtctgttccacgagaatgagtgtattgtgaaaattaataacgtcgacctggtcgacaaaacatttgcgcaggcgcaggacgtgttcagacaagcaatgaaaagtccgtctgttctgctgcacgtcctgccacctcagaacagggagcagtatgaaaaaagcgtgatcgggtcgctgaatatcttcggtaataacgatggagtgttgaaaacaaaggttccgccaccagtgcatggtaagtctgggctgaaaaccgccaatctgacaggcaccgactcacccgaaactgacgcctctgcgtccctacagcagaacaagagtcctagagtgccaaggctcggggggaagccctcttctccttcactgtccccactgatgggattcggcagcaataaaaatgccaagaagatcaaaatcgatctgaaaaaagggcccgaaggcctgggctttaccgtggtaactagagactcatctatccacggccctggccctatcttcgtcaagaatatcttacctaagggggctgccatcaaggacggaagactgcagtcgggggatcggatattggaagttaacggccgcgacgtaacaggtcgaacgcaggaagaactggtggcgatgctgcgcagcaccaaacagggggagacagcttctctggtcatcgccaggcaggagggccacttcctccctagagagttgaaaggcgagcctgattgttgcgccctgtctctggagacttccgagcaacttacgttcgaaattcctttaaacgattcaggtagcgctgggcttggtgtcagcctgaaggggaataagagccgcgaaacaggtaccgacctgggaatattcataaaatccattattcacggaggggcagctttcaaggatgggcgtctgaggatgaacgatcaactcatcgcagtgaatggagaaagtttgcttggtaagagcaaccacgaggccatggagacactgcggcgcagtatgagcatggagggcaatataagagggatgatccagctggtgattttaagacggcccgagcgtcctatggaggatcctgctgaatgcggagccttttcaaaaccatgcttcgaaaactgtcagaatgccgtgaccacctctagaagaaatgacaacagtattctgcatccacttggcacctgttctccgcaggacaagcagaaggggctgcttcttcctaacgacggatgggctgagtccgaggtgccgcctagcccgacaccacacagcgcactaggtctggggctggaggactactcacattcgtctggcgttgatagcgcagtgtattttcctgaccagcatatcaacttccgaagcgttacgcccgcccggcagccagagtccatcaacttgaaggcgtccaagtcaatggatctagtccccgacgaaagcaaggtgcactctctcgcaggccagaaatcagagtcccctagtaaagacttcggccccacattgggtttgaaaaagagtagtagtctggaaagtttgcaaaccgctgttgcagaggtcagaaagaacgatctcccgttccatagaccccgtccccatatggtgcgaggcagagggtgcaatgagagcttcagggcagctattgacaagagctacgatgggcctgaggaaattgaggcagacggactcagtgacaaaagcagccactcgggtcagggtgcactaaattgtgagtcggcgccacagggcaactccgagttggaagatatggagaataaggcccgaaaagtcaagaaaaccaaggaaaaagaaaagaagaaggagaaaggtaagctgaaggtcaaagaaaagaaaaggaaggaggaaaatgaggaccccgaacgaaagatcaagaaaaaggggtttggagctatgctccgttttggaaagaagaaagaggacaagggtggtaaagctgaacagaagggtacactgaagcatggcggattgagggaagaggagctggagaagatgaaggaggagagggagaggatcggtgccaaacaccaggaactgcgtgagaagcaggcccgtggacttctggattacgctacaggagcgatcggcagtgtgtacgatatggacgatgacgaaatggaccccaactacgcgagggtgaatcattttagagaaccctgtacatccgctaacgtgttccgctcacccagtcccccacgcgcggggccgttcggctatcctagggatgggcatccactctcgcccgagcgcgatcacctggaaggcttatacgcaaaagtgaacaaaccctatcaccccctcgtgcccgccgatagtgggaggccgacaggaggtagtactgatcgaatccaaaagctgcggaaggaatactatcaggctcgcagggaagggtttcctctctatgaggacgatgaggggcgggctaggccaagcgaatacgacctgctgtgggtgcctggacgtggacccgacggaaacgctcataacttgcggtttgaggggatggagaggcaatacgcctcgcttcccaggggcgggcctgccgaccctgtggattacctccctgcagcacctagaggactatacaaagaacgtgagttgccttactatccaggtgcccaccctatgcatcccccgaaagggagctatcctcgtcccactgagttgcgcgtagccgatctgcgctatcctcagcattaccccccccctccggcaccccagcataaaggcccatttcgacaggacgttccacctagcccacctcagcatcaaagaatgcctgcatatcaggagaccggccgacccggacctagaggcgggagccccgaccagtacccatatcggacacaagatagtaggcaaaagaatccgatgactgccgccgtgtag

SEQ ID NO: 44703 - DNA, 828 bp, Artificial Sequence
  Description of Artificial Sequence: Synthetic coding sequence
atgccctacgccaaccagcccaccgtgcggatcaccgagctgaccgacgaaaacgttaagttcataattgagaacaccgaccttgcagtggctaattctattcgacgggtttttattgcagaagtgccaatcatcgcaatcgattgggtacagattgatgctaattcttctgtgttacatgatgaattcatcgcgcatcgcctaggattgattcctctcatttccgacgacatcgtcgacaagctgcaatactcccgcgactgtacatgtgaggagttctgtcccgaatgctctgtcgaatttacgcttgatgtccggtgcaacgaggaccagacacggcacgtgacttcgagggacttaatctcaaactctccgcgggtgataccagtcacgtcgagaaacagggacaatgatccgaacgattacgtcgagcaggacgatatcctgatcgtgaaactcagaaaggggcaagagctgcgactcagagcatatgcgaagaagggctttgggaaggaacacgccaagtggaaccctactgcgggagtggctttcgagtacgaccccgacaatgccctgagacatacggtttaccctaaacctgaggaatggcccaaatcagagtatagtgagcttgatgaagatgagtcacaggccccctatgatcctaatggaaagcccgaacggttttactacaacgttgagtcctgtggatcgctgcgacccgagaccatcgtgctgtccgccctatccggactgaaaaagaaactgagcgacctacagacgcagctgagccatgagatacagtctgacgtgctcacaattaattag

SEQ ID NO: 44704 - DNA, 1038 bp, Artificial Sequence
  Description of Artificial Sequence: Synthetic coding sequence
atggcccggccccagcggacccccgcccggagccccgacagcatcgtcgaggtaaagtctaagtttgatgctgaatttcgacgatttgctttgcccagagcttccgtctctgggttccaggaattttcacggttactaagggctgtgcatcagatccccggactggacgtgctccttggctacactgatgcccacggcgatcttctgcccctcacaaatgacgatagcttgcaccgagcactagccagcgggccacctccgctcagactcctcgttcaaaaacgggaggccgattcatccgggcttgcctttgcctcgaactctctgcagcgacggaaaaaaggccttttgttaaggccggtcgcgccgcttcggacaaggccacccctgctcatatctctccctcaggatttccgtcaggtcagtagcgtgatcgacgttgacctgcttccagagacacacaggcgggtcaggctccacaagcacggctctgatcgccccctcggtttttacatcagggacgggatgtctgtgagagttgcgccacaaggactcgagagagtaccaggaattttcattagccgactggttcggggtggactggcagagtctaccggacttttggccgtcagtgatgagattctagaggtgaacggaatcgaagtcgccggaaagaccttggatcaggtgaccgacatgatggtggccaattcgcacaatttgatcgtcacagtcaagccagcgaaccagcggaacaatgttgtgagaggggctagtggccgccttaccggccctccctcggccggacccggccctgccgagcctgattccgacgacgattctagtgatctcgttatcgaaaaccggcagccaccaagtagcaatgggctttcgcaaggccccccctgctgggatcttcaccctgggtgcaggcaccctggaacgcgtagttcgctaccgagcctggacgatcaagaacaggcgagttctgggtggggttctagaatccggggggacggctccggtttttctctgtag

SEQ ID NO: 44705 - DNA, 1032 bp, Artificial Sequence
  Description of Artificial Sequence: Synthetic coding sequence
atggaggtgctggccgccgagaccaccagccagcaggagcggctgcaagcaattgcggaaaagaggaaaagacaggccgagatcgagaataagagacggcagcttgaggatgagcgacgccagctgcagcacctgaaatctaaagctttgcgcgagagatggctgttggagggtactccgtcttctgctagcgagggagatgaggacctcagaaggcagatgcaggatgacgagcagaagacccgcctgttagaggactccgtgtcccggctcgaaaaggagatcgaagtactggaacgtggcgattctgctccagctacagccaaggaaaatgcggccgccccatcccccgtcagggcccccgccccatcaccggcaaaggaagaaaggaaaaccgaggtagtaatgaactctcagcagacacccgtgggcactcccaaggataagcgagtgtctaacactccgctgaggaccgtggacggctctcctatgatgaaagctgtggttcatgcggtggacgggactgctgagaacggaatacatcctctgagttcctctgaggtcgacgagttgatccacaaggccgacgaagtcaccttgtccgaagctggctcaaccgctggagctgcagaaacgagaggagccgtcgaaggcgccgcgcgcacaacacccagtaggagagagattacaggggtgcaagcgcagcccggggaagctacctctggccctcccggcattcagcccggtcaagaacccccagtgactatgatttttatgggctaccagaatgttgaagacgaagctgagacaaagaaggtcctgggtctgcaggatacaataaccgcagaactggtcgtgatagaagatgcagctgaaccgaaagaacccgcccctccaaatggaagcgcagcggagccaccgaccgaagcggccagtcgcgaggaaaatcaggccggaccggaagcaacaacctccgacccacaggacttagacatgaagaagcatcgatgtaaatgttgttctatcatgtag

SEQ ID NO: 44706 - DNA, 1164 bp, Artificial Sequence
  Description of Artificial Sequence: Synthetic coding sequence
atggaggtgctggccgccgagaccaccagccagcaggagcggctgcaggcaatcgccgagaagaggaaacgacaggctgagatcgaaaataagcgccgccagcttgaggacgagagaaggcagctgcaacatctcaagtcgaaggccctaagggagcggtggctactggagggcaccccgtcctctgcctcagaaggagatgaagaccttaggcggcagatgcaggacgacgagcaaaagactagattgctcgaggatagcgtttcaaggctcgagaaagaaatcgaagttctggagagaggagacagcgcaccggccaccgcaaaggaaaacgcagccgccccctcacccgtgcgtgcacctgctccctctccagccaaggaggaaagaaagaccgaggtggtgatgaactcacaacagacaccagtcggaactcctaaggacaagagagtgtcaaacaccccactgcggactgtggatgggagccctatgatgaaggccgccatgtacagcgtggagattactgtggagaaggataaagtgacaggggagaccagagtcctctcgagcaccaccctgttgccgcggcagccgttaccgctgggaattaaggtctacgaagatgaaacgaaagttgttcatgcagtggacgggacagcggagaacggaatccacccgctttccagctcagaagtcgacgaactgattcataaagcagacgaggtcacactgagtgaagccggcagtactgctggcgcagccgaaacccggggagcagtagagggggccgcgaggaccacgcctagtcgccgcgaaattaccggtgtgcaggcacagcctggtgaggcaacatcaggaccgcccggcattcagcccgggcaggagccaccagtgaccatgattttcatggggtaccagaatgtagaagacgaggccgaaaccaagaaggtgctaggactgcaagatactataacggcggagttagttgtgatcgaagatgccgcagagccgaaggaacctgcccctcccaacggatctgcagctgagccccccacagaggccgctagcagggaggaaaaccaagcaggtcccgaagctacgacctccgacccccaggacctggacatgaagaagcatcgctgcaaatgttgcagcattatgtag

SEQ ID NO: 44707 - DNA, 759 bp, Artificial Sequence
  Description of Artificial Sequence: Synthetic coding sequence
atgaacagccagcagacccccgtgggcacccccaaggacaagcgggtttctaacacaccactgcggaccgttgatggaagccctatgatgaaggcggctatgtattctgtagagataactgttgaaaaggataaagtcaccggggaaacccgagtgctatccagtacgaccctcctgcctcgccagcctcttccactaggcattaaagtttatgaagatgagaccaaagtagtccatgccgttgatggcacggccgagaacggcatccacccactgtcctcgagtgaggtggatgagctcatacataaggccgatgaggtgactttgtcagaggccgggagtaccgcaggtgcggctgagacccgcggggccgtcgaaggagctgctcggacaacaccaagccgacgggagataacaggagtccaggcccagcctggcgaggctactagcggcccacctggcatacagccaggtcaagagcccccagtgaccatgatcttcatgggatatcagaatgtggaagacgaagcggaaacaaagaaagtcctggggctacaggatactattaccgccgaactggtggtgatcgaagacgccgctgaacccaaagagccggccccccccaacggatccgccgcagagccaccaacggaggcagctagtcgtgaggaaaaccaggccgggccagaagccacaacttcagatccccaggacttggatatgaagaaacacaggtgtaagtgctgtagcataatgtag

SEQ ID NO: 44708 - DNA, 1062 bp, Artificial Sequence
  Description of Artificial Sequence: Synthetic coding sequence
atggccatgaccctgctggaggactggtgccggggcatggacgtgaactctcaacgcgccctcctcgtgtgggggatccctgtgaactgcgacgaagccgagattgaggaaaccctccaagcagcaatgccgcaagtgagttataggatgttgggccgaatgttctggagagaagaaaacgcgaaggctgcattgttggagcttactggggcggtggactacgccgctattccacgagagatgcccgggaagggaggagtctggaaggtgctgttcaaacctcccacatctgacgccgaatttctcgaaagattgcatctctttctagcgagggaaggctggactgtgcaggacgtcgcccgggtgttgggattccagaacccgacaccgaccccaggacctgagatgccggccgaaatgctgaactacatcctggataacgtgatacagcccctggtagaatctatctggtacaagcgcctaacgctgttctcaggaagggatattcccgggccaggtgaggaaaccttcgacccttggctggaacacacaaacgaggtgctagaggagtggcaggtgtcagatgtggagaagagacgaaggctaatggagagcctgagaggccccgctgcagatgtgatcagaatcctaaaaagcaataacccggcaattacaaccgctgagtgcctgaaggccctcgaacaagtttttggatcggtggaatccagccgggatgcgcagatcaagttcctgaatacctaccagaatccaggggaaaagctgagcgcatatgttatcaggttagagcccctgcttcagaaggtcgtcgagaagggtgcgatcgataaagataatgtgaaccaggccaggctagagcaggtgattgccggggctaatcattcaggggccattagacggcaactgtggcttactggagctggtgagggccctgctcctaacctgtttcaattgctcgtccagattcgagaggaggaggctaaagaggaggaggaagaggctgaggccacgctgctgcagcttgggttggagggccacttctag

SEQ ID NO: 44709 - DNA, 1782 bp, Artificial Sequence
  Description of Artificial Sequence: Synthetic coding sequence
atgggcaccgcccggatcgcccccggcctggccctgctgctgtgctgcccagtcctcagctccgcgtacgcattggtggacgctgacgacgtcatgaccaaagaagagcaaattttcctgctgcaccgggcccaggcacagtgtgagaagaggctgaaggaggtcttgcagcgcccggcatctattatggaaagcgacaaaggctggacaagcgcctctacgagcggcaagccccgcaaggataaagccagtggaaaactgtatcctgagagtgaggaggataaggaggcccccacagggagtcggtatagaggaaggccttgtctccctgaatgggatcatattctctgctggcccctgggggctccaggagaagtggtggccgtgccctgtcccgactatatctatgactttaatcacaaagggcacgcctacaggcggtgcgaccgtaatggatcttgggagctggtgcccgggcacaacagaacatgggccaactattctgagtgcgtgaagtttttgactaatgagacccgtgaacgcgaagtttttgacaggctgggaatgatttacaccgtcggctactctgtgtcccttgcatctctgactgtcgcggtcctcattcttgcctatttcagaaggctccattgcacacggaattacatacatatgcaccttttcctgagtttcatgcttagagctgtgagcatttttgtgaaagacgctgtactgtacagcggagccacgctggatgaggctgagcgattgaccgaggaagaactcagggctatcgcacaggcacctcctccaccagctacggccgcagccgggtacgccggatgtcgtgtggctgtgactttcttcctgtactttcttgccacgaattattattggattctggtcgaggggctctatctccactctctgattttcatggctttcttcagcgaaaaaaagtatctctggggatttacagtctttgggtggggtctgcccgctgtgttcgtggccgtctgggtgtctgtgcgcgcgacactcgccaatacaggatgctgggacctgtcctctgggaacaagaagtggatcattcaggtccccatccttgcgtccatagtcctgaacttcatactttttatcaatatagtgcgcgtcctagccaccaagctccgggagacaaatgctggccgctgcgacacacgacagcagtaccgcaagttgctcaaaagcaccctggttttgatgcccctgtttggtgtgcattacattgttttcatggctactccatacacggaggtgagtggaaccttgtggcaagtccaaatgcattatgagatgcttttcaacagctttcagggctttttcgtcgccataatttactgcttttgcaatggtgaagtgcaggccgagatcaagaagtcctggagtaggtggacgctcgccctagactttaaaagaaaagcacggagcggtagctcgtcatactcctacggccccatggtgtcccatacctccgtcactaacgttgggccccgtgttggattggggctgcccctcagcccacgcctgctgcccacagctaccaccaatggtcacccccagcttcccggacatgcgaagccaggaactccagcgcttgagacccttgagacaactcctcccgccatggcagcacccaaggacgacggctttctcaacgggtcctgcagcggtctggacgaagaagcgtctggaccagaacgccccccagcattacttcaggaggaatgggaaactgtcatgtag

SEQ ID NO: 44710 - DNA, 1782 bp, Artificial Sequence
  Description of Artificial Sequence: Synthetic coding sequence
atgggcaccgcccggatcgcccccggcctggccctgctgctgtgctgcccagtgttaagtagtgcctacgccctcgtggatgctgatgacgtgatgactaaggaggagcagatcttcctcctgcatcgggcccaggcgcagtgtgagaagagactgaaagaagttcttcagcggcctgcgtcgataatggagagcgacaaagggtggacatcagccagcacgtccgggaagcccaggaaagataaagcttcagggaaactttatcccgaatctgaagaagacaaggaggcacccactggatctcgttacaggggccgtccctgccttccagagtgggaccacatcctttgttggccgttgggagcacccggggaagtggttgctgttccctgcccggactacatttatgattttaaccataaggggcacgcctacaggcggtgcgaccgaaacgggagttgggagcttgtgccagggcacaatcgcacatgggcaaattactcggagtgcgtaaagtttctcactaatgaaactcgagagcgggaagtgttcgaccgtctcgggatgatctatactgtggggtattcggttagcctcgcatctctaacggtggctgtccttatcctagcctatttcagacgcctgcattgtacgcgtaattacatccacatgcatctgttcctctcctttatgctccgcgctgtgtctatctttgtgaaagacgccgtgctgtactccggcgctacacttgacgaagccgagcggctcacagaggaggagcttcgagcgatcgctcaagcccctcctcctcccgcgaccgccgctgccggctacgctgggtgtcgagtcgctgtaaccttctttctctacttcctggccaccaattactattggatcttagtggaaggcctgtatttacacagtctaattttcatggctttctttagcgaaaaaaagtacctatggggcttcactgtctttgggtggggccttccagcagtgtttgtcgctgtctgggtgtcagtacgcgccacgctggcaaatactgggtgctgggacctatcttcggggaacaaaaaatggatcatccaggtgccaatcctggcaagtatcgtactcaacttcatcctgtttatcaacatagtgagagtgctcgcaactaaactcagagaaacgaatgcagggcgctgcgacacgcgacagcagtaccgtaagctcttaaagagcacattagtccttatgcccctgttcggcgtgcactacattgtgttcatggccacaccatacacagaggtaagcggcacattatggcaagtgcagatgcactatgagatgctgtttaactcatttcaggggtttttcgtcgccattatctactgtttttgtaacggagaggttcaggctgaaatcaagaaatcttggtctcggtggaccctggctctggatttcaagagaaaagctcggagcgggagctcgtcttattcttacggcccaatggtatctcatacatcagttaccaatgtgggcccccgagtgggcttgggactgccattatctcccagattactgccaactgcaaccactaacggacacccccagctcccggggcatgcaaagccaggaacccccgctctcgagacgctcgagactacccctccggcgatggcagcccctaaagatgatggctttttaaatgggtcctgtagtgggttagacgaggaagcctccggtccagagagaccacccgcgctgctgcaggaggagtgggagacggtcatgtag

SEQ ID NO: 44711 - DNA, 1584 bp, Artificial Sequence
  Description of Artificial Sequence: Synthetic coding sequence
atgggcaccgcccggatcgcccccggcctggccctgctgctgtgctgccccgtgctgtctagtgcctacgctctggtggacgctgacgacgtgatgaccaaagaggagcagatatttctgcttcaccgggcgcaagcgcagtgcgagaaacgcttaaaagaggtactgcagaggccggccagcatcatggaatctgacaaggggtggactagtgcatctaccagcggcaaaccccggaaagataaggcctcaggcaaactctacccggaaagtgaggaggacaaagaggcaccaacgggtagccgatatcgagggcggccatgcctgcctgaatgggaccacatcctgtgctggcctctcggcgcgccaggagaggtcgtggccgtgccctgccccgactatatttacgatttcaaccataagggccatgcttaccgccggtgcgaccggaacggttcctgggagctggttccggggcacaaccgtacgtgggcaaactattccgagtgtgttaagttcctgacaaatgaaactagagagagagaggtgttcgatcgcctcggaatgatttataccgtcgggtacagcgtgtccctggcaagtctaaccgttgcggtgcttatcctggcctacttccggcgcttgcattgcacaaggaactatatccacatgcacctattcctctcattcatgctcagagccgtctctattttcgtgaaggatgccgtgttgtattccggggctactctggatgaggctgagaggctgactgaggaagagttgagggccatcgctcaagccccccctcccccggccactgccgctgcagggtatgctggatgtcgtgtggctgtaacgtttttcctgtatttcttagctaccaactactattggatcctggtcgaggggttgtatcttcacagtcttattttcatggccttcttctcagagaaaaaatacctgtggggcttcactgtgtttggatggggcctgcccgccgtcttcgtagcggtttgggtgagtgtgcgggccacattagccaatacaggctgctgggacttatcctcaggaaacaagaagtggattatacaggtcccaatactggcctccatagttctgaattttatcttattcataaatattgttcgcgttctggccactaaactgcgggagacaaacgcgggacgttgcgatactagacagcagtatcgcaagttactaaaatccacactcgtcctcatgccccttttcggcgtgcattatatcgtgttcatggccactccctacacagaagtgagcggaaccctgtggcaggtgcagatgcattatgaaatgctgttcaactcattccagggcttctttgtggccatcatctactgtttctgcaatggcgaagtgcaagccgagatcaagaagagttggtcacgttggactctggcactagacttcaaacgcaaggccaggagcggttctagcagttattcatacgggccaatggtgtcccatactagcgtaacgaatgtcgggccgcgcgtcgggctgggtctgcccctctctcctcgactcctgcccacagcgacatag

SEQ ID NO: 44712 - DNA, 1002 bp, Artificial Sequence
  Description of Artificial Sequence: Synthetic coding sequence
atgggcaccgcccggatcgcccccggcctggccctgctgctgtgctgtcccgtactctctagtgcttacgcactggtagacgcagacgatgtcatgaccaaggaggagcagatatttctcttgcaccgtgctcaggcacagtgcgagaagaggttgaaggaagttctgcaacgccccgctagtatcatggaatctgataaaggctggacgagcgcctctaccagtggcaagccaagaaaggacaaggcttccggaaaactctaccctgagagtgaggaggacaaagaagccccgactggctctagataccgcggcaggccttgcctgcccgagtgggatcacatcctttgttggcccctgggggcacccggcgaggtcgtcgctgtgccatgccccgattacatatacgacttcaatcataagggccatgcctatcgtcgctgtgatcggaacggcagctgggagcttgtgccagggcacaacaggacatgggccaactacagcgaatgtgtgaagtttctgacgaatgaaacccgggaaagagaggtgtttgatcgtctgggcatgatctacaccgtggggtacagtgtatcccttgcttcattgaccgtcgctgtgttaattctcgcctatttcagaaggctccattgtactcgcaactacatccatatgcaccttttcctgagcttcatgctgcgagccgttagcatcttcgtcaaagatgcagtactctacagcggagccacattagacgaggcagagagactgaccgaagaggaactgcgggccattgcccaggcccccccccctcctgctaccgccgccgccggatacgccgggtgtcgcgtggccgtcacgttcttcctctacttcctagccaccaattactattggatcctggtggaggggctgtatttgcatagcctgatcttcatggcgtttttcagtgagaagaagtatttatgggggttcacagtgttcggttggggtgccgggacttag

SEQ ID NO: 44713 - DNA, 1782 bp, Artificial Sequence
  Description of Artificial Sequence: Synthetic coding sequence
atgggcaccgcccggatcgcccccggcctggccctgctgctgtgctgtcccgtcttgtcatccgcctacgcactggtggacgcggatgatgttatgacaaaagaggagcagatatttctcctccaccgcgctcaggcccagtgcgagaaacggttgaaggaggtgcttcagcgacctgcgtctataatggagtctgacaaaggttggacttccgcatcaacctctggaaagcccagaaaggacaaagcatccggtaagctgtaccctgagtccgaagaagacaaagaggcaccaacagggtcaaggtacagagggcgtccctgtttgccagaatgggaccacatattgtgctggccgcttggtgctccaggagaagtcgtagctgtgccctgccctgactacatttatgatttcaatcacaaggggcacgcataccgcaggtgcgatcggaatgggtcttgggagttagtgcctggccataataggacatgggcgaattattctgagtgcgttaaattcctaacaaacgagaccagggagcgagaggttttcgatcggctcggtatgatctataccgtaggctattcggttagcttagcgagtctgactgtagccgtcttaattttggcatactttagacgcctccactgcacccggaattacattcacatgcacctgtttctgagctttatgttgcgcgccgtgtcaatattcgtgaaagatgccgtgctctacagtggggcgacactagacgaagccgagcggctcacagaggaggagctgcgggccattgcacaagcaccaccaccgcccgcaaccgcggccgctggatatgccgggtgccgcgtggccgtaacattttttctctactttttggcaaccaattattactggatcttggttgaaggactctatctccacagtctgatattcatggcgttcttctccgaaaagaaatatttatggggctttactgtcttcggttggggcctgccagcagtctttgtagctgtgtgggttagtgttagggccactctggcaaatacgggatgctgggatctgagctcaggcaacaagaaatggatcatccaggtgcctatcttagcctccattgtcctcaacttcattctgtttattaacatcgttcgggttttggctactaagctgcgcgagaccaacgccgggcgctgtgacactagacagcagtatcgcaagcttctgaaatccacattggttctgatgccactgtttggggtgcattatatagtctttatggctacaccctatacggaggtgagtggtacactgtggcaggtccaaatgcactatgagatgctcttcaattctttccagggttttttcgtcgcgattatctactgcttctgtaatggtgaggtgcaggccgagattaagaagtcatggtcccgctggacactggcccttgacttcaagagaaaggccaggtctggcagtagtagttactcttatggacctatggtgagccacactagcgtgacaaatgtggggccgcgtgttggtctgggcctgccactgtctccccggctgttgccgaccgctaccactaatggtcacccccagttaccggggcacgccaagccagggacaccagccttggagactttggaaacgactccccccgccatggccgcacctaaggacgatggattccttaatgggtcttgcagcggactggacgaagaggccagcggccccgagcgtcctcccgcgttactccaggaagagtgggagacagtaatgtag

SEQ ID NO: 44714 - DNA, 1782 bp, Artificial Sequence
  Description of Artificial Sequence: Synthetic coding sequence
atgggcaccgcccggatcgcccccggcctggccctgctgctgtgctgtcccgtgctatcctcagcatatgcacttgtggacgctgacgacgtgatgaccaaggaggagcaaattttcttattgcaccgcgcgcaagcccaatgtgaaaagcggctcaaggaggtcctccagcgcccagcgtccataatggagtccgataaggggtggacttccgcatcaactagcggcaagcctcgtaaggataaagctagcggcaagctgtatccagagtctgaagaagacaaggaggctccaaccggtagtcggtacagaggacgtccatgcttaccagagtgggaccatatcctgtgttggccacttggcgcccccggagaagtagtcgctgtgccttgtccagactatatctatgactttaatcataaagggcatgcgtatcggcgctgcgaccggaacggatcctgggaactcgttccagggcacaatcgtacctgggcgaattattccgagtgtgttaagtttctgactaatgagactcgcgagcgagaggttttcgataggttaggaatgatctataccgtcggctacagcgtgtccctcgcatcactgactgtagccgtgctgatactggcctatttccgacggctgcactgtactaggaattacatccacatgcacctctttctgtcattcatgctcagagcggtctctatcttcgtgaaagacgctgtcctgtatagcggggcgactcttgatgaggctgagcggctgaccgaggaagagctgcgtgctattgcacaggcccccccccctcccgccactgctgcagccggatatgccggttgcagggtcgccgtcactttcttcctctattttctggctacaaattactactggattctggtggagggcttgtatctacacagcctgatttttatggcctttttctccgagaaaaaatatctttggggatttaccgtgtttggttggggactgcctgccgtattcgtcgccgtttgggtatccgtgcgcgccaccctggcgaacactggatgctgggacctctctagtggaaataagaaatggattatacaagtgccaattctggcatctattgtcctgaattttatcctgtttatcaacatcgtgagggtgttggcaactaaacttcgggagactaatgcaggccgctgtgacacacgccagcagtatagaaagctcttaaaatccaccttggtcctgatgcctctgttcggggtacactatattgtgtttatggccacaccatataccgaggtctctggaaccctatggcaagtgcagatgcactatgaaatgttattcaactcttttcagggctttttcgtggcaatcatatactgtttttgtaacggtgaggtgcaggcagagatcaagaaaagctggtcccgctggactcttgctctcgactttaaacggaaggccaggtccggcagtagctcctattcttacggtcctatggtgtctcatacgtctgtcacgaacgtgggcccacgggtgggcctcggcttgcctctctcgcctcgcctcctccccacagccactactaatggacacccacagttgcctggtcacgctaaaccaggaaccccggcgcttgagactttggaaacaacacccccggccatggcagcccccaaagatgacggctttctgaacggcagctgttccggattagatgaggaagcttctggtcccgagcgcccccccgcactgctgcaggaggaatgggaaacagtgatgtag

SEQ ID NO: 44715 - DNA, 1653 bp, Artificial Sequence
  Description of Artificial Sequence: Synthetic coding sequence
atggccggcctgggcgccagcctgcacgtgtggggctggctgatgctgggttcttgcttgctagcgagagcccagctggattccgacggcacaattactatcgaggaacaaattgtactggtcctgaaggctaaggtccaatgtgagctgaacattaccgcacagcttcaggaaggagagggaaattgtttccccgagtgggacggccttatttgttggccacgcggaacagtcggcaagataagcgcagtgccctgtcctccgtacatatatgactttaatcataaaggcgttgccttccgccactgcaatcccaacggaacctgggacttcatgcacagtcttaacaagacatgggcgaactactcggattgccttaggtttcttcaaccagacatctccattggaaagcaagaattctttgaaagactttacgtgatgtatacggttggctactccatctctttcggctccttggcagttgccatcctgattattggatacttcagaagactgcattgcacacgcaactatattcacatgcacctatttgtgagctttatgctgagagcaacgtccatttttgtgaaggatagggtcgttcacgcacacattggagtgaaggaactggagtccctgataatgcaagacgatccacaaaactccatagaggctacttctgtggacaaatcccagtacattggctgtaagattgcagtcgttatgttcatttatttcctggctacaaactattactggattctggtcgagggcctgtatctccataacctgatcttcgtcgcgttctttagcgacaccaagtacctgtggggatttatcctgatcgggtggggatttcctgccgcttttgtggccgcctgggcagtcgctcgcgcaacgttggcagacgccaggtgttgggaactgagcgccggggatattaaatggatctaccaggcccctattcttgctgccatcgggttgaactttattctattcctgaataccgtgcgagtcctggccacaaaaatctgggaaacgaatgcagtcggccatgataccagaaagcagtacagaaaactcgccaagtcgactctggtgcttgtgctagtatttggggttcactatatcgtgttcgtctgtctgccccactcctttacaggactcggctgggagatcagaatgcactgcgaactgttctttaatagctttcagggtttttttgtgtccatcatttactgctactgcaacggggaagttcaggcggaagttaaaaaaatgtggtctcggtggaatttgagtgtggactggaaaagaaccccaccctgcggaagccggagatgtggctcagtcctaaccacagtcacccattctacatcaagtcagagccaggtagcagcttcaactaggatggtacttatctctgggaaagcagccaaaatcgccagtcgtcagccggactctcatatcacattacccggatacgtttggtctaatagcgaacaggactgtctgccacattcatttcatgaggagacgaaggaggacagcggtcgccagggggacgacatactaatggagaagcccagcagacctatggaatcaaacccagacacagaggggtgccagggggaaacagaagatgtgctgtag

SEQ ID NO: 44716 - DNA, 345 bp, Artificial Sequence
  Description of Artificial Sequence: Synthetic coding sequence
atgagcgccctgagcctgctgatcctgggcctgctgaccgccgtgccacccgcctcatgccagcaggggctgggcaatctccagccctggatgcaaggcctcatcgctgtggcggtgttccttgtgctagtggccatcgccttcgcagtgaatcacttttggtgccaggaggaacccgaaccggctcacatgatcctgactgtcggaaacaaggccgacggcgtgctagtaggcacagatggccgctactcctctatggcagcctccttcagatcttccgagcacgagaacgcctatgagaacgtccccgaggaagaaggaaaggtcagatcaactcccatgtag

SEQ ID NO: 44717 - DNA, 345 bp, Artificial Sequence
  Description of Artificial Sequence: Synthetic coding sequence
atgagcgccctgagcctgctgatcctgggcctgctgaccgccgtgcctccagcatcctgtcagcagggattgggtaacttgcaaccctggatgcaaggactgatcgcagtggccgttttcttagtgctggtggctattgcctttgctgtgaaccatttttggtgccaggaggagccagaaccagcccatatgatcctgaccgtaggaaacaaggccgacggcgtgctggttggtactgacgggcgatattcctcgatggctgcatcctttcggtcctctgagcatgaaaacgcctatgaaaatgtgccagaggaggaggggaaggtgcgttccacccccatgtag

SEQ ID NO: 44718 - DNA, 6810 bp, Artificial Sequence
  Description of Artificial Sequence: Synthetic coding sequence
atgggcagccagaccctgcagatcctgcggcagggcgtgtgggccgctctgtccggaggctggtattacgacccccaccaagcaacatttgtcaacgccctgcatttgtacttgtggctcttcctgctgggcctgcccttcactctgtacatggctctgccgagcacgatgatcatagtggccgtatactgcccagtaattgccgccgtctttatcgttctgaagatggtgaactatcggctgcatagggccctggacgccggagaagtggtcgacaggactgctaacgagttcacggaccagcggactaaggccgaacaagggaactgttcaaccaggcggaaggactcaaatgggccttctgaccctggcggtggcatagagatgagtgaattcatcagagaagccacacctcctgttgggtgcagctcccgcaatagttacgctggactggaccccagcaatcagatcggaagtggtagctcgcgcctgggcacggcggctaccatcaaaggcgatacagatactgcaaaaacatcagacgatatctctctttctctcggccaatcaagtagcctttgtaaggaggggtccgaggaacaggacttagctgcagataggaagctgtttcggctcgtgagcaatgactccttcatctccatccagccctcactctcatcctgtggtcaggatctgcctagagacttctcggacaaagtcaatctgccttcccataatcatcatcaccacgttgaccagtccctgagcagcgcctgcgacacggaggttgccagtcttgtgccgctccacagtcactcttatcgtaaagaccacagaccaagaggggttcccaggacatcgagctcagccgtggcctttccagatacatctctgaatgatttccccctgtaccaacagcggagagggctagaccccgtgtcagagctggagtcctccaaacctttgagtggctccaaagaatcactcgtcgagaattcagggctcagcggagaattccagctggccggggacctgaaaattaacacctcacagcctcctactaaaagtggtaaaagcaagccactaaaagcagaaaaatctatggactccctgcggagcttgtccaccagatcctccggcagtactgagtcctactgttcaggaacggacagggacactaatagcactgtgagctcctacaaatccgagcagacaagtagcacacacattgagtctattctgagtgaacatgaggaaagtcccaaagctgggacgaagtcgggcaggaaaaaggagtgttgtgctggtcccgaagaaaagaatagctgcgccagcgacaaacgcaccagctcagagaagatcgctatggaagccagcactaacagcggggttcatgaagccaaggacccgacgccttccgatgagatgcataaccagaggggtctgagtacctccgcatcagaggaggcaaacaaaaacccccatgcgaatgagttcacatcgcaaggagaccggcccccagggaacaccgctgaaaataaagaagagaaatctgataagagcgcggtaagcgtggatagtaaggtgcggaaggacgtaggaggaaaacagaaggaaggagatgtgcggcccaagagcagttcagtgatccacagaacagccagcgcgcacaagagcgggcggagacgcaccggaaaaaaacgggcgtcatcctttgacagctctagacaccgagactacgtgtgcttcagaggagtttcaggaaccaaaccccatagtgccatcttctgtcatgacgaagattcttctgaccagagcgacctgagccgagcaagctctgtgcagagtgcccatcaatttagctccgatagctccagcagtactacctctcattcatgccagagccccgagggtaggtattccgcgctcaaaaccaagcacacccataaagagagagggactgacagcgaacacactcacaaggcgcacttggttccggaagggacaagcaagaagagggctacaaggcgtacctctagtacaaacagcgctaagacccgcgctcgcgtgttgtctttagactccggcacagtagcctgcttgaacgattctaaccgcctgatggcccccgaatccattaagcccctgaccaccagcaagtcagatctggaggccaaggagggcgaggtcctcgatgaattgtcgttgttgggacgggcttcacagctggaaacggtaacgcgatctcggaactctcttcccaaccaggtggcctttcctgagggtgaagagcaggacgctgtgtctggggctgcccaggccagtgaggaggctgtttcatttaggagagaacgttctacttttagaagacaggccgttaggagaaggcataatgccgggtctaacccaaccccgccgacgctgctgattggctcccccctctccctgcaggacggacagcagggccagcagagcaccgctcaggttaaggtgcaaagccgacccccttcccaagccgccgtcctttccgcgtctgcatcactgctagtacgtaacggctcagttcacctggaagctagtcacgacaacgcctctgcggtcggcggatcttccttgcacgacgagctcgggaagttctcttcaactttatacgaaaccggaggatgcgacatgagcctggtgaacttcgaacccgcggcgcgtagggcatccaacatttgcgacacagacagtcacgtgtcgtcgtctacgtcagtgaggttctacccccatgatgttctctcccttccccagatcaggctaaatagactcctcacaatcgacacggatctgttagaacagcaggatattgacctctcacctgatcttgcagctacgtacggtccaactgaagaggccgcacagaaggtgaaacattactatagattttggatcttgcctcagctttggatcggtattaattttgaccgcctgactctcctcgctctgtttgatcgtaacagagaaatcctcgagaacgtactggccgttatcctggctatcttagtggcattcctgggctccatcctgctgatacagggattcttcagggacatctgggtattccagttttgtcttgtgatcgctagttgccagtactctcttttgaaaagtgtgcagcccgattcctctagcccgagacacggccacaaccgaattattgcttattcacgtcccgtttacttctgtatctgttgcggcctgatatggctcctcgattacgggagcagaaatctgactgcgacaaagtttaagttgtacgggattacctttaccaacccacttgtgtttataagcgccagggacctagtgattgtatttacactctgcttccccattgtgtttttcatcggcctgctgccacaggtcaacacctttgtgatgtacctgtgcgagcaacttgacatccacatctttggcgggaatgcaactacttctctgcttgctgcactgtactcattcatctgctctattgtcgccgtggccctgctttacggactctgttacggcgcgttaaaggactcttgggacggacagcatatcccagttctgtttagcatcttctgtggcttgctcgtcgccgtgtcctatcacttgagccgtcaaagttctgacccatcagtcctgttctcgctcgtacagtccaaaattttccctaagacagaggaaaagaatcccgaggatcccctttccgaagtgaaagacccacttccagaaaaactgaggaacagcgtgtccgagcgtttgcagtcagatctggtcgtctgcatcgttatcggcgtgctgtatttcgccattcacgtgtccacggtgtttacagtgctccagcccgctttaaagtatgtgttgtacaccctcgtaggtttcgtcggcttcgttacacattatgtgctcccccaggttaggaaacagctcccttggcattgcttctcccatccacttttaaagaccctggaatacaaccagtacgaggtaagaaatgctgccacgatgatgtggttcgagaagttgcacgtatggctgctttttgtggaaaaaaacatcatttatcctttaattgtattgaacgagctgagcagttccgccgaaacaatagcttcacctaagaagctaaataccgagctgggagcgttaatgattactgtggccgggctgaagctcttgcgcagctctttctcaagtcctacatatcagtacgttaccgtgattttcacggtgctgttttttaaattcgactatgaggccttctccgaaacaatgctgctggacttgttctttatgagcattcttttcaataaactttgggaattgctgtacaaactgcagtttgtttatacatatatcgctccctggcagatcacatggggaagcgcctttcatgctttcgcccaaccctttgccgtgcctcactcagccatgctgttcattcaagccgcagtgtctgcattcttttccaccccactcaatcctttcctgggatctgccatatttatcaccagctacgtgcgcccagtaaagttctgggagagagactacaatactaaacgggtggaccactctaatacgcggctggcctctcaactggaccgcaatcctggaacctactgtcagcaacgagaggttgaagcaatcaccgagggggttgaggaagacgagggcttctgctgctgcgaacctggccacatcccccatatgctttccttcaatgccgccttctctcagaggtggctcgcttgggaggtcatcgttactaagtatattctggagggttactcaatcaccgataacagcgcagcctctatgctgcaggtgtttgacttacgtaaagttctcactacctactatgtcaaagggatcatatattacgtgacaacgagtagtaaattagaggagtggctggctaacgagaccatgcaggagggtcttcgtctttgcgccgaccgcaactatgtggacgtggatccaaccttcaaccctaacatcgatgaggattatgatcatcggctggcggggatttcgcgcgaaagtttttgtgtgatatatctaaactggatagagtattgtagcagtcgtcgagcaaagccggtggacgtggataaagatagttccctggtgacgttgtgttacgggctgtgtgtgttgggaagacgcgccctgggaacagctagccaccatatgagttccaatctcgaaagctttttgtatggacttcacgccctctttaaaggggactttaggatttcatctatcagagatgaatggatcttcgccgacatggagctgctccgcaaggtggttgtgcccggaattcgaatgtctatcaaactgcaccaggatcactttacaagtcctgacgaatatgatgatcccacagtgctttatgaggccatcgtctcccatgagaaaaacctcgtgatcgcccatgaaggtgatcccgcgtggcgttctgccgttcttgcaaacagccccagtctactggccttacgccacgtgatggacgacgggaccaatgagtacaagatcattatgctgaatcgccgatacctgtctttcagggtcatcaaggtaaataaagaatgcgtgcggggcctctgggccggacagcagcaagaactggtgtttctgcgtaatcgaaaccctgagagggggtcaatccaaaatgccaagcaggccctccggaacatgatcaattccagctgcgaccaaccaatagggtaccctatctttgtttccccattaacaacttcctacagtgactcacatgagcaactgaaagatatcttgggtggacccatctccctcgggaacatccgtaactttatagtctccacgtggcaccgcctcagaaaaggctgcggcgctggatgcaattctggcgggaatatagaagattctgacactggcgggggcacctcctgcacaggcaataacgctacaacggcgaacaacccacacagtaatgtcacccagggctctataggcaatcccggacaggggtcgggtaccggcttgcatcccccagtgacgtcttatccccctacactagggacttcgcacagtagccatagcgttcagtcggggctggtacgacaaagccctgctagagccagcgtggcatctcagtccagctactgctactcctcaagacattcaagccttcgaatgtctaccacgggcttcgtgccttgtcgacggtctagtacgtcccagatcagcctgcgtaacctcccttcttctatccagtctcgtctcagcatggtcaaccaaatggaaccgagcggccagtccgggttggcttgcgtccagcacggattgccatccagttcttccagctcccaatcaatacccgcctgtaaacatcacacacttgtgggtttcctcgccaccgaaggaggtcagtcctctgcaaccgacgcccaacccggcaacacattaagccccgcgaataacagtcacagcaggaaggctgaggtgatttacagagtgcagatcgtcgatccatctcaaattctcgaaggaataaatttgagcaagagaaaggaactgcagtggcctgatgagggcatacggctgaaggcaggtcggaactcgtggaaggactggagtccacaggagggaatggagggccatgttatccataggtgggtgccttgctctagggatcccggaactcggtcacatatagataaagccgtgctcctggtgcaaattgatgataaatacgtgacggtgattgagaccggcgttctggagctgggggccgaagtctag

SEQ ID NO: 44719 - DNA, 7026 bp, Artificial Sequence
  Description of Artificial Sequence: Synthetic coding sequence
atgggcagccagaccctgcagatcctgcggcagggcgtgtgggccgccctctcaggagggtggtactacgaccctcatcaggcaacattcgtcaatgcgcttcacctgtacctgtggctctttttacttggtctgccctttactctctatatggctctgccttccaccatgatcatcgtggccgtgtactgtcctgtgatcgctgctgtgtttattgtgctcaagatggtgaattaccgcctgcatcgtgctctggacgccggtgaggttgttgatcgcactgctaatgagttcaccgatcagcgaactaaagccgagcaggggaattgttcaacaagacgaaaggacagtaatggcccctctgacccaggcggcgggatcgagatgtctgagtttattcgggaggctacgcctccggtgggctgcagttcgcgcaatagttacgcgggcctggatccatcaaatcagatcgggtccgggtcaagcaggttaggaacggcggcaactatcaaaggcgacactgacaccgcaaagactagtgacgacatcagtctgtccctgggacagagttcctcattatgcaaagaaggatcagaagagcaggatctggcagccgataggaaactgttccggctagtcagtaacgactcattcatctccatccagccgtcactctcctcctgcggccaggacctgcctcgcgacttcagcgataaggtcaatctcccatcccacaatcatcaccaccatgtggaccaaagtctgtcgtccgcttgtgataccgaagtcgcttctctggtcccgcttcacagccactcttaccggaaggaccacagaccgaggggcgttcctcgcacaagttcctccgcggtagcgttccccgacactagtttgaacgattttcccttataccagcagcgtcggggactggacccagttagcgagctggagtcaagcaagccattgtcaggctcaaaggagtcactggttgagaactcagggctgagtggcgaattccagcttgcaggcgacctgaagattaatacaagccaaccgcctaccaagtcggggaaatccaaacctctgaaagccgaaaagtcaatggattcactccgatcattaagtactagatcttcgggatctacagagtcttattgcagtggcactgatcgcgataccaactctacagtgtcttcctacaagagtgaacagacgagctctacccacatcgaatctattttgagcgagcacgaagaaagtcccaaagcgggtacaaaaagcggcagaaagaaggaatgctgtgccgggcccgaagaaaaaaactcatgcgccagcgataaaaggaccagtagtgaaaagatagcgatggaagcttcgacaaattcaggggtgcatgaagcaaaagaccccaccccttcagatgaaatgcataatcaacgcgggttgtccacgagtgctagcgaggaggcgaataagaatcctcacgccaacgaatttacttcccagggagaccggcctccgggaaacacagcagaaaacaaggaggagaaatcggataagagcgccgtgtcggtggattccaaagtgaggaaggatgttgggggcaagcagaaagaaggcgacgtacggcccaagtcttcctccgtgattcatcggacagctagcgcgcacaagagtgggaggcgtcggaccgggaaaaagcgcgcttcatcttttgattcttcccgacatcgggactatgtttgttttagaggagtgtccggaaccaagccacattccgctattttctgtcatgatgaagacagtagcgaccaatctgacctgtcaagggcgagtagtgttcaatcagcccatcagttctcaagtgactcatcatctagcacaacaagccatagttgtcaatccccagagggacgctatagcgccctgaaaacgaaacacacccataaggaacgcgggaccgatagcgaacatacccataaggcgcatctcgtgccggagggcacttcaaagaagcgggctaccaggcggacatccagcacaaatagcgcaaaaacccgggcccgagtactcagtctggacagcgggaccgtggcctgcctgaatgactctaatcgcctgatggcacccgagagcattaagcccttgactacctccaagtctgacctggaagccaaagaaggcgaggtcctggacgagctgtccctcctaggccgggccagtcagcttgagactgttacgagatcgaggaactctctgccaaaccaggtggcatttcctgagggagaggagcaggatgccgtctctggtgcagcccaggcttctgaagaggccgtgagtttccgccgtgaacggtccacgttccggcgccaggcggtcaggaggcgacacaatgctggaagcaatcctaccccaccaacacttcttatcgggagcccgcttagcttacaggatggtcaacaaggtcagcaatcaactgcccaggtgaaggtacagtcccgccctcccagtcaagccgccgtgttgagcgctagcgccagtctgctcgtacgcaacggctccgtgcatctggaggcctctcacgacaacgcctccgccgtcggcggtagctcattgcatgacgagttaggaaaattcagctccacactgtacgaaactggaggttgcgacatgagcctcgtgaattttgagccagccgctcgtcgtgcgagcaatatctgcgatactgattcacacgtctcctcatcaacctccgtgcgcttctatccacacgatgtgctgagtttgcctcagataaggctgaacaggttgctcaccatagatacggacttgttagaacagcaagacatcgatctgtcccctgatctcgctgctacctacggtcccacagaggaggccgctcagaaagtcaaacattactatcgattttggatcctcccccagctctggatcggaattaacttcgatcgattgactttgctggcactctttgaccgcaaccgagagatcctggagaatgtcctcgctgtcattctcgctatcctggtcgctttcctgggaagtatcctcttaattcaggggttttttcgcgacatctgggtctttcaattctgcttagttattgcatcgtgtcagtactccctcttgaaatctgtccagccagattctagttcacctcggcacggacacaatcgaatcatcgcatacagccgaccagtctatttctgcatttgctgtggtctcatctggctcttggattatgggtccaggaatctgacagcaacaaaatttaaactgtatggcatcacctttacaaatcctcttgtattcatcagtgctcgggacttggtaattgtgtttaccctgtgtttcccaatcgtgttcttcatcgggctactgccccaggtgaatacatttgttatgtacctgtgtgagcagctggacattcacatctttggaggaaatgctactacctcactgctcgcagctctgtactcatttatctgctcaatcgtcgcggtggcgctgttgtacggactatgctatggagctctcaaggattcttgggatggtcaacatatccctgttctgttcagtatcttttgtggcttactggtggcagtgagctaccatttgtcaagacagtcatcggacccctcggtgttatttagtttagtgcaaagcaaaatatttcccaaaactgaggagaaaaacccggaggaccctctgtccgaggtgaaggacccactcccggaaaagctgcggaatagtgtaagcgagcgcttgcaaagcgacctagtggtttgcattgtcatcggcgtgctctactttgctatacacgtgagtacggtgttcactgtgctccagcccgccctgaaatatgttctgtacactctggttggattcgtaggattcgtgacccactacgttctcccgcaagtgcgcaagcagttgccttggcactgcttctcacacccactgttgaagaccctggaatacaaccagtacgaagttcggaacgccgcgacaatgatgtggttcgagaagttgcatgtctggctcctgtttgtagagaagaatatcatttaccctcttattgtgctgaatgagctgtcgagtagcgcagagacgatcgcttcgcccaaaaaactcaatactgagctcggagcactgatgataactgtggcaggtcttaaacttctacgtagtagtttctcatccccgacctaccagtacgtgacagtcattttcactgttcttttttttaaattcgactatgaggcgttcagcgagaccatgttgctcgacctcttttttatgtctatcttgtttaacaagctctgggagctcttatataagctgcagttcgtctacacatacatcgccccttggcaaatcacctggggctctgccttccatgcttttgcgcagccatttgcagtaccccactccgccatgctctttattcaggccgctgtgagtgcattctttagtactccactgaacccatttcttggaagcgccatatttatcaccagctacgtccgccccgttaagttttgggagcgcgattataatacaaagagggtggatcactccaacaccagactggcaagtcagttagataggaaccccggatccgacgacaataatttgaactccatcttctacgagcaccttacccggtccctccagcatagcttgtgcggggatcttctgctggggcggtggggcaattactccactggagactgctttatcctcgctagcgactacttgaatgcgttggtgcatctgattgagatcggaaatggcctggtgaccttccaattaagagggttagagtttcgcggaacatattgccagcagcgagaagtagaggcaatcacggagggagtggaggaagacgagggcttctgctgctgcgaacccgggcatatcccacacatgcttagcttcaacgccgcctttagccaaagatggctggcttgggaagttatcgtgacaaagtacattcttgaaggctacagcataacagacaacagtgccgcctccatgcttcaagtcttcgatttaaggaaagtcctgactacttactacgtcaagggaattatctattacgtaactacctccagcaagctcgaggaatggcttgctaatgaaactatgcaggagggcttgcgtttgtgtgctgacagaaattacgtggacgttgatccaacgttcaacccaaacattgatgaggattacgaccatcggctcgccggtattagtagagagtctttttgtgtgatttacctgaactggattgaatattgcagctcaaggagagcaaagcctgtggacgtggacaaggattcctcgttggtcacattatgctacggcctgtgcgttctcggcaggagggccctgggcaccgcctcacatcacatgtcaagtaacctagaatcgttcctctatggtctgcacgcattgttcaaaggcgatttcaggatatccagcattagggatgagtggatttttgcggatatggagctgcttcgaaaggttgtcgtgccgggtattaggatgagcattaaactacatcaggatcattttactagtcccgatgaatacgacgatccaactgtgttgtacgaggccattgtctcccatgagaagaatctggttatcgctcacgagggggaccccgcatggagaagcgctgtgctggctaatagcccctcactccttgcactcagacacgtcatggacgacggcactaatgagtataagatcattatgcttaatcgaaggtacttgagttttagagtgatcaaagtaaacaaagagtgcgtcagaggcctctgggctggacagcagcaggagctggtttttcttcggaaccgtaatccagagcggggctccatccaaaatgctaagcaggctcttaggaatatgattaactcctcctgtgaccagcccatcgggtacccaatctttgtgagtcctctgactacatcctatagcgactcacacgagcaactcaaggacatcttgggtggcccgatttctctggggaatattcggaacttcatcgtaagcacttggcaccgactacgaaagggttgcggagctggatgcaatagcggcggcaacatagaggactctgatactggcggtggaacaagctgtaccgggaacaatgctacaacagccaataaccctcacagcaacgtgactcaggggtcaatcggcaatcccggacaaggcagcggcacaggcctgcatccacctgtgaccagctaccccccaacactcggaacttctcattcctctcacagcgtccagtccgggcttgtccgacagagccccgccagagcaagcgtggcaagtcagtcgtcttattgttattccagcaggcacagtagccttcggatgtcaaccaccggtttcgtcccgtgccggcgctccagcacctctcagattagcctgcgtaatctccccagtagcattcagtccaggctttcaatggtgaatcagatggagccgtccggtcagagcggcctcgcctgtgttcagcatggactcccaagctccagtagttcttctcagagcattcccgcttgtaagcaccacactctcgtcgggtttttggctacggagggcggtcagagctccgctaccgatgcccagccaggcaacactctgtcgcctgccaacaacagccacagtcggaaggcggaggtgatttacagggttcaaattgtggatccgtctcagatcctcgagggcattaatctgagtaaacgcaaggaattgcaatggccagatgaaggcatccgtttaaaggctgggagaaattcatggaaagactggtcccctcaggagggaatggaaggccatgtgatccaccgctgggtgccttgctcgcgcgatccagggacacgttctcatatcgataaggctgtcttgttagtgcaaatagatgacaaatacgtaactgtgattgagacgggcgttctggagctgggagcggaagtgtag

SEQ ID NO: 44720 - DNA, 6693 bp, Artificial Sequence
  Description of Artificial Sequence: Synthetic coding sequence
atgggcagccagaccctgcagatcctgcggcagggcgtgtgggccgctctctcaggcggctggtattatgaccctcaccaggctacattcgttaatgctctgcatttgtacctgtggctgttcctcttggggttgccgtttaccctttatatggcactaccgtctactatgatcattgtggccgtctactgtcccgttatcgcggcagtgtttattgtgctaaagatggttaactacaggctgcaccgtgccctggatgctggagaggttgttgatcgaacagccaacgagttcacagaccagaggacaaaggctgagcagggaaattgttcaaccagacgaaaagacagtaatggaccaagtgaccccggcggaggaatcgaaatgtctgaattcataagagaagccacgcctcccgtcggctgcagcagccgaaattcttacgccgggctggatccaagcaatcagatcggctctgggtcgtctcgcctcggcaccgctgctactattaagggcgacacggacactgcaaagacgagtgacgacatttccctctctctggggcagtcctcatctttatgcaaagaaggcagcgaggaacaggacctggctgctgataggaagcttttccggttagtcagtaacgattcattcatatcaattcagccctcactgagctcttgtggacaggatctacctcgggacttcagtgataaggtcaacctgccttcccataaccatcaccatcacgtagaccagagtctgtcttcagcttgtgacacagaggtggctagcctggtgccccttcactcccacagctaccgcaaggatcataggccccggggcgttccgcggaccagcagttctgccgtggcatttcctgatacttctctgaacgacttcccattgtaccagcagcgtcggggcctcgaccccgtcagtgagctcgagtctagtaagcctcttagcgggtccaaagagagtcttgtagaaaattcaggcctaagcggggagtttcagctggccggcgacctgaaaataaacacgtcgcagccgcccaccaagtcaggtaagagcaagcccctaaaggccgaaaaaagcatggatagtctccggagcctgagtacccggtcgtccggcagcaccgaaagctattgcagcggaactgatagggataccaatagtaccgtgagcagttacaaaagcgaacagacttcctcaacccacatcgaatccatcctctctgagcatgaagagtcgcctaaagctggaacgaaatcggggcggaaaaaagagtgttgcgccggcccagaggagaagaattcttgcgcatctgacaaaaggaccagctcagagaagattgccatggaggcgtcgactaatagcggggtgcacgaagccaaggatcccacgcccagcgacgaaatgcataatcagcgcgggctgtcaacaagcgcctccgaagaagctaacaaaaaccctcacgccaatgagttcacctcgcaaggggatcgcccccctggcaacactgccgagaataaagaagagaagtccgacaaaagcgccgttagtgtagactctaaggttaggaaggacgtcggtggcaagcagaaggaaggagacgtgaggccaaagtcgtcatccgttatccaccggactgcctctgcccataaaagtggacgcaggaggacgggaaagaaacgggcctctagctttgactcttccagacatcgagattacgtatgtttcagaggggtatccggcacaaaaccacatagcgcaattttttgccacgatgaggactcaagtgaccagtcagatttgtcccgcgcctccagcgtgcagtccgcccaccaatttagcagcgattcatccagttcgactacttctcacagttgccagagtccagaaggccggtactctgctctcaagactaagcacacacataaggagcggggcacagacagcgagcatactcacaaagcacatctggtgccagagggcaccagcaagaagcgcgccacacggcggacctccagcaccaactccgccaagactcgcgcacgcgtgttatccctggatagcgggaccgtcgcctgtttgaacgactcgaacagacttatggctcccgaatcaatcaagccactgacaacctccaaatcagatcttgaggccaaggagggcgaagtgcttgatgaactcagtttacttggccgcgcatctcagctcgagacagtgacacggtcacggaatagcttgcctaaccaggtagcattccccgaaggcgaggagcaagatgctgtgagtggaggtaaattctcatccacgttatatgaaaccggcggttgcgatatgtccctcgtgaatttcgaaccagccgcgagacgtgcttcaaatatctgcgacacagactcccatgtgtcaagttctacctctgtaaggttctatccccacgatgtgattcggcttaatagacttctcacgatcgacacagacctgttagagcagcaggatattgatctgtctccagatcttgcagcaacatacgggcccaccgaagaagccgcccagaaggtgaagcactattaccggttctggatccttccacagctttggattggcatcaacttcgaccgccttacgctgctcgctctgtttgaccggaatcgggaaatactggaaaatgttctggcagtcattcttgccattctcgttgcgttcctcggctccattctcctaattcagggcttcttccgagacatctgggtattccagttctgcctggtaatagcgtcttgtcagtacagcctgttgaagtctgtgcagcccgactcttcgtccccacgccacggacataacaggattatagcctatagtaggcccgtgtacttctgtatctgttgtggactcatttggcttctagattacggatctcgcaacctgacagccacaaaatttaagctatacggaataacatttactaacccgttagtctttatctccgcccgcgatttggtgatagtgttcacactgtgttttcctatagtgttctttatagggctattacctcaggtgaacacttttgtgatgtacctatgtgaacagctcgacatacatatctttggtggcaacgccactacctccctgctggcagccctgtatagcttcatttgttcaattgttgcagtcgctctgctgtacggattgtgctatggcgccctgaaagactcttgggatggacagcacattcccgtgctgttctccatattctgtggtttactggtggccgtctcctaccatctttcccggcagtcctcagatccctctgttctgttctccctcgtgcagtctaagatatttcccaagacagaggaaaagaacccggaagacccattatcagaggttaaggatcccctgccggagaaactccgtaactcagtgtccgaacggcttcagagcgacctcgtggtctgtattgtcatcggtgtcctgtatttcgccattcatgtgagcactgtctttaccgtcctgcagccagccctgaaatacgtgttgtacactctggtgggatttgtcgggtttgtgacccactatgtgttacctcaggtgaggaagcagttgccttggcattgtttctctcacccgctactcaagaccttggagtacaaccaatacgaagtgcgaaacgctgctacgatgatgtggtttgagaaactccatgtttggctcctgttcgtggagaaaaacatcatttatcctctgatcgttctgaacgaactgtcgagctctgccgagaccatcgcgagtccaaaaaagctgaacacagaacttggagctttgatgatcacagttgcaggcctaaagctgctgcgcagctcattttcttctcctacataccagtacgtgactgtcatcttcacggttcttttcttcaagtttgattatgaggccttctccgaaaccatgctgttggacctgttttttatgagcatcctgtttaataagttatgggaactgttgtacaagttgcagttcgtatacacatatatcgcaccatggcagattacttggggtagcgctttccacgcatttgctcagccattcgccgtgccccactctgctatgttattcatccaggcggccgtgtcagcctttttctctacacctctaaatccatttcttggttccgccatcttcattactagctacgtcagacccgttaagttctgggaacgcgactacaacaccaagagagtggaccattccaacacccgcctggcttctcaactagatcgaaatcccggctctgacgacaacaacttgaactctattttctacgagcacttaacccggagccttcaacatagcttgtgcggcgacctacttcttgggcgctggggaaattactctacaggagattgcttcatccttgcgagcgactacctgaatgcactagtgcatttaatcgaaatcgggaacgggctcgtcaccttccaactccggggattagagttcaggggaacctactgccagcagcgagaagtagaggccattaccgagggggtcgaagaagacgaaggattttgctgttgcgagccagggcatattccacacatgctgagtttcaatgcagcattctcccagagatggctggcttgggaggtgatcgttacgaaatacatcctagaaggctacagcatcacagacaacagtgccgccagcatgctgcaggtgttcgacctgcgcaaggtactcacaacctattacgtgaagggtatcatctactacgtcacaacatcttctaagctggaggagtggctggcaaatgaaactatgcaagagggccttcgcttgtgtgcagacagaaactacgtcgacgtagatcccactttcaaccctaacatagatgaggactacgatcacaggcttgccggaatttctagggaatctttctgtgtgatctaccttaattggattgagtattgttcctcgagacgagccaaacccgttgacgtagataaagactcttctctggtcactctgtgttacgggctgtgcgtgttaggacggcgagctctgggcacagcctctcatcacatgagttcaaatctcgagtcgttcctctacgggctccacgctttgttcaaaggagattttagaatatcttccattcgggacgagtggatcttcgctgacatggagctgctgcgaaaggtggtggttccagggatccgcatgagtataaagctgcaccaggaccattttaccagccctgatgaatacgacgatccgactgtgctgtatgaagccatcgtgtcccatgaaaagaatctggtgattgcacacgaaggggatccagcctggcggtctgccgtgctggccaacagtcctagtctactggccttacggcacgtcatggatgatggcactaatgagtacaaaattatcatgctcaacagacggtacttgtcttttcgcgtgatcaaggtaaataaagagtgtgtgcgggggctttgggctggccagcagcaggagctagtttttctccgaaataggaacccagaaagaggatcaattcagaatgctaaacaagcactgcggaatatgatcaactcttcttgtgatcagcccataggctaccccatcttcgtatcccccctgacaacatcatatagcgactcccacgaacaactgaaggatatcttgggcggaccgatctccctcgggaacattaggaattttattgtttccacatggcaccgcctccgaaagggctgcggtgccggctgcaactccggcgggaacattgaagatagcgacaccggcgggggaacatcttgtactgggaacaatgctacgactgctaacaaccctcatagcaacgtcacgcagggttctatcggcaaccccggtcaaggatcagggacaggcctgcatcccccagtgaccagttaccccccaaccttgggcaccagtcactccagccactccgtacagtcgggcctggtccggcaatctcccgcgcgcgcctccgtcgcctcacagagcagctattgttactcctcacgccactcctccctccgtatgtccacaaccggctttgtgccatgtcgacgcagcagtacaagccaaatctcactcagaaacctgccatcttccatccaatctcgtctgtctatggtgaaccagatggaaccttccggccagagtgggctggcgtgcgtgcaacacggcttgccatctagcagctccagcagccaatctattccagcctgcaagcaccacaccctagtgggattcttggctacggagggcggccaaagcagcgcgacagatgctcagcctgggaataccctctctcccgccaacaactcccatagtcgtaaggcggaggtgatctaccgggttcagatcgtcgacccgtctcaaatactggaaggaatcaatctctccaaaaggaaagagctgcaatggcccgatgagggaatccgcctcaaggccggacgcaacagctggaaagattggtcaccccaagaaggaatggagggacacgtgatccatcgttgggttccctgtagtcgggaccccgggacacggtcacatatcgacaaagctgtgctgctggttcagattgatgacaaatatgtgacggtcatcgagaccggggtgctcgagctaggggctgaggtgtag

SEQ ID NO: 44721 - DNA, 3987 bp, Artificial Sequence
  Description of Artificial Sequence: Synthetic coding sequence
tgagacctgctggagcagcaggacatcgacctgagccccgacctggcagcaacttatggaccaaccgaagaagccgcccagaaggtgaagcattactatcggttttggatcctgccccaactttggattggaattaacttcgaccgcttgacacttttggctctgttcgacaggaacagagaaattctggagaacgtgctggctgtcatcttggccatcctggttgcattcctgggtagcatccttctgatccagggttttttcagggatatctgggtctttcagttctgccttgttatcgcctcttgccagtatagcttgctgaagagcgtgcagccagatagctccagtccgagacatggacacaatagaatcattgcctattcacgccccgtgtacttctgtatttgctgtggcctcatttggctgctggactacggcagcagaaacctaaccgctacgaaattcaagctgtacgggatcacttttactaatccgctggttttcatatcagccagggacttggtgattgttttcactctgtgtttcccgattgtgtttttcatcggactcctcccacaggtgaacacctttgtgatgtatctgtgtgaacagcttgacattcatatcttcggcgggaatgcgacaaccagccttttggctgcactgtattcgttcatctgttcaattgtggctgtagcactgctgtatggcctgtgttatggagcattgaaagattcttgggacggccagcacatccctgtgctcttcagcatattctgcggacttcttgttgcggtgtcttatcatctgtcaaggcagtcgtcagacccttctgtactgttctctctagtacagagcaagatattcccgaagaccgaggaaaagaatcccgaggatccccttagcgaggtgaaagacccactgccagagaagttgcgaaattcagtgtcggagagactgcagtcagatttggtcgtctgtatcgtaatcggtgttctgtatttcgcaatacatgtgtccaccgtgttcactgtgctgcagcctgccttgaagtacgtgctctataccctggtagggttcgtgggatttgtgacccactacgtgctgccccaagtgcggaagcagctgccctggcactgtttttcgcatcccctgctcaaaacacttgaatacaaccagtatgaagtgaggaatgctgctacaatgatgtggttcgagaaactgcacgtgtggctgctattcgttgagaagaacataatctacccactcatagttctgaacgagctgtcgtccagcgcagaaacaatcgccagccctaagaaactgaacacagaactcggtgctttgatgataacggtcgccggattgaagttgctgagatccagcttcagcagccccacataccagtacgtgaccgtcatctttaccgtgttgttcttcaagttcgattatgaagctttttccgagaccatgctcttagatctcttctttatgtcaattctttttaacaagctctgggagttgctttacaaacttcaattcgtctacacatatattgcaccatggcagataacctggggtagcgctttccacgcgttcgcgcagcccttcgctgtaccccactccgcgatgctattcattcaggccgccgtttcagcattttttagtacgcctctgaaccccttcttaggtagcgcgatcttcattacaagctacgtgcgtcctgtaaagttttgggaaagagattacaacactaagcgagtggatcactccaacacccgactggcgagccaattggataggaatcctggtacatactgtcaacagcgggaagtggaagctataaccgaaggggtggaggaggacgaaggattctgttgctgcgagcccggtcatattccccatatgttaagcttcaacgccgctttctctcaacggtggttggcgtgggaagtcatcgtgacaaagtacattctagaggggtactctatcacagataattctgcagcctccatgctacaggttttcgacctgaggaaagtgttaaccacttattatgtgaagggaatcatctattacgtgacaacatcctcaaaattggaagaatggcttgccaatgaaactatgcaggaaggacttcgcctttgtgctgaccgcaactatgtagatgttgaccccacattcaaccccaacatagacgaggattacgatcataggttggctggaatttcccgcgaatcgttctgcgtgatttacctgaattggattgaatattgttcaagtcgccgcgctaaaccagtcgatgtcgataaagactcaagtctggtcaccctctgttatggcctgtgtgtgcttggtagacgggccctgggcacagcctctcaccacatgtcatcaaatctggagtcctttctgtatggcctgcacgctctatttaaaggcgacttcagaatctctagcatccgggacgagtggatttttgccgacatggagctattgcgaaaggtcgtggttcccggcattagaatgtcaatcaaactgcaccaggatcactttacatctccggacgagtacgacgatcccacagttctgtatgaggcaattgtttcccatgagaagaacctagtcattgcccatgagggggacccagcttggagaagtgctgtgttggcaaactcaccatcattgctggcattgcgccatgtcatggatgacggcaccaatgaatacaagataatcatgctaaacaggagatacctgtccttccgcgtcattaaagtgaacaaagagtgtgtcagaggtctgtgggctgggcagcagcaagagctggtgttcctgcgtaaccgaaatcctgagcgggggtccatacagaatgccaaacaggctctgcggaacatgatcaattcttcctgcgaccagcccattgggtaccctatttttgtgtcacctcttacaacctcctactccgactcccatgaacagcttaaagacatcctggggggccccatatcactgggcaacatccggaatttcatcgtctcaacctggcacagactgcgcaaggggtgcggcgctggatgcaactctggcggaaacatcgaagattctgacaccggggggggcacttcatgcactggcaacaatgcgacaactgccaacaacccccactccaatgtcacccaggggagcatcggcaatcctggacaagggtccgggactggcctccacccacctgtgacctcttatcccccaacccttggaacctcgcatagtagtcattccgttcagagcggtcttgtccgacagtctccagctcgggctagtgtcgccagtcagtcctcctactgttacagcagccgccatagtagtctaaggatgtctaccacagggttcgtgccctgtaggaggagtagcacctctcagattagcctgagaaatctccctagttctatccagtcaagactctccatggtgaatcagatggagccaagcggacagtccgggctcgcctgtgtacagcacggattacctagcagctcctcctcgagccagtcaatccctgcgtgtaaacaccacacactcgtgggattcctagctactgaaggcggacagtcctccgcgaccgatgcccagccgggaaatacgctgtccccagcaaacaatagccactctaggaaagctgaggtgatctacagagtccagatcgtggacccttcccagatcctggagggcatcaatctgtcaaagagaaaggagcttcagtggccagatgagggtataaggttaaaggcgggcagaaacagctggaaggactggtcaccacaagagggaatggaaggccatgtaatacacagatgggtcccttgctcccgtgaccccggaacaaggtcccatatagataaggcagtccttctggtgcagatcgatgacaaatacgtgacagtaattgagaccggggtgctcgaactgggcgcggaagtgtag

SEQ ID NO: 44722 - DNA, 6414 bp, Artificial Sequence
  Description of Artificial Sequence: Synthetic coding sequence
atggtgagccaggtgctgcagctgctgcggcagggcgtgtgggccgccctgacaggtggatggtatcatgatccagagcaatcaaagttcaccaacagttgtcacctttacctgtggctcttcctcttactccttcccctggccctccatctggcatttccccccaacgctatcattgtgttcttctattgtagtgccgttactatcttctttactatcattaagctggtgagctataggcttcacctcatgtttgacaagggggaagtgattcagcagaagccctcacgaaaagaagaaaaaccgaacaaggacaaagaagccaagggggaacacattacaaatcacaggaatccatccaacaaccgccaaatccataatggaaaaaaggaagaggcgtcccggaacctatcaaccccccccctgcgttgttcttcccggggccaatctattacttctcaccacagctctggccccctggaactgtctgcccaggagaccgtcgaggatctgaaaggagtgattctgctggaggaccaccctatagcacctgttagttctacatcaccaggcataaaggtggaatccctcccggcatctcaggctcacatgttggagaccacgaccaagtcagtgatcccagttaagcctgtcgctactgaaacactgatcaacggtaagggaaaagaacgagggggcaaaggtcagcctccactcaggcatcggagcgagggtgggctcgtcgataaaggccctctaaagaaattgcctcacttatccctttcacagtatgacctacttgagacggacgtcagttttcaaccctggggctccgagaactctgtactcattcccgaacctgtcagctgcccccggggctcgattcgggaaagagttcaatctaaatctcctcaagatagtcttagttccagctgtccacagtgtgacactatcgtggctaaaccagtagaagagcccgccgatacctcctgtcaagtggatacgtcttgccagggggacctgcccctgcaccaggaggtggacagctccgacagtgaagttgcagtgacgcttatagatacatcccaaccaggggatccactttctctccacgaacccatcaagatcgtgatcaccatgagcagcacccctaatagcatgacagatttggaatctagtctacatctgcgcgtggtagggactgagaagacctcggtaaagtctgacgcggaaccaactaaccccggtgctgccgggtcaccaaatgccgagcagatctccattccagtcattactctagacctacctgaagggggtggggggggcgtgccatgtcccgagggcaacggatccgaacgcacccccgagcgcttgaagacccgagtttccaccaatcagtgttccggctacggaagcggagagggaggcaacgctattaaagaccatagtagcagctcccgagagccttgggagtcagtgagccgtctcacaccggacacggggagcgagagtaaggtgggcaaggagggtcagacaaatttagacccgtcaagttgcaagtctagccacgagaaacggcacgctagagtcctgtcggtcgatagcggaaccgatgtctttctttccaaatccagtgccgagatcgtgaatgacaccgaaaaaacgatgccgacatctaagtccgatttggaggccaaagagggccagatgcccaacgagtctaactttcttgaattcgtcagcctactagagtcaattaatacaagtaaaatgacagcttccagccagctgaacggatctgccgagcaaaatgaagagagcgggttgttgcgggacaactgctcccaggagaagaaggaagagattctggaaaacgaaaaacccagcggacacagtagtaagcaggggaagcccgatctgcaatctcaggatcacacctctaccgggcctgcttgtacacagccagcaaagacgactgccttcttccagggaaatcggcagcgccaaataatataccgtgtcacatcacaacaggattccagcgtgctgcaggtgatcagcggtcctgaaacatcggtccaagaggagatctcagtggatgctatgcatgtgtttatcgacgagcacggagaaattcggagctgctacttgaaatctggaaaccagaaggagggaccgctgcaacctctgccttctaataacgattgtttatcccaggcaagggagatgcaagttagttcctcctccactacgactagtgaatctcaggaccctagttccggcgaccccgcagtaagcgctctccagcaacagctccttctgatggtagcccggcgtacacagtccgagacccccagacacgtcagccaggatctggaggcatcatcttgttcatctactcagggcaagtttaatcgggagcaattttataaattcatcatatttcccggtaagtggatcaaggtttggtacgaccgcctgacgcttctcgcgctacttgatcggactgaggatataaaagaaaatgtgctggccattcttctaatcgtgcttgtgtctctgttggggtttcttacacttagccagggattttgcaaggacatgtgggtgttgctgttctgcctggtgatggcctcctgccagtatagtcttctgaaatctgtacagcccgatcccgccagcccaatacacggccataaccaaatcataacttactcacggccaatctatttctgtgtgctgtgcggcctgattctgctcttggataccggcgccaaggcacgccatccgccctcttatgtggtttacggtctgaaattattctcgcctgttttcctacagagcgctagggactacttaatcgtcttcctgtactgctttccagccataagccttcttggactctttccccagatcaacactttttgtacttatctgttagaacagattgacatgctgtttttcggggggagcgcagtctctggaattacctctgctgtgtactcagtggcgagaagcgttctggccgctgctctcctgcatgcagtctgctttagcgcagtgaaggagccatggagtatgcagcatattccagccctctttagcgccttttgcgggctgctcgtcgccctcagctaccacctgagtcggcaaagttcggatcccagcgtgctaatgagttttattcagtgcagactcttcccgaaatttcttcatcagaatctggccgaaagcgcagcggatcctcttccaaagaaaatgaaagactctgtgaccgacgtcctgaagtgggatcttatagtttgcgctgtagtcgccgtgctgagtttcgccgtatccgcaagcaccgtctttctaagcttgcgacctttcctgagcatcgtcctctttgctttggctggagccgtaggattcgtaacccactacgtgttgccccagctgcggaagcaccatccttggatgtggatctcccatccaatcctcaaaaataaagagtatcatcagcgtgaagtgcgggacgtggcacacctgatgtggttcgagaggctgtacgtctggttacagtgctttgagaagtatattttgtatcctgccctcattctgaatgctttaacaatagatgctttcctaatcagcaatcacaggcgcctcggaacgcactgggacatctttctgatgatcattgcaggaatgaagctgctgaggacttcattttgcaatccagtctaccagttcatcaatctctcttttaccgtgatcttttttcatttcgactacaaggacatttccgagtcattcttgttggatttttttatggtatctatccttttctccaagctgggggatttgctgcacaagctccagttcgtgttgacctacgtggctccctggcagatggcatggggctcttccttccacgtcttcgctcagttgtttgccattccccattctgctatgttatttttccaaactatagctactagcatcttttccacacctctctctccctttcttggtagcgtcatattcatcacttcatatgtgaggcctgtgaagttctgggaaaagaactataatacccggcgcgtcgataattcaaacaccaggctggctgtccaaattgaaagggatcccgggaatgacgataataacttaaactcaatcttctatgaacatctgacacggactctgcaggagtccctttgcggtgatctcgttctgggtcggtggggcaactattcctccggtgactgctttatcttagccagcgatgacttgaatgctttcgtgcatctaatcgaaatcggcaatggactagtcacattccagctgaggggattggagttccgggggacctactgtcagcagcgcgaagtcgaggctataatggaaggcgacgaggaggaccgaggatgctgctgctgcaagcccggccatcttccccatctcctgtcctgcaacgccgcgttccaccttaggtggctcacctgggagattactcagacccagtatatcctcgagggctattctatcctagacaacaatgcggctaccatgctgcaggtattcgatttgcgccgcatcttaatcaggtattatattaagtctataatttactacatggtgacatctcccaagctacttagctggatcaagaatgagtccctcttgaagagtctgcaaccttttgctaagtggcactacatagaacgagacttagcaatgttcaatattaacatagatgacgactatgtgccttgcctccaaggaatcacacgggcctcattttgcaacgtttacctggaatggattcagcactgcgctagaaagcgccaggaaccttctacaacattggacagtgatgaggatagtcccctcgtcacactctccttcgcgctgtgtacactgggtagaagggccttggggaccgctgcacacaacatggccatctcgctggactctttcttgtacgggctgcatgtcctgtttaagggtgactttcggattactgcacgggacgagtgggtcttcgcagatatggatttgctccacaaagtggtggccccagccattagaatgagcttgaagctacaccaggaccagtttacatgccccgacgagtatgaagacccggccgtgctctacgaagcaattcagtcattcgaaaagaaggtggttatatgccacgagggagaccctgcttggagaggcgcagtcctgtctaataaagaggaacttcttacacttagacacgtggtagatgagggcgccgacgagtataaggtaattatgctgcaccgtagcttcctgagctttaaagtaatcaaagtaaataaagaatgcgttcgcggactgtgggctggacaacagcaggaactgatcttcctgagaaaccgcaaccctgaacgtggaagcatacagaacaacaaacaggtgttgcgcaaccttataaattcaagctgcgaccaaccactcggctatcccatgtatgtgtcacctctgactacctcatacctgggtacccatcggcagctgaaaaatatttggggaggtccaatcaccctcgaccgcattaggacctggttttggaccaaatgggtgcggatgaggaaagactgtaacgcacgacaacacagcggggggaacatagaggatgtggacggcggcggagctccaactaccggggggaacaatgccccatctggagggagccaggaaagctccgctgaacagccgcggaaaggcggagcccagcacggcgtctcttcttgcgagggaacccagaggacggggagaagaaaggggcgatcccagagtgtacaagctcactccgctctgtctcaacggccgcccatgcttagctcctcggggcccatacttgagtcaaggcagaccttcctgcaaacgtccacctccgtgcatgaattagctcagagacttagcggaagtaggctgtctctgcacgcaagtgccactagtctgcacagccagcctccacccgtcaccaccaccggtcacctgtcagtgcgggagcgggccgaggccctgatccgcagctcgttgggctcgagcacctcctctactctgtccttccttttcggaaagagaagcttctcctcagccctagtgataagcggcctgtccgccgccgagggaggaaatacttctgatactcagtcatcatcttcggtcaatattgttatgggtccgtcggccagagctgcctcacaggctaccagacatttatcagagccttgcgagccacccgatgcaacagagcagggccagttgcacgatcgatgtcttgctgaagccgtcgcagataccctgggtgttgtatgccggcgggcgagccaagaggacatgggcctggatgacaccgcctcccagcagagcgtgtcagatgagcagtag

SEQ ID NO: 44723 - DNA, 2334 bp, Artificial Sequence
  Description of Artificial Sequence: Synthetic coding sequence
atgaccttctaccccttcgtggccagcagcagcacccggcgggtggataactcaaacacacggctcgccgtgcagattgagagggacccaggaaatgatgataacaatcttaactcgatcttctatgagcatctgactagaacgttgcaagaatcgctgtgtggcgatctcgtgctaggacgatggggtaactattcaagcggcgactgcttcatcctagcctcagatgatcttaatgccttcgtgcatttaatcgagatcggcaatggactggtgaccttccagctcagaggcctggagttcagggggacctactgccaacagcgtgaagtcgaggccataatggagggagacgaagaggatcgaggctgctgttgctgtaagccaggccatctccctcatctgctcagttgtaacgccgctttccacttgcgttggctaacatgggagatcactcagactcagtatattctggaggggtacagtatcctggacaacaacgccgccactatgctgcaggtctttgacttgcgccgtattctaatcagatactacatcaaatcaataatctactacatggtcaccagtccgaagttactgtcgtggattaaaaatgagtccttgcttaaatccctccagccctttgccaaatggcactacattgaaagagatctagctatgttcaatattaacatcgatgatgactacgtgccgtgcttgcagggcataacaagagcctccttttgcaacgtgtacctggagtggatccagcactgcgcccgcaaacggcaggagcccagcaccacgttagacagcgatgaagattccccgttggtgacattgagcttcgcgctttgcaccttgggtcgccgtgccttaggaactgcagcccataatatggcaatctccttggacagcttcctttatgggctgcacgtgctgttcaaaggcgacttccggatcactgctagagacgagtgggtgtttgccgacatggatctgctccacaaagtcgtagcacccgcaatccgcatgtcgcttaaactgcaccaagaccaattcacttgccccgacgaatatgaagacccagcagttctctatgaggctatccagtcatttgagaaaaaagtagtgatctgccacgaaggtgatcccgcatggaggggcgccgtactctccaacaaagaagaactcctgacactgagacatgttgtcgatgaaggcgccgatgaatataaggtgatcatgctccacagatccttcctgtctttcaaggtgatcaaggttaacaaagagtgcgtgagggggctctgggcgggtcagcaacaggaactgatctttttgagaaatcggaatcctgaaagggggagtatccagaataataaacaagtactgaggaacctgatcaattcgagttgtgaccaaccactcgggtaccctatgtacgtttcaccactcaccacctcatacctgggaacccatcgccagctgaaaaacatctggggaggtcccataacgctggatcgcatccggacgtggttttggaccaaatgggtgcggatgcgaaaggactgcaatgctagacagcactcgggcggaaatatagaagacgtcgacggaggcggcgccccaaccactggcggtaataacgcaccctctggagggtcgcaagagagtagcgccgagcaacctcggaaggggggcgcccagcacggagtctccagttgcgaggggacccaacggactggacgccgcaaaggtcggagtcagtccgttcaggctcactcagctctgagccaacggcccccaatgctctcgtcttctggccccatcttagagtcacggcaaactttcctccagacctcaacgagtgttcatgaactcgcacaaaggctgagtggaagtcggctttcactgcatgccagcgcaactagtttacacagtcagcctccacccgtgaccacaaccggtcacctgtctgtgcgcgaacgggccgaggccctgattcgttccagcctgggatcttctacatcgtcaacccttagttttttattcgggaagagaagcttcagtagcgccctggtcatttctggcctgtctgctgccgagggcgggaacacatccgacacacaatctagctcaagtgttaatatcgtaatggggccctcggcgcgagccgcaagccaggccacccgggtgcgggggtgggctggtctgacccgcacgggatgggatggcgggactggctcttggccagaacggggtacctgcttggccttcccccccttctgcctgcaaaaccctatccccttttctatgggactccctgaatag

SEQ ID NO: 44724 - DNA, 861 bp, Artificial Sequence
  Description of Artificial Sequence: Synthetic coding sequence
atgcacgtgttcatcgacgagcacggcgagatccggagctgctacctcaagtccggcaatcagaaggaggggcccttgcagccactcccatctaacaacgactgtttgtcccaggcccgcgaaatgcaagtctccagcagcagcacaacaacttccgagtctcaggacccctcctcaggtgatccagccgttagcgccctccagcagcagcttctcttgatggtggctcgccgtacacagagtgaaacccctaggcatgtgagccaggacttggaggccagttcatgttcttccactcaagggaagtttaaccgcgagcaattctacaagttcattatctttccgggtaagtggatcaaggtgtggtacgaccgactgacactcctggcacttttagaccgcacagaggacatcaaagagaatgtgttggccatattgttgatcgtgctagtctctttattagggttccttactctcagccaggggttctgcaaggatatgtgggtacttcttttctgcctagttatggctagttgtcagtactccctgcttaagtccgttcagccagatcccgccagccctattcacggacataaccagatcattacatacagccgcccaatctacttttgcgtcctatgtgggctaatcctcctgctggatacaggagcaaaggcgcggcatcctccctcgtatgtcgtatatggattaaaactgttcagtccagtctttcttcagtcagcacgggattatctcatcgggaagatcatgaactctcataaggacttcttcacttctgagaagaaaaaagacaaaatcatatcagcaatcagttccgtcattttcttgaaatcctggtag

SEQ ID NO: 44725 - DNA, 6105 bp, Artificial Sequence
  Description of Artificial Sequence: Synthetic coding sequence
atgggcagccaggtgctgcagatcctgcggcagggcgtgtgggcctcactgactggcggctggtttttcgatccgcatcagtcgaccttcagcaactgcttccatttgtatgtgtggatcttcctgctgatctttccctttctattgtacatggtgcttccaccgtccctcatggtggcgggggtgtattgtttggttgtcgcagtcatattcgctacaattaagacggtcaactatcggctgcatgcgatgtttgaccagggggagatagtagagaagaggagcagcaccatgggtgagctggaggaagagccggcacagggggactccaacccgcctcgcgatcctggcgtggagatgactgtttttagaaaagtgtctagcacaccccctgttcggtgctcctctcagcatagtgtatttggattcaaccaggtgtccgagttgctgccacggatggaggattccggccccttgagggacatcaaggagttggtaagagagcagggttcaaataatgtgatcgtgacatcagcagatagggagatgctgaagctatcctcacaggaaaagctcatcggcgatctacctcagaccccacctggggccgtgcccgacccctccttagcttccaccgacagtagtgagcccagccccttagcgggggacggggctccctggagcggatcatccatggcggacacacccatgagtcccctccttaaaggctcactttctcaagaattgagcaagtcctttttgaccctgacccagcccgaccgggcactcgtaagaacctccagtagaagggagcagcgaagaggagcagggggttatcaacccctcgacagacgcggaagcggagaaccgacgccgcaaaaagccgggagctccgactcttgcttttccggaactgacagggagactctttctagcttcaagtccgagaaaacgaactcgacccatctggattctccacctggaggccctgcccctgagggatcagataccgacccaccatccgaggctgagcttccagcaagtcccgacgccggggtcccatctgacgatacactgcgttctttcgacactgtgattggcgctggaacaccccctgggctggccgagcccttgttggttgttcgccctaaggatctcgcactgctgagaccctctaagaggcagcctcccctcaggcgccacagtccgcccggacgcgcccccaggcgtcctctgttggagggtggcggcttcttcgaggacgaggatacaagtgagggatccgagttgtctcccgcctccagcctccggagccaaaggcggtatagcacagactccagtagtagtacctcttgttactccccagagtctagcaggggagcagccggcggcccaaggaagcgaagagccccccacggcgccgaagaaggcactgctgtccctccaaaacgcccttacggaacacagagaaccccatcaaccgcctctgcgaaaacacatgctcgggtcctcagcatggatggagccggaggagatgtcctgagacctcctttggccggatgcaaggcggagctggaggcacaagtcggtgtcgaacaggccgcctcagagcccgtggtgctgcctgccgaggcgagacgtggacctgccgccaaccaacctggttggcgcggggagttgcaggaagagggggctgtcggaggagccgctgaagagactggacggagagaccgttcaagtagtgtgagaaggacacaggccatccggagacgacataacgccggctctaatccaactccccccgctagcgtcatggggtcccctccctcatcccttcaagaggctcagagaggccgggccgcaagccactctcgcgctctcacccttccgagcgcgctgcactttgcctccagcctacttctgacccgggccggcgcaaatgttcacgaggcctgcacctttgacgacaccagcgaaggtgccgtgcactatttttacgatgagtccggcgttagaaggagttataccttcggcctggctggcggaggatatgagaatcccgtgggccaacagggagagcagaccgccaacggggcatgggatcgccactcacattcctcatctttccattcagcggatgtacctgaggcgaccggtgggttgaatttgttgcaacccagacccgtagtcctccagggtatgcaggtgcggagggtgcccctggaaatccccgaagaacagacccttatggaagaggcccctccaagagcccagcattcctacaagtactggttattacccgggcgctggacatctgtcagatatgaacgcttagccttattagccctcctcgatagaacacgcggggtgttagagaacatatttggagtgggtctatcgtctctggtagcttttcttggataccttcttctgcttaagggcttcttcactgacatctgggtttttcaattctgccttgtgattgcatcatgccagtatagtctgcttaaatcagtgcaacctgatgctgccagccctatgcacgggcataattgggtgatcgcgtatagcaggccagtctatttttgtatttgctgccttttaatttggctactggatgccctaggcagcgcccaaccattcccccccgtaagtctctacggtcttactctcttttcagcaagcttttttttttgtgccagggatgtagctaccgtgttcactctgtgcttcccattcgtgttcctgttggggctgcttccgcaagttaacacttgcctgatgtatctgctcgagcagattgacatgcatggcttcggcggaacagccgccacatccccattgaccgccgtgttcagcctatctcgttccttgctagctgcagcgctcctgtatggattctgccttggcgctatcaagacaccttggccggagcagcatgtcccagttctattttccgtgttctgtggcctgcttgttgccctctcgtatcacctctctagacaaagctcagaccccacagtactgtggagtttaataagaagcaaactgttccctgaactagaagaaaggtcactggaaactgcgcgggccgagccccccgacccgcttcctgacaaaatgaggcagtcagtgcgcgaagtgttgcactctgatctcgtgatgtgcgtcgttatcgccgtgcttactttcgccatcagcgccagcactgttttcattgcactgaagagcgtgcttggattcgtgctctatgctctggctggtgccgtaggctttttcacacactacttgttaccccagctccgcaagcagctcccatggttctgcctgtcccagccagtgctgaaacctctggaatattctcaatatgaggtcagaggggccgcgcaggtcatgtggtttgagaaactgtacgcaggacttcagtgcgtggaaaaatatttgatctacccagctgtggtcctgaatgccctgactgtggacgcccatacagttgtatcccacccagataagtattgtttttattgtcgcgccctcctgatgaccgtcgccggcttaaaactactgcggagcgcattctgctgccccccacaacagtacttgactctcgcatttacagtcctccttttccatttcgattacccgagactcagtcagggctttctcctcgactatttcctgatgagccttctttgctcaaagctttgggacctcctgtacaagctgcggtttgtgctgacatacattgctccatggcagattacatgggggtcagcgttccatgcattcgcccagcctttcgcagtgccccacagtgccatgttattcgttcaagccttgctttccggcctgtttagcactcccttgaatcccctgctgggatccgccgtgttcattatgagctatgccagacccctcaagttctgggagcgagactataatacaaagcgtgtggaccatagcaacactcgactcgtgacacagctggatagaaacccaggggcagacgataacaatctgaattccattttctatgaacatcttacaagatcactgcagcataccctctgtggcgacctggttctgggacggtggggcaactacggtcctggggactgctttgtgctggcgagcgactacctaaatgctttagtccatcttatcgaagtgggcaatgggttggtcaccttccagttacggggcctggagttcagagggacatactgtcagcagcgtgaagttgaggccattactgagggagttgaagaagacgagggttgctgctgttgtgagcccggtcacctgcccagggtgctgagttttaacgctgcatttggacaaagatggctggcatgggaggttaccgccagcaagtacgtactcgagggttactctatctcagataacaatgctgcatccatgctccaggtatttgatctccgaaagattctgattacctactatgttaagagcatcatctactacgtctccagatctcccaagctggaagtgtggttatcccacgagggaataacagccgctctccgcccagtaagagtgcctggatatgctgactcagatcctacttttagcctgtcggtggatgaagattacgatttgagactgagcggattgagcctaccctctttttgcgccgtgcacctggaatggattcagtattgcgcttccagacgtagccagcctgtggaccaagattggaactcccctttggtgacgctgtgctttgggctgtgtgtacttggtcgaagggccctgggtactgcgtcccatagcatgtccgctagccttgagcccttcctctacgggctccacgccctcttcaaaggtgatttccgcatcacctcaccaagggacgaatgggttttcgccgatatggacctactccatcgggtggttgcccccggagttcgaatggcactgaagctgcaccaggatcacttcaccagccccgatgagtacgaggaacccgctgccctgtacgatgccattgccgccaacgaagaaagactcgtgatttctcacgaaggcgacccggcatggcgtagcgccattctcagcaacaccccttcactgctggccctgaggcacgtgctcgacgacgcaagcgacgaatataagatcatcatgctgaatagaagacacttaagcttcagagtgatcaaggtgaatagagagtgcgtgagaggactgtgggcggggcagcagcaggaactcgtgttcctgaggaacaggaatcccgagaggggatctatccagaacgcaaaacaggcgttgcggaatatgatcaatagctcatgtgatcagccactgggttaccctatctacgtgagcccacttaccacaagtctggcaggcagtcacccacagctgcgcgccctctggggggggcctattagtctcggagctatcgctcactggcttctcaggacatgggagaggctccacaaaggttgcggcgctggatgcaatagcggggggaatgttgacgattccgattgtagcgggggcggaggattgacttccctgagcaataacccaccggtagcccacccgacccctgagaacactgctgggaacggggaccaaccgttacctccaggaccaggctggggacccaggtcctcactgagtggttccggagacggccgaccaccccctttactgcaatggcccccgccccggctgcctggccccccccctgcttctcccatccctacggagggaccgaggacatcccgtccacctggccctggtctgttaagctccgaaggtccttccggcaaatggagcctggggggcaggaagggactgggtggaagtgacggagaacccgcctcaggctcccctaaggggggtacgccaaagtcgcaggcaccgctagacttgtctttaagtctttcactttcattaagtcctgacgtaagtactgaagcatctcctcccagggcgtcccaggacattccttgcctggactctagcgcccctgagtcaggaacaccaatgggggccctgggggactggccggcaccaattgaggaacgggaatctcctgcagctcagccacttttggaacaccaatactag

SEQ ID NO: 44726 - DNA, 1167 bp, Artificial Sequence
  Description of Artificial Sequence: Synthetic coding sequence
atggtgcgggacagcatggccgccgccttccggcccagcaaccgggttttgctccaggcactgcagatcctcgtgtatcccggtgtcggcgggtccggatccgttagctgtaggtgtcccctgggagctaaaagatatctgctgactgacaacgttgttaaactgaaggagttccagcagaaaaaggttgctgttgcatgcaatctctccgggactaaagaaacatacttccgaaatctaaagaaaaaactgacacagaacaaactcatactaaaaggcgaactgattacactcctccacctgtgcgaatcccgcgatcacgtagaattggcaaagaatgttatttatagatatcacgccgaaaacaaaaatttcaccctcggcgagtacaagtttggccctttgttcgtgaggttgtgctacgagctggacctcgaggaatcagccgtcgagctgatgaaagaccagcacctgagaggttttttctccgactcaacctcttttaacatcctgatggatatgctctttatcaaaggcaagtataaatctgcacttcaggtactgattgagatgaagaatcaagatgtgaaatttaccaaggacacctacgtcttggcatttgccatctgctataagcttaactcaccagagagtttcaagatatgtactactctgcgggaagaggccctgttgaagggggaaattctgtcgcgacgcgccagctgtttcgccgtcgctctggccctcaaccagaacgagatggctaaagcagtctctatattttcacagatcatgaatccagagagcattgcgtgcatcaacctcaatatcattatccacattcagtccaatatgctggaaaacctgattaagaccctgaaaaatgctgctgaggggaacttgtcgaagtttgtgaaacgacatgtgtttagtgaagaagttcttgcaaaggtgagggaaaaggtaaaggacgtacctgctctggtggctaagtttgacgagatatatgggacactgcatataaccggacaggtcacgaccgacagcctcgatgctgtgctttgccatactccacgcgatcgaaaaagtcacactctgcttctaaataagaggatggtgtcgagaaggacatttcagcccctgtcacagtctctgttggcggagtag

SEQ ID NO: 44727 - DNA, 1167 bp, Artificial Sequence
  Description of Artificial Sequence: Synthetic coding sequence
atggtgcgggacagcatggccgccgccttccggcccagcaaccgggtgttgctgcaggcactccaaatcctcgtctacccaggagtgggaggaagtggtagtgtctcttgccgttgtcccctcggagctaaaaggtatcttctgactgataacgtcgtcaagttaaaggaattccagcagaaaaaagtggccgtcgcgtgtaatctgtcggggaccaaggaaacttatttccggaacctgaagaagaaattaactcagaataaactgatcctaaaaggagagcttattaccctgctgcacctgtgtgagagccgtgatcatgtggagttggccaaaaacgtcatataccgataccatgccgagaacaaaaattttaccctgggggagtataagtttgggccgctcttcgttaggctttgttacgaactggatctggaagagtcagcagtggaattgatgaaggaccagcatcttcggggttttttcagcgattcaaccagcttcaatattcttatggacatgctgttcataaagggaaaatataagtcggctctgcaggttctcatcgagatgaaaaaccaagatgtgaagtttaccaaagacacctacgtcctcgcctttgccatctgttacaaactgaactcccctgagtcattcaagatttgcacaaccctccgggaagaggcattgttgaagggtgagatcctctctagacgggcctcttgctttgccgtggcccttgccctgaaccagaacgagatggctaaggctgtgtctatctttagccagatcatgaacccagaaagcatcgcctgtattaatctcaatatcatcatacatatccaaagcaatatgctggaaaatctcatcaagactcttaaaaacgctgcggagggcaatttatcgaagttcgtcaagagacacgtgtttagcgaggaggtcctggccaaggtgagagagaaggtcaaagatgtgcccgcactggtggctaagtttgatgaaatctacggcacactccacattactggtcaggttaccaccgactctctggacgccgtgctctgccatacaccacgggatagaaaatcacatactctgttgttgaacaagaggatggtgtctcgcaggacctttcagccactgagccagagtttgctcgccgaatag

SEQ ID NO: 44728 - DNA, 651 bp, Artificial Sequence
  Description of Artificial Sequence: Synthetic coding sequence
atgtggaactggctgaagatgagcttcaccggcgccctgcaggtgcttattgagatgaagaatcaggacgtgaagttcaccaaggatacttacgtcttagcatttgctatttgctacaagcttaattcacccgagtccttcaagatctgcaccacccttagagaggaagcacttttgaaaggcgaaattctgagccgccgggcgtcctgtttcgcagtggccctggccctcaatcaaaacgaaatggcaaaagccgtttcaatcttcagccagattatgaaccccgaaagcatagcttgcataaacctcaatatcatcattcatattcagtctaacatgttggaaaatctaatcaaaactctgaaaaacgcagctgagggcaaccttagcaagtttgttaaacggcacgtcttttcagaggaagttctggcgaaggtgcgagagaaagtcaaggacgtccccgcactcgttgcaaaattcgacgaaatctatggaaccctgcacataacgggccaggtgacaaccgattctttagatgcggtgctatgtcatactcctcgtgatcgcaaatcccacaccctgcttctgaacaaaagaatggtctctcgacggacctttcagccactgtctcagtcactgctggccgagtag

SEQ ID NO: 44729 - DNA, 486 bp, Artificial Sequence
  Description of Artificial Sequence: Synthetic coding sequence
atggtgcgggacagcatggccgccgccttccggcccagcaaccgggtgttactgcaggctttgcagatcctggtctacccaggagtcggtggatccggcagcgtgagctgtcgctgccccctcggcgccaagcgctatttgcttaccgataatgtggtgaaactgaaggaattccaacagaagaaagtggctgtggcatgcaatctgtcaggaaccaaagagacttactttaggaacctcaagaaaaagttaacacaaaacaagctcattctgaaaggggaactaatcacgttgctgcacttgtgtgagtctcgtgaccatgtggaactggcaaagaatgtgatatatcggtaccacgccgaaaacaaaaattttacactgggtgaatacaaattcgggcctttattcgtcagactgtgctacgaactggacttagaggagtcagccgtggaactaatgaaggaccaggtgctgtgcaaatactag

SEQ ID NO: 44730 - DNA, 2070 bp, Artificial Sequence
  Description of Artificial Sequence: Synthetic coding sequence
atggccgtggtgagcgccgtgcggtggctgggcctgcggagccggctaggccaacctctgaccggccgcagggcaggcctctgtgagcaggccagatcctgtagattctactccgggtcagcaaccctttctaaagtggagggaactgacgtgaccggaattgaagaagtggttattcccaaaaaaaaaacatgggataaggttgcagtgctgcaagccctggcctccacagtgaatcgagatacgacagctgttccctacgtctttcaagatgatccttatctgatgcctgcatccagtctcgagtccaggtcctttctcctggcaaagaagtctggagagaatgttgctaagtttattataaattcctatccaaagtattttcagaaggatattgctgaaccccatatcccttgtttgatgccggaatactttgagccacagattaaagacatctccgaggccgcactcaaggaaaggatcgagctgcgcaaagtgaaagccagcgtagacatgtttgaccagctactgcaagccggcaccacagtgtctttggagacaacaaattcacttctggacctgctctgttattacggagaccaagaacctagcaccgattaccactttcagcagacaggccagtccgaggctctcgaagaggagaacgacgagactagtaggcgaaaagcggggcatcagtttggggtaacttggcgagctaagaacaatgctgagcggattttttccctcatgcctgagaagaacgagcattcatattgtaccatgattcggggcatggtcaaacacagagcctatgaacaagccctcaacctgtacacagaattgcttaacaaccgactccatgccgatgtatacacattcaatgccctgattgaggctactgtctgtgcgatcaacgagaaatttgaggagaaatggtctaagattctcgaactgctgagacacatggttgcccaaaaggtaaaaccgaatctccagacatttaacactatactgaagtgtctaagacggttccacgtgttcgcccggagtccggctctgcaggtgcttagggagatgaaagctatcgggatcgaaccaagcctggctacgtaccaccacatcatccgcctgttcgaccaacccggcgaccccctaaaaagaagttctttcatcatatacgatattatgaatgagctgatggggaagagattctcacctaaggatcccgacgacgataagttttttcagtcagcaatgtccatctgttcctcattgagggacctggaattagcttatcaggtgcacgggctgctcaagacaggggacaattggaagttcatcggcccagatcagcacaggaatttctattattctaagttctttgatttaatttgtctgatggaacaaatcgacgtgaccctaaagtggtacgaggatttgataccttctgcttactttccccactcacagactatgatccatctgctgcaagcgcttgatgtcgctaatagactggaggtcataccaaagatttggaaggactcaaaagagtacgggcatacattccgaagtgatctcagggaggaaatcctcatgttaatggccagggacaaacaccccccagagctgcaggtggcctttgcggactgtgccgctgacatcaaaagcgcttatgaatcccagccaatacggcaaactgctcaggattggccagccaccagtcttaactgcatcgctatcttgtttctgcgcgccggtcgcacccaggaagcatggaagatgttgggactgtttcggaagcacaacaaaattcccagatcagagcttctcaatgagctgatggactcagccaaagtaagtaattctcctagccaggccatagaagttgtggagctggctagcgctttctctctgcccatctgcgaaggtctgacccagcgtgtcatgtccgattttgccatcaatcaggaacagaaggaagccttaagcaacctgactgccctgactagtgactctgatacagatagcagctctgatagtgattccgacacttccgaggggaaatag

SEQ ID NO: 44731 - DNA, 627 bp, Artificial Sequence
  Description of Artificial Sequence: Synthetic coding sequence
atggccgtggtgagcgccgtgcggtggctgggcctgcggagccggttggggcagccactgacaggccgtagggctggattatgtgagcaagcccggtcctgtagattttacagcggttccgcgaccctctccaaagtggagggcactgacgttactgggattgaggaagttgtaatccccaagaagaaaacttgggataaagtagccgtccttcaggcccttgccagtacagttaaccgcgacacaacagccgtgccttacgttttccaagatgacccatatttaatgcctgcttcttccctcgagagccgatcatttctgctcgcgaagaagtccggggaaaacgtggcaaagttcatcatcaattcgtatcctaaatattttcagaaggatatcgctgaaccccatattccagagcccttgtgtctgctgaaacagcagattgtaagctggatttactgcgtcaccatggtaacccgatccccacagctcattacaatctttaacaagcttgattcgcagaaacattggaaacgcaaaatgatgaggcacctgggcgggaagctggtgatctctctagaactgcacggtgaacagaaaaccactttgagagaatcattcttgtag

SEQ ID NO: 44732 - DNA, 1470 bp, Artificial Sequence
  Description of Artificial Sequence: Synthetic coding sequence
atggccgccgccgccgcccgggtggtgctgagcagcgccgcccggcgtcgtctctggggcttcagcgaatccctgctcatacgaggcgccgctggcagatccctgtactttggagagaaccgcctccgtagcacccaggcggccactcaagtcgtgctcaacgtccctgagacacgggttacctgtcttgagtccggcttaagggtggctagcgaggactccggtcttagtacttgcacagtcggcttgtggatagacgcaggttcacggtatgaaaacgagaagaataatggcacagctcattttctggagcacatggcttttaagggaacaaagaaaaggtctcagctcgacttggaattggagatcgagaacatgggagcacatcttaatgcttatacaagtcgggagcagactgtatactacgccaaggctttttccaaagacctaccaagagctgtggaaattctcgccgacatcatccagaacagcaccttgggagaggccgaaatcgagagggagcggggggtgattctccgcgagatgcaagaggttgaaactaatttacaggaggtcgtctttgactatctgcacgctactgcgtaccaaaataccgcactgggccggacaatcttaggccccacagaaaacattaagagcattagtcggaaggaccttgtggattatatcaccacacattataaagggccccggatcgtgttggcggcggccggcggagttagccatgacgagctgctcgatctggccaaattccactttggcgactctttatgtacccacaagggcgaaattccagctctcccaccttgtaagttcactgggtctgaaattcgcgttagggatgacaagatgccccttgctcacttagccatcgccgttgaggccgtgggatgggcacatcctgatactatctgccttatggtggctaacacactgataggtaactgggatcgttcatttgggggaggaatgaatttatcatcgaaactagctcagctgacgtgccatgggaacctctgccatagttttcagtcttttaacacttcgtacacagatacaggcctctgggggctgtatatggtgtgcgagagctccaccgttgccgacatgctgcatgtggttcagaaggagtggatgcgactttgcacttccgtcaccgaatctgaggtcgcccgggcaagaaatcttctgaaaacaaacatgttgctccaacttgacggttcaacacctatctgcgaggatatcgggcgccaaatgttgtgttataacagacgtattccaatacccgaactggaagctcgaatcgacgccgtcaacgccgagactattcgggaagtctgtacaaagtacatatacaataggagtcctgctatcgccgccgtggggcccattaaacagttgccagactttaagcagatccgatccaacatgtgctggcttagagactag

SEQ ID NO: 44733 - DNA, 1212 bp, Artificial Sequence
  Description of Artificial Sequence: Synthetic coding sequence
atggccttcaagggcaccaagaagcggagccagctggacctggagcttgaaatcgagaatatgggcgcccatttgaatgcctacacttctcgagaacagaccgtatactatgcaaaggcatttagtaaggacttaccaagggcagtggagattctggcagatattatccaaaacagcacgctcggggaggcagagatcgagcgcgagcggggagttatcctgagagagatgcaggaggtggaaaccaacctccaggaagtcgtttttgactacctccatgccactgcataccagaatacggctctgggtagaaccatattgggtcccacagagaatataaaaagtatctcaagaaaagatctagtggattatatcactacacattataaaggcccacgaatcgttttggcagccgctggcggtgttagccatgacgagcttctcgatttggcaaagtttcactttggggattctctgtgtactcacaaaggggagatccccgcgctgcccccgtgtaagtttactggctcagaaatccgagtgagagacgataagatgccactggcccacttagccattgcggttgaggcagtaggatgggcacacccagacaccatttgcctcatggtcgcgaataccctgatcggaaactgggaccgatccttcgggggtggaatgaatttgtcatccaagctggctcagctgacctgtcacggtaacctgtgtcactctttccagagctttaatacaagttacacagacacaggcctttggggtctgtatatggtctgtgaaagctcgacagtcgcagacatgcttcacgtggtgcaaaaagaatggatgcgtctctgtacgagcgtgacagagtcggaggttgcccgggctcgcaacctgttaaagacaaatatgctcctccagctcgatgggagcacacccatctgcgaggacatcgggagacaaatgttgtgctataaccgcaggattcctatcccagaactggaagcgagaattgatgcagtgaacgcagagacaatcagagaagtttgtaccaagtacatctataacaggtcaccagccatcgccgcagtgggatacaaccaccgatcagagctacacgaatggaaatggaataaacttttctctaagagacagacaatttcatattcatacgttaacatcttgttgccacagccccagccccaatatgtctag

SEQ ID NO: 44734 - DNA, 645 bp, Artificial Sequence
  Description of Artificial Sequence: Synthetic coding sequence
atgcggcccggcggcttcctgggcgccggccagcggctgagccgggcaatgagccggtgtgtgctggagccacgtccccccgggaaacgctggatggtggctgggctaggcaaccctggactgccaggaactcggcattctgtcggaatggctgtactgggacaattggcgaggcgacttggcgtagcggaatcatggaccagagaccggcactgtgccgctgacttggcactggcgcccttgggagacgctcagctcgttctcctgcggcctcggcgccttatgaacgcgaatgggcgctccgtagctcgggccgccgaactcttcgggttaactgcggaggaagtatacctggtccacgatgagcttgacaagcctttagggagacttgctctgaagctgggtgggagcgcccggggccacaatggcgtgagatcctgtatttcgtgcctgaatagcaacgcaatgcctcggctgcgcgtcggtatcggaaggcccgcacatccagaagcggtccaggctcacgtgttggggtgcttctcaccagccgaacaggagctgcttcctctgctcttagacagggcaaccgacctcatccttgatcacattcgtgaacgctcccagggaccctctctgggaccttag

SEQ ID NO: 44735 - DNA, 645 bp, Artificial Sequence
  Description of Artificial Sequence: Synthetic coding sequence
atgcggcccggcggcttcctgggcgccggccagcggctgagccgggccatgtcccgatgcgtgctggagccaaggcctccgggaaaacgctggatggttgccggactcggcaaccccgggctgcctggaactaggcacagtgttgggatggcagtgctgggccagctggctagacgactgggggtggcagagagctggacaagggacagacactgtgctgccgaccttgcactagcgccgttgggagacgcgcagctcgtcctgttaagaccaaggagactgatgaacgcaaatgggaggagtgtggctagagcagcagagctgttcggattgactgctgaggaagtgtacctcgtacacgatgagctcgataagccccttggcaggcttgccctgaagcttggcggatcagctcggggccacaacggtgtcaggtcgtgcatttcttgtctgaattcgaatgcgatgccacgccttagagtagggatcgggcgacccgctcatcctgaagcagtccaagcccatgtgctgggatgtttcagccctgccgaacaagaactcctgcctctcttattagatagggccactgacctgatcttggatcacatcagagagagatcccaaggcccctccctaggaccctag

SEQ ID NO: 44736 - DNA, 4074 bp, Artificial Sequence
  Description of Artificial Sequence: Synthetic coding sequence
atgcagaccctgggcagcttcttcggcagcctgcccggcttcagctcggccagaaacctggtggcgaacgcacactcatcagcccgcgccagacccgctgctgaccctactggcgctcctgctgctgaagctgcacaaccacaagcccaggtggcagcgcaccccgagcaaacggcaccctggacagaaaaggagttgcagcctagcgaaaagcagatggtgtccggagcgaaggaccttgtgtgctcgaaaatgagccgggccaaggatgctgtatcttcgggagtagccagcgtggttgacgtggccaagggcgtggtccaggggggcctggatacaacccgctccgcactaacagggactaaagaagtggtctcttcaggcgtgaccggtgccatggacatggcgaaaggggctgtgcagggaggactggacacatcaaaggccgtgctaacgggcacaaaagacacggtcagtactggactcaccggcgcggtgaacgtggcgaaaggcacagtgcaggcaggagtggatacaacgaaaacagtgctgacgggaaccaaggataccgtcaccacaggcgtgatgggtgccgttaacctcgccaaaggaaccgtacagactggtgtcgagacttccaaggcggtcttaacaggaaccaaagatgctgtgagcactggactcacgggagctgttaacgtcgcacgggggtcaatacagacaggcgtggataccagcaagacggtcctgacagggactaaagacaccgtttgctcaggagtgacaggcgccatgaacgtggctaagggcaccatacaaacaggggtggatacatctaagactgtcttgactggcacgaaggatactgtatgcagcggcgtcactggagcaatgaatgtcgcaaagggtacaatccagaccggggtcgacacatcaaagacagtgttgacaggaacaaaagatactgtatgctccggcgtgacaggggccatgaacgtcgcgaaaggcactatccagacaggtgtcgacaccacgaaaaccgttctcactggaacgaagaatacggtctgcagtggcgtcacgggagccgtcaacttagctaaggaggccatccagggaggcttggataccacaaagtctatggtgatgggaacaaaggatacaatgtcaacagggctgactggcgccgccaacgtggccaagggagcaatgcagacagggttaaatactacccagaacatagctaccggaactaaggacactgtgtgttcaggagtgacaggcgctatgaatcttgctcgcgggacgatacaaacaggcgtggacactactaaaatcgtcctaacgggtaccaaggacactgtgtgctctggcgttaccggagccgcgaatgtggccaaaggtgcggttcaaggcggcttggatacaaccaaatcggtcttgaccggtactaaggacgccgtctcaacaggtctcactggggcagttaacgtcgcaaagggcactgtgcagactggggtggacactaccaaaactgttctgacgggcacaaaagacactgtctgctctggtgtgacctcagccgtaaatgttgccaagggggctgtccagggcggcctcgacaccaccaagtccgtcgttattggcactaaagataccatgagcactgggctgacaggggccgctaacgtggctaagggagcggtgcagactggcgtggatactgcaaagaccgtcctcacaggcacgaaagacacggtgaccacgggcctagtcggggccgtcaacgtcgctaagggaactgtacaaacggggatggatacaactaaaacagttttgaccggaacaaaagataccatatattcgggagtcacgtcagcggtcaatgtagccaaaggtgcagtacagaccggtctaaaaaccacccaaaatattgctactggcacgaagaacacctttggcagcggtgtcacctctgccgtgaatgtcgccaagggtgccgctcagacgggtgtagacactgcaaagaccgttctgacagggacaaaggacactgtgaccacaggacttatgggggcggtgaatgtcgcgaaagggactgtgcagacctccgtggacactacaaaaactgtgctcacagggacgaaggacactgtatgcagcggtgttacaggggctgcaaacgtagccaaaggcgccatccagggtggcctggacactaccaaatctgtcctcacgggcaccaaggatgcggtgtccactggtctgactggcgccgtaaagctcgccaaagggacagtgcagacaggtatggacaccaccaaaacagtactcaccggcacaaaagatgcggtttgtagtggggttactggggctgcaaacgtggcaaagggggccgttcagatgggggtagatactgccaaaacggtgctcactggcacgaaggacactgtttgttccggagtcacaggcgccgccaatgtggcgaaaggagcagtgcaaaccgggctcaagacaactcaaaatattgcaaccggaacaaaaaacacgctgggaagcggtgtcacaggggccgcaaaagtggcaaaaggggcggtacagggcggcctggacaccacaaagtccgtcttgacagggaccaaagatgctgtgtctacgggcctgacaggcgcagtgaatctagctaaggggaccgtgcaaactggtgttgatactagtaaaaccgtactgaccggaactaaggacactgtttgctctggtgttactggagctgtgaatgtggcaaagggcactgtgcagacaggtgtggacactgctaaaacagtcctctcgggagctaaggacgcagttaccacgggagtgacgggcgctgtcaatgtggccaaggggacagtccagactggagtggacgcctccaaagcggtgctaatgggcacaaaagacactgtgttttccggtgttactggagccatgtcgatggctaagggcgcagtgcaaggcggtctcgacacaaccaaaaccgtgcttaccggtacaaaggatgctgtgagcgccggtcttatgggttctgggaacgtggcaacaggcgccacccacacaggtctgagcacatttcagaattggctgcccagcaccccagccacctcctgggggggcctcaccagctctcgtacgactgacaatgggggagaacagacagccctgagtcctcaggaagcgcctttctccggcatttcgacaccgcctgatgttttgagtgttgggcccgaacctgcctgggaggctgcagctaccacaaaggggctcgccacagatgtggccacattcacccagggtgccgcaccggggcgcgaagatacgggactcctggctacaactcacggaccagaggaggcacccaggttagcaatgcttcagaacgaactcgagggactcggagacatcttccaccctatgaatgctgaggagcaagctcaactagcagcctctcaaccagggccaaaggttttgtccgccgagcagggcagctattttgtcaggctaggcgacctgggcccatcctttaggcaacgtgccttcgaacacgccgtgagccatctgcagcacggccaatttcaggccagagataccctcgctcagctccaagactgcttcagactgatagagaaggcacagcaggcccccgaagggcagcctaggctggatcagggaagcggtgcctctgctgaagatgctgctgttcaggaagagcgggacgccggtgtgctgagtcgcgtgtgcggacttctccgtcaactacatacagcttattcaggcctggtgtcaagtctgcagggcctccctgccgaactgcagcaacccgtaggccgggctcgccactccctttgtgagttgtacggtatcgtggcctctgccggaagcgtggaagagctgccagccgagcgacttgtccagtcacgtgagggggtccatcaagcttggcagggtctcgagcagttgcttgaggggctgcagcacaatccacccctctcctggctggtgggcccctttgccctgcctgctggtggtcagtag

SEQ ID NO: 44737 - DNA, 780 bp, Artificial Sequence
  Description of Artificial Sequence: Synthetic coding sequence
atggacgcctgggtgcggttcagcgcccagagccaggcccgggagcggctctgtagagccgcacagtacgcctgctctttgttggggcatgctctgcagcggcacggcgcttcccctgagttacagaaacagattagacagttggaaagtcacttgagtctcgggcggaagctcctgcgcctggggaacagtgccgatgcactggagagtgctaagagggccgtgcacctcagcgatgtggttttgagattctgtattactgtaagccatcttaaccgggcattgtacttcgcgtgcgacaacgtgttgtgggccgggaagtctggcctggccccccgtgttgaccaagaaaagtgggctcagcgcagctttaggtattatctgtttagcctgattatgaacctgtctcgcgacgcctacgaaatcaggctcctcatggaacaagaatccagtgcctgcagccgaagactgaaaggctccggcgggggagttcccggcggctcagagacgggcggactggggggacctggcacacccggcggcggcttgcctcaactggcattgaagctcaggctgcaggttctgctcttggcccgagtgctgcgcggccatccacccctgttgctggacgtagtgcgtaatgcgtgcgatctcttcattcctctggataaactgggcttgtggcgttgtggtccggggattgtgggtctgtgcgggttggtcagcagcatcctgtccatcctgaccctcatctacccgtggctgcggcttaagccttag

SEQ ID NO: 44738 - DNA, 246 bp, Artificial Sequence
  Description of Artificial Sequence: Synthetic coding sequence
cccggcggcggcctgccccagctggccctgaagctgcggctgcaggtgcttttattggccagagttcttcggggccatccccctctgctgctcgacgtggtgagaaatgcatgcgacttattcattccattagataaactaggcttgtggagatgcggcccgggaatcgtgggtctgtgtgggctggtgtcatcaatcctgagtattctgactctcatctacccctggctgaggttgaagccttag

SEQ ID NO: 44739 - DNA, 738 bp, Artificial Sequence
  Description of Artificial Sequence: Synthetic coding sequence
atgggcaagctgcgggccgcccagtacgcctgcagcctgctgggccacgctctgcagaggcacggtgcaagtcccgagttacagaagcaaattaggcagttagagagccacctctccctggggcgcaaattactgcggctcggcaatagtgccgacgctttggagtcggccaagcgcgcggtgcatctcagtgatgtggtcctgcgattctgcattaccgtcagccacctgaaccgagctttgtacttcgcttgtgataacgtcctttgggccggcaagagtgggctagcacccagggtggaccaggagaaatgggctcaacgcagctttcgctattacctgttctcccttatcatgaatctgagccgcgacgcatacgagattaggctcctgatggagcaagagtcaagtgcatgtagtcgcaggcttaaaggatcaggtgggggcgtaccagggggctcagagaccggcggcctgggtggacctggcacccccggtgggggcctgccccagctggccttgaagctgcggctgcaagttctcttgctggctcgagtgctgagaggtcaccctccacttctgctcgacgtggttcgcaatgcttgcgatctgttcattcctttggacaaactgggactctggagatgtgggcctggcatcgtgggactatgtggccttgtaagctccatactgagtatcctaaccctgatctacccctggttgagactgaagccttag

SEQ ID NO: 44740 - DNA, 297 bp, Artificial Sequence
  Description of Artificial Sequence: Synthetic coding sequence
atgaaggtgagcgccgtgctgctgtgcctgctgctgatgaccgccgcctttaaccctcagggcctcgctcaacccgacgccctgaatgtgccttccacctgctgtttcacattttcttctaaaaaaatctcgctgcagaggctgaaatcttatgtgatcactactagtcgatgtccacagaaggcagtcatcttcaggacaaaactgggaaaagagatatgtgctgatcctaaggagaaatgggtgcagaattacatgaagcacttagggaggaaggctcatacactcaagacctag

SEQ ID NO: 44741 - DNA, 975 bp, Artificial Sequence
  Description of Artificial Sequence: Synthetic coding sequence
atggccgagcacggcgcccacttcaccgccgccagcgtggccgacgatcagccttccatttttgaagtggtggctcaggactccctgatgacggcagtccgcccagctctccaacatgtagtgaaggtactagctgagtcaaacccaacacattatggctttctatggcgctggttcgacgaaatctttaccctcctggatctattgttacagcagcactatctctcacggacgagcgcctccttctccgagaatttctatggtctgaaacgaattgtcatgggcgatactcataagtcccagcgcctggcctctgccgggctacccaaacaacagctgtggaagagcatcatgtttctggtgcttctgccttacttaaaggttaagttagagaagctcgtgtccagtctcagagaagaagatgaatacagcatacacccaccatcatccagatggaagagattctatcgagcctttctcgcagcctatcccttcgtcaacatggcctgggagggatggttcttggtgcaacagttacggtacattctgggcaaagctcagcaccactccccattacttcgactggctggtgtgcagctgggacgattgacagtccaggacatccaggcactggagcataagcctgcaaaggcttccatgatgcagcagcctgccaggtccgtcagtgaaaaaattaactcagctctgaagaaagctgttggcggagtcgctctgtctctgtccaccggtctgagcgtgggtgtgtttttcctgcagttcctcgattggtggtacagcagtgaaaatcaggagactataaagagtctcactgcgttgccaaccccccctccacccgtacatttggattataacagtgatagcccattgctcccaaagatgaagaccgtgtgtcccaagaaaaaaaaaaaaaaggagaggaagaagaaaaaggaacgaaagaaggaaaggcggtag

SEQ ID NO: 44742 - DNA, 588 bp, Artificial Sequence
  Description of Artificial Sequence: Synthetic coding sequence
atggcccccgccgccagccggctgcgggccgaggccggcctgggcgctctccccagaagagcactcgcacaatacctcctcttcctgaggctttatccagtgctcacaaaggcagctacctcaggaatcctgtccgctctcggtaactttctcgcccagatgatcgagaagaagcgcaagaaggagaactccaggtccctggatgtcggtggccccctcagatatgccgtgtacggctttttctttactggacccctctcacacttcttttattttttcatggaacactggataccccccgaggtaccacttgcaggcttgcgccggttactcctcgacagactggtttttgctccggcctttctgatgctcttcttccttattatgaattttctggaaggtaaagacgcttctgcattcgctgcgaagatgcgtggagggttctggcctgcgttgcggatgaattggcgagtatggacgccccttcaatttatcaatatcaactacgtacctctcaagttccgagtgctgttcgccaacttggcggcactgttctggtatgcctatttggcatccctgggaaagtag

SEQ ID NO: 44743 - DNA, 504 bp, Artificial Sequence
  Description of Artificial Sequence: Synthetic coding sequence
atgcccttcaccggcgagcggcggctgagcctgcggcggcaggacgagggaggactgctcgcaggcgccgaggacgaacttgccggtgtagacgctactaccgtacatcagcaccagttgcggcccagcgaagttcctggcgccttgcggcaacctggttcctcagtgcttgtctgtcttcctggcttgctgggggaagtaacaactgcgggtcgtacttcaggagctctgtggacctgggtgtggggatctcacccccctagcgaatctcgcacgaatcccgtacggatgtcactcacacttaatcaggcacgaactactgtgagtgatcagagggcagaagaggaacggggaatctggggtcggcgagccggagtacaagcgggccctctccagagccagggacacgcagctcacctgccccaccaggccttccctgttccgaggggatggctgcctggagagggccctcactccgatccggcgggcagtggcgcaggttag

SEQ ID NO: 44744 - DNA, 216 bp, Artificial Sequence
  Description of Artificial Sequence: Synthetic coding sequence
atggccgcccccccccagctgcgggccctgctggtggtggtgaacgcattgttgagaaagaggagataccacgccgcgctggccgtcctgaagggattccgcaacggggctgtgtacggagccaaaatccgcgccccacatgccctagtcatgacatttctgttcagaaatggaagaagtacttgtacatgctgccacgcaagctgcctgccgtag

SEQ ID NO: 44745 - DNA, 639 bp, Artificial Sequence
  Description of Artificial Sequence: Synthetic coding sequence
atggccgcccccccccagctgcgggccctgctggtggtggtgaacgctctcctaagaaagaggaggtaccacgcggctttggccgtgctgaaggggtttcgtaatggcgccgtctatggggctaagatacgggctccacatgctctggttatgacattcctgtttcgcaatggatcacttcaggaaaagttgtgggcaatcctgcaagccacctacatccatagctggaatctggcgaggttcgtgtttacctacaaaggtttgagggccctgcagtcttacattcaggggaaaacctacccagcccacgctttcctggctgctttcctcggaggtattcttgtttttggcgagaacaataacattaattcacagatcaacatgtatctgctttcccgggtgctctttgctctgtctcgactggccgttgagaagggatatatcccggagccaaggtgggaccccttccccctgctgaccgcagtggtgtggggtctggttctctggttgtttgagtaccataggagtacacttcaaccctccttgcagtcatctatgacatatctttatgaggactcaaatgtgtggcacgatatctcggacttccttgtgtataacaaatcgagacccagcaactag

SEQ ID NO: 44746 - DNA, 528 bp, Artificial Sequence
  Description of Artificial Sequence: Synthetic coding sequence
atgatccggtgcggcctggcctgcgagcggtgccggtggatcctgcccctgttgcttttatccgaccacggacagacaagtagtctttggtggaaatgctcacaggaaggaggcggcagcggtagttatgaagagggctgccagtcattaatggaatatgcctgggggagagctgccgctgcaatgttattctgtgggttcattatcctggtgatatgtttcattttgtctttttttgccctctgcggacctcaaatgcttgtgttcctccgggtgataggcggcctccttgctctggccgccgtgtttcagatcataagtctcgttatttaccctgtgaagtatacacagaccttcaccctccacgccaacccagctgtcacatatatatacaattgggcatatgggttcggttgggccgccacgatcattttgattggttgcgcattctttttctgttgtttgccaaattatgaagacgacctcctggggaatgccaagccacgctatttctacacaagtgcctag

SEQ ID NO: 44747 - DNA, 582 bp, Artificial Sequence
  Description of Artificial Sequence: Synthetic coding sequence
atgatccggtgcggcctggcctgcgagcggtgccggtggatcctgccactgcttctccttagtgccattgcattcgacattattgctttggcaggacgcggatggctccaaagctctgatcacgggcagacatcatcgctgtggtggaagtgttctcaagaaggcggaggtagcgggagttacgaagaaggctgccagtcactgatggagtatgcctggggccgggctgccgccgccatgctattttgtgggttcatcattctggtcatatgtttcattctgtccttcttcgctctctgcggccctcagatgctcgtgtttctgcgggtcattggaggtttacttgcgctagcagctgtctttcagatcatttcactggtaatttatcccgtcaaatacacccagacttttacactccacgcgaatcccgctgtgacttacatctacaattgggcctatggcttcggctgggctgccactatcattttaatcggctgtgccttcttcttttgttgtctacctaactacgaagatgatttgctgggtaatgcaaagcccagatatttttatacctccgcctag

SEQ ID NO: 44748 - DNA, 1674 bp, Artificial Sequence
  Description of Artificial Sequence: Synthetic coding sequence
atggccgcccccatgctgcggtggggctgccggggccggcggtgggctttcgcgagagtagacggaggatcctgccacaggcgaggagctccaacagggagcacaagcaaccagatcaggggagagtctagcgtcgcacaacagccccttcacacggcgcagaagacacgcaagggcgagcacaagtgggccgcagtggtgggcctagagatacatgcccagataagcagtaactctaagctctttagtggtagccaggtacgattttctgccccacccaatagcctcgtttcgttttttgacgccagtctgcccggaaccctcccagtactgaaccgcagatgcgtggaagccgcagtgatgacagggctggctctgaattgccatattaataaaaagagcttatttgatcggaaacattatttctacgctgatttacccgcggggtaccaaatcacccaacagcggctcccgattgccgtgaatggtagcttgatctatggtgtctgtgctggtaaaaaacagtctcaggtcattccgaaaacagttcgaataaagcagattcagctggagcaagatagtggcaagtcccttcacgacaacctgcgtagccaaaccctgatcgacctgaatagagccggggtgggcctactggaggtcgtgttagaacccgatatgagttgcggagaagaggccgctacggccgtccgcgagctgcaactcatactgcaagctctgggcacctctcaggccaacatggcagagggtcagctgcgcgttgatgccaatattagcgtgcatcacccaggcgaaccgctgggggtccgcaccgaagtcaagaaccttaactcgattcggttccttgccaaggccatcgactacgaaatccagaggcaaataaacgaactggagaacgggggcgagattctcaacgagacgcggagcttccatcacaagttagggtgcaccatgtccatgcgggataaagagggtaaacaagattatcgattcatgcctgaacccaatctccccccgctggtgctgtatgatgccacaagcctgcctgccggagcagatccccaacaggtgattaacattgaccaaatccgggagactctgccagagctgcctagcgtcacccgggaaaagcttgtgcaacagtatgggatgctcctggagcattccttcacattactgaatgaggtgggcttactcgaatttttccagaacgtcattaaagagactagggcagagcccaagaaggttacatcctgggtgctgaataccttcctgggatatctaaaacagcagaacctagcagtctcggagtcccccgtgactcctagcgccttagcagaactcttagatctgctggactccaggacgattagttccagcgccgctaaacaagtatttgaggaattgtggaagagggaaggcaaaactcctggccagattgtaagcgaaaagcaactcgaattgatgcaggatcagggagctctcgagcagctgtgccactccgtcatggaagcgcatccccaggtggtgatggacgtgaagaaccgtaatccccgggcaatcaacaagctgattggcttggtcaggaaagccacccaatccagagctgatccggtgatgataaaagaaattctggagaagaagttgagtctctag

SEQ ID NO: 44749 - DNA, 786 bp, Artificial Sequence
  Description of Artificial Sequence: Synthetic coding sequence
atgcacggcatcggccccagcggcagcttcaccgagttcctggaccccttccagagggtaatccagcctgaagagatttggctgtacaaaaaccctctggttcagagcgacaatatcccaacacgcctgatgtttgcgatcagcttcctaactccacttgctgtcatttgtgtggtcaagatcatacggcgcaccgataaaactgagatcaaagaagccttcctggccgtctctctggccctggccctaaatggagtgtgtaccaacactattaaactgatcgtcggccgccctcgacccgactttttttatagatgctttcccgacggagtaatgaattccgagatgcactgcaccggagatcccgacctcgtgtccgagggccggaagagtttcccctccatccactcttccttcgctttcagcggactgggctttactacattctatctcgctggcaagctgcactgtttcacagaaagcgggaggggaaagtcctggcgcctctgcgctgccatcttacctctctactgcgccatgatgatagccttgtccaggatgtgcgactacaagcaccactggcaagacagctttgtgggaggagtgatcggtttgattttcgcgtacatctgctatcggcaacattatcccccgctcgccaatactgcctgccataaaccctacgtgagtctgcgggtacctgcatcactgaaaaaggaagagcgcccgacagccgactccgcgccttctctccctctggagggtattacagagggccctgtttag

SEQ ID NO: 44750 - DNA, 291 bp, Artificial Sequence
  Description of Artificial Sequence: Synthetic coding sequence
atgcgggagctggccatcgagatcggcgtgcgggccctgctgttcggtgtattcgtgttcacggaattcctcgacccctttcagcgggtcattcagcccgaggaaatttggctgtacaagaacccccttgtgcagtcagacaacattccgacacgattgatgtttatcccactttgggtggaatcttcagcttccttcttacatacgttcgccaccgacagcaccattctgctgtggcccactcagcttgccatcaatcccacattagtgtgtgaatcacaacctcattag

SEQ ID NO: 44751 - DNA, 816 bp, Artificial Sequence
  Description of Artificial Sequence: Synthetic coding sequence
atgcgggagctggccatcgagatcggcgtgcgggccctgctgttcggcgtgttcgtcttcaccgagtttctcgatccgttccagagggtcatccagccggaggagatctggttatataagaatcccctggttcagtccgacaacatccccactaggttgatgttcgccatctccttcttgacccccctggccgtgatttgtgtggtgaagattattagacgtactgacaagaccgaaatcaaggaagcttttttggcggtcagcttggccctggccctgaacggcgtatgtacaaataccatcaaactgattgtgggccgtccccggccagattttttctacaggtgctttccagacggagtcatgaacagcgaaatgcactgcacaggggacccggaccttgtgtctgaagggaggaagagctttccctctatccattcctcttttgcattttcggggctgggctttaccactttttatctcgccgggaaactgcattgcttcactgagagtggtaggggcaaaagttggcgtctatgcgcagcaattctgcccttgtactgtgccatgatgatcgccttgtcgcggatgtgtgactataaacaccattggcaggattcattcgtaggaggagttatcggactgatctttgcatacatttgctaccggcagcattatccacccttggccaacaccgcctgccataagccctatgtgtcgctgcgcgtgcctgcttcccttaagaaggaggaaagacccacagccgattccgctccttccctaccgctggagggcataacggagggccctgtttag

SEQ ID NO: 44752 - DNA, 804 bp, Artificial Sequence
  Description of Artificial Sequence: Synthetic coding sequence
atgcgggagctggccatcgagatcggcgtgcgggccctgctgttcggtgtattcgtgtttacagagtttctggatccatttcagcgtgtaattcagccagaggaaatctggctgtataagaacccacttgtccagtctgataatatccctactagactgatgttcgccatttctttcctcaccccgctggcagttatttgcgtggtaaagataattaggcggacagataaaactgagataaaggaagcatttctggcagtgagtcttgctctggccctgaatggtgtctgtacgaatactattaagctgattgtgggacgccctcgccccgatttcttctatcgctgcttccctgatggagtaatgaacagtgagatgcactgtaccggggatcccgatctcgtgtctgaaggcaggaaatccttcccgagcattcactccagtttcgccttttccggcctcggtttcacaactttctatctcgctgggaaacttcattgcttcactgaatccggcagaggcaaaagttggaggctatgtgcagcgattcttccactttactgtgccatgatgatcgctctaagtagaatgtgtgactataaacaccactggcaagacagctttgtgggaggtgtgattgggttgatcttcgcctatatctgttacaggcagcactatccacctctcgccaacactgcatgccacaaaccttacgtgagtttgagggttcctgcctccctgaaaaaggaagaacggcccaccgctgactctgcgccttccctgcccctggaaggaatcacctag

SEQ ID NO: 44753 - DNA, 627 bp, Artificial Sequence
  Description of Artificial Sequence: Synthetic coding sequence
atgcgggagctggccatcgagatcggcgtgcgggccctgctgttcggcgtgttcgtttttactgaatttcttgatccctttcaaagagttatccagcctgaggaaatttggctctacaagaaccccctagtccagtcagataatattccaacccgtctgatgttcgcaatttctttcctcaccccccttgcagtgatttgcgtagtcaagatcatcaggagaacggacaaaacggagattaaagaagcttttcttgtggcgttctcgggcctgggttttaccacattctatcttgccggaaaactccattgctttacggagagcggcagggggaaatcctggcggctgtgtgcagctattctgcctctgtactgcgctatgatgattgctctctcacgcatgtgtgattacaagcaccactggcaggactcctttgtgggcggtgtcatcgggttgattttcgcttacatttgctataggcagcactacccgcccctagccaacacggcttgtcacaagccctatgtcagcctacgtgtccctgcgtctctcaagaaagaggaaagaccaaccgctgacagtgcccccagtctgccccttgagggcattacagagggcccagtgtag

SEQ ID NO: 44754 - DNA, 702 bp, Artificial Sequence
  Description of Artificial Sequence: Synthetic coding sequence
atgcgggagctggccatcgagatcggcgtgcgggccctgctgttcggcgtattcgtcttcaccgaatttttagacccttttcaaagggtaatccagcccgaggaaatatggctctacaaaaatccgctggtgcagtccgacaatatcccgacccgccttatgttcgccatcagcttcctgacgcctctcgcagtcatctgcgtagtaaagatcattcgccggactgataaaactgagataaaagaggcttttttggctgtctctctggccttagccttgaacggagtgtgcaccaatacaatcaaactgatcgtcggcagaccacggcccgatttcttttaccggtgttttcccgacggagtaatgaatagtgagatgcactgtacgggcgatcccgacttagtgtctgagggacgtaaaagcttcccttctattcattctagctttgcgttctccggacttggatttaccactttctaccttgcgggaaaactccactgttttactgagtctggacgtggaaagagctggcgcctgtgtgctgccatactgcccctgtattgcgcgatgatgatagccttgagccggatgtgtgattataaacaccattggcaggtgggctgctgtgtgtggcagggaccacagtcccacctgccctccgccgcgaatccgagattgtgcttgggcacatcagagccctag

SEQ ID NO: 44755 - DNA, 456 bp, Artificial Sequence
  Description of Artificial Sequence: Synthetic coding sequence
atgcccgccagccagagccgggcccgggcccgggaccggaacaacgtgttgaaccgggccgaatttctctcacttaatcaaccgccaaagggcggccctgaaccccgttcctccggccgcaaggcctcaggcccaagcgctcagccccctcctgccggagacggcgcccgggaaagacggcaatcgcagcagctgcctgaggaggactgcatgcagctgaatcccagttttaagggcattgcttttaattcactcctggctatcgacatctgcatgtcaaagcgtctgggcgtttgcgcgggacgggctgccagctgggcatccgccaggagcatggtgaaactgatagggataacaggacacggtattccctggatcggcgggacaattttgtgcctcgtgaagagtagcactcttgccggacaagaagtccttatgaaccttctcctggactag

SEQ ID NO: 44756 - DNA, 816 bp, Artificial Sequence
  Description of Artificial Sequence: Synthetic coding sequence
atgcccgccagccagagccgggcccgggcccgggaccggaacaacgtccttaaccgggccgagttcctatcactgaaccagcctcctaaaggagggccagagccacgtagttcaggacgaaaagcttcaggcccaagcgcacaacccccacccgctggggacggagcccgtgagagacgccagtctcagcagctgccagaagaagattgtatgcaattgaacccatcatttaagggaattgcattcaacagcctgctggccatcgacatctgtatgtcgaaacggcttggtgtgtgcgccggaagggcagcctcctgggccagcgcaagatcaatggtcaaactgatcggtataacaggtcacggaataccttggatcggtggaacgatattgtgcctcgtgaaatcgagcacccttgccggacaggaggtactgatgaatctgctcctcgccctgttattagatatcatgaccgtggctggcgttcagaagcttattaaaagaagaggcccctacgaaacttctccttctctgcttgattacctgacgatggatatttatgcatttcccgctggtcatgcctcacgagcagccatggtatcaaagttctttctgtctcatctcgtcctggcagtccctctgagagtcctgctcgtcctttgggctctctgcgtcggcctcagccgtgtgatgatcgggagacaccacgttaccgatgtgctaagtgggtttgtgatcggctatcttcaatttcggttggtcgagttggtatggatgccgtcttcaacttgccagatgttgattagcgcatggtag

SEQ ID NO: 44757 - DNA, 858 bp, Artificial Sequence
  Description of Artificial Sequence: Synthetic coding sequence
atgttcgacaagacccggctgccctacgtggccctggacgtgctgtgtgtgttattggctagcatgccaatggccgttttaaagctcgggcagatctaccccttccaaagggggtttttttgtaaggataacagcattaattacccttatcatgactcaaccgttacgtcaacggtattgattcttgttggagtgggattgccaatctcatcaattatattaggagaaacactaagtgtgtattgtaacttgcttcactctaattcctttatacgcaacaattatatcgctactatctacaaggccatagggaccttcctgttcggagctgcagccagtcagagccttacagacattgctaaatattctattggcaggctcagacctcatttcctggatgtctgcgaccccgactggtctaaaattaattgttccgacggctacattgagtattacatttgcagaggaaatgcagagcgtgtaaaggaaggaagactgagcttttactcaggacactcttccttttccatgtattgcatgctgtttgttgcactctacctgcaggccagaatgaagggggattgggcaaggctgttgaggcctactctgcagtttggcctggtggcagtgtccatttacgtggggctttcccgggtcagcgactacaaacaccattggtctgatgttttaaccggactgatccagggcgcactcgtagccattctggtcgcagtttacgtctccgactttttcaaagaaagaaccagcttcaaggaacgcaaggaagaagacagccatactaccctccacgagacccctaccacgggcaatcactacccatcaaatcaccagccgtag

SEQ ID NO: 44758 - DNA, 855 bp, Artificial Sequence
  Description of Artificial Sequence: Synthetic coding sequence
atgttcgacaagacccggctgccctacgtggccctggacgtgctgtgtgttctgctggctggtttaccattcgcgatattaaccagccgtcatacacccttccagagaggcgtgttttgcaatgatgagagcatcaagtacccttataaagaagatacgatcccttacgcactcctcgggggaatcattattccattcagtatcatcgtgatcattctgggggaaacactttccgtgtattgtaacctgctccacagcaactccttcataaggaacaactacattgctactatttacaaggcaatcggtacgttcctgtttggggcggctgcctcccagtcacttacagatatcgccaaatacagtatcggacgtctgagaccgcatttcctcgatgtgtgcgatcctgattggagtaaaatcaattgttccgatgggtacattgaatactacatctgtcggggaaacgcggagcgcgtcaaagagggtagattgagcttttatagtggtcattcttctttttcaatgtattgcatgctgtttgtagcactgtacctgcaggcgagaatgaagggcgattgggccagacttctgcgtccaactctacagttcggtttggtggccgtgagcatctacgtcgggctgtcccgcgtgagcgactataagcatcactggagtgatgtgctcacaggcctcatccagggagctctagtggcaattcttgttgccgtgtatgtgtccgatttttttaaagaacggacgtcgttcaaagagcggaaggaggaagattcacatacaacccttcacgaaaccccgacgaccggaaatcattacccatccaaccatcaaccgtag

SEQ ID NO: 44759 - DNA, 936 bp, Artificial Sequence
  Description of Artificial Sequence: Synthetic coding sequence
atgcagaactacaagtacgacaaggccatcgtgcccgagagcaagaacggcgggagtcccgctctgaacaacaaccctcgcaggtcaggctcaaaaagggtacttctcatttgcctggacttattttgcttattcatggcgggcctgccgtttctgatcattgagacctctactataaagccttaccatagggggttctattgcaacgacgaaagtattaagtaccccctgaaaaccggagaaactatcaacgatgcagtcctctgtgctgtgggaatcgtgatcgctatcttggcaattatcacaggcgagttctatcggatttattatctcaagaagtcgaggagtacaatccagaatccttatgtcgcagctctgtacaagcaggtgggatgtttcctgtttggctgcgccatcagtcagtccttcactgatatcgctaaggtgagcatcggccgcctgcgtcctcacttcctgtccgtgtgcaaccctgacttctcgcagataaactgtagcgaaggctacatacaaaactatcggtgccgaggggacgactcaaaggtgcaagaggctcggaagtcctttttcagcgggcatgcctccttctcgatgtatacgatgttgtacttggtcctgtacctgcaagccagattcacatggcggggggctaggctcctgcggcccctgcttcagttcactttgattatgatggccttctatacaggcctgtcccgggtctctgaccataagcaccatccttctgacgtcctcgccggattcgcccagggcgccttggtggcctgttgtatcgtgttttttgtttcagatctgttcaagaccaagacgacgttatctctgcctgctccagcaatccgaaaagagatcctctcacctgtcgatataatcgatagaaacaatcatcataatatgatgtag

SEQ ID NO: 44760 - DNA, 867 bp, Artificial Sequence
  Description of Artificial Sequence: Synthetic coding sequence
atgcagcggcggtgggtgttcgtgctgctggacgtgctgtgcctgttagtggccagccttccattcgcgatcttgaccctggtaaatgccccttacaaaagaggcttctattgtggcgatgattccatccgatacccgtacaggccggacactattactcacggtctgatggctggagtgacaataaccgccacagtgatactggtgtccgcaggagaagcgtatctggtctacactgatcgcttatattcacgctctgactttaataactacgtggctgccgtctacaaggtactgggaaccttcctcttcggcgctgccgtgtcgcagagtcttacggacctggccaagtacatgattggccgcctgcgacccaactttcttgccgtgtgcgaccctgattggagtcgagtgaactgtagcgtttacgttcagttggaaaaggtgtgcagggggaatcccgccgatgtcacagaggcaagattatcgttctacagcggccactcatccttcggcatgtactgtatggtcttcctggcgctgtacgtgcaagcccgtctttgctggaaatgggctaggctgctccgtccgaccgttcagttcttcctggtggccttcgcgctctacgtgggatacacccgggtgtctgattataagcatcattggtcagatgtcttagtggggctgcttcaaggtgcactcgtagcagctctgaccgtgtgctatatctcagactttttcaaggctcggccccctcagcattgtctgaaggaggaggagctggaaaggaagccatccctttcactcacccttacactgggggaggccgatcataatcattacggctatccacacagctccagttag

SEQ ID NO: 44761 - DNA, 930 bp, Artificial Sequence
  Description of Artificial Sequence: Synthetic coding sequence
atgggcgtggcccggggccccggcagccggggccagcacccccccccacggcagcaggaggtctgtgctgagggccctcgagcacgactgcatcccgcccccccagggctaggcgccagcctccccttcgcgattttgacactagtcaacgcaccatataagcgaggattttattgcggtgacgattctatcaggtacccatataggccagatacaatcactcatgggttaatggccggagtgaccattactgcaacagtgatcttggtctctgccggtgaggcctacctggtgtacaccgaccgtctctactcaagatccgattttaacaattatgtcgctgccgtctacaaagtccttggaactttcctcttcggcgctgctgtgtcccaatctcttacggacttagcaaagtacatgatcgggagactgcgaccgaactttctcgccgtctgtgatccggattggtcacgagtcaactgctctgtttatgtgcagctggaaaaagtgtgtcggggaaaccccgccgacgtaacagaggctagactgagcttttatagcggccactcatcgtttggaatgtattgcatggtgttcctggcactgtatgtgcaagctaggttgtgctggaaatgggcacggctactgcgacctactgtccagtttttcttggtggcattcgcgctttacgtaggatacaccagagtcagcgactacaaacatcactggagtgatgttctggtcgggctgctccagggcgctctcgtagccgccttaactgtgtgttatatttcagacttctttaaggcaaggcctccccaacactgcctcaaagaagaggagcttgagaggaaaccatctctgagcttaaccctgaccttgggcgaagcagatcacaatcattatggatatccacattccagttcttag

SEQ ID NO: 44762 - DNA, 699 bp, Artificial Sequence
  Description of Artificial Sequence: Synthetic coding sequence
atggccggcgtgaccatcaccgccaccgtgatcctggtgagcgccggcgaggcatacctggtgtatacggaccgtctctacagcagaagcgacttcaacaactatgtcgccgcagtgtataaggttctggggacgttcctctttggagcagcagtgagtcaatccttgacagatcttgccaaatatatgatcggtagactgcgccctaatttcctggcagtgtgcgacccagactggtctcgagtgaactgttctgtttacgtgcagctcgagaaagtgtgtcgcggcaatccagctgacgtgaccgaggctaggctgtcattctattccgggcacagctctttcggtatgtattgtatggtgttcttggcattatatgtgcaggccaggttgtgctggaagtgggctcggcttctgcggccaacggtgcaatttttccttgttgcttttgctctgtacgtgggctatactcgggtgagcgattacaaacatcactggagtgatgtgctggtagggttgctccagggggctttagtggcagctctgacagtctgttacataagcgatttctttaaagccagacccccacagcattgtcttaaggaagaagagctcgaacggaaaccttctttgagcctgacactgacattgggcgaagccgaccataatcattatggttacccccactcttccagctag

SEQ ID NO: 44763 - DNA, 711 bp, Artificial Sequence
  Description of Artificial Sequence: Synthetic coding sequence
atgaagcggagcggcaaccccggcgccgaggtgaccaacagcagcgtggccggccctgactgctgtgggggactaggtaatatcgacttccggcaagcagacttctgtgtaatgaccaggttgttaggttatgtcgatccgctcgacccttccttcgtggccgctgtgattactatcacctttaatcccctgtactggaacgtggtggcacgatgggagcataagacccgaaaactgtcgagggcttttggcagcccttacctcgcctgctacagcctcagcgttacgatactcctcctgaactttctgcgatcccactgttttactcaggctatgctgtcgcagcctagaatggagagcctggacactccagctgcatactcccttggattagccctcctcgggcttggcgttgtactcgtgttatccagtttcttcgccctgggcttcgccgggacatttttaggggattattttggaatcctgaaggaggctagggttactgtatttccctttaacatcctggacaacccaatgtattggggcagcacagctaattatctcggctgggcgatcatgcacgcctcacctacagggctgctactcaccgtgctcgtcgctttgacatatattgtggctctgctttatgaagaaccctttacagccgaaatttatcggcagaaagcaagcggctcacacaaacgcagttag

SEQ ID NO: 44764 - DNA, 699 bp, Artificial Sequence
  Description of Artificial Sequence: Synthetic coding sequence
atgaagcggagcggcaaccccggcgccgaggtgaccaacagcagcgtcgccggccccgattgttgcgggggactcggaaacatagacttccgtcaggcagatttttgcgtgatgactcgactcctcggttacgtggaccctcttgatcccagcttcgtcgccgctgttataaccatcacttttaacccgttgtactggaacgtcgtcgcccgctgggaacacaagactcggaagctaagccgggccttcgggtcaccttatctggcatgctattccctcagtgtaaccatactcctgttgaatttcttacggtcccactgtttcacacaagcaatgttgtcccagcctcgtatggagtctctggacacacctgctgcatactctctcggccttgccctgctcggtcttggcgtggtgctggtgctttcaagtttctttgcattaggtttcgccggaacgttcttaggcgactacttcggcattctaaaggaggctcgcgtaacagtcttcccttttaatattctggacaacccgatgtactggggaagtactgcgaattatctaggctgggccataatccctgctccggcgggggctgttgggagcgaggcccggcaaccacacgggcctgccccagatggcgctggtggaccacacttgcattctggatccccaatacggcgggccttacatcggtag

SEQ ID NO: 44765 - DNA, 600 bp, Artificial Sequence
  Description of Artificial Sequence: Synthetic coding sequence
atgacccggctgctgggctacgtggaccccctggaccccagcttcgtggctgccgtgatcacgatcaccttcaatcccttgtattggaatgtggtggctcggtgggagcacaagacacgcaaactgtctcgtgccttcggatcgccctacctcgcgtgctattccctctctgttacgatcctgcttctgaatttcctcaggagccattgctttacgcaggccatgctgtctcagcctcgcatggagagtctggatactcctgcagcttactccctcgggctcgcactcctagggttgggtgttgttctcgtgctgtcttcatttttcgcactgggattcgcgggcacctttctcggagattacttcggcattctgaaggaggcccgcgttaccgtgttcccctttaacatcttggataatcccatgtattggggatcaaccgcgaattacctcggctgggcaatcatgcatgcatcccctacagggctgttgctgacagtgctagtcgcactaacatacattgtggcgcttctgtacgaggagccttttacagctgaaatttacaggcagaaagccagtgggtcccataagagatcttag

SEQ ID NO: 44766 - DNA, 600 bp, Artificial Sequence
  Description of Artificial Sequence: Synthetic coding sequence
atgacccggctgctgggctacgtggaccccctggaccccagcttcgtcgccgccgtcatcactattacattcaaccccctttactggaacgtagtggcccgatgggagcataagacccggaagctttcgcgtgcctttggaagcccctatcttgcctgttatagtctctccgtcacgattctccttcttaactttctccgatcccactgcttcactcaggctatgcttagtcagcctcgcatggaatcactggacactcccgccgcctatagtcttggactagcgctgctcggacttggtgtcgttctggtgctgtcttccttctttgctctgggattcgctggaaccttccttggagattacttcggcatcctgaaggaggcaagagtcactgttttcccttttaatatcttggacaaccctatgtattggggctccacggccaattacttaggctgggcgatcatgcatgcctcccccaccggcctgctgttaaccgtgctggtggcgctgacttacatcgtggcattgctgtacgaagaacctttcactgctgagatctacaggcaaaaagctagtggctcccacaagagaagctag

SEQ ID NO: 44767 - DNA, 642 bp, Artificial Sequence
  Description of Artificial Sequence: Synthetic coding sequence
atgaagcggagcggcaaccccggcgccgaggtgaccaacagcagcgtcgccgggccagactgctgcggcggtctcgggaatatcgactttaggcaggccgatttttgcgttatgaccagactgctgggttatgtagatcctctggacccatcattcgtcgccgccgtgataacaatcaccttcaatcctctctactggaatgtggtggcaaggtgggaacataaaacccgcaagttaagtcgggctttcgggtccccctatttagcgtgttattccctatccgtaactatattgctcctgaacttcctacggagccactgctttacacaagcaatgctatctcagccacggatggaaagcctcgacacccccgctgcctactctctggggctagctctactggggctcggagtggtgctggtcctctcaagtttttttgcactggggtttgctggtacctttttaggcgattacttcggcattctgaaggaagccagggtgacggtgtttcctttcaacatactggacaaccccatgtattggggctctacagccaactacctggggtgggctatcatcctttgcccttgtggccgctatcctttcccacagaggggaccacgtgccatgcgggaggcttag

SEQ ID NO: 44768 - DNA, 636 bp, Artificial Sequence
  Description of Artificial Sequence: Synthetic coding sequence
atgaagcggagcggcaaccccggcgccgaggccgacttctgcgtgatgactcggctcttgggctatgtcgatcccctcgacccatccttcgtggcggcggtcataacgattacatttaatccgctatactggaatgtggtggctaggtgggaacataaaactcgtaaactcagcagagcctttggatctccctatctcgcttgttatagcctgtctgtgaccatcctcctccttaatttcctgagatcccactgttttacacaggctatgctcagccagccgaggatggaatccctggatacaccggcggcatattccctaggcctggccttgctcggtttgggcgtcgttctggtcttgtcatcctttttcgctctcggatttgctggaacgttcctcggcgactatttcggtatcctgaaggaagcacgggtgaccgtcttcccatttaacatactagacaatcctatgtactggggctctacggcgaattatcttggatgggccatcatcagccctgccccagcaggcgcagtggggtcagaagcgcgccagccacacggaccagcccctgatggcgctgggggcccacatctgcacagtggatcaccaatcaggcgggcccttcatagatag

SEQ ID NO: 44769 - DNA, 684 bp, Artificial Sequence
  Description of Artificial Sequence: Synthetic coding sequence
atgggctggaccatgcggctggtgaccgccgccctgctgctgggcttaatgatggtggtaactggcgatgaggacgagaattccccttgcgcacacgaagcactgctggatgaagacaccctgttctgccaaggcctggaggttttttaccctgagttggggaacatcggttgtaaggtggtcccagactgtaataactaccggcagaaaataacctcgtggatggaacccattgtaaaatttcctggggccgtggacggagctacttacatcctggttatggtagatccagatgcaccatctagggcagaacctagacagcgtttctggcgacattggctggtgaccgatattaagggtgccgatctgaaaaaaggcaaaatccaggggcaggaactgtcagcctatcaggctccgtctcctcccgcccactcgggttttcaccgttatcagttttttgtctacctgcaagaaggcaaggtgatcagtctcctgcctaaagagaacaaaaccaggggaagctggaaaatggacagatttcttaaccgcttccacctcggagaacccgaagcctcaacacagttcatgactcagaattatcaggattcgccaactctgcaggcgccacgtgagagagcgtccgagcctaaacacaagaatcaggccgaaatcgccgcatgttag

SEQ ID NO: 44770 - DNA, 1671 bp, Artificial Sequence
  Description of Artificial Sequence: Synthetic coding sequence
atggccgtggccgccgccgccgccgccggccccgtgttctggcggaggctgttgggtcttctgcccgggagacccggattggctgcgctgctgggtagactgtccgatagacttggaagaaaccgcgacaggcagcggcggagatcaccttggttacttctcgcccctctccttagcccggcagtgccacaggtgacatcacccccatgctgtctgtgccctgagggagtgcatcggtttcagtggatacggaatttggtgccggagttcggggtgtcttccagccacgttagagttctttcatccccagcagagttctttgagctcatgaagggacagatccgggtcgcaaaaagaagggtggtgatggcttccctttacctgggtacgggccccctggaacaggaattagtggattgcctcgagagcacactcgagaaaagcctccaggcaaagttccccagcaatctgaaggtatcaatactgttggacttcacacgaggttcacgcggcagaaaaaacagccgcactatgctattaccgttactgagaagatttcctgagcaggtgcgggtgtccttatttcacaccccacatctacggggcctgctccgcctcctgataccggagaggtttaatgagaccatcggtctgcagcacatcaaggtctatcttttcgataactctgtcatactgtctggtgccaatttatccgatagttacttcacaaaccgacaggacagatatgtctttctgcaggattgcgctgagattgccgacttcttcacagagctcgtggatgcagttggcgatgtgagcctgcaattacagggggacgataccgtccaggtggtggatgggatggtgcacccatataaaggcgaccgcgccgagtactgtaaggccgccaataagcgcgtgatggatgttatcaatagcgcccgcaccagacagcagatgctgcacgctcagacgttccacagtaacagccttttgacccaggaagatgccgctgcagccggagatcggcgtcccgctcctgacacatggatctaccccctgattcagatgaagccatttgagatacaaattgacgaaatcgtgactgagaccttgctgaccgaagccgaaagaggtgctaaggtgtacctgaccactggatattttaatctgactcaggcttacatggacctggtcctcggcacgcgcgccgagtatcaaatcctgttagcctctcccgaagtaaatggattttttggggctaagggagttgcgggcgctatacccgctgcctacgtccatatagagcggcagttttttagtgaggtgtgctccttgggtcagcaggagcgtgtccagttacaagagtactggcgcagaggctggactttccatgccaaaggtctgtggctgtacctggcggggtcctcactaccttgcctgactctaataggctctcccaactttggatacagatcagtgcaccgggacctggaggcgcaaatcgccatcgtgacagagaatcaagccctgcagcagcaactccaccaggaacaagaacagctttatctccggagtggagtggtgtcctccgctaccttcgagcagccgtcccgccaggtgaaactgtgggtgaaaatggtcactccacttatcaaaaactttttttag

SEQ ID NO: 44771 - DNA, 1266 bp, Artificial Sequence
  Description of Artificial Sequence: Synthetic coding sequence
atgaaggtggactgcctggagagcaccctggagaagagcctgcaggcgaagttcccgagcaacctcaaagtttccattctgcttgatttcacgaggggaagcagggggcgcaagaattctcggactatgcttttgcccctgctgaggcgctttccagaacaggtgcgcgtgtcactcttccatactccacatctgcggggtctgttacgactgctgattccggagcgatttaatgagaccatcgggcttcagcacatcaaagtctatctgtttgacaactcagtgattctttctggcgcaaacttaagcgacagctacttcaccaaccgccaagaccggtatgtgttcttgcaagactgcgccgaaatcgctgattttttcaccgagctggtggacgctgtcggggacgtgtctctgcaattgcaaggggatgacacggtacaagtggtggatgggatggtgcatccttacaagggggatcgcgcagagtactgtaaagccgccaacaaaagggtaatggacgtaatcaatagtgcacgcactagacagcagatgctgcatgcgcaaaccttccacagcaacagtctgttgacccaggaggatgcggccgctgccggggaccgcaggcctgcaccagatacctggatttatcctctgatacagatgaagcctttcgagattcagatcgatgagattgtgacagaaaccctcctcacggaagctgaaagaggtgccaaggtatacctgaccacgggttattttaacctaacacaggcatatatggacctcgttctaggcactagggccgaataccagatccttctggcatccccagaggtgaatggtttctttggcgcgaagggagtggcaggggccataccggccgcctacgtgcatattgagcggcagttctttagtgaagtgtgctctctgggccagcaggagcgtgtgcagcttcaggaatactggcggcgagggtggacctttcacgcgaaggggctgtggctctaccttgccggatcctcattaccctgtctgacgctgatcgggagcccaaacttcgggtatcgctcagttcatcgcgaccttgaggcgcagattgctatagtaacagagaaccaggccctgcagcagcagctgcaccaggaacaggagcagctttatctgcggagtggggtggtttctagcgctacttttgaacagccaagtcggcaggtaaaactctgggtcaagatggttacacccttgattaaaaattttttctag

SEQ ID NO: 44772 - DNA, 807 bp, Artificial Sequence
  Description of Artificial Sequence: Synthetic coding sequence
atgaaggtggactgcctggagagcaccctggagaagagcctgcaggcaaagtttccctcaaaccttaaagtttcaattctgctggattttactaggggatcacgcggtcggaagaattcgcgaaccatgctcctccctctgctgaggagatttcccgagcaggtacgggtttctctgttccatacaccccacctgcgaggactcttacgcctccttattcccgagagatttaacgaaacaattggactgcagcacattaaggtctatttattcgataattccgtgattcttagcggcgcaaatttatccgactcctacttcactaaccgccaggatcgctatgtgtttctccaggactgcgctgagatagccgacttctttaccgaactggtagacgcggtcggggatgtatccctgcagttgcagggagatgatacagtgcaggtggtcgacgggatggtacacccctacaaaggggatcgtgccgagtactgcaaggctgcaaacaaacgagttatggatgtcataaactcagcccgcacgagacagcaaatgttgcatgcccagacgttccactccaatagtctcctgacacaggaggatgctgctgcggctggagataggcgcccagctccagatacatggatttaccctttgattcagatgaaaccttttgaaatccagattgacgagatagtgaccgagaccttgctaacagaggccgagcgcggtgccaaggtgtacttgaccacaggctacttcaacctcacccaagcctacatgccgggtctaggccactctggttag

SEQ ID NO: 44773 - DNA, 900 bp, Artificial Sequence
  Description of Artificial Sequence: Synthetic coding sequence
atgccctacaccacctacctggtggagaagggcgccagccacagcttcgtggccgaggccaagccccctaccgtcactatgcctaggattaaggccctgatgactggcagtcttccaggattcgtagatgtgattagaaatttgaattctcccgctctgttggaagactccgttattcgccaagccaaagccgccgggaaaagaatagtgttctatggcgacgagacttgggtgaagctgttccccaaacattttgtcgaatacgacggcactacttccttttttgtgtccgactatacagaggtcgacaataatgtgacccggcatttggacaaagtgctaaaacggggcgactgggacatcctgatcttgcattatctgggcctcgatcacattgggcatatcagtggtcccaacagcccgctaattggacagaaactgagtgagatggactcggtactgatgaaaattcatacttctctgcagagcaaggagagggaaaccccactgcctaacctgctggtgctgtgcggggaccacggcatgtccgaaacaggaagtcatggtgcaagcagtactgaggaagttaacacccccttgattctcataagctccgccttcgaaaggaagcctggcgacattcgacacccaaagcatgtgcagcagactgatgtggcggccactctggccatcgccctaggcctgccgattcctaaagattctgttggctccctactgtttcctgtcgtggaggggcggcctatgagagaacagcttcgcttcctccatctcaacactgtccagctttccaaactgcttcaagagaacgtgccctcttacgagaaaggctctcatcccgccccggcgcaaaggcctaccgggaccgcacaaaagggctag

SEQ ID NO: 44774 - DNA, 2928 bp, Artificial Sequence
  Description of Artificial Sequence: Synthetic coding sequence
atgcggctgggcagcggcaccttcgccacctgctgcgtggccatcgaagtactcggcattgccgtctttctgagagggttttttcctgctcctgtgagaagctccgcacgcgccgaacatggggctgagcctccagccccggagccctccgccggagcaagcagtaattggaccacactcccgccccctctgttttccaaggtggttattgttctcatcgatgccttacgtgatgattttgtcttcggctcaaagggggttaagttcatgccttatacaacctacctcgtcgagaaaggtgctagccactcctttgtagccgaagccaaaccccccaccgtaaccatgccaagaatcaaggctttaatgactggatctttacccggatttgttgatgtgatacggaacctgaactctccagcactcctggaagactcagtgattcggcaggctaaagctgcaggcaaaaggatcgtgttttatggggatgaaacgtgggtgaagctgttcccgaagcacttcgtggaatatgacggaaccactagcttcttcgtcagcgactacacggaggtggacaacaatgtcacacggcacctcgataaggtgctaaagcggggagactgggacattctcatactacattacctgggactggatcatattggacatatctcaggaccaaatagtcctctgattggtcagaagctaagcgaaatggattctgtactgatgaagatacacacctctttgcaatcaaaagagagggagacaccactgcccaatctactcgtgttgtgtggtgatcatggtatgtccgaaaccggttcccatggcgccagttctacagaggaagtgaacacaccgttgattttgatctcatctgcctttgaacgaaaacctggagacatcagacatccgaaacacgtccaacagactgatgttgcggcgacattggcaatcgccttgggcctgcccatccctaaagattccgtcggcagtctgctattcccagtcgtagaggggaggccaatgagggagcagttgcggtttttgcatctgaacactgttcagctcagcaaactcctgcaagaaaacgtaccaagctatgaaaaggatcccggttttgagcagttcaaaatgagcgagaggctgcatggaaattggattaggctgtatctggaagagaagcattctgaggtgttgttcaacctgggtagtaaggttcttcgacagtatcttgatgcattgaaaacactctccctgagtcttagcgcccaggtggcccagtatgatatctactcaatgatggtactgacactactgctgctgtccgtgccacaagcactgcgtaggaaagccgagcttgaggtgcccttgtcatcaccaggcttctccctgctgttttatcttgtgatcctggtcctatcggcagtccacgtaatcgtatgtacctctgccgagagcagttgctatttttgcggccttagttggttagcagcagggggggtcatggtgctggcgtccgccctcctttgtgtgatagtctccgtcctgactaacgtgttggttggtggaaataccccacggaagaaccctatgcacccttcatcaagatggtcagaacttgacctcctgatcctgctgggaactgcaggccatgtgttaagtctgggagccagcagttttgttgaggaagagcaccagacttggtactttctggtaaatactctgtgcttagcgctttcacaggaaacatacagaaattacttcttaggtgacgacggggagcctccgtgcggactgtgtgtcgaacagggtcatgatggcgcaacagctgcgtggcaagacggtccagggtgcgacgtcttagaacgagacaaaggacatggatctccaagtacctcagaagtactgcgagggcgagagaagtggatggtgctggctagcccttggctgatcttagcctgttgtagactgctcaggtccctgaatcagaccggcgtgcaatgggcacataggccagacttgggacactggctgactagttccgatcataaggccgaattgtcggtcctagcggctttaagcctgttggtggtgtttgtgctggtccaacgtggttgtagccctgtgtccaaggcagctttggcgctgggcctgttgggtgtctattgctatagagcggcgattggcagtgtgcgatttccatggagacccgatagcaaagacatttcaaaagggatcattgaggctcgttttgtttatgtgttcgtactgggcattctttttactggcaccaaggacctgttgaaatctcaggttatcgcagccgactttaagctgaagaccgtgggcctttgggagatctattctggtctggtcctgttggcagccctgctattcaggccacacaacctgcccgtgctggcattctctctacttatccagacattgatgactaaatttatttggaaaccactgcgacacgacgcagccgagataacggtgatgcactactggtttggacaggcttttttctactttcaggggaattcaaataatattgccacggttgatattagcgcaggatttgtgggtcttgatacctacgtcgaaatccccgcggtgcttctgaccgccttcggcacttacgccggacccgtcctttgggcttctcatcttgttcactttttgtctagcgaaacacgctccgggtccgccttgtcacacgcatgcttttgctacgctctcatctgctctatcccagttttcacctatatcgtgttagtgacatcactgagatatcacttgttcatttggagtgtgttcagccctaagttgctgtacgagggaatgcatctgctgattacagctgccgtatgtgtgttctttacagctatggaccagacgcgcctcacccagtcatag

SEQ ID NO: 44775 - DNA, 2553 bp, Artificial Sequence
  Description of Artificial Sequence: Synthetic coding sequence
atgcggctgggcagcggcaccttcgccacctgctgcgtggccatcgaagttctgggaatcgctgtgtttctccggggctttttccctgcaccagtgaggtcatcagcccgtgcagagcacggtgctgagccccccgcgccggagccgtcagctggggcatcctcaaactggaccacactgccacctcccctgttttctaaggtggtcatcgtgctgatagatgccttgcgcgacgactttgtcttcggatctaagggagttaaattcatgccatatacaacctatctggtggaaaaaggtgcgagccactcgtttgtggccgaggcaaagccaccaaccgtgactatgcccaggattaaagagcgggagactccactcccaaatcttcttgttctgtgtggtgatcatggaatgtctgagacgggaagccacggcgcgtcatctacagaggaagtcaatactcccttaatccttatctctagtgctttcgaacggaaacctggagacatacgccaccctaagcacgtgcagcagaccgatgtggccgctacactggccatcgcactggggttgcccatccctaaggattctgttggaagtttgcttttccctgtggttgaaggcagacctatgagggagcagttacggtttctgcaccttaacactgtgcagctcagtaagctactgcaggaaaatgtcccatcctacgagaaggaccccggcttcgagcagttcaagatgagcgaacggctgcatggaaactggattagactctacctagaagagaaacattcggaagtcctctttaatctcggaagcaaggtgctcaggcaatatctagacgccttaaagaccctgagcctgagcttgagtgcgcaggtagcccaatatgacatctactccatgatggtgggcactgtggtggtgcttgaagtgcttaccttactgctgttgtctgttccacaagcattgcgcaggaaagccgaacttgaagttcccttatcctcacccgggttttctctactcttctatctggtaatcctcgtcctcagcgccgtgcacgtgattgtttgcacctctgccgagtcaagttgctatttttgtggattatcatggctggctgccggaggggtgatggtcttggcctcagcgctgctgtgcgtgatcgtgagcgtgctcaccaacgtactggtggggggcaacactccccgcaaaaaccctatgcatccgtccagcagatggtccgaacttgaccttctcatcctcctgggcaccgctggccatgtgctgtcactgggagcatcatccttcgtcgaagaggaacatcagacatggtattttcttgtgaacaccctctgtctggctctgtcacaggagacgtatcgcaattattttttgggggatgacggtgaacctccttgcggcctgtgtgtggagcaaggccacgatggagctacagcggcctggcaagatggacccggatgcgacgtacttgaaagggataaggggcatggatctccttcaacatccgaggtattgaggggccgtgaaaaatggatggtgttggcctctccatggctcattcttgcgtgctgtcggctacttagatctctgaatcagaccggcgtccagtgggcacatcgacccgaccttggccactggctgacttcctctgatcataaggcagagctgtctgtgttggccgctctgtccctgctcgtggtttttgtgttggtgcagcgcggctgctcccccgttagcaaagctgcactcgcattgggcctgctcggcgtgtactgttatcgagccgctatcggttccgtgcgctttccttggagacctgattcaaaagatatttcgaaagggattatcgaagccagatttgtgtatgtctttgtgctcgggatcctgtttactggaactaaggacttgcttaaaagccaggtgatcgccgctgacttcaaattaaagacagtgggtttatgggaaatctactccggccttgttctcctggctgctctgctgtttcgtccccataacctgccagtcttagccttttctctgctcatccagaccctcatgacgaagtttatctggaaaccactgcggcatgacgctgctgaaattactgtgatgcactactggtttggtcaggcctttttctacttccaaggtaattctaataacatagccactgtggatatctccgcaggcttcgtcggccttgacacttacgttgagatcccagccgtattactcaccgcattcgggacctacgcagggcctgtgttgtgggcgtcccacctggtgcattttttgtcttcggagacccgtagtggatccgctctgtctcacgcttgtttttgctacgcactcatctgtagcattccggtctttacctacattgtcctggtgacatccctccgttatcacttatttatatggtccgtatttagtcccaagctgctgtacgagggcatgcatttgttgatcacggctgctgtctgtgtctttttcaccgctatggatcagaccagactgactcaatcctag

SEQ ID NO: 44776 - DNA, 2952 bp, Artificial Sequence
  Description of Artificial Sequence: Synthetic coding sequence
atgcggctgggcagcggcaccttcgccacctgctgcgtggccatcgaagtgcttggtatcgcagtgtttctgcgagggttcttcccggcaccagttcgcagttctgcaagagcagagcacggggccgaaccacccgcacctgagccctctgcaggggcctcatcaaattggaccacactgcctccgcccttgttctcgaaggtggtgatcgttctcatcgacgcattacgcgatgacttcgtatttggctccaagggtgtcaaattcatgccctataccacgtatcttgtggaaaagggggccagtcactctttcgtggcagaggccaagccccccacagtcacaatgcctcggatcaaagccctgatgaccgggtctctcccgggattcgtggatgtgattagaaatctgaactccccggctctgctcgaagattcggtgatccgacaggcgaaagctgctggtaagaggattgtgttctatggcgacgagacatgggtgaaactgttcccgaaacatttcgttgagtacgacggtacgacaagcttttttgtgagtgattacacagaggttgataacaacgttactcggcacttggacaaggtccttaagcgcggtgattgggacatacttatccttcactatttgggcctcgaccacattgggcacatctcagggccaaactcccccttaatcgggcagaagctttctgaaatggattctgttctcatgaagattcatacaagtctgcagtccaaggagcgagagaccccccttccaaatcttttggtgctatgcggcgatcatggtatgagcgagacgggcagccatggtgcttcttctacagaagaggtgaatactcccttgatactgatctcatccgcctttgagcgtaagcccggggatatccggcacccaaaacatgttcagcagacagatgtggccgcgaccctggctatcgcacttgggctccctattccgaaagactcggtaggatctcttctattccctgtcgtggaagggaggcctatgagagagcaacttcggtttctgcatttaaatactgtacagttaagcaagctgctgcaggagaacgtccccagctacgagaaggaccccggcttcgagcagtttaaaatgagcgagcgcttgcatggaaactggatacggctgtatctggaggagaaacatagtgaggtgttattcaaccttgggagcaaagtgctacggcagtatttggatgcactgaagaccctgtcactgagccttagcgcccaggtcgcccagtacgatatatacagcatgatggttggcaccgttgtcgtgctcgaggtgctgaccctgttgcttctctccgtcccccaagccttgcggcggaaggcggagctcgaggtgcccctgtcatccccgggcttttcattattgttctaccttgtgattctggtactctcggctgtgcatgttattgtgtgtacctcggccgaatccagttgctatttttgcggcttaagttggctcgctgcaggcggcgtaatggtcttggcatctgccttattgtgcgtaatcgtgagtgtgttgacaaatgttttggtcggcggcaacaccccccgtaagaacccgatgcatcccagcagccgctggtctgagttggacttactgattctcctagggacagcagggcatgtcctctccctcggagcttccagctttgtagaggaggaacatcaaacatggtacttcttggtgaatactctgtgtctggccttgagtcaagagacctacagaaattacttcctcggcgatgacggggagccaccatgtggactgtgcgtggagcaggggcatgacggcgccaccgccgcctggcaagacgggccagggtgcgacgttttagagcgggacaaaggccacgggtccccatctacaagtgaagttctcagagggcgggagaagtggatggtcttggcttcaccttggcttattttagcatgctgcagactgctgcggagccttaaccagacaggcgttcaatgggctcacagaccagatctcgggcactggctgacaagttccgatcacaaggccgagctgtccgtgctggctgctctctccctcctggttgtatttgtcctagtgcagaggggctgttcccccgtctcaaaagccgctctggcactgggtctgcttggcgtttactgttatcgcgccgcaatcggctccgtgcgattcccctggcggccagactcaaaggatattagtaaggggatcatagaggctcggttcgtgtacgtcttcgtactggggatcctgttcacgggaacaaaggacctgctgaagtcccaggtcattgccgccgatttcaagctcaaaaccgttggactttgggaaatctactctggtctggtgcttctcgccgcccttttgtttaggccccataatctgccagtattggccttctctttactcatccagactctgatgacgaaattcatctggaagcccctgcgccatgatgccgctgaaatcaccgtgatgcactactggttcggtcaagcattcttttactttcaaggtaattcaaacaatattgctaccgtggatattagcgcaggctttgtcggactggacacctatgtcgagatcccagcagtgcttcttactgctttcggcacctacgctggccctgtgttgtgggcctctcatctggtccattttttgtcttctgagactaggagcgggtccgctctcagtcacgcttgcttttgttatgccttaatttgctccatcccagttttcacctatattgttcttgtaaccagtctgaggtaccatctgtttatttggtctgtgtttagtcctaagctgctgtacgaggggatgcacctcctgatcactgcggcagtctgcgtattcttcacagcaatggatcagactagattgacccaatcgtag

SEQ ID NO: 44777 - DNA, 426 bp, Artificial Sequence
  Description of Artificial Sequence: Synthetic coding sequence
atgcactactggttcggccaggccttcttctacttccagggcaactccaataatatcgccactgttgatatcagtgccggtttcgttggtctggatacctacgtagaaatccctgccgtgctcctgaccgcctttgggacttacgccggccctgtgttgtgggccagtcaccttgtccatttcctgagcagcgagacaaggagtggatctgctctcagtcacgcctgcttttgctatgccttaatctgctcaattcccgtttttacatacattgtgctggtgacaagtctgaggtaccacctctttatttggagcgtcttctcccctaaactcctgtatgaggggatgcaccttctgattaccgctgccgtctgtgtgttttttacctggattaagcctgatagtcatagcctgagactgagctag

SEQ ID NO: 44778 - DNA, 900 bp, Artificial Sequence
  Description of Artificial Sequence: Synthetic coding sequence
atgccctacaccacctacctggtggagaagggcgccagccacagcttcgtcgcagaagctaaacccccaacggtcacaatgccccgcataaaggccctcatgacaggctccctgcccggttttgtagacgtcattcgcaatctgaactctccggcccttttggaggactccgtgatccggcaggccaaggctgcagggaagaggatcgtgttttacggggacgagacctgggtgaaattatttccgaaacattttgtggaatatgacggaaccaccagtttttttgtcagtgattacactgaagttgataacaatgtgacccgccacctcgacaaagtgttgaaacggggtgattgggacatacttatcttacattacctcggcctggaccacatcgggcatatctctggacctaactccccgctgatcggtcagaaactgagcgagatggatagcgtcctaatgaagattcacacatccttgcagagcaaagagcgcgagactccacttccaaacctcttggttctctgcggtgatcatgggatgtcggaaactggatcccacggcgcttcttcgaccgaggaagtgaatacccctctgattctgatctcaagtgcatttgagaggaaaccaggggatatccgccacccgaaacatgttcagcagaccgatgttgctgccacgctggccatcgcccttgggctgccaattcctaaggattccgtggggtccctcctatttccagtggtagagggaaggcccatgcgggaacagctcagatttctgcatctcaacacagtgcagctgtccaagctgctccaggaaaatgttccctcctacgaaaagggcagccatccagcacccgcccagcggcctactgggactgctcagaaagggtag

SEQ ID NO: 44779 - DNA, 1026 bp, Artificial Sequence
  Description of Artificial Sequence: Synthetic coding sequence
atgaccggcagcctgcccggcttcgtggacgtgatccggaacctgaactcaccggccttacttgaggacagtgttattagacaagcaaaggccgctgggaagaggatagtgttttacggtgacgagacctgggtgaaattatttcctaagcatttcgttgagtacgatggcactacaagcttttttgtatcagactacacagaagttgacaacaatgtgacgaggcacctcgacaaagtgctgaaacgcggagactgggacatccttatcctgcactacctgggactcgaccacattgggcacatcagcggtcctaatagcccgctcattggtcagaagctgagcgaaatggactccgtgctcatgaagattcacaccagcctccagtctaaagagcgtgaaacacctcttcctaacctgcttgtcctgtgtggggaccacggcatgtctgagactggctcccacggggcaagcagtacggaggaggtgaacaccccactcatcttaataagctcggcttttgagaggaaacccggggacatcagacatcccaagcatgtgcaacagactgacgtcgccgcaactttggcgatagctttggggctgcccattcccaaggatagcgttggctccctcctgtttcctgtagtcgaaggtcgaccaatgcgtgagcagttgcggttccttcatttgaataccgtccaactgtcgaagttactccaagagaacgtccctagctatgagaaagaccccggctttgagcaattcaagatgtctgaacgtctccacggcaattggattagactttacctcgaggaaaaacactctgaagttctgttcaaccttgggtccaaagtgctgcgtcagtatcttgacgccttaaaaaccctatctctgtcacttagcgctcaggtggcccaattcagcccatgtagctgttccgcttcacaccggcactgtgcagagagactttcatggaagagtcattgtcatttactcgggttcctttgctcgttcatttggtag

SEQ ID NO: 44780 - DNA, 2019 bp, Artificial Sequence
  Description of Artificial Sequence: Synthetic coding sequence
atgcagaaggccagcgtgctgctgttcctggcctgggtgtgcttccttttttatgccggcattgcattgtttacatctgggttcctccttactcggctcgagcttacaaatcattctagctgccaggaacccccaggtcctggtagtttaccatgggggtcgcagggcaaaccaggagcctgttggatggctagccgattcagtagagtagttctagttctgatcgacgcattacggttcgactttgcccagcctcagcattctcacgtcccccgcgagccacctgtaagcctcccctttttaggcaagttgtcttccctacagagaattctggaaattcagccacaccatgcacgactctacagatcccaagtcgatccgccaaccacaacaatgcagcggctgaaggccctgaccactggttccctgccaaccttcattgacgccggatctaactttgcctcacacgccatcgtcgaggataatctgattaaacaactcactagtgcaggcagacgcgttgtgttcatgggcgacgatacatggaaagatttgtttcctggtgccttttcaaaagccttctttttcccttcctttaacgtgagggacctggacacggtggataatggtattcttgaacatctatatccaacaatggattccggggagtgggacgtgctcattgcacacttcctgggggtggaccactgcggccacaagcacggtccccatcacccggaaatggcaaagaagctttctcagatggatcaggtaatccagggcttggtagaacgactggagaacgatacactccttgtagtggccggggaccacggcatgaccactaacggcgaccacgggggagattccgagttagaagtgagcgctgccctctttctgtactcccctaccgccgttttcccgtccactccacccgaggaacctgaagtgatcccccaggtctcactggtgccaacccttgccctgttgctcggcctacctatacctttcggaaacattggagaagtgatggcagagctgttctccggcggggaagattcccagcctcactctagcgccctagcccaggcatccgccctgcatctgaacgcgcaacaggtttctcgtttcttacacacctattccgccgccacccaggaccttcaggctaaggaactgcaccagctgcagaacctgtttagtaaagctagtgccgactaccagtggctccttcagtctcccaaaggggcggaagccacccttcctactgtgatcgctgaactgcagcaatttttacgtggtgcccgcgccatgtgtatcgaatcctgggcaaggttcagcctgtcttttcttctgctacacctgctggctgcaggcataccagttaccactccaggaccttttacggttccatggcaggccgtctcagcgtgggccctaatggccactcaaacattctatagtacgggccatcagccagtgtttcccgcaattcattggcacgctgcctttgtgggctttcccgagggccacggctcttgtacctggctgccagccctgctggtcggagccaacacattcgcctctcacctgctattcgctgttggatgtccgctgctcctactgtggccttttctgtgcgagtcccagggactgcgtaagcgtcagcagccccccggcaatgaggccgacgcccgcgttcgacctgaggaggaggaggagcctctgatggagatgcgcttacgcgatgccccccaacatttctacgctgcactgctccaacttggccttaaatacctttttatcctgggaatacaaattttggcctgcgctctggccgcgagcatcctcaggaggcacttgatggtttggaaggtcttcgctcccaaatttatatttgaggcggtgggttttatcgtcagctcagtcggactcctgctgggtatcgctttggtcatgagagttgacggcgcagtgagcagttggtttagacagctattcctggctcaacaacggtag

SEQ ID NO: 44781 - DNA, 3270 bp, Artificial Sequence
  Description of Artificial Sequence: Synthetic coding sequence
atgcagaaggccagcgtgctgctgttcctggcctgggtgtgcttcttgttctatgctggaattgccctgttcacgagtggctttctcctcacgcgacttgagctgaccaatcactcctcctgccaggagccccctggtccaggatcgcttccctggggctctcaggggaagcccggcgcgtgttggatggcgtcccgattcagcagagtggtccttgttctcatcgatgcccttaggttcgattttgctcagccccagcatagccacgtacctagggaacctcctgtgagcctcccatttcttggaaagctgtcttcactgcagaggatactggaaattcaaccccaccacgctaggttgtaccggagtcaggtggaccccccaactaccacaatgcagcgccttaaagctctgactaccggcagtttacccacctttatagacgctggaagtaacttcgcttcacatgccatcgtcgaagataaccttatcaaacagctaaccagtgctggtcgaagagtggttttcatgggagatgacacttggaaagacctgttcccaggggcctttagcaaagcttttttctttccaagcttcaacgtgcgtgatctggatacagtcgataatggaatcctggaacatctgtaccctacaatggattcaggggagtgggatgtgttgatagcccatttcctcggggtggatcactgcggccacaagcacgggccacatcaccccgagatggccaagaaactgtcccaaatggatcaggtaattcagggattggtggagcgcctcgagaatgataccctactggtggtggccggggatcatggtatgaccacgaacggagatcatggcggcgatagtgaactggaggtcagcgcagccctctttctttattccccaaccgccgttttcccatctacaccgcctgaggagccggaagttatccctcaggtctccctcgtgcccactctagccttattgctagggctgcccattcctttcggcaatattggtgaggtgatggctgagctattctcgggaggcgaggactcacagcctcattcttcggccttggcacaggctagtgccctgcaccttaatgcgcagcaggtgtcaagattcttgcacacctacagcgcggctacccaggatctgcaggctaaggaactccaccagctccaaaatctgttctcaaaagcctctgccgattaccaatggctccttcagagccccaaaggggcggaggcaaccctccctaccgtcatagctgagcttcaacagttcttgagaggagcaagggccatgtgcattgaatcttgggctagattctcccttgtacgaatggccggcgggactgcactactggccgctagctgtttcatttgcctgctggcctcacagtgggccattagccctggattcccattttgtcccctgctgctgactccagtggcctgggggctagtcggtgcaattgcctacgccggtctcttaggcaccattgaactgaagctggatctggtcctgttgggcgctgtggctgccgtaagcagcttccttcctttcctgtggaaggcttgggctggatggggttccaagcgtcctctggccacactgttccccattccaggccctgtacttttgctgctgctgttcaggctcgcagtgtttttcagcgattctttcgtagtggccgaagcccgcgccacgccgttccttctaggcagcttcatccttttgctggttgtgcaactgcactgggaggggcaactgctgccccccaaactgctgacgatgccaaggttgggcacctccgctactacaaatcctcctcggcacaatggcgcgtacgcactcagacttggtattggccttctgctgtgcactaggctcgcgggactgttccatagatgtccagaagaaacacctgtttgccactcaagtccttggctctcccctctggcatcaatggtgggagggagagccaaaaatctttggtatggggcttgcgtcgcagcgctggtggccctcctcgcagccgtacgactgtggttgaggcgctacggcaacctcaaaagccccgagccccctatgctttttgtcaggtggggtctgcctttaatggccctcggaactgccgcttactgggcgttggcatccggggcagacgaagccccccccaggctgagagtgctcgtgtcaggagctagtatggtcctgccccgggccgttgccggcttggccgcctcaggcttggctttactgttatggaagcctgtgacagtgctcgtgaaggcgggcgctggcgctccaagaaccagaacagttctgacaccattttctgggcctcccacctcccaagctgacctagattacgtggtccctcagatttacaggcacatgcaagaggagtttaggggccgtctggagcgtaccaaatctcaagggcctttgaccgttgcagcttaccaacttgggagtgtatattccgcagccatggtgaccgccctaacattgctggcttttcctctcctcttgctccacgcagagcggatctccctggtgtttctgctcctgttcctgcaaagctttttactcctccacttgctggccgctggcatccctgtgaccacccctggcccgttcaccgtgccttggcaggccgtgtctgcttgggccctgatggctacccagactttctattcaacaggccaccaaccagtgttccccgcaatccactggcacgccgccttcgttggattccccgagggccacggcagctgtacatggcttcctgctttattagtcggcgcaaataccttcgctagccaccttcttttcgcagtgggctgccctctcctactgctgtggcctttcctttgcgaaagtcagggcctaagaaagcgacagcagcctcccggtaatgaagcggacgcacgggtgaggccggaagaggaggaggaacctttgatggaaatgagactacgggatgccccacaacacttctatgcggcgctgctacagctgggcctgaagtatctgtttatcctgggcatccagatcctagcatgtgcacttgctgcctccatacttaggcgccatttgatggtgtggaaagtcttcgcccccaaatttatttttgaagcggtaggtttcatagtgagcagcgtagggttgctgctgggaatcgccctggtgatgagggtggatggagccgtatcatcttggtttaggcagctgttcctggctcagcaacgatag

SEQ ID NO: 44782 - DNA, 2019 bp, Artificial Sequence
  Description of Artificial Sequence: Synthetic coding sequence
atgcagaaggccagcgtgctgctgttcctggcctgggtgtgcttcttattttacgctggaatcgccctttttactagtgggtttctgttaactcgcctggagctcaccaaccactcttcctgccaggagcctcccgggcctgggtccctcccctgggggtctcaggggaagcctggcgcctgctggatggcctctcggtttagtcgggttgtgctagttcttatcgatgcgcttcggttcgactttgcccagccccagcacagccacgtgccgcgcgagcccccagtaagtctgccgttcctcggcaagttgtcttcgctacagcgtattcttgagattcaacctcaccatgcaagactctacagaagtcaagtggacccacccaccactacaatgcagcgtcttaaggcactcacgacaggctccctgcctacattcattgatgccggctcaaacttcgcgagccacgcgattgtagaagataacttaataaagcagttaacatctgccggacgacgtgtcgtgttcatgggagacgacacctggaaggatctcttccctggagcatttagcaaggcattcttttttccaagctttaatgtccgagatctggacaccgttgacaatgggatattggaacacttgtatccaaccatggactctggcgagtgggacgtgcttattgcccactttctgggagtggaccattgtgggcacaagcacggtccccaccaccccgagatggccaagaagctctcacagatggatcaagtgatccagggtctggtggagcggctcgagaacgacactctgctggttgtggccggcgaccacggtatgactacaaacggggaccatgggggggacagcgagctcgaagtgtcggcagcactgttcctgtatagtccgaccgccgtgttccccagcaccccacccgaggagcctgaagttatcccccaagtgagcctagtgccaacgttggcccttctcctagggctacccatcccgtttggaaacattggcgaggtgatggcggagctttttagtgggggagaggatagtcagcctcattcaagcgcactcgcccaggcatccgccctgcacctaaatgctcaacaagtctctcgattcctgcacacctatagtgccgctacccaggatttacaggcaaaggaactccaccagcttcagaatctattttccaaagcctctgctgattatcagtggttattgcagtctccaaagggagcagaagccacactgcctactgtaattgcagaactccagcagttcctgagaggagcgagagctatgtgcattgaaagctgggctcgcttcagcctgagcttcctcctgctgcacctgctcgcagccggaattcctgtgaccacccctggaccattcaccgttccctggcaggcggtgtccgcctgggctctcatggccacccaaaccttttatagcaccggccatcaacctgtgttccctgctattcactggcatgcggctttcgttggtttcccggaaggccacggatcgtgcacatggctcccggcgctgttggtgggcgccaacacattcgccagccatctgttgtttgccgtgggatgtcctcttctgctactgtggccgttcctatgcgagtctcagggtctgcgaaagcgccaacagccgcccggcaatgaggccgatgcacgcgtcagacctgaagaagaggaagagccgctgatggagatgcgcctgcgggacgctccccagcatttttacgctgccttactacaactgggtctgaagtacttatttatcctcggtatacagatcctggcttgtgccttggccgccagcatcttgaggcggcatctgatggtgtggaaggtgttcgctccaaagtttattttcgaagctgtgggctttattgtcagctcagttggtctgcttttaggaatcgcccttgtcatgagagtcgacggagctgtctcctcctggtttcgccagttgttcttagcccagcaacgttag

SEQ ID NO: 44783 - DNA, 3270 bp, Artificial Sequence
  Description of Artificial Sequence: Synthetic coding sequence
atgcagaaggccagcgtgctgctgttcctggcctgggtgtgcttcttattctacgccggcattgctctgtttacctccgggttcttgctgacgcggttggaactgaccaatcatagctcatgtcaggaacctcccgggccaggcagtttgccctggggcagccagggtaaacctggagcctgttggatggcatcaaggtttagtagagtggttctggtactgatcgacgcattacggttcgattttgctcagcctcagcacagccacgtgcctcgcgaaccgccagtgtctctgccttttctgggtaaattgagttctctccagcgcatcctggaaatacaaccacatcacgctaggttgtaccggagtcaagtggacccccccaccactaccatgcagcgcctgaaggctctcacaactggctccctgcctacctttattgacgccgggagtaactttgcttctcatgcaatcgtggaagataatctgattaagcagctcacatcagctggaaggcgggtggtcttcatgggggatgatacttggaaagacctatttccaggcgcattcagcaaagcctttttttttcccagttttaatgtgagagatctcgacaccgtggacaatgggatcttggagcatctttaccccaccatggacagcggtgagtgggacgttcttatcgctcacttcttgggagtggaccactgtggacacaaacacggaccccatcacccggagatggctaaaaaactgagccagatggatcaggtcatccaggggcttgtcgaacggctggagaatgatacactgttggttgtggccggcgaccacggcatgaccactaacggtgatcacgggggggacagtgagctcgaggtgtctgccgcactcttcctgtactctcctacagccgtctttccctcaacaccaccagaggaaccagaggtgatcccccaagtgagtcttgtaccaacacttgccttactgcttggactaccaatcccattcgggaatataggcgaagtgatggctgagctgttttccggcggcgaggactctcagcctcacagttccgccttggctcaggcaagtgcactgcacctcaatgcacaacaagtaagtaggttcctccatacttatagcgccgctacacaggacctccaggcgaaagagttacaccagctgcagaatctctttagcaaggcctccgccgattatcaatggctgttacagtcccctaaaggggccgaggccactctgccgactgtgatcgccgaacttcagcagtttctgagaggtgccagagccatgtgtattgagtcctgggcccgatttagtctagtccggatggccggtggaacagctctgctggccgccagttgcttcatctgcttgctggcctcccagtgggcaattagccccggtttccccttttgcccgctgctgctcacccctgtggcgtggggcctcgtgggtgctattgcgtatgctggtctcttagggacaattgagttgaagctggacctggtgttgctcggagcagttgccgcagttagttcgttcttgcccttcctatggaaggcttgggccggctgggggtcaaagaggcctctggccactctcttcccaatcccaggacctgtgctgctgttgctgctcttccgactggctgttttcttctctgattccttcgtcgtcgctgaggcacgagccacaccttttctcttgggaagcttcatcttgctgctagtggtgcagctccattgggaaggacagctcctgcctcccaaactgctgacaatgccgaggttaggtactagtgccaccacaaaccctcctagacataatggagcctatgccctgcggctgggcatcgggctcctgctctgcacgcggttagctggcctcttccacagatgtcccgaagagactccagtgtgtcactctagtccttggctctccccccttgccagcatggttgggggccgggccaagaatttgtggtatggtgcctgcgtggctgccctggtggcactgctggcagccgtccggctttggttgcgtagatacggaaatctgaaaagcccagagcctcctatgttgttcgtgcgatggggactgcccctaatggccctggggaccgcagcatattgggcgttagccagcggtgctgacgaggctcctccgcgcttgcgggtgcttgtgtcaggagcaagcatggtgctcccaagagccgtagctggactggccgcctctggattggccctgctgctatggaaaccagttacggtactggtcaaagccggggctggtgccccacgcaccaggacagtgctgactccctttagcggaccccccacctcccaggccgacctggattacgtggtacctcagatctataggcacatgcaagaggaatttcgggggcgactggagaggacaaaatcacagggccccctgaccgtggcagcctaccagcttggttccgtttatagtgctgcgatggtaacggcgctgacactccttgcattcccccttctattgttgcatgctgagcggatatcattggtcttcttgctgctctttttgcagtcttttctgttgcttcacctgctcgcggcggggattccagtcaccacacccggcccttttacggtaccatggcaggcagtgtccgcctgggcgctgatggctactcaaacattctactctacaggacaccagcccgtcttccctgccatacactggcacgcggctttcgtgggattcccagaaggccacggatcctgcacctggctcccggctctcctggttggcgctaacacattcgcatcccacctactcttcgctgtcggctgccctttgctgctgctctggccttttctctgcgaatcccagggactgcgcaaaagacagcagcccccaggaaatgaggctgacgcaagggttaggcccgaggaggaagaggagcctttaatggagatgcggctgcgggacgcaccccaacacttttacgctgcactccttcaactcgggctgaagtatttattcatcttgggcatccagattttggcctgcgccctcgctgcttctattcttagaagacatctgatggtgtggaaggtgtttgcaccaaagttcatatttgaagcagtaggctttattgtgagctccgtaggtctcctgctcggcatcgcacttgtcatgcgtgtggacggcgctgttagctcatggttcaggcagctcttccttgcgcagcagaggtag

SEQ ID NO: 44784 - DNA, 2283 bp, Artificial Sequence
  Description of Artificial Sequence: Synthetic coding sequence
atggtgctgaaggccttcttccccacctgctgcgtgagcaccgactcagggctgctcgtgggacggtgggttcctgaacagtcctctgcggtcgtgctagccgtgctgcatttccccttcatccccatccaggttaagcagctgctagcacaagtgcggcaggcaagtcaagtcggtgtcgcggtgctcggaacctggtgccactgtcgccaggagcccgaggagtcccttggacgattcctggaatccctgggagccgtatttccacatgagccttggctgagactatgtcgtgagcgcggcgggacattttggagctgtgaggctactcacaggcaggcgcctacagcaccgggcgcgccaggcgaggatcaggtgatgcttatcttctatgatcagaggcaggtgttactaagccagctgcacctgcctaccgtcctacctgacaggcaggctggcgctacgactgccagtaccggagggctggccgccgtttttgataccgtagcacgaagtgaggtgctgttcagaagtgatcggtttgacgaggggcctgtcagattgtcccactggcagtcagaaggggtggaggcctcaattttagccgagctcgccagaagagcatcgggccctatctgtcttctgctcgccagtctactgtccctggtatcagccgtatcagcatgtagggtctttaaattgtggccactttcttttcttggtagtaaattgtccacctgtgaacagctgcgacatagactcgaacatctgaccctcattttctctaccaggaaggccgagaatcctgcgcaactaatgcggaaggcaaatacagtggcgtcagtactgctggatgtggcgctgggtctcatgctcctgagttggttgcacggccggtcacgtatcgggcatctcgccgacgccctcgttcccgtggcagatcacgttgccgaggaacttcagcacttactccaatggctcatgggcgcccctgccgggttgaagatgaaccgagcactcgatcaggtgttggggagattttttctctaccatatccacctctggatcagctatatacatctgatgagcccctttgtggaacatattctttggcacgtaggtctgagtgcatgtctggggttgaccgtggccttaagtctgttatccgacattatcgctcttctaacttttcacatatactgtttctacgtgtacggcgccaggttgtactgcctgaaaattcatggcctctcctccctctggcgcttattcagggggaagaaatggaacgtgctgcggcagcgagttgactcttgcagctacgatctcgatcagctgttcatcgggacccttctgttcacaattctcttgtttctgcttcccaccaccgcactatactatttggtgttcacactacttcgcttactggtcgtggcagtccagggcttaatccacctcttggtggatcttatcaactctcttcctctgtattccttggggcttcggctgtgtcggccctatagactcgccgacaagcccacagccctacaaccccgcggcgctcacctgccccctccccagctgtggcttcccccacaggcgctgttaggccggcccgtgccgcaggctgtgccctggggcgctcatcttccactggaagctgagcgcgggcaagccggactgagagaactgcttgctagactcgcccctccacacggccatagccagccctccgcccttccgggatggcatcagctatcttggcgcatgagctgcgctctctggactctgctgtgcgcaccagagcacggcagaccctgttatcacaccctgggcctggaagtgatcggatcggagcagatgtggggatggccagccaggcttgcagcacttcaccattggcactgcctcccttgggaccctttgcccacttgctgtgggcaccacgggggagaacactccaatcctcgctgtccagagcactgtcctatgcctaccttgtgtacccaggtccagagagtgcgaccaccacagcagccccaggtggaggggtggagcccgtggggactgccatctggttcagctctggccgttggagtggaaggcccttgccaggacgaacccccgtccccacggcatcctctcgccccatccgccgaacagcacccagcttctggaggactgaagcagtcactgacgcctgtgcctagcggacccggcccttcccttccagaaccccatggggtgtatctgagaatgttccccggagaggtggccttgtag

SEQ ID NO: 44785 - DNA, 447 bp, Artificial Sequence
  Description of Artificial Sequence: Synthetic coding sequence
atggtgctgaaggccttcttccccacctgctgcgtgagcaccgactccggactcctagtgggacgctgggtgccggaacagtcctctgccgtggtgctggccgtacttcatttccctttcattcctattcaagtgaaacagctcctggctcaggtccgccaagcgtcccaagtcggcgtcgccgttctggggacatggtgtcactgtaggcaggaacctgaggaaagcctgggccggtttctggaaagcttaggggcagtttttccccacgagccctggctccggctctgccgtgagcgcggtgggaccttttggtcatgcgaagctacccataggcaggcgcctaccgcgcctggcgccccaggcgaggaccaagtgatgctgatcttttatgaccagcgacaggttttgctttcgcaactccatttgcctactgtgttaccatag

SEQ ID NO: 44786 - DNA, 1746 bp, Artificial Sequence
  Description of Artificial Sequence: Synthetic coding sequence
atggtgctgaaggccttcttccccacctgctgcgtgagcaccgacagcggcttgctagtcggccggtgggtgccggagcaatcctctgccgtggtgcttgctgtgctgcactttccttttatccctatccaggtcaagcaactcctggctcaggttcggcaggcttcccaggtaggcgttgcagtgcttggcacttggtgtcactgccgccaggagcctgaggagtccctggggcgtttcctggaaagtctcggagcagtgtttccccacgagccctggctgaggttgtgtcgagaaagagggggaacattctggagttgtgaggccacccatcggcaggcaccgactgctccaggcgcgcctggggaagatcaggtcatgcttatcttctatgatcagcgccaggttttgctgagtcagctgcatctacctactgtgctacctgaccggcaggcaggtgctacaaccgctagcaccggaggcctggctgccgtgttcgatactgtggccaggtccgaagtactctttcgatcggatagattcgacgaggggcctgtccgcctgtcacactggcagagcgaaggagtggaagcgagcatcctggctgagttggctcgaagagccagcggccccatctgcctcttacttgcttcactgctgagccttgtctccgctgtgtccgcatgtagagtcttcaaattatggcccttatcttttttggggagcaaactgtccacgtgtgaacagcttagacacagactggaacacttaacgttgatcttcagcacccgcaaggccgagaatcccgcgcagctgatgcgcaaggccaacaccgtggccagtgtcctgctcgatgtggctcttggcttgatgctgctgagctggttgcatggccgcagtcggataggccacctcgctgatgcactggtccctgtggccgatcacgtagctgaggagttgcagcacctgttgcagtggctgatgggggcaccagccgggctgaagatgaacagggccttggatcaggtgctcggtagattctttctttaccacatacacctgtggatttcgtacattcacctaatgagcccattcgtggaacatatcctatggcatgttggactgagcgcgtgcttaggtttgacagttgcgttgtccctgcttagcgatatcattgcactgctgacattccacatctactgtttttacgtctacggggcgcggctgtattgcctcaagatccacggtctatcctccctctggcgcctcttccggggcaaaaagtggaatgtactccgtcagagagttgatagctgctcctacgatttagatcagcttttcattggaacccttctatttaccatcctcctgttcctgctgccaacgactgccctgtactacttggtttttaccctactccgacttctggtagtggcagtgcaaggtctgattcaccttctcgtcgatctaatcaactccctgcccctgtactcactggggctgcgcttgtgccgaccttaccgactagctgccggcgtgaagttcagagtgctccggcacgaagcagggaggccccttcggctgctgatgcaaataaatcctctcccttacagtcgagtggtgcatacataccgtctcccaagctgcggctgccatcccaagcacagctggggtgctctgtgcaggaagctctttctgggagagcttatttatccttggcggcagcggggcgacaagcaagattag

SEQ ID NO: 44787 - DNA, 756 bp, Artificial Sequence
  Description of Artificial Sequence: Synthetic coding sequence
atggtgctgaaggccttcttccccacctgctgcgtgagcaccgacagtggattgcttgtcggtcggtgggttcctgaacagtcctctgctgtggtgctagccgttctgcattttccattcatccctattcaggttaagcagttgctcgcacaggtgcgtcaggcgtcccaggtcggggttgccgttctgggcacatggtgtcactgtcggcaagaaccggaggagtccctaggcagatttctcgaatccttaggggcagtgttccctcatgagccctggctccgtctgtgccgtgagcggggaggaacattttggtcttgcgaggctacacatcggcaggccccgaccgcaccaggcgcccccggagaggaccaggtgatgctaatcttctacgatcagcgtcaggttctgcttagtcagctgcatctgccaactgtgctaccggaccgccaagcaggagccacgacagcttctaccggcggcttggccgccgtattcgacactgtcgccaggtctgaggttctgtttcggtctgatcgattcgatgaggggcccgttcgcctctctcactggcagtcagagggcgtagaagcctctattctcgccgagctggctcgtagggccagtgggcctatctgcctgttgttagctagtctgctgtcgttggtttctgccgtgtccgcgtgtcgtgtctttaagctgtggccactcagtttcctggggtccaaattgtcaacttgtgaacagctgcgatag

SEQ ID NO: 44788 - DNA, 1746 bp, Artificial Sequence
  Description of Artificial Sequence: Synthetic coding sequence
atggtgctgaaggccttcttccccacctgctgcgtgagcaccgactcaggactgctcgtggggaggtgggttccagagcagagctccgccgtggtgctcgccgtactacacttcccattcattcctattcaggtcaaacaattgctggcccaagtgagacaggcctcacaggtcggcgtggccgtgctggggacatggtgtcattgccggcaagagcccgaggaatcgctcgggcgattcctggagtctctgggggcggtatttccccacgaaccatggctgcgactgtgccgtgagagaggaggcaccttttggagttgcgaggcgactcatagacaggctccaactgctccgggggcccccggggaagaccaagtgatgcttattttctacgaccagaggcaggtcctcctcagccaactgcacctgccaacagttcttcctgatcgacaagccggcgccacgacagcctcaacaggcggccttgccgcagtgtttgacacagtggcccgaagcgaggtactcttccggagcgatcggttcgacgaaggtccagtcagactttcccactggcagagcgagggagttgaggccagcatcctggctgagctggccagacgagcctctggtccaatttgcctgttactggctagcctcctgtccttggtgtccgccgtgtctgcttgtcgcgtgtttaaattgtggcctctgtcctttctggggtcgaaattgagcacgtgcgaacagctgaggcatcggctggagcacttaaccctgatcttctctactcgcaaagccgaaaaccccgcccagcttatgcggaaggccaacactgtggcttccgttttactggacgttgcactcggtctcatgctcttatcctggttacatggtcgttccaggatcggccaccttgccgatgcattggtgcctgtggccgaccatgtggcagaggagctgcagcacttactacagtggttaatgggagccccagctggcttaaagatgaatagagccctggaccaagtacttggccggttttttctgtaccatatacacttgtggatatcttatatccacctgatgtccccttttgttgagcatattctctggcatgtgggcctgtcagcatgcctaggcttgactgttgcactctcccttctctctgacataatcgccctccttacctttcacatctactgtttctatgtgtatggagcccgcctatactgtctaaagattcacggcttgtctagtctatggcgcctgtttcgaggaaagaaatggaatgtattgcgccagcgagtcgacagttgcagctatgatttagaccagctttttataggcacattactcttcaccattttgctgtttcttctccctactaccgcactgtattaccttgtcttcacattactccgactgctggtcgttgccgttcagggactgatccatctccttgtggacctcataaattcgttgcctttgtattcactgggacttcgcctttgccgaccatatcggctggctgccggagtaaaatttagggtgctgcggcacgaggccggccggccactgcggcttttgatgcaaattaaccccctgccttattccagagtggtccatacatacagactacctagttgtggctgccaccctaaacattcatggggtgccctctgtcgcaagcttttcctaggggaactgatttacccctggaggcaacgcggcgacaagcaggactag

SEQ ID NO: 44789 - DNA, 945 bp, Artificial Sequence
  Description of Artificial Sequence: Synthetic coding sequence
atggtgctgaaggccttcttccccacctgctgcgtgagcaccgacagtggactgctcgtgggtagatgggttcctgagcagtcttctgcggtggttttggccgtgttgcattttccctttattcctatccaagtaaaacagctgctggctcaggttagacaggcttcccaggtcggcgtcgctgtgttaggaacatggtgccactgccgacaagagcccgaggagtcattgggtaggtttcttgaaagcctgggggcggtctttcctcacgagccatggttgcgcctgtgccgagaacggggcgggaccttctggagctgtgaggcaacacatcggcaagcgcccactgcgccgggcgctccgggcgaggaccaggtgatgctgatcttctatgaccaaaggcaagtgctcttatcacaactccatttgccaactgtgctgcccgatcggcaggccggtgccactacagcctccacagggggccttgcagcagtgttcgataccgtcgccaggagcgaagtgctattcaggtcagatcggttcgatgagggcccagtccgactgtctcactggcagtcagagggagttgaagcgagcattctcgctgaactggcccgtagggcaagcggccccatctgtttgctgcttgcatcactcctttctctcgtgtcagcggtgtccgcttgtagggtttttaaactctggccattgagctttcttggatctaagcttagtacttgcgagcaactgagacaccgactcgagcatctcacactgattttttccacacgtaaggccgaaaatccagcccaactaatgcgcaaggcaaacaccgtggcgagcgtattattagacgtagccctgggactgatgttactgagctggttgcacggccgatcacgtatcggtcatttggcagacgcgctcgtgcctgtcgctgactag

SEQ ID NO: 44790 - DNA, 339 bp, Artificial Sequence
  Description of Artificial Sequence: Synthetic coding sequence
atggtgctgaaggccttcttccccacctgctgcgtgagcaccgacagtggtttgctggtcggtcgatgggttcccgagcaatcatctgctgtggtcctggccgtactgcactttccatttattccaatccaggttaagcagctcttagcacaagtcaggcaggcaagtcaggttggagttgctgttttaggcacatggtgtcactgtaggcaggagccagaagaaagcttagggcgctttcttgagtcccttggggcggtgttcccccacgaaccctggctccgcctgtgccgagagcggggggggaccttctggtcgtgcgaagccacacacagatag

SEQ ID NO: 44791 - DNA, 1725 bp, Artificial Sequence
  Description of Artificial Sequence: Synthetic coding sequence
atgtggtgggccctgcggccccccggcatcctgccccccggcatggttctcaaggcttttttccctacatgttgcgtcagtacagatagcggcttgcttgtaggccgctgggtgccagaacagagctccgccgtcgtgttagcagtcctgcattttcctttcatccccatacaagttaaacagctcctcgcacaggttagacaggcatcacaggtcggcgttgccgtgctcggcacttggtgtcattgcaggcaggaacccgaggagagcctagggagatttctcgagtcccttggtgccgtgtttcctcatgaaccctggttgagattgtgccgagagcggggtgggaccttctggagctgcgaagccacgcaccggcaggctccaactgcccccggagcccctggcgaggaccaggtaatgctgatcttctatgaccagagacaggtcctgctgagccagttacacctccccactgtgctaccggataggcaggctggggctaccacagccagtacagggggtctagccgcggtctttgacaccgtggccagatcagaagtactgttccggagcgaccggttcgatgaagggcccgtacgcctcagccactggcagtctgagggagtcgaggcctccatcttggccgaactcgcgcgacgggcatcaggaccaatttgtctgttgctggcaagcctgctttcactcgtaagtgcggtctctgcctgtagagttttcaagctttggccgctgagttttttaggctccaagctgagcacctgcgaacagctgcggcaccggctggaacatctgaccctaattttctcaacgcgtaaggccgagaacccggcgcaactcatgaggaaggccaacaccgttgcctcagtgctgctggatgtggcacttgggctgatgctgttgtcttggttgcacggccgcagtagaatcggacatttggccgatgctttagtgccagttgctgaccacgtcgctgaggagctgcaacacctgctgcagtggcttatgggtgcaccagccggactcaaaatgaatagagccctcgaccaagttctcggaaggttcttcctgtaccatatccacctgtggatttcctatattcacctgatgtccccgttcgtcgaacatatactctggcacgtcggacttagcgcctgcctcggcctgacagtagctctgagcctcctttccgacatcatcgcactgctgacattccacatttactgcttctacgtttacggtgcaaggttatactgcctcaagattcacggactgagcagtctgtggaggctgtttagggggaaaaagtggaacgtgctgagacagcgagtcgatagttgtagctacgatcttgatcaattattcattggcacacttctgtttaccatactcctattcctgttacctactaccgccctgtactatctggtctttaccctcttaagattgctggtggtggccgtgcagggcctgattcatctcctggtggatttgatcaactcccttcctctctattccctgggactccgactgtgcagaccttatagattggctggttcagaaccttggaggcccgaggccactggtctgtgcagctccgcactgggattttctggactcggttcactgaactgccgaccgggcgctaaacgtgggaaagttaggggcacacgctctcaacaagggggacatcacccgttggcctag

SEQ ID NO: 44792 - DNA, 900 bp, Artificial Sequence
  Description of Artificial Sequence: Synthetic coding sequence
atggtgctgaaggccttcttccccacctgctgcgtgagcaccgacagtggtttactcgtagggaggtgggtgccggaacaaagcagtgcggtggtcctggctgtgctccacttcccttttatacctattcaggtgaaacagttgttagcccaggttcgacaggcgagccaggttggggtcgcggtcttaggcacgtggtgccactgcagacaggagcctgaggagagtcttggccgatttcttgaaagcctgggcgctgtgtttccccacgagccgtggctgcggttatgcagagagagaggggggactttctggagctgcgaagcaacacaccgtcaagcccccaccgccccgggcgctcctggtgaggatcaggtaatgctgatcttctacgatcagagacaggtgctgctctcgcagctgcacctaccgacagtccttccagatcgccaagcaggagccacaacggccagcacgggcggattagccgcagtatttgacactgtggctcggtctgaagttctgttcaggtccgatcgcttcgacgagggtcctgtcaggctgtcccattggcaatcagaaggcgtagaggccagcattctcgccgaactggcacgacgtgcctcaggccccatttgtctgctgttggcaagtctgctgagcctggttagtgcagtgagtgcatgtcgcgtgtttaaactgtggcctttgagcttcctgggcagtaaattgagcacctgcgagcaactgagacacaggctggaacatctcacgctcatattttctacaagaaaggccgagaacccggcgcagctcatgcggtgcggtcctgccctggtgagcgccggtcttggtgcatgtcctttagcacctagcccgtctcctagcgctcccaggtag

SEQ ID NO: 44793 - DNA, 480 bp, Artificial Sequence
  Description of Artificial Sequence: Synthetic coding sequence
cagcccttcctgaacgccctgggcgccgccctgctgtgcggcctgtccgatagcctactctgtaatgtgggaggtgaatctcctcttactcagttgccccctgccacaatatggacatgcaccgccagtccaatgagttccacccagtggtcccccggctgggatcctgtactaccaccttgcactctctgttccacgttttacagcacctgtctttctttgcacacacacagatgtacgtttcgtacgcggatggcactccagtggccaccaatgccttcaatcgtgcctgcaggggtggggagcctggtgtacaatgtagattctaagacctataacgcttctgtgctgcctgtaagggtcgaagtggacatggtccgttggcgctgctcatggcactcctgtggttgctcacttggtttgctgagcccatcttgtctgcaaaatgcatgtttccaaggactccgcgttaagggttag

SEQ ID NO: 44794 - DNA, 1668 bp, Artificial Sequence
  Description of Artificial Sequence: Synthetic coding sequence
atggccgccgccggcgccgccgccacccacctggaggtggcccggggtaagcgggcagccttgttcttcgcagcggttgcaatcgtgctgggccttcccctgtggtggaaaaccacagaaacgtatcgggcgagtcttccttattcacaaatcagcggactaaacgctcttcagttacggctgatggtgccagtaaccgttgttttcacccgcgaatccgttcccctggacgaccaggagaaattacctttcactgtagttcatgagcgcgagatcccactgaaatataagatgaaaataaagtgtcgcttccagaaggcctataggcgggccttggatcatgaggaagaggcactctctagcggcagcgtgcaggaggctgaagccatgctcgacgaacctcaggagcaggccgagggttccttgactgtatacgttatatccgagcattctagccttttgccccaggatatgatgagttatatcggccccaagcggacggctgttgtgcgcggaattatgcaccgggaagctttcaatatcataggtagaaggattgttcaggtcgctcaggcaatgagccttactgaggacgtgctcgccgccgctctggcggaccacctgcctgaggacaagtggagcgcagaaaagcgcagacccctgaaaagcagcttgggatacgagatcacctttagcctgctaaatccagaccctaaaagccacgatgtttactgggatatagagggggcggtccgtcggtatgttcaaccattcctgaatgctcttggcgccgccggtaatttctctgttgatagccagatattgtattacgccatgctgggcgtgaatccgcgcttcgattccgcctcgtccagctattacctggatatgcatagcttaccccacgtgatcaacccggtcgagtccagattaggatccagcgccgcctctctgtaccccgtactcaacttcttactgtacgtcccagaattagctcattctcctttgtacatccaggacaaggacggtgcaccagtggcgacgaatgcgtttcactcccccagatggggtggtatcatggtttataatgtggattctaaaacgtacaatgcgtccgtcctacccgtgagagttgaagttgacatggttcgcgttatggaggtgtttctggcccagttgaggcttttatttggcatagcgcagccacagctgccacccaaatgtctgctgagtggacctacctcagaagggctcatgacttgggaactcgataggctgctctgggctagatcagtcgagaatctggccaccgccacaaccacgctgactagcctcgctcaactactcggaaagatttccaacatagtgatcaaggacgacgtggcgtccgaggtttacaaggcggtcgccgccgtccaaaaatcggcggaagagctcgcgtcgggccatctcgcatccgcgttcgtggctagccaagaggccgtgacttcaagtgaactggccttttttgatccgagtctgttgcacctgttgtacttccccgatgatcaaaaatttgctatctacattcctttgttcctgccaatggccgtgccaatcttgcttagtttggtgaagattttcctggaaactcggaaaagttggcgcaaacccgagaagactgattag

SEQ ID NO: 44795 - DNA, 1644 bp, Artificial Sequence
  Description of Artificial Sequence: Synthetic coding sequence
atgcccagcgaggtggcccggggcaagcgggccgccctgttcttcgcagcggtggctatagtattgggcctgcccttgtggtggaaaaccacagagacatatcgggctagtttgccctattcacagatctcaggactgaacgctctgcagttgcggcttatggtgcctgtgactgtagtatttaccagagagtccgtgcctttagatgaccaggagaagctgcccttcacagtggtacacgagcgtgaaatcccgctgaagtataagatgaaaattaaatgccgctttcagaaggcctaccgacgagcactcgatcatgaggaggaggccctgagttcggggagcgtccaagaggctgaggctatgctggacgaaccacaggaacaggccgagggtagcctgacagtttacgtcatctccgagcatagctctctcctcccacaggacatgatgtcgtatataggaccaaagagaaccgcagtggtgcgggggattatgcatcgagaggccttcaatatcataggccgcaggatagtgcaagtggcccaggctatgtctttgactgaggatgtgcttgcagccgcacttgcagatcatctgcctgaagataagtggagcgctgagaaacggcgacctctcaagagtagtctgggctatgaaattacattcagtcttttaaatccggatccgaaatcccacgacgtgtattgggatatcgagggtgcagtgcgccgatatgtgcagccattcctcaacgccttgggcgcagctggtaatttctcagtggatagtcagatcctctattacgctatgctcggcgtgaatcctcgttttgactcagcttcatcgtcatattacctggacatgcactcccttccacatgttatcaacccagtcgaatccagactgggatcctccgccgctagcctgtatcctgtcctgaattttctactgtatgtccccgaactggcgcactcccccctgtacattcaggataaggacggagcacctgttgcaactaatgccttccacagccctaggtggggcggtattatggtttataatgttgatagcaagacatacaatgctagcgttcttcctgttcgcgtggaagttgacatggtgagagtgatggaggtcttccttgctcagctgagactgctctttgggatcgctcaaccccagttgccccctaagtgcctgctgagtgggcctacatctgagggactgatgacatgggagctggaccgtctcctgtgggctaggtctgtggaaaatctggcaaccgccacaacaactcttacctctctagcccagcttttgggaaagatctctaacattgttatcaaggatgacgtcgcctctgaggtgtataaggcggtcgccgcagttcaaaaatcagccgaagagctggcctcggggcacctcgcgtctgcttttgtagcgagccaggaagcagttacctcgtcggagttggctttttttgacccatcgctgcttcacttgctctacttccccgatgatcaaaagtttgccatatatattcccttgttcctgccaatggccgtccctatactcctatccctggtcaagatctttttagaaacacgtaagagctggcgcaaacctgagaagacagattag

SEQ ID NO: 44796 - DNA, 1485 bp, Artificial Sequence
  Description of Artificial Sequence: Synthetic coding sequence
atggtgcccgtgaccgtggtgttcacccgggagagcgtgcccctggacgaccaggaaaaactgccatttacagtggtccacgaacgcgaaatacccctgaaatacaagatgaagataaagtgcagatttcaaaaagcctaccgtagagcactagaccacgaagaagaggcattgtcctcgggaagtgtccaagaggctgaggcgatgcttgacgaaccacaagagcaggccgagggctctcttactgtatatgtgattagtgagcacagctccctgctgccccaggacatgatgagctacattggcccaaaacgtaccgcggttgtgcgaggaatcatgcatcgggaggccttcaacataattggccgtaggatcgtgcaggtggctcaggcaatgagcctaaccgaagacgtgctggcggccgccttagcggaccaccttcctgaggataaatggagtgccgagaaacggcgccccttaaaatccagccttggatatgagatcactttcagtttactgaatccggaccccaaatcacatgacgtctactgggacatcgaaggcgccgtgagaaggtatgttcagccttttctcaacgcactgggagccgctgggaacttctctgtggactcccaaattttatactacgccatgctgggagtcaatccaaggttcgatagcgctagtagttcctactatctggatatgcattctctgcctcatgtgattaacccggtcgagagtagactcggcagctccgctgcaagcctgtatcccgtgttgaattttctattgtacgtgcccgagctcgcacacagtcccttgtacatacaggataaggacggcgcgcccgttgcaactaacgccttccactccccgcggtgggggggtattatggtatacaatgtggattctaaaacgtacaacgcttcagtactcccggtacgagttgaggtggacatggttcgggtgatggaagtttttttggcccagcttcggctgctatttgggattgctcagccgcagttgccacctaaatgcctcctgtcaggcccaacaagcgaaggtctgatgacttgggagctggaccgcctcctatgggcccgttctgtggagaacctggccaccgccaccaccacattgacatccctcgcccaactactcggaaaaatttccaacatagtgatcaaagacgacgtggcgtccgaagtgtataaggcagtagctgcagtgcagaagtcagccgaggagctggcctccgggcacctggcatccgctttcgtagctagtcaggaagccgtgacgagctctgaattagcgttctttgacccatcgctcctacatttgttgtacttccccgatgaccagaaattcgccatatacatccccctatttttgcctatggcagtgcccatcctgctcagtctcgtcaagatcttcttagaaaccaggaagagctggcggaagcccgaaaaaacggattag

SEQ ID NO: 44797 - DNA, 1431 bp, Artificial Sequence
  Description of Artificial Sequence: Synthetic coding sequence
atggccgccgccatgcccctggccctgctggtgctgctgctgctgggaccgggaggttggtgcctggccgaaccacccagagactccctccgagaagaactggtgataacccctcttccttctggagacgtggctgctacatttcaattcaggacaagatgggactcagagctgcagcgggaaggagacacggatcactactttctgcgctatgcggtcctcccccgggaggtagtgtgcactgaaaacttgactccatggaagaagctacttccatgctcatcaaaggctggcctcagtgtcctgctcaaggctgaccgccttttccacacatcgtaccactctcaagcagtgcacattcggccagtctgcaggaatgcccgctgtactagtatcagctgggagctccggcagaccctctccgtggtcttcgatgcctttatcacagggcagggtaagaaagactggtccctctttagaatgttcagccgcaccctgacggaaccttgtcccctcgccagtgaatcacgtgtctacgtggacattacaacctacaatcaggataatgagaccctggaagtccaccctcctcctactaccacgtatcaagacgtcatcctagggacgaggaaaacatacgccatctatgacctgctcgataccgctatgatcaacaatagccgcaatcttaatattcagcttaagtggaaaagacctcctgaaaacgaggctcccccggtgcctttcttgcatgcacagagatacgtgtctggatacggactccagaaaggagagctatcaaccctgctctataacacacacccataccgagccttcccggtgctcttactggacactgtcccttggtatctgagattgtacgttcacacccttactatcacctctaagggcaaggagaacaagccgtcatatattcattaccagccggcccaagatcgactccagccccacttgctcgagatgctgattcagctgcccgccaactctgtaacaaaagtttcaattcaatttgaacgtgccctgctgaaatggacggaatatacaccggaccctaaccatggcttctatgtgtcaccatctgttctctccgcactcgtgccaagtatggtggctgctaaacccgtggattgggaagaaagtcccctgttcaacagtctctttcccgtaagcgatggtagtaattactttgtgcgcctgtacaccgaaccactcttagtgaacctgcctactccagattttagtatgccttataatgtgatttgcttaacatgcacagtggtcgcagtttgttacggctccttctataaccttctgactagaacatttcacattgaagagccccggacggggggtctggctaaaaggctagccaacctgatcagacgcgctagaggcgtgccacccctctag

SEQ ID NO: 44798 - DNA, 1737 bp, Artificial Sequence
  Description of Artificial Sequence: Synthetic coding sequence
atggccgccgccatgcccctggccctgctggtgctgctgctgctgggtccaggtggttggtgcctcgctgagcctccgcgagacagcctcagggaggagctggttatcaccccgctgcccagtggagatgtcgccgccacctttcagtttagaacacgctgggacagtgagctccagcgggagggagtgtcgcattatagactgtttcccaaggctttagggcagctgatcagcaaatattcactgcgggaactgcatctgagcttcacgcaggggttttggagaacccggtactggggccctccctttctccaggcccccagtggcgctgagctgtgggtgtggtttcaggacacagtgaccgacgttgataaaagttggaaggaattgtccaacgttcttagtgggatattctgtgcctccttgaacttcatcgatagtaccaacacggtgaccccaactgcttctttcaagcctctggggcttgccaacgataccgaccactatttcctgcggtatgcagtacttccacgtgaagttgtctgcaccgagaacctgactccctggaaaaagctgttgccctgttcatccaaagctgggttaagtgtgctcctgaaagctgatagattgtttcatacatcataccacagccaggctgtccacatccgacctgtctgtcggaatgctaggtgtacctcaatctcctgggaactccggcaaacacttagcgtcgttttcgacgcctttatcacagggcagggaaagaaggactggagcctgtttcgtatgttctcccgcacattgactgagccttgccccctcgcatctgaatctagggtgtacgtggatatcactacttacaaccaggacaacgaaacactcgaggtgcaccctcctcctacaacaacttaccaggatgtgatactgggcactaggaagacgtacgccatttatgacctcttggatacggctatgatcaacaacagtcgcaacttgaacattcaactgaaatggaagagacccccagaaaatgaggccccacctgttccattcctgcatgcccagagatacgttagtgggtacggactccagaaaggggaactctccactctgctgtacaatactcacccttaccgggcctttcctgtcctgctcctggatacggtgccatggtatttgcgcctgtacgtccacacactgactattacgagcaagggcaaagagaacaagcctagctacatccactatcaaccagctcaagacagacttcagcctcatctgctggaaatgctgatacagttgccagccaattcagttacaaaggtttccatccagtttgaaagagctctgttgaaatggactgagtacactcctgatcctaaccacgggttctatgtttcaccttctgttctgtcagccctggttccttctatggttgcggccaaaccggtagattgggaggagtcaccactgtttaactctcttttcccagtgtcagacggatcaaactacttcgtgcgactgtatacagaacctctattggtaaacctcccaacccccgatttctccatgccctataacgttatttgcctgacctgcaccgttgtggccgtgtgttacggctctttttataatctgttaactcgaactttccatattgaagagcccagaacagggggcctggcaaagcgactggccaacctaatcaggcgcgccaggggcgtgccccccttatag

SEQ ID NO: 44799 - DNA, 1155 bp, Artificial Sequence
  Description of Artificial Sequence: Synthetic coding sequence
atggccgccgccatgcccctggccctgctggtgctgctgctgctggggcccggcggttggtgtctggccgaacctccccgggattctctgagggaagaacttgtcatcaccccgctcccctccggtgatgtggccgctactttccaatttaggactaggtgggattctgagctgcaacgagagggggactggtcattgtttcgcatgttctcaaggacccttaccgagccatgcccactggcaagcgagagtagggtgtacgtggatattacaacgtacaaccaggacaatgagacgttggaggtgcatcctccccccacaactacctatcaagacgttatactgggaacaagaaagacatacgccatttacgatctgttggatacagccatgataaacaactctaggaatctgaacattcaattgaagtggaaaaggcctccagaaaacgaggcaccacctgtgccatttctgcacgcccagcggtatgtctccggctatggactgcagaaaggcgaactaagtacacttctgtataacacccacccataccgtgcttttcccgttctgctgctggacacagtcccttggtacctcaggttgtatgtgcacaccctgacaatcacctccaagggaaaggagaacaagccctcttacatccattaccagccagcccaggacagattgcagccgcacctattggagatgctcattcagctccctgccaacagcgtgactaaggtttccatacaatttgagagggccctgcttaagtggaccgagtacacccccgacccaaatcatgggttttacgtatccccatcagtgctctccgccctggtccctagcatggtagccgccaagccagtggactgggaagagagccctctattcaatagcctgtttcccgtttctgatggctccaattatttcgttagactgtatactgagccgctgctggttaatttgccaactcccgatttcagtatgccatacaacgtcatctgtttgacctgtactgtcgtagctgtgtgttatggttcgttttataacctgctgacaagaacgttccacatagaggagcctagaactgggggactggcaaaaaggttggctaatttgatacgacgcgctcgcggagtgccgccactgtag

SEQ ID NO: 44800 - DNA, 1536 bp, Artificial Sequence
  Description of Artificial Sequence: Synthetic coding sequence
atggccgccgccatgcccctggccctgctggtgctgctgctgctggggccaggggggtggtgccttgccgagcctccacgcgacagtctccgtgaagagcttgtgataacgccgctcccttcaggtgacgtcgcagcaacatttcagttccgtactcggtgggattctgagctgcaacgggaaggagtgtcccattaccgattgtttccaaaggccttaggtcagctgattagtaaatatagtctgcgtgagttgcacctgtccttcacccagggcttttggcgtacccggtattggggacccccatttctgcaggcccctagcggagctgagctgtgggtgtggttccaggatacagtcacagacgtggataagagttggaaggagctttcaaatgtcctgagcgggatcttttgtgcctcactgaacttcattgactcgaccaataccgtgacaccaacagcatcctttaagcccttggggctggctaacgacaccgaccattactttctccgctacgccgtgctgccccgagaggtggtgtgcacagagaacctgacaccatggaagaaactcctgccttgcagtagcaaagccggtctttctgtactgctcaaagcagaccggctgttccacacctcttaccactcccaggctgtccacattcggccggtgtgccggaacgcgagatgcacgtcaatctcctgggaattgaggcaaactttgtcagtggttttcgacgcatttattaccggtcagggcaagaaggactggtccctctttcgtatgttctccaggacactgactgagccctgtccacttgccagtgaatctagggtgtacgtggatatcaccacctacaatcaggacaacgagacgctcgaagtccatccaccaccaaccactacgtatcaggatgttatactgggcacccgcaagacctatgcgatttatgacctactcgacaccgctatgattaataactcccggaacctgaatattcagctcaagtggaaacgacctcctgagaatggatatatacattatcaacccgcccaggataggctccaaccgcacctgctcgagatgctgatccaactgccggcaaatagtgtgactaaagtgtccatccaatttgagcgggcgctgctgaagtggacagaatacactcccgaccctaatcatggcttctacgtttctcccagcgtgttgtccgctctagtgccctcaatggtggccgccaaaccagtcgattgggaagagagccctctgtttaactccctgtttcccgtgtcagacggatcaaattactttgtaagactgtatacagaacccctcttggttaatttacctactcccgatttcagcatgccctataatgtaatctgcttgacttgcaccgtagtggccgtctgctatggcagcttttacaacctgctaacacggacattccacattgaggagcctcggacaggcggactcgctaaacggctggccaatctgatccgaagggcccggggagtgcccccactttag

SEQ ID NO: 44801 - DNA, 1272 bp, Artificial Sequence
  Description of Artificial Sequence: Synthetic coding sequence
atgtggatcaacctgggccggagcagcgtgatgagcagccagggctcttctgctccactctccacatcctcaactcccccaactcagtcactgcccttgcccccgtcaaacccctgggtttggccgatggccggcctaagtgtgctcctcaaggctgaccgtttgtttcacactagctatcattcccaggctgtccatattcgacctgtatgccgaaatgcacggtgcacgtccatctcttgggaactgcgacaaacactcagcgttgtcttcgatgcttttattacgggccagggtaagaaagactggtctctgttcagaatgtttagccgcactctaacggagccgtgtcctctcgcctcggagagccgtgtttatgttgatatcaccacttacaaccaggacaatgaaacactcgaagtacaccccccacctactacaacctatcaggatgtgatattggggactcgaaaaacctacgctatctatgatctgttagacaccgctatgatcaacaactctcgaaatctaaatattcagctcaagtggaagcgcccacccgagaacgaggcccccccggtgccatttttacacgctcagcggtatgtctctggctatgggctacaaaagggagagctgtctaccttactgtataacacgcatccctaccgcgcgtttcccgttcttcttttagacacggttccgtggtatctccgattgtatgtgcacacactgactatcacctctaaagggaaagagaataaacctagctacattcactatcaaccggcacaggatagactgcagccacatctactggagatgttgattcagctgcccgctaattcagtaaccaaggtgtcaatacaattcgaaagggcgttgctcaaatggaccgaatatacacccgaccccaatcacggattttatgtgtcgcccagcgttctgagcgcactcgtaccctccatggtcgcggcaaaaccagtggactgggaagaaagtccccttttcaacagcctgtttcccgtgagcgatggaagtaattactttgtcaggctttatactgaacctctgctagtgaatctgcctacacccgacttctccatgccgtacaatgttatttgtctgacgtgtactgttgtggctgtatgctacgggtccttttataatctgctgacacgaaccttccacattgaggaaccccggacggggggactggctaagagattagctaacctcatacgacgcgcaaggggggttccgcctctctag

SEQ ID NO: 44802 - DNA, 1569 bp, Artificial Sequence
  Description of Artificial Sequence: Synthetic coding sequence
atggccgccgccatgcccctggccctgctggtgctgctgctgctggggccaggtggatggtgcctggccgagccaccacgcgatagcctgagggaagaattggtcattaccccactgccttctggtgatgtcgcggccactttccagtttagaacacggtgggactctgagctacaacgggagggggtgagtcactatcgcctcttccccaaagccctgggtcagttaattagtaaatactcactgcgcgagctgcatctgtcttttacccaggggttttggcggacccgctactggggacctccctttctccaagcgccctccgacaccgaccattattttctacgttacgccgtgttgccgcgcgaggtcgtctgcacagaaaaccttaccccttggaaaaagttgctgccttgttcatcgaaagctgggctcagcgttttgctaaaggctgaccgcctgttccacacatcctaccactcccaagccgtacacatcagacccgtatgccgcaatgcccgctgtacttccatctcatgggagctgaggcagaccctaagtgtggtgtttgatgcctttataaccggccagggtaagaaggactggtcccttttccgcatgttttccaggacgctcaccgagccatgccccctcgcgagcgagtcaagggtctatgtcgatattaccacctacaatcaggataatgagaccctagaggtgcacccccctccaaccactacttatcaagacgtgatcctcggtaccaggaaaacctatgccatctacgacctgctggacacagcaatgataaataattctcgaaatcttaacatacagttaaagtggaaacgccccccagagaatgaagccccccccgtgccgttcctgcatgctcagagatatgtgtccggttacgggcttcaaaagggagagctctccactttactctataacactcacccctacagggcttttccagtgctgttacttgatacggtgccctggtatctaaggctctatgtgcacactctgacgatcactagtaaagggaaggagaataagcccagttatattcactatcagccagcccaagatcgtcttcagccccatctactggaaatgctgatccaactccctgctaatagtgtcacaaaagtcagcatccaatttgagagagccctgctgaaatggacagaatacacacctgacccgaaccatggcttctacgtcagtcccagcgtcctgagtgcattagtgccctcaatggtggccgcaaagcccgtggactgggaagagagccctctgtttaacagtctgttcccggtgagcgatggttccaattatttcgtgagactgtatacggagcctcttcttgtgaacctgcctacaccagatttctccatgccttataacgtgatatgtcttacatgtacggtcgtggccgtctgttacggctcattttataatctgctgacgaggacattccacatagaagagcctcgaacgggtggcctggcaaaaagactggctaacctcattagacgggcccggggagtcccgcccttgtag

SEQ ID NO: 44803 - DNA, 951 bp, Artificial Sequence
  Description of Artificial Sequence: Synthetic coding sequence
atgttcagccggaccctgaccgagccctgccccctggccagcgagtctagagtttatgtggacattacgacctacaaccaagacaacgaaaccctggaagtacacccaccgccaaccacaacgtatcaggatgttattctaggaactcgcaagacttacgccatctatgacctgctggacacagctatgatcaataactcccggaaccttaacatccagctaaaatggaagcgcccaccagagaacgaagccccacctgtacccttcttgcatgcccagagatatgtgtccggatacggccttcagaagggcgaactgtcaaccctgctttataacactcacccttacagggctttccctgtgctcctgctcgatactgtaccatggtatctccgcctatacgtccatacgctgaccatcacatcaaaaggaaaagagaataagccaagctacatccactatcaacccgcccaggataggcttcagccccatctcctcgagatgctcatccagctcccggctaactcagtcactaaggttagcatccagtttgagcgggcacttcttaaatggaccgagtataccccagatcccaatcatgggttttacgtttctcccagcgtgctgagcgccttggttccttccatggtcgcagccaagccagtcgattgggaggagtcgccactttttaactctctgttccccgtaagcgatggatctaattattttgtccgtctgtacacagagcctttgttggtaaatctcccaacacctgactttagcatgccctacaatgtgatttgtcttacctgtactgttgtggccgtatgctatgggagcttttataatctcctgaccagaactttccacattgaggagcctcggactggcggcctggcaaaaaggctcgccaacctcattaggcgggcccgcggcgtgcctccactgtag

SEQ ID NO: 44804 - DNA, 345 bp, Artificial Sequence
  Description of Artificial Sequence: Synthetic coding sequence
atgctgagcggcgcccggtgccggctggccagcgccctgcggggcactcgggcgccacctagcgcagttgcccggcgctgcctgcacgccagtggaagcaggccccttgctgaccgcggcaagaagactgaagagcctcctcgggatttcgatccagctcttctggagtttctggtgtgcccgctgagtaaaaagcccctacgctacgaggcctcaacaaatgaactcattaacgaggagctagggatcgcttatccgattattgatggaataccgaacatgattccacaggcggcccgaatgactcggcagagtaaaaagcaggaagaggttgagcaaaggtag

SEQ ID NO: 44805 - DNA, 216 bp, Artificial Sequence
  Description of Artificial Sequence: Synthetic coding sequence
atgttcctgagcctgcccaccctgaccgtgctgatccccctggtgtctctggctggcctgttttattccgcctccgtggaggaaaatttcccccagggttgcacttccactgcttcgctgtgcttctattctctgcttctgcccattacaatccctgtgtatgtctttttccatctttggacctggatgggcatcaaactctttaggcacaattag

SEQ ID NO: 44806 - DNA, 4032 bp, Artificial Sequence
  Description of Artificial Sequence: Synthetic coding sequence
atgatcatcaaggagtaccggatccccctgcccatgaccgtggaggaataccgcatcgcccagttgtacatgatccagaagaagagccgcaatgaaacctatggagagggatcaggagtcgagatcctggagaatcgcccatacacggacggccccggaggcagcggtcagtatacgcacaaagtgtaccacgtcggcatgcacatcccctcatggtttaggtcaattctgccaaaagccgcactgcgggtcgttgaggaatcatggaacgcttatccatatactcgtactagatttacttgcccatttgtggaaaaattctctattgatattgaaacattttataagacagatgccggtgagaaccctgacgtattcaacctgtccccagtcgaaaagaatcaactgaccattgactttatcgacattgttaaagatcccgttcctcataatgagtataaaacagaggaggatcctaaactgttccagtcaaccaagacccagcgcggtccactgtcggagaattggatcgaggaatacaagaagcaggtctttccgatcatgtgtgcatacaagttgtgtaaagtagaatttaggtattggggaatgcagtccaagattgagagattcattcacgacactggcctgcgtcgggtgatggtgcgggcgcatcgacaggcatggtgttggcaggacgagtggtacggactgagcatggaaaacatcagagagctcgagaaggaggcccagctaatgctgagccggaagatggcacagttcaacgaagatggtgaggaggccacagaactggtaaaacacgaggcagtgtcagaccagacctctggggaacctcccgaaccatctagctctaacggcgagccgcttgtcggccgtggactcaaaaagcagtggtccaccagcagtaagagtagtcgttcttccaagaggggtgcctccccaagtcgccactctatcagcgaatggcggatgcagagcattgcgagggactcagacgaaagcagcgatgacgagtttttcgatgcccacgaagatctgagtgacacagaagagatgttccctaaggatatcactaagtggagtagcaatgacctgatggacaaaatcgaaagcccggagcccgaggatactcaggacggtctgtatcgccaaggtgcccccgagttccgcgtggctagctcagtggagcagctgaatataatcgaggatgaagtgtcccagccactcgccgcaccaccttccaagattcacgtcctgctcctagtcctgcatggaggtaccatcctcgacacgggagccggagacccctctagcaagaagggtgatgcgaatacgatcgcaaatgttttcgacaccgtgatgcgcgtgcattacccctccgcactgggcagactcgctatcaggctggtaccatgcccccccgtgtgcagtgacgcctttgccctggtgagcaacctctcaccttatagccatgatgaaggatgcctgtcctcttcccaggaccatatccccctcgccgcattgccactgctagccacctcctcgccccagtaccaagaggcagtggctacagtgattcagagagcgaatctggcatatggcgatttcattaaaagtcaggagggcatgacatttaacggacaggtgtgtctgatcggggactgcgtggggggcattctcgcatttgacgctctgtgctacagcaaccagcccgtctctgaaagccagtcctcttccaggcgcggttccgtggtaagtatgcaggacaatgacttgctgtcaccgggcattctgatgaatgccgcacattgttgtggaggaggagggggcggcggagggggcggcggaagttccggaggaggcggcagctccggcgggagctcgctcgaatcatcccgccacctcagccgttcaaacgtagacatccccagatcaaacggaactgaagatcctaaaaggcaattaccgaggaagcgttcagattcaagcacgtacgagctggataccatccagcaacaccaggcattcttgagttcccttcacgcaagtgtgttgaggaccgagccctgctccaggcatagttcaagttccactatgcttgacgggaccggggctttgggcagatttgattttgagatcacggatctctttctgtttggctgtcccttgggcctcgtactggcactgagaaagacagttatccccgccttggacgttttccagttaaggccagcctgccaacaggtttacaacttgtttcatcccgccgaccctagcgcatcccggcttgagcccctactggagaggagatttcacgccctgccccccttcagcgttccccgctaccagcgctaccctttgggcgatgggtgttccaccctgctggtggagactgtccagaggaatccagaactggtattagaaggtggtcccctggcaccactgcctcatggtgacggcttccttgagacatctatgcctgtacccgctcctacatggcaggacgggcctaggcctggttgtgccgagtccgatgtgctgcagacgcataacgctgcatttcaggagcacggggcgccctcctctcccggcacagcccccgccagccgaggctttcggagggcgtccgagattagcattgccagccaagtgagtggcatggccgagagctacactgcatcttccattgcccagatcgctgcaaagtggtggggccagaagcggatcgactacgcactgtactgcccagacgcactcaccgctttcccgactgtggctctccctcatcttttccatgctagctactgggaatcgacggacgtggtcagctttcttcttagacaggtcatgagacatgataacagctccattctggaactcgatggtaaagaggtgtccgtttttacccctagcaaaccccgcgaaaagtggcagcgtaaacggactcatgttaaactccgaaacgtgaccgctaaccatagaatcaacgatgccttagcaaatgaagatgggccgcaagtgctgacaggccgtttcatgtacgggccgcttgacatggtgacgctcactggggagaaggtggacgtccacataatgacacagcctccaagcggggaatggttgtacctggataccctggtgacgaacaattctggcagggtgtcttacacaattcccgagtcacatagactgggcgtgggcgtctaccctatcaagatggtggtgaggggagatcacacttttgcagacagttatatcaccgtgcttcctaaaggtactgagtttgtcgtgttttctatagacggctcctttgcggcctcagtcagtatcatgggaagtgatcctaaagtgcgagccggggcggtggacgtggtgcgccactggcaggatctcggctacctgataatttacgttactggaagacccgatatgcaaaaacagagggtggtggcctggctggctcagcacaatttcccccacggcgtagtgtctttctgcgacggactcgtgcatgacccactccggcacaaggccaactttctcaaactgctgatttctgaactccatttgcgagtgcacgctgcctatggctcgacgaaggacgtcgccgtctacagtgccatcagtttaagcccaatgcaaatttacatcgtgggaagaccgactaagaaattgcagcagcagtgtcagtttatcacagatggatacgccgctcacctggcccaactgaaatatagtcaccgagctcgtcccgcacgcaacactgcaactaggatggctctgaggaagggaagtttcggccttcccgggcagggggactttctacgatcacgaaaccatcttctcagaacaattagcgcccaaccctcaggcccgtcacacaggcacgaacggacacagagccaggcggacggagagcagcggggacagaggtctatgtctgtcgccgccggatgttgggggagagccatgactgggaggctcgagcccggggcagctgctgggccaaaatag

SEQ ID NO: 44807 - DNA, 4050 bp, Artificial Sequence
  Description of Artificial Sequence: Synthetic coding sequence
atgatcatcaaggagtaccggatccccctgcccatgaccgtggaggagtatcgaatcgcccagctgtatatgatccaaaagaaaagcagaaacgagacctacggcgaaggctcaggagtcgagattttagagaacaggccttacaccgatggccccggtggcagcggccagtacacccacaaagtttatcacgtcggtatgcacatccccagctggtttcgcagcattctgcctaaagcggccctcagggttgtggaggaatcctggaatgcttacccatacacccggacaaggttcacctgtccatttgtggagaagtttagcattgacatagaaactttctacaagacagacgcgggcgagaaccccgacgtcttcaatctgtccccagttgaaaagaaccagttgaccattgatttcatcgatatagtgaaggacccagtgccgcataatgaatacaagactgaggaggaccctaaactgttccagtctactaagacccaacgaggcccgcttagtgagaactggatcgaagagtataagaagcaggtttttccaataatgtgtgcttataagctttgcaaggtcgagttcagatattggggcatgcagtccaaaatcgagcgcttcattcatgacactggattaagacgcgtcatggtccgtgcacaccggcaggcctggtgctggcaggatgaatggtatgggttaagtatggaaaacatacgcgagctagaaaaggaggcacagcttatgctgagtaggaaaatggcccagtttaatgaagacggggaggaggccacagagctcgttaaacatgaagcagtaagcgaccagacatccggcgagcctcctgaaccctcatccagcaatggcgagcccttggttggcaggggtttgaaaaagcagtggagcacgagctccaagtcctcccgctcgagtaagcgcggtgcttctccaagtagacacagtatctccgaatggaggatgcagagcattgcccgtgactctgacgagtcatccgatgacgagttctttgatgcccatgaagacctatcggacaccgaagagatgttcccaaaggatatcaccaaatggtcatccaacgacctgatggataagattgagtcacccgaaccagaagacactcaagacggactttaccgtcagggggctccggagttcagggtggcctcaagcgtggaacagttgaatataatcgaggatgaagtgtctcagccgcttgcggctccaccctctaagatacatgttctgttactggtactgcacggcggtaccatactcgacactggtgccggtgacccatcgagtaagaaaggggatgccaataccatagccaatgtgtttgacacagtgatgcgagttcactacccttctgccctcggacggttggccatcaggctcgtgccttgtcctcccgtgtgctcagacgccttcgccctcgtgtctaatttatcgccctacagtcatgacgaaggttgtttgtcaagctcacaagatcacatcccactcgcggcactgcctctgttggcaaccagtagcccccagtaccaggaagctgtcgccacagtgattcaacgagcaaacctcgcatatggggacttcattaagagtcaggaaggtatgacattcaatggacaggtgtgcctcatcggggactgtgtcggtggcattctggcattcgatgccctgtgctacagtaaccagccagtctccgagagccagagcagctcccgccggggatcggtcgtctctatgcaggataatgacctcttgagccccggaattcttatgaatgccgcacattgctgcggcggagggggcggcggtgggggaggcggtgggtcaagcggcggaggaggaagctcgggtggcagctccctggagtcatctaggcatctcagccggagcaatgtagatattccccgatccaacggaacagaggacccgaaacgacaactgccgcggaagcgcagtgatagtagtacctatgagctggataccatacagcaacaccaagctttcctgtctagccttcatgccagcgttctccgcaccgagccgtgctcacgacatagtagctcttcgacaatgctcgacggcacaggagccttaggccgatttgacttcgaaattaccgacttgttcttgttcggatgcccattgggcttagtgttagctctgagaaaaaccgtgattccggccctcgatgtgttccagcttcggccagcctgtcagcaagtttataacctgtttcaccccgcagatccaagcgcctctcgcctggaacccctgttagagcgacgcttccacgccttgccaccgttctccgtgccgagatatcaacgatacccattaggggatgggtgctctactcttctcgcagacgtgctgcaaacacacaacgccgcttttcaggaacatggggcaccgagcagtccagggaccgccccagcatccagaggatttcggagggcgtccgagataagtattgctagtcaggtgagcggcatggcagaatcctataccgccagtagcatagctcagaaagcacccgacgctcttagtcacacgccatccgtccggaggctctctctgctggcgctgcctgctccatcccctaccacgcctggcccacaccctccggcccggaaggcgtccccaggcctggagagagcaccaggtttgccagagcttgatataggcgaagtggccgccaagtggtggggccagaagagaatcgactatgccctttactgccctgatgcattgacagcatttcctacggttgcactgccccacctgtttcacgccagttactgggagagcacggatgtggtgtcattcctcttgcgtcaagtgatgcgccacgataattcctcaattctggagcttgacggcaaggaagtgagcgttttcacaccatcaaagccgcgtgagaaatggcaacggaagcggacgcatgtcaaactccgaaacgtgacagctaatcatcggataaacgacgcgctcgctaacgaggatggtccacaggtgctgaccgggcgttttatgtacggccctcttgacatggtgacattgaccggcgaaaaagttgatgtgcatattatgacgcagcctccctccggtgaatggctctatctggacaccctggttacgaataatagcggacgggttagctataccatccctgagtctcaccgcctgggggtgggggtctatcccatcaaaatggtcgtgaggggagatcacaccttcgcagacagctacatcacagtcctccctaaagggaccgagtttgtcgtgttttccattgacgggagtttcgccgcctctgtgtctattatgggatccgatccgaaggttagggcaggagctgtcgacgtggtcaggcactggcaggatctaggctacctaatcatctatgtcactggcagacccgatatgcagaagcagcgggttgtcgcgtggctcgcccagcacaactttcctcatggagtggtaagcttttgcgatggtctcgttcatgaccccttgaggcataaagcaaactttctcaagctgctgatttctgagttgcacctccgggtacacgccgcgtatggatcgaccaaggatgtggccgtctatagcgctatatctctgagtccgatgcagatctacatcgtgggaaggccgactaagaagcttcagcagcagtgccagttcataaccgacggctacgctgcccacctcgcccaactgaaatactcccaccgcgcacgcccggcacgaaataccgctaccagaatggccctgagaaagggttcctttggactgcccgggcagggggacttcctcagatccaggaaccacttgcttcgtacaatttccgctcagccttcaggcccttctcaccgccatgagcgcacccagtctcaggccgacggagagcagcgaggtcagcgcagcatgtccgtggctgcggggtgctggggcagggccatgactgggcgcctggaacccggcgccgccgcagggcctaaatag

SEQ ID NO: 44808 - DNA, 3213 bp, Artificial Sequence
  Description of Artificial Sequence: Synthetic coding sequence
atgatcatcaaggagtaccggatccccctgcccatgaccgtggaggagtaccgcattgcgcagttgtacatgattcagaaaaagagccggaatgagacatatggcgaagggagcggagtggagattcttgagaacagacctttctggcgcatgcagtctatagctcgcgactctgacgagtcgtcagatgatgagttttttgacgcgcacgaagatctgtccgacacggaagagatgtttccaaaagatatcaccaagtggtcttcaaatgacctgatggacaaaatcgagagtccagaaccagaagacacacaggatgggctgtacagacagggcgccccggagtttcgcgttgccagtagcgtggaacagttgaacattatagaggacgaggtgtcccagccattggccgcccccccatccaagatacatgttctgctcctcgtcttgcacggcggcactatcctcgacactggggctggagatccctcctcaaagaagggagatgccaacacaatcgcaaacgtgtttgacaccgtgatgagggtccactacccctcagcactcggccgtttagcgattaggctggtgccttgcccacctgtttgttctgacgctttcgctctggtgtccaatctgagtccttacagccacgacgagggttgcttatcctcctctcaggatcacatcccactggccgccctgcctcttcttgccacatcctccccgcagtatcaagaagccgtggccacagtgattcaacgggctaatctggcctacggggatttcattaagtcgcaggaaggcatgacattcaacggccaggtgtgcctcatcggtgattgtgtcggcggtattctcgcttttgacgccttatgctactccaaccagcccgtttctgagtcacagtccagctcaaggcgcggctcagtggtgtcaatgcaggacaacgatctcctatctcccgggatcttaatgaacgcggcgcactgctgtggcggcgggggtggaggagggggcggggggggctctagtggcggggggggtagctccggaggctcctccttggaatcctccaggcatctgtcccgctccaatgtcgatatccccaggtccaacgggaccgaagaccctaagagacaactccccagaaagaggagcgatagttctacatacgagctggacactattcagcagcaccaggcctttttgtcatccttgcacgctagtgttctgagaacagagccatgcagccggcactcttcttcttctacgatgctggatgggacaggggctctcggccggttcgatttcgaaatcactgacctttttctgttcggatgccctctaggactggtcctggccctgcgaaagactgttattcctgcattggacgtgtttcagttaaggccagcttgtcagcaggtttacaatctgtttcatcctgccgacccttcagcaagtcgcctggagccattactggaaagacgctttcatgccctcccgccctttagcgtacccagatatcaaagatatccgctcggagatggctgctcaaccctgctggccgatgtgctgcagacccacaatgctgcctttcaagagcatggcgcaccttccagccccggaaccgccccagcctcccgcggctttagacgagcatctgaaatcagcattgcaagccaagtgagcggcatggcagagtcctacacagcctcaagtattgcccagaaagcccccgatgcactgtcccataccccttccgtacgtaggctgtcgttgttggcattacccgcgcccagcccaaccactccaggtccccatccaccggcccgcaaagcctcccctggcctggaaagggctcccggcctgccagaattggatatcggggaggtggccgcgaaatggtggggacagaagcgcatcgactatgccctgtattgccccgatgcgctgactgccttccctactgttgctctcccacacctgttccacgcttcttactgggaatccaccgatgtggtgtccttcctgttgagacaggtcatgcgccatgacaacagctctattttggagctcgatggtaaggaagtgagtgtgtttacccccagtaagccacgagaaaaatggcagagaaaacggacccacgtgaaactgagaaatgtcacggccaatcacagaataaacgacgcactggctaacgaagacgggccgcaagtcctaacaggccgtttcatgtacggacccctcgatatggtcactctgacaggggaaaaggtggatgtccatatcatgacccagcccccctccggcgagtggctgtaccttgacaccctggtgacaaataacagcggccgcgttagttatacgatccctgaatctcaccggctgggagtcggcgtgtaccccattaagatggtggtgcggggagaccataccttcgctgactcttacatcacagttctccctaaggggactgagtttgtcgtttttagcatcgacggctccttcgccgcaagcgttagcatcatgggttcagatcctaaagtgcgagcaggagcagtggatgtcgttcggcattggcaagacctaggctatctcataatctatgtcacaggcaggccggacatgcaaaagcagcgggtcgtcgcctggctggcccaacacaatttcccacacggtgtagtgagcttttgtgacggcctggtccacgacccgctgcggcataaggccaacttcttaaaactgctcatcagcgaactgcacttgagggtgcacgccgcttacggctccactaaagatgttgctgtgtattccgcgatttccctgtccccaatgcagatttatattgttggccggcctacaaaaaagcttcagcaacagtgccagtttattactgacgggtacgcggcccatctcgcccagcttaagtacagccatcgtgcgcgcccagctagaaacactgctacgagaatggcattacggaaaggcagctttggactgccgggacagggcgacttcctgaggagtaggaatcacttactgaggacaatatccgcccagcctagcgggccctcacacaggcacgagagaacacagtctcaagctgatggcgagcagaggggccaacggtcaatgagcgtcgctgccggctgctggggcagggccatgactggtagactggagccaggagccgccgcagggccaaaatag

SEQ ID NO: 44809 - DNA, 48 bp, Artificial Sequence
  Description of Artificial Sequence: Synthetic coding sequence
atgatcatcaaggagtaccggatccccctgcccatgaccgtggagtag

SEQ ID NO: 44810 - DNA, 126 bp, Artificial Sequence
  Description of Artificial Sequence: Synthetic coding sequence
atgatcatcaaggagtaccggatccccctgcccatgaccgtggaggaataccggatagctcaactgtatatgatccagaagaagtcacgcaacgagacatacggagaaggctcaggggtggagtag

SEQ ID NO: 44811 - DNA, 4050 bp, Artificial Sequence
  Description of Artificial Sequence: Synthetic coding sequence
atgatcatcaaggagtaccggatccccctgcccatgaccgtggaggagtatcggatcgcccagctttatatgatccaaaagaagtcccggaacgagacatacggggaaggatcaggtgtggaaatcttggagaacagaccatatactgacggtccaggcggcagtggccaatatacacataaggtctatcacgtgggtatgcacatccccagttggtttcgatccatactccccaaggctgccctgagggtagtggaagaatcatggaacgcttacccttatactcgtaccaggtttacctgtccttttgtcgagaagttcagcatagatattgagaccttctacaagacagatgccggggagaatccagacgtcttcaacctgagtcctgtggaaaaaaatcagttgacaattgattttatcgacatcgtaaaggatccagtgcctcacaatgaatacaagacggaggaagatcccaagttattccagtcaaccaaaactcagcgggggccgcttagtgaaaactggattgaggagtacaagaagcaagtcttccccattatgtgtgcatataagctgtgcaaagtggagttcaggtactggggaatgcaatctaagattgaaaggttcatccacgatactggattacgccgcgtcatggtccgagcccatcgccaggcatggtgttggcaagacgaatggtacggactgtctatggaaaatatccgggagctggagaaagaagcacagctgatgctctcccgaaaaatggctcagtttaacgaagacggagaggaggcaactgagcttgtcaaacacgaggccgtgagcgatcagacctctggcgagcccccagaacccagctcatcaaatggcgagcctttggtgggcaggggacttaaaaagcagtggtctacaagctccaagtcctctcgctcctctaaacggggagcctcgccctcacgtcatagcatctctgaatggagaatgcagagcattgcccgtgactctgacgaatcctcagatgatgagttttttgacgcgcacgaagacctgagtgatacagaggagatgttcccaaaagatatcaccaagtggtcttcaaacgatctgatggataaaattgagtccccggagccagaggatacccaggatggactttaccgccagggagctcctgagttccgtgtagcttcctcagtggagcaactgaatattattgaggacgaagtatcacaacccctggctgctcctcccagtaaaatccacgtgttactgctggtgctacacggcggcactattttagacacaggtgcgggagatccatcaagcaagaaaggagatgctaatacaattgcaaacgtgttcgataccgttatgcgtgtccactatccatcggcccttggacgactcgctatccggctcgtgccgtgtcctcccgtctgctctgatgcctttgccctggtctcaaacctgtccccctacagtcacgatgagggatgtctgagcagttctcaggaccacattccgttggcagccttacccctgctggctaccagcagcccccaataccaggaagctgtcgccactgtgatccagcgcgccaatctcgcatacggggattttatcaagtcccaggagggcatgacctttaatggtcaggtgtgcctcataggcgactgcgtgggaggaatcctcgccttcgacgccctttgctacagtaatcagcccgtgtccgagagccagtcatccagccggcggggcagcgtagtcagcatgcaggacaatgatttactgtcccccggcatccttatgaatgccgcccattgctgtggaggaggaggcggtggtggtgggggaggtggctcaagtggcggtggaggaagttcaggcggctcatcattggaaagttcaagacatctcagcaggagcaacgtggacatccctcggtctaacggaactgaggatcctaaaaggcagttaccccgcaagagaagcgatagcagcacctatgaactggacactatccagcaacaccaggccttcctgtcttctctgcacgccagcgtcctccgtacagagccctgttctcgtcatagcagcagctccactatgttagatggcacaggcgccttgggccgctttgatttcgagattaccgacctgtttctgttcggctgccccttagggttggttctggccttaaggaagaccgtgatcccagctctcgatgtgtttcagcttagaccagcctgtcagcaggtctacaatctttttcaccctgctgacccctccgcttcccgcttagaacctctgctggagcgtcgatttcacgccctaccacctttctctgtgcctcggtaccagcggtaccctctgggcgacgggtgctccaccttgctggctgacgttcttcaaacccacaatgccgcatttcaggaacacggcgcgccatcctctcctggcaccgccccagctagccgcggctttcggcgggcatctgagattagcatagcctcccaggtgtcaggaatggcggaatcgtatactgcttcctccatcgcccaaaaagccccggacgcactgtctcacactccgtctgttagaagattatccctcctggccctgccggcaccttcgccaacaacccctggcccacacccgcccgctcgcaaagccagcccgggactcgagcgcgcaccggggctgcctgaactggacatcggtgaggtcgccgctaagtggtggggtcagaaacgaattgattatgcattgtactgccccgatgctttaacggcctttcccactgtcgcactccctcacctatttcatgcatcatactgggagtccaccgatgttgtctcattcctcctcagacaggtgatgagacacgacaatagttcaatcctcgagttagatggcaaggaagtctctgtctttacaccgtctaagcccagggaaaaatggcaacgcaaacgaacgcacgtgaagttgagaaacgtgaccgcaaaccacaggattaatgatgctctggccaatgaggatgggccccaggtgttaacaggcaggtttatgtatggccctctggacatggtcaccctgactggtgagaaagtggatgttcacatcatgacccagcctccctccggggaatggttgtacctcgacacccttgttactaacaatagcggtcgcgtgtcttatacaatcccagaatctcaccggctcggggtcggtgtatacccgattaagatggtcgtgcggggcgaccatacctttgccgacagctacattaccgtattgcctaaaggaacggaattcgtggttttttcgatagatgggtccttcgcagcttccgtgagtatcatgggttccgatcctaaagtccgagcaggcgcggttgacgtggttaggcactggcaggatctggggtaccttattatatacgttacgggccgcccagatatgcagaaacagcgtgttgtggcctggctcgctcagcacaactttccccacggggtagtgtctttttgtgacggccttgtgcacgatcctcttaggcataaagcgaacttccttaagctcctcatcagcgaactgcatctgcgggtccacgccgcatatggctctaccaaggacgttgcagtgtattccgcaatatccctcagccccatgcaaatctatatcgtagggcggccgactaagaagctgcagcaacagtgccagtttattaccgacggctatgcggcccatctcgcgcagttaaaatattcgcaccgtgcaagaccagcaaggaatacggctactaggatggcgctcaggaaaggctctttcggtcttccaggtcagggggactttctgcgttcaaggaaccacctgctaagaactataagcgcacagccttctggcccatcacaccgtcacgagcgtactcaaagccaggcggatggggagcaacgcggccagcgaagcatgagtgttgcagcgggctgttgggggagagcaatgaccggtcgcttagaaccaggcgccgctgctggccctaaatag

SEQ ID NO: 44812 - DNA, 1251 bp, Artificial Sequence
  Description of Artificial Sequence: Synthetic coding sequence
atgagcagcaactgcaccagcaccaccgccgtggccgtggcccccctgagcgcatctaaaacgaaaacaaagaagaagcattttgtttgccaaaaggtgaaattgttcagggcttccgagccaatcctgtcagtgctgatgtggggtgttaatcacactattaacgagctcagcaatgtgcccgtacccgtgatgctgatgccggatgacttcaaagcttacagcaaaattaaagttgataaccatctatttaacaaggagaacctgcccagcagatttaagtttaaggagtattgccctatggtgttcagaaatcttcgtgaacggttcggaatcgacgaccaggattatcagaactcagtcacacgcagcgctcccataaatagcgatagccagggtcgctgcggaactagatttctgacaacgtacgaccgacgctttgtaataaaaacggttagctccgaagatgttgccgaaatgcataatatcctcaagaagtaccatcagttcattgtggagtgtcatgggaatactcttctgccacagtttctagggatgtataggctgactgtagatggtgtagaaacttatatggtagttacgaggaatgtgtttagccaccgtctgactgtgcatcggaaatatgacctgaaaggcagtacagtggcacgggaggcaagtgataaggagaaggctaaggacctgcccacctttaaggacaatgactttctcaacgagggacagaagttgcacgtaggcgaggaaagcaaaaagaattttctcgagaagctgaaacgcgatgtggaattcctggcccagctcaagattatggattactcacttctggtgggaattcatgacgtggacagggcagagcaggaagagatggaggtggaggaaagagccgaggacgaggaatgtgagaatgatggtgttggtgggaatttgctttgtagttacggcacccctcccgatagcccaggtaatcttttgagctttcctagattctttggacctggtgaatttgacccatcggtggacgtctacgctatgaaatcacatgaatcatcgccgaagaaggaggtgtactttatggctattattgacattctaactccctatgacaccaaaaaaaaggccgcccatgccgctaagaccgttaaacatggtgccggagccgagatcagcaccgtgaatcccgagcaatactccaaacggtttaatgagttcatgtctaacatactgacttag

SEQ ID NO: 44813 - DNA, 834 bp, Artificial Sequence
  Description of Artificial Sequence: Synthetic coding sequence
atgagcagcaactgcaccagcaccaccgccgtggccgtggcccccctgtccgccagcaaaacaaagactaaaaagaaacatttcgtctgccaaaaagtgaaactcttccgggcctccgagccaatactttccgtgctcatgtggggggttaatcacaccatcaacgagctttccaacgtgcccgtccctgtcatgctgatgccagacgactttaaggcatattcgaaaattaaagtggacaaccatctctttaacaaagaaaatcttcctagcagattcaagtttaaagagtattgcccaatggtgttcaggaaccttcgcgaacgcttcgggatagatgaccaggactaccagaactcagtgacccgtagcgctcctattaatagcgactctcagggacggtgcgggacacggtttctgacaacttatgaccgcagatttgtgatcaaaacagtctcctctgaagatgtggccgagatgcataacattctcaagaagtatcatcagtttattgttgagtgtcatggcaacacactgctgccacagttcctggggatgtaccggttaacagttgacggggtggaaacctacatggtggtcacgagaaacgttttctcccacagactgacagtgcacagaaaatacgatctgaaagggtctaccgttgctagggaagcctcagacaaggagaaggccaaggatctcccaacttttaaagataatgattttctgaacgagggccagaagttacacgtcggcgaggagagtaagaaaaactttctggaaaagctcaagcgagatgtagaggagatcttggtgctgtcgccaggctag

SEQ ID NO: 44814 - DNA, 1830 bp, Artificial Sequence
  Description of Artificial Sequence: Synthetic coding sequence
atgtggcggctgcccggcgcccgggccgccctgcgggtgatccggaccgcagtggaaaaactctcccgcgccgaggcgggctcccagaccgctgcaggggccatggaaagggctgtagtgcgatgcgtgccttctgagcccaaattgagtctctcctttgccctggcagatggttctcataaaaacatgcagagggaccagagtgagccacttggtagggtcttgtctaggattgccaccaacgccttaaagggacatgccaaggctgcggctgctaaaaaaagtaggaagagtcgcccaaatgcctctggcggcgctgcatgctctggaccaggtccagagcctgccgtgttctgcgagccagtggtcaagctctattacagggaggaagctgtggccgaggacgttctgaacgtggacgcatggcaggacggggcagtcctccaaattggggacgtgaaatataaagttgagcggaacccccctgcgttcaccgagttgcagctgcccagatatatcatggcaggcttccccgtctgcccgaagctgtcactcgagttcggtgacccggcatcgagcctgtttcgttggtataaagaggctaaacctggggccgccgagcctgaggtgggcgtcccgagctccctgagtccctcttcaccatcttctagctggacggagaccgatgtggaagaaagagtgtatacaccatcgaacgccgatatcggacttcggctgaagctgcattgtacacccggggatggtcaacgttttggccactctcgcgagttggagagtgtgtgtgttgtagaggcaggccctggaacatgcacttttgaccaccgacatctctacacgaaaaaggtgaccgaagacgctcttattcgcaccgtgtcttataatatcctggctgacacttatgcccagacagaattctcgaggacagtgttgtacccatattgcgccccctacgcgttggagctggattatagacaaaaccttatccagaaggagcttacaggatataatgcagatgtcatctgtctgcaggaggtggaccgtgccgtgttttccgattctctggttcctgccctggaagcgtttggcctggagggcgtgttcaggataaagcagcatgaggggctggctaccttctatagaaaaagcaagttttctctgctgtcccaacatgatatttctttttatgaggcgcttgagtctgaccctctccataaagagcttctagaaaaactggttctgtacccgtccgcccaggagaaagtcctgcagagaagttccgtcctgcaagtgtccgtactgcagtctacgaaagattccagcaaaaggatctgtgtcgctaacactcatttatactggcaccccaaaggcgggtacatccgactgatccaaatggccgtcgcgttggcacatatccgccatgtatcctgtgatttatacccgggcattccggtgatattctgtggagatttcaattcgacacctagtaccgggatgtatcacttcgtcatcaacggctctatccccgaggatcacgaggattgggctagcaacggggaggaagagagatgcaacatgtcgctcacgcacttctttaagctcaagtccgcttgtggcgagccagcgtatacaaattacgtgggcggctttcacggatgcctggactacatcttcatcgacctgaacgccctcgaggtggagcaggttattccactgccctcccacgaggaggtcaccactcaccaggccctaccctctgtctcccatccatccgatcatatcgccctggtgtgtgatctgaagtggaagtag

SEQ ID NO: 44815 - DNA, 1419 bp, Artificial Sequence
  Description of Artificial Sequence: Synthetic coding sequence
atgtggcggctgcccggcgcccgggccgccctgcgggtgatccggaccgccgtggagaaactcagtagggcagaggcaggaagccagacggccgccggggctatggagcgggccgtcgtccgctgtgttccttcagagccaaagttgtccctctcatttgccctggccgacgggagtcacaaaaatatgcagcgggatcaaagcgagcccctcggtagggtcttgtccagaatcgccacaaatgccctaaagggacatgcaaaggccgccgcagctaagaagagcaggaagagtaggcctaacgcttccggcggcgcggcgtgcagcgggcccggtcccgagccggccgtattttgcgaacccgtcgtgaagctttactaccgggaggaggcggtcgcagaagacgtcctcaacgtggacgcttggcaggacggagcagttctgcagatcggcgatgtcaagtacaaagtggagagaaacccccctgctttcaccgaactgcagctgcctcgctacatcatggcaggctttccagtatgcccaaaactgtcattagaatttggagatccagcctcctctctatttcgctggtataaggaagctaagccgggcgcagccgagcccgaagtgggagtaccgagttccctgtctccatcttctcccagtagttcgtggacggagaccgacgtagaggaaagagtgtacacgccttccaacgctgatatcggactccggttgaaacttcactgcacacctggagacggccagcggttcggccacagtagagagctcgaatccgtgtgcgtggtcgaagcaggaccgggaacatgtacattcgaccaccggcacttgtataccaaaaaggtaaccgaagatgcactgatccgaactgtgtcctacaacattctggcggatacgtacgcccaaactgaattttccagaacagtgttgtatccgtattgcgccccctatgcattagagctggattatcgtcaaaatctgatccagaaagagttgacaggatacaatgccgacgtgatctgtctgcaagaagtggaccgagccgtgtttagcgattcattggtgcctgccctagaggcatttgggcttgagggagtttttcgaatcaagcagcacgaggggctggcgacgttttacagaaaaagcaagttctctcttctgtctcagcacgacatatctttttatgaggctctggagtcagatccgttacacaaggaactgctggagaagctcgtgttgtacccaagcgcacaggaaaaagtcctgcagagatctagtgtgctgcaggtgagtgtgctacagtcaacaaaggactcctccaaacgaatttgcgtggccaatactcatctgtactggcatcccaagggcaggttttatttggtgtctcaggtgacctag

SEQ ID NO: 44816 - DNA, 2826 bp, Artificial Sequence
  Description of Artificial Sequence: Synthetic coding sequence
atgggccaggcctgcggccacagcatcctgtgccggagccagcagtatcccgccgccagacccgcagaaccaaggggccaacaggtcttcctcaagcccgacgagccgccacctccgcctcagccatgcgctgatagtctgcaggacgcgctgctgtccctgggttccgtcattgacatctccggcctgcagagagccgttaaagaagcactttctgccgtactccccagagtggagaccgtgtatacctacctattggatggggagagtcagttggtgtgtgaagatcctccacatgagcttccccaggagggcaaggttagggaggctatcatcagtcaaaagcgccttgggtgtaacggactgggcttctctgacctgcctggaaaacccttggcccgactggtcgcaccgctggctccagatactcaggtgctagtgatgcccttagccgacaaggaggcgggtgccgtcgccgcagttatcctggtgcattgtggccagctgagcgacaacgaagaatggtcactccaggcagtagagaaacataccctggtggcccttcgcagagtgcaagtgttgcagcagagagggcccagagaggctcctcgggccgttcaaaacccgcctgagggaacagctgaagaccagaagggaggcgccgcctacacagaccgcgaccggaaaatcctacagctgtgcggggaactgtacgatctggacgcctcttcactccaactaaaggtgctgcagtacctgcagcaggagactagagcatcccgctgttgtttattgttagtctccgaggacaacttgcagctttcctgtaaagtgatcggcgacaaggtgctgggtgaggaagtatcctttccgctcactggatgccttggacaggtagtcgaggacaagaaatcaatacagctgaaggacctcactagtgaggacgtgcagcagcttcagtccatgcttggatgtgagctgcaggccatgttgtgtgttcccgttatctccagagcaactgatcaggtagtggccttagcttgcgccttcaacaagctcgaaggcgacctgtttacggacgaggatgaacacgtgattcagcattgttttcactacacgtccacagtcctgacctcaactctggctttccagaaggaacagaagctgaaatgcgagtgtcaggccctgttgcaggtggctaagaatctgttcactcacctagatgacgtcagtgtcctgttacaagaaatcattacagaggcgagaaacttgtcaaatgcagagatatgctccgtgttcctgctggaccagaatgagctggtggcgaaggtgttcgatgggggagttgtggacgatgagtcctacgagatacgcattcctgctgatcagggcatcgctggccacgtggctacaacgggacagatcctgaatattccagacgcgtatgcacacccactgttctacaggggcgttgacgattccacaggattccgaactcgaaacatcttgtgtttcccaatcaagaatgagaaccaggaggtcatcggggttgccgaactggtcaataagataaatggaccctggttctccaagttcgatgaagacttagctacggcatttagtatctactgcggaatttctatcgcacatagcctgctgtataaaaaagtgaatgaggcccaataccggtcccacctcgccaacgagatgatgatgtatcatatgaaagtgtccgatgatgaatacacgaagctcttgcatgacggcattcagcccgttgccgccattgattccaatttcgcttcattcacatatactcctcggtcactgccggaggatgatacttccatggccatcctgagcatgctgcaagatatgaactttatcaataactacaagatagattgccccaccctggcccgattctgccttatggtcaagaaggggtacagggacccgccttaccacaattggatgcacgccttcagcgtgtcacatttttgctacctactgtataaaaatctggagctcacaaattatctggaggacatcgagatcttcgcccttttcatatcttgtatgtgtcatgatttggaccaccgcggcactaataattcctttcaagtagcttccaaaagtgtgctggcagcactatattcttctgaaggatccgtaatggaacgccatcattttgcgcaagcaattgctatcctgaacacacatggatgcaatatattcgatcacttctcccggaaggattatcagcggatgcttgatctcatgcgggatatcatcctggcgacagatctcgcccatcacttaaggatttttaaagaccttcaaaaaatggctgaagtaggatatgaccggaacaacaagcaacaccacagattattgctctgtctgctgatgacctcttgtgatctgagtgatcaaactaagggatggaaaacaacccgtaagatcgcagaactcatctataaggagtttttctcgcagggggatttggaaaaggccatggggaaccgccctatggaaatgatggatcgggagaaagcatatatacccgagttgcagatcagctttatggaacatatcgcaatgcctatttacaaattgttgcaggacctgtttcctaaagctgcggagctttatgagagagtggcatccaatagggaacactggaccaaagtgagccacaaatttaccatacgcggattgccttctaataacagcttggacttcctggatgaggaatatgaggtgcccgacctcgacggtacaagagctccaatcaacgggtgctgtagtttagatgccgagtag

SEQ ID NO: 44817 - DNA, 2058 bp, Artificial Sequence
  Description of Artificial Sequence: Synthetic coding sequence
atggtgctggtgctgcaccacatcctgatcgccgtggtgcagttcctgagaaggggacagcaggtgttcctgaagcctgatgaaccccctcctccgccccaaccctgcgctgatagtttgcaagatgccctccttagcctggggtccgtgattgacatttcagggctccagagggctgtgaaagaagcactatcagcagttctacctcgcgttgaaaccgtctacacatacctcctggatggagagtcgcaattggtctgtgaggatccaccccatgaactgccacaagaggggaaagtccgatttaccgatgaggatgaacacgtcattcaacactgttttcattacacctccaccgtgctcacttccacacttgcatttcagaaggaacagaaactgaagtgcgagtgccaggccctgttgcaggtcgccaagaatctgttcactcacctcgacgacgttagcgtgcttctgcaggaaattataacggaagcaaggaatctctcaaatgccgaaatctgctctgttttcttgttagaccagaatgaacttgtggccaaagtgtttgacggcggtgtggtggacgacgagtcctacgagatccgtattccagcagaccaaggaatcgccgggcacgttgctacgactggccagattcttaacattcctgacgcatacgcccacccactgttctacagaggggtcgatgacagcacaggctttcgcacccgcaatattctgtgttttcctatcaagaacgaaaaccaggaagtcatcggagtcgcagaacttgtcaacaaaataaatggcccgtggttcagcaagttcgatgaggatctagctacagctttttcgatttactgcgggatctccatcgctcactctcttttgtacaagaaggtgaacgaagctcaataccggagccacctggccaacgaaatgatgatgtatcatatgaaggtctctgatgatgagtacaccaagcttctgcacgacggtatccagcctgtggctgcgatagactccaatttcgcctcttttacctacacaccacggagtcttcctgaagatgacacatccatggctatcctctccatgctgcaagatatgaacttcattaacaactacaagattgactgccctaccctcgcaaggttttgcctgatggtaaagaaggggtaccgagatcccccttatcataactggatgcacgcgttcagcgtgtctcatttttgctatctcctctacaaaaaccttgagctcaccaattatctggaggacatcgagatcttcgcactcttcatcagttgtatgtgtcacgatcttgatcacagaggaaccaacaactcctttcaggtcgcaagtaagtccgtcctggctgcactctattcgtccgagggcagtgtgatggagaggcaccatttcgctcaggcaattgctatactgaatacacacggctgcaacattttcgatcattttagccgcaaggattatcagaggatgctggacttaatgagggacataattctggccactgacctagcacaccacctccgcattttcaaagatcttcagaaaatggcagaggtgggatatgaccgcaataataagcagcaccataggctcctgctgtgtttgctgatgacctcctgcgatctgtcagaccagaccaaaggatggaaaaccactcgaaaaattgccgagcttatctacaaagagtttttctcgcagggagatttggagaaggcgatgggaaatcgacctatggaaatgatggaccgagaaaaggcgtatatccccgaacttcaaatctccttcatggaacacatagctatgcccatttacaaacttctgcaggacctgtttcctaaggccgccgagctgtacgagagggtggcaagcaatcgcgagcactggactaaggtgtctcataaattcaccattcgaggactaccctcaaacaacagcctggactttttagacgaggaatacgaagtccccgatctggatgggactagagctccaattaatgggtgctgttcgcttgatgcggagtag

SEQ ID NO: 44818 - DNA, 2853 bp, Artificial Sequence
  Description of Artificial Sequence: Synthetic coding sequence
atgagctacatcctgaagatgcccggcacctgcctgcccggcgaggggaccacgtacgagctacctccctcaagtctacacccctcttcggctccagttaccagcggcggtacctgccccgctttgctgacggaggctgggtgggaggcacctataatggctttcacagaggcggcgtcggctgtggggccaagctggactcacagccgcgcatctgtttcttccactgtcaagacagaacgccggagaagagtgcttcaggcatgcggcatggtgaggcgggggcagcaggtgtttctgaaaccagatgagccccctccccctccccagccatgcgcagatagcttacaggacgcattgctgtccttgggctccgtgattgacatcagtgggctgcagagggccgtcaaggaagctttaagcgccgtgctgccaagggtagagaccgtttatacctaccttttagacggtgagagccagctagtgtgtgaagatccaccccacgaactgcctcaggagggaaaggtccgggaagccattatctcgcagaagagactgggatgtaatggactggggtttagcgaccttcccggaaagcctctggcgagactcgtcgccccactagcaccggacacccaggttctagtgatgccgctggctgacaaagaggcaggagcagtggccgcggtgattctcgtgcactgcggtcagttatctgataatgaggaatggtctcttcaggcagttgaaaaacacacccttgttgcccttcgccgggtccaggttcttcaacagagagggcctagagaggcgcccagggcagtacagaacccccccgaaggaactgccgaggatcaaaagggaggggcagcctatactgatcgagaccgcaagatcctacaactgtgcggcgaactgtatgatctcgacgcatcctcactgcaactcaaggtcctgcagtacctgcagcaggagacccgagcctcgcggtgttgcttacttttggtgagcgaagacaacctccagcttagctgtaaggttatcggagacaaggtgctcggggaggaggttagcttccccctgacaggttgtctgggccaggtcgtggaggataagaagagcattcagctgaaggacttaaccagcgaagacgttcagcagttacagtcgatgctcgggtgtgagctgcaggcaatgctgtgcgtcccagtaatatcccgggccacagatcaggtggtagctttggcctgtgcatttaacaaattggagggggatctgtttacagacgaggatgagcacgtgatccagcactgcttccactacacttcaactgtgctgacatctactttagcgttccagaaggaacaaaaactgaagtgtgagtgccaagctctgttacaggtggcaaaaaacctcttcacccatctcgatgatgtgtctgtgctgctccaagagatcataacagaggctagaaacttgtccaatgccgagatctgctccgtgttcctgctcgatcagaacgagctggtggcaaaggtgtttgatgggggggtagtggacgatgagagttacgaaatcaggatcccagccgatcagggcatcgccggccatgtagcgactacgggccagatcctgaacatacccgatgcctatgcccatccgctgttctatcggggtgtggatgattcgacgggctttcgtactcgcaacatactgtgcttcccaatcaaaaacgaaaatcaggaagtgatcggagtggcggaactagtcaacaagatcaacgggccttggttttccaagttcgacgaggatctcgccaccgcatttagcatatactgcggtatctcaatagctcactctctcctgtataaaaaagtcaacgaggcacaatatcgttcccatctggccaatgagatgatgatgtaccatatgaaggttagtgatgacgagtatactaaattgctacatgatgggatccaaccagtggccgccattgactccaatttcgcgtcattcacctatacaccccgcagcctgcccgaggatgatacaagtatggcaatcctctcgatgctgcaggacatgaattttattaataactacaagatcgattgtcctaccctggctaggttctgcctcatggttaagaaagggtaccgcgaccctccctaccataactggatgcacgccttctccgttagtcatttctgctacctgctatacaagaatctggaactgacaaactacctggaggacatcgagatcttcgccctttttatctcgtgtatgtgtcacgacctggatcaccgtggcactaataattcgttccaagtcgcttctaagtcggtcctggccgctctctactcatccgaaggtagtgttatggagcgtcatcattttgcgcaagctattgccatcttgaatacccacggatgcaatatttttgatcacttcagccgtaaagactaccaaagaatgttagacctgatgagggatataatcctcgcaacagacctggcccatcacttaaggattttcaaagacttgcagaaaatggccgaggtgggctacgataggaataacaaacagcaccacaggcttctactgtgtctcctcatgacaagttgtgacctgtccgatcagaccaagggatggaagaccacaaggaagattgccgaactcatctataaagaatttttttctcagggggatttagagaaggctatgggcaaccgtccaatggagatgatggacagggagaaagcttatattccagagctgcagatttcttttatggaacatatcgccatgccgatctacaagctgctccaggacctctttcctaaggcctag

SEQ ID NO: 44819 - DNA, 2799 bp, Artificial Sequence
  Description of Artificial Sequence: Synthetic coding sequence
atgaagaagcagcggatccaggagggcaagagcctggcccaccggcggggacagcaagtgttcttgaaaccagatgagcccccgcccccaccccagccctgtgccgactccctgcaggatgccttgttgtccctggggtccgtcattgacatctccggcctccaacgcgctgtgaaagaggccctttcagcagtgctgcctcgagtcgagaccgtctacacatatctattagacggggagagccagttagtgtgtgaggaccctccccatgagcttcctcaggaaggcaaggtgcgtgaggccatcattagtcaaaagcgacttggctgtaacgggctgggtttttcggacctcccgggcaaaccattggctcgactggtagccccgctcgcccccgacacgcaagtgctggtcatgcctctggccgataaggaggccggggccgtcgcagccgttatactggtccactgtggtcagttgagtgacaatgaggagtggtccctgcaggctgtggagaagcacacccttgtggcgctgagaagagttcaagtgctccagcagcggggtcccagagaagccccacgggccgtgcagaatccccctgaggggactgctgaagatcagaaaggcggcgcagcatatacagacagggatcgaaaaattctgcaactgtgtggggagctctatgatctcgacgcatccagtctgcagttgaaggttctgcagtacctccagcaagagactcgcgcctcccgttgctgcttattgctggtttctgaggacaacctacagctctcttgcaaggtaattggtgataaagtgctaggggaggaggtgagttttccactgacagggtgtctgggacaggtggtggaggataagaaaagtatccagctcaaggatctgacctccgaggacgtgcagcagctgcagagtatgctaggttgcgagctgcaggctatgctttgcgtcccagtgatatcacgagcaaccgatcaagtggtggctctcgcctgtgcctttaacaagctggagggcgatctctttacagatgaggatgaacatgtgatccagcactgcttccactacacctcaacagtgctcaccagcacacttgcattccagaaggaacagaagctcaagtgtgaatgccaggcactgctgcaggtcgcaaaaaacctgttcacccatctcgacgacgtgtccgttttacttcaagagattattacagaggcacgcaacctaagcaatgcggaaatttgcagcgtcttcttgctcgaccaaaacgaactcgtggccaaggtcttcgacggcggcgtcgtcgatgatgaatcttatgagatcaggatcccagcagatcagggcatcgccgggcacgttgccacaacaggccagatcctcaacatacccgatgcatatgcccaccctctgttctaccgaggtgttgatgactcaactgggttcaggacacgcaatatattgtgttttcctatcaaaaatgagaaccaagaagttatcggggttgctgagttagtgaataagattaacggtccatggttctccaaatttgacgaagatctcgcgaccgcgttcagtatttattgcggcattagtatcgctcattcgttactctataagaaagtgaatgaagcccaatatagatcccacctggcaaacgagatgatgatgtatcacatgaaggtctccgacgatgagtacaccaaactgctgcacgacggaattcaacctgtggccgccatcgatagcaatttcgcttcgtttacgtacacaccgagatcccttccagaggatgatacctcaatggccattctgtctatgttgcaggatatgaacttcatcaataactacaagattgattgccctaccctggcacggttttgcttgatggttaaaaaaggatatcgagatccgccgtaccacaattggatgcatgctttcagcgtttcccacttttgctacctgctgtataagaatctcgagcttacaaactatctggaagacatcgagatatttgctttgtttatctcctgtatgtgccatgacctggatcaccgcggcactaacaactcatttcaggtcgcctcaaaatctgttttggcggccctgtattctagcgaggggtcggtaatggagagacatcattttgctcaggcaattgcaatcctgaatactcacgggtgtaacatctttgatcacttctcacgcaaggattatcagcgcatgttggatctgatgagggacatcattttggcaacagatctcgctcaccatttgagaattttcaaagacctgcaaaaaatggccgaggtgggatatgaccgaaacaacaaacagcaccaccgtcttcttttgtgcttattgatgacttcatgtgatttaagcgatcagaccaaagggtggaaaacgactaggaagatcgccgagctcatttacaaggaatttttcagtcagggagacctggaaaaggcgatgggtaacagacccatggagatgatggacagggaaaaagcttacatacccgagctgcagatttctttcatggaacatatcgctatgccgatctacaaactcctccaagacctctttcccaaggctgcagagctctacgagcgggtggctagtaaccgggaacattggactaaagtatcccacaagtttaccattcggggcctcccatcaaacaattctcttgattttctggacgaggaatatgaggttccagacctggatggaacacgcgcacccattaacggatgttgttcgctagacgcagagtag

SEQ ID NO: 44820 - DNA, 2805 bp, Artificial Sequence
  Description of Artificial Sequence: Synthetic coding sequence
atggtgctggtgctgcaccacatcctgatcgccgtggtgcagttcctgagacgcggccagcaggtattcctgaaaccagacgagccaccacctcctcctcaaccatgcgccgacagtctccaagatgcactgttgtcactggggagcgttattgatatctccggactacagcgggctgttaaggaggccctgagcgcagtgttgcccagagtcgagaccgtgtatacatacctactggatggagaaagccagctggtgtgcgaggatccccctcatgaactgccccaggaaggaaaagttagagaggccataatctcccaaaaacgtctaggatgtaacggcctgggttttagtgatctgcccggcaagcctctcgcaaggctcgtcgcgccgctcgctccagacactcaggttcttgttatgccgctggccgacaaggaagcaggagcagttgcagctgtaatacttgtccattgtggacagctgagcgacaatgaagaatggtccctgcaggccgtggaaaagcacaccctggtagcactgcggcgagtgcaagttctccagcagagagggccaagagaggctccacgggccgtgcagaatccgcccgagggcaccgccgaggatcagaaaggcggagccgcatatacagatcgggacaggaaaatacttcaattatgtggtgaattatatgacttggatgcctcgagcctacagcttaaagtgctgcagtatctgcagcaggagacaagggcctcacggtgctgtctcctgttggtgtccgaggataacctgcaactgtcctgcaaggtcatcggcgataaggtgcttggtgaggaagtttccttcccattgacaggttgtcttgggcaggtggtggaagacaagaagtccatacagctcaaggatttaacctctgaagacgtgcagcaactgcaatcaatgctgggctgtgagctgcaggccatgctttgtgttcccgttatatcccgcgccacagaccaggtggtagctttagcctgcgcctttaacaagcttgaaggtgaccttttcacggacgaagacgagcacgttattcagcattgctttcactacacatctaccgtgttaacctctaccttggcatttcagaaagagcaaaagttgaagtgtgagtgccaagctttgcttcaggtggccaagaacttattcacccacttggatgacgtctcagtgctactccaggagatcatcaccgaggccagaaatctcagcaacgccgaaatatgttctgtttttttgttggatcagaatgaattggtggcgaaggtcttcgatgggggggttgtcgacgacgaatcgtatgaaatccggatccctgccgatcaagggatagctggccatgtggcgacgacgggccagattcttaatattcctgacgcatatgctcacccgttgttctataggggggtggatgacagcaccggattccgtactaggaatattctgtgcttcccgattaagaatgagaatcaggaggtgatcggcgttgccgaactggtgaataaaatcaatggaccctggtttagtaagttcgacgaagacctggctacggcctttagtatctactgcggcataagcatcgctcattcgctgctatacaagaaggtgaacgaggcccagtaccggagccacctggccaatgagatgatgatgtaccacatgaaagtgtccgatgacgaatacactaaactccttcacgacgggatccagcccgtggccgctatcgatagtaactttgcctctttcacttatactccaagatccctgcctgaagatgatacatccatggccatactgtcaatgctgcaggatatgaattttataaataactacaaaatagattgtcctactttagcccggttttgtctaatggtaaagaagggctaccgggatcccccttatcacaattggatgcatgccttcagcgtgagtcatttttgctatctactgtataagaatttggagctgacaaattacctcgaagatatcgaaatcttcgctctctttatttcttgcatgtgccacgatctggaccaccgaggaactaacaattcctttcaggtcgcatccaagtcagtgttggcagctctgtatagctctgagggtagtgtgatggagcgtcaccacttcgcccaggctatagccatactcaacacccacgggtgcaatatctttgaccactttagcaggaaagactatcaacggatgctggacctgatgcgggatatcattcttgctactgacttggctcaccatttacgtatttttaaggatctgcagaagatggcggaagtcggatacgatagaaataacaaacagcaccaccggttgcttctctgcctgctcatgaccagctgtgacctgagcgatcagacaaaaggctggaagaccacaaggaagatcgctgaactcatctataaggagttcttctctcagggagacctggagaaggcgatgggaaacaggcccatggagatgatggacagggagaaggcttacatacctgaactccagattagttttatggaacatatcgccatgcccatttacaaacttctccaggatctcttccccaaagcagcggagctatacgaaagggtggcaagcaacagagaacattggaccaaggtcagccataagtttacaattcggggtctgccatccaacaatagcctggattttctggacgaagagtatgaagtgcctgatctagacggtaccagggcccccataaatgggtgttgcagtctggacgcagaatag

SEQ ID NO: 44821 - DNA, 3426 bp, Artificial Sequence
  Description of Artificial Sequence: Synthetic coding sequence
atggccgtgcccggcgacgccgcccgggtgcgggacaagcccgtgcacagcggggtgtctcaggccccaacggctggccgcgactgtcatcaccgcgccgaccccgcgtccccaagagatagtgggtgcagaggctgttggggggatctggtactgcaacccctgagatcctctaggaagttgtctagcgccctgtgcgcaggcagcctctcgttcttattggctctcctggtgcgcctcgtcaggggggaagtgggctgtgacctcgagcaatgtaaagaggcagccgctgcagaagaagaagaggcagcacccggggccgagggtggagtgtttccggggccccgagggggggcccccggtggcggcgcacggttaagtccttggctccagccctcagctttgttgtttagcctcctgtgtgctttcttttggatggggctctatctgcttcgggcaggagtccgattacccctggcagtcgcactgttggcagcttgttgtggcggagaggcacttgtccaaatcgggcttggtgtcggcgaggatcatctgctgtccttgcccgctgcaggagtggtgttgagctgtctggcagctgcaacctggctggtcctgagattgcgcctgggagtcctgatgattgcactcaccagcgccgtccgcaccgtgtctctcatatcgctagagaggtttaaggttgcctggagaccatacttagcatacctggccggggtgctgggtattcttctcgcccggtacgtagaacagatcctgccccagagcgcggaagctgccccccgggagcatctcggctcacagctcatcgccgggacaaaggaagacatccccgtctttaagcgaaggcggcggtctagttctgttgtgtctgctgagatgtccggatgcagtagcaagtcacacaggaggacatcactcccatgtattcccagggaacagctgatgggacactctgaatgggaccacaaaaggggcccccgcggctcacagagctcaggcacttctatcaccgttgacatcgcagtaatgggagaggctcatggccttattacagacttactcgcagatccctcactgccacctaacgtgtgtaccagcctgagggcagtctctaatctgttgtccacacagctaactttccaggctattcacaaacccagggtcaatccggttaccagcctcagtgaaaattacacttgctctgacagcgaagagagtagtgagaaagacaagctcgctatcccaaaacgtctccgcagatccctaccaccgggactactgcgcagggtgtcgagtacatggactacgactacatctgccaccggactgccaaccctggaaccagcccctgtgcgccgggatcgttccacctccattaagttgcaggaggcccctagctcgagccctgatagctggaacaatccagtgatgatgacgttaaccaagagccggtcatttacatctagctatgccatttccgccgccaaccacgtcaaggccaagaagcaaagccgccctggggccctggctaagatctcgcccctatccagtccgtgttcttctccactgcaggggacccctgcgtcctccctggtcagtaagattagcgcggtgcagtttcccgaaagtgccgatactactgctaagcagagcctcgggagccaccgcgctctcacatatactcaaagcgcacctgacctctctccacaaatcctgaccccacccgtcatttgttcctcttgcggccggccatactcacaaggcaaccctgcagatgagccgctggaaagatccggggtggccacaagaactccctcccggaccgatgacactgctcaggtgactagcgactacgagaccaacaacaactcagatagtagtgacatcgtgcagaacgaagacgagacagagtgccttcgcgagcctctcaggaaagcatctgcatgtagtacatacgcgccagagacgatgatgttcttggataaacctatcctggccccagagcctctggttatggacaatcttgattcaattatggagcagctcaatacatggaattttcccatctttgatctggtcgaaaacatcggaagaaaatgcggacgaattctgtcacaggtttcctatcgactttttgaagacatgggtttgttcgaggctttcaaaattcccattcgcgaattcatgaactacttccatgcactggaaataggatatagagatattccttaccacaatcgcatacacgctaccgatgttttgcatgcagtttggtacctaactacacaacccatacctggcttgtctacggttattaatgatcatggaagcacttctgatagtgactccgattccgggtttactcatggacacatgggctacgtgttctcaaagacctacaacgtgaccgatgataagtacggctgcctgagcggcaatattccagcccttgaattgatggctctgtatgtagcagcagcgatgcacgactatgatcacccagggagaactaacgcctttctcgtggccaccagtgcaccccaggcggtgctgtacaatgacagaagtgtcctggagaaccatcacgccgccgcagcgtggaatcttttcatgagccgtccagagtataacttcctcataaatttggaccatgtggaatttaagcacttccggtttcttgttattgaggcaatcctggctacagatctgaaaaaacatttcgatttcgtggccaagttcaatggcaaggtgaacgatgacgttggaatcgactggactaacgagaatgaccgcttgcttgtgtgccagatgtgcattaaactggctgatattaacgggccggctaaatgtaaagagctgcacctccagtggacggacggcatcgtcaacgaattttacgaacaaggagacgaagaggccagtctgggactgcctatctcaccgtttatggaccgatctgcacctcagctagccaacctgcaagagtctttcatctcacacatcgtcggaccgttgtgtaactcctatgactcagctggcctcatgcccgggaagtgggtggaggactctgatgaatccggagacactgacgacccagaagaggaagaagaagaagcacctgctcctaatgaagaggagacttgcgaaaacaacgagtcccccaagaaaaaaaccttcaagaggcggaagatctactgccagataacacagcaccttttgcagaaccataagatgtggaagaaagttatagaagaagagcagagactggcaggaatcgagaatcaatcactggaccagaccccccagtcgcacagcagcgagcagattcaggccattaaggaggaggaggaggaaaaaggtaaaccaaggggtgaggagatacctacgcaaaaacctgatcagtag

SEQ ID NO: 44822 - DNA, 2670 bp, Artificial Sequence
  Description of Artificial Sequence: Synthetic coding sequence
atggccgagcggggccggctgggcctgcccggcgcccccggcgcccttaatacccccgtgccaatgaatctgtttgcaacgtgggaagtggacggctcctcaccaagttgcgtgccccgcctgtgtagccttactttgaaaaagcttgtggtattcaaggagctcgaaaaggaattgattagtgtggtaatcgctgtgaagatgcagggttctaagaggatattacggtcccatgaaattgtgctgcccccctcaggccaggtggagacggaccttgcactcacattctcactgcagtatccccactttcttaaaagagagggaaacaagctgcagataatgcttcagaggaggaaaaggtataaaaataggacaattcttggctataaaaccttggcagccggatcaataagtatggcagaagtgatgcaacaccctagcgaaggtggccaagttcttagtctgtgcagcagcattaaagaggcacccgttaaagctgccgaaatctggattgctagtctctctagtcagcctatcgatcatgaggactctacaatgcaagccggaccaaaggcgaagtccaccgataattattcggaagaagagtacgaaagcttctcctcagagcaggaggcctctgatgacgcagtacagggccaggatctggatgaggatgattttgatgtaggaaagcctaagaagcaacgtagatccatcgtgcgcacgacgtccatgacacggcagcagaacttcaagcaaaaggtggtggcactgctgcggcgattcaaggttagtgacgaagtgctcgactccgaacaggacccagcagagcatatcccagaagccgaagaggatctggaccttctttacgatacgctggatatggaacatcctagcgatagcgggccagacatggaagacgatgatagtgtgctgagtacgcctaaacctaagctgcggccctacttcgaaggtctgagtcattcctcatctcaaaccgagattggcagcatccatagcgcccgctcccataaagagcccccaagcccagcagatgtcccggagaagactcgctccctcgggggcaggcagccatctgatagcgtctctgacactgttgccctcggagtgcccgggcctagagagcacccagggcaacccgaggactcgcctgaagccgaggcgtctacacttgatgtatttaccgagagactcccaccaagcggccgcatcacaaaaactgagtctctggttattcctagcactcgctctgaaggaaaacaggcggggcggaggggccggtccacctcccttaaggagaggcaggccgccagaccccagaacgaaagggcaaacagcctggataacgagcgatgtcctgatgcacggagccagctacagattcctcgcaagaccgtctacgaccaactgaatcatattctgatcagcgacgaccagctgcccgagaacatcatcctggtcaacacaagcgactggcagggtcagttcctgtccgacgtgcttcaacggcacaccctgcccgtggtctgtacttgttcacctgccgacgtccaggccgcgttctctactatcgtgagcaggatccagcggtactgtaactgcaactcccagcctcctactcctgtgaagattgctgtggctggtgcccagcactacctttctgctatactgagattatttgtggagcaattgagccataagactccggactggctgggttatatgcggttcctggtgattcccctgggtagccatcccgtcgctaggtacctgggtagtgtggattatcgatacaataacttctttcaggacctggcatggcgggatctctttaataaactggaagcccaatctgctgtccaagatacaccagacatagtgagtagaataacacaatacatcgccggcgcaaattgtgcccaccaacttcctatcgcagaagcgatgctgacctacaaacagaagagccccgacgaagagagctcacagaagttcatccccttcgtgggggtagtgaaggtaggcatcgttgagccttcatctgccactagcggagactccgatgatgcggcaccatccgggtctgggactttatccagcactcctccatctgcttcgccggccgccaaggaggctagtccaactcccccttcctcgccctcagttagcggcggactctccagtccaagtcagggagtcggagcagaacttatgggattgcaggtcgactattggaccgctgcccaacccgccgatagaaagcgggatgccgagaaaaaggacctccccgtgacaaagaatacccttaaatgcacttttcgaagccttcaagtttccaggttaccctcctctggcgaggctgcagccacccccactatgagtatgaccgtggtcaccaaagaaaaaaacaagaaggtaatgtttctacctaagaaggccaaggacaaagatgtcgaatcaaagtcccagtgtatcgaaggcatcagccggctgatctgcacagcccggcagcagcaaaatatgctgcgcgtgctcatagacggtgtagagtgctctgatgtcaaattctttcaactggctgctcagtggagttcccacgttaaacacttcccaatctgtatatttggccactctaaggccaccttctag

SEQ ID NO: 44823 - DNA, 2682 bp, Artificial Sequence
  Description of Artificial Sequence: Synthetic coding sequence
atggccgagcggggccggctgggcctgcccggcgcccccggcgccctcaacacccctgtgcctatgaacttgtttgccacctgggaagtggatggcagcagcccttcctgcgtgccccgcctgtgttccctcaccctgaagaagttggtcgtctttaaagagctcgaaaaggaactgatctcagtggtcatagcagtaaaaatgcagggatcaaagcggattctgaggagtcacgaaatcgttctgcctccctccggccaggtcgagactgatcttgcactaacattttctttgcaataccctcattttctcaagagagaggggaacaaactccagattatgctgcagaggagaaagcggtataagaaccggactattctcggttataagaccttggcggctggcagtatcagcatggcggaggtgatgcagcacccctccgagggcggccaagtgctaagcctgtgctcctccatcaaggaggcccccgtgaaagccgccgaaatatggattgcttctttgtccagccaaccaatagatcatgaagacagtaccatgcaggctggccccaaggcgaagtctaccgacaattactccgaggaagagtatgagtccttttccagtgaacaggaggccagcgatgatgctgttcagggtcaagacctcgacgaggatgactttgatgtcggaaaacccaaaaagcagcggcggtcaattgttagaaccacaagcatgactcggcagcagaatttcaagcagaaagtggtcgctcttctccgacgcttcaaggtgagtgacgaggtgttggatagcgagcaggaccctgccgagcacatacccgaggcagaggaggatttagacctgttatacgacactttggacatggaacatcccagtgactccggtcctgacatggaagacgatgatagtgtgctctccaccccgaagccgaaattgcggccctactttgagggtctgagccacagttcatcacagaccgaaatcgggtccatccatagtgcaaggtcccacaaagagccccctagtcctgcagacgttcccgaaaagacccgatctcttggggggagacaacccagtgatagcgtatctgacaccgtcgcactgggggtacccggaccccgtgagcatccaggacagccggaggactccccagaagcggaagcatcaaccttggacgtatttaccgaaagactccctcctagtggccggattactaagacagagtctctggtgatccccagcacacgttccgagggcaagcaagctggacgccggggtcgctcgacttccttaaaggaacgccaggccgcgagacctcaaaatgagcgtgccaattcccttgacaacgaacggtgtcccgatgccaggagtcagctgcaagttcaactccagatcccacgcaagacggtatacgaccagttgaaccacatcctaatctccgacgatcaacttccagagaacatcatcctggtgaatacaagtgactggcagggacagttcctttctgacgtactgcagcggcacacccttcccgtggtttgcacctgcagtccagccgacgtccaggctgccttctctaccatcgtcagccggatacagcgatattgtaattgtaatagccagccccccacgccagtgaagattgctgtggctggcgcacagcactacctgagcgccattctgcggcttttcgtggagcagctttcacacaaaactcctgactggcttggctatatgaggttcctcgtaattccgcttgggagccaccccgtggcccggtacctggggtcagttgattaccgctacaataacttcttccaggacctggcctggagggatttattcaacaaactcgaagcgcaaagcgctgttcaggacacccctgatatcgtcagccgcatcacacagtatatcgcaggggcaaactgcgcccaccagctgcccatcgctgaagccatgcttacctataaacagaagtcacctgatgaggagagctcccaaaaatttatacctttcgttggtgtcgtaaaagtagggattgtggaacccagtagcgctacaagtggcgactccgatgacgccgccccttctggctctggcacactgagctctaccccaccctcggccagtccagctgctaaagaggcttctcccacacctccttccagcccgtcagtgagtggtggcctgtcctccccatctcaaggagtgggagcggagctgatgggactccaggtggattactggaccgctgcacagccggcggatagaaaacgcgatgctgagaagaaggatctgcccgtgaccaaaaacaccctcaaatgtacattccggtccttgcaggtgtcccggctcccctctagcggtgaggccgctgctaccccaaccatgtccatgacggtggtaaccaaggagaaaaataagaaggtgatgttcctccccaagaaagcaaaagacaaagatgtggagtctaaaagccagtgcatcgagggcatcagccgcttgatctgtactgccagacaacagcagaacatgctgcgcgtactgattgacggcgtggagtgttctgacgtgaagtttttccaacttgctgcacagtggagctcccatgttaagcattttccgatttgcatattcggtcattcaaaggccactttttag

SEQ ID NO: 44824 - DNA, 2715 bp, Artificial Sequence
  Description of Artificial Sequence: Synthetic coding sequence
atggccgagcggggccggctgggcctgcccggcgcccccggcgccctgaatacgccggtacctatgaatctgttcgccacttgggaggtcgatggcagtagcccctcatgtgttccaagactgtgcagcctaaccctcaaaaaactggttgtgttcaaggaactggagaaagaattgattagcgtcgttattgccgttaaaatgcagggatcgaagaggatcttgaggtcccacgaaatagttctgccaccaagcgggcaggtggaaaccgatctcgctctgactttttccttacagtatccccatttcttaaaacgggagggcaacaagctccaaatcatgttgcagcgtcggaagcgttataagaatagaactatattgggctataagacactagcagccggttcgatctcaatggctgaggttatgcagcatcctagcgaggggggccaggtcttatctctgtgtagttccattaaagaggcccccgtcaaagccgcagagatctggattgcgtccctgtccagccagcccatcgatcacgaggattcaactatgcaggcgggccctaaagccaaatcaacagataactactcagaggaagagtatgaatcgttcagtagtgagcaggaagctagtgacgatgccgtccaagggcaggatctcgacgaggatgattttgacgttggtaaacccaagaagcagcgcagaagcattgttcgtacaacgagcatgactcgccagcagaactttaagcagaaggtagtggccctgctccgtcgatttaaggtgtctgatgaggtgctggatagtgagcaggaccccgccgaacatattccggaggccgaagaagatttggatctgctttacgacactttggacatggaacatccctctgatagcggcccagacatggaggacgatgacagcgtactgtctacaccaaaacccaagctccggccctatttcgaaggcctctcccactctagctctcagactgaaatcgggagcatccacagtgcccgaagtcataaggaacctccaagtccagccgacgtccctgaaaaaacacggtccctaggagggagacagccatctgactcagtttcagacacggtggccctgggagtgcctgggcctcgagagcaccctgggcagcccgaggactcacccgaagccgaggctagcactctcgacgtgtttacggagagactgccacctagcggaagaatcacaaaaaccgagagcttagttatcccctcgacccgctctgagggcaagcaagccggcagacgtggccggtctactagtcttaaggaaagacaggctgcaaggccacaaaatgagcgggctaattctttggataacgagcggtgtcccgatgcccgttcccagctgcaggtgcaactccaaattcccagaaaaaccgtgtatgatcaactgaaccacattttgatcagcgacgaccagctacctgaaaacattatcctggtgaacacatccgattggcagggccagttcctttccgatgtcctccagcgtcacactctgccagtagtctgcacatgcagccctgctgatgtgcaggccgcttttagcacaattgtgtcccggatccaacggtattgtaactgtaatagccagcctcctacccccgtgaaaattgcagtagccggcgcccaacactatctgtctgccatcctgcggctgtttgttgaacagctgtcacataagacgccagattggcttgggtacatgcgtttcttggtgattcccttgggatctcacccggtggcaaggtatcttggcagcgttgattatcgctacaataacttcttccaggatcttgcctggcgggatttattcaacaagttagaggcgcagtctgccgtacaggacactccagatatagtgagtagaattacacagtacatcgcgggcgccaactgtgcacatcaactcccaatagctgaagcgatgcttacatataaacagaaaaggaagaagcattttcattttgatttcacattatcccccgacgaagagtccagccagaagtttataccatttgtgggcgtggtcaaggtggggatcgtagaacccagtagtgcaaccagcggcgactcagacgacgcagcaccaagtggctctggaacacttagctctactccaccatcagcgtccccggcggccaaggaggcttcacctactccgcccagtagtccctccgtttcaggagggctttcttctccatcacagggcgttggggccgagctcatggggctgcaggtagactactggactgctgcccagcccgccgaccgtaagcgtgacgccgagaaaaaggaccttcctgtcacaaaaaacacccttaagtgcactttcaggtctcttcaggtgtctcgactgcctagcagcggtgaggccgccgccacaccgactatgtctatgacagtcgtgactaaagagaagaacaagaaggtaatgttcctgcctaagaaagctaaggacaaggatgtggaatcaaagtcccagtgtatcgaaggcataagtaggctgatctgcactgcgaggcagcaacagaacatgctacgagtcctgattgacggggtggagtgttccgatgtcaaattcttccagctggctgcccagtggtcttcccacgttaaacatttcccaatctgcattttcggacactccaaggctaccttttag

SEQ ID NO: 44825 - DNA, 768 bp, Artificial Sequence
  Description of Artificial Sequence: Synthetic coding sequence
atggccttccggcaggccctgcagctggccgcctgcggcctggccggcggcagcgccgctgtgctgttttccgcggtggctgtgggaaagccccgcgctggcggagacgcagagcccagacccgcagaacctcccgcctgggcaggcggcgcacggcccggcccaggtgtctgggatccaaattgggacagacgagagcccctttcattaataaacgtgcgcaaaagaaacgtagaatctggggaggaagaactcgccagtaaactcgatcactacaaagccaaagctaccagacacattttcttgatcagacacagccaatatcacgtcgatggctcacttgagaaggatcgtacactcacacccctcgggagagagcaggccgagctgaccgggctgaggttagccagcctcggcctcaaattcaacaagattgtgcattcatctatgactagagccatcgagaccacagatatcatttcgcggcacctccccggcgtgtgtaaagtgtccactgacctacttagagagggggctccaatcgagcccgatcccccggtcagccattggaagcctgaagccgtgcagtactatgaggacggtgcgcgcattgaggctgcttttcgcaattacattcacagagctgacgcgcgacaggaggaggattcatacgagatcttcatttgtcacgccaacgtcatccggtacattgtttgcagcattcccccgctgctgtcggccggcgactttgttctgctagggtcctag

SEQ ID NO: 44826 - DNA, 870 bp, Artificial Sequence
  Description of Artificial Sequence: Synthetic coding sequence
atggccttccggcaggccctgcagctggccgcctgcggcctggccggggggtctgcagccgttttgttctctgccgtggcagtggggaagccccgcgccggcggcgatgcagaaccacgtcctgctgaacctcctgcttgggctggcggggccaggccaggcccgggcgtgtgggatccaaactgggacaggcgtgagcccctttcgctaattaatgttagaaagcgtaatgtcgaatccggggaggaggagctggcttcaaaactggaccattataaagcaaaagctaccagacacatttttttaatccggcactctcaatatcacgtggacggtagtttggagaaggaccgaactctcacgccccttgggagggagcaagctgagctgacaggcttgagattggcaagcttagggctgaagtttaacaaaatcgtacactctagcatgaccagggcgatcgagacaaccgacattatcagccgccatctgcccggcgtatgcaaggtgtcgaccgacctgcttagggaaggagctcccattgaacccgacccacccgtgtctcactggaaacccgaggctgtccagtattacgaggacggtgcacgcatagaagctgcttttcgcaactacatccatagagcagacgcacgtcaggaagaagacagctatgaaatttttatttgtcatgctaatgtgatccgctatatcgtgtgcagagctctgcagttcccacccgagggctggttgcggctgtccctgaataatggcagcataacccacctggtgatccgtccgaatggcagggtggcccttagaacactgggtgacacaggttttatgccccctgacaaaataactcgatcatag

SEQ ID NO: 44827 - DNA, 2418 bp, Artificial Sequence
  Description of Artificial Sequence: Synthetic coding sequence
atggccgccagcggcgtgccccggggctgcgacatcctgatcgtgtacagcccagacgccgaagagtggtgtcagtatctgcagacactgtttctgtcatctagacaggtgcgcagccagaaaatcctgacacaccggttggggcccgaagcgtctttctctgcagaggatttgagcctgtttctgtccactcgttgcgttgtggtacttctgagcgcagaacttgtgcagcatttccataaacccgctctgctgcccctgcttcaaagagcgtttcaccctccccaccgtgttgtgaggctgctgtgtggagtgcgggatagtgaggaattcctggacttctttcctgattgggcccattggcaagaactaacttgtgacgatgagcctgaaacctatgttgccgcggttaaaaaggctattagtgaagactccggctgtgacagcgtcacggacaccgaaccggaggacgaaaaggtggtgagttactcaaagcaacagaacctaccaacagtgacgagccctgggaatctgatggtggtgcagcccgataggatcagatgtggcgccgagactacagtgtatgtgattgtgagatgtaaattggatgaccgagtcgccaccgaggccgagttcagtccagaagactcccccagtgtacggatggaagcaaaagtggagaatgagtacacaatctccgtgaaagctccaaatctgtcatccggaaacgtatcacttaagatttattccggagacctcgtcgtgtgtgaaactgttatttcttattacacggatatggaagagattgggaacttactgtccaacgctgcgaatcctgtggaattcatgtgtcaggctttcaagatcgttccatataatactgaaaccttggataaactgctgacggagtctcttaagaataatatcccagcctccggactgcacttgttcggcattaaccagctggaggaggaggatatgatgactaaccagcgcgacgaggaactccccaccctgctgcatttcgcggccaaatacggcctgaagaacctaacggctctgctgctcacttgcccgggagcactgcaggcttattccgtagccaataaacacgggcactatccaaataccatcgcagaaaagcatgggtttcgggacctgcgacaatttattgatgagtatgtggaaaccgtcgacatgctcaagtcccatattaaagaggaactaatgcacggcgaggaggctgacgctgtatatgagagtatggcgcacctgtccaccgatctcctgatgaaatgctccttaaaccctgggtgcgacgaggatctttacgaaagtatggctgctttcgtgccagccgccacagaggacctatacgttgagatgctgcaggcttcgacttccaaccctatcccaggcgatggcttctctcgcgccacaaaggacagtatgatcagaaagtttctagaaggcaacagcatggggatgacaaacctggagcgtgatcaatgccacctcggccaagaagaagacgtttatcacacagttgatgatgacgaagcgtttagcgtggatttagcctctcgcccgcccgtacccgttcctcgtcccgagactactgctcccggcgcacaccagctcccggacaacgagccatacatcttcaaggtcttcgccgaaaagagccaggagagaccgggtaatttctacgtgtctagtgagtccattaggaagggcccacctgtgagaccgtggagagatcgcccacagtcttccatctatgacccttttgctggaatgaaaacaccaggtcagaggcaactgatcactttacaagagcaagtgaaactcggcatagtcaatgtggacgaagctgtgctccacttcaaagagtggcagctgaatcagaagaaacggagtgagtcattcaggttccaacaggaaaacctaaagcgcttgcgcgactccatcacccgacgtcagagggagaagcagaagagcggcaagcagacagacctggagatcactgttcccattcggcattcacagcacttgcctgccaaggtagagttcggcgtgtacgaatccggtcctcgcaagtcagttattccacctcgcactgagctgaggcgcggagattggaaaactgactctacatcttctaccgcctctagcacatcaaaccgatccagcactcggtcgttgctgagcgtttcctctgggatggaaggggacaatgaagataatgaggtgcccgaggtcacccgatctaggtcgccaggaccacctcaggtcgacgggacgccaaccatgtcgctggagagaccaccacgtgtaccccccagagcggcctctcagcggcccccaacccgggagacattccaccctccaccacccgtccctccaaggggccgatag

SEQ ID NO: 44828 - DNA, 1215 bp, Artificial Sequence
  Description of Artificial Sequence: Synthetic coding sequence
atgcggttcttcaccagcgtggcctgctacggcagctgcctgttcgcatccgagcttcttattcggtgtaaagattggcttaaggggagacctgccctgttcaccgccctcctggcttgcgtcctgtatctctgtgaatggaccggagccaagcacgtacctggttcaagttacgtggagatgctccaggcatctactagcaaccctatccctggtgatgggttctcaagggccactaaggacagcatgattcgcaagtttctggagggcaattccatgggaatgacaaatctggagcgtgaccagtgccatctgggccaggaagaagacgtgtaccacacagttgacgacgatgaagctttctcagtagatctggctagcaggccccccgttcctgtcccccgccctgagaccaccgctcccggcgcccatcagctgcccgataatgaaccgtatattttcaaggtctttgccgagaagagccaggaaagacctgggaacttctatgtgtctagtgagtctattagaaaggggcccccggtgaggccatggagggataggccacagtcgagtatttatgaccctttcgccgggatgaagacacccgggcaacgccaactgattacactgcaggagcaggtgaaactcggcatcgtgaatgtggatgaagccgttttacactttaaggagtggcaactgaaccaaaagaagcgctccgagtctttcagatttcaacaagaaaacctcaaaaggcttcgcgactctatcacccgccgtcaaagggagaagcagaaatccggtaagcagaccgacttggagattaccgtgcccatacgtcactcccagcacttgcctgcgaaggtggagtttggtgtgtacgaatcaggtcctaggaaaagtgtcatccctcccagaaccgagctgcggcgcggggattggaaaacagacagcacatcgagtacagcatcctcgacttctaatcggtcatccacccgaagcctgctgtcagttagtagtggaatggagggggataatgaggacaacgaggtgcccgaggtgacccgctccagaagtccaggccctccgcaggttgacggcacccctacaatgagtcttgagcggccacctcgagtacccccaagggcggcttcacaaagacctccgacgcgcgagacgttccatccccccccgccagtaccacctcgaggtagatag

SEQ ID NO: 44829 - DNA, 1884 bp, Artificial Sequence
  Description of Artificial Sequence: Synthetic coding sequence
atggtggtgcagcccgaccggatccggtgcggcgccgagaccaccgtgtatgtaattgtccgctgtaagctggacgacagggtcgccacagaagccgagttttcaccagaagatagccccagcgtgagaatggaagccaaggtggagaatgagtacaccatctctgtcaaagctcccaacttgtcctctggaaatgtgagtctgaaaatttactctggtgatctggtagtgtgcgaaaccgtgatctcgtattataccgacatggaagaaatcggcaacttattgtctaatgctgcaaatccagtggaatttatgtgtcaggcttttaagatcgttccctataacactgaaaccctagacaaactcttgacagagtcgttaaagaacaacatacccgctagtggacttcatctgtttgggatcaatcagctggaggaagaggatatgatgaccaatcagagagatgaggaactgcccacgttactgcactttgcggcaaaatatggtctgaaaaacctcactgccctcttgcttacttgcccgggtgcgttacaggcgtattcagtggccaacaagcacggtcactaccccaatactatagctgagaagcacggctttcgcgatttaagacagtttatcgatgaatacgttgagaccgtggacatgctgaagagccatattaaggaggagcttatgcatggggaggaggcagacgctgtatatgaatctatggctcacctatccaccgacctccttatgaaatgtagtttgaaccctggctgtgacgaggatctctatgagagcatggccgcttttgtccctgcagccacggaggatctgtacgttgaaatgctccaagcatcaaccagtaatcccatccccggggacggcttcagccgcgccacaaaagattctatgatcagaaagttcttggagggcaactcaatgggcatgactaacctcgaaagagaccaatgtcacctgggtcaggaggaggacgtctaccatacagtggacgacgacgaggcattttcagtagacttagcctccaggcccccagtcccagtccctcggccagaaactaccgctcccggagcacaccagctgcccgacaacgaaccttatatctttaaggtctttgctgaaaagtctcaggagcgcccaggaaatttttacgtgtcttctgaatcaatcaggaaaggcccgccggtgcgaccttggcgggaccgtcctcagtcttccatctacgacccctttgctgggatgaaaacccccggacaacgccagctgatcaccctgcaggagcaggtcaagctgggtatagttaatgtggacgaagcagtgcttcatttcaaggagtggcagttaaaccagaaaaaacggagcgagtccttcaggttccagcaggaaaatctgaagcggctgcgggatagtattaccagacggcagagagagaaacaaaagtcaggaaagcagacagatctggaaattactgtcccaattcgccacagtcagcatctgcctgccaaagtcgaatttggggtttatgagtcaggccccaggaagtctgtgattcctccaaggacagagctgaggcgcggcgattggaagaccgatagcacgtcatccacggcaagctccacctccaaccgttccagtacacgaagtctgttatctgtgagcagtgggatggagggagataacgaggacaatgaagtgcccgaggtgacgcgctctagatcaccgggtcccccccaggtagacgggacaccgaccatgagcttggaacgtcctccacgcgttccgcccagggccgcttcacaacgcccaccaacacgcgaaacctttcaccctccaccacccgtacccccaaggggtaggtag

SEQ ID NO: 44830 - DNA, 408 bp, Artificial Sequence
  Description of Artificial Sequence: Synthetic coding sequence
atggcctgcggcctggtggccagcaacctgaacctgaagcccggcgaatgccttcgcgtccgcggcgaagtagctccagacgcaaaatcttttgtgctcaatcttgggaaagacagcaataatctctgcttgcactttaatccccggttcaatgcgcacggggacgctaacaccatcgtgtgcaatagcaaggacgggggggcttggggcacagagcagagggaggcggtgtttcctttccaacccggatccgtggctgaagtctgcattaccttcgaccaggcaaatctcacagttaagcttcccgacgggtatgagttcaaattcccaaaccgcctgaacctggaggccatcaattacatggcggcagatggggattttaagatcaagtgcgtggcattcgattag

SEQ ID NO: 44831 - DNA, 705 bp, Artificial Sequence
  Description of Artificial Sequence: Synthetic coding sequence
atgctgctggcctgggtgcaggccttcctggtgagcaacatgctgttggcagaggcttatgggtctggagggtgtttttgggataacggtcatctctatagggaggatcaaactagtcccgcccctgggctgcgatgtctgaactggctggacgcccagtccggactcgcctcagcccctgtcagcggcgctggtaaccatagttactgccgaaaccccgacgaggatccgaggggaccctggtgttatgtttctggggaggccggggtgcccgaaaaacgaccatgtgaagatctgcggtgtcccgaaacgacgagccaagctttgcctgcttttaccaccgagatccaggaagcctctgagggccctggggccgatgaggttcaggtgttcgcaccggctaacgcgctgccagctaggtctgaggctgcagctgtgcagccagtgataggcatctcccagagggtgcgcatgaacagcaaagagaaaaaggatttggggactcttggttacgtgctcgggatcaccatgatggttattattatagccattggagctggaattattctcggctactcgtacaagcgcagtgtggcttccctcttgggacccctccgccggcgagggggtcgctatacgaaaagtaatttcgtcgcatttctcccgaaacgcaaacaggacgttgagaaccagctcaaaatgtag

SEQ ID NO: 44832 - DNA, 726 bp, Artificial Sequence
  Description of Artificial Sequence: Synthetic coding sequence
atgctgctggcctgggtgcaggccttcctggtgagcaacatgctgctagctgaagcttacggatccggcggatgtttctgggacaacggacacctctatcgtgaagaccagaccagcccggctcccgggctaagatgtttaaactggctggacgctcagagcggccttgcctctgcgcctgtgagcggcgccggcaaccacagctattgtcgcaatccaggagaggaccttaggtgccccgaaactacttcacaggcgctgcccgcatttacaacagagatccaagaggctagtgaggggccaggagccgatgaggtgcaggttttcgccccggctaatgctttgcccgcacgcagcgaagctgcagctgtccaacccgtcatcgggatctcccaacgcgttcgtatgaattcaaaggagaagaaggatttaggtacactgggttacgtcctgggcatcactatgatggtgatcatcattgccattggagccgggatcattcttggttactcatataaaagaggtaaggaccttaaggagcaacacgatcagaaggtgtgcgaaagggagatgcagcggataacgctccctctctccgcattcactaatccgacatgtgagattgttgatgaaaagaccgtcgtcgtacacacgagccagacccccgtggacccccaggaggggacaactcctctcatggggcaggcaggtacgccaggtgcatag

SEQ ID NO: 44833 - DNA, 522 bp, Artificial Sequence
  Description of Artificial Sequence: Synthetic coding sequence
atgctgctggcctgggtgcaggccttcctggtgagcaacatgctgctggccgaggcttatggcagcgggggatgtttctgggataacggccatctctatcgggaggaccagacctccccagctcctggattaagatgtcttaactggttagatgcccaatctggtttagcctctgcacccgtgagcggcgccggtaaccactcctattgccggaacccagacgaggatccaagaggaccctggtgttatgttagtggggaagcgggggttccggaaaaaaggccatgtgaggatcttcggtgcccagaaacaaccagtcaggccttgcctgcattcacaacagagatccaggaggcctcggagggaccaggcgcggatgaagttcaggtttttgctccagccaatgccttgcctgctcggtctgaggctgctgcggtccagccagtgatcgggatctctcagagggtccgaatgaattcgaaagagaagaaggacctgggtacactaggtggccgcatatag

SEQ ID NO: 44834 - DNA, 555 bp, Artificial Sequence
  Description of Artificial Sequence: Synthetic coding sequence
atgctgctggcctgggtgcaggccttcctggtgagcaacatgctgcttgcagaggcatatgggagcggcgagacaactagccaggcactgcccgcttttaccacggaaatacaagaggcttctgagggcccaggagccgatgaggtgcaggttttcgcaccggccaatgctcttcctgctcgcagtgaagcagccgccgtccagccagttataggcataagtcagcgcgtgaggatgaacagcaaggaaaagaaggacctggggacactaggctatgtattaggtatcaccatgatggtcataatcatagcaatcggggcaggcattatcctgggatattcatataagcgcggaaaggatttaaaagagcagcatgatcagaaagtgtgtgagcgcgaaatgcagcgaatcaccctccccctatcagcattcactaatccaacgtgcgagatcgtggatgaaaagacagttgttgttcacaccagtcagacccccgtagatccccaggaaggcaccacccccctgatggggcaggcgggcacaccaggtgcgtag

SEQ ID NO: 44835 - DNA, 2538 bp, Artificial Sequence
  Description of Artificial Sequence: Synthetic coding sequence
cagttcgtgcagcccgaggagcggcggcagggcagcctgctgggccccgggttgccttcccatgctctgggtacactggccaaagtggcggggcgacaggacgccgcaccccccggagggagcgccgcctccgaggagcgcgaggaaggcccatccgtcgaagctctcgctgtgagcaaagccgactgctatgtacaactctggctgccaacggcaagtccgagccccgctcagacgcggatagtggctaattgttctgaccctgaatggaacgagacctttcactaccaaatccacggcgcagttaaaaatgtactggaactaacattgtacgacaaggacatccttggcagtgatcagctctcgctgttgctcttcgacctgcggagccttaagtgcgggcagccccataagcacactttccctttgaaccaccaggattcacaggagttgcaggtcgagttcgtcctcgaaaaatcgcaagtccctgctagtgaggtcataacgaatggagtgttagtggcccacccttgcctccgtatacaaggaacactgcggggggacggtacggcccctagagaagagtacggaagccgccagctccagttggccgtgcccggcgcctatgaaaagccacagctgttaccacttcagccacccaccgaacctggactccctcccacgttcacatttcatgtgaaccccgttttatcctcacgcttgcacgtcgagttgatggagttgttagcagcagttcagtcgggtccatccgccgaactcgaagctcagacgtcaaagctgggggaaggaggaatcctgctaagcagtctgcctttaggacaggaagagcaatgttctgtcgcactgggagaaggacaagaggtggctctctctatgaaggtggaaatgagctcaggcgatctcgatcttcgcctcggtttcgatttgtccgatggggaacaggagtttctggatcggagaaagcaggttgtctcaaaggcactccagcaggtgttgggtctaagcgaggctcttgactccgggcaggtcccagtggttgccgtgcttggcagtggcggtggcacaagggccatgtcctcgctgtacggcagcctggccggtctgcaggaattagggctacttgacacggtgacttacttgtcaggcgtgtctggtagcacatggtgtattagtactctgtacagagacccggcatggagccaggtggccttgcagggacctattgaaagggctcaggtgcacgtctgttctagtaaaatgggtgccctttccactgagcgcctacagtattacactcaagaactaggggtgagagaaagaagtggacactccgtgagtctcattgatctatggggacttctggtcgaatatttgctgtatcaggaggagaacccagccaagctgagcgaccagcaggaggcggtgcgacagggacagaacccctaccctatctatacaagcgtaaacgtgagaaccaacctgtcaggggaggacttcgctgaatggtgcgaattcacaccatatgaagttggatttcccaagtatggggcgtacgtgcccaccgagctttttggatctgaacttttcatgggcaggcttcttcagctccaacccgaaccacggatctgctacctgcaaggtatgtggggaagcgcattcgcgaccagcttggacgagatctttctcaaaaccgccgggagcggcctgtccttccttgagtggtacagagggagcgtgaatatcactgatgattgccagaaaccacagctgcataatccatctagactacgcaccagacttctcactccccaaggccccttttctcaagctgtattggacatttttaccagtcgctttacctctgcccagtcgttcaacttcacacggggcctctgcctgcacaaggactatgtggccggcagggagtttgtcgcctggaaggacactcacccagacgctttcccgaatcagcttacaccgatgcgtgattgcctctatttagtcgatggcggcttcgctatcaattctcccttccccctggcactgctgcctcaaagagctgtagacctcattctgagttttgattatagcctcgaagctccttttgaagtgctcaagatgaccgagaagtactgcctggacaggggcattccttttccttccatcgaggtcggtcccgaggatatggaggaggctcgagaatgctatctattcgccaaggctgaggaccccaggtccccaattgttctccactttcccctggtgaacagaacattccggacacatctggcgccgggagtcgaacggcagaccgccgaggaaaaggcatttggtgatttcgtcatcaatagacccgacacaccctacgggatgatgaactttacctatgagccccaggatttctatagactggtggcgctgtcgagatacaatgttcttaacaatgtggagacactgaagtgcgcactgcagctggctctggatcggcaccaggcccgggagagagccggcgcctag

SEQ ID NO: 44836 - DNA, 1365 bp, Artificial Sequence
  Description of Artificial Sequence: Synthetic coding sequence
atgctgtgggccctgtggccccggtggctggccgacaagatgctgcctcttttgggcgctgttctgctccaaaaacgcgagaagaggggacccctgtggcgacattggcgaagagaaacctacccatattatgatctgcaggttaaggtgcttagagctactaacatccgggggaccgatttgctgtcaaaagccgattgttatgttcagttgtggctcccaaccgcttcgccatcacctgctcagacacgcattgtggctaattgctctgatccagaatggaatgagacctttcattatcagatccacggagccgtgaaaaatgtcctcgagctgactctgtacgacaaagatatcctgggatctgatcagctcagcctgctgctgtttgacctgcggtccctaaagtgcggtcagccccataaacacaccttcccactgaaccaccaggactcacaagaacttcaggtcgagtttgtgctggagaaatcacaggttccggcatctgaagtgataacgaatggcgtgcttgtggcacatccttgcttgagaattcagggaactctgcggggtgatggaacggcgcccagagaggagtatggctcccgacagcttcagttagcggtgcctggtgcctacgaaaaaccacagctactgcctctgcagccaccaaccgagcctggattaccgcccacttttacctttcatgtaaaccctgttctttctagccgtctgcatgtcgagctcatggaactgttagcagccgtccagtcggggcccagtgccgaacttgaggcacagactagtaagctaggagagggtgggatactgttaagtagtctgcccttgggtcaggaggaacagtgctccgtggcgctgggtgaaggccaggaagtggctctgtccatgaaggtggaaatgtctagcggtgaccttgacttgagactcggcttcgacctctctgacggggaacaggagtttcttgaccggaggaagcaggtagtatccaaggccctgcagcaggtcctgggactgtctgaagccctggactccggccaagtccccgttgttgcagtattggggtctggtggcggaaccagagcaatgtctagcctttacggctccctcgcggggctccaggagcttgggctcctggatactgtaacatacctttcaggggtcagcggctctacctggtgtatttccaccctataccgcgaccccgcctggtcccaggtagccctgcagggtcctattgaacgtgctcaggtccatgtttgcagcagcaaagttggagatgtgagggtgagcccatgccaactccctagactccatagctcaaatctcgaccacagtctgtggtag

SEQ ID NO: 44837 - DNA, 2550 bp, Artificial Sequence
  Description of Artificial Sequence: Synthetic coding sequence
atgctgtgggccctgtggccccggtggctggccgacaagatgctgcccttactgggcgccgttctgctccagaagcgcgagaaacgggggccactttggcgtcattggaggagggagacatacccctattacgacctccaggttaaagtccttcgggcaacaaatatacgaggaactgatctcctgtccaaagctgactgttacgtgcagctgtggctccccaccgcgtctccatcccccgctcagacccgaatagtggccaactgttcagatcccgaatggaatgagacgttccactatcaaatacacggagccgtgaaaaacgttctcgaactcaccttgtacgacaaagatattctgggctcagatcagctgtctctactacttttcgaccttcgcagcctcaaatgcggacagcctcacaaacacacatttccactaaaccaccaagactcccaagagctacaggtggagttcgtcctggagaagagtcaggttccagcatctgaagttatcacgaatggcgttctcgtcgcccacccttgtttgaggatccaaggaactctccgtggagacgggacagcaccacgtgaggaatatggaagtagacagctacagttggctgtaccgggcgcttacgaaaagcctcagctgcttccacttcaacccccaacggaacctggcctaccacctacctttacatttcatgttaaccccgtactgtcttcccgcctgcatgtggagctgatggaacttttggccgctgtgcagagtgggccgtccgcagaattggaagctcagacatctaagctgggggaaggtgggattcttttgagctccttaccgttgggccaggaggagcagtgctcagtggccctcggagagggccaggaagtagctctcagtatgaaggtggaaatgtcttccggtgatctcgacctccgcctgggcttcgatctctccgatggagaacaggagttcttagatcggcggaagcaggtagtaagtaaggccctccagcaggtcctggggttgagtgaggctctggactcggggcaggtccccgtggtggcggtgctggggagcgggggcggcacacgtgccatgtcaagtctgtacggctcactggccggcctgcaagagctgggactcctggatacggtgacatacctttctggggtctctggctctacttggtgcattagtacgctttatagagatccagcatggtcccaggtcgctctgcagggtccaatcgagcgggcccaagttcacgtgtgttcctctaaaatgggagctctatctaccgaaagactgcagtactacactcaggagttaggggtcagagagaggtccggccacagcgtctcgttgatagacctctgggggctcctagtggagtatttgctttatcaggaagaaaatccagctaaactgtctgaccaacaggaagcagtgcgacaaggccagaatccataccccatttatacctctgtgaacgtacgaactaacctcagcggtgaagacttcgcagagtggtgcgaattcaccccatacgaggtgggcttccccaaatacggtgcttatgtgcctacagagctgttcggcagcgaactgtttatgggaagacttctacaacttcagccggaaccacggatctgctatctgcagggaatgtggggctcagccttcgccacatcactcgacgagatcttcctcaagaccgctggcagtgggctgtcgtttctcgagtggtacagagggtcggtgaacatcacagacgactgtcagaaaccacaactgcataaccccagcagattgaggacacgattattaaccccgcaaggtccctttagtcaagctgtgttagatatcttcacgagccgctttactagtgcccagtcttttaacttcactcggggactctgcctgcacaaagactatgtggccggccgggagttcgtggcttggaaggatactcatcctgacgcctttccaaaccaactgacgccgatgagggattgcctttacctggtagacggaggctttgctatcaattccccatttcccctggccctgctgccccagcgtgcagtggacctcattcttagtttcgactattcattggaagcaccctttgaagtcctaaagatgaccgagaagtactgtcttgacaggggcatcccatttccttccatcgaggtcggtcccgaggatatggaggaggcccgggaatgttacctgtttgctaaagccgaggacccccgttctcctatcgtgcttcattttcccctggtaaacagaacattcaggactcaccttgcgccaggtgtggaacgccagacagcggaagagaaagccttcggcgactttgtgatcaaccgaccagataccccctacggaatgatgaactttacttacgaaccacaggacttttacagattggtagctctcagcaggtacaacgtgctgaataatgtcgagacactgaagtgcgcacttcagcttgcactagacaggcatcaagcaagggaacgagccggagcatag

SEQ ID NO: 44838 - DNA, 2556 bp, Artificial Sequence
  Description of Artificial Sequence: Synthetic coding sequence
atgctgtgggccctgtggccccggtggctggccgacaagatgctgcccttactcggagctgtcttgcttcaaaagagagagaagcggggacctctgtggcgacattggcgcagggagacctacccatattatgacctgcaggtgaaggtgctgcgtgcgactaacatacggggcactgatctgctatcaaaagccgattgctatgtccagctctggctgcccacggcctctccttccccagcccagacccgaattgtggcaaattgctccgaccccgagtggaacgaaactttccattaccagattcatggcgccgttaagaatgtgttagagctgactctttacgacaaggatatactcggctccgatcagctcagtttgcttctcttcgacctgaggtctttaaaatgtggacagccacacaaacacaccttcccgcttaaccatcaggattcccaggaattgcaggtcgaattcgtactagagaagtcccaagttcctgcaagcgaggtcattacaaacggggtgctggtagcacatccatgcctgaggatccaaggaacactccgcggcgacggcacagccccaagggaagaatacgggtcacggcagctccagctggctgtgcccggcgcatacgaaaagcctcagctgctaccgctacagccaccgactgagcccggactcccccctacttttaccttccatgtaaacccagttctgtcctcaaggctgcacgtggaactgatggagctacttgcagctgttcagagcgggccttccgccgaattggaagctcagacttctaagctcggcgagggaggaatcctcttgagtagcttacccttaggacaggaagagcagtgtagcgtagctctcggggaaggccaagaagtggcactttccatgaaggtcgaaatgtcctccggcgatctcgatctgaggttgggatttgacctgtccgatggtgagcaagaatttttggatagacgcaagcaggtggtgtcaaaggctctccagcaagtgctggggctgagtgaggccctcgattccggccagacacaagtccccgtggtggctgttctcggttccggcggcgggaccagagccatgagcagcctgtatgggtctctggcaggcctgcaagagctcggactcttagataccgtgacgtatttaagtggcgtgtctggaagcacctggtgtatcagcactttatacagggaccccgcctggtcacaagtcgctttacagggcccaatagagagagcgcaggtccacgtgtgctctagcaaaatgggagcccttagtaccgagcggcttcagtattatacgcaggaactgggggtgcgcgaaagaagtgggcactctgtgtcattaattgacctctggggcctccttgttgagtacttactataccaggaggagaaccctgccaagctctccgatcagcaggaggcagtgcggcagggccagaatccttaccccatctatacatccgtgaatgttcgtactaatctgtctggggaagactttgcagaatggtgcgaattcacaccctatgaggtaggatttcccaagtatggagcatacgtgccaaccgagctgtttggctctgagctgttcatgggcagactactgcagctgcagcccgagcctcgcatctgctatctgcaggggatgtggggctctgccttcgcaacaagcctagatgagatatttctaaaaactgctggaagtggcttatcattcctcgagtggtaccgtggatccgttaacatcaccgacgattgtcagaagccgcagctgcacaatccgtcccggctgaggacaagactgttgaccccccagggccctttttctcaggccgtcctggatatcttcacctctcggtttacctctgcacagagcttcaacttcacccgcgggctgtgtctgcacaaagattatgtggcaggccgggagttcgtagcgtggaaagatacccatccagacgcattccccaaccaacttacccctatgagagactgtctgtatttggtcgacgggggttttgcgatcaattccccatttccgcttgccctgctaccccagcgcgcagtagatctgattttgtctttcgactacagtttagaagcacccttcgaggtcctgaaaatgaccgaaaagtactgtctggatcggggaataccgttcccctctattgaagtggggcccgaggacatggaagaagcacgagagtgttacctgttcgccaaggccgaagaccctagaagtccaattgtgctgcactttccattggtcaatcggacctttcgcactcacctggctcccggtgtcgagcggcagacagctgaagagaaagccttcggggatttcgtgataaaccgacctgacactccatatgggatgatgaacttcacctatgagcctcaagacttctacagactggtcgcattgagccgatacaacgttttgaacaacgtggaaaccctcaagtgcgcacttcaattggcactagaccggcatcaagcccgggagagggctggagcctag

SEQ ID NO: 44839 - DNA, 2598 bp, Artificial Sequence
  Description of Artificial Sequence: Synthetic coding sequence
atgctgtgggccctgtggccccggtggctggccgacaagatgctgccactcctgggtgctgtcctgctccaaaaaagggaaaagcggggaccactttggcggcattggcgcagagagacctacccatattacgacttacaggtaaaggttctcagggccaccaacatccgcgggaccgatcttctaagcaaagccgattgctacgtgcaactgtggctgcctactgcgtctcctagccccgctcaaacccgcatcgttgcgaactgttcagacccggagtggaacgagacgtttcactaccagatacacggcgccgtaaagaatgtgctggagctcactctgtacgacaaagacattctgggcagtgatcagctgagtctgctgctctttgacctgagaagcttaaaatgcggccaacctcacaaacatacttttcccctgaaccaccaagactcacaggaacttcaagtggagttcgttctggagaagtcccaggtgcccgcctcagaagtcatcactaatggggtgctggtggcgcacccttgcctgagaatccagggcacactgcggggggacggtacggcacctcgagaagaatatggttcaaggcaactccagctagccgtgcccggcgcctacgagaagccccagctgctaccactgcaaccccccaccgagccgggcctgccgccaacattcacctttcacgtgaaccctgttctgtcctcccgactgcatgttgaactgatggagctgctcgcggcggtgcagagcggcccctctgccgagctggaggcccaaacctctaagcttggggagggcggcattttactctcgtccctgcccctgggtcaggaggagcagtgttcggtcgctcttggcgaagggcaggaagtggccctgtccatgaaagtggaaatgtcctctggtgatctcgacctgagacttggttttgacctttcagacggagagcaggaatttcttgacaggcgcaaacaggtggtcagcaaagcacttcagcaagttctcggcctgtctgaagccctggattcaggacaagttcccgttgtggccgtgctcggcagtggaggaggcacgagagctatgtccagtctgtatggatcactcgcgggcctgcaggaacttgggctgcttgacacagtgacctacctgtctggggtgtctggttccacgtggtgcataagcacactctatcgagaccccgcttggtcccaggtggctctgcagggacccatcgagcgcgcccaggttcacgtgtgttcctccaagatgggtgccctgtcaacagaacggttgcagtactatacgcaggaactgggagtcagggagcgatctggtcatagcgtgtcactgatagacctatggggacttctggtggagtacctgctgtaccaggaggagaatccagcgaagctctcggatcagcaggaggccgttcgccagggacagaacccatatcctatctacacttctgtgaatgtccgcaccaatttgtctggggaggattttgcagagtggtgcgagttcaccccgtacgaagtgggcttcccaaagtacggtgcttatgtcccgactgagcttttcggcagcgagttatttatgggacggctgctgcagctgcagcctgaaccgaggatttgttatctgcagggtatgtggggatccgccttcgccacgagcctggacgagatatttctaaaaaccgccggttccggactgtcatttctagaatggtaccggggcagtgtcaacatcacagatgattgccagaaacctcagctgcacaatcctagccgactgagaactcgcctactgaccccccaggggcccttctcccaggctgtcctcgacatatttacctcacggtttactagcgcacagagctttaatttcacccgcgggttgtgtctacacaaggactatgtggccggccgtgagtttgttgcatggaaggatacccaccccgatgcattccccaatcagcttactcctatgcgcgactgtctttaccttgtggacggcgggttcgctattaatagtcctttccccctcgctctgctgccacagagggccgtggatctcattctaagcttcgactattcactcgaggccccctttgaagtgttgaaaatgacggagaaatactgcctcgacaggggcattccttttcccagcatcgaggttggccctgaggacatggaggaagcgcgggagtgctatttattcgccaaagcagaagatccaaggagccctattgtgcttcacttccccctggttaatcggacctttaggacacatctggcccctggggtggagcgccagaccgccgaagaaaaggccttcggcgactttgttattaacagacccgacaccccttacgggatgatgaatttcacttatgagcctcaggatttctacagactcgtggctctctctcggtacaatgtgctgaataacgtcgaaacactcaagtgcgcccaccccagacaccgccgcactagcgaaggccctagcccacagactcacacagaacaggggctgagggcgctgaggtctcagcttagtagtctacactag

SEQ ID NO: 44840 - DNA, 1770 bp, Artificial Sequence
  Description of Artificial Sequence: Synthetic coding sequence
atggtgggccagatgtactgctaccccggcagccacctggcccgggccctcacacgcgcgctcgccttggctctggtgcttgctctgctcgtgggcccattcctgagtggactcgccggcgcaataccagcccccggagggcgatgggcccgggacggacaagttcctcccgcctcccgctcgaggtctgtgctgcttgacgtcagcgctgggcagttgctgatggtggatggaaggcaccccgatgcagttgcttgggccaacctgactaacgccatccgggagacaggttgggcctttctcgagctgggaacaagcggacagtataacgatagcttacaggcctacgctgcaggggttgtcgaagcggctgtgagcgaggagttgatctacatgcactggatgaataccgttgtgaactattgtggccctttcgaatacgaagttggctactgcgaacggctgaaatctttcctggaggcaaacctcgagtggatgcaggaggagatggagtcaaatccagatagcccgtattggcatcaggtgcgactcactctccttcaactgaaagggctggaagacagctacgaaggcagagtttcattccctgctggcaagttcactataaaacccctcgggttcctgctgctgcagttgagtggagatctggaagatctggagctggccctgaataaaaccaaaatcaagcctagccttggcagcggatcatgttctgccctcattaagctcctccccggccaatccgacctgctggttgcgcacaatacttggaacaattatcagcatatgctccgggtaatcaaaaaatactggctgcaattccgggagggtccctggggcgactatccattggtccccggtaacaagctcgtgttctcaagctatcctggcacaatattctcatgtgacgatttctacattttagggtcaggacttgtcactttagaaacaactatagggaataaaaaccccgcactctggaagtacgttcggcctagaggctgtgtgctcgaatgggtgaggaatatcgttgccaacaggttggcatcggatggggcaacttgggcggacattttcaagagatttaactctggaacatataacaaccagtggatgatcgtcgactacaaagcattcattcccggaggtccctcccctgggagcagggtcctcaccatcttggagcaaattcccggcatggttgtggttgcagataaaacgtcagaattataccagaaaacttactgggcctcgtataacatcccgagctttgagactgtctttaacgccagtggattacaggcgctggtcgcccagtacggagattggttcagttacgacggctctcctcgggcccagatctttcggaggaatcagtctttggtccaggatatggatagtatggtgaggttgatgcgttataacgacttcctgcatgaccccctcagcctctgcaaggcatgtaacccccagcctaacggggagaatgcaatctccgctagatctgatcttaaccccgctaatggttcatatccattccaggcgctgcgacagagaagccatggggggattgacgtgaaggtgacatctatgtctttagccaggattttgtctctgctagctgcttcggggcctacctgggatcaggtcccccctttccaatggtccaccagtcccttcagtggactgctgcatatgggccagccggacttatggaaatttgctcctgtcaaggtaagctgggattag

SEQ ID NO: 44841 - DNA, 1674 bp, Artificial Sequence
  Description of Artificial Sequence: Synthetic coding sequence
atggtgggccagatgtactgctaccccggcagccacctggcccgggcgctgacacgcgccctcgccctcgccctggtccttgcacttcttgtgggccccttcctcagcgggctggcaggcgccatccccgctcccggcgggcgctgggctagggatggacaggtacctcccgctagtcgctcacgctctgtactgttagacgtgtccgccggacaactcctgatggtggacggtagacaccctgacgctgtggcctgggccaacctgacaaacgctataagagaaacaggctgggcttttttagaattagggacctccggacagtacaatgattcattacaggcttacgccgcaggggttgtggaggctgccgtttcagaagagctcatctatatgcactggatgaacactgtggtgaactactgcgggccattcgagtatgaggtagggtattgcgagcgccttaaaagctttttggaggccaaccttgagtggatgcaggaggagatggagagcaatccagattcaccatactggcaccaggtgagactcacactgctgcaattgaaaggcttggaagactcatatgagggaagagtctccttcccggccggcaagttcactattaaaccactcggcttcctgctgctgcagctgagcggcgatctcgaagacctggagctggccctgaacaagaccaaaatcaagcccagcttaggatctggatcatgctcagctctcatcaaactcctacctggacaatcggatctgctagtggcacacaatacctggaataattatcagcatatgttgagggtgattaagaagtattggctgcagtttagggaaggcccctggggagactacccactcgttccaggtaacaaacttgtattcagctcataccccggaactatcttttcttgtgatgacttctatatcctaggtagtggactggtgaccctggaaacgacaatcggcaacaagaaccccgccttatggaagtatgttcgaccccggggctgtgttctcgagtgggtgcggaatatcgttgccaacaggctggcatctgatggggctacatgggcggacatattcaagcgttttaactcagggacgggcatggttgtcgtggccgacaagacaagcgagctgtatcagaagacctattgggctagctacaacataccgtccttcgagactgtctttaacgccagcggccttcaggccctcgtcgcacaatatggagattggtttagctatgacggaagtccacgggcccagatcttccgcaggaaccaatccctggtgcaggatatggatagcatggtgcgcctcatgcgctacaacgattttttgcatgatccgctgtctttgtgcaaggcttgtaatcctcagccaaacggcgaaaacgccatctccgctcggtctgacttgaatcctgccaacgggagctacccattccaagcactccgtcaaaggtcacatgggggcatagacgtgaaggtgacatccatgagcctcgcacgcatactttcactgctcgccgccagtggcccaacatgggaccaggttcccccgtttcagtggagtacatcgcccttttcaggcctcctgcatatgggacagccagacctgtggaaatttgccccagtcaaggtgtcctgggattag

SEQ ID NO: 44842 - DNA, 1473 bp, Artificial Sequence
  Description of Artificial Sequence: Synthetic coding sequence
atgaagcccaagctgatgtaccaggagctgaaggtgcccgccgaggaaccagcaaatgaactgcccatgaacgagatagaagcatggaaggcagcggagaagaaagctcgatgggtcctgttggtgctgatcctcgcggtagttggtttcggtgcgctgatgacacagttattcctctgggaatacggggacctccacctctttggtcccaatcaacgccctgctccttgttacgatccttgcgaggccgtccttgtcgaaagcatcccagaggggctggatttcccaaatgcttccacgggcaaccccagcacctcccaggcctggctcggactgttagccggagcacactcatcactggacatcgcttctttttattggactctgactaataacgacacccacacacaggagccttccgcacagcagggagaagaggtgctccgtcagttgcagaccctggctcccaaaggtgtgaatgttcgtattgcagtttccaaacctagcgggccccagccccaagccgatctgcaagcccttctgcagagcggggcccaagtgaggatggtggatatgcagaagttgacgcacggcgttctgcatactaaattttgggtagtcgaccagacccacttctaccttgggtccgcaaacatggattggcgaagcttgacccaagtgaaggagctgggcgtcgttatgtataattgctcctgcctggctagagacctgactaagatttttgaggcctattggttcctgggccaggccggcagctcaatcccctccacctggcccaggttttacgatactcggtataatcaggaaacgccaatggaaatctgtctcaatgggacccccgccctggcctacctcgccagtgcaccaccacccttgtgtccctcaggcagaactcctgatcttaaggccctgttgaacgtggttgacaacgcccggagttttatttatgtggccgtaatgaactatctgcccaccctggagttcagccacccccatcggttttggcctgccattgatgacgggctgagaagggccacgtacgaacggggtgtgaaggtgcgactactgattagctgctggggacatagtgaaccttccatgcgggcttttctattgagtcttgcagcacttagggataaccacacacattctgatattcaggtcaagctcttcgtggttccagcggacgaggctcaagcccgaataccctacgcgcgggtaaaccacaacaagtacatggtcaccgagcgggcaacgtacatcgggacgagtaactggtctggcaactacttcacagagaccgccggtacttcgttgttggtaactcagaatggcagaggaggtcttcggtcccagctcgaggccatttttctccgcgactgggatagtccctactcacatgacctcgatacctcagcagactctgtggggaacgcatgtagactcctttag

SEQ ID NO: 44843 - DNA, 534 bp, Artificial Sequence
  Description of Artificial Sequence: Synthetic coding sequence
atgaagcccaagctgatgtaccaggagctgaaggtgcccgccgaggaacctgccaacgagctgcccatgaacgaaattgaagcgtggaaagccgcagagaagaaagcccgttgggttcttctggtgctcattctggccgtggtgggtttcggcgccctgatgacgcagctattcctttgggagtacggggacctgcacctgttcggtccaaaccagagacccgcaccatgctatgatccctgcgaagccgttttggtcgaatccatacctgagggcttagacttcccgaacgcttccaccggcaatcccagtacctcacaggcttggctcggactgctggcaggcgctcatagctccttggatattgccagcttctactggactctcaccaataatgacacacacacacaggagccgtccgctcagcagggcgaagaggtgctcagacagctgcaaacgctcgcccctaagggcgtaaatgtccggattgctgtgagtaagcctagtgggccccagcctcaggcagacctgtag

SEQ ID NO: 44844 - DNA, 390 bp, Artificial Sequence
  Description of Artificial Sequence: Synthetic coding sequence
atgaagcccaagctgatgtaccaggagctgaaggtgcccgccgaggagcctgccaatgaacttccaatgaatgagatcgaggcctggaaagcggcggagaagaaagcacgttgggttcttttagtcctaatccttgccgtcgtgggctttggggcgcttatgacccagctgttcttgtgggagtacggggatctccaccttttcggacccaaccaaagacccgccccctgttatgacccatgcgaggccgtcttggtggagtctatacctgaaggtctagatttccctaatgcgtcaacggggaacccgagcaccagtcaggcctggttgggcttactggccggcgctcactcgtcgctggatattgcctcattttactggactctttag

SEQ ID NO: 44845 - DNA, 1473 bp, Artificial Sequence
  Description of Artificial Sequence: Synthetic coding sequence
atgaagcccaagctgatgtaccaggagctgaaggtgcccgccgaggaaccggccaacgagctgcctatgaacgagatcgaggcttggaaagctgctgagaagaaagcacggtgggtcctgttggttctcattttggccgtcgtcggattcggcgccctgatgacgcagttatttctgtgggaatacggagatctgcatctgttcgggcctaatcaacggccggcaccatgttacgatccctgcgaagcagttctggtcgagtcaatacctgagggcctggactttccaaatgcatccaccggtaaccccagtactagccaggcctggcttggactcttagctggggctcactccagcttggatatagcatcattctattggactctgaccaacaacgatacccacacccaggaaccttccgcgcagcagggagaggaggtcctacgtcagttgcagacactcgcaccaaaaggagtgaatgtaagaattgcagtttctaagccttccgggccgcaacctcaggccgacctccaagcgctgctccagtccggggcccaagtgagaatggtcgacatgcagaaactgacacatggagtcctacatactaaattctgggtcgtggaccagacgcatttctatctcggttcagccaatatggattggcgatccctgacacaggtgaaggaacttggtgtggtaatgtataactgctcatgcctggcaagagacctgactaagatctttgaggcctattggttcctaggccaggccggatcttcaattccaagcacatggccccggttttacgacacccgttataatcaggaaaccccaatggaaatttgcttaaacggaacgcccgcactggcctatttagcctccgcaccaccacccttatgtcctagcggacgaacccccgatcttaaagccctcctgaacgtggttgataacgcgaggtcattcatctacgtcgccgtgatgaattatttgcccactctggagttttcacaccctcatcgattttggccagcaatcgatgacggcttgagacgcgcaacctacgaaagaggtgtgaaagttagacttctgatctcctgctggggtcacagtgaaccttctatgcgagcttttctcctcagcctcgccgccctccgagacaatcacacacacagcgacatacaggtgaagctttttgtggttccagcagatgaggcacaggccaggattccctatgctagggtgaatcataacaagtacatggtcaccgagagggccacatacatcgggacaagcaactggagcggcaattacttcaccgagacggcgggaactagcctgcttgtgacccagaatggcagaggaggactccgtagtcaactggaagctatctttttgagggactgggattccccgtatagccacgacctggacacctcagcggacagtgtgggcaatgcatgtcggctgctgtag

SEQ ID NO: 44846 - DNA, 1473 bp, Artificial Sequence
  Description of Artificial Sequence: Synthetic coding sequence
atgaagcccaagctgatgtaccaggagctgaaggtgcccgccgaggaacctgcaaacgaactgccaatgaacgaaattgaggcatggaaggccgcagaaaaaaaagctagatgggtgctcttggtcctgattcttgctgtggtgggttttggcgcactgatgacccagctatttctatgggagtatggagacctccacctctttggtccaaaccaaaggcctgccccctgctacgacccatgcgaggctgttcttgtggagagcattcctgaggggctagacttccctaacgccagcacaggcaacccgtcgacgtcccaggcctggctggggctcctggccggcgctcacagtagtctggatatcgcatctttttactggacactaactaacaatgatacccacacacaagagccttcagctcagcagggagaagaagtgctccggcaactgcagacgctggcccccaaaggcgtcaacgtgcgaatcgctgtatccaagccttcaggcccccagccccaagccgatctccaggctctgctccagagcggagctcaggtccggatggtggacatgcagaaactgactcatggagtactgcacacaaaattctgggtcgtggatcaaacacatttttacctggggtccgctaacatggattggcggagtctcacccaggttaaagagttgggcgtggtaatgtacaactgctcgtgccttgcccgcgaccttactaaaatcttcgaagcctattggttcctggggcaggctggttcgagtattccttccacctggcccagattttacgacacccggtataaccaggaaactccgatggagatttgcctgaacgggacccccgcattggcatacctggcatcagcccctcctccgttgtgcccatctggccgcacaccagacttgaaggcccttctgaatgtcgtcgacaatgcacgttcatttatctatgtggcagtgatgaactatttgcccaccctcgaattctcacaccctcaccgattttggcccgctattgatgatggcctacggagggctacctatgaaagaggggtcaaagtcagacttcttatctcatgctggggacactccgagccatccatgcgcgcctttctgttgagtctcgctgctctccgggacaatcacactcactctgatattcaggtgaaattatttgtggtgcccgcagatgaggctcaggcccgaattccctatgcccgggttaatcataataagtacatggtgactgaacgggccacgtacattggaacatctaattggagcgggaactatttcaccgagacggctgggacatcattgctagttacccagaacggacgcgggggtctgcgaagccagctggaggccattttcctgcgagactgggattcgccatattctcatgatctcgacacctcggccgactcagtggggaatgcctgtcgacttctgtag

SEQ ID NO: 44847 - DNA, 1473 bp, Artificial Sequence
  Description of Artificial Sequence: Synthetic coding sequence
atgaagcccaagctgatgtaccaggagctgaaggtgcccgccgaggagccagctaacgagttgccaatgaatgagatagaagcctggaaggcagccgagaagaaagctcgctgggtactcctcgtactgatcctggcagtggtgggcttcggcgcactcatgacacagcttttcttgtgggaatacggcgatctgcatctgtttggcccaaatcagcggccagccccttgctatgatccatgtgaagccgttctggtagagtccatccccgagggcctggatttcccaaacgcttcaaccggaaacccttcaaccagccaggcttggttaggtcttctagcgggggcccatagctctctggatatagcttctttctactggactctgactaacaacgacacgcacacccaggagccctctgcacagcagggagaagaggtgcttcgccaactgcagacacttgcccccaagggcgttaacgttcgtattgcggtaagcaagccctccggcccacagccccaagccgatctgcaagctttacttcagtccggagctcaagtccgtatggtggatatgcagaagttaacccacggcgttctgcataccaagttttgggtcgtggaccagacgcacttttacttaggaagcgcgaatatggactggaggtctctgacacaggtaaaggaactcggcgtggtgatgtacaattgctcctgtttggcacgggaccttacgaaaatttttgaagcatattggtttcttgggcaggccgggtcctcgatcccttctacctggcccagattttacgataccagatacaatcaagagactcctatggagatttgtctcaacgggacccccgctctggcatatttagcatcagcgccaccgcctctctgcccatcagggaggacaccagatcttaaggcactgcttaatgttgttgataatgccaggagcttcatctatgtggcagttatgaattacctgcccaccctggagttcagccatccgcatagattctggccagctatcgacgatggactaaggcgggcgacgtacgagaggggagtgaaagtgcgccttttaattagctgctgggggcacagcgagccttccatgcgcgctttccttctgtccctagctgcgcttcgcgacaaccatacccattcggacattcaagttaaattgttcgtcgtgcctgccgacgaagcccaggcccgtatcccatacgctcgcgtcaatcacaataagtacatggtgaccgaaagagcaacctatatcggtaccagcaattggtccggcaattacttcacggagacagcggggaccagtctactggtgacacagaatgggcggggcggactgagatcacagctggaagcgatctttttgcgtgattgggactcaccttattctcatgatctagacacgtccgcggattctgtgggcaacgcttgcagactcttgtag

SEQ ID NO: 44848 - DNA, 1473 bp, Artificial Sequence
  Description of Artificial Sequence: Synthetic coding sequence
atgaagcccaagctgatgtaccaggagctgaaggtgcccgccgaggagcccgctaacgaactgcccatgaatgagattgaagcctggaaggctgcagagaaaaaagcacgctgggttctgctagtattaatcctagctgtggtgggtttcggggccctgatgacgcaactgtttttgtgggaatacggcgatctgcatctcttcgggcctaaccagagacctgccccctgctatgacccgtgtgaggccgttctcgtcgagtccatcccagaggggctggattttccaaatgccagcacagggaacccctctacaagccaggcctggcttggcttgctggctggcgctcactcctctctcgacatagcttctttttactggaccttgacaaacaacgatacccatacgcaagagccgtctgcacagcagggcgaggaagttctgagacagcttcaaacgctagcacccaaaggcgttaatgtgcgcattgcggttagcaaacctagcggcccccaacctcaggcagatctccaagctctgctgcagagcggcgcccaagtgcgaatggttgatatgcagaagctcactcacggggtcttgcataccaagttctgggtggtggaccagacgcacttctacctgggctcagccaacatggactggaggagcctcacacaggtgaaagaactgggggtggtaatgtacaattgttcctgtttggccagggaccttacgaagattttcgaggcgtactggttcctgggccaggccggcagcagtatcccttctacctggccacgattctacgacacacggtacaatcaggagacaccaatggaaatctgccttaatgggacacccgccctggcctacctggctagcgcgccaccacccctgtgtccttccggcagaacacccgatctcaaggccctccttaacgtggtcgataacgcccgttctttcatctacgtcgcagtgatgaactaccttcccacgctcgagttttctcacccccacagattttggccagccattgatgacgggcttcgccgtgctacctatgagaggggtgtcaaagtccggctgttaatcagctgctggggacactcagaaccgtctatgcgcgctttcctgctaagtttggcagcgcttcgcgacaatcacactcatagcgatattcaggtgaagttattcgtggttccagccgatgaagctcaagcccgcatcccatatgctcgtgtaaatcacaacaaatatatggtcaccgaaagggcaacttacatcgggacgtccaactggtccggcaactactttaccgaaacagcaggcacttctctcctggtgacccaaaatgggcgcggaggactgcggtcccagttggaggccatcttcctgagggactgggactcaccgtattcccatgacctcgatacctccgccgacagcgtcggcaatgcatgtaggttactgtag

SEQ ID NO: 44849 - DNA, 1209 bp, Artificial Sequence
  Description of Artificial Sequence: Synthetic coding sequence
atgaagcccaagctgatgtaccaggagctgaaggtgcccgccgaggagcccgctaacgagttgccaatgaatgaaattgaagcgtggaaagcggccgaaaagaaggctcgttgggtgctactcgtgctcatcctggctgttgtgggctttggggcattaatgactcaactcttcctatgggaatacggcgacttacatctcttcggccccaatcaacggccagccccatgctacgacccatgcgaggcagtgctggtagagtctattcctgaaggcctgctcgctggtgctcatagcagcctggacatcgccagtttttattggaccctgacaaataacgacacacatacgcaggaaccctcagcacagcagggagaggaagttctgagacagttacagaccctggccccgaagggggtaaacgtgaggatcgcagtatcgaagccaagcgggccacagccacaggctgatctgcaggctctcctccagtccggcgcccaggtccgcatggtcgacatgcagaagctgacccatggtgtcttgcacaccaagttttgggttgtagaccaaactcatttctatttaggatccgctaatatggattggagatcactcacgcaagttaaagaactcggcgtcgttatgtataactgctcatgcctggccagagatttgacaaagatattcgaggcttactggtttctgggccaagccggctcctccattccctccacttggccacgattttacgacaccagatacaatcaagaaacgcccatggagatttgcttgaacgggacccccgcccttgcgtatctcgcgtccgcgcctccccctctgtgtccctcggggcggacgcccgatctgaaggcgttacttaacgttgtcgacaatgcgcggagttttatatacgttgctgtcatgaattatctcccaacattagagttcagccacccacaccggttttggcccgctatcgacgatggcctcaggcgcgctacgtacgagcgcggagtgaaagttagactgcttatttcctgctggggccacagcgaaccatctatgagggcctttctgctgagcttggccgctctacgagataaccatactcactctgatatccaggtaaagttgttcgtggtacctgctgacgaggctcaggcactgtcacctgcattaccaccactgccgccgccccctccagcctag

SEQ ID NO: 44850 - DNA, 1521 bp, Artificial Sequence
  Description of Artificial Sequence: Synthetic coding sequence
atgctgaagcccctgtggaaggccgccgtggcccccacctggccctgtagcatgccacctaggagaccttgggatagagaggcaggaaccctacaagtgttgggcgccctagccgtgctttggctcggatccgtggcactgatatgcctactgtggcaggtaccccgacctcccacttgggggcaagttcagcctaaggatgtgccccgctcatgggaacacggcagctcccccgcttgggaacccttggaggccgaggctaggcaacagagggactcatgccagctggttcttgtagagtcgatccctcaggatctgccttcagctgctggctccccaagcgcccagcccctcggtcaggcctggcttcagctgctggacactgcccaggaatctgtgcatgtggcgtcttactactggtcactcactggacccgatattggagtgaacgattcaagtagccaactcggagaggctctgctccagaaactccagcaacttctcgggcggaacatttcactggccgtcgccacaagctccccaacactggccagaactagtaccgacttgcaggtacttgccgcacggggggcccacgtacgacaggtgcccatgggccggcttacgcgcggggtactacactccaaattctgggtggtggatggcagacacatttacatgggaagcgccaatatggactggaggtccctgacccaggtgaaagagctgggtgccgtcatctataattgcagccatctggcccaggacctggagaagacatttcagacttactgggtactgggagtgcctaaggcagtgctgccaaaaacgtggcctcagaatttcagttcccactttaatagatttcaaccttttcacggcttattcgatggcgtccccacgaccgcatatttttctgcgtctccacctgctctgtgtccacagggacgcacacgcgatctggaagccctgctagccgtgatggggtctgcacaggagtttatttacgcctccgtcatggagtacttccccactacccgtttctctcatcccccaaggtactggcccgtactggataatgctctccgtgctgcggcattcggcaaaggcgttcgagtgagactgctggtgggatgtggcctgaacacagacccaaccatgttcccgtatttacggagtttgcaggccctgagcaatcctgctgctaatgtgtctgttgacgtcaaagtctttatcgttcccgtgggtaaccattcaaacattcccttcagcagagtgaaccacagtaagttcatggttaccgagaaagccgcctatattggcaccagcaattggtccgaagactacttctcgagcacggcgggagtgggactagtggttacccagagccctggcgcccagcccgcaggcgcaaccgtccaggaacaactacgtcagctttttgaaagagactggagcagccgctatgccgtgggattggacggccaggcacctggacaggactgcgtctggcagggctag

SEQ ID NO: 44851 - DNA, 1542 bp, Artificial Sequence
  Description of Artificial Sequence: Synthetic coding sequence
atgcccggctgccccgtgcagatgctgaagcccctgtggaaggccgccgtggcacccacttggccctgttctatgccccctcgccgtccatgggatcgggaggcgggaaccttacaggtccttggcgctctggctgtcttgtggctgggctccgttgctctcatctgcctgttgtggcaggtcccgcgccctccaacctggggacaggtccagcccaaggatgttccgcgatcatgggagcacggctcctctcccgcatgggagccgttagaagctgaagcacgccagcagagggattcctgtcagctggtgctggttgagagcatcccccaagacttaccgagcgccgctggatcaccatccgcacagccattaggtcaggcatggctccagttactggatacagcacaggaatccgtgcatgttgcaagttactattggtctttgaccgggcctgatatcggggtaaacgacagcagttctcagctgggcgaggcactgctccagaagctccaacaacttctgggcagaaacattagccttgctgtagccacaagctcccctacccttgctcgcacttcaacagatctgcaggtgctggccgcacgcggtgcacacgttagacaggttcctatgggacgtttaacgcggggtgtactgcactccaagttctgggtggtagacgggagacatatctacatgggaagcgctaacatggactggaggtcacttacgcaggtaaaagagctcggcgctgtgatctacaattgttcgcatctcgcgcaagacctggaaaagacttttcaaacgtattgggttctgggtgtcccaaaggctgtacttcctaagacctggccacaaaacttttccagccacttcaatcggtttcaacctttccacggactcttcgacggcgttcctactaccgcatacttctccgctagcccaccggccctctgtccacagggtcgcacacgggatttggaggccctcttagcagtgatggggtccgcacaggagttcatctacgcctccgttatggaatattttccaaccacacggttctcacatccgcctcggtactggccggtgctcgataatgctctgcgggccgccgcgttcggaaaaggggtccgggtgagacttctagttgggtgtggcctcaacacagaccctacgatgttcccatacctgagaagccttcaggccctttcgaacccagcagcaaacgtgagtgtagatgttaaggtgtttattgtgccagttggcaaccatagcaacatcccgttttcacgcgtcaatcattccaagtttatggtcaccgagaaggcggcttacattgggacgtccaactggagcgaggattacttttcctcaacggccggcgtgggtctggtcgtcacacagagcccaggtgcccagccggcaggagccaccgtacaggagcagttgcgccagctcttcgagagagattggtcatctagatacgccgtgggcctggatggccaagcgcccggtcaagactgcgtttggcaagggtag

SEQ ID NO: 44852 - DNA, 1425 bp, Artificial Sequence
  Description of Artificial Sequence: Synthetic coding sequence
atgagccagcagaagtgcatcgtgatcttcgccctggtgtgctgcttcgctatactggtggccctgattttttcagctgtggatattatgggggaggacgaagacggactcagcgaaaagaattgtcagaacaagtgtcgcattgccctggttgagaatattcccgagggcctcaactattctgagaacgcccccttccatttgtcccttttccagggctggatgaatctactgaatatggccaagaagtcggtggacatagtgagttcacattgggacctaaaccatacccatcccagcgcttgtcaaggtcagcgtttgttcgaaaaattactgcaactgacctcccagaatattgagatcaagctggtgtctgatgtgaccgccgattccaaggtcctcgaggccctgaaactgaagggtgcagaggtgacatatatgaatatgacagcctataacaagggcaggctccagtcttctttttggatagtggacaaacagcatgtatatattggtagtgctggtctcgactggcaatccttgggacagatgaaagaacttggggtgattttttataattgctcatgccttgtacttgacctccagcggatctttgcgctctattctagcttgaagttcaaatctcgtgtaccacagacatggtctaaacgtttatatggcgtttatgacaatgagaagaagctccaactccagctcaacgagacgaagtctcaggcttttgtgagcaattccccgaagcttttctgcccaaagaatcgctcattcgatattgatgccatatattccgtgattgatgacgctaaacagtatgtctatatcgctgtcatggactacctgcctatttccagcacctctaccaaacggacttactggcctgatctggatgccaaaattagggaggcactggtgctgagatctgtgagagtcagactgctgctgagcttctggaaggaaaccgaccccctgacatttaattttatatcgtccctgaaggcaatctgtactgagattgccaattgctccctcaaggtgaaattctttgatctggagcgggaaaacgcttgtgccacgaaagaacagaaaaaccataccttcccgagactgaatagaaacaagtatatggtgacagacggcgcagcctatattggcaatttcgactgggtgggcaatgacttcacgcagaacgctggaaccggtcttgtgataaaccaggccgacgttcggaataaccgaagcatcattaagcaactcaaggatgtctttgagagagactggtattccccttacgccaagactctgcagcctaccaagcagcccaattgtagttctctctttaagctgaagcctctctctaataaaacagccacagacgatactggaggtaaagatccacgaaacgtctag

SEQ ID NO: 44853 - DNA, 1335 bp, Artificial Sequence
  Description of Artificial Sequence: Synthetic coding sequence
atgcggatggacagccagaagaagatcgccaagatcaacgtgggcaaaaggatcgcactggtggagaacatccccgagggattgaattacagtgagaacgctccatttcatctgtccctgttccagggatggatgaatctgttgaacatggctaagaagtccgtcgacatcgtctccagccattgggatctgaatcatacccatccttctgcctgtcagggtcagagattgttcgaaaaattgcttcagctgaccagccagaacatagagatcaagctcgtgagtgacgttaccgcagacagcaaagttctggaggctttgaagctcaaaggagctgaggtgacctacatgaacatgactgcttataacaagggtagactccagagcagtttttggatagtcgataagcaacacgtttacattggttccgcaggcctggattggcagtctttaggccaaatgaaggagctcggggtcattttctacaattgctcttgcctggtgttagacctgcagagaatatttgccctgtattcgtcgctcaaattcaagagccgtgtgccacaaacctggagtaagaggctctacggggtatacgacaacgagaagaaacttcagttgcagttaaacgagacaaagtcgcaagccttcgtgagcaactcaccaaagctcttttgccctaaaaaccggtcctttgacattgatgcaatatattctgtgatagatgatgcaaaacaatatgtctatatcgctgtgatggattatttgccaatctctagtacaagcacaaagcgcacctactggccagatctggacgcaaagatacgggaggccctcgtgttacgcagcgtacgggtgcggttgcttcttagcttctggaaggagactgaccctctgacctttaatttcatctcatctctgaaggctatctgtacagagatcgctaattgctctctaaaggtgaagttctttgaccttgaaagggagaacgcctgcgcaacgaaggagcagaaaaatcacaccttcccacggctgaataggaataaatatatggtgaccgacggcgcggcatatattggtaactttgattgggtgggcaatgatttcacccagaatgctggaaccggactcgtcatcaatcaggctgacgtccgaaacaacaggagcattatcaagcagctcaaagacgtgttcgagagggactggtactctccatatgccaagaccctgcaacctactaagcagcccaattgcagtagcctctttaagctcaagcctttatccaacaagacagcgaccgacgacacaggaggaaaagacccacgcaacgtttag

SEQ ID NO: 44854 - DNA, 1611 bp, Artificial Sequence
  Description of Artificial Sequence: Synthetic coding sequence
atggagatccggcagcacgagtggctgagcgccagcccccacgagggattcgaacagatgcgtcttaaaagcaggcccaaggaaccaagccccagtcttacgcgagtgggcgctaacttctactcgtccgtgaaacaacaagactactccgccagtgtttggctcagaaggaaggacaaactcgagcactcgcaacagaagtgtatcgtcatcttcgcactggtgtgctgcttcgcgattctagtggcattaattttctcagccgtggacatcatgggcgaggatgaggatgggctgagcgaaaagaactgtcagaataaatgccgtatagccttggtggagaacattcccgagggcctgaattacagtgagaacgctccctttcacttaagtctgttccagggatggatgaaccttctgaatatggccaaaaaaagcgtggatatagtctcaagccactgggaccttaatcatacccacccgagcgcatgtcagggtcagcgcctgttcgagaagctactgcagttaacgtcccagaatattgagattaaactggtgtccgacgtgaccgccgatagcaaagtcctcgaagccctgaaactgaagggcgcggaagtgacctacatgaatatgacagcatataataagggccggctgcagagcagtttctggatagtcgacaagcagcatgtgtacatagggagtgccggcctggattggcagagccttggccaaatgaaagagctcggagtaattttctacaattgctcctgtctggtgttagacctgcagagaatctttgcgctatacagctctctgaagtttaaatctagggtgccacagacgtggagcaagcgactctatggagtgtacgacaacgaaaagaaacttcagctgcagctgaacgagacaaaaagtcaggccttcgtctctaactcccctaaactattttgccccaaaaacagatcttttgatattgacgcaatctactccgtgatcgacgacgcaaaacagtacgtgtatattgcagtgatggattacctgccaatcagctcaacttctacgaagaggacatactggccagatcttgatgccaagatacgagaggcactcgtgctcagatccgtgagagtccgtttattactttccttctggaaggaaactgacccattgacctttaatttcatctcttccctgaaagctatctgtactgagatcgcaaattgcagtctcaaggttaaatttttcgacctggaacgcgagaatgcctgcgcaacaaaggagcagaaaaatcatacctttcccagactgaacagaaacaaatatatggtgactgatggtgccgcttacatcggaaattttgattgggtcggaaatgactttacccagaatgctgggacaggtctggtcatcaaccaggccgacgtgagaaataatagaagcattatcaagcagctgaaagatgtgtttgagagggattggtacagcccgtatgcaaaaaccctgcaacctacaaagcagccgaattgctctagcctgttcaaattaaaaccgctctccaataaaactgccaccgatgatactggcggaaaagatccaaggaacgtctag

SEQ ID NO: 44855 - DNA, 759 bp, Artificial Sequence
  Description of Artificial Sequence: Synthetic coding sequence
atgggccggctgagctggcaggtggccgccgccgccgccgtgggcctggctctgactctggaggccttgccctgggtgctcagatggctaaggagtcgacgccgtcgtccgcggcgagaggcgctgttctttccaagccaggtcacctgcacagaagccctcttaagagcgcccggcgccgaactggccgagcttcctgagggctgtccctgcggcctgcctcatggtgagtcagctttgtcacgtcttttacgagctctgttggctgccagggcttctttagatttgtgtctgttcgccttctcatctccccagctcggacgggcagttcagcttttacatcagcgcggggtcagagtccgggtcgtgaccgactgtgattatatggctttgaatggcagtcagattgggttgctcagaaaggccgggatacaagtgagacacgaccaggacccaggctatatgcatcacaagttcgctatcgttgataaacgtgtcctgatcaccggcagtttgaactggaccacgcaggccattcagaataaccgcgagaacgtgcttattactgaggatgacgagtacgttcggctattcctggaagagttcgagcggatttgggagcagttcaatcctaccaaatatacatttttcccccctaagaagtcacacggctcatgcgccccccctgtatctcgggccggtggccgtctcctttcctggcataggacctgtggtacctcatctgaatcccagacctag

SEQ ID NO: 44856 - DNA, 528 bp, Artificial Sequence
  Description of Artificial Sequence: Synthetic coding sequence
atgggccggctgagctggcaggtggccgccgccgcccggggcgccgtgctcccagtctccggagacctttacagagggcccgccgccggtagcggacggggtgccggacgcgctcccagagggctgcctgttcgtcctgccccccggagagaacgcgccaagcctccagccgcttgccctgctggtaggccccgacaacctggcagccttcccgtgcggctgctgcagccagcagctggtcctaggcgtgctgtcgcagcacctgcctggggcgcttctgccgggcgacaccggctacgactccatggtccacagaggcttgctaacagaagtgccgcgcagggcagagatccggggcccgcaaggtcccggcctcggttgcatgccagccaggtatgtcatcgcggccaggaaggtgcgcatcactggcttgcacagctcgaccacgcatctcatcccgagcaacagggcgagtgttctcaccatggaggcaggagagtgagggccgccttctccggcagaatttag

SEQ ID NO: 44857 - DNA, 678 bp, Artificial Sequence
  Description of Artificial Sequence: Synthetic coding sequence
atggtgagccacagcgagctgcggaagctgttctacagcgccgacgcagtctgttttgatgtcgattctaccgtgatcagggaagaaggtatagacgagctcgctaaaatttgcggagtcgaagatgccgtctctgagatgaccaggcgcgccatgggtggagccgtaccattcaaggccgctctgactgagcgtttggctttaatacaaccaagccgcgaacaggtgcagaggttgatcgcagagcagccaccacacctcacccccggcattcgagagctggtgagtcggctgcaggagaggaatgtgcaagtttttttgatatccggtggtttcagatcaattgttgaacacgtcgcttccaagttgaatatacccgccacgaatgtcttcgccaaccggctgaaattttacttcaatggcgagtacgccggtttcgacgaaactcagcccaccgcagagtccggagggaaaggtaaggtgataaaactacttaaggagaagtttcactttaagaagattattatgatcggggacggggcaactgacatggaagcttgtcccccagcggacgcttttattggatttggcgggaatgttatccgccagcaagtaaaagacaacgctaagtggtatatcactgattttgtggagctcctaggggagctggaggaatag

SEQ ID NO: 44858 - DNA, 678 bp, Artificial Sequence
  Description of Artificial Sequence: Synthetic coding sequence
atggtgagccacagcgagctgcggaagctgttctacagcgccgacgctgtgtgtttcgatgtagatagtacagtgatccgtgaagaaggaattgatgaactggctaaaatttgcggagttgaagacgctgttagcgagatgacaaggagggctatggggggggccgtcccattcaaagctgcccttacggaacgactggcactgatccagccttcacgtgaacaggtacaacggttgatcgccgagcagccaccacacctgacacccgggatcagggagctggtgagccggctgcaggagcgtaacgtgcaggtgttcctgattagcggcgggtttcggtctatcgtcgaacacgtcgcatcgaaacttaatatccctgccactaacgtgttcgcaaataggctgaagttctatttcaacggggaatacgccggttttgatgaaacacagcctaccgcggaatccgggggcaaaggcaaagtgatcaaactgttgaaggagaaatttcattttaagaaaattattatgattggcgacggcgccaccgatatggaagcatgtcccccagcggacgctttcatcgggtttgggggcaatgtgattcgccagcaggtgaaggataacgctaaatggtacatcacagatttcgtagaactgctgggggaactggaggaatag

SEQ ID NO: 44859 - DNA, 9 bp, Artificial Sequence
  Description of Artificial Sequence: Synthetic coding sequence
atggtgtag

SEQ ID NO: 44860 - DNA, 9 bp, Artificial Sequence
  Description of Artificial Sequence: Synthetic coding sequence
atggtgtag

SEQ ID NO: 44861 - DNA, 141 bp, Artificial Sequence
  Description of Artificial Sequence: Synthetic coding sequence
atggtgagccacagcgagctgcggaagctgttctacagcgccgacgcggtgtgcttcgacgtggacagcactgtcattcgcgaagaaggcatagatgaactggctaagatctgtggcgtggaagacgctgtgagtgaatag

SEQ ID NO: 44862 - DNA, 141 bp, Artificial Sequence
  Description of Artificial Sequence: Synthetic coding sequence
atggtgagccacagcgagctgcggaagctgttctacagcgccgacgctgtttgctttgatgtcgattctactgtgatcagggaggagggcatcgacgaactggcaaagatttgtggagtcgaggacgcagtgagtgaatag

SEQ ID NO: 44863 - DNA, 564 bp, Artificial Sequence
  Description of Artificial Sequence: Synthetic coding sequence
atggtgagccacagcgagctgcggaagctgttctacagcgccgacgccgtttgtttcgatgtggattctaccgtgatccgtgaagaggggatcgatgaattggctaaaatctgcggcgttgaagacgctgtcagcgagatgacgaggcgagccatgggcggcgccgtgcccttcaaggcagcgctgactgaacgtctggccctgattcaacccagtagagagcaggttcagcgccttatcgctgagcagccccctcacctgacccctggtataagagaacttgtgagcagactacaggagcgaaatgtccaggtctttctaatctcaggcggttttcgctccatcgtggagcacgtggcctccaaactgaatattccagccaccaacgtgtttgccaacaggttaaaattttactttaatggggaatacgcggggtttgacgagacacagccgactgctgaatctggcggaaagggcaaggtgattaaactgctgaaggaaaagttccattttaaaaaaataataatgataggtgacggggccacagacatggaggcctgctag

SEQ ID NO: 44864 - DNA, 33 bp, Artificial Sequence
  Description of Artificial Sequence: Synthetic coding sequence
atggtgagccacagcgagctgcggaagctgtag

SEQ ID NO: 44865 - DNA, 678 bp, Artificial Sequence
  Description of Artificial Sequence: Synthetic coding sequence
atggtgagccacagcgagctgcggaagctgttctacagcgccgacgccgtgtgtttcgatgtcgacagcacggtgattcgcgaagaaggcatagatgagctagctaaaatatgcggtgtggaggacgctgtaagtgaaatgactcgacgagctatgggtggcgcagtcccgttcaaggctgcgttaacagagcggctcgctctgattcagcctagtagggaacaggtgcagcgcctgattgctgagcagcccccgcacctgacacctgggattcgcgagttggtaagcaggttgcaagaaaggaatgtgcaagtattcctgatctctggaggctttcgctccatcgtcgaacacgtagcctcaaaactcaatattcctgccactaacgtatttgcaaaccgtctcaagttctatttcaacggggagtatgctggtttcgatgaaacccagcctacagctgagagcggagggaaaggtaaggtgataaagctccttaaagaaaagttccactttaagaagattatcatgatcggcgatggcgccacagatatggaggcctgtccgcccgccgacgcctttataggctttgggggaaacgtgattcgacaacaagtgaaggacaacgctaagtggtacataaccgacttcgtggagctgctcggcgagctcgaggagtag

SEQ ID NO: 44866 - DNA, 1047 bp, Artificial Sequence
  Description of Artificial Sequence: Synthetic coding sequence
atgaagaccgccgagaacatccggggcaccggcagcgacggcccccgcaagcgcgggctatgcgtactgtgtggactcccagccgcagggaaatctacgttcgcccgggcacttgcgcaccgcctccagcaagaacaggggtgggctattggggtcgtcgcctacgacgacgtgatgcctgacgcctttttagcgggcgcgagggccaggcccgcgccttcccaatggaaactacttcgccaggaacttctgaagtatcttgagtatttcctaatggccgtgatcaacggttgccagatgtccgttccccccaatagaacagaggctatgtgggaggattttataacctgtcttaaagaccaggatttaattttttctgccgccttcgaggcccagtcctgctatctgctgacgaaaacagcagtgagtaggccgctctttctggtgctggacgataacttttattaccagagtatgaggtacgaagtgtatcagctggctaggaagtactctttaggattctgtcagctatttctcgattgcccactggagacatgcttacaaagaaatggacagagacctcaagctctgcctccagagactatccatttgatggggaggaaattagagaagcctaatccagagaaaaatgcgtgggaacataattccctcacaatcccgagcccagcctgcgcgagcgaagcctccctggaggtgacagacctcctgcttaccgccttggagaatccggtgaaatacgcggaagataacatggagcagaaggatacagatagaatcatttgtagcactaatattttacacaaaacagaccagactctgaggcggatcgtgtcccaaacaatgaaagaagcaaaaggtaatcaggaggccttctctgagatgactttcaagcagcgctgggtgagggccaaccacgctgcaatctggagaattatcttaggcaacgaacacataaaatgccggtctgcaaaggtgggatggctccagtgctgccgaattgagaagcgccctttaagcacgggctag

SEQ ID NO: 44867 - DNA, 870 bp, Artificial Sequence
  Description of Artificial Sequence: Synthetic coding sequence
atgaagaccgccgagaacatccggggcaccggcagcgacggccccagaaagcgtggcctgtgcgtgctctgcggcctcccggcagccggcaagtcgacatttgcgcgcgccctcgctcatagactgcagcaagagcagggctgggccattggtgtggtggcgtacgacgatgtcatgccagacgcattcctggcgggagctcgggctagacctgccccttcccagtggaaacttcttcgccaagagctcctaaaatatcttgaatactttttaatggctgtaatcaatggatgccaaatgtccgtgccgcccaacagaaccgaggcaatgtgggaggattttataacttgtctcaaggaccaggacctcattttcagcgccgcctttgaggcccagagctgttatctactgaccaagacggcagtttcgagacctctcttcttggtcttagatgacaacttttattaccaaagtatgcggtatgaagtttaccagctggcccgtaagtactcactaggcttttgtcagctgtttcttgactgccccttagagacctgcctgcaaaggaacggacagcgtccgcaggcactgcctccagaaacaatccaccttatgggcagaaaactcgaaaaacccaatccagagaaaaacgcttgggagcataatagtttaactatcccaagccctgcctgcgccagcgaagcttccctcgaggtgaccgacctcctcctgaccgccctcgagaatccggtgaagtatgcggaggacaatatggagcaaaaggtgaattttcagtgcaagtttaatgtcaacgagaaggagcaactgttcgttggaaggtctttcgaacccaatatcaagtgtgagtag

SEQ ID NO: 44868 - DNA, 1080 bp, Artificial Sequence
  Description of Artificial Sequence: Synthetic coding sequence
tgaatgaagaccgccgagaacatccggggcaccggcagcgacggcccaagaaaacgcggcttatgtgtgctctgcgggcttccagccgccggtaagtcaacattcgctagagcactagcccacaggctacagcaggagcagggatgggctatcggggtggttgcctacgacgacgtaatgcccgatgccttcttggctggcgccagggcccgcccggcacccagccagtggaagctactacggcaggagctattaaagtacctggagtattttcttatggccgtcatcaatggttgccagatgagtgtacccccgaaccggacggaggccatgtgggaagattttatcacttgtttgaaagaccaggacctgatattttccgcggcctttgaagctcagtcatgttacctgttaacaaagaccgcggtgtcacgccccctattcttagtcctggacgacaacttttattatcagtccatgcggtacgaagtgtaccagctggcgagaaagtattccctgggcttctgccaactgtttctggactgtcctctggagacgtgcttgcagagaaatggacagcgcccccaggctcttcccccagagactatccacctgatggggcgaaaactcgaaaagcccaatcctgaaaaaaacgcttgggagcacaatagcctgaccatcccatcaccagcttgcgcatccgaagccagtttggaggtcactgacctgctgctgacggccctggagaacccggtgaagtacgcagaggacaacatggagcagaaggacaccgatcggataatctgcagcacaaatattcttcacaaaacggatcagacgcttcgcaggattgtctctcagaccatgaaggaggccaaagacgagcaagtgctaccccacaacctcaaactgctcgccgaagagctcaataagttaaaggcggagtttctggaagacttaaagcaaggcaacaagaaatatctgtgcttccaacagacaattgatatccccgatgtcataagttttttccactacgaaaaggacaatatcgtacagaagtatttcagcaaacagcattag

SEQ ID NO: 44869 - DNA, 7566 bp, Artificial Sequence
  Description of Artificial Sequence: Synthetic coding sequence
atggagccccacgtgctgggcgccgtgctgtactggctgctgctgccctgtgccctgctcgcagcatgcttgctgagattcagtggcttatccctggtttatctcctgttcctcctccttctcccttggttcccggggcccaccaggtgcggtcttcaggggcacaccggacgcctcttgcgcgcactgcttggccttagcctgctatttttggttgctcacctggcattgcagatttgcctacacattgtgcctcgcctggatcagttgctgggcccttcctgtagccgctgggagacgctaagtcggcacataggcgtgaccaggttggatctgaaggacatcccaaacgctatccggctcgtagcaccagatctaggtatactcgtggtgtcttccgtctgtctgggaatctgcggtaggctcgccaggaacacccgccagagtccacacccacgggaactggatgacgacgaacgggatgtggacgcaagcccaacggcgggcctccaggaagcagccaccctagctcccacaagacgctcccggctggcggcccgcttcagggtcacagcccattggctcttagtagctgccggacgcgtgttggccgtgaccctgctagcgctggcagggatagcacacccatccgcactgtccagtgtatatctgttactttttttggctctttgtacatggtgggcgtgtcatttcccaatctccactagaggcttctctagactttgtgtggccgtggggtgttttggagcagggcatctcatctgtctgtactgctaccaaatgccgcttgctcaggctctgctacccccggctggcatctgggctagggtgctcggtctgaaggacttcgtcgggccaacgaactgctcaagtccacatgctctcgtcctaaatacaggcctcgattggcccgtttatgcatcccccggagtgctgctgctgttgtgttacgccaccgcctccctgcgcaaactgcgtgcctacagaccatccgggcagagaaaggaagccgcaaaaggatatgaggcacgggagctcgagctagcagaactggatcaatggccacaggagagggagtccgatcagcacgtggtaccgaccgcaccagataccgaggcagataattgcatagtgcatgagctgaccggccaaagctctgtactccggcggcccgtcaggcccaaaagggccgagcctcgggaagcaagtcccctgcatagcctcggtcaccttatcatggaccagtcatatgtgtgcgcactgatcgcaatgatggtgtggtctatcacctaccactcttggctgacattcgtactgctcctttgggcatgtttaatctggacggtgagatcccgtcaccagttggccatgctgtgtagcccgtgcattctgctgtatggcatgaccctttgttgcctccgctacgtgtgggccatggacctccgccccgagcttcccacaacacttggtcccgtatcacttcgtcaactgggattggaacacacgcgttacccttgcctggacctaggtgccatgcttctgtacaccctgacattttggctactgctccgacagtttgtaaaagaaaaactgttaaaatgggccgaatcccccgctgcgttaacggaagtgacagtcgctgatactgaaccaacaagaacccagacacttctacagagcctgggcgagctcgtcaaaggcgtgtacgccaagtactggatctatgtctgtgcaggcatgtttattgttgtcagtttcgcaggacgacttgtggtgtataagattgtgtatatgttccttttcctcttgtgtcttactcttttccaggtctattactcactgtggagaaaacttcttaaagccttttggtggctcgttgtggcctacactatgctggtgctcatcgctgtttacacatttcagttccaggactttcccgcttattggaggaacttgacaggctttactgatgaacagttgggtgacttaggcctagagcagttttccgtgtcagaacttttttcctccattttagttccaggcttttttttgctggcgtgcattcttcagctgcactattttcataggccctttatgcagctgaccgatatggaacatgtatccttgcccggcacaaggctgccccggtgggcacacagacaagacgcagtcagtggtaccccactgcttcgggaagaacagcaggagcatcagcagcagcagcaggaagaggaggaggaggaagaggactccagggacgagggcctgggggtagctactccacaccaggctacccaggtgcctgagggagcagctaagtggggcctcgtggccgagaggttacttgagctcgcagctggcttttcagatgtgctcagccgagtgcaggtttttctaaggaggctgctggaactgcatgtgttcaaattagtcgcactctatacagtctgggtggccttaaaggaagtgtccgtgatgaatttactacttgtcgtcctgtgggcgttcgccctgccttacccaaggttcaggcccatggcttcttgcttatccactgtttggacttgtgtgatcattgtgtgtaaaatgctctaccagctgaaggtcgtgaatccacaggagtactcgtcaaattgcacagaaccattccctaattccacgaatttgctgcctacagagatatctcagtccttgctctaccggggacccgtcgacccagcaaactggttcggggttcgcaaagggtttcccaatctgggttatattcaaaaccacctgcaggttctcctgttattggtctttgaagcaatcgtgtacaggaggcaggagcactaccgcagacagcaccagctggccccccttccggcccaagccgttttcgcatcagggactcggcagcaactggaccaggacctgctggggtgcctcaagtatttcattaattttttcttctacaagttcggcctcgaaatctgttttttgatggctgtgaacgttatcgggcagcggatgaactttttggtgacattgcacgggtgttggctcgtcgctattctgactcgcaggcatagacaggcaattgcgcgactgtggcccaattattgtctgttcctagcactcttcttactttatcagtatctgctctgtcttggcatgccccccgccctatgcattgactacccttggagatggagccgagcagtgcctatgaactcagcactgatcaagtggctgtacttgcccgattttttcagggccccgaacagcaccaacctgatttcggattttctgctcctcctctgcgcctcccagcagtggcaggtgtttagtgctgaacgaacagaggagtggcagaggatggccggggtgaatactgatcgtttagagcccctcagaggcgagcccaaccccgtgcccaattttatacactgtcggtcttatctggacatgttaaaggtcgccgtctttcgctatcttttctggttagttctggtggttgtctttgtcaccggtgccaccagaattagtattttcggcctgggctatctcttggcctgtttttacttgctgctctttggtacggctctgctccagcgagatacgcgagctcgactggtactgtgggattgtcttatcctctataatgtgacggtgattatatccaagaatatgctaagtctgctggcctgtgtcttcgtggaacagatgcaaaccggcttttgttgggttatacagctctttagtctcgtctgcacggtgaaggggtattatgatcctaaagagatgatggaccgggaccaggactgcttgctgccagtcgaggaggctggtattatatgggacagtgtgtgttttttctttctccttcttcagcgtagagtcttcctgtcccactactacctacatgtccgcgccgatctgcaggccaccgccctactggcctctcgtgggttcgcgctgtataacgcggcaaatcttaaatccattgacttccataggcggattgaggaaaagagtctcgcacagttaaaacggcagatggaaaggattcgcgccaagcaggaaaagcatagacagggcagggtggatcgctcaagacctcaggacaccctggggcccaaggaccctggactcgaaccagggccagacagtcccggcgggtcatcccctccgcgcaggcagtggtggaggccctggctggaccacgcaacagtaattcattccggcgactacttcttgtttgaatctgattcagaggaggaggaggaggccgtgcctgaggaccctagacccagcgcccagagcgcattccagctcgcctaccaggcttgggtcactaatgcccaggctgtcttaaggagacggcagcaagagcaagaacaggccaggcaggaacaggccgggcagcttccgaccggcggaggaccaagccaagaggtggaacccgcggaggggcctgaggaggcagcagctggaaggagccacgtggtccaacgggtactgtccactgcccagttcctttggatgctgggccaggcactggtggacgaactgactagatggttgcaggaatttacaagacaccatggcacaatgtctgatgtcttaagagctgagaggtatttgttgacacaagagctgttgcagggaggggaagtacacaggggggtgctggatcagctgtacacatcccaggctgaggccacgctcccgggcccaacagaggctccaaatgctcccagcaccgtgtcctccggcctaggagcggaggaaccgctgtcttccatgacggacgacatgggatctcccctcagcactggctatcatacaagatctggcagtgaggaagcagtgacagaccctggggaacgcgaggctggcgcatcactgtaccaagggctaatgagaacagcatcagaattgctgctggacaggcggctaaggattcctgagctggaggaggcagaactctttgccgaagggcaggggcgcgcgctccgcctgctcagagctgtgtatcagtgcgttgcggcccactcagagctgctgtgttattttatcatcatcctgaatcacatggtgactgcttccgccggcagccttgtactcccggtgctggtgttcctgtgggctatgctctcaattccccggccgagcaaaagattttggatgacagcaattgtgtttactgagatcgcagtcgtcgtgaagtaccttttccagtttggatttttcccatggaatagccacgtggtcttgcggagatacgagaataaaccatacttcccgcctagaatcttggggttggagaagacggacggatatattaaatacgatctggtccagctaatggcgctgttcttccaccgctcccagctgctatgctatggtttatgggaccatgaggaggactctccgagtaaggagcacgataaaagcggtgaagaggagcagggcgctgaggaaggcccaggggtgccagcagcaactaccgaagatcatatccaagtggaggccagggtcggtcctaccgacgggacccctgagccacaggtcgagctccgacccagggacacaagacgtatttctttacgtttcagaagacggaagaaggagggcccggctagaaagggagctgcagctatcgaggcagaggaccgggaggaggaggagggtgaagaggagaaggaggcccctacaggccgcgaaaaaaggccatctcgcagcggaggaagagtgcgagccgctggccgtaggctgcagggcttttgcttgtccttggcccagggaacctaccggcccctcaggcgctttttccatgacatcctccataccaagtaccgcgcagccacggatgtttacgccctgatgtttttggcggacgttgttgatttcataatcattatattcggcttttgggccttcggcaaacacagcgctgccacggacattacgtcctctctgtcagatgatcaggtgcccgaagcctttttggtgatgctcctgatccagttttcaaccatggtcgttgacagagctctctatctcaggaaaacggtgctcggcaagctggcctttcaggtagcacttgtgttggctatacatctatggatgttctttatcctgccagcagtgaccgaacggatgttcaaccagaacgtggtcgcccaactgtggtattttgtgaaatgtatttactttgccctgagcgcctatcaaattagatgtggctaccctacacggattctgggcaacttcctgacgaaaaaatacaaccatcttaacctgttcctgttccagggctttcgcttggtgccgtttctcgtggaactgcgagcggtcatggactgggtttggacagacacaacactgtccctgagcagctggatgtgtgttgaggacatctatgccaatattttcataatcaagtgttccagagagaccgagaaaaaatatccacagcctaagggccaaaaaaaaaaaaaaattgttaaatacgggatgggtggcctgatcattctgttcttaatagcaattatttggttccctctgctcttcatgagtctcgtgagaagcgtcgtgggggtcgtaaatcagcctattgatgttactgtgacacttaaacttggaggctacgagccactattcactatgagcgcacagcagccctccatcatcccctttactgcccaggcatatgaggaactgagccgccagttcgaccctcaacccctggccatgcagtttatcagccagtacagcccagaggatatagtgaccgctcagatagaaggcagttcaggggctctttggcggatctcccccccctccagggcccagatgaaacgggagctgtacaacgggacggccgacattacactgcgcttcacatggaattttcagcgggacctggccaagggcgggactgtggaatatgctaacgaaaaacacatgctggctctggcccccaattctactgcccgacggcagctagcctctctgctggaaggtaccagtgaccagtctgttgtgataccaaacctgttccccaaatatatccgggcccctaatggtcccgaggccaatcccgttaagcagcttcagccgaatgaggaagcagattacttaggggtcaggatacagctacgccgcgagcagggcgctggggcaactggctttcttgagtggtgggtcattgagttacaagagtgtaggaccgattgtaacttacttccgatggtcatattttctgacaaagtgtctccgccatccctcggattcttagccgggtacggtatcatgggactgtacgtgtccattgttcttgtcatcggaaagtttgtccggggatttttttcagagatatctcatagcatcatgtttgaggaattgccttgtgttgacaggatcttgaagctatgtcaggatatcttcctggtgagggagacccgcgagctggagctggaagaggagctctacgcgaagcttattttcttgtatagatctccggaaaccatgatcaagtggacccgggagaaggagtag

SEQ ID NO: 44870 - DNA, 1122 bp, Artificial Sequence
  Description of Artificial Sequence: Synthetic coding sequence
atgaagatctgccccttcagcagcaagagcagcatcgtgctggccctcaagtttcgttcgctgatacacttcgagaagtacccccaacccaaagggcagaagaagaagaaaatcgtcaagtacggaatgggtggcctgattatcctgtttctgatagccattatctggttccccctgttgtttatgagcctcgtgcgaagtgtcgttggtgtcgtgaaccagccaattgacgtcacagtcacacttaaactgggaggctatgagccactttttaccatgagtgcccaacagccttcaatcatcccctttaccgcccaggcgtatgaagaactctccagacagttcgaccctcagccgctcgcgatgcagtttattagtcagtatagtccagaagatatcgtgaccgcacagattgagggatctagcggcgcactatggcggatctctccaccgagtcgggcacagatgaaaagagagctctacaatggaactgctgacatcacgctgcggtttacgtggaacttccagcgggatctggctaagggcggcaccgttgagtacgccaatgagaagcacatgctggcactggcaccaaacagcaccgccaggcgccagcttgcaagtttgttagagggtacatctgatcagtcggtggtgatccccaatctcttcccgaaatacatccgggcacctaacggccccgaggcaaaccctgttaaacagctacaaccaaacgaggaggcggattatttgggcgtccggattcaactgcggcgagagcagggtgcaggggccacgggcttcctcgagtggtgggttatagaacttcaagaatgccgcaccgactgcaacttactccctatggtgatcttctcggataagcatcatggcgcagtgcgcgtgcaccgggccgggcacaggcaggtgagagctcgcatcctccaacgtgacctcgcattacactacgtgcgaggggcagctgtaaggggcccccacccccaggccctccctggccaccttccaggggctggagattccggagcgggagccgggggcggcgtagtacgtcaggcccatctgcccctgcctctgaccggagatcatgatcaagtggattcctag

SEQ ID NO: 44871 - DNA, 7404 bp, Artificial Sequence
  Description of Artificial Sequence: Synthetic coding sequence
tgaaccggccggctgctgcgggccctgctgggcctgagcctgctgttcctggtggcccacctggcactgcaaatttgtctgcacattgtgccccgccttgaccaacttctgggcccttcatgctcccgatgggaaacactgtcaagacacatcggcgtgacacgacttgacctgaaggacattcccaacgccattaggctggtagctccagaccttggaatcttggtggtaagtagtgtctgccttgggatctgtggacggctggcaagaaatacgaggcagtccccccatcccagagaactggatgatgatgagcgagatgtcgacgcatctccaaccgcaggccttcaggaagccgcaactttggcccctactcgccgcagcaggttggcggccaggtttcgggtcactgcacattggctgctcgtggcggctggaagggttctggccgtcacactgcttgcactggcgggaatcgcacacccgagcgccctgtctagcgtgtatctgctcctttttcttgccctgtgcacttggtgggcttgccacttccccataagcaccaggggcttctcccgtctgtgtgttgctgttggctgctttggtgctggccaccttatatgcctttactgctaccagatgcctctggcgcaggctcttctccctcccgccggtatctgggcgagagttcttgggttgaaggacttcgtgggaccaactaattgcagttcaccgcatgcgctggtgctgaataccgggctcgattggcccgtctatgcctcgcccggcgtattactgctgttatgttacgctacggcctctttaagaaagcttcgcgcataccggccgtcagggcaacgaaaagaagctgccaaagggtatgaagcccgcgagcttgagctggccgagctggaccagtggcctcaggaacgtgaatcagatcagcatgtagtccccaccgcaccagatactgaagccgataactgtatagttcacgagttaacaggacaaagtagcgttctgcggcgtcctgtgcggccaaagagggccgagccccgggaggcatctcctctgcattctctcggacatctgataatggaccagagctacgtctgcgccttgatcgccatgatggtgtggagcattacctaccactcttggttaacgttcgtgcttctgttgtgggcatgcctcatttggacagtgagatcacgtcatcagctggcgatgctgtgttccccctgcattctgctgtatggcatgaccctgtgctgtctgcggtatgtctgggccatggacttacgacccgaactgccaacaacacttgggccagtttctcttaggcaacttggccttgagcatacacggtacccatgcttggatctcggtgcaatgctcctgtacaccctgacattttggctcctgttgcggcagtttgttaaggaaaaactgttaaaatgggccgagtcccctgccgcactgaccgaggtgacagtggcagacaccgagcccacccgcacacagactctacttcagtccctcggggaactggtgaagggagtttacgcaaaatattggatctatgtgtgcgccggaatgttcatagtcgtttcattcgccggccgcctggtcgtctacaaaattgtatatatgttcctcttccttctgtgtctgacactctttcaggtatattactctttatggcggaagctgttaaaagctttctggtggttagttgtggcttacactatgctcgtcctgatagcagtctacactttccagtttcaggacttccccgcttattggaggaatctcaccggtttcacagatgaacagttgggtgacctcggcctggaacagtttagcgtcagcgagctgttttcctccatcctggtgcctgggttcttccttctggcatgcatcctgcagttacactactttcataggccattcatgcaactcaccgatatggagcatgtttcactccccggaacgcggctcccccgctgggctcatcggcaggatgcagtcagcggtaccccattactgcgcgaggaacagcaggagcatcaacaacagcagcaggaggaagaagaggaagaggaagattcccgtgacgagggtcttggcgtagctacccctcatcaggcgacccaagtgcccgagggggctgccaagtggggtcttgtcgcggagaggctgctggaactggcagctggttttagcgatgtcctctccagggtccaagtattcctgcgccgactgctcgagctacatgtatttaagctagtcgctctgtacaccgtgtgggtcgctctgaaagaggtctctgtgatgaacctgcttttggtggtgctttgggccttcgcacttccctaccctcggtttaggccaatggcttcatgcctttctaccgtgtggacatgtgtgattatcgtctgcaaaatgctctaccagctgaaagtcgtgaacccacaggagtattcttcaaactgtactgagcccttcccaaattcaactaacctactacccaccgagatcagccagagcctgctgtacaggggtcccgtcgatcctgcaaactggtttggcgtaaggaaaggctttcccaacctggggtacatccagaaccatctgcaggtcctgttacttcttgtattcgaagcaatcgtgtaccggaggcaagagcattatcggaggcaacaccagctagcaccccttccagcccaggcagtgtttgccagcgggacgcggcagcagctggatcaagatctgctgggctgtctgaaatattttatcaacttcttcttttataagtttggactcgagatttgcttcctaatggctgtgaatgtgatcggacaacggatgaattttttagtcaccctgcacggatgctggttagtagctatcctaacgcgaagacacagacaagccatcgcaagattgtggccgaactactgcctgtttctggccctttttcttctgtatcagtacctcctctgcttaggcatgcctccggcgctttgtatagactacccgtggcgctggagtagggccgtaccaatgaactccgccctgataaagtggctgtatttgccagatttcttccgtgcacctaattcaacaaatcttattagcgattttcttctgttgctttgtgcctcgcagcagtggcaagtttttagtgcggagaggaccgaggaatggcagagaatggccggtgtcaataccgacagactggaaccactccgaggagagcccaatccagtgcctaacttcattcactgccggagttatttggatatgctgaaggttgctgtttttagataccttttctggctggtccttgtggtcgtctttgtaactggagcaacaaggatcagcatctttgggttaggttatctgctggcatgcttctacctgctgctgttcggcacagccctccttcaacgggacactagggccagactagtgttgtgggactgcctgattctgtacaacgttaccgtgattatctccaaaaatatgttgtccctgctggcttgtgtcttcgttgaacagatgcagaccggattctgttgggttatccaacttttttcactggtttgcaccgtcaaaggatactacgaccctaaagaaatgatggaccgcgatcaggactgccttctaccagtggaagaggctgggatcatttgggactccgtgtgcttctttttcctcctgttgcagaggcgggttttccttagccattactacctccacgtgagagccgatttacaggccactgccctcttggcctcaaggggtttcgctctttacaacgcagctaatttgaagtccattgatttccaccggcgaattgaggagaaatccctggcgcagctgaagcggcaaatggagaggattcgagcgaaacaggaaaaacaccggcaaggacgggtggacaggtctcgaccccaagataccctcgggcccaaggatcccggcctggaaccaggcccagactctcctgggggcagctcacccccgcggcgccagtggtggcgcccatggttagaccacgcaactgtgatccatagtggtgactactttttgtttgagtcagactccgaggaggaggaggaggccgttccagaggacccccgccccagtgctcagtcggctttccaactggcatatcaggcttgggttacaaatgcccaagcggtgctgcgccggaggcagcaggagcaggagcaagccaggcaggaacaagctggtcagctgcctactggcggcgggccttcccaggaagtagaacccgctgaaggacccgaggaggccgccgcaggccgatcccacgtcgtacagagggtgctctcaacagctcagttcttgtggatgctgggccaggccttggtagacgaactcaccaggtggcttcaggaattcacacgacaccacggaacaatgagtgatgtgctcagagccgaacggtacctgctgacccaggaactgttgcaaggtggtgaggtgcaccgaggggtgcttgatcaactttacaccagccaggccgaggcaaccctgcccggtccaacagaggctcctaatgccccatccactgttagttccgggctgggcgcagaagaaccactctcctcaatgacggatgatatgggcagccccctgagtaccggatatcacacacggtctggctccgaagaagcagttactgatcccggagagcgagaggccggtgcgtccctgtaccaggggttaatgaggaccgccagcgaattactcctcgaccgacgcctgagaatcccggaactcgaagaagcagaactgttcgccgagggacagggtagagcgctgcggctgctccgggccgtataccagtgtgtagccgcacactctgaactgttgtgctacttcatcattatactcaatcacatggtaacagcatccgctggtagcttagtgctgccagtgctggttttcctgtgggccatgctgtctatcccccggcccagcaagaggttctggatgacggccattgtcttcaccgaaatcgctgtcgtcgtcaagtatcttttccagtttgggttcttcccctggaattcccacgtggtgctgagacgctacgagaataaaccgtatttccctccgcggatacttggattggagaagaccgacgggtatataaagtatgatctcgtgcagctgatggccctgttcttccatagatcccaactgctgtgttacggactctgggatcatgaagaggactcaccctcaaaggaacatgacaaatcaggagaggaggaacaaggggcggaagagggcccaggggtacccgccgcaaccactgaagaccacatccaagtggaagccagagtcgggcctacagatgggacccctgaacctcaggtggaactgaggccccgggatacccgaagaattagcttgcgctttaggcgccgcaaaaaggagggcccagcaaggaagggtgccgctgccattgaggcagaagacagagaggaagaagagggcgaggaggagaaggaggccccaacagggcgggaaaagaggccctctagatctggcgggcgcgtacgggccgctggtcggaggctccagggcttctgcctgtcccttgctcagggaacttacagaccacttaggaggttttttcacgacatcctgcacacaaaatatagagcagcgacggacgtctacgctctcatgttcctggccgacgtcgtcgattttatcataatcatctttggtttttgggccttcggaaagcactcagcggcaaccgacataacaagctcgctgagcgatgaccaagtgcctgaggctttccttgttatgttgctcatacaattctctactatggtggtggacagagccctgtacctgagaaaaaccgttctgggaaagctagcattccaggtggcactggtccttgccattcacttgtggatgttctttatcctgcccgcggtgacagagcgcatgttcaaccagaacgtagtagctcagctatggtacttcgtaaagtgtatttattttgctttatctgcataccagattagatgtgggtatccaacaaggatcctcgggaatttcctcaccaagaaatacaatcacctaaacctgttcctgttccaggggtttcggctggtaccttttctggtggaactgcgggcagttatggactgggtatggactgacacgacactgtctctgagctcatggatgtgcgtggaggatatatacgcgaacatttttatcattaagtgttccagagagactgagaagaagtaccctcaaccaaagggccagaaaaagaagaagattgtcaaatatgggatggggggactgatcattctattcctcatcgccattatctggttcccactcttgtttatgtctctggtccgatcagttgtgggtgtcgtgaaccagccaatcgatgtgactgtgacactgaaactcggtggatatgagccccttttcacaatgtctgcgcagcagccttctattattccttttacagcgcaggcatacgaagagctcagtcggcagtttgacccccagcctctagccatgcaattcatcagtcagtattcaccagaggatatcgtcacagctcagatcgagggatcatccggcgccctctggagaatctctcccccttcccgcgcacagatgaaacgcgagctgtataacgggacagccgatatcaccctccgcttcacctggaatttccaacgggacctcgccaagggcggcaccgtggagtatgctaacgaaaagcatatgctcgctcttgcaccgaactcaaccgctcgccgacagttagcctccctgttggaggggaccagcgatcaaagcgtcgtgatccctaatctcttccctaaatatattagagcccccaacggccccgaagccaacccagtaaagcagctccagccaaatgaggaagccgattacttgggcgtacgcatccagctgcgccgagagcagggtgccggcgctaccggtttccttgagtggtgggtcatcgagttgcaggagtgccgaacggactgcaatctgctccctatggtcattttcagtgataaagtgtcgccaccttcactaggctttctggcgggatatggcatcatggggctatacgtcagtatcgtgctggtgatcggtaagttcgtccgagggtttttctcggagattagtcacagcataatgttcgaggaattgccctgcgtggaccggatcctgaagctgtgtcaggatattttcctcgttcgagaaactcgggagttagaattagaggaagagctctacgccaaactgatcttcctgtacaggagcccagagacaatgataaagtggacaagggagaaggaatag

SEQ ID NO: 44872 - DNA, 1665 bp, Artificial Sequence
  Description of Artificial Sequence: Synthetic coding sequence
atgcccgactaccggacccgggccctgttcgtgcagagcaccctgggcgattcggcaggacccgagctccagttactatccatcgtgcctggccgtgacctacagccatcggacagctttaccgctagctcatccccgcccccatccgtttggtccgaactcgaacacattagaggaaaatcagaagccacaacagaactgaaaagaccctctctgcccggctccatccattcctgtctatgtggtgtatggtgtggggttggcaagagaacaccaagcagcctggtgagttcactgcaggacctggagcttctgggccaacggcaacgacagctatggatggaaagcacacccaggcctccttacaatccgtttctcgtcccttgcacaccagtcgggaaattgtctgcggagcatggcggcccaaccaggaaaatgcctccttccgccagcgctgtggacttctttcagcttttcgtgcctgataatgtgctgaagaacatggtggtgcagacaaacatgtacgctaagaagttccaagaacggtttgggagtgatggcgcctgggtagaagtgactctgacggagatgaaggctttcctggggtacatgatctcgacatcaatctcacactgcgagtcagtgctttccatctggtctggtggtttttattctaacagatctctcgctctagtgatgagccaggccaggttcgagaagatcttgaaatacttccacgtggtggcattcagatctagccagaccactcacggtctttataaggtgcagccatttttggattctttgcagaacagcttcgatagtgcctttcggccttcgcagacacaggttttacacgagccactaatagatgaggatccggtgtttattgcaacttgcacagaaagagagctgaggaaaagaaaaaagaggaaattttctttgtgggtgcggcagtgttccagcacgggcttcattatacagatctacgtccatctcaaagagggtggcggacctgacggtctggatgcactgaagaataaaccccagctccatagcatggttgcacggagtctttgtcgcaacgccgcaggcaaaaactatatcatcttcaccgggccaagcatcacgagcttaactttatttgaggaattcgagaagcaggggatctactgctgtggattactgcgtgctaggaagagcgattgcacaggtctccctttgtcgatgctcacaaacccagctactcctccagcccgcggtcagtaccaaattaaaatgaagggcaatatgagtctgatctgttggtataacaaggggcatttcaggttcttgaccaacgcgtactccccggtgcagcaaggagtcattattaaacggaagagtggtgaaatcccttgtccactggctgtcgaagccttcgccgcacacctctcctacatatgtagatacgatgataaatattccaagtacttcatctctcacaaacctaacaaaacctggcagcaggtgttttggttcgcaatctctatcgctattaacaacgcgtacatcctttataagatgagcgacgcctaccacgtcaagcggtacagccgggcccagttcggcgagcgtttggtaagagagttgctgggcttggaggatgctagccctacccactag

SEQ ID NO: 44873 - DNA, 1368 bp, Artificial Sequence
  Description of Artificial Sequence: Synthetic coding sequence
atgcccgactaccggacccgggccctgttcgtgcagagcaccctgggagactcagcggggccggagctgcagctcctcagtatcgtcccgggacgcgaccttcaaccatccgactcattcactggcccaacacggaagatgcctcccagtgcatcagctgtggatttcttccagctattcgtgcctgacaatgtgctgaaaaacatggtcgtccaaactaatatgtacgcaaagaagtttcaggagcgcttcgggagtgatggtgcctgggtggaagtgaccctgacggaaatgaaggcatttttgggctacatgattagcaccagtatttctcactgcgaatccgtgttgtctatctggtctgggggcttctacagtaatcgcagtctggcattggtgatgtcacaagcccgctttgagaaaatcctgaagtactttcacgtcgtggccttcaggagtagtcagacgacacacgggttatataaggtccagcctttcctcgacagtcttcagaactcgtttgacagtgcgtttagaccctcacagacccaggtgcttcacgaaccactgatcgacgaggaccctgtgtttattgcgacctgcaccgagcgcgaactgcggaagcggaaaaagagaaagttttccctgtgggtgcggcaatgcagttctacagggttcattatacagatctatgtgcatctcaaagaaggcggcggacccgatgggctggatgctctaaaaaataagccccagctgcattccatggtggcccgttccctctgccggaacgcagccggcaagaactacatcatcttcactgggcccagcatcaccagcctaacccttttcgaggagttcgagaagcaagggatttattgttgcgggcttcttcgagcgagaaagagcgactgcacgggtctgcctctctcaatgctgactaacccggccacaccccccgcgcgcggacaatatcagataaagatgaaaggaaatatgagtctcatctgctggtacaataagggccatttccgttttctaactaacgcctatagcccggttcagcagggggttattataaaacgaaagagcggcgaaattccctgcccacttgccgtcgaggcgttcgccgctcacttgtcttacatatgcagatacgacgacaaatattctaagtatttcatcagccacaaaccgaacaagacatggcagcaggtgttctggttcgccattagcattgccatcaataatgcatatattctgtacaagatgtcagacgcatatcacgttaagagatatagcagggctcaatttggcgagaggctggtacgtgaattgctcggacttgaggatgcatcccccacgcattag

SEQ ID NO: 44874 - DNA, 3114 bp, Artificial Sequence
  Description of Artificial Sequence: Synthetic coding sequence
atgagcccccccctgtgccccctgctgctgctggccgtgggcctgcgtctggccggcacgttaaacccgagtgatcccaacacatgctctttttgggagtcatttacaacaacaactaaggagagccacagcaggccattttctctcttacccagtgaaccctgtgaaagaccatgggaagggccccacacctgcccccagcctacagtggtgtatagaacagtttacagacaagttgtgaaaacagatcatcgccaaaggctccagtgctgccacggcttttatgagtcccgcgggttctgcgtccctctttgcgctcaggaatgtgtgcacggtagatgcgtagcccctaatcaatgtcagtgcgtgcctgggtggaggggagacgattgttctagtgagtgtgcaccaggaatgtggggcccccagtgcgacaaaccttgcagctgcggaaataattcctcttgcgatccaaagtcaggggtgtgtagttgtccgtcgggcttacagccccccaactgtctccagccctgtacaccgggatattacggcccagcttgtcaatttaggtgccagtgtcatggtgccccttgcgacccacagacaggggcttgcttctgtccagccgagcgaaccggaccctcgtgtgacgtgtcctgttctcaggggacatccggattcttctgtccctcaacccacagttgtcagaacggaggtgtgttccagaccccccagggatcttgctcatgtcctccaggctggatggggacgatatgtagccttccctgccctgagggttttcacggaccaaattgttcccaggagtgcagatgtcacaacggcgggctttgtgatcgattcactggtcagtgcaggtgtgcacctggttacaccggcgaccgctgccgcgaagaatgccctgtgggtaggttcggacaggactgtgccgaaacatgtgattgcgccccggacgcgcgatgcttccccgcaaacggagcctgcctctgcgaacatgggttcaccggagaccggtgtacagatcgactgtgtcccgacggattctacggcctctcttgccaggccccttgcacctgcgacagagagcacagcctatcttgccaccccatgaatggcgagtgctcctgcctaccaggctgggccggcctgcattgcaatgagtcttgcccccaggatacccacggaccaggttgtcaggagcactgtctgtgcctccacgggggtgtttgccaggccacaagtggcctttgccagtgcgcaccaggatatactggcccacattgcgcctccctctgtcctcccgacacatatggggtgaactgctccgctaggtgctcatgtgaaaatgccatcgcttgctcccctatcgatggcgagtgtgtatgtaaggaagggtggcagagaggaaattgtagcgtgccttgtccaccagggacctggggctttagttgtaatgcatcgtgccagtgcgctcacgaagcggtttgctccccccagactggcgcgtgtacatgtaccccgggctggcacggcgcacactgccaattgccgtgtcctaagggccagtttggtgaaggttgcgcctcccggtgcgactgcgaccattctgatgggtgcgatccggtgcacgggaggtgccaatgtcaggccggatggatgggagcccggtgccatctgtcctgtcccgaaggactgtggggcgtgaactgttccaatacatgtacttgtaagaatggtggcacctgcctaccagagaatggaaattgtgtatgcgcccccggatttcgggggccaagctgtcaacgctcctgccagcccggacgctacggcaagaggtgtgtaccatgtaagtgtgccaaccattcattttgccaccctagtaacggtacatgctattgccttgctggttggaccggtccagactgctctcaaccctgtcccccagggcattggggagaaaactgtgcccagacctgtcagtgtcaccacggcggcacttgtcatccacaggatggttcttgtatatgtcccttaggctggacaggccatcattgcctggaggggtgtccactagggaccttcggagccaactgttctcagccatgccaatgtggaccaggagaaaagtgccacccagaaaccggcgcctgtgtctgccctccaggtcactccggggctccttgtagaataggcatccaggagcccttcacagtgatgcccaccacccccgtagcatataattcccttggggccgtaatcggaatcgcagtgctgggcagcctggtggttgcccttgtggcactgttcatcggatacaggcattggcaaaaagggaaagagcatcaccatctcgcagtagcctattctagcgggaggctggatggcagtgagtatgtgatgcctgacgttccgccatcctattcccattactatagcaaccccagctatcatacactgagccagtgctcacctaaccctccccccccgaataaggtccccggacccctctttgcaagtttgcaaaacccagagcggccaggcggcgctcagggacacgataaccacactactctgcctgccgactggaaacatagacgtgaaccacctcccggccctctggaccgcggctcgagtagactcgatagatcttactcatatagttattccaacggtcctggcccattctacaataaagggctgatctccgaggaggaactcggagcatccgtggcatcactctcctcagaaaacccgtacgcaaccattcgggacctgccttcattgccgggggggccgcgagagagctcatacatggagatgaagggcccgcctagcggtagtcccccaagacaacctccccagttctgggacagccagagaagaaggcaacctcagcctcagcgagattcggggacatacgaacaaccatctccactgattcatgatagggattccgtcgggagtcaacctcctctccccccgggtctcccccctggacactatgacagtcccaaaaatagccatatccctgggcattacgacctgcctcccgtgcgtcacccacccagcccccccctgcggcgacaggatcggtag

SEQ ID NO: 44875 - DNA, 3114 bp, Artificial Sequence
  Description of Artificial Sequence: Synthetic coding sequence
atgagcccccccctgtgccccctgctgctgctggccgtgggcctgcgcttggctggaactcttaacccctcggaccctaacacttgtagcttttgggaaagcttcacaacgactaccaaagaatcacactcaagaccattcagccttcttccgtccgaaccttgcgaacggccatgggagggcccacatacgtgtcctcaacctactgtcgtgtaccggacggtctaccgacaggttgttaagactgaccaccgccagcgcctacagtgctgccatggcttttacgaatccaggggcttttgtgtacctctgtgcgctcaagaatgcgttcatggtcgctgtgtggcacctaaccagtgtcagtgtgtccctggatggagaggcgacgattgctcgtccgaatgtgctcccgggatgtgggggcctcagtgcgataagccctgttcctgtggtaacaatagcagctgcgatcctaagtctggcgtgtgcagctgtccctcaggcctccagcctcctaactgtttgcagccatgtactccgggttattatgggcctgcctgtcagtttcgctgccagtgtcacggcgccccctgcgatccccaaacaggtgcttgtttttgtcctgccgaacggaccggcccttcgtgcgacgttagttgtagccagggcacctcaggcttcttctgcccctcaacacactcctgtcagaacgggggagtctttcagactcctcaaggcagctgcagttgtccccccggctggatgggcaccatttgtagcctgccctgtcctgaaggatttcacggccctaattgttctcaggaatgtcgctgtcacaatggcgggctgtgtgacaggtttactggccaatgccgatgtgcaccgggctatactggagatagatgccgagaggaatgccctgtggggcggtttggccaggactgcgctgaaacatgcgactgtgcccccgatgcacgctgctttcctgccaatggggcctgtctatgtgaacatggcttcacgggtgatagatgtacggaccgcctgtgcccggacggtttttacgggctgagctgccaagcaccgtgcacttgcgaccgcgaacatagtcttagttgccatccgatgaacggtgagtgttcctgcctcccgggctgggccggtctgcattgcaacgagtcttgcccccaggacactcacggtcctggctgtcaagaacattgcctgtgtctacacggaggtgtgtgccaggcgacatccggcctttgccagtgcgctccagggtacaccggacctcattgcgcatcactttgtccacctgatacgtacggcgtcaattgtagtgcccgctgttcgtgcgagaatgccatcgcgtgttctccaattgatggcgagtgcgtttgtaaagagggttggcaacgcggcaactgcagtgttccttgccctcctggcacttggggcttcagctgcaatgcatcctgtcagtgcgcccatgaagcggtgtgttccccacagaccggtgcctgcacgtgcacacccggctggcacggcgcccattgtcagcttccctgtcccaaagggcagtttggcgagggatgcgcaagcaggtgtgattgtgatcactctgacggttgcgatccggtccacggccgatgccaatgtcaggccggatggatgggcgcaagatgccatttaagttgcccagagggactttggggggtcaattgtagtaacacctgtacctgcaaaaatgggggcacttgtcttcctgaaaacggcaactgtgtgtgtgcacccggattcagaggtccgagttgccagcgctcatgccagcccgggcggtatggcaaacgctgcgtgccatgtaagtgcgccaatcattctttttgccatccaagcaatgggacttgctactgtctggccggttggactggccctgactgttctcagccctgtcccccaggtcattggggcgaaaattgcgcacagacatgtcagtgccaccacggcggaacatgtcacccacaggacgggagctgcatatgtccactggggtggacaggccaccactgcctcgagggctgtcctttaggcactttcggagccaactgttcacagccttgtcagtgcgggcccggcgaaaagtgccatcccgaaaccggcgcatgcgtgtgtcctcccggccacagcggggccccttgtagaatcgggattcaggagccgtttaccgttatgccgaccacacccgttgcatacaatagtcttggggccgtgatcggcatcgctgtgttgggcagtcttgtagttgctctggtcgcactgttcattggctatagacattggcaaaaaggaaaggaacatcatcacctagcagttgcctattcttcaggacggctcgacggctcagagtatgtgatgcccgatgtccctccatcttactcccactactattcgaatccctcataccacaccctttctcagtgtagcccgaacccgcctccaccaaataaggtgcctgggccactcttcgcaagccttcaaaatcctgagaggcccggtggcgcacagggtcacgataaccacaccactctcccagcggattggaaacacagacgggagcctcctccggggccactggacaggggatcttccagactcgaccggtcctactcctattcttacagcaatgggcccggtccattctacaacaagggtctcatctccgaggaagagttgggggcatccgttgccagcctctcgtcagagaacccatacgctaccataagggaccttcccagcctacctggcggcccgcgggagtccagttacatggaaatgaaaggccctcccagcggcagccccccgcggcaaccccctcagttttgggacagtcaacgccgtagacaaccccagccacagcgggatagtgggacatatgaacagcccagccctcttatccacgaccgcgattcagtgggatctcagcctcccttgccacctggactgccacctggccactacgacagtcccaagaatagccacatccccggccactatgaccttccccccgtgagacatcctccctcaccgccactccggcgccaggatcgctag

SEQ ID NO: 44876 - DNA, 522 bp, Artificial Sequence
  Description of Artificial Sequence: Synthetic coding sequence
atgagcccccccctgtgccccctgctgctgctggccgtgggcctgcggcttgcaggaacactgaacccctccgatcctaatacctgttctttttgggaatcattcactacgacaacaaaagaatctcactctcggcccttcagcctgctgcccagcgagccttgtgagagaccctgggaaggccctcatacatgcccccagccaactgttgtgtatcggaccgtgtacagacaggtcgttaaaactgatcaccggcagcgtcttcagtgttgtcatggcttttacgaatccagagggttttgcgtccccctgtgcgcccaggaatgtgtacacgggagatgtgtggctccaaaccagtgccagtgtgttcctggctggagaggggacgattgctcttctgaatgtgcccccggcatgtggggtccccaatgtgataaaccctgctcctgtgggaacaactcttcctgtgatccaaagagtggagtgtgttcatgtccatctggcctccagccacctaattag

SEQ ID NO: 44877 - DNA, 2316 bp, Artificial Sequence
  Description of Artificial Sequence: Synthetic coding sequence
atggaggaggacaagctgctgagcgccgtgcccgaggagggcgacgccacccgcgaccccgggcccgagccagaggaggagccaggcgtgaggaatggcatggctagtgagggactgaacagtagcctctgcagtcctggccacgagaggcgcggaacccccgccgataccgaagaaccaaccaaagaccctgacgtggcttttcatggactctccctaggcctctcactgactaatgggctggctctggggccggatttgaatattctcgaggattctgcggaaagccgtccatggagagcaggcgttttggccgagggagacaatgcaagccgctccctttacccagacgctgaggacccgcaactgggtctcgacggccccggagaaccagacgttagggacgggtttagtgcgacattcgaaaagatcttggaatccgagctcctgcggggcactcagtacagttcactggactcactggatggcttgtcgctaacagacgagagtgacagctgtgtgtctttcgaggcccccctgacccccctaattcagcagagagcaagggatagccccgaacccggagctggcttgggcattggtgacatggctttcgaaggggatatgggcgccgccggtggagacggcgaacttggtagcccacttcgcaggagcataagttcttctaggtctgagaacgtgctgagtcggttgtccctcatggccatgccgaatggctttcatgaggacgggcctcaggggcccggtggggacgaggatgacgatgaagaggacacggacaagctgctcaattccgcgtcagatccctctttaaaggatggtttaagcgacagtgactctgaactgtcttcctccgaggggcttgagccgggaagtgccgaccctctcgcaaacggctgccagggcgtgagcgaagctgcacaccgcttggctagacggctgtaccacttggaaggctttcagagatgtgatgtggctagacagcttggtaagaataatgagttcagcaggctcgtcgctggagaatatctgagttttttcgacttttccggactcactcttgatggcgcgttacgaactttcctgaaagcctttccacttatgggtgaaactcaggagagggagagggtgttaactcattttagtcggaggtactgccagtgcaatccagatgacagtaccagcgaggacggcatccatactctgacttgcgcactgatgctgctgaacaccgatcttcatgggcataacattgggaagaagatgagttgtcagcaattcatcgccaatctggaccagctgaatgatgggcaggactttgccaaggatctgctcaaaaccctgtacaactcaataaagaacgagaagttggaatgggccatcgacgaagacgagctcaggaaaagccttagcgaactggtggacgacaaatttggtaccggtactaaaaaggtaacaaggatattagacgggggcaatccctttctggacgttccgcaagctctctctgctacaacttacaaacacggagtgttaaccaggaagacacacgctgatatggatgggaaaaggacgccaaggggcaggcggggctggaaaaaattttatgccgtgctaaagggaaccattctatacctgcaaaaagatgagtatcgcccggataaggcgctgagcgaaggcgatttaaaaaacgccattcgggtacatcatgctctggcgaccagagcttctgattacagcaaaaaatccaatgtgcttaaactgaaaaccgctgactggagagtctttctgtttcaagccccttctaaagaagagatgctgtcctggatccttagaattaacctagtggccgccatcttctctgcgcctgccttccccgctgcagtatcatcaatgaaaaagttttgtcgtcctctattgcctagctgcacaacacgactctgccaggaagaacaactacgttctcatgaaaacaagctcaggcaattaaccgctgagctggcggagcatcggtgtcatcccgtggaaagaggcattaaaagtaaagaagctgaggagtaccgcctcaaagaacactacctcaccttcgaaaaatcgcgatacgaaacatacatccacctgctggccatgaaaatcaaggtcggctcagacgacctggaaagaatagaagctcggctcgcaacccttgagggggacgacccttctctgcgcaagacccatagtagcccagctttgtctcagggtcatgtgacaggctcaaagactaccaaagatgccaccggaccagacacatag

SEQ ID NO: 44878 - DNA, 2601 bp, Artificial Sequence
  Description of Artificial Sequence: Synthetic coding sequence
atggaggaggaggacaccaagcgggaggtgcccaaggaggacggcgtgggggacgtgcagcattttgattcctctaagattatggaagagcacagttatatccagaaggaattagacctccaaaatggatcattggaggaggacagcgtagtccactcagtggagaatgactcacaaaacatgatggaaagtctgagtccaaaaaagtactcttcttcactgagattcaaggctaatggtgattattccgggtcctatcttactctttctcagccagtccctgctaaacgcagtccttctcctctcggcacaagcgttcgttcttcaccttctttggccaagattcagggatctaaacaattcagctatgatggtaccgataaaaacatccccatgaagccacccacgccgctgctgaacaccacctcatcactaagcggctatcctcttggccgcgctgactttgaccactacaccggcagagacagtgagagggcattgaggctctcagaaaaaccaccctactcaaagtatagtagccgacataagtctcacgataacgtatatagcttgggcggactggagggccgcaaagcctccgggagcctgctggccatgtggaacgggtcctctctttctgacgcaggcccccctcctatcagcaggtcgggtgccgccagtatgcccagttcacccaagcaggctcgtaaaatgtcaatccaggacagtctggcacttcagcctaagctgacccgtcacaaggagttggcaagtgaaaatattaatttgaggacccgaaaatactcctccagctcactgtcacacatgggagcatacagccgctctctgcctcgtctctatcgggcaacggagaaccagctgactcctctcagcctgcctccccggaattccttgggaaactcaaagagaactaagctgggggagaaggatctgccccatagcgtcatcgacaatgacaattacctcaatttcagcagcctttctagtggggcgctgccctacaaaacgagtgcttctgaggggaacccctatgtctcctctaccctgtctgtgccagcaagcccacgcgtcgcgaggaagatgctcctggcctcaacgtcatcttgcgcctcagacgatttcgaccaagcaagctatgtgggtacaaatccttcccactccctgctggctggcgagagcgaccgcgtctttgcaactagacgtaacttctcttgcggatcagtggaattcgacgaagctgatctggagagcctgcgtcaggctagtggaacaccccagccggcacttcgagaaagaaaaagtagcatctcatctataagcggtagggacgatctcatggactatcacaggaggcagcgggaagagaggctgcgcgagcaggaaatggagagattggaaagacagaggctcgaaactatcctgtcactctgcgccgaatacacaaagccggactctaggctttcaaccgggactacggtggaagacgtgcagaagataaacaaagagctggaaaagctacagctgagcgatgaggagagcgtctttgaggaggcgcttatgtcacctgatacccggtaccggtgccacaggaaagactccttgcctgatgcagatctcgcctcctgcggatccctaagccaatcatcggccagcttttttacaccccgatccacaaggaacgacgagcttctgtccgacttaacccgcactcctccacctccctcctcgaccttcccaaaggcatccagcgagtcctcatacctatcgattctgcctaagacacctgaaggaattagcgaagagcaaagatcccaggagctcgccgcgatggaggagactcgaattgttattcttaacaaccttgaggaactgaagcagaagatcaaagatattaatgatcaaatggatgagtcattcagggagctggatatggagtgcgcccttctggacggggagcagaaatccgagaccactgaactgatgaaggagaaggaaattttagatcaccttaaccgcaagattgctgagctggagaagaacatcgtgggtgagaaaaccaaagacgcagacctcctcgacgtggagtcaaagcacttcgaggatttggagttccagcaactggaacacgaatcacgcctggatgaagaaaaagagaatcttacacagcagttacttagggaagttgcagaatatcagagaaacatcgtttctcgaaaagagaagatctccgcgctcaaaaaacaggcgaatcacatcgtacaacaagcgcagagggaacaagatcattttgtcaaagaaaagaacaacttaataatgatgttgcaaagagagaaagagaatctttgcaacctggagaagaagtacagctcactatcgggcggcaaaggcttcccagtgaaccctaatacattgaaagagggttacatttcagttaacgagatcaatgaaccgtgcggcaacagtactaatctgagtccctcgacacagttccccgcagatgccgatgccgttgcaaccgagcccgcgaccgcagttctggcttcccaaccccaatccaaggaacactttcagggcccttag

SEQ ID NO: 44879 - DNA, 3714 bp, Artificial Sequence
  Description of Artificial Sequence: Synthetic coding sequence
atggaggaggaggacaccaagcgggaggtgcccaaggaggacggcgtgggggacgtgcagcatttcgattctagcaagatcatggaggaacattcctacatccagaaagaactcgacttacagaatggttcccttgaagaggatagtgttgtacactctgtcgagaatgattcacagaacatgatggagtcgctgtcacctaagaagtacagcagttcactccggttcaaagcaaacggagactacagtgggtcgtacctcacattgtcacaaccggttcccgctaaacggtctcctagtcccctgggaacgagcgtaagatcttctccctcattagcaaagattcagggcagcaaacagttctcttacgacgggaccgacaaaaatatccctatgaagccgcccaccccccttctgaacacaacctcatccctgtccgggtacccacttgggcgggccgactttgaccattatactggaagggactctgagagggctctccgcctgagtgagaaaccaccctactctaagtatagtagtcggcacaaaagccacgacaacgtgtatagtcttggcggcttagagggtagaaaggcctcaggaagcctgctggctatgtggaatggtagttctctgtcggacgctggccctccaccaatttcacgcagcggtgccgctagtatgccttctagtccaaagcaggctcgcaaaatgagtattcaagacagcctggccctccagcctaaactaactaggcacaaggagctcgccagtgaaaatataaatctacggacaaggaaatactcttcttcttccctgagtcatatgggcgcatactcgcgaagcctcccacggctataccgcgccaccgaaaaccagttgacacctctgagtctccctccacgcaatagcctcggcaactctaagcgaaccaagttaggagagaaggatctcccccatagtgtcattgacaatgacaactacctgaacttttcttcactatcatccggagcactcccctataagacatccgcctccgaggggaacccctacgtcagctccacactgagtgtccctgcctcaccgcgagtggccagaaagatgctgctggcctcaacctcatcgtgcgcctccgacgattttgatcaagcctcctacgtgggaacaaatcctagccatagcctgctcgccggtgaatccgatagggtgtttgctacacgccgcaatttctcttgcggctcagtggagttcgatgaagccgatctcgaaagtttgcggcaagctagcggcacgccccagccagccctgcgcgaacggaagagttctatctcctccattagcgggcgggatgacctaatggactaccacaggagacagagggaggagcgtctcagagagcaggagatggaaagactcgagcgacaacggttggagaccattctttctctctgtgccgaatacaccaagcctgattcccgtctttctaccgggacaacagttgaggatgtgcagaagataaataaggagctggagaagctgcagctgtccgacgaggagtccgtgtttgaagaagctcttatgtccccagacacccggtatcgctgccatagaaaggatagcctacctgatgcagacctagcatcttgtgggagtctgtcccagtctagcgcgtccttcttcactccacggtccactcggaatgacgaactcctgagcgacctcacacggacacctccccctccaagctctaccttccccaaagccagctctgaaagttcatatctctcaatcctgccaaagacacccgagggaattagcgaggagcagagaagccaggagctagcagcaatggaggagacacgtatcgtgattctgaacaacttagaggaactgaagcagaaaataaaagacataaatgaccagatggacgaatctttcagagaacttgatatggagtgcgctctgctcgacggtgagcaaaagagtgagactacagagcttatgaaagaaaaagaaattttagatcatctgaatagaaagatcgcagagttggagaaaaacatcgtcggggagaaaacgaaggatgctgacctgttggatgtggagtcaaaacactttgaagatctcgagtttcaacagctcgagcacgagtctagactggacgaggagaaagagaacctgacccaacagctgctgcgtgaagttgcagaatatcagcggaacatcgtgtcccgcaaggagaagatctcagctctcaaaaagcaggcaaatcatattgtccagcaagcgcaaagggagcaggatcactttgtgaaagagaagaacaacctgatcatgatgctgcaaagggagaaggaaaacctgtgcaatctcgaaaagaagtactcctctctgtccgggggaaagggctttcccgtgaaccccaacactctaaaggagggatacatctccgtaaacgagatcaatgagccctgcggtaattccacaaatctgtctcccagtacccagtttcctgcagacgccgacgccgtggccacagagcccgctaccgctgtcttagccagtcaacctcaaagcaaggagcacttccgatcactggaggagagaaagaaacaacacaaggagggcttgtacttgagcgacacgctgccccggaagaagaccactagctcgatttctccacattttagctccgcaaccatgggcaggtctataactcccaaggcccatcttcccttaggccagtctaactcatgcgggtccgtgctgccccccagcctcgcagcaatggctaaagactctgagtcccgccgcatgctgcgcgggtacaaccatcaacagatgtctgaaggtcatcggcagaagagtgagttttacaacaggactgctagcgagtccaatgtttacttgaattcttttcactacccggatcactcctacaaggaccaggcctttgacacactttcgcttgacagttccgattcaatggagacgagcattagcgcttgtagccctgataacataagcagtgcaagcacctcaaacatagcccggatcgaggagatggagcgtctcctcaagcaggcgcacgcggaaaagacccgcttgttggagagccgggaacgggagatggaggcaaaaaagcgcgccctggaagaagagaagcgcagacgcgagatactggagaaaaggctgcaagaggagaccagccaacggcagaagctaatcgagaaagaggtgaagatcagggagaggcagcgggcccaggctcggcccctaacacgctacttacctgtgagaaaagaagatttcgatttaaggtctcacgtggagactgccgggcacaatatagacacgtgttatcacgtatctatcactgagaaaacgtgccgcggcttcctcatcaagatgggcggcaagatcaagacttggaaaaaacgttggttcgtattcgacaggaacaagcggaccttctcatattacgcggataagcacgaaacaaaactgaaaggagttatctattttcaggcaattgaggaagtttactatgatcatcttaagaatgctaacaaatccccaaaccctcttctgacattcagcgtaaagactcatgaccgaatttactatatggtcgccccatccccagaggccatgcgcatctggatggacgttattgtcaccggggctgaggggtatacccacttcctgttatag

SEQ ID NO: 44880 - DNA, 3762 bp, Artificial Sequence
  Description of Artificial Sequence: Synthetic coding sequence
atggaggagcacagctacatccagaaggagctggacctgcagaacgggtctctcgaagaggattctgtagtgcacagcgttgagaatgacagccaaaatatgatggagtccctgagccccaagaaatacagttcttccttgcgattcaaagctaatggagactactcaggctcctacctaacacttagccagcccgtgccagcaaaacgcagccctagcccattaggtacctccgtgagatctagcccctcgttggctaagatccagggatccaaacagttctcctacgacggcacggataaaaacatccctatgaagccgccaacccctctcttaaacaccacctcatcgctgagcggctaccccctggggcgtgccgatttcgatcactacactggccgggattcagagagggcgcttagactgtcggagaagccaccatattctaagtactcctctaggcataagagccatgataacgtctatagtctgggcggtctggaggggagaaaggccagcgggtccttgctcgccatgtggaatggaagctctctttccgacgccggtccacctcccatcagtagatccggcgccgcctcaatgccaagcagccctaaacaggcacgaaagatgtctattcaggattctctagctttacagcctaaactcacacggcacaaagagctggcatcagagaacatcaatttgagaactaggaagtattcctccagctcactctcccacatgggcgcttatagccgttcactgccccggctttatcgggctactgaaaatcagttgacccctctgtctctgcccccgagaaattcccttggcaatagtaagcgcacgaagctgggtgaaaaggacctgccacacagcgtgattgacaacgacaattatctcaacttttccagcttaagctctggcgcactgccgtataaaacatctgcctccgagggcaatccatatgtctcgagtacactgagcgtcccagcctccccgcgagtcgcaagaaaaatgctccttgcctcaacctcatcctgtgcaagcgacgactttgaccaggcaagctatgtaggtacaaacccttcccactcccttctcgccggcgagagcgaccgagttttcgccacacggcggaatttttcttgtgggtctgtggaattcgacgaggccgacctggagagtttgcgtcaagcatcaggcacgcctcagccagccctcagggagcgcaagtcttccatttcctctatatccggtagagacgacttaatggattaccacagacgccagcgtgaagaaagactgagagaacaggaaatggaacgattggagcgccagcgactcgaaactattctctctctttgtgcagagtacaccaagccagacagccgtctgtctaccggaacgaccgtcgaggacgtgcagaaaataaacaaagaactggagaagttgcagctctccgatgaggagtcagtgtttgaagaagcactaatgtctcccgacaccagatatagatgccacaggaaggactccctccccgatgctgatctggctagctgtgggagtttatcccaatcctctgcctcattcttcactcctcggagcaccagaaacgacgagctactttctgacctgaccagaactccaccacctccaagcagtaccttccctaaggcgtcttcagagagcagctatctttcaattctgcccaagacaccggagggcattagtgaagagcagcgctcccaggagttggccgcgatggaggaaactcgcatcgtgattctgaacaatctggaggagttgaagcaaaagattaaggacatcaatgatcagatggatgaaagtttcagagagctggacatggaatgtgctcttctggatggagagcagaaatctgagactacagaattgatgaaagaaaaagagatcttggatcacctgaacagaaaaatagcagagctggaaaagaacatcgtgggtgaaaaaactaaagagaaagtgaagctcgacgcagagcgggaaaagctggaaaggctccaggagttatattctgagcaaaaaacccagcttgataattgccctgagagcatgcgtgagcagctgcagcaacagctgaagcgggacgccgaccttctcgacgtggagagcaagcacttcgaagatctcgagtttcaacagctcgagcacgaatcaagactggacgaggagaaagaaaacctcacacagcagctgcttagggaggtcgccgaatatcagcggaacattgtgtcgagaaaagaaaaaatttcagctttgaaaaagcaagccaaccacattgtgcagcaggctcagcgagagcaggaccatttcgtgaaggaaaagaataatttaatcatgatgctccagcgggaaaaggaaaatctgtgtaatctcgaaaagaaatacagctcactttcaggaggtaagggctttcctgtcaatccaaatacattgaaggagggatatataagcgtgaatgaaataaacgaaccatgcggcaatagtactaacctgagcccctctacgcaattccctgctgacgctgacgccgttgccacggagcccgctacggctgtgctggcatcgcagccccagagtaaggagcactttcgatccctcgaagaaaggaaaaagcagcacaaggagggactatacctgagcgacacactgccacgcaagaaaactacctctagcatttccccccacttctcttcagccactatgggacgctctattaccccgaaggcccacctgccattggggcagagcaatagctgcgggtccgttctgccgccttctttggccgcaatggccaaagatagtgaatcacggcgcatgctgcgaggttacaatcaccagcagatgtccgaagggcacaggcagaaatccgaattctataataggaccgcctccgaaagcaacgtgtatttgaattcatttcattatccagaccacagttataaggatcaggccttcgacacactctctctggattcttcagatagcatggagacgagcataagcgcctgcagcccagataatatttcatctgcctccacttcaaacatcgctcgcatcgaagaaatggaacgactgcttaagcaggctcacgcagaaaaaacacggctgctggagagccgagaaagagaaatggaggccaaaaaaagagcccttgaggaggagaaaagaagacgggaaatactggaaaaacggctgcaggaagagacctctcagagacaaaagttgatcgagaaagaggtcaagattcgggaacggcagagggcacaggcacgaccactgaccagatatttgcccgtcagaaaagaagattttgacctgcgctctcatgtcgaaacggccggacacaacatcgacacatgttaccatgtgagtatcacagaaaagacttgccggggttttcttatcaaaatggggggcaaaattaagacgtggaagaaaagatggttcgtcttcgataggaacaaacggaccttctcttactatgctgacaaacacgaaactaaactaaaaggagtgatttactttcaagctattgaggaagtgtactacgaccatttgaaaaacgccaataagtcaccaaaccctctcctaacatttagcgtcaagacacatgatcggatctactatatggtagctccctcaccagaggccatgcgtatctggatggatgttatagttacaggagccgaaggttatactcactttctgttgtag

SEQ ID NO: 44881 - DNA, 3633 bp, Artificial Sequence
  Description of Artificial Sequence: Synthetic coding sequence
atggaggagcacagctacatccagaaggagctggacctgcagaacggatccctggaggaggactctgtggtacactccgtggaaaatgactcccaaaatatgatggagtcactaagcccaaagaagtacagctcttcgttgcggtttaaagccaacggagactattctggatcttatctcaccttgtcccagcctgtgccagccaaaaggagtccctcgcccctagggaccagcgtcagaagctcaccctccctggctaagattcagggatccaaacagttctcatatgacggcacagataagaacatccccatgaagcctccaacacccctgctgaacacgactagctccttatctggataccctctggggcgagctgattttgaccattatacaggccgggatagtgagcgagccctgagactgagcgagaagccaccttattcgaaatattcctcgcgacacaagtcccatgacaacgtgtactcactgggggggcttgagggacgcaaagcctccggcagcctgctcgccatgtggaacggttcctctctcagtgacgcagggccaccccccatctctcgctctggggcagcttccatgccatcctcccccaaacaggctcgtaagatgagcattcaagatagtctggcactgcaacccaagctgactcgccacaaggaactggcgtcggaaaacattaacctgcgtacccgcaaatatagttcaagctcccttagccacatgggtgcttatagcagatcgctcccccgactttatcgcgccacagagaatcaactcacccctctctctttgccacctcggaattccctcgggaactccaaacgtacgaagctcggagagaaagaccttcctcactcagtgatcgataacgacaactatctgaatttttcatcactttcgtcaggtgctctaccgtacaagactagtgcatccgaaggcaatccctacgttagtagtacattgtcggtgccagcctcccctcgagttgcaaggaagatgctgctggcaagcacgagtagttgtgcctccgacgacttcgatcaggcatcatacgtgggtaccaatccgtcccattctttgttggcaggtgagtcggaccgcgtgtttgccaccaggcggaacttctcatgtgggagtgtggaatttgatgaagctgacctagagtccctgagacaagccagcggaaccccgcagcctgctctgagggagagaaagtcaagcatcagctcaatttccggaagagacgacttaatggattatcatagacgccaaagagaggagcggctgcgggagcaggaaatggaaagactcgaacggcagcgactcgagactatactgtccctttgcgctgaatacaccaaacctgattcccgccttagcaccggtactacagtagaagacgtgcagaagatcaacaaagagctggaaaaactacagttatccgatgaagaatctgtatttgaagaggccctgatgtcacccgacacaaggtaccgctgccatcggaaggactcacttcccgacgcagacctggcttcttgcgggagcctgtcacagtcctccgcatcctttttcaccccccgctcaaccaggaacgacgaactcctgagcgacttgacccggacacctccaccaccctcttccactttccctaaggcctcatccgagtcctcgtacctgtccattctgcccaagacaccggagggcatctctgaggaacaaaggtctcaagaattggctgccatggaggaaacccggattgtgatactgaataatctggaagagctcaaacagaagataaaagacatcaacgaccagatggacgaaagttttagggaattggatatggaatgtgcactgttagatggcgaacaaaagagtgagactacagaactgatgaaagagaaggaaatactagaccatctcaaccgtaagattgctgaactggagaagaacatcgtcggcgagaaaactaaggatgctgatctgctggatgtggagagtaagcacttcgaggacctggagttccagcagctggaacatgaatcgcgcctggatgaggaaaaagagaacctgactcagcagctcctccgtgaggtggccgagtaccaacgcaatattgtatcgaggaaagagaaaataagcgcactcaaaaaacaagcaaatcacatagtccagcaggcacagcgggagcaggaccatttcgtcaaagagaaaaacaacctgatcatgatgttgcagagagaaaaagagaacctgtgtaaccttgaaaagaagtattcatccttatctggggggaagggattccctgttaatccgaacacactcaaggaagggtacatctctgtgaatgagattaacgagccttgtggtaattccactaacctgtctccatcaacgcagtttcctgctgacgctgatgcagtcgctaccgagccagccaccgcagtccttgcttcgcagccgcagtccaaggagcatttccggtcactcgaggagcgcaagaagcaacacaaagagggcttatacttgtcggatacacttcctcgcaagaaaacaactagcagtatttctccccacttttccagcgcaaccatgggtcgatcaatcacccccaaggctcaccttcccttaggccagagtaactcatgcggctcggtactcccgccatccctagccgctatggctaaggattccgagtcgaggagaatgctcagggggtacaaccaccagcagatgtccgaaggccacagacaaaaatcggaattctataataggactgcctccgagagcaatgtctacctcaactctttccattaccctgatcatagctacaaggatcaagcattcgatactctgtcattagattcatcagatagtatggaaacatccataagcgcctgtagtcctgacaacatcagcagtgccagcacgtctaatatcgcaaggatcgaggagatggaaagactgctgaaacaggcccacgctgagaagactcgcttgttggagtcacgcgagcgcgagatggaggccaagaagagggccctggaagaagagaaaagaaggagggagattttggagaaaaggctccaagaggaaaccagtcagcgtcaaaagctgattgaaaaagaggtgaaaatccgggagaggcagagggcacaggctcggccactgacccgctacctccccgttcgcaaagaagactttgatttgaggagtcacgtggagaccgctggacataacattgacacctgctaccacgtttcaatcactgagaaaacttgtagaggcttcctcattaaaatggggggaaaaatcaagacctggaagaagagatggttcgtgttcgaccgcaacaagcgaacattctcctattatgcagacaaacacgaaactaagctgaaaggcgtcatttattttcaggcaatcgaagaagtgtactatgaccacctgaaaaacgctaacaaatccccaaatcccctcctcacatttagtgtgaaaactcacgaccggatttattatatggtggccccgagtcccgaggccatgagaatctggatggacgtaatcgtaacaggcgcagaggggtacactcattttcttctgtag

SEQ ID NO: 44882 - DNA, 3762 bp, Artificial Sequence
  Description of Artificial Sequence: Synthetic coding sequence
atggaggagcacagctacatccagaaggagctggacctgcagaacggctctctggaagaggacagcgttgtccactcagttgaaaatgattcacagaacatgatggaatctcttagccccaaaaagtattcatccagcctgagattcaaggcaaacggcgattacagcgggagctacctgacccttagccagcccgtccctgcaaagagatctccgtcgccgctgggaacgtcagtaagaagttccccttctctggctaagatccagggctcaaaacagtttagctacgatggaactgacaaaaacatccccatgaagcctccaaccccactcctgaacacaacctctagcctgtccggatacccacttggccgtgcagacttcgaccattatacggggcgggactcagaaagagctttgcgactgagcgagaagcctccatattctaagtattcatctcgtcacaagtcacacgacaacgtgtacagcctgggcggcttagaaggacggaaggcctcgggctctttgttggccatgtggaatggttccagcctgtccgatgcgggccctcccccgatctctcgctcgggcgctgcaagtatgcccagctctcccaagcaagcgcgcaagatgagtatccaagacagcctcgcactccaacctaagttaacccgccataaagagctggcgtcagagaatatcaatctccgaacacgaaaatatagttcatctagcctgagccacatgggtgcctattctcgctccctgccgagactgtacagagcaactgaaaatcagctcacacccttatccctgcctcctcgtaattctttaggaaactccaaacggacaaaactgggtgagaaggacctccctcattcggtgattgacaacgataactacctcaatttcagcagtctgtcaagtggagcattgccatataagacctcagcctccgaagggaatccttatgtgagtagcaccctatccgtgccagcttcaccccgtgtggcccgtaaaatgctcctggcgtcaaccagcagctgtgcatctgacgacttcgaccaggcctcctatgtcggcaccaatccttcccactctctgctggctggtgagagcgatcgcgtcttcgccacgcggcggaatttttcgtgtggcagcgtagagttcgacgaagcagatctcgagtctctccgccaggcgagcggcacccctcagcccgcgcttcgggagcgcaaatctagtatatctagcatatctggaagggatgatctcatggattatcacaggcgacagcgtgaagaacgccttagggagcaggaaatggagaggctcgaacgacagcgcctcgagactattctgtcactgtgtgctgaatataccaaaccagatagcaggctgtctaccgggacaactgtggaagatgttcagaagatcaataaagagctcgaaaagctgcaactgagcgatgaggagtccgttttcgaggaggctctgatgtctcctgacacaaggtatcggtgtcataggaaagactcactgcctgatgcagatctagcgtcttgcggtagcctgagtcaatcttccgcgtctttctttactccgaggagtacaagaaacgatgaattactgtctgatctgacgcggacgccccctccccctagctcaaccttccctaaggccagcagtgaaagttcctacctcagtattctgccgaagacgccagaaggtatatccgaggagcagcggtcccaggagttggcagccatggaagagacacgcatcgtgatcctgaacaatctggaggaactgaagcaaaagataaaagatataaacgatcagatggatgagtccttccgggaactcgacatggagtgcgccctgctcgacggagagcagaagtccgaaacaacagagctgatgaaagaaaaggaaatcctggaccacctgaaccggaagatcgcagaactggaaaaaaatatcgtgggggagaagactaaagaaaaggttaaactagacgcagagcgggagaagctggaacggcttcaggagctgtattccgagcagaaaacgcagttggacaactgtcctgagtccatgcgcgagcaactgcagcagcagctaaagcgagacgcagatctgctcgacgtggaatccaagcatttcgaggacctcgagttccagcagctcgagcatgagtctcgtctggatgaggagaaggagaacctgacccagcagctgttgcgcgaggtcgctgagtatcagagaaacatagtatcacgaaaagagaagatctctgctctcaaaaagcaggcgaatcatatcgtccaacaggcccagcgcgaacaggaccatttcgttaaagaaaagaataatcttatcatgatgttgcagcgggaaaaggagaatctgtgtaatttagaaaaaaagtacagctccctgtctggaggtaagggctttcctgttaatcctaacaccctgaaggaaggctatataagtgtcaacgagatcaatgaaccatgtggcaattcgaccaatctttcccccagtacccagtttcctgctgacgccgacgcagtcgctactgagcctgctacggctgtgttggcatcccagcctcagtctaaggaacacttcaggtcactcgaagaaaggaaaaagcagcacaaagagggcctgtacctgagcgatactctcccacgaaagaagacaacttcgtccatatctccgcatttttctagcgccacgatggggagatcaataacacccaaggcccatcttcctttgggccagtcaaactcatgtggttctgttctccccccatcccttgctgctatggccaaggatagtgagtcgcgccgaatgctgcggggctacaatcatcagcagatgtccgagggccacaggcagaagtctgaattctataacagaaccgccagcgagagtaacgtttacttgaattctttccattatcccgatcactcatacaaggatcaggccttcgacactctctctttagattcatcggatagcatggagacaagcatatccgcttgcagcccagacaacatcagtagtgccagcacctcaaatattgccaggattgaggagatggaacggctgctcaagcaggcacacgccgaaaaaacaaggcttttggaatctcgcgagcgggagatggaggctaagaagcgtgcactggaggaagagaagcggcgtcgcgagatcctggaaaagcgacttcaggaggagacctcccagcgtcagaaactgatcgagaaagaggtaaaaatcagggagcggcaaagggctcaagcccggccactaacgaggtacctgccagttcggaaggaagacttcgatctgagatcccacgtcgaaacagccggccacaatattgacacatgctatcacgtaagcataacagaaaaaacatgtcgtgggttcctcatcaagatgggcggcaaaatcaaaacatggaagaagcgttggttcgtcttcgatcggaacaaaaggaccttctcgtattacgctgataagcatgagaccaagctcaagggtgtgatctactttcaagccatagaggaggtgtattacgatcacttgaaaaacgccaacaagtccccaaatcccctgttgaccttctcggtcaaaactcatgataggatatactatatggtggccccaagtcccgaggctatgcggatctggatggacgtgatcgtgaccggcgctgaggggtacactcactttctgctgtag

SEQ ID NO: 44883 - DNA, 3633 bp, Artificial Sequence
  Description of Artificial Sequence: Synthetic coding sequence
atggaggagcacagctacatccagaaggagctggacctgcagaacgggagtctggaggaggattcggtagtccacagtgttgaaaacgacagccaaaatatgatggaatccctttcccctaaaaaatactccagctcattgcggtttaaggctaatggagactacagcggttcatacttgacattaagccagcctgtgcctgctaagaggagtccatcacccctaggcacgtctgttcgttcttcaccctccttggctaagatccagggctccaaacagttctcctacgacggcactgacaaaaatattccaatgaagcccccaacacctttgctgaacaccacatctagtttgtccgggtatcccctgggtcgtgccgactttgaccactataccggccgggacagcgagagagctctgaggctcagtgagaagccgccatattcaaagtactcatcgcgtcataaaagtcacgataacgtctatagcctcggcgggcttgaaggccggaaggcttccggatctttattagccatgtggaacggctcctctctgagcgatgccgggcccccacctatttctcggtccggcgcagcttccatgcccagcagtccgaaacaggctcggaagatgtccatccaggactctctggctctgcagccaaaactgacccgccataaagagctcgcctccgaaaatatcaacctgcgcaccagaaaatacagtagtagttctttgtcccacatgggcgcttacagccgaagcctgccacgcttatatagagcaacagaaaaccaactgaccccactatcactcccccctaggaattctcttggcaacagcaagaggacaaagctcggtgaaaaagatctgccacacagcgtgatcgacaacgacaattatctgaacttctcctcattatcaagcggagccctcccatataaaacctccgccagcgaaggaaatccctatgtgtccagtaccctgtctgttccagctagccccagagtcgcgagaaaaatgctgctggcttctacctcatcttgcgcaagcgatgatttcgaccaagcttcatatgtggggacaaacccatcccattctctcctggccggagagagtgatcgggtgttcgctacccggaggaatttctcctgcggctccgtggagttcgacgaggctgatctggagtctctcaggcaggctagcgggaccccccagcctgcgctcagggagcggaagtcttctatctcaagcataagtgggcgggatgacctgatggattatcatcgacgccagagagaagagaggctaagggagcaggagatggagaggctggaaagacagcgtctggagacgatcctctctctctgtgcagagtatactaaaccagacagcagactgtccactggtacaaccgtggaagatgtccagaagatcaacaaggagctcgagaaactgcaactttcggatgaggagtctgtgtttgaggaagcgctcatgtcccctgatactagatatcgctgccatcggaaggattctcttccagacgctgatttggcaagctgcgggtccctgtcccagtcctcagcctctttttttacccccaggtctacaagaaacgacgaactgctgtctgatttgacgagaaccccccccccaccgtccagtacattccctaaggcgtccagcgagtcctcctatttgtccattctgcctaagactccagagggaatatccgaagaacagcggtcacaggagctggctgctatggaggaaactagaatcgtgattctgaataacctcgaagagctgaaacagaagattaaggatatcaacgatcagatggacgaatcatttagagagctggatatggagtgcgcactgctggatggggagcagaaatccgagaccaccgagctgatgaaagagaaggagatcctggatcacttgaatcggaagatagccgagctcgaaaaaaacatagttggcgagaaaaccaaggacgccgacttgctggacgttgaaagcaagcatttcgaggacctggaatttcagcagctggagcatgagtcacgccttgacgaagagaaagagaacttaacacagcagttacttcgcgaggtcgcagaatatcagcggaatatcgtgagtaggaaggagaaaatcagcgcgctgaaaaagcaggctaaccacatagtgcagcaggctcagcgcgaacaggaccatttcgtcaaagagaaaaacaatctaatcatgatgctccagcgtgagaaggaaaacctgtgtaacctagaaaagaagtatagctcactatccggtgggaaaggattcccagtcaacccaaacaccctgaaggaaggctacatctctgtgaacgagatcaatgagccgtgcggaaactcaactaatcttagtccctcaacccagttcccggccgacgctgacgcagtagctaccgaacctgccaccgctgttcttgctagccagccacaaagcaaggagcacttccgcagtctggaagagcgcaagaaacagcataaagagggcctgtatctctccgacacactgcctcggaagaaaacgacaagctctatcagcccacatttttcctccgccaccatgggccggtccatcacccccaaggcccatttgcccctgggtcagtcgaacagttgcggttccgtgcttcctcctagccttgccgccatggcaaaagacagcgaaagccggaggatgcttcgggggtataaccaccaacagatgtctgaaggacaccggcaaaagtctgaattctataaccgaaccgcctcggaatccaatgtctatctgaatagcttccactaccccgaccacagctataaagatcaggcgtttgataccctatcactggactcctcagattccatggagacttctataagtgcctgcagccccgacaatatcagttccgcatccacctctaatatcgcccggatcgaggaaatggaaaggctgctcaaacaagctcatgcagaaaagacccggttactcgaaagtagggaaagagagatggaggccaagaagcgcgctctagaggaagaaaagcgtaggcgggaaatccttgagaaaagactgcaagaagagacaagtcaacgtcagaaacttatcgagaaagaggttaagatccgcgaacgacaacgggcccaggccaggccgcttacccggtacctgcctgtaagaaaggaggacttcgatctaagatcacacgtagagaccgccggacacaacatcgatacatgctatcacgttagcatcacggaaaagacgtgtagaggcttcctgattaaaatgggcggtaaaatcaaaacctggaagaagagatggttcgtatttgacagaaataaacggaccttttcctactacgcggacaaacatgaaaccaaactgaagggggtgatctattttcaggctatcgaggaagtctactacgaccatctgaagaacgctaataagtctcctaacccgctcttgacctttagtgttaagacccatgacagaatctattatatggtagccccatctccggaggcaatgcggatctggatggatgtaatcgtcactggagctgaaggctacacacatttcttactgtag

SEQ ID NO: 44884 - DNA, 3348 bp, Artificial Sequence
  Description of Artificial Sequence: Synthetic coding sequence
atggaggagcacagctacatccagaaggagctggacctgcagaacgggtcacttgaggaggattcagtcgttcactcagttgagaatgattcgcagaatatgatggaaagtctgtcacctaagaagtattctagttctttgcggtttaaagccaatggcgattatagcggttcatacctgacactgagccagcctgttcccgccaagcgatctccttcccctcttgggacatctgtccgcagcagcccaagcctcgcaaagattcaaggcagtaagcaattcagttacgatgggaccgataagaacataccaatgaagccccctacaccactgctgaataccacatcaagtctgtcaggctatcccctggggcgtgctgatttcgaccattataccggcagggattcagaaagagccctaagactgagcgagaaacctccttatagtaagtactccagccggcataagtcacatgacaacgtctattccctgggaggcctagagggcagaaaagcctctgggagcttattggccatgtggaacggctctagcctcagcgatgccggaccaccgccgatttccaggagcggcgcggcttctatgccatcctccccaaaacaggccaggaagatgagcattcaggattccttggctttgcaacctaaattgaccagacacaaagaactggccagcgagaatataaacctacgcacccggaagtactctagttcatctctgagccacatgggtgcttactccagaagtctacccaggttatatcgggccacagaaaaccagttaacacctctgtccctcccaccccgcaacagtctcggcaactccaagcgcacgaagttaggcgaaaaggacctgccccactcagtgatcgacaatgataactatctgaacttttcctcactaagctcaggggccctgccttacaaaacttcagcatctgaaggcaatccctatgtgtcttcaactttgtctgtcccagcctctccaagggttgcaaggaagatgctgctcgctagtaccagctcatgcgcctcagatgattttgaccaagcgtcatacgtcggcacaaatccctctcacagcctcttggccggggagtcagaccgagtgtttgctaccaggcgcaacttctcatgcggatccgtggaatttgatgaagctgatctcgaatccctgaggcaagcctctggaacccctcaacctgctctccgtgagcgcaagtcaagtataagctccatatccggcagagatgacctgatggattaccataggagacagagggaggaacgccttcgggagcaggaaatggagcgtctggagaggcagcggctcgagaccattttgtcactatgcgccgaatacacaaaaccagatagtagactgagcactggaaccacagtagaggatgtccaaaagatcaacaaagaactggagaagcttcaacttagcgacgaggagagtgtatttgaagaggctctcatgagccccgacacccgctatcgttgccaccgaaaggatagtttaccggacgcagatctggcgtcttgcggctcattgagtcagtccagcgcaagcttcttcacaccccggtctacccgaaacgacgaactgctatcagatttgacccgaactcctcccccgccgtcatccaccttccccaaagcatctagtgaaagcagttacctgtccatactgccaaaaacccctgagggcatctcggaagaacagaggtcccaggaactggcggcaatggaggagacgcgaatcgtgattcttaacaatttggaggagctaaagcagaagattaaagatattaacgaccagatggacgagagttttagagagctggatatggagtgtgcccttctcgatggggagcagaaatcggagacgacagaactgatgaaagaaaaagagatcctggatcatctgaaccggaaaatcgccgagctagaaaagaacatcgtaggcgagaagactaaagacgccgatctgctcgacgtcgagtctaaacactttgaggacctggagttccagcagctggagcatgaatccaggctcgacgaggaaaaggagaatctgacccagcagcttctcagggaggttgcagagtatcagaggaatattgtttctaggaaagagaagatctcagcgctgaagaaacaggcaaatcatatcgtccaacaagcccaaagagagcaggatcacttcgtgaaagagaagaataaccttatcatgatgctgcagcgtgaaaaggaaaacctgtgcaatctggagaagaaatacagtagcctgagcggtggaaaaggctttcccgtaaacccaaataccctcaaggaggggtatatatctgtgaacgaaatcaacgaaccgtgcggcaactcaacgaacctgagcccaagtacgcagtttccagccgatgcagatgccgtggccactgaaccagccaccgctgtgcttgcctctcaacctcagtcaaaggagcattttcgtagcttggaagagagaaagaaacagcacaaggaaggactatatctatccgacaccttgccacgtaagaagactacatcaagcatttcaccccacttctccagtgctactatgggtagatcaattaccccaaaggcacatctcccactaggccagagtaattcctgcggctcagttctgcccccaagccttgccgcaatggctaaagatagtgagtctaggaggatgctacgtggatataaccaccaacaaatgtccgagggtcatcgtcagaagagcgagttctataatagaactgcatcagagagcaatgtctacctgaactccttccactacccagaccatagttacaaagaccaggcctttgacacactgtcactcgactccagcgacagcatggaaacatcaatttccgcttgctctcctgacaatatcagctcggcgtctaccagcaacatagctcggatcgaagagatggagcggctgctaaagcaagcacacgcagaaaagacaaggctgctcgagtcaagagaaagggaaatggaggccaaaaaacgcgccctggaagaagagaaacggcgacgagaaattctagagaagcgtcttcaggaggagacctcccagcggcagaagttgatcgaaaaagaagtcaagatccgagagcgccagagggctcaggcgcggcccctgacaaggtatttgcctgtccgcaaggaagattttgacttgaggtcacacgtggagaccgccggacacaacatcgatacctgttaccatgtgagcatcaccgagaagacatgtcgcgggttcctgataaagatgggaggcaagattaagtag

SEQ ID NO: 44885 - DNA, 5616 bp, Artificial Sequence
  Description of Artificial Sequence: Synthetic coding sequence
atgcccagcgtgtgcctgctgctgctgctgttcctggccgtgggcggtgctctcggtaatcgcccatttagggcattcgttgtcaccgacactaccctcacccatctggccgtgcatagagtaacaggggaagtatttgtgggcgctgtaaacagggtatttaaattggctcccaatctgaccgaactgagagcccacgtgaccggacctgttgaagacaatgcacgctgctaccctcctccttcaatgagggtttgtgcacatcggctggccccagtagataacattaataaactgttgttaatagactatgcggcgcgccgactcgtggcctgcgggagtatctggcaggggatttgccagtttctccggttagatgatctgttcaagctgggcgagccacatcacagaaaagagcactatctctccggcgcgcaggagcccgactcaatggctggggtcatcgtcgagcagggccagggcccatcaaaactgttcgtcggtaccgcagtggacggcaaaagcgagtattttccaaccttgtcctcacgcaagctgatctccgatgaggactcagcggatatgttctcattggtgtatcaggacgagttcgtgtcttcacagatcaaaattcctagtgatacccttagcctttatcctgcatttgatatctattacatatacggctttgttagcgccagcttcgtttactttctgaccctccaactggacacccagcaaacactgctcgacaccgctggggagaaatttttcactagcaaaatcgtgcgtatgtgtgcgggagactcagagttctacagttatgttgaatttcctataggctgcagctggcggggcgtggaataccggttagtccaatccgctcacctggccaagcccggactgttgctggctcaggctctcggagtacccgcagacgaggatgtgttgttcacaatattttctcagggacagaaaaacagggcgagccctccccggcagaccattctctgcctctttactctgagcaacatcaatgcgcacattaggaggaggatccagtcttgctatagaggggagggcactcttgcgttgccatggctgctgaataaggagctgccttgtatcaatacccccatgcagattaacggcaacttctgtggcctggtcttgaaccaacccctcggcggccttcatgttattgaaggcctgccactgctggcggattctacagatggaatggcatcagtggcagcttacacctatagacagcactcagtggtgtttattggcactaggtctggctctcttaaaaaggtgcgagtagatggcttccaggacgcccacctgtatgaaacagtgcctgtagttgatggttcccctattctgcgggatctgctgttttcacccgaccaccggcacatttacctgctgagcgagaaacaggtctcgcagctccctgttgaaacctgtgagcagtaccagagctgtgcagcgtgccttggttccggagatcctcattgtggctggtgcgtgcttagacatcgctgctgtagggagggggcttgtcttggagctagcgcacctcacgggtttgctgaagagttgtctaagtgcgtgcaggtcagagtgagacctaacaatgtgtccgtaacgtccccgggtgtccaactcaccgtgactctgcacaacgtcccagacctttctgccggagtgtcctgcgcattcgaagccgcagccgagaatgaagcagtgctgcttccgagcggggagctgctgtgtccctctccaagccttcaggagctgcgtgccctgacaagaggacacggagcgactcgaacggtgaggctgcagttactgtccaaagaaaccggagtacgcttcgcaggggctgactttgtgttttataactgttctgtgttacaatcttgcatgtcctgtgtcgggagtccgtacccctgtcactggtgtaagtataggcacacctgcacaagtagaccccacgagtgttcatttcaagagggaagagtccattccccggaggggtgcccggaaattctaccatccggagacctgttaatccccgtgggggtgatgcagcctctcactctgagggcaaaaaatttgccccagcctcaatccggacaaaaaaactatgaatgcgtggttcgggtccagggccgacaacaaagagtgcctgctgttcggttcaattccagctctgtgcagtgccagaatgcctcctactcttacgaaggggacgagcacggagataccgaactggacttctccgtagtttgggatggcgactttcctattgacaagcctccctctttccgcgcgctgctttataagtgttgggcacagaggccatcatgcggactatgcctgaaagcagaccctcgttttaactgtggctggtgcattagcgaacacagatgtcaactcagaacgcactgccctgccccgaaaactaactggatgcacctctcccagaaaggtacgaggtgcagccacccaaggatcacacaaatccacccactggtgggcccgaaagaaggggggacacgcgtgaccatagtgggagataacctcggacttcttagccgggaggtggggcttcgcgttgccggcgtgcgatgtaatagcatccctgccgagtacatcagcgccgagaggatagtctgtgaaatggaagagtctctggttccaagtccccctcctgggcccgtggaactgtgcgtaggcgactgctctgccgactttcggacccagagcgagcaagtctactcttttgtgactccgactttcgaccaggtgtccccatcccggggtcctgcttctggcggaacccggcttactatctctggctcctctcttgacgcaggcagccgtgtgacagtcactgtccgtgactctgaatgccagtttgtgcgccgtgacgccaaggctattgtttgcatttccccattgagcacgctgggcccaagccaagccccgattaccctggccatcgacagggcaaatatctccagcccggggctgatctacacatacacgcaagatccaacagtgacccggttggagcctacctggtccatcattaacggctccacggccataacagtatccgggacccatctgctcaccgttcaggaacctcgggtgagagccaagtataggggaatcgaaactaccaatacatgtcaggtcattaacgataccgcgatgctgtgtaaggctccaggtatcttcttagggaggccccagccaagggcccagggcgagcatcccgatgaattcggcttcctgctggatcacgtgcagactgcgagatctttgaaccgtagctccttcacttactatccagacccaagctttgaacctttgggaccttcaggtgtgctcgacgtcaagcctggctcccacgtggtccttaaggggaagaacctcatcccggcagccgctgggtcctcacgcctgaactacaccgtgttgattggcggtcagccgtgttcccttactgtgagcgatacacagctactttgcgacagtcctagccaaaccggtcgccagcccgtgatggttctggttggcggactggagttctggctgggtacgctgcacatttctgccgagagggcactgaccctccctgccatgatgggactggccgctgggggcggcctgttgttgctggccattacagctgtgttggtggcgtataaacgtaagactcaggacgccgacagaacactgaaacgcctgcaactgcagatggataacctagaaagcagggttgccctggaatgtaaggaggctttcgcagagctccagaccgacatcaacgagctgaccaatcacatggacgaggtccagatacccttcctggattacaggacatatgcagtgagggtgctgtttccaggcattgaagcccacccagtcttgaaggaattggacactcccccgaatgtggagaaggcccttcgcttattcgggcagcttttgcattctagggcctttgtgctgaccttcatacacaccctggaagcgcaaagctccttcagcatgagagacagggggactgtcgcctccttaacaatggtcgccctgcaatctaggctggactacgctaccgggctcttaaaacagctactcgcggacttgattgagaaaaacctcgagtccaagaaccaccctaagttgctgctcaggcgcaccgaatccgtggcagagaagatgttgactaactggttcactttccttctccacaagttcctgaaggaatgtgcgggcgaaccgctgttcctgttgtactgcgccataaaacagcagatggaaaaaggtccaatcgacgctatcacaggcgaagctcgttatagtctgagtgaagataagctgatacgccagcagattgattacaaaactctcactctccattgcgtgtgccccgagaacgagggctccgcacaggtccccgttaaagtcctgaactgtgattcaattacacaggcgaaagacaagctactggatacggtgtacaagggcatcccttacagccaaaggcccaaggccgaggatatggacctggagtggagacagggcaggatgacccgcatcatcctacaggatgaggatgtcacaacaaagattgaatgcgactggaagcgactgaattcacttgcacactaccaggtgactgacgggtctctagttgcattggtgccgaagcaggtgtctgcctataacatggcaaacagcttcacgtttacacggagtctgtccagatacgagagcctcttacggaccgcaagtagtcctgacagccttaggagcagagcccctatgataacccctgaccaagaaacaggcaccaagctgtggcacctggtgaagaatcatgaccacgctgatcaccgagaaggcgaccgcgggagcaagatggtcagtgaaatctacctgacgcgactgttggctaccaagggaacgttgcagaaattcgtggatgacttgttcgagactgttttttctaccgcacatagaggatctgctctcccgttagctatcaaatacatgttcgactttcttgatgagcaggccgatcagaggcaaatctctgatcccgatgtgcggcatacgtggaaaagcaactgcctacctctcaggttctgggttaatgtcatcaaaaaccctcagttcgtgtttgatatccataagaattccataactgatgcttgtctcagcgttgtggcccagaccttcatggacagctgttcaacatctgaacatcggcttggcaaggattccccatctaataagctgctgtacgctaaggatataccaaactataagagttgggtggagcgctattatagggatatagctaagatggcctctatttcggaccaggacatggatgcctacttagtcgaacaaagtaggctgcacgcatcagatttttcggtgcttagtgctctcaatgaactgtacttttatgtgacaaaatacaggcaagagatcctcaccgctctggatcgcgatgccagttgtaggaagcataaactccggcagaagctcgagcagatcattagccttgtttccagtgactcatag

SEQ ID NO: 44886 - DNA, 4707 bp, Artificial Sequence
  Description of Artificial Sequence: Synthetic coding sequence
atggaggtgagccggcggaaggcccccccccggcccccccggcccgctgctccactgcccctgctcgcatatctgctggcattggccgctcctgggaggggtgctgatgaacctgtgtggagatctgaacaggccatcggcgcaattgctgcttcccaggaggatggggtattcgtggcaagcggatcctgtctcgatcagctggactacagccttgagcacagtctgtctcgtctttatcgtgaccaggctggaaactgtacagagccagtcagtctggctccccctgctagacctagacctggctcatcgttttctaaacttcttttgccatatagggagggcgccgcaggcctgggggggttgctactgaccggatggacattcgatcggggagcatgcgaggtcaggccactgggcaaccttagccggaattcactgaggaatggaaccgaggtggtttcttgccacccacagggctccacggccggcgtcgtctaccgggctggccgaaataacagatggtacctcgccgtggccgctacatacgtgctgcctgaacccgagaccgcttctagatgcaacccagccgccagcgaccatgataccgccatagccctgaaggacactgaaggacggtccttagccactcaggagctgggtcgactaaagttatgtgagggtgctggatcactccattttgtggacgcatttctgtggaacggctccatctatttcccatactacccatacaattacaccagcggggctgccacaggttggccgtcgatggcccgcatcgctcaatcaacagaggttttgttccagggtcaggcttctctcgattgtgggcatggccatcccgacggtcgcagattactattaagctcctccctggtggaggcattggatgtgtgggccggggtcttcagtgctgcggccggggagggtcaggagagaagatccccaacgaccactgctctctgcctcttccgcatgagcgagattcaggctcgtgccaagcgtgtctcctgggacttcaagacagccgaatctcattgtaaagagggtgatcagcccgaaagagttcagcctattgccagtagcacgctgattcattcggacctcacaagcgtttatggtaccgtggtgatgaaccggactgtccttttcttgggtaccggcgatggccagttgttaaaagtgattttaggtgagaacctgacatcaaactgtccagaggtgatctacgagattaaagaagagaccccagtgttctataagctcgtgcctgacccagtaaagaacatttatatttaccttacagccgggaaagaagttcggagaatcagggtggctaattgcaacaaacacaaatcgtgtagcgagtgcctgacagctaccgacccccattgtgggtggtgtcactcccttcagagatgcacgttccaaggagactgtgtgcattccgagaatttggagaattggctggacatcagtagcggagctaaaaaatgccccaagattcagatcattcggtccagcaaggaaaagactaccgtgacaatggtgggatctttcagccccagacattcgaagtgcatggtgaagaatgtagatagttctcgagaactgtgccagaataagtcccagcccaaccgtacctgcacttgttctatccctacccgggccacctataaggatgtctccgtagtcaatgtcatgttctcttttgggagctggaatttatccgacagattcaacttcaccaattgctctagcttgaaagagtgtccagcgtgtgttgaaacgggctgcgcttggtgcaaatccgcaagacgttgtattcacccctttaccgcttgcgatccttcagactacgagaggaatcaggaacaatgtccagtcgccgtcgaaaagacaagcggcggggggagaccaaaggagaataaaggtaatcgaactaaccaagccctgcaggttttttatataaagtctatcgagccacagaaagtgtctaccttgggcaaaagcaatgttatcgtcaccggcgccaactttacaagggcttctaacattaccatgatacttaaggggacaagtacatgcgataaagacgtaatacaggtttcacacgttctcaatgacacacatatgaagttctcattgccatccagcagaaaagagatgaaagatgtttgcattcagttcgacgggggcaattgcagttctgtgggatctctgtcatacatcgctctgccccactgcagtctgatttttccagccacaacttggattagcgggggccagaacatcactatgatggggcgcaattttgacgtaattgataatctgatcatctcccacgaattgaagggcaatatcaacgtgtctgagtattgtgtcgccacatattgcggattcctggccccaagcctaaagagttccaaagttagaaccaacgtcaccgtcaaacttcgagttcaggatacatatctggactgtggaaccttgcagtatcgcgaggaccctaggttcacaggttatcgggtcgagagtgaggtggatactgaactggaggtgaaaatccagaaagaaaacgataacttcaacatcagtaagaaggatatcgaaattaccctgtttcacggagagaacggacagttgaactgctcattcgagaatatcacgagaaaccaagacctgacaacaattttatgcaagattaaggggattaaaaccgcatccactattgcaaactccagcaaaaaggtccgggtcaagcttggcaacctggagctttacgtggagcaagagtccgtaccttctacctggtactttctgattgtgctgccagtgttgctagtgatcgtgattttcgccgctgtcggggtaacgaggcataagtcaaaggagctgagcagaaaacaaagccagcagttggagctcctggagagcgagcttcgaaaggaaattcgagacggattcgctgagttgcaaatggacaaactggatgtcgtggactctttcggtacagtgccctttcttgattacaaacactttgcattacggacattctttcctgagtccggtggcttcactcacatcttcacggaggacatgcataaccgcgatgccaacgacaagaacgaatcactgactgcactggacgcgcttatttgcaataagagctttttggtaactgtgatccatacattggagaagcaaaaaaacttttccgtgaaagatcggtgcctttttgccagctttctcaccatcgctctgcaaactaagcttgtgtacctgacttcaatcctcgaagttcttacacgggatctgatggagcaatgcagtaatatgcaacctaagctgatgctgagacggacagagtcagtggtggagaagttactgaccaactggatgagtgtgtgcctatctggcttcctgcgtgagaccgtgggtgagcctttctacctattggtgactacccttaatcagaagatcaacaaaggcccggtggacgtaatcacgtgtaaggctctttacactctcaatgaggattggctgttgtggcaggttcctgaatttagtacagtagctctgaacgtggtgtttgagaaaatccccgagaatgagtcagcagacgtgtgccgtaacatcagcgtgaatgtgctcgattgcgacaccattggccaggctaaagagaagattttccaagcattcctctcgaagaatggatctccttacggactgcagctaaatgaaattgggctcgaactgcagatgggcactcgacagaaggagcttctcgatattgattcctccagtgttattcttgaggatgggattactaagctgaacacaataggacactacgagatcagtaacgggtctacgatcaaagtgttcaagaaaatagcgaatttcactagcgacgtcgagtatagtgacgatcattgccacctgatcctacccgacagcgaagcattccaggacgtgcaaggcaaaaggcatcgagggaagcacaagtttaaagtgaaagaaatgtacctcaccaaactgttgagcactaaggtggctatccactctgtacttgaaaagctgttccgctctatttggtctctccccaattcccgagctccttttgcaattaaatacttcttcgactttcttgatgcccaggcagagaataaaaagattacggatcctgacgtggtacacatttggaagaccaatagtcttcctctacggttctgggtgaacatcctgaaaaatccccaattcgtgttcgacattaaaaaaacgccccacattgatggctgcctgtccgttatcgcgcaggcttttatggatgcttttagtctgactgaacagcaactcggaaaagaggctccgacgaataagctgttgtatgctaaggatatccctacatacaaggaggaggttaaaagttactataaagccattagggacctcccacctctaagcagctctgagatggaagagtttctgacgcaggagtccaaaaagcacgagaatgaattcaacgaggaggtcgctctcacagaaatctataaatacattgtgaaatatttcgacgaaattctgaacaagctcgagcgggaacgggggctcgaggaagctcagaaacagctgctgcacgtgaaggttttgttcgacgagaagaagaagtgtaagtggatgtag

SEQ ID NO: 44887 - DNA, 1848 bp, Artificial Sequence
  Description of Artificial Sequence: Synthetic coding sequence
atgcagcacctgtgcctgctggccgccgtgggcgtgacccggcacaagagtaaagagctgtctagaaaacagagccaacaactggagttgctggagtccgaactcagaaaggagatccgagatgggttcgctgagctccagatggataagctggatgtggtagatagctttggcacggttccattcctggattacaaacatttcgccctccggaccttttttcccgaatcgggggggtttactcatattttcactgaagacatgcacaatcgcgacgcaaatgacaaaaacgaatctttgacggcactagacgcgttgatttgcaacaagtccttcctggtgactgtcatccacaccctggagaaacagaagaattttagcgtaaaagaccgctgcctgttcgccagctttctgactatcgccctccaaactaagctggtctacctgacttcaatcctggaggtgctgacccgtgaccttatggaacaatgttctaatatgcaaccaaagctgatgttaaggagaaccgagtcagtggtcgagaaactgctgacaaattggatgtcagtatgcctgtcagggtttctgagggagaccgtgggggaacctttttacttgctggttaccacactgaaccagaagattaataaaggccccgtggatgtcattacctgtaaggcactctacaccttaaacgaggactggctcctgtggcaggtgccggaattctccacagtagccctgaatgtggtctttgagaagatccccgaaaatgaatctgccgacgtgtgtagaaatatatcagtgaacgtcctagactgcgacacaatcggtcaagccaaggaaaagatcttccaggcatttctgtcaaaaaatgggagcccatacggcctgcagttgaatgaaatcggcctggagctgcagatggggacccggcagaaggaactactggacattgattccagctctgttatcctggaagacggcattactaaattaaacacaatcggacattatgagatctccaatggtagcaccatcaaggtgtttaagaagatcgcaaatttcacaagcgacgtcgagtatagcgatgaccactgccatttaatcctgccagacagcgaggcgttccaggatgttcagggcaaacgccacagagggaaacacaagttcaaagtgaaggagatgtacctgaccaaactattatccactaaagtggcaatacattcagtgctagagaaactgttcaggtctatctggagcctcccaaactcaagggcccctttcgctattaagtacttctttgacttcctcgacgcccaggcagaaaataaaaagatcactgatccagacgtcgtgcatatctggaagactaactcccttcccctccggttctgggttaatatccttaagaacccccagtttgttttcgacattaagaagactccgcacatcgacggatgcctgagtgtcattgcacaggctttcatggacgcattcagtctcaccgaacagcaacttggcaaagaagctccaacaaataaactgttgtatgctaaggacatcccgacctataaggaggaagtcaagagttactacaaagcaataagagacttgccacctctctccagttcagaaatggaagaattcctcacccaggaatccaagaaacatgaaaacgaatttaacgaggaggtcgctcttaccgaaatatataagtatattgtgaagtacttcgatgagatcctgaataaactggagagagaacggggactcgaggaagctcagaagcagctactgcacgttaaagttctgttcgatgaaaaaaaaaaatgcaagtggatgtag

SEQ ID NO: 44888 - DNA, 1593 bp, Artificial Sequence
  Description of Artificial Sequence: Synthetic coding sequence
atgggccggctgctgcgggccgcccggctgccccccctgctgagccctctcttattgctcttagtcggtggggcattcctgggggcgtgcgtggctggctcggacgaaccaggccccgaggggctcacctcaaccagcctgcttgatctcctgctgcctacgggcctcgagcccctggattctgaggaacctagtgagactatgggtctcggagctgggctgggagcaccagggtcaggattccctagcgaagagaacgaggagtccaggatcctccagccccctcaatacttctgggaggaggaagaggaactgaatgattccagtctcgatctcgggcccacagctgattacgtgttccccgatctgaccgaaaaggccggcagtattgaggatacatcacaggcccaggagctgcccaacctcccaagtcccctaccaaagatgaatcttgtggaaccgccatggcatatgccaccaagagaagaggaggaagaagaggaggaagaagaggaacgcgagaaagaagaggtggagaagcaagaagaagaagaggaagaagaactcttgcctgtcaacggttcccaggaggaggccaagccacaggttagagacttcagcttaaccagcagcagtcaaacacccggtgccacaaaatctcggcatgaggactctggggatcaagcctctagcggtgtagaggtggagagctctatgggccctagcctgttactgccgtctgtgaccccaaccaccgtgactcctggagaccaggattctacaagccaggaggctgaggcaaccgtgttgcccgccgctgggctcggtgtggaattcgaagctccacaggaagccagcgaggaggccaccgcaggagcagcaggactgtccggtcagcacgaggaagtacccgccctccctagtttccctcagacaaccgctccatctggagcagagcaccccgatgaggacccacttggcagcagaacgtcagctagctcccccccacaactgctcgctctggtggaggaagtcctgccaagacacgggtctggtcaccatggggcctggcacattagtctttctaaaccgtccgaaaaggaacaacacttactaatgaccctagtcggggaacagggtgtagtaccaacccaggatgtcctatccatgttgggagatatcagacgtagtctggaggagatcggcattcagaactactccacaacctcctcttgccaggcaagggcctcccaggtgcgcagtgattacgggaccttgttcgtggtactcgtggtgatcggagctatctgcattattattattgctctcggccttctgtataactgttggcagaggagactcccaaaacttaaacacgtatcccacggcgaagagctgcgcttcgtcgagaatggatgccacgataaccccacgctggacgtcgcttccgatagccagtctgagatgcaggaaaaacaccccagcctaaatggaggaggggcactgaatggcccgggctcctggggcgctcttatgggtggcaagcgtgatcccgaggactcagatgtatttgaagaggatactcacctgtag

SEQ ID NO: 44889 - DNA, 1818 bp, Artificial Sequence
  Description of Artificial Sequence: Synthetic coding sequence
atgggccggctgctgcgggccgcccggctgccccccctgctgagcccactgctgctgcttctggtgggtggcgctttcctgggagcctgcgttgccggctctgatgaacctggcccagaaggactgacctctacgtccctgctggatcttctcctaccgacaggactggagcctctggactcagaagagccctctgagacaatggggctgggagccgggctcggggctcctggatctggtttcccctccgaagagaacgaagaatcccggatattgcaacccccccaatatttttgggaggaggaggaggaactaaacgacagctccctggatctcggaccaacagctgattatgtctttccagacctcactgaaaaagctggatcaatagaggacacctctcaggcccaggagctgccaaatctgcctagccctctgccgaaaatgaacctggtggagcctccttggcacatgcctccacgagaggaggaagaggaagaagaagaggaagaggagcgagagaaagaagaggtcgagaagcaggaggaagaggaggaagaggagcttctgcccgtcaacggcagccaggaggaggccaagccccaagtgagggatttttccctaacatcaagttcccagacccccggcgctacaaagtcccgtcacgaagacagtggtgatcaggcgagtagcggcgttgaagtggagtcgtcgatgggaccttctttgctactgccatccgtcacacccacgacagtgacacccggagaccaggactctacttcccaagaggcggaagcaacagtgttacccgccgccggccttggcgtggagttcgaggcaccccaggaagctagcgaagaggcaaccgccggcgcagctggtttgagtggtcaacacgaggaagtgcccgctctgcctagtttcccccagacgacagccccttctggcgcagagcatcctgatgaggacccactgggttctcggacctctgctagcagcccccttgcccccggggatatggaactcaccccatccagtgctacgcttgggcaggaggatttaaatcaacagctcctagagggccaggcagctgaggcccagtcgcgtatcccatgggacagtacccaagtaatctgcaaagactggagtaatctggcaggtaaaaattatatcattctgaatatgaccgagaacatcgactgcgaggtgttccggcagcataggggaccgcaactcctggccttggtggaagaggtgctgccacggcacggctccggacaccatggcgcttggcatatctcactgagtaaaccctcggagaaggagcaacacctgctgatgaccttggtgggggaacagggagtggtgcccacccaggacgtgctctcaatgttgggggatatccggagatcattggaagagatcgggattcagaactactccacaacttccagttgtcaggccagggcttctcaggtgcggtccgactatgggacgctgtttgtggttcttgtggtgataggagcaatttgcatcattatcatcgcccttggcctgctgtataattgttggcagaggcggctgcccaagctgaagcatgttagccatggtgaagagctgcgattcgtggaaaatggctgccacgacaacccaacattggatgttgcatcagatagccagtccgagatgcaggagaaacatccttcacttaatgggggtggcgccttgaacggaccgggctcctggggcgccctgatgggagggaaaagagaccctgaagacagcgacgtgtttgaagaggatacccacctctag

SEQ ID NO: 44890 - DNA, 717 bp, Artificial Sequence
  Description of Artificial Sequence: Synthetic coding sequence
atgctgacccccctgggcaagttcagcaccgccaagttcgccgtgagactgcctagagtgtgggaggcgcgcgcgccctccctgtcaggggctcctgcgcctactccccccgcaccacctcccagtcggtctagccggctgggcctgtggccacggtgtttcctaatcttcccacagcttcggatcttgctgttgggaccacaagaatctaacaactcaacgggcaccatgtggaaagtcagtgccctgctattcgtgctcgggagcgccagtctttgggtgctggctgagggagctagcacaggtcagcctgaagatgacactgaaactactggccttgaaggaggcgtcgctatgcccggcgcggaggatgatgtcgtgacccctggaactagcgaggatcggtacaagagtggcttgaccactctcgttgcaacatcagtaaacagtgtcacaggtattcgcatcgaggatctgcccacctcagagagcactgtacacgctcaggaacagtctcctagcgcaaccgcatccaacgtggccacaagccatagcaccgagaaagttgatggcgacactcagaccaccgtggaaaaggacgggctgagcaccgtcaccctggtgggcattatcgtgggtgtgctgctcgcaattggctttataggcgccatcatcgtggtcgtgatgcgcaaaatgagcggtcgttactctccttag

SEQ ID NO: 44891 - DNA, 711 bp, Artificial Sequence
  Description of Artificial Sequence: Synthetic coding sequence
atgctgacccccctgggcaagttcagcaccgccaagttcgccgtgaggctgccaagggtgtgggaggccagagcaccgtcattgagcggcgcaccagcacccactcctcccgccccccctccaagcagaagcagtcgcctcggcctttggcctaggtgcttcctgattttccctcagttgagaatactgttactgggaccgcaggagagtaacaacagcactgggaccatgtggaaggtgtcggctttgttattcgtgctcgggtccgcaagcctctgggttctggccgagggcgccagcacagggcagcctgaagatgataccgagactaccggactggaaggcggggtggccatgcccggcgctgaggatgatgtcgtgacgccagggacttctgaagatcggtacaagtctggtttaactacattagtcgccacttccgttaattctgtgacaggcatccgaatcgaggatctgcctacttcagagtctactgtgcatgcacaggaacagtccccgtctgccacggcatctaacgtggcaactagtcacagcacagagaaagttgatggcgacacacagacaaccgtagaaaaggacgggctctctacagttaccctggtcgggatcattgtgggggtgctgctggccattggcttcattggcgctattatcgtagtggttatgcgcaaaatgtccggacgcccgtag

SEQ ID NO: 44892 - DNA, 363 bp, Artificial Sequence
  Description of Artificial Sequence: Synthetic coding sequence
atgcccggcgccgaggacgacgtggtgacccccggcaccagcgaggaccgatacaaatccggcctcacaacactggtggctaccagcgtgaactcagtcaccggaatcagaattgaggatcttccaacaagtgaaagcaccgttcatgcccaggaacagtcaccctctgccacggctagtaatgtagccacttcccactcaaccgaaaaagtggacggcgatactcaaactactgttgagaaggacggactgagtaccgtgacccttgtgggaattattgtaggagtgttactggctatcggctttattggagccatcatagtggtcgtgatgaggaaaatgtcaggccgatatagcccctag

SEQ ID NO: 44893 - DNA, 357 bp, Artificial Sequence
  Description of Artificial Sequence: Synthetic coding sequence
atgcccggcgccgaggacgacgtggtgacccccggcaccagcgaggacaggtataagtccggcttgactacgttggtggcaacttcagttaactccgtgacaggcatccgcatcgaagatctgcctacatctgaaagcacagtacacgcccaggaacagagccccagtgctactgcttcgaacgtcgccacgagtcatagcacagaaaaggtggatggtgacacccagaccactgtcgagaaagacggcctgtcaaccgtcaccctggtagggatcattgttggggtgctgcttgccattggcttcataggggctatcatcgtggtcgtcatgcggaaaatgtcagggaggccgtag

SEQ ID NO: 44894 - DNA, 363 bp, Artificial Sequence
  Description of Artificial Sequence: Synthetic coding sequence
atgcccggcgccgaggacgacgtggtgacccccggcaccagcgaggacagatacaagtctggattaacaaccttggtagccaccagtgtgaactccgtcacaggaatccgcatcgaagaccttcccacttccgaatctactgtccacgcgcaggaacagtcaccttcagcaacagcaagcaatgttgcaacatcccattcaacggagaaggttgacggggatacacagacaacagttgagaaagacgggctttccacggtgacactagtgggaatcattgtcggagtgctgctcgccatcgggttcatcggcgccattatcgtcgtcgtaatgagaaaaatgagcggtagatactctccctag

SEQ ID NO: 44895 - DNA, 363 bp, Artificial Sequence
  Description of Artificial Sequence: Synthetic coding sequence
atgcccggcgccgaggacgacgtggtgacccccggcaccagcgaggatagatataagtctgggctcaccacactggtagcaacatcagtgaattcagtcacagggataaggatcgaagacctccccacaagcgagagcacagttcatgcgcaggagcagagcccctctgccacggccagcaacgtggctacaagtcatagcaccgagaaggtggacggggatacacagacgaccgtggagaaagacggactttctacggtgacattggtggggatcatcgtcggggtactgttggctattggctttatcggggctataatagtagtggttatgcgcaagatgagtggccgctacagcccatag

SEQ ID NO: 44896 - DNA, 981 bp, Artificial Sequence
  Description of Artificial Sequence: Synthetic coding sequence
atgcggaccgaggcccaggtgcccgccctgcagccccccgagcccggtctggaaggggccatgggacaccggacactggttttgccctgggtgctgttgaccttatgcgtaacggctggaactcccgaggtgtgggttcaggtgagaatggaggccacggagctgagttcattcactatccgatgcgggttcttggggagcggttccatctcccttgtgaccgtcagttggggaggcccaaatggagctggtggtacgacattggccgtgctgcatcctgagcggggcatcaggcagtgggctcccgcccgacaggcccgctgggaaacccagagtagcattagcctgatcctagagggaagcggagcatcatcaccatgtgcaaatacgactttttgctgcaagtttgccagcttccccgaaggctcttgggaagcctgtggatctctaccaccaagctccgacccagggctctcagccccacccacccctgcgccaatattgcgggccgatttagcgggaatcttgggtgtcagtggcgtcctccttttcgggtgcgtgtaccttctccacctgctgcgccgacacaagcataggcccgctccgcgcctgcagccatcacggacctctcctcaggccccccgggctcgagcctgggctccaagccaggcttctcaggctgctctacacgtgccatacgccaccatcaatacatcttgtcgcccagccaccctggacactgcccatcctcacggcggaccaagctggtgggcctccctgccgacccacgcagcgcatcggccacagggccccgcggcatgggctagtacaccgatccccgcccggggtagtttcgtttcagtggaaaacgggctgtacgcccaggcaggcgaacggcctccccacaccgggcccggcctgacgctgttccccgatccacgcggtcctagagctatggaaggccctctgggcgtgagatag

SEQ ID NO: 44897 - DNA, 972 bp, Artificial Sequence
  Description of Artificial Sequence: Synthetic coding sequence
atgcagcccagcggctgggccgccgcccgggaggccgccggccgggatatgctcgcagccgatctccggtgcagcctgtttgcctctgcgctccagtcatacaagagagacagtgtgctgagaccctttccggcttcctacgcacggggcgactgcaaggactttgaagccttactggccgacgcgagcaagctccccaatctcaaggagctgctgcaatcttcaggtgacaatcataagagggcctgggaccttgtctcttggatcctgagctcaaaagtactgaccatacactcagccggcaaggccgagttcgaaaagatccagaaactgaccggcgctccacacactcctgtccctgcccccgacttcctgttcgaaattgaatacttcgacccagccaacgccaagttctatgagactaagggggagagagacttgatttatgcgttccatggtagccgccttgagaatttccactccattatccacaacggtctgcactgtcacctgaataagacctccctctttggtgagggcacctacctgaccagtgacctcagtttagctctgatctactctccccatggtcacggctggcagcactctttgctgggcccaatcctcagctgtgtcgctgtgtgcgaggttatagaccacccagatgtgaagtgccagacaaaaaagaaggactccaaagaaatcgatagaaggagagctcggattaaacactcggaaggcggggacatccccccaaaatacttcgtggtgacgaataaccaactactgcgggtgaagtacctccttgtttatagtcagaagcctcctaaatcgcgggccagtagccagctgagttggttcagcagtcactggtttaccgtgatgataagcctatatctgctcttgctgctgattgtttcagtgatcaattccagcgcatttcagcacttctggaatcgcgcgaagaggtag

SEQ ID NO: 44898 - DNA, 1563 bp, Artificial Sequence
  Description of Artificial Sequence: Synthetic coding sequence
atgttctgcacccggggcctgctgttcttcgccttcctggccggcttagacatagaatttaccgggctgcgttccaacctgtccggtccccaacagatctccctcttcgatctgccgtctgagtggtacctcaagactagacagagcgtgcagcagttcacagtgtgccaaatcggcctttcagtgtttagtgcaattgaaggggaagccaacaaatatatcgctcacagttgcaatttttacttgtttccaacaacatttggaatactggattccgagttttcctttcaagcctcatccgtgcagttcttgaaccagtacggattcaattacaataaattcttgaagaatggcattccctatatgaacgaagagcaggaaaagaagattaggcatgacatcctgacaggtaattggcgtgtgaggtccagcccagacaaggatcaaataaaggtggtcattgatgaagtgacacgctggctcgagctcgccaaggagggggactggatgactctgccggggatcactggctttcaagcctttgaggtgcaactggttttacggcaggcacttcccaatatctggaccgtgctgaaggacgagggagtggtggtgaaaaaagtcagtaagcagcacagatggtaccttcagaatacctcatgtgatcgcgagagctgctggaaggagaatatcctgctctcggctcgaggattctcagtattctttcagatgcttgtgaaggcccagaagccacttgtggggcataatatgatgatggacctgctacaccttcatgaaaagttcttccggccactacctgaatcctacgaccagtttaaacaaaacattcactctctgttcccggtgctcatcgacacaaaatcggtaaccaaagacatttggaaggagatgaacttccctcgagtgagtaacttatctgaagtctatgaagttctgaattctgacttaaatcccacaaaaaactccggccccgaaatcgtgcacgcctctcgatgtgagaaatatgtcgagacaaaatgcccacatgaagcagcttatgatgcgttcctgtgcggatcagtgctcctcaaggtggcgcatctgctattgcagaagatatatcatatcgacccagtgccagagtcttcttttcctcagtaccttgatgtgctggctccatacgtaaaccaggtgaatcttatacgcgccggtgtgccaaagattaacttttctggccctgactatcctagtatcaggccacccattcttatattgtcggtgaaacgatggccgggagttagcgagcagcaagtgtatcacaaattccaaaacctgtgcaagtttgatgtgagacgtttgactaggagccagttcctgcttctgaccaacaaatttaaggacgctcgcaatatcctcaaagaataccgcgaccatccgaccttgtgcatttccctgtaccggtattggagacacagtcctaacgttaactgcctactgcaggtctgtggaattgtgaccgcatgggctcttctcgcatttatcctcggaaggtctggaacctag

SEQ ID NO: 44899 - DNA, 792 bp, Artificial Sequence
  Description of Artificial Sequence: Synthetic coding sequence
atggacaacagctggcggctgggccccgccatcggcctgagcgccggtcagtcccagctgctcgtgtccctgcttttgctgttgacaagggtgcagcctgggaccgacgtagctgcaccagagcatatttcttacgtcccccagctctcaaatgatacgctcgcagggcggttaaccctttccacgttcacactcgagcagcccctagggcaatttagctctcataacattagtgatctagatacaatctggcttgttgtggcactgtctaatgcaacccaaagcttcaccgctccaagaaccaaccaggacattcctgccccggccaacttcagccagcggggatattaccttacactccgcgctaatagagtcttatatcagacaaggggtcagctgcacgtacttcgagtcggcaatgacacacactgtcagcccaccaaaattggatgtaaccaccctctcccaggaccgggcccctatagggtaaagtttctggtgatgaatgatgagggccctgttgccgagactaagtggtccagtgacacccgtttacagcaagcccaagcgctccgagcagtacctggccctcagtcccctggcacagtggtcattattgccatcttatcaattctgctcgcagtactcctgacggttctgctggcggtactgatttatacttgtttcaattcctgtcggtctacttccctgtccgggccagaggaagcagggagcgtcaggcgctatactacccacctcgcatttagcacaccagcggaaggtgcatcctag

SEQ ID NO: 44900 - DNA, 2352 bp, Artificial Sequence
  Description of Artificial Sequence: Synthetic coding sequence
atggccgcctgccggtactgctgcagctgcctgcggctgcggcccctgtctgatggaccctttctccttccgcggcgtgaccgtgctttgacacaacttcaggttagagcactgtggagctcagctgggagccgggccgtggccgtggatctgggaaatcgcaagcttgaaatctccagcggcaagctggcccgattcgccgacggttctgctgtagtgcagtccggcgacaccgccgtaatggttaccgccgtgagcaaaaccaaacctagccctagtcagttcatgcctctcgtggtagactatcgacagaaagccgccgctgccggtcgaattcccacaaactatctccggcgagagataggcactagcgacaaagagatattgacatcccgtatcattgatagatccatccgtccgctcttccctgcgggttatttctatgacacacaagtcctgtgtaatcttctggccgttgatggggtaaatgaaccagacgtgctggccatcaacggtgcctcagtcgccctttccttaagtgatatcccttggaacggccctgtcggggccgtccggatcgggattatcgacggggaatatgtggtgaaccctaccagaaaagagatgtcatcgtcgactttaaacctcgttgtcgccggagcccctaagtcccagatagtgatgttagaggcttctgccgagaatattctgcagcaggatttctgtcatgcgatcaaggtgggggttaagtatacccaacagattatccaaggtatccaacagttggtgaaagaaaccggggtgaccaaaagaacaccgcagaagctattcacaccaagtcctgagatcgtcaaatacacccacaaactggccatggaacgactgtatgctgtttttactgactatgaacatgacaaagtgtcccgggacgaggcagtgaataagattcgcttggacaccgaggaacagttgaaggagaagttccccgaagcagacccttatgaaattatcgaatccttcaacgtggtcgcaaaagaggtgtttcgctccatcgttctcaacgaatataagagatgtgatgggcgtgatctgacttctctgagaaatgtatcatgtgaagttgacatgttcaagacattgcatggtagtgctctctttcagcgaggccagacccaggtcctctgcactgtcacctttgactccctggaatccggcatcaaatccgaccaggttatcacagccatcaacgggatcaaagacaagaacttcatgcttcactacgagttccctccgtatgccaccaacgagatcggcaaagtgaccggactaaataggcgtgagctcggccacggagccctcgcagaaaaggcactctacccggtgatcccccgcgacttcccgtttaccatccgtgtgacctccgaggtcctggagagcaacgggagctcgagcatggcttccgcatgtggagggagtcttgccctcatggatagcggcgtcccaataagcagtgctgtcgcaggagtcgccattggccttgtcactaagaccgatccggaaaagggcgagattgaggactatagactcttaacggatatcttgggcatcgaggactacaacggcgacatggacttcaagatcgcgggaactaacaagggaatcaccgctcttcaggccgacattaaactgccggggatccccatcaaaatcgtaatggaagccattcagcaggcatctgtggcgaagaaggagatactacaaatcatgaataagactatctctaaacctagggcaagcaggaaggagaacgggccagtcgttgaaacagtgcaggtgccactgtccaagcgggcgaagtttgttggcccaggcggctacaatttgaagaagttgcaggccgagaccggagttactataagccaggtggacgaagagaccttctccgtgtttgcgcctacgcccagtgctatgcacgaggccagagattttattacagaaatctgtaaagacgaccaggaacagcagcttgaattcggcgcagtgtacacagcaacgatcaccgaaatccgggatacaggggttatggtgaaactgtatcctaatatgaccgctgtacttctgcacaatactcagctggatcagaggaaaatcaagcacccgactgccttggggcttgaggttggccaggaaatccaagttaaatacttcggaagagacccagcggatgggagaatgcgactttctcgtaaagtgcttcagtctccagccacaacagtcgtcaggaccctgaacgatcggtcttcaatcgttatgggcgaacccatttcccagagcagttcaaatagccagtag

SEQ ID NO: 44901 - DNA, 2352 bp, Artificial Sequence
  Description of Artificial Sequence: Synthetic coding sequence
atggccgcctgccggtactgctgcagctgcctgcggctgcggcccctgtcagatggtccttttctgctcccaagacgcgaccgcgctcttactcagcttcaagtgcgcgccctgtggtcttccgctggaagccgcgctgttgcggtcgatctaggcaatagaaaactggagatatccagcggaaagctggcccggttcgctgacggctccgctgtggtccagagcggcgataccgccgtgatggttactgccgtttcaaagaccaaaccatctccttcacagttcatgcccctggtggtagattaccgccagaaagccgcagccgccggtaggattcccacaaactatctccggcgggagatcggcacctccgacaaagaaattttgacttcccgcattatcgaccgctctatccggcctttgtttcccgccggatacttctacgatactcaggtgctctgcaacttgcttgccgtcgatggagttaatgagcctgatgtacttgccattaacggagcgagtgtggctctttcactctcggacatcccatggaacggcccagtcggcgccgtgaggattgggataatagatggagagtatgtcgtgaaccccacccgaaaagagatgtcaagctctacattaaacttagtcgtagcaggcgcccccaagtctcaaatcgttatgttggaggctagcgcagagaatatcctccagcaggatttttgtcacgcaattaaagtgggagtgaaatacacacaacagatcatccaggggattcagcagctggttaaggagacaggtgtgactaaaagaaccccccagaagctctttacccctagcccagagatagtgaaatacactcataaattggccatggagagattatacgctgtgttcactgattacgaacacgacaaggtgtccagagacgaagcagtcaacaagatcaggctggataccgaagagcagcttaaggaaaaatttccagaagccgatccctatgaaatcattgagagctttaatgtcgttgccaaagaagtgttcagaagcatagtcctgaatgagtataagagatgtgacgggcgcgacctgacctcactcaggaacgtgtcgtgcgaggtggatatgtttaaaaccctgcacggtagcgcactgtttcaacggggacagactcaggttctgtgcactgtcacgtttgactctctggagagtggaatcaagtctgatcaggtgatcacagccatcaacgggattaaggacaagaattttatgcttcattacgaattcccaccttatgctaccaacgaaattggcaaagttactggtctgaatcgaagagagctcggacacggagcactggccgagaaggccctgtatccggtaattccacgcgatttcccatttacgattcgagtcacttccgaggtcctggaaagcaatgggtcgtcaagcatggccagcgcctgtggcggaagtctggcattaatggattctggggtccccatttcgtccgccgtggcaggggtcgccattgggcttgtcactaaaactgaccccgagaaaggcgagatcgaggattacagactactgacagacatcctaggcattgaggattataacggcgatatggatttcaaaatcgccgggacgaataaggggattacagccctccaagccgatattaagctgcccgggattcctattaagatcgtgatggaggctattcaacaagctagtgtagcgaaaaaggaaatattgcagattatgaacaaaacaatctctaaaccccgcgcctcacgaaaggagaacggccccgtagtggagacagtccaggtgcctcttagcaaacgggctaaatttgtcggtccaggaggatataacctgaaaaagctgcaggccgaaacaggagtgacaatctcacaggtggacgaggagacattcagcgtctttgctcctactcccagtgctatgcacgaggctcgcgactttattaccgagatttgcaaagacgaccaggaacaacaactcgagtttggggctgtatacaccgcgacaattaccgagatccgcgataccggagtaatggttaagctgtatcccaacatgacagctgtgctgctgcacaacacccagcttgaccagcggaaaattaaacacccaactgctttaggcctagaagttggacaggaaatccaggtgaaatattttggaagagaccccgccgacggccgaatgcgtctgtcacgcaaagttctccagagtccagccacaaccgttgtgcgaactctgaacgacaggagcagcatcgtgatgggcgagcccatctcccaaagcagctccaattcacagtag

SEQ ID NO: 44902 - DNA, 2955 bp, Artificial Sequence
  Description of Artificial Sequence: Synthetic coding sequence
atggtgtgcagccccgtgaccgtgcggatcgccccccccgaccggagattctcccgttctgcaattcctgagcagatcatcagttccaccctgagctccccctctagcaatgcacccgatccttgtgcaaaagaaactgtgttgagtgccctcaaggaaaaagaaaagaagcggaccgtagaggaggaagaccagatttttctcgacggtcaggagaataagcgcaggcgacacgattcaagcgggagtggccacagtgctttcgagcctctcgttgctaacggcgtgccagcgtcgtttgtgccaaagccaggaagcctaaaaagagggctaaattctcagtcctctgacgatcatctgaataagcggagtcgatcttcctccatgtcgtccctgaccggagcatacgcctctggaatccccagctcatcacgtaacgctataacctcctcctattccagcactcgcggtatatctcaactctggaagcgaaacggcccaagctcatcccccttctcctcacccgctagtagcaggagccagacgcctgaacggcccgcgaaaaaaatccgcgaggaggagttgtgtcatcattcctcaagctcgactccactggccgcagatcgcgaatctcaaggcgagaaagccgcggacacgacaccacgcaaaaagcagaactcaaacagtcagagtacacctggcagttctggccagcggaaacgaaaagttcagcttttaccgtcccgcaggggagaacaactaacactgcccccgccacctcaattggggtattcgataacagccgaggacctcgacttagagaaaaaggctagcttgcagtggttcaaccaggccctggaggacaaatccgatgccgcgagcaacagcgtcacagaaactccccctataacccaaccaagcttcacgttcaccctcccggctgctgcacccgccagtccccctactagcctattggcaccctctacgaatcccctactggagagtttgaagaagatgcagactccacctagccttcccccatgcccagagagtgccggggccgccaccacggaagctctgagcccaccaaagacacctagtttgttaccacccctgggcctgagccaatcaggccccccgggactgctcccttcccctagctttgacagtaagcctcctaccactctgctcggactcatccccgctccctcaatggtccctgctaccgatactaaagctccgcccactctccaagcagagaccgccaccaaaccacaagcaaccagcgcaccaagcccagctccaaagcaatccttcctctttggcacacagaataccagcccatcctctcccgccgctccggcagcctcctcagcacctcctatgttcaagcccattttcaccgcgccacctaagtctgagaaggagggtccaacaccccctggaccttccgtcacggccaccgccccctcatccagttcactcccaacgaccacctctactacggcccccaccttccagccagtcttctcatctatgggacctccagcttcggtgccgcttccggccccattcttcaaacagactacaacacccgcaacagcacccacgacaaccgccccactgtttacaggcctagccagtgctactagcgctgtcgcccccataaccagcgcgtcaccatccacggacagtgcttctaaacctgccttcgggttcggtatcaattctgtgtcctcatcttccgtatccaccacaacatctacagccactgccgcgagccagccgttcctcttcggggccccccaggcaagcgccgcaagtttcacccctgccatgggttccatcttccagttcggcaaaccccctgccctgcccaccaccacaaccgtgactaccttttcccagagcctgcacactgccgtgccgaccgcgacgagctcctccgctgccgatttttccggattcgggtccaccctggcgaccagcgcccctgctacatcgtctcagcctaccctaacattcagcaacacatccaccccaacattcaatatcccctttggctcctcagcgaaatctcctctgcctagctacccaggagccaatccacaaccagcatttggggccgcagaggggcagcctcctggtgctgctaaacctgctcttgcgccttcatttggaagttcttttaccttcggaaacagcgcagcgcccgccgcagcgccgactcccgcaccgccctctatgatcaaagttgtgcctgcatacgtgcctaccccgatacacccaatttttggcggcgctacccattctgcattcggcctgaaggccaccgcctcagcttttggtgcgcccgccagctcccaacccgcttttggcggtagcactgcggtgttcttcggagccgctaccagttccggattcggcgctaccacacagaccgcctcatctgggagctcttcctctgtgtttgggtctactactccgagcccatttacatttggcggcagtgccgcacctgcgggaagtggaagtttcgggataaatgtggccaccccgggcagcagtaccacaactggagccttttcttttggggccggccagtctggaagtactgccacatccacacccttcgccggtggactaggtcagaacgccctgggaaccacaggacagagcaccccattcgcttttaacgtgtcgagcactactgaatccaagcctgtcttcgggggcacagctaccccaacgttcggactgaacactccggcacctggggttggtaccagtggctctagcctgtcgtttggagcatcatcggcccctgcgcagggctttgtgggagtggccccatttggcagtgctgccctcagctttagcattggcgccggcagtaaaacaccaggcgccagacaacgtttacaagcccggagacaacacacaagaaaaaaatag

SEQ ID NO: 44903 - DNA, 2955 bp, Artificial Sequence
  Description of Artificial Sequence: Synthetic coding sequence
atggtgtgcagccccgtgaccgtgcggatcgccccccccgaccggaggttctctcgctccgcaatccccgaacagatcattagttccacactgtcgtcaccctcttccaatgctccagacccatgcgccaaggaaaccgtcttatccgccttgaaagagaaagagaaaaagcggaccgtagaggaggaagaccagatatttctggatgggcaggagaacaagaggaggcggcacgatagctccggcagcggacactctgccttcgagcccttagtggctaacggcgtccctgccagctttgtgcctaaaccaggctctctgaagcgtggactcaactcgcagtcctccgatgaccacctcaataagcgcagccgctccagttctatgtcctccctaacgggcgcatatgcctctggtattccttcctccagtcggaacgccataacatcttcatattccagcacccgcggaatcagccagctgtggaagcgcaatggcccaagctcctctccattctcgagcccggcctccagccggtctcagacacctgagcgtcctgctaagaaaatccgagaagaggagttgtgccatcactcctcatcaagcacaccgctggccgccgatcgagagtcccaaggcgaaaaagcggcagataccaccccgcgcaagaagcagaattccaattcccagtctactccaggcagcagcggacagcggaaacgcaaggtgcaactgctacccagccggcgtggagaacaactgactcttcccccgcctcctcagttgggctattcaataacagctgaagatctcgatctagagaagaaagcatccctccagtggtttaatcaggccctggaggacaagtctgacgcagcctccaattctgtgaccgaaactcctcccatcacacagccaagcttcacctttacactccccgccgccgcacccgcatctcctccaacaagcctgttggccccgagcaccaacccgctgctcgagtccttgaagaagatgcagacaccaccatcattgcccccttgtccagagagcgcgggcgctgccaccacagaagctctgagtcctcccaagactccctcgcttctgccgcctctgggactgtcccagagcgggcctcctggcttactcccttcccccagcttcgatagcaaacccccaaccacccttttgggactgattcccgcgccttccatggtacccgcgactgacacaaaggcgccgcccactttgcaggctgagacagctaccaaacctcaggccacttcagctccttctccggcgcccaaacagagctttctgttcggcacacagaacacgtcacctagttctccagcagctcccgccgcaagctccgcgccaccgatgtttaagcccatctttaccgccccccctaagtcggagaaggaaggccccaccccacccggaccatcggtaacagccactgctccctcgagttcctctcttccaactaccacctcaactacagctcccactttccagcctgtgttctcgtccatggggccaccagcatctgtgcccctccctgccccattttttaagcaaactaccacacctgccactgctcctaccacaacagctccgttgtttactggtttagcatcggccacctcagctgtggctcctattacgagcgcctcccccagcaccgactcagccagcaagcctgctttcggatttggcatcaacagtgtgtcatccagctcagtcagcacaactacttctacagccaccgctgcgagccagcccttccttttcggcgcccctcaggcctctgcggcaagttttacccctgccatgggtagcatattccagttcgggaaaccccctgccctgcctaccaccactacagtgaccacatttagccagtcactgcatacagccgtgcccaccgcaacctccagctccgcggccgatttttcaggcttcggaagcacactcgccaccagtgcacccgctacctcatcccagcctactctaacttttagtaatacctcgacgcccacatttaacatcccctttggatcgtcagccaagagccccctgcctagctacccaggcgccaatccccaacctgcattcggtgcggcagaggggcaacctccaggcgcggcgaagcccgctctggcccccagcttcggctcctccttcactttcgggaacagtgccgcccccgccgctgctccgactccggcgccaccttccatgattaaagttgtacctgcatacgtgcccacaccaatacaccctatcttcggaggggccactcactccgccttcggccttaaagccacagcatccgcctttggcgcacccgctagctcgcagccagccttcggcggatccactgctgttttttttggcgccgcgacatcaagcggattcggtgccaccacccaaactgcttcatctgggtcctctagtagtgtgttcggcagcacgacccccagccccttcacattcggcggctcggctgctccagcgggctcaggaagcttcggaataaacgtcgccacgccagggtcatccaccaccacaggggctttctcattcggggctgggcaatcgggatcaactgctacctctacacctttcgccgggggcttggggcagaacgcccttgggaccacggggcaatccaccccttttgcttttaatgtatcatccactaccgaatcaaaaccggtgttcggcggaacagcaacccccacatttggccttaatactcccgccccaggcgtggggactagcgggtcaagtttgagtttcggggcgtcttcagcccctgcacagggcttcgtgggggtggcaccattcggtagcgccgctttaagcttctcaattggtgctggtagcaagacccccggggccaggcagcgcttacaggctcgacgacaacacacaaggaagaaatag

SEQ ID NO: 44904 - DNA, 3000 bp, Artificial Sequence
  Description of Artificial Sequence: Synthetic coding sequence
atggtgtgcagccccgtgaccgtgcggatcgccccccccgaccggcgctttagccggtccgccatcccagagcagatcatctcatccaccctgagctctccctcctcaaacgctcccgatccttgtgcaaaagaaactgtgttatccgctctaaaggagaaagagaagaagcgcacggtcgaagaagaggatcaaatcttcctcgacggacaggagaacaagcggagacgccacgattcctccggctccgggcattcagcttttgagcccttggttgcaaacggggtaccagccagttttgtgcccaaacctggcagcctgaagagaggactcaactctcagtcttctgatgatcacctaaacaagcggtctcgctcctcctccatgtctagcctgaccggcgcttatgccagtggaatcccctcatcatccaggaacgcgattacgagtagttactcaagcacccgcggcatcagtcagctttggaaacgcaacggcccatcgagttcacctttttccagccctgcgtcttctcgttcccaaactccggaaaggcccgcgaaaaagatccgagaggaggagctgtgtcatcacagtagcagtagtactccactggccgcagaccgggaaagccagggcgagaaagccgccgatacgactccccgcaaaaaacagaacagcaactcccagtctacccccggctcctctggacaacgaaagcggaaagttcagctgctgcctagtcgtaggggcgagcagctgaccctgcctcctccaccacaactcggatactcgatcacggccgaggatctcgatctggagaaaaaggccagcctacagtggttcaatcaggccctcgaggacaagagtgacgccgccagcaatagcgttacagaaacccctccgatcacccaaccgtcattcaccttcacgcttccagccgccgcccccgcatctccccccacttcgctattagcaccctcaaccaaccctctcttggaatcccttaaaaaaatgcaaacccctccgagcctgccaccttgtcctgaatctgctggagcagctaccacggaagccctgtctccccctaagaccccatcccttctgcctcctctcggcctatcccagtccggacccccagggctgctgccgagtcccagctttgattccaaaccaccgaccaccctgctcggtcttatccctgcacccagcatggtgccagccacagataccaaagctccccctactctgcaagccgaaactgctacaaagcctcaggccacgtccgctcctagcccggcccctaaacagtcctttctctttgggacccaaaatacttcccctagttctcctgccgcaccagccgcttcatcagctccgccgatgtttaaaccaatttttaccgcccccccaaagtctgagaaagaaggccccactcctcccggacccagcgttacggctacagccccatcctccagctccctacccacgaccacctctacgacggctccaacctttcaacccgtttttagcagcatgggaccccccgcatccgtgccactgccggcacccttcttcaagcaaacgaccacacccgcgactgcacctacaaccacagcacccctgtttactgggctcgctagtgctacgagcgctgttgcacccattacaagtgcctctccatcaaccgacagcgcttcaaagcccgcgttcggatttggcatcaattctgtgtcgagttcctccgtgagcaccaccacatctaccgccactgctgcttcgcagcccttccttttcggcgcccctcaggcatccgcggcgagtttcacaccagccatgggcagcattttccagtttgggaagccacccgctctgcctaccactaccactgtgaccactttttcacagtccctacacacagcagtccccaccgccacatcttcaagcgctgccgattttagcgggttcggcagtaccctggcgaccagtgccccagccactagctcccaacctacgctcacatttagtaacacaagtacccctacctttaacatcccatttggctccagcgctaaatccccattgccgtcatatcctggcgccaatccgcagccagcttttggcgccgcagaaggtcagccgcccggagccgccaagcccgctctggccccttcttttggcagtagctttacatttggaaacagcgccgcaccagcagctgcccctacgcctgcacccccgtccatgatcaaggtcgtgcccgcctatgtccctactccaatccaccctatatttgggggcgcaacccacagtgcctttggcctgaaggccaccgcttctgctttcggcgcgcccgccagctcccagcctgcctttggcggatccacagccgtattttttggggccgcaacatcatcgggattcggtgctacgactcaaacagcctcatccgggtcctctagctctgtgttcggctctaccaccccatccccgtttacatttggagggtccgcagctcctgccggaagcggctcgttcggcataaacgtggctacgcccgggagcagtacgaccactggtgccttctcgttcggcgcgggccagtcgggctccaccgctacaagcactcctttcgccggtggccttggtcagaatgctttgggtactacaggacaaagcacaccctttgccttcaacgtgagttccactaccgaatctaagcccgtattcgggggcaccgctactcccacctttggtctgaacacacctgcccctggggtcggaacctccggttcttcactctcctttggggcttccagtgcgcctgcccaaggatttgtgggcgtagctccgttcgggaacactttcgcccaccaacaggagcattcgccaaggaaaggtcccaacaacctgtccaagcggaaactgctccctgctgtgcgggctcagggattaccgaggagaggccaggcgagttcgtttcccacccggaaagagtag

SEQ ID NO: 44905 - DNA, 3750 bp, Artificial Sequence
  Description of Artificial Sequence: Synthetic coding sequence
atgagccccgccgccgccgccgccggcgccggcgagcggcggcggcctatagccagcgtacgggacggaagggggcgagggtgcggcggacctgcgcgggccgtgcttttgggcctctctctggttgggttgttgctgtatctggtgccagccgccgcggcgctcgcctggttaactgtgggcgctaccgctgcctggtggggtctgtctcgtgagcccagaggctctcgccctctgtctagcttcgtgaggaaggctcgacatcgacggccgctctcgagttttgtgcggaaggctcggcataggagaactctgtttgcttctcctctggccaaatcaaccgctaatggtaaccttctagagccccggacgctgttggagggaccagaccccgctgagttgctcttgatgggctcctacctggggaagccgggcccaccgcagcctgcggcagccccagagggccaggatctgcgggatcgccccggacggagacctccagccagacccgctccccgcagtccacccccccggagcccgccaccccgctcccccccaccatcacccccaacgcaccgtgcccaccacgtatatccgagcctgcctactcctcttcttcggccatcgagacgccctagtccccgtgattgcggaacactgcccaatcgctttgttatcaccccaaggagaaggtacccgatccaccaggctcaatacagctgtctaggggtgctgcccaccgtctgctggaacgggtaccacaagaaagccgtgctgtcacccaggaatagtcggatggtctgttcacccgttacagtccggatcgcgccacctgatagaagattcagtcgctccgccattcccgagcagatcattagctccacactgtcctccccatctagcaatgctccagatccatgcgcaaaagaaactgtcctgtccgccctcaaggagaaagagaagaagaggacggtggaggaggaggatcaaatctttctggatggacaggaaaataagcgcagaaggcatgacagctccggctcaggtcacagcgctttcgagcctttggtagccaacggtgtgcctgcaagttttgtccccaagcccggtagtttaaaacgtggtttaaactctcagagcagtgacgatcacttgaacaagagaagccgctcttcatctatgagcagcctcactggggcctacgcaagcggcattccatcttcttcccgaaatgcaattacgtcttcttactcaagtaccaggggcattagccaactctggaagagaaacggtccaagttcctccccattctcctcccccgctagctcccgctctcagacgccagaacgaccagccaaaaagataagagaagaagagctgtgccatcattcctcttcctcaacccccctcgcagctgaccgtgagtcacagggtgagaaagccgccgacactactccacgcaaaaagcaaaactcgaattcacaaagtacaccagggtcttccggacagcgcaaacgaaaagtgcaacttcttccctcccggaggggagagcaacttacactgcctcctcctccccagctcgggtactcaatcactgcagaggatttggacctggaaaagaaggctagtttgcaatggtttaatcaagctttagaggacaagtctgacgcagcctccaatagtgtaaccgagactccaccaattacccagccctcttttacattcacactgcctgcggccgcgccagcatctccccctacatccttgctggctcccagtaccaaccctttactcgagtcacttaaaaagatgcagaccccacccagcttgccaccatgtcccgagtccgccggcgctgcaactaccgaggcactctctccacctaagacaccttcgctgcttcctccactggggctaagtcagagcggaccacctgggctgctgccctccccttcattcgattccaagccacctaccaccctactcggcttaatccctgccccatctatggtgccagctacagacacgaaagcaccaccaacattgcaggctgaaacagccaccaagccccaggccacaagtgcaccatccccggcacctaaacagagctttctgttcgggactcagaacacctcccctagttcacctgctgcccccgccgcctcatctgctcctcctatgttcaaaccaatcttcacggctcccccgaagagcgagaaagagggaccgacgcctcccggccctagcgtcaccgcaacggcacccagctcatcatcgttaccaacaactacctctacgacagccccaacatttcagccagtgttctcctccatgggcccccctgcgtcagtgcccctgccggctccatttttcaagcagactaccacgccagccaccgcccccacaacgacagcgccattgttcactggactggcctccgcaacctcagcagtggcaccgatcacaagcgcttccccttcaaccgacagtgcatcgaagcccgcctttgggttcggtatcaattcggtgtcttctagctctgtgagcaccactacaagtactgctacagcagcttctcagccctttctttttggagcccctcaggcgtcagccgccagctttacaccagctatgggaagcatcttccaattcggaaagcctccggctctgcccaccactaccaccgtgacgacattcagccagagtttgcacacggcagtgcccactgctacctcctccagcgcagctgatttttctgggttcggatcgacactggcaacctctgctccagcaaccagttcccagccaactctgactttcagtaataccagcaccccaaccttcaatattccttttggttcaagcgcgaaatcacccttacccagttaccccggggccaacccccaacccgctttcggcgcagctgagggccagcccccaggggccgcgaagcctgccctcgcacccagttttggaagttcctttaccttcgggaacagcgccgcccctgccgcagctcctacccccgccccgccgtccatgattaaagtggtgcctgcgtatgtaccaactcccatccaccccatctttgggggcgccacccactccgcattcggactgaaagccaccgcctcagcattcggcgcaccagccagcagccagcctgcgtttggggggagtaccgccgtattcttcggcgccgccacctcatccggcttcggagctactactcagactgccagttcaggatctagtagttccgtctttggtagtaccactccgagtcccttcaccttcggcgggtctgccgccccggccggaagtggctccttcggcatcaacgtggcgacccctgggtcctctacaaccacaggcgcctttagctttggcgccgggcagagtggcagcacagccacgtcgactccatttgccggggggttggggcagaatgctctggggactactggacagagcaccccctttgcgtttaatgtttcttccacgacggagtccaagcccgtttttggcggtactgccacacccacgtttggcctcaacactcctgcgcccggggtggggacctctgggtcctccctgtctttcggggcatcctctgcccctgctcagggatttgttggagtggcaccatttggatcagccgctctgtcttttagtatcggggccggcagcaaaacacccggcgctaggcagagactgcaggctaggcgacagcatactagaaagaagtag

SEQ ID NO: 44906 - DNA, 3000 bp, Artificial Sequence
  Description of Artificial Sequence: Synthetic coding sequence
atggtgtgcagccccgtgaccgtgcggatcgccccccccgaccggaggttttctcgctccgcaattccggagcagataattagcagcactctgagtagtcctagcagtaacgccccggacccctgtgctaaagagaccgttttatctgctctgaaagaaaaagaaaagaagagaaccgtggaagaagaggaccaaattttcctggacggccaggaaaataagaggcgacgccatgacagttccgggtctggtcattcggcgttcgaaccgctggtggctaatggcgtgccagccagctttgtgccaaagcctggaagcttaaagcgcgggctgaattcgcagtcctcagatgaccatcttaacaagcggagtcgatccagctccatgagcagtctgactggggcatacgcaagtggaatcccttcgtcatcacggaacgcgattaccagtagctattcctccacaagagggatctctcaactatggaagcgcaacgggccgtcctctagcccgttttccagcccagccagcagccgttcccaaacacccgagcggcctgctaagaaaatacgcgaagaagagctgtgtcatcacagcagctcatccacgccgcttgccgcagaccgcgagtcgcagggggaaaaggcggccgacacaacaccacgtaaaaaacagaacagcaattctcaaagtacccccggttcctctggccagcgtaagaggaaagttcagctccttcctagtagaaggggagagcagctgacgctaccccctccaccacagctgggctatagtattacagcagaggatctggaccttgagaaaaaggctagtttgcagtggtttaaccaggctttggaggacaagagtgacgctgcgtcgaactccgtaactgagacccctccaataacccagccgagcttcacgttcaccctgccggcggctgccccagcctctcccccgacatctctgctcgctcctagcacaaatcctctgttggaaagtctgaagaaaatgcagacgccgccttccctgcctccttgtccagagtcggccggcgctgccaccaccgaggcactgagcccccccaaaactccatccctgttgcctcctctcggactgagtcaatccggaccaccaggcttactaccatcgccatccttcgactccaaaccgcccactactctacttgggttaatccccgccccgtcaatggtacctgcaactgataccaaagcaccccctacattacaagcagaaacggccacaaagccacaggctacctctgcacctagtccagcacctaaacaatcctttctgttcggcactcagaacacgtcgccaagctctcccgccgcaccggccgcttcaagcgcgcctccgatgttcaagccaatttttacagccccccctaagtctgaaaaagaggggcctaccccccctggaccatccgtcacggcgacagcacctagtagctcatcgctacccactaccacctctacaacggcccccacttttcaacccgtcttttccagcatgggaccccctgcaagtgtgcctttaccggctccgtttttcaaacagactacaactccggcaactgcccctacaacaactgcccctctgtttaccggtttagccagcgcaacaagcgccgtagccccaattacaagtgccagcccctcgactgacagcgcaagtaagccagcctttgggttcgggatcaattccgtttcctcgtcaagcgtgagcaccaccaccagcaccgctacggccgcatcccagccatttctgtttggcgccccccaggcctcagctgcaagtttcacaccagccatgggttctattttccagtttggcaagcccccagctcttccaaccaccactaccgtgactaccttcagccaatcactgcacaccgccgtacccaccgcaacgtccagtagcgcagccgacttctccggctttggttcaacccttgccacttcggcccccgccacgagcagccagcccactctgaccttctcaaatacatccaccccaacttttaacattcccttcggttcgtccgcaaaaagtcctcttcctagttaccccggcgccaacccccagccagccttcggagccgccgagggacaacctcccggggctgccaaaccggccctagccccatcgtttggatcttcgtttacttttggaaactccgcagcccctgccgcggctccgacacccgctcccccctctatgataaaagttgtccctgcctatgtgcctacccctatccacccgatatttggcggagccactcactcagcctttggactgaaagccaccgcaagcgcctttggtgcccctgcctcctcgcagcctgcgtttggcggaagtactgctgtgtttttcggcgcagctacatcatccggctttggtgcaacaacacagactgcttcttcaggatcttcgtccagtgtgttcggaagtaccactccttctcctttcaccttcggaggaagcgctgcccccgcgggttccggttcatttggcatcaacgtggctacccctggcagctccaccacaactggtgctttttcttttggcgccggtcaaagtggatctaccgctacctccactccttttgctggaggtctcggccagaatgcactggggacaaccggccaaagtaccccctttgctttcaatgtgtccagtacgactgagtcaaaacccgtctttggtgggacggcgaccccaaccttcggactaaacactcctgcgccgggcgtgggcaccagcggatctagcctttcttttggcgcctccagtgctcctgcccaaggctttgttggagtcgctccctttggcaatacgttcgctcaccagcaggagcacagtcctcgaaaaggccctaataatttgtcaaagcgaaagctcctgcctgctgtccgcgctcagggactgccgcgacgaggtcaagcaagctcattccccacacgcaaggaatag

SEQ ID NO: 44907 - DNA, 3690 bp, Artificial Sequence
  Description of Artificial Sequence: Synthetic coding sequence
atgagccccgccgccgccgccgccggcgccggcgagcggcggcggcctatcgcttctgtgagagatggcaggggtaggggttgtgggggccccgctggtgctgccctgcttgggctgtcccttgtcggtttgctgctatacctcgtacccgccgctgccgccctagcttggcttgcggtgggtacgaccgcagcttggtggggcctatctcgtgagcctagaggcagtcgccctttatcctcgttcgtccaaaaagctaggcatcgcagaactctgttcgcatctccacctgccaaaagcactgccaatggcaatttgctggaaccacgaacacttctcgagggtcccgatccagcagagcttctcctcatgggttcctacctggggaaaccagggcctcctcagccagctccagcccccgagggtcaggaccttaggaacaggcctggacgcagaccgccagctcgcccagccccccggtccacaccccctagccccccgacccatcgcgtccaccatttttacccctctcttcccaccccgctgctgagacccagtggcaggccttcgccaagagatagaggtaccctcccggatagattcgtgatcacgcccagacgccgctatcccatccaccagacacagtactcttgcccgggagtgctcccaacagtctgttggaatggttaccataagaaagccgtgttatccccccgaaactcgcggatggtgtgcagcccagtgaccgtgcgaattgctccacccgatagaagattctcacggtccgctattcccgagcagattatcagcagtaccttgtcttctccatccagtaacgctcccgacccctgtgccaaggaaacggtgcttagtgccctaaaagagaaaaagaagaagcggacagtagaagaggaagaccaaatctttctggatggacaggaaaacaagcgacgaaggcatgatagcagtggaagcggccacagtgcctttgagccactggtggctagcggcgttcccgcaagtttcgtgcccaaaccagggtctctgaagagaggtctcaattctcagagtagcgatgaccatctgaacaaacgatccaggtcatcctcaatgtcatccttgacaggagcatacacatcagggatccctagtagcagtaggaacgctattacctctagctattcatccactcgaggaatttctcaactgtggaagcgcaatggtccaagctcctcacccttcagcagcccagcttcatcgcgaagtcaaacacctgagaggcccgccaagaaaattcgcgaggaagagctctgtcaccactcctcaagctccacaccactcgccgccgataaagaaagtcagggagagaaagccgctgatacaacaccccggaagaagcagaattccaactcccagtccacccctggctcatcgggtcaacgaaaaaggaaagtgcagctactgccttcaagaaggggggaacagcttacgctaccccctcccccccagcttggatactccattacagctgaggatttagacctggaaaaaaaggcaagcctccagtggtttaatcaggcattagaagacaagtctgatgccgctagcaattcggtgacagaaactccaccgaccacccaaccatcatttactttcacactgccggccgcagcaactgcgagccccccaacctcgctcctcgcgcccagtactaaccctctgttagagagcttgaagaaaatgcagacccccccctctttgccaccctgccccgagagtgctggtgccgcaactactgaggcactaagcccgccaaagaccccttccctcctgccacctctgggactgagtcaatcaggccctcccgggctccttccatccccgagttttgacagtaagcctccaaccacgcttttaggcctgatccctgctccaagcatggtgccagcgacagacacaaaagctccacccactctacaggcagagactgccacgaagccccaggcgactagtgctccgagccccgctcctaagcaaagttttctgttcggcacacagaacacttcgccttcctcccctgcagcccccgcagcctccagcgcatctcccatgtttaagcccattttcaccgcccctccaaagtcggagaaagagggccccaccccacctgggccctcagtgaccgcaacagccccaagctcatcctcactcccaaccacgacctccactaccgcgccaactttccagcctgtgttcagtagcatgggcccccccgcctcggtgcccttgcctgccccattcttcaagcaaactactacacccgcgactgcaccaaccacaacagccccactgtttacaggtctggcctccgccacctccgccgtggcccctattacgagcgcctcaccttcaacagactcggcctctaagcccgcattcggatttggaattaactctgtgtcgtcatccagcgtaagtacaactacctccacggcgactgccgcctctcagcctttcctatttggcgccccccaggcctccgccgccagcttcacaccagcaatgggcagcatctttcagttcggcaaaccaccagccttacctactactactaccgtcacaactttctctcaatctctcccaactgctgtgcctactgctacctcttcgtctgcagccgatttctctgggttcgggagcacgctggccacatctgcccctgctacctcgagccaacctacactgacattttcaaatactagtaccccgacttttaacattcccttcggttcctcggcaaaatcccctctcccatcatatcccggggccaatccacagcctgctttcggggccgcagaaggccaaccgcccggagccgcaaaacccgctctgacaccctcctttgggagttctttcacctttggaaattcagccgcacctgcccccgctaccgcccctacccctgcacccgcctcaacgatcaaaatcgtgccagctcacgtgcccacccccattcagccaacttttggcggggccacccacagtgccttcggacttaaggccaccgcttctgccttcggggcccctgctagttctcagcccgcctttggcggctccacagcagtcttcagcttcggagccgccactagctctggcttcggcgctacaacgcagacggcctcgagcggttcctcgtctagcgtctttggatcaaccaccccgtctccgtttaccttcggtggtagcgccgcgccagctgggtccgggtctttcggcattaacgtagccacacccggtagctccgctaccacaggggcctttagcttcggagccggacaaagtggtagcacagctactagtacaccgttcacagggggattggggcagaacgccctaggaactaccggacagagtacaccattcgctttcaacgtgggttccacgacagagagtaaaccggtatttggcgggaccgccacacccactttcggtcagaacacccccgcaccaggggtgggaaccagtgggtccagcctctcatttggggcaagctcggcccctgcccaaggatttgtgggcgtgggcccgtttggatccgctgcgccatcatttagcattggggccggatccaagactcccggcgcgagacagagactccaggcaaggagacagcatacacggaagaaatag

SEQ ID NO: 44908 - DNA, 129 bp, Artificial Sequence
  Description of Artificial Sequence: Synthetic coding sequence
atggtgtgcagccccgtgaccgtgcggatcgccccccccgaccggcgcttcagtcgctccgctattccagagcagattatttcctccaccctctcctctcctagttcgaacgctcccgacccgtgctag

SEQ ID NO: 44909 - DNA, 2964 bp, Artificial Sequence
  Description of Artificial Sequence: Synthetic coding sequence
atggtgtgcagccccgtgaccgtgcggatcgccccccccgaccggcgtttctcaagatccgccatccctgagcagatcatctcctccactctcagctccccatctagcaatgcacctgatccatgcgcaaaagaaacagttctgtcagccctgaaggaaaaaaaaaagaagcgtactgttgaggaggaagaccagatattccttgacgggcaagagaacaagagacggcgccacgactcatcaggctctggccattctgcattcgagccgctcgtggcatccggcgtacccgccagctttgtccccaagccagggtccctcaaacgcggcttgaactctcagagctccgacgaccacctcaacaagcgtagccgaagcagtagcatgtcatccctgactggggcctacacctccggaattccttcaagtagtcggaacgccattacatcatcttactccagtaccagaggcatctcccagctctggaaacggaatggcccctcttctagtccattctcctcccctgctagcagtaggtcacaaacacccgaaaggcctgccaaaaagattagagaggaggaactgtgccatcatagctcaagcagtacaccgctggcggctgataaagagagccagggggagaaggctgccgatactactccacgcaagaaacagaacagcaattcacagtctacacctggcagcagtggccagcgtaaacggaaagtgcagctcctgccctcaaggaggggggagcagttgacgctcccaccacctccacaactgggatattcaatcacggcggaggatctcgacctggagaagaaggccagtctccaatggttcaaccaggccctggaggataagagtgatgctgctagtaattctgttacagaaactccccccactactcagcctagtttcacgttcacgttgcctgctgctgcaacagcttctccaccaacatccctgctggctccaagtaccaaccccctcctcgagtcgcttaaaaaaatgcagacccccccttctctccccccgtgtcccgagtccgctggggccgccactacggaagcgctgagtcctcccaagactccttctctgctaccacctctgggtttgagtcagtccgggcccccagggctgctgcctagtccctcatttgattcaaaaccaccaaccacactcttaggactgattcctgccccctccatggtccctgcgacagacacaaaggcaccacctaccctccaagcagagactgctaccaagcctcaggcaacctccgctcctagcccggcccctaagcagtcgtttctgtttggtacacaaaatacatctccttcctcacccgcagcccctgcagctagttccgcctcacccatgtttaagccgatttttactgcacctcctaagtctgaaaaggagggccctactccgcctggtcctagcgtgaccgccaccgctccatcatcaagtagcttgccgactaccacgtccaccactgcaccaaccttccagcccgtcttctcatcgatgggaccacccgctagcgtacccttaccagctccttttttcaagcaaacaacgacaccagccacagctcctactaccactgcccctctcttcaccggccttgctagcgccacatccgccgtcgcccccattactagtgcaagcccaagcactgatagcgcctctaaaccagcatttggctttggcatcaatagtgtaagctccagttctgtgtctaccactacatctaccgccaccgctgcctctcagccatttctctttggtgccccacaagccagcgctgccagttttaccccagcaatgggatcaatctttcagtttgggaagccacccgctctaccaaccaccaccacggtgactacattctctcagagcttgccaacagccgtgcccaccgcaacctcatcttctgctgccgattttagcgggttcggcagtacactcgctacaagcgcccctgccactagttctcagcctaccctgacattcagtaacacctccaccccgacattcaatataccatttggatcctctgcaaagtctccgctcccgtcctacccgggagccaacccacagccggcgtttggagctgctgagggccagccccccggcgcagcgaaacccgcactgacaccaagcttcggctcaagtttcacgtttggcaattctgcagcccctgcgcccgccaccgcccctaccccagctcctgcctccacaataaaaatagttccggcccacgtgcccacgcctatccagccaacattcggcggtgcgacacactcagccttcggactgaaggcgactgccagtgcctttggcgccccagcctcctcccaacccgccttcggcggatcgacagccgtttttagctttggcgcagctacttcatctggctttggggctacaacgcagacagcttcctcagggagcagctcttcagttttcgggagcactactccatctcctttcacatttggcggatctgctgcacctgccggcagtggatcttttggaatcaacgtcgctacgccaggaagttccgccaccaccggggccttctcctttggtgctggacagagcggctcaacagctacctcaacccccttcaccggcggccttggtcagaacgctctggggacaaccgggcagagcacccccttcgcgtttaacgtcggctctacgacagagtccaagcccgttttcggcggaaccgccactcctaccttcggacagaacactcctgcgcctggcgtcgggacttcaggcagttcgctttctttcggggccagttcagcccctgcacagggattcgtgggtgtggggcctttcggctccgctgccccaagcttttcaattggggcgggaagtaaaactcccggggctcggcaacgcctccaggcaagacggcagcacacgcgcaagaagtag

SEQ ID NO: 44910 - DNA, 948 bp, Artificial Sequence
  Description of Artificial Sequence: Synthetic coding sequence
atgtaccaggtgcccctgcccctggaccgggacggcaccctggtgcgcctgagatttacaatggttgcacttgttacagtctgctgccccctggtcgcgtttctattttgtatactgtggtccctgctgtttcactttaaagagacaaccgccacgcactgcggcgcaacgccctgtagaatgtttagcgccgcatctcagcccctcgaccccgatggcacactgttccggctgcgcttcaccgcaatggtgtggtgggccatcactttccctgtttttggtttcttcttttgtatcatctggagtcttgtgttccacttcgaatatactgttgcaaccgactgcggagtacctaactacctgccctctgtttcaagtgctatagggggggaagtaccccagaggtacgtgtggcggttttgtataggtctccactccgcccccaggttcctggtcgccttcgcctactggaaccactacctctcctgtacctccccctgtagttgctaccgtcccctctgtcgcctgaactttggcctgaacgtggtggaaaacctcgcgttgcttgtgctcacctacgtgtcctcttctgaggatttcacaatacacgagaatgcatttatcgtattcatcgcaagctcactgggacatatgttactgacatgtatcctttggaggttaactaaaaaacacaccgtgtcgcaggaagacagaaagagctactcctggaaacagcggctgttcattataaatttcattagcttcttttccgcactcgcagtttacttcagacacaacatgtattgcgaggcaggcgtttataccatcttcgccatcctcgaatatacagtagtgctcacaaatatggctttccacatgacagcctggtgggacttcgggaataaggagcttttgattacatcccaacccgaggagaagcggttttag

SEQ ID NO: 44911 - DNA, 924 bp, Artificial Sequence
  Description of Artificial Sequence: Synthetic coding sequence
atggcccggctgggcagcaccggcggcgtgagcggccgggtggtgactcaacatagggattccgcccctttcctcggagcaccaagactcgggctgcgcgaactgggtcccattcggggaactgcccccgagtggcacggccggtggaacgctgctgagagaagtgacaagatgtaccaggttccactcccgttggaccgggatggtacactggtacgtcttcggttcacgatggtggctttggtgacagtttgctgtccccttgttgcattcctcttctgcatactgtggtctttactctttcattttaaggaaaccactgcgactcactgcggtgttcccaactatctgccaagcgttagctccgcaattggcggggaggtgccacaacgctacgtctggcggttctgcataggtttgcattcagctccacggtttctagtggcctttgcttattggaaccattacctctcatgtacgagtccctgctcttgttacaggccgctatgccgacttaactttggtcttaatgtggtggagaacctcgccctgctggtcctcacctatgtctcaagttccgaggatttcacaatccacgagaatgccttcatcgtgtttatcgcctctagcctgggacatatgctgctgacatgtatattatggaggttgaccaagaagcacacagacagaaagtcgtacagctggaaacaaaggctgtttattatcaattttattagctttttctctgcgctagcagtctacttccgtcacaatatgtattgcgaggctggcgtgtacactatttttgctatcctcgaatacaccgtcgtgctaaccaacatggcttttcatatgactgcatggtgggacttcggcaacaaagagctcctcatcaccagtcagcctgaagagaagcgcttttag

SEQ ID NO: 44912 - DNA, 948 bp, Artificial Sequence
  Description of Artificial Sequence: Synthetic coding sequence
atgtaccaggtgcccctgcccctggaccgggacggcaccctggtgcgtcttagatttactatggtagccctggttacggtgtgttgcccattggtggcatttctgttttgtatcctttggtcccttctatttcacttcaaggaaaccactgccacccattgcggcgcgaccccatgcaggatgttcagcgcagcctctcagccattggatcccgatggaacacttttccggctccggtttactgctatggtttggtgggctatcacattccctgtattcggcttctttttttgtatcatttggtctttagtatttcacttcgagtacactgtcgccaccgactgcggggtcccaaattatcttcctagcgtgtcctccgccattggcggcgaggtgccccagcgatacgtttggcggttctgcatagggctccactccgcaccaaggttcctggtcgcattcgcatactggaaccactatttgtcttgcacatccccttgcagttgttatcggccgctgtgcagactcaattttggtctgaacgtcgtggaaaatctcgcacttcttgtactaacctatgtcagcagttcagaggacttcactattcacgaaaacgcttttatcgtgttcatcgctagctcactcggacatatgctcctcacctgtattctttggcgacttacaaagaagcatactgttagccaggaagacaggaaatcttacagctggaagcagcgccttttcatcattaacttcatctcattcttctctgccttagcagtgtatttcagacataatatgtactgcgaagcaggtgtgtacacaatcttcgcgattctggaatacaccgtggtgttgacgaacatggcctttcacatgacagcatggtgggactttggcaacaaagagttgctgattacatctcagcctgaggagaagcgcttttag

SEQ ID NO: 44913 - DNA, 486 bp, Artificial Sequence
  Description of Artificial Sequence: Synthetic coding sequence
atggtggacggcacccagctgcggggcgcccagctgcccgccctgggagaactgtcccatcgacggggtggagcccccgcactgcgggtagcctttttgcaccggccggcattgggagcgtctcttctcggaggcctcaggcttcttgagccccttccacaactgcatctgccagtttttctcctctcacccgctctgcctccgcaacttcgtcctcaatgcagaggagagcctcgagtggccagcgcacacttatgtctgctgctacggggtttgcatcatccaaggaagtgtttccactgcgtgcactgcctgatcccgagggcgcacgcaccacaccttcattccctggccgttgaccaggaggcccattcaaagtcaggcggttcgcaggtgttgcagcttgaaactgccgcactccatcaccagctgcacctactcctgctcggcgcagggtgtctgttgtccgcccagcacgtgctctag

SEQ ID NO: 44914 - DNA, 765 bp, Artificial Sequence
  Description of Artificial Sequence: Synthetic coding sequence
atgtaccaggtgcccctgcccctggaccgggacggcaccctggtgcgcctgagattcaccatggtcgcacttgtgacggtgtgctgtccactcgtggcctttctgttttgtatcctttggagtttgctgttccacttcaaagagaccaccgcaacccactgtggcgtccccaattatttaccttctgtctcatcagctataggcggtgaagtacctcagcgctacgtttggagattttgtatcgggttgcatagtgcaccaagattcctcgttgcctttgcctactggaatcattacttgagctgtacatccccttgttcctgctaccgccccctgtgtagactgaatttcggcctgaatgtcgtggaaaacctggccttgctggtgctgacctacgtgtccagctctgaggacttcactattcacgagaatgcctttattgtgttcatagcttcatctctgggccacatgctcctaacctgcatcctttggcgtctgaccaagaagcatacagtctcccaggaagatcgcaagagctactcctggaaacagcgacttttcataattaatttcatatcatttttctccgctttggccgtctacttccggcacaatatgtactgcgaggctggtgtctatacaatatttgcaattctagaatatacagtagtgttgaccaacatggcattccacatgaccgcctggtgggacttcggaaataaagaactgctcattacatcacagcctgaggagaagagattctag

SEQ ID NO: 44915 - DNA, 1038 bp, Artificial Sequence
  Description of Artificial Sequence: Synthetic coding sequence
tgacggctgggcctgcgggagctgggccccatccggggcaccgcccctgagtggcacggcaggtggaacgctgcggaaaggagcgacaaaatgtatcaggtgccgctgccacttgacagagacggcaccttggtcaggttgcgatttaccatggtcgctttggttaccgtgtgttgccctctggttgctttcctgttctgcatactttggtctctgctctttcacttcaaggagactacagccacccactgcggtgcaacaccttgtcggatgttcagtgccgccagccagccgctcgaccctgacggcaccctgttcaggttgcggttcacagctatggtctggtgggccatcacctttcccgtatttggcttttttttctgtataatctggtccctcgttttccacttcgagtacacagtggctacggactgcggtgttcccaattatctcccgtccgtgagttctgctattgggggcgaggtgcctcagcgttatgtttggaggttctgcatcggcctgcacagtgcaccccgatttctggtggcgttcgcctattggaaccactatctatcttgtacctccccgtgctcgtgctaccggcccctgtgcagactaaatttcgggctaaatgtggttgagaacctggccctcttggtcctgacatatgtgagctcgtctgaagactttaccattcatgagaacgccttcatagtgtttatcgcctcctccctggggcacatgctgctgacttgcatcctttggagactcacgaagaagcataccgttagtcaggaggatcggaaatcctacagttggaagcagcgcttgtttattatcaatttcatctctttttttagtgcactcgctgtctatttcaggcataatatgtactgcgaagcaggtgtgtacactatttttgccatcctggagtacaccgtggtcctgacgaacatggccttccacatgacagcttggtgggatttcggcaacaaagagctgctgatcaccagtcagcccgaagaaaagagattttag

SEQ ID NO: 44916 - DNA, 624 bp, Artificial Sequence
  Description of Artificial Sequence: Synthetic coding sequence
atgttcagcgccgccagccagcccctggaccccgacggcaccctgttcagacttagatttactgccatggtgtggtgggcaatcactttcccagtctttggattcttcttttgtataatttggtccctggtgttccatttcgaatacaccgtggctaccgattgtggagtcagcgcctccagccccgccccaggctcaggccctggacaggaagttgccgtaagggtggaattggatagcggcgaagaggtcgaggaccaacgcgaaggcaaagggcagggcgatggcggccgcgttggaaagagcgaatcggagattattcatggtggccggctgcgggagaatcggatcacagttctacctgagctagaggatgacgatcgcaacgctagggaaatgaccggcgctgtggcacacacttgcaaccttagtaccagtgggggaaggtcacagtggatcacccgcgtgcagttcgagacttccctggggaacatggtgaaaccaagactgtataaaaaatgcaagaaaataagctgggtcccttggcacgcacctgtcgtcccagccacatgggaggccaaggctggggaactgctggaagcgggccgttggacgtttcagtag

SEQ ID NO: 44917 - DNA, 936 bp, Artificial Sequence
  Description of Artificial Sequence: Synthetic coding sequence
atggcccggctgggcagcaccggcggcgtgagcggccgggtggtgacccagcacagggatagtgcaccattcttgggggccccccggctgggcttgcgggagctggggcctattcgaggcaccgccccagagtggcatgggcgttggaacgccgctgaacgtagcgacaagatgtatcaggttccactgcccctcgaccgcgacggcactctcgtcaggctacgctttaccatggtggccttggttactgtctgctgcccactggtggcgttcctcttctgtatcctctggagcttgctgtttcactttaaggaaacaactgctacccactgcggagtgcccaactatctgccatccgtgtcaagcgcaattgggggcgaggttccacagagatatgtttggcggttctgtatcgggctccatagcgctccccggttcctcgtcgcgttcgcttattggaatcactacctgtcctgtactagtccttgcagctgctaccgccccctatgtcgattaaacttcgggctgaatgtggtggagaacttagcactcctggttctgacctacgtttcctcatctgaggatttcaccattcatgagaacgcgttcatagtgtttatcgcttcttccctgggccatatgctcctgacctgcatcctgtggaggctcacaaaaaagcatacagtttctcaggaagaccgcaagtcctattcctggaaacaaaggctcttcattattaattttatatcttttttttccgccttggccgtctactttcggcacaatatgtactgtgaggctggagtgtatactatcttcgcgatacttgaatatactgtcgttctcacaaatatggcgttccacatgactgcgtggtgggactttggcaacaaggagctgcttataaccagtcagccggaagaaaagcgattttag

SEQ ID NO: 44918 - DNA, 699 bp, Artificial Sequence
  Description of Artificial Sequence: Synthetic coding sequence
atgtaccaggtgcccctgcccctggaccgggacggcaccctggtgcgtctgcgattcaccatggtagcactcgtgaccgtctgttgtccgcttgtggccttcctcttctgtatactgtggagcctcctgttccacttcaaggagaccacggctacccactgtggcgttcccaactacctgcccagcgtcagctctgccattggtggagaagtgcctcaacgctacgtctggcgattctgtattggattacatagcgccccccgcttcttagtggccttcgcgtactggaaccattatctttcttgcacaagcccctgcagttgctaccgccctctgtgtagactgaacttcgggctgaacgtcgtcgaaaaccttgcgcttctagtcctgacctacgtcagctccagtgaggatttcaccatacacgaaaatgcctttatcgtttttatagccagttccttgggacacatgttactgacatgtattctttggagactaactaagaagcacaccgtgagccaggaggtgcgcagcatcccatccggcggatcaaaagccgctcaaaaaaaaatcaaggatatatgcccccaggacagcggtagccaggtgctgcagcttgaaactgcagcactgcaccatcaactgcacctcctcctcctcggtgctggctgcctgctgtccgcccagcatgtgctgtag

SEQ ID NO: 44919 - DNA, 171 bp, Artificial Sequence
  Description of Artificial Sequence: Synthetic coding sequence
atgtaccaggtgcccctgcccctggaccgggacggcaccctggtgcgcctgcggtttactatggtagcccttgtaactgtctgctgtccgttagtggcctttctgttttgtatcctatggagcctgctttttcacttcaaggagactactgccactcactgcggcgattag

SEQ ID NO: 44920 - DNA, 963 bp, Artificial Sequence
  Description of Artificial Sequence: Synthetic coding sequence
atggccggcctggccgcccggctggtgctgctggccggcgccgccgccttggccagcgggtcacaaggcgaccgagagccagtgtatagagattgcgtgttgcagtgcgaagaacagaattgtagtgggggcgccctgaatcatttccggtctcgacagccgatctacatgtccctggcgggatggacctgtcgagatgattgcaagtacgaatgtatgtgggtgacagtcggtctgtacctgcaagagggccacaaggtccctcagttccacggcaagtggccttttagccgattccttttttttcaggaacccgcgtcagctgtggctagtttcctaaatggtctggcgtcactcgtgatgctatgtcgctatcgtacctttgtgcccgccagctccccaatgtatcacacatgtgtcgcatttgcctgggtctcactgaacgcctggttttggtccactgttttccatacccgcgatacggacctcacggaaaagatggattacttttgcgcatcaaccgtcatcctgcactccatttatttatgctgcgtccgaactgtgggccttcagcaccctgcagttgtctcagccttccgcgccctcctcctgctaatgctcactgtgcacgtatcttatctttctctgatcagatttgactacggttacaacttagtggctaacgttgcaattggcttggtgaacgtcgtgtggtggctcgcttggtgtctctggaatcagaggagacttccccatgtccgcaagtgtgtagtggtggtgctgctgttgcagggtctatctctgctggagctcttagattttcctcccttgttttgggtactagatgcacatgctatctggcatatcagcacaatccccgtgcacgtcctcttcttctcttttctggaagatgactctctctatctactgaaggagtccgaagataaattcaagttggattag

SEQ ID NO: 44921 - DNA, 795 bp, Artificial Sequence
  Description of Artificial Sequence: Synthetic coding sequence
atgagcctggccggctggacctgccgggacgactgcaagtacgagtgcatgtgggtgacggtgggactctaccttcaggaagggcataaggtgccccagttccacggcaaatggccattctctagatttctcttctttcaggaaccagcttctgcagttgcatctttcttgaacggactcgcctcactagtaatgttgtgcaggtataggacatttgtgcccgccagttccccgatgtatcacacatgtgtggcttttgcatgggtttccctgaatgcttggttctggagtactgtgttccatacccgagacactgatctcaccgagaagatggattacttttgcgcttcaaccgtgattctacactcgatctacctgtgttgcgttcggaccgtggggctgcagcatccagctgtggtgtctgccttccgggctcttttgctgctcatgctcacagtgcacgtgtcctacctctctctgatcaggttcgactacggctataatctcgtcgcaaacgtggcgattgggctcgtgaacgtggtatggtggcttgcttggtgcctgtggaaccagcgaaggctgcctcatgtgagaaagtgcgtggtcgtcgtactgttactacagggactcagtctcttggagctgctcgatttcccacccctgttctgggtgctcgatgcccacgccatctggcacataagtacaatccctgtgcatgtgctgtttttctctttcctggaggacgactctttgtacctactgaaagaaagcgaggacaaatttaagctagattag

SEQ ID NO: 44922 - DNA, 810 bp, Artificial Sequence
  Description of Artificial Sequence: Synthetic coding sequence
atggccggcctggccgcccggctggtgctgctggccggcgccgccgcactggcatctgggtcccagggcgatcgggaacccgtatacagagattgtgtgctgcaatgtgaggagcagaattgtagtggcggcgctctgaaccatttccgttcgagacagcctatttacatgagcctcgcgggttggacttgccgcgatgattgtaaatatgagtgcatgtgggttacggtgggcctgtacctccaggaaggtcacaaggtgcctcagttccacggcaaagtctcattgaatgcatggttttggagtactgtgttccacacaagggacactgacctgacggagaaaatggactatttttgcgcaagcactgtcatcttacattccatctacctgtgctgtgtgaggacagtgggattgcagcaccctgcagtcgtatccgctttcagggcactgttgctgctcatgctgaccgtccacgtttcctatctgagtctgatccggtttgattacggctataatctcgtggctaatgtggccatcggccttgtgaacgtcgtctggtggctggcctggtgtctgtggaaccagaggcgtctgcctcacgtcagaaagtgcgtcgtggttgtactgctgctgcagggactctctctgctggaactactcgattttcccccactcttctgggtcttggatgcccatgctatttggcacatctcgacaattccagttcacgtgctttttttttcatttttggaggacgacagcttatatctgctcaaggaaagtgaggataagttcaagctggattag

SEQ ID NO: 44923 - DNA, 900 bp, Artificial Sequence
  Description of Artificial Sequence: Synthetic coding sequence
atggccggcctggccgcccggctggtgctgctggccggcgccgccgccctcgcatcaggctcacagggggacagagaaccagtgtatagagattgcgtactgcagtgtgaagagcagaattgctcggggggtgccttgaatcactttaggtcgagacagcctatatatatgagcttagcagggtggacctgccgggacgattgtaagtacgagtgcatgtgggtgactgtgggtctgtatctgcaggagggccataaggtgccccagtttcatggcaagtggcccttttcccggttcctgttctttcaggagcccgcttccgccgtggctagttttttgaacggactggcaagcctcgtaatgctttgtcggtataggacattcgtacctgcaagctcacctatgtaccatacctgtgtggccttcgcgtggaagatggactacttttgcgcctccaccgtgatcctgcactcaatctacctgtgttgcgtccggactgtggggctgcagcacccggcagttgtcagcgccttccgtgcgctacttctcctcatgttaacggttcatgtcagctatctatctcttatccgcttcgactacggttataacctggtcgcgaatgtggctattggattagtcaacgtggtttggtggctggcatggtgtctgtggaaccagcgccgactacctcacgtccgaaaatgtgtcgtggtggtgctgctattgcagggcttgtccttgctggaactgctggacttccccccactcttctgggtactcgatgctcatgctatctggcacatctctactatcccagtacacgtgctgttcttttcgttcctcgaggatgactccctctaccttcttaaggagagcgaagacaaatttaaactcgactag

SEQ ID NO: 44924 - DNA, 819 bp, Artificial Sequence
  Description of Artificial Sequence: Synthetic coding sequence
atgagcagccaggagctggtgaccctgaacgtgggcggcaagatctttacgacacggttcagcacaatcaagcagtttcctgccagccgattggctcgcatgctagacggaagagatcaagagttcaaaatggtgggggggcagatatttgttgatcgcgatggagatctcttcagctttattttggacttcctgcggacccaccagttgctattacctaccgaattttccgactatctgcgactgcagcgggaagcccttttctatgagcttaggagcctcgtagatttgctgaatccatatctactgcagccccgtcccgcgctggtcgaggtgcacttcctcagtcgcaacacacaagccttcttccgggtgtttgggtcctgctctaaaactatcgaaatgctgacaggcaggattactgtttttactgaacaaccttcagctcctacctggaacgggaacttctttcccccgcagatgaccctgctgccacttccaccccagaggcctagttatcatgacctggtgttccagtgtggcagtgatagcacaacagataaccagactggcgttcgttatgtatcgatcaagcccgataatagaaaactcgctaatgggaccaatgtgttaggattgctgattgatactctgctcaaggaggggtttcacttagtctccactagaacagtttcatcagaagataagacggagtgttacagtttcgaaagaatcaagtccccagaggttctgataactaatgagacccccaagccagaaacaatcatcattccagagcagagccagatcaagaagtag

SEQ ID NO: 44925 - DNA, 690 bp, Artificial Sequence
  Description of Artificial Sequence: Synthetic coding sequence
atgagcagccaggagctggtgaccctgaacgtgggcggcaagatcttcacgacaagattcagcaccattaagcagttccccgcctccagactggctcggatgctcgatggcagggaccaggaattcaaaatggtaggtggccaaatctttgtagatagggatggagatctgttttcttttattttagactttctaaggactcatcagttgcttcttccaacagagttctctgactatttgaggctgcagcgagaggccctgttctacgaactccgctcgttggtggatctgctcaatccctatctattgcagccgcgccccgcgctcgtggaggtgcatttcctgtcccggaacacgcaggcattcttccgcgtctttgggtcatgtagcaaaacaattgaaatgcttactggcaggatcacagtgttcaccgagcagccttccgccccaacatggaacggtaattttttccccccccagatgaccttgctgccattgcctccccagaggccgagctatcacgacctcgtattccaatgcggaagtgatagcacaacagataaccaaaccggggtgcgtctggtttgcaatggtgtgatatctgcacatcataaccttcgcttatgggggtcctctgatagtcctgcttcagcttctagggttgctgggattacaggcatgttcctgtag

SEQ ID NO: 44926 - DNA, 978 bp, Artificial Sequence
  Description of Artificial Sequence: Synthetic coding sequence
atggccctggccgacagcacccggggcctgcccaacggcggcggcggcggcggaggctctggcagtagcagctccagcgccgagccacctctgttccccgatatagtggaattaaatgttggaggacaggtatatgtgaccaggcggtgcacagtcgtttccgtgccagattcattgttgtggcggatgttcacccagcaacagcctcaggaactggcaagggactctaagggccgcttctttcttgacagagatggttttttatttaggtatatactcgactatttgcgagatctgcagctggtcctgcccgactacttccctgaaaggtcccggttacagcgtgaggcggagtatttcgaattgcccgaactggtgaggcggctgggtgcaccccagcagccaggccctgggcccccaccctcgagaagaggggttcataaggaaggctcactcggcgatgagttattacctctgggctattcagaacctgagcagcaggagggcgcttccgctggagcgccgtcaccgactctcgagttggcaagcagatcacctagtggaggcgcagcaggccccctgttgacgccaagccagtcacttgatgggtcccgtagatccggatacattacaattggatatcgtggatcgtacaccataggccgggatgcacaggcggacgcaaagtttagaagagtggcacgaatcaccgtctgcggaaaaacctctctcgctaaagaagtgtttggcgacacactcaacgagagccgggatcctgataggcctccagaacggtacaccagccggtattatctaaagttcaatttcctcgaacaggccttcgacaaattgagcgagagtggcttccacatggtcgcatgctcctcaactggtacctgcgcgtttgctagctccaccgatcagagtgaagataaaatttggacatcatataccgaatatgtcttctgtcgagaatag

SEQ ID NO: 44927 - DNA, 978 bp, Artificial Sequence
  Description of Artificial Sequence: Synthetic coding sequence
atggccctggccgacagcacccggggcctgcccaacggcggcggcggaggcggtggctctggctcgtcctcctccagcgctgagccacctcttttccctgatatcgtggaactgaacgtcggaggccaggtttacgtaacaagacgctgtacagtggtatccgtgcctgattcactcttatggagaatgtttacccagcagcagccccaggagttggctagagattccaaagggaggttctttctggatagggatgggtttctgttccgatatattttagactatctgagggatttacaacttgttctacccgattatttccctgaaagatctcggctgcagagagaggccgaatatttcgaattgccagagctggtacggagactgggagcccctcagcagcccggtccaggaccaccccctagccggcgaggagtgcataaggaggggagtcttggcgacgaacttctgcctctcggttattccgaaccagagcaacaggagggagctagtgccggcgctccatcccccacactagaattagccagccgaagcccctcgggaggagccgcaggacccttgttaactccttctcagagcttagatggcagcaggaggtctgggtatatcactatcgggtatagaggcagttataccattggacgagatgctcaagccgacgcaaagtttagacgggtggcacgaatcaccgtttgcgggaagaccagcctggccaaggaggtctttggggacacccttaacgaaagccgggatccagacagaccacccgagcggtacacctctcgttattaccttaaatttaattttctggaacaggcctttgacaagttgtccgaatccggattccacatggtggcttgctctagcacaggcacctgcgcgtttgctagctcaacggaccaatctgaggataaaatatggacgagctataccgagtacgtcttttgccgcgagtag

SEQ ID NO: 44928 - DNA, 768 bp, Artificial Sequence
  Description of Artificial Sequence: Synthetic coding sequence
atgtggcagggctgcgccgtggagcggcccgtgggccggatgacctcacagacgccgctcccccagagcccacgaccccggcggcccacgatgtccaccgtcgtggagctgaatgtcggtggggagttccatactacaactttgggcacacttcggaagttcccaggatcaaagcttgccgagatgttctctagcctggctaaagctagcaccgacgccgaaggcagattcttcatcgaccgaccatctacctacttcaggccaatactggactacctgagaaccgggcaggtgcccacccagcacatccctgaggtatatcgagaggcacagttctacgagatcaagccactcgtgaaactattggaggatatgcctcagatctttggagagcaggtcagccggaaacagtttctcctgcaggtccccggatacagcgagaatctcgaactgatggtcagactagcacgggccgaagccattacagccaggaagtcaagtgtgctggtgtgtttagtggagaccgaggaacaggacgcctactattctgaggtgctgtgttttctgcaggacaagaagatgtttaaaagtgttgtaaagttcgggccatggaaagccgttctcgacaattctgacctcatgcactgcctggagatggatataaaggcgcaaggttacaaggtgttttctaaattctatctgacatatcccacaaagcgtaacgaattccactttaacatctattctttcaccttcacctggtggtag

SEQ ID NO: 44929 - DNA, 678 bp, Artificial Sequence
  Description of Artificial Sequence: Synthetic coding sequence
atgagcaccgtggtggagctgaacgtgggcggcgagttccacaccaccaccctggggaccctccgaaagtttccaggctctaagctggcagaaatgttcagttccctcgctaaggctagcactgatgccgaggggcggttctttatcgaccggccttccacttacttcaggcctattctcgactacttacgtacaggccaggtgcccactcagcacatccctgaggtgtatagagaggcgcagttctacgaaatcaagccgctggtgaagctgctggaagacatgccacagatctttggtgagcaagtctcgcgtaagcagttcctcctgcaggtcccgggctactccgaaaatctcgagcttatggtgagactagccagggccgaggccattaccgcgaggaaatcatccgttctcgtttgtctggtggaaacagaggagcaagacgcatactactcggaagtgctctgcttcttacaggacaagaagatgtttaaaagcgtggtcaaatttggaccatggaaggccgtgctggacaactcggacctgatgcactgtttggaaatggatattaaagctcaaggctataaagtgttctccaagttttacctgacatacccaacgaagcggaatgagttccactttaacatttactctttcacattcacttggtggtag

SEQ ID NO: 44930 - DNA, 861 bp, Artificial Sequence
  Description of Artificial Sequence: Synthetic coding sequence
gacgcccagatgccccaccggaaggagcggcccagcggcagcagcctccatacacacgggagtaccggtaccgccgaagggggtaacatgtctcgattgagtctaacacgttcgccagtcagtcctctggcagcccagggaattccgttgcccgcacaattgacaaagtctaacgctccagtgcacattgatgtgggtggtcacatgtatacaagctccttggcaactctgactaagtacccagattccagaatcagtcgcctgttcaacgggactgagcccatcgtgctagactcattgaagcagcactatttcattgatcgggacggtgaaatcttccggtacgttcttagcttcctgagaaccagcaagctgctgttaccagacgacttcaaagatttttctctactctacgaagaggccagatactatcagctgcagcccatggtccgtgaactcgagcggtggcaacaagagcaagagcagagaagacgcagccgggcttgcgactgtctcgtggtcagggtgacgcctgacttgggcgagcggatcgcactctctggtgagaaagccctgatagaggaagtgttcccagaaactggcgacgtgatgtgcaactcagtcaatgcaggatggaatcaagaccctacccacgtgattaggtttccattgaatggctactgtagactgaattccgtgcaggtgctggagaggctcttccagcgaggcttttctgtcgccgcctcctgcggcggaggcgttgatagctcacaatttagtgagtatgtgctctgtcgtgaagaacggcggccacaacccacccccacagcggtaagaatcaaacaggagccactggattag

SEQ ID NO: 44931 - DNA, 852 bp, Artificial Sequence
  Description of Artificial Sequence: Synthetic coding sequence
atgccccaccggaaggagcggcccagcggcagcagcctgcacacccatgggtctaccggcacagctgagggaggtaatatgtcgcggctgagcctcacacgctctcccgtaagtcccctagccgcccagggaatccccctgcccgcccagcttacaaaaagcaatgcacctgtccacattgatgtgggagggcatatgtacacgtcctcccttgccaccctaacaaagtaccccgattctagaatctctagactttttaatggtacggagcctattgtactagattccttaaagcagcactatttcatagaccgagatggtgaaatattccggtatgtgctatccttccttcgcacatcaaagctgctgttgcccgacgatttcaaggattttagtctgctttatgaggaggctagatattaccagcttcagccgatggtgagagagctggaacgatggcaacaagagcaagaacaaagacgccgatcccgcgcttgtgattgtctcgtggtcagggtgaccccagaccttggcgagaggatcgccctgtccggggaaaaagcgctgatcgaagaggtgttcccagagaccggtgacgtcatgtgtaactctgtcaatgcgggctggaatcaggacccgacccacgtgatccgctttcctctgaatgggtattgcaggctgaactcggtccaagtactcgagcgactcttccagaggggattctccgtggccgcttcatgcgggggaggcgtggattcttctcaattcagcgagtacgtgctctgcagggaagagagacgaccccagcctacccccactgccgtgagaatcaagcaggaacccttagattag

SEQ ID NO: 44932 - DNA, 894 bp, Artificial Sequence
  Description of Artificial Sequence: Synthetic coding sequence
atgcagaccccccggcccgccatgcggatggaggccggcgaggccgccccccccgctggtgcgggcgggcgagccgcagggggatgggggaaatgggtcaggctgaatgtcggcggaaccgtgtttttaactacaagacagacgctgtgccgagaacagaaatccttcctgagcagactgtgtcaaggagaagaattgcagagtgacagggacgagacaggggcttatctcatcgacagagaccctacctactttggcccgatactcaacttcctgcgacacggcaaattggtcctcgacaaggacatggctgaggagggggttcttgaggaggctgaattctacaacattgggcctctcatccgtattattaaagatcggatggaggagaaagactacactgtgacacaggtgccaccaaaacatgtgtaccgggtcttacaatgtcaagaggaggagctcacccagatggtctcaacaatgtcagatggatggcgattcgaacaacttgtaaatattggtagcagttataactacgggagcgaggatcaggcagagtttctgtgtgtcgtaagcaaagaacttcattccacacccaatggactgagtagcgagagttctcgtaagaccaaatctacagaggaacaactggaagaacagcagcaacaggaggaggaagttgaagaggttgaagtagaacaggtgcaggtggaagctgacgcacaggagaaagggagcaggccacaccctttaaggcctgaggctgagctcgctgttcgcgcatccccaaggcccctggcccgccctcagtcctgccacccctgctgctacaaaccagaagcccctggatgcgaagccccagaccatttgcagggtctcggggtgcctatctag

SEQ ID NO: 44933 - DNA, 966 bp, Artificial Sequence
  Description of Artificial Sequence: Synthetic coding sequence
atgcagaccccccggcccgccatgcggatggaggccggcgaggccgctcctcccgctggggccgggggtagggccgccggaggatggggcaagtgggtgcggctaaatgtgggcggtaccgtctttcttacgacgcgacaaacgttgtgtagggagcagaaatctttcctgtcacgcctttgtcagggagaagagctgcaatctgatagggacgaaaccggtgcctacttaattgaccgggaccccacgtacttcggacctattctgaatttcctgagacatggaaagctggttttagacaaggatatggccgaagagggagtgctggaagaagcggagttttataacatcggtcctctgattcgcataataaaggaccgcatggaagagaaagactacacagtcacacaagtccctcccaagcacgtgtaccgcgtgctgcaatgccaagaggaggagctgactcagatggtgagtaccatgagtgacggatggagattcgaacaactggtgaacattggttccagctacaactatgggtctgaggatcaggcagagttcttatgtgtcgtatccaaggagctgcacagcacgccaaatggcctatcttccgagagttcccggaaaactaaaagtaccgaggagcaactggaggagcagcaacagcaggaagaggaggtggaggaagtggaagtggaacaggttcaggttgaagccgacgctcaggaaaaggctcaatctagccaggaccccgcgaacctcttctctcttcctcctctgcccccacctcctttgcccgccggagggtccagaccccatccactccggcctgaggccgagctggccgtgagggcctcacctagacccctcgctaggccgcagtcttgccacccttgttgttacaagccagaggccccgggctgtgaggctcccgatcatctgcaaggcctgggggtcccaatctag

SEQ ID NO: 44934 - DNA, 192 bp, Artificial Sequence
  Description of Artificial Sequence: Synthetic coding sequence
atgaccagcaaggtgagctgcccccccagcgtgaccctgcggtgctgtggcctctggcaggttgcgtcgccgctcaacgtgtcagacctctctgatgagacgggtgcctatctgattgatagagacccaacatatttcggaccaattctgaacttcttacggcatggtaaactcgtgttggataaggactag

SEQ ID NO: 44935 - DNA, 543 bp, Artificial Sequence
  Description of Artificial Sequence: Synthetic coding sequence
tgacagaccctgtgccgggagcagaagagcttcctgagccggctgtgccagggggaggagttgcagtccgatagggacgagaccggtgcgtatttaatagaccgggatcccacttatttcggccccatactgaacttcttacgtcacggaaagctcgtgctggacaaggacatggccgaagagggcgttctggaggaagcagagttttataatatcgggcccctgattcggatcattaaagaccggatggaagagaaggattacaccgttactcaggtgccccccaaacatgtgtatcgtgtgctccagtgtcaggaggaggagttaacccagatggtgtcgaccatgtctgacggatggaggtttgaacagctggtgaatattggaagctcctataattatgggagcgaggaccaagcagagttcctctgtgtggtgtccaaggaattgcactccacccctaatggcctgtcctcagagtccagcagaaagaccaaggtacccgtcagaacccttagcgacctgcggctttcgctgcagtag

SEQ ID NO: 44936 - DNA, 1281 bp, Artificial Sequence
  Description of Artificial Sequence: Synthetic coding sequence
atggagggccacaaggccgaggaggaggtgctggacgtgctgcggctgaacgtgggagggtgtatttatactgcacgcagagaatctctgtgtagatttaaggacagcatgctggctagcatgttctctgggcgctttcccttgaaaacagatgaaagcggggcgtgcgtcatagaccgcgacgggcgcctgtttaaatacctgctggactacctacatggcgaggtacagatccctactgacgaacagactcggatcgccctccaggaggaggccgactatttcggtataccttatccttattccctttccgaccaccttgcgaatgagatggaaacctattcacttcggagtaacattgagctgaaaaaagccctcaccgatttttgtgatagctatggcctcgtgtgcaacaagccaacagtgtgggttctccactacctcaacacctctggcgcctcgtgtgagagccgcataatcggtgtttacgccactaagactgatggcactgacgcaattgagaaacagctgggtgggcgtatccactctaagggcatcttcaagcgagaggccggaaataatgtacagtacatttggagttattattcagtggccgaactgaagaaaatgatggatgctttcgatgcatgggagggcaagggagtgagctactggagagtgccacacgagcttatcgaatgttggactctcgaggagcggccgctccttggttccttgcgtcatatggcccccatccgaaagcggagacttattacgttcaatgaggcggacgagagcgttaattacaaaactggcccgaagccggtacggtttcttggcccctccacttcaactcagatcaaagttaagaactctgcctctgtgacagttagtcctgcatctgccattcagacgtccgcaggtgccactgccaatcgtttccaatctgggtcaaggagaaaagccgcccagcgatctgccccttctcgtgccactgcacttgtggggactggtgctccaggccatccgcaggcatctccaggtgccgcatctgcggagaacggtgggacccacctgccacccgccaaggtgctgttgtctgacaaaaaacccaccccccagcgggtcattaaacttaaacggaccccgctgtgcgccacggcgccatgtctcccatcgcccaccgctacaagacaggccaattcccttaaaccgctcccaggcgaagctgcccgggctctgggtgttcgaactgaaaatggaaagaacaaaggcaactag

SEQ ID NO: 44937 - DNA, 1281 bp, Artificial Sequence
  Description of Artificial Sequence: Synthetic coding sequence
atggagggccacaaggccgaggaggaggtgctggacgtgctgcggctgaacgttggaggctgtatttatactgccagacgcgaatctctttgccgtttcaaagacagtatgcttgcctccatgtttagcggccgcttccctctgaaaactgatgagagcggagcctgtgtgatcgaccgcgacgggagactatttaagtacctgctggactacctgcatggggaggtacagattcctactgatgagcagacacgcatcgcattgcaggaggaagcagattacttcggaattccatatccttacagtctatccgatcacctggcaaacgagatggagacttacagtctccgctcaaacattgagctgaagaaggccttgaccgatttctgcgatagctatggcctagtgtgtaacaagcccacagtctgggtgctgcactacctgaatacctctggagcatcctgtgagtcccggatcatcggcgtatacgccacgaaaacggatggcaccgatgctattgagaagcagctcggcgggcgtatacactccaagggaatctttaaacgggaagccgggaataacgtgcagtatatctggtcctactattccgtagctgagctgaaaaagatgatggatgcattcgatgcctgggaggggaaaggggttagctattggagggtgccacacgaactgattgaatgctggacattagaagaacgcccgctcctgggcagcctgagacacatggccccaatcagaaagaggcgactgatcacctttaacgaggccgacgaatctgtgaattataagaccggacccaaaccagtacggtttcttggcccttccacttccactcagattaaggtgaaaaactcagcatcagtaactgtgtcacctgcaagcgcaattcaaacgtccgctggggccactgcaaacagatttcagagtggttctagaaggaaggcggcacagcgaagcgcccccagccgggcaacagccctcgtgggtaccggtgcccccggccatcctcaagccagccccggagctgctagcgcagagaatgggggaacccatctgcctccggctaaggtgctgctcagtgataaaaagcccacaccgcagcgcgtaattaagctgaagcggacaccactctgcgccactgctccttgtctaccgtcgcctacagctacacgccaggccaactccttgaaaccattgcccggggaggccgcgcgggccttgggtgtgcggactgagaatggcaagaacaagggaaattag

SEQ ID NO: 44938 - DNA, 2781 bp, Artificial Sequence
  Description of Artificial Sequence: Synthetic coding sequence
atggaggagagcggcatggcccacgagagcgccgaggacctgttccactttaatgtcggaggttggcacttcagtgtgccccgcagtaagttaagccagttccctgacagtctgctttggaaggaggctagcgccctgaccagtagtgaatctcagcgcctcttcatcgaccgggacggatccacttttcggcacgtgcactattatctgtatacttcaaaactgtccttcagttcctgtgccgagctcaatctgctgtacgagcaggccctgggccttcagctcatgccattactccagactctggacaacctcaaggagggaaaacaccaccttcgcgtgagaccagctgatctgcccgttgccgagagagccagtctaaactactggcgcacttggaaatgtatcagtaaaccttcagaattcccaattaagagcccagccttcactggcctgcacgataaagctccgcttggccttatggatacgccactgctcgatacagaagaagaggtgcactattgttttctacccttggacctggtggccaaatatccctcattagtgacggaggacaacctactttggctcgcggagacagttgcactcattgaatgtgaatgtagtgagttccgttttatcgtgaatttcctcaggtctcagaagatcctactcccggataacttcagtaacatcgatgtactggaggcagaagtggaaattctggaaattccggcgctgaccgaggcagttagatggtacaggatgaatatgggtggctgttcgcctaccacctgcagtcccctgtctccaggcaaaggagcacgaactgcatctctggagtctgtgaagccactgtacacaatggcactcgggctgcttgtgaaatatcctgactccgcactcgggcaactgagaatagagtctaccctagatggatctcgcctatatattacaggtaacggtgtgttattccaacatgttaaaaattggctcggaacatgtagactaccgctgaccgagacaatttcagaggtatatgaactgtgtgccttcctggacaagcgggacattacttatgagcctataaaagtggcactgaaaacgcacctggaacctaggactttagcccctatggacgttctcaatgaatggaccgccgagatcactgtttactctccacaacagatcattaaagtgtacgtggggtcgcactggtacgccaccacgctgcagacccttctaaaataccctgagctgctgtctaaccctcaaagggtatattggatcacgtacgggcagacactgctgattcatggcgatggtcagatgttccgtcacatacttaatttcttaagactggggaaattgtttcttcccagcgagtttaaagagtggcctcttttctgtcaggaagtcgaagaataccatatccctagcctcagcgaggccctcgcccagtgtgaggcgtacaagtcttggacccaggagaaagaaagcgaaaacgaggaagcattcagcatccgcaggctccatgtggtgacagagggaccaggctcgctcgtggaattttcccgggacacaaaggaaactacagcatacatgccagtcgacttcgaggattgttccgacagaactccgtggaataaagccaaagggaatctggtacgttccaatcagatggatgaggctgaacagtatacccgtcctattcaggtttccttgtgccggaacgctaagcgagcaggaaatcccagcacttattcacactgccgaggcctttgcacaaaccccgggcattgggggtcccacccagaatctccgcctaaaaagaagtgtaccacaatcaatctcactcagaaatccgaaactaaagatcctcctgcaacacccatgcagaaactcataagtctggtgcgcgagtgggacatggtgaactgtaaacagtgggagttccaaccccttacagccacccgcagttcccccctcgaggaggctactctacaactgccacttggttcagaagcggcatcccagccaagcacctccgccgcttggaaagctcactccacggcatcagaaaaggatccgggcccccaggctggtgccggtgctggcgcgaaagacaaaggaccggaaccaaccttcaaaccctatcttccccccaaacgcgccggcacactcaaggattggtcgaaacagaggaccaaagaacgagagtccccagcccctgagcagcctttaccagaagcctctgaggtcgattcattaggagttatattgaaggtaacccacccccctgtagtcggatccgacggattctgcatgttctttgaggacagcatcatttacaccactgaaatggacaaccttcgacataccacccccacagccagcccccagccacaagaagtcacctttctgagtttctccttgagttgggaagaaatgttttatgcgcagaagtgtcactgctttctggcagatataataatggacagcatcagacaaaaggatcctaaagccatcacggcgaaggtcgtgagtttggctaaccggctatggactctgcacattagccctaagcaatttgttgtcgacttgttggccattaccggctttaaagatgatcgacacactcaagaacgactctattcatgggtggagttgactctgccctttgcacgaaaatatggccgctgcatggaccttctcatccagcgcggtctgtccagatcagtctcctactccattctgggcaagtatctgcaagaggactag

SEQ ID NO: 44939 - DNA, 1260 bp, Artificial Sequence
  Description of Artificial Sequence: Synthetic coding sequence
atgaacgtgcaccggggcagcgacagcgaccggctgctgcggcaggaggcgtcgtgcctcgtcgacgatactttagcagtagcccaggagaaagaggctaactccctggccagctcaggcccacacaatctgacttatccactgggacccaggaatgaagatctgtcgctcgactatgctagtcagcccgctaacctccagttcccgcacatcatgcctctggctgaagacattaaagggagctgcttccagagcggaaataaacgtaaccatgagcccttcatagcgcctgaacgcttcggtaatagttcggtgggatttgggtccaattctcattcacaagcaccagagaaggttaccctcttagtagacggaaccagattcgtggtgaacccccaaatttttactgcacaccccgacactatgttagggagaatgtttggcccgggaagagaatacaactttacccgcccgaatgaaaagggggagtacgagattgccgaagggatctcagcgaccgtcttcagaacagtgctggattattataaaaccggcattattaactgtcccgacggcattagtattcccgatctcagagatacatgtgattacttatgcattaatttcgacttcaacacaatacgatgtcaggatctgtctgcgctgctgcatgagctgtccaatgacggcgcccacaaacagttcgaccactatctcgaggagctgattctacctataatggttggttgcgccaaaaagggtgaaagagagtgtcacatagtcgttcttactgatgaagacagtgtagactgggacgaagatcacccccccccaatgggggaggaatacagtcaaatactgtacagctcaaaactgtacaggttcttcaagtacattgaaaaccgagatgtggcaaaaactgtgctgaaagagagaggtctcaagaatatccgtatcggtatcgaaggctaccctacatgcaaggaaaaaatcaaaaggcgaccaggaggtaggagcgaggtaatatataactacgtgcagcgaccctttatccagatgtcttgggaaaaggaggaagggaaaagcaggcacgtagacttccaatgcgtccgatctaagtcactcaccaacctagtggcagccggggatgatgtcctggaggatcaagaaattctgatgcaccacccaccacaagtggacgagctggacaggctcaatgcccctctcagccagatggcctcaaacgatttccaagattag

SEQ ID NO: 44940 - DNA, 762 bp, Artificial Sequence
  Description of Artificial Sequence: Synthetic coding sequence
atgaacgtgcaccggggcagcgacagcgaccggctgctgcggcaggaagcttcctgcttggtggatgacacattagctgtcgctcaggaaaaagaggctaattcactcgcgtcttcaggcccgcacaatctgacttacccgcttgggccaagaaacgagggcgctctcctccacgagctgtcgaatgacggagctcataagcaattcgatcattacttagaggaactcatactgccaatcatggtcgggtgtgctaagaagggcgaaagagagtgccatattgtcgtccttacagatgaggatagtgtggattgggatgaggatcacccacccccaatgggggaggaatattcacagatcctatacagctctaaactgtaccgcttcttcaagtacattgagaatcgcgacgtggctaagaccgtgttaaaggagagaggcctgaagaatatcaggatagggatagaaggttaccccacgtgcaaggaaaaaattaaaagaagaccggggggtcgtagcgaggtaatttataactatgtccagcggccgtttattcaaatgtcttgggaaaaggaagaggggaagagcaggcacgtggacttccagtgcgtcaggtcaaaatccctgaccaatctggttgccgccggagatgatgtcctcgaggaccaggaaattttgatgcatcacccacctcaggtggacgaattagaccggcttaacgcacctctgtcgcagatggcgagcaatgactttcaggactag

SEQ ID NO: 44941 - DNA, 264 bp, Artificial Sequence
  Description of Artificial Sequence: Synthetic coding sequence
atgaacgtgcaccggggcagcgacagcgaccggctgctgcggcaggaagcctcatgcctggtggacgacactttagcggtggcgcaggagaaggaagctaattcactggcttcctctgggcctcacaatctgacttaccctctcggtccccggaatgaagatctgagcctcgactatgcctcccagccagctaatctgcagttcccccatataatgccactcgccgaagacataaaaggctcatgttttcagtccggcaactag

SEQ ID NO: 44942 - DNA, 330 bp, Artificial Sequence
  Description of Artificial Sequence: Synthetic coding sequence
atgaacgtgcaccggggcagcgacagcgaccggctgctgcggcaggaggcgtcctgccttgttgatgacaccctagctgtggcacaggaaaaagaagcaaacagtctggcgagcagcggcccacacaacttgacatatcctttaggacctcgcaatgaagatctaagcctggattacgcctctcagccagccaacctccagttccctcacatcatgccgctggctgaagacatcaagggatcctgttttcagtccgggaacaagaggaatcatgagcctttcattgcaccagagcggtttgggaactcttcggtcggcttcgggagttag

SEQ ID NO: 44943 - DNA, 294 bp, Artificial Sequence
  Description of Artificial Sequence: Synthetic coding sequence
atgaacgtgcaccggggcagcgacagcgaccggctgctgcggcaggaggccagttgcctagtggatgacacattggccgttgcacaggagaaggaagctaatagccttgcgagcagtgggcctcataacctcacataccccctagggcctaggaatgaggacctttctctggattacgccagccaacccgctaatcttcagtttccccacatcatgccactggctgaggatatcaagggatcgtgctttcagtctggaaataaaaggaaccatgaacccttcatcgctccttag

SEQ ID NO: 44944 - DNA, 825 bp, Artificial Sequence
  Description of Artificial Sequence: Synthetic coding sequence
atgttcggccccggccgggagtacaacttcacccggcccaacgagaagggggagtatgaaattgcagagggaataagcgcaaccgtcttcagaactgtgttggactactataagacggggattatcaactgtccggatggaataagcatcccagacctgagagacacatgtgattacctgtgtattaactttgactttaatacaataaggtgtcaggatctgtcagccctactccacgagcttagcaacgacggtgctcataagcagtttgatcattatttggaagaactcatcttaccaattatggttgggtgcgctaagaagggggagcgtgaatgtcacattgttgtgctaacagacgaggactcagttgattgggacgaggatcatccacccccaatgggcgaggagtatagtcaaatcctatattccagtaagctgtaccggttcttcaagtacatagaaaacagagatgtggctaaaactgtcctgaaagagcgtgggctcaagaatataaggatagggatcgaaggatacccaacgtgtaaagagaaaattaaaaggcgcccagggggcaggtccgaggtcatttataattacgtccagcgccccttcatacagatgtcgtgggaaaaagaagaaggcaaatctcgtcatgttgatttccaatgtgtcaggagtaagagcctgaccaacctggtggccgcgggggacgatgttctggaagatcaggagatactgatgcatcatcctccccaggtggatgaacttgatcgcctaaatgcaccactctcccaaatggcaagcaatgacttccaggactag

SEQ ID NO: 44945 - DNA, 522 bp, Artificial Sequence
  Description of Artificial Sequence: Synthetic coding sequence
atggtgggctgcgccaagaagggcgagcgggagtgccacatcgtggtgttgactgacgaggactctgtcgactgggacgaggaccacccaccacctatgggagaagagtactcacagatcctgtatagtagtaagctgtatcgctttttcaaatatatcgagaatcgggatgtcgccaaaacagtcctgaaggaacgtggcctaaagaatattaggatcggcattgaagggtatccgacttgtaaggaaaaaatcaagcgaaggcccggcggcagaagtgaagtaatttataactatgtgcagcgcccgtttattcagatgtcatgggagaaagaggagggaaaaagccggcatgtggattttcagtgtgtgcgttctaaatccctcacaaatctggtagcagctggcgatgacgtactagaggatcaggagatccttatgcaccatcctccacaggtcgacgaattagaccgtctgaatgcccccctatcccaaatggcgtcaaacgacttccaagactag

SEQ ID NO: 44946 - DNA, 783 bp, Artificial Sequence
  Description of Artificial Sequence: Synthetic coding sequence
atgagcgaccccatcaccctgaacgtgggcggcaagctgtacaccacgtctctggcaacactgacgagttttcccgattccatgctgggagctatgttttctggcaagatgccaaccaaaagggattcccaaggcaattgcttcatcgatagggatggaaaggtttttcggtatattctgaacttcctacggacgagccacctcgacttgcctgaagattttcaggagatggggttactgcgccgcgaggcggatttctaccaggttcaacccctcattgaggcactgcaggaaaaggaggtggaactgagtaaagccgaaaagaacgcaatgctgaatatcactctgaaccaacgcgttcagacagtgcatttcactgtgcgagaagcaccacaaatctactcattgtcgagtagctcgatggaggttttcaatgctaacattttttcaacttcttgtctcttcctgaagctcctcggttccaagctgttctattgctctaacgggaacctctcttctatcaccagtcatttgcaagacccgaaccacttgactcttgactgggtggccaacgtcgaaggtcttcctgaggaggagtataccaaacagaacctgaaacggttgtgggtggtgccggcaaacaagcagattaactcgttccaggtctttgtggaagaagtgttaaagatagctctgtccgatggtttctgcatcgattctagtcaccctcacgcactggacttcatgaacaacaaaatcattagactcatacggtaccggtag

SEQ ID NO: 44947 - DNA, 423 bp, Artificial Sequence
  Description of Artificial Sequence: Synthetic coding sequence
atgagcgaccccatcaccctgaacgtgggcggcaagctgtacaccacaagcttggctacattgacctcttttccagattccatgttaggcgccatgttttcaggcaaaatgccaaccaaaagggacagccagggcaattgcttcatagatcgggatggcaaagtgttccggtatattcttaacttcttaaggacgtctcacctcgatctgccagaagattttcaggagatggggcttttacgtcgcgaggcagatttctatcaggtccagccactgattgaggccctccaggagaaggaagtggagctgtcaaaggccgagaaaaatgcgatgctgaacattacactgaatcagcgagtgcagacggtacattttactgttcgcgaagccccccagatatactctctgtcgtcatccagttag

SEQ ID NO: 44948 - DNA, 780 bp, Artificial Sequence
  Description of Artificial Sequence: Synthetic coding sequence
atggagcggaagatcaaccggcgggagaaggagaaggagtacgagggtaagcataatagcctcgaggataccgaccaggggaaaaactgtaaatcgaccctaatgacacttaacgtcggaggatatctctacattactcagaagcaaactctcactaagtatcccgacacttttctcgagggtatcgtaaacggcaaaatcctatgccctttcgatgccgatgggcactattttatcgacagagacgggctgctctttaggcatgtccttaatttcctgcggaacggagaactgctgttacctgagggttttcgggaaaaccaattgctcgctcaggaagccgagttcttccagcttaagggactggccgaggaggtgaagagcagatgggagaaagaacagctcactccgagagaaacaacctttctcgagataacagacaatcatgacaggtcacagggattgagaattttctgcaacgcacccgacttcatttccaagatcaagagccgaattgtgcttgtgtctaagtctaggttagatggcttccctgaagagttttcgatttcgagtaacataattcaatttaagtactttatcaaatccgaaaatgggaccaggcttgtgctgaaggaagataatactttcgtgtgtacgctagagaccctcaagtttgaagccatcatgatggccttgaaatgtgggttcagactgttgacaagcctagactgctcaaaaggatccattgtgcactcagacgctttacattttatcaaatag

SEQ ID NO: 44949 - DNA, 780 bp, Artificial Sequence
  Description of Artificial Sequence: Synthetic coding sequence
atggagcggaagatcaaccggcgggagaaggagaaggagtacgagggcaagcacaactccctcgaggatactgatcagggaaagaactgtaaatcaactttaatgacattgaacgtgggaggatacctctacattactcaaaaacagactctgacaaaatatccagatactttcctggagggaattgtcaacggaaaaattttgtgtccatttgacgctgatggtcactattttatagatagggacggactgctctttcgccacgtcctcaactttctaaggaacggagagctgctgttgccggagggattccgtgaaaaccagctgctggcccaggaggccgagttcttccaacttaagggcttagccgaagaagtgaaaagcaggtgggagaaggaacagctcaccccacgtgagaccacatttctcgagatcacagacaaccacgaccgcagtcaaggtctgaggatcttttgcaatgctccagattttatcagtaagattaagtctcgcattgtcctggtcagtaaatcaaggttggatgggtttcctgaagagttttctatatctagtaacattatccaattcaagtattttatcaagagtgagaatggtactcgattagtcctcaaggaggataacacgttcgtgtgcacactggaaacgttgaagtttgaagcaatcatgatggcgttaaaatgcggctttagactcctaacctccctggattgctctaaggggtctattgttcattctgacgcacttcattttatcaaatag

SEQ ID NO: 44950 - DNA, 705 bp, Artificial Sequence
  Description of Artificial Sequence: Synthetic coding sequence
atggccgagaaccactgcgagctgctgagccccgcccggggcggcataggtgcaggcctgggcgggggtctgtgccggcggtgtagtgcaggcttgggtgcactggcccaacgccccggatccgtgagcaagtgggtgaggctcaatgtgggcggaacctacttcctgaccacccggcaaacgctgtgtcgggaccccaagagtttcctgtacagactatgccaggctgatccggacctcgatagcgataaagacgagacaggggcttatctgattgaccgagatccaacctacttcggacccgtactgaactacttgcgccatgggaagctggtgatcaacaaggatctggccgaggaaggagtgcttgaagaggcagagttttataatatcacatctttgatcaaactggtcaaggacaagatcagagaaagagatagcaagaccagccaagtccccgtcaagcacgtgtaccgagtcttgcagtgccaggaggaagagttaacccagatggtgagcaccatgtctgatggatggaagttcgagcagcttgtctccattgggtcttcttataattatggtaatgaggaccaggctgagtttctctgtgtggtttccaaggagttgcataataccccatatggtactgcatccgagcccagcgaaaaggccaaaattctccaggaacggggatctcggatgtag

SEQ ID NO: 44951 - DNA, 714 bp, Artificial Sequence
  Description of Artificial Sequence: Synthetic coding sequence
atggacaacggcgactggggctacatgatgaccgaccccgtgaccctcaatgttggtggccacctttacacaaccagcttgacaaccctgactaggtacccagactccatgttaggcgccatgttcggtggggatttccctactgccagagatccacagggcaattactttatcgacagggacggtcccttgtttcggtacgtgctaaacttccttaggacttcagaactcacactccccctggactttaaagaattcgacttgttacgtaaagaagccgacttttaccagatcgaacccttaatccagtgcctcaatgaccctaaaccgctgtatcctatggacacgttcgaggaggtggttgagctgagttctacaagaaaactgtctaagtattccaatccggtcgctgtcatcatcacccagctgacaattacgacgaaggtgcactcactattagagggtatctctaattacttcacaaaatggaataagcacatgatggacacgcgggactgccaagtgtctttcacctttggcccatgtgattaccaccaggaggtcagccttcgggtgcaccttatggagtatataaccaaacagggatttacaatcaggaatacgagggttcatcacatgagcgaacgcgctaatgagaacacagtcgagcataactggaccttttgccggttggcccggaagaccgatgactag

SEQ ID NO: 44952 - DNA, 714 bp, Artificial Sequence
  Description of Artificial Sequence: Synthetic coding sequence
atggacaacggcgactggggctacatgatgaccgaccccgtgaccctcaacgtgggtgggcatctgtacactactagcctcactacactgactcgctatcctgacagcatgctgggggcaatgttcggcggggactttcccaccgctcgtgatcctcagggaaactacttcattgatcgagatggcccacttttccggtatgtgctcaacttcttgcggacatccgagctgacattgccattggattttaaagagttcgacctcctgcgaaaggaagccgatttctaccagatcgagccactaattcagtgcttgaacgaccccaagcccctctaccccatggatacctttgaggaagttgtggagctgagtagtacacgtaaactgagcaaatatagtaatccggtggccgtcatcatcacccagttgactattacaactaaagttcatagcttgctggaaggaatttctaactacttcactaagtggaacaaacacatgatggatacccgagactgtcaggtgagctttactttcggtccctgtgactatcatcaggaagtgagccttcgggtgcacctgatggagtacattactaagcagggatttactatccgaaataccagagtgcaccacatgagcgagcgtgcaaacgagaacaccgtggagcacaactggaccttttgccggctggcaaggaaaacggatgactag

SEQ ID NO: 44953 - DNA, 30 bp, Artificial Sequence; identical to SEQ ID NO: 20989
  Description of Artificial Sequence: Synthetic coding sequence

SEQ ID NO: 44954 - DNA, 714 bp, Artificial Sequence
  Description of Artificial Sequence: Synthetic coding sequence
atggacaacggcgactggggctacatgatgaccgaccccgtgaccctgaacgtgggtggccacctgtacactacgtccttgaccaccctaacccggtatcccgattcgatgctgggcgccatgttcggcggcgacttccctactgctagggacccacagggcaattacttcatcgatcgtgacggtccactgttccggtatgttctcaacttcctgagaacctccgaattgactctgccacttgatttcaaggagtttgacctgctgcggaaagaagccgacttctaccaaatagagcccttaatccagtgcttaaacgaccccaaaccattatatcccatggatactttcgaagaagtcgttgagctgtcatcaaccaggaaactgagcaagtatagcaatcccgtcgcggttatcatcacacagctgaccatcacaacaaaggtgcactcgttattggaagggatttccaattactttacaaaatggaataagcacatgatggacactagggactgtcaggtcagtttcacattcgggccatgtgattatcaccaggaggtgtcattgagggtgcatctgatggagtatattactaaacagggcttcacgatccgaaatactcgcgtgcaccatatgtcagaaagagcgaatgagaacaccgtcgagcacaactggacattctgcagattggcccgcaaaaccgacgattag

SEQ ID NO: 44955 - DNA, 1422 bp, Artificial Sequence
  Description of Artificial Sequence: Synthetic coding sequence
atggccctgaaggacaccggcagcggcggcagcaccatcctgcccatttccgaaatggtttcttctagcagcagccccggagcctccgcagccgcagcccctggaccttgtgccccgagccctttcccagaggtagtggagctcaacgttgggggccaggtgtatgtcacaaagcattccactctcctaagcgtgcctgatagcacgctagctagcatgtttagtccttcatcaccacgcggcggcgctagacgtcggggcgaactgcccagggattctcgtgcacggttttttatcgatagggatggattcctgttcaggtatgtcctggactatctgcgggacaagcagctcgccctaccagaacatttccccgaaaaagagcggctccttagagaggcagaatacttccagcttaccgacctagtcaaactcttgagtcctaaagtgacaaaacaaaactctctcaatgacgaaggatgccaatctgaccttgaggacaacgtgagtcaaggctcgtctgacgctctcctgttgcgtggggctgcagccgccgtgccaagcggaccaggagcacacgggggaggcggtggtggcggcgctcaggacaagaggtctggctttctgactctcggttatcgagggtcctacaccaccgtgagggataaccaagccgatgccaaattccgacgtgtggcacgaattatggtgtgcgggcggatagccctggccaaggaggtgtttggagataccctgaacgaatccagggatccggaccgccagccagagaagtacacctctagattttatctaaagttcacttacttggagcaggcttttgaccgactctccgaagctggctttcacatggtggcctgcaattcttcgggaaccgcggcctttgtaaaccagtatcgggatgataagatttggtcgtcttatacagagtatatttttttccgcccgccacagaaaattgtaagccccaagcaggagcacgaggatagaaaacacgacaaggtcactgataagggatccgaatcaggtacctcttgcaatgaactaagcacatcctcctgtgattcccactctgaggccagtacacctcaggataatccgtcttccgcacagcaggcaaccgcccaccagccaaatacactgactttagataggccctcaaagaaagctcctgtgcagtggatcccaccaccggataagagaagaaatagtgagctgtttcagacactgatttcaaagagtagagagacaaatttgtcaaaaaagaaagtttgcgagaaactttctgtcgaggaggagatgaaaaaatgcatacaagatttcaagaaaattcacatacccgactactttcccgaacggaaaaggcagtggcagtcagagctcctgcagaaatacggtctttag

SEQ ID NO: 44956 - DNA, 2751 bp, Artificial Sequence
  Description of Artificial Sequence: Synthetic coding sequence
atgagctacaccctggacagcctgggcaaccccagcgcctaccggagggtgacagagaccaggagtagcttctcccgcgtctctggttcaccttcaagcggattccgatcgcaatcatggagtcgcggttccccttctactgtgtcgtcgtcttacaagagatcaatgctagccccccgtctggcctacagcagcgcaatgctgtcaagcgccgaaagctcgctcgacttttcgcagtcgtcctctcttctcaatgggggcagtggcccaggaggggactataagttgagtcgttccaatgaaaaagagcagctgcagggcctgaatgacaggttcgctggttacatcgagaaggtgcattatctggagcaacagaacaaagaaatagaggcggagattcaggctcttagacagaaacaggccagtcacgcccagcttggagatgcatatgatcaggaaattagagaacttcgggccaccctggaaatggtgaaccacgagaaagcccaggtacagcttgactcagaccaccttgaggaagatatacatcggctgaaggagagatttgaagaggaggcgcggctgcgcgacgacactgaagcagctatccgggccctgagaaaggatatcgaggaggctagccttgtgaaggttgagctcgataaaaaggtccagagtctgcaggatgaagtcgcctttctgcggtcgaaccacgaagaggaggtggcagacctgctggctcagatacaggctagtcacataacagttgagagaaaggactacctcaaaaccgatatctcgacggccctgaaggagatccggagccaactggagagtcacagtgaccagaacatgcaccaggcagaagaatggtttaaatgcaggtacgccaaactgaccgaagccgctgagcagaataaagaagctatcagatccgcaaaagaggaaatcgccgaatatagacgacagctacaatccaagtccatcgagctcgaatcagtgcggggtaccaaggaaagtctggaaaggcagcttagcgatatagaggaacgccacaatcacgatctttcctcctatcaggatacaatacagcaacttgaaaatgagcttagaggaaccaaatgggaaatggcaaggcacctcagagaatatcaggatctgctgaacgtaaagatggctctggatatcgagatagcggcttataggaaactccttgagggcgaagagaccaggttcagtacatttgcgggaagcatcaccggccccctgtatacacatcgcccccctattacgatttcgtctaagatacaaaaaccgaaggtggaggcccccaagctgaaagtccagcacaaatttgttgaggagataatcgaggagaccaaggtagaagatgagaaatctgagatggaggaggccttaactgcaattacggaggagctcgccgtatcaatgaaggaagagaaaaaggaggcagctgaagagaaggaggaagagcctgaggccgaggaggaggaggtagctgccaagaaatcaccggtaaaggctaccgctcctgaagttaaggaggaagaaggagagaaagaggaggaggagggacaggaagaagaggaagaggaggatgaaggagccaaaagtgatcaggctgaagagggtggatccgaaaaggagggtagctccgagaaggaggaaggtgaacaggaagagggtgagacagaggcagaggccgaaggtgaggaggcggaggccaaggaggagaagaaagttgaggagaagagcgaggaagttgcaacaaaggaggagctggttgccgacgccaaagtcgaaaagcctgaaaaagctaaatcccctgtgcccaaatcaccagttgaagagaaggggaagtcccccgtaccaaaaagtcccgtggaagaaaaaggtaagtcccccgtaccaaaatcccctgtcgaggaaaaaggcaagagccccgtgccaaaatcccccgtggaagagaagggtaagtccccagtatcaaagtcaccggttgaggaaaaggccaagtccccagtgccgaagtcacccgtggaggaagccaaatctaaagctgaagtgggtaagggagaacagaaagaggaggaggagaaagaagtgaaagaagcaccgaaggaagaaaaagtcgaaaagaaagaggagaagccaaaagacgtgcctgagaagaagaaggcagagtctccggttaaggaggaagccgttgccgaagtggtgacgatcacaaagtccgtgaaagtgcatctggagaaagagactaaagaagaagggaaaccgctgcaacaggagaaagaaaaggagaaggccggcggggaaggtggatcagaagaggagggaagtgataaaggggccaagggtagcaggaaggaagatatagcagttaacggcgaggttgaaggaaaggaagaagtggagcaggagacgaaggagaagggaagtgggcgggaggaggaaaaaggcgtggtgacaaatggactagatctgagtcctgctgatgagaaaaagggcggagataaaagcgaggagaaggtcgtggtgacaaagaccgtcgaaaagattacgtcagagggaggggatggggccaccaaatacataaccaaatcggtgaccgtgactcaaaaggtcgaggaacatgaagaaacctttgaggagaaactagtatcaacaaagaaggttgagaaggttacgtcgcacgcgattgtcaaagaggttacccagtcggactag

SEQ ID NO: 44957 - DNA, 1932 bp, Artificial Sequence
  Description of Artificial Sequence: Synthetic coding sequence
atggaggccgtggagaccggcgagcggcccaccttcggcgcctgggattatggcgtgttcgcccttatgcttctcgtctcaacaggcattgggctgtgggtgggacttgcgcgtggagggcagagatccgctgaggatttcttcaccggcggacggcgtcttgccgcactgcctgttggcctgagcctcagcgccagttttatgtctgctgttcaggtgctgggagtgccatctgaagcatacagatatggcttgaaatttctgtggatgtgtctggggcagttgctgaatagcgtgctgacagcactgctgtttatgcccgtcttttataggctgggcctaaccagcacatatgaatacctagaaatgagattctctagggctgtcaggctgtgcggaaccctgcaatacatcgtcgccacgatgctatacacaggcattgtcatatacgccccggccctgatcctcaatcaggtgacaggactggatatctgggcctccctcttgagtaccggcattatctgtaccttttatacagctgtcggaggaatgaaagctgtcgtttggacagatgtgtttcaagtggtggtgatgttgagtggtttctgggtcgtcttagcacgtggcgtcatgctagtaggtgggcccaggcaggtattgactctggcacagaaccattccagaatcaacctcatggacttcaacccggaccccagaagcaggtacacattctggacgttcgtggtgggcggaacgctggtttggctgtcaatgtacggcgtgaaccaggcccaagtgcaacgctacgttgcctgtagaaccgagaaacaggcaaagctggcactgctaatcaatcaagttggcctctttttaatcgtgtcatcagctgcctgttgtggcatcgtgatgttcgttttctatactgattgcgatccattgctgctgggcagaattagcgcacccgaccagtatatgcccctccttgtgctggacatattcgaagatcttcctggtgtgccgggcttattcctggcctgcgcttacagtggaactctcagcacagcatcaacttctattaacgccatggccgccgtgactgtggaggacctgatcaagccgcgcctcaggtcccttgccccacggaaactggtgattatatccaaaggtcttagccttatctacggctctgcctgtctgacggtggctgccctgtcatccctgttgggagggggagtgttgcagggttcattcactgtcatgggcgtgatctcaggcccacttctgggagcttttatactgggcatgtttctgccagcctgcaacacaccaggcgtgttagcaggcttgggcgccggcctggctctcagtctttgggtggccctgggggccacgttgtacccgccgtccgagcaaacaatgcgtgtcctgccttccagcgctgccagatgcgtcgccctcagtgtgaacgctagcggtctgctggaccctgccctcctgccagccaacgattcctcaagagcacctagctccggaatggacgcaagccggcccgctctcgcagactcgttctacgctatctcctacttatactatggggcattgggcactttgacgaccgtcctgtgtggagcattaatctcttgcctcactggacccactaagaggtccacattggctccaggactgttatggtgggatctggctaggcagacggccagcgtcgctcctaaggaggaggtggcaatccttgacgacaacctggtaaagggcccggaagagctgcctaccggtaacaaaaagccccctggctttctcccaaccaacgaggatagactgttcttcctcggtcagaaagagctagagggggccggctcttggacaccttgtgtggggcacgacggcgggagagaccagcaggaaacgaacctgtag

SEQ ID NO: 44958 - DNA, 1230 bp, Artificial Sequence
  Description of Artificial Sequence: Synthetic coding sequence
atgaacagccacagctacaacggcagcgtgggccggcccctgggctctggacccggcgcacttggtcgagacccgcccgacccagaagctggtcaccctcctcagccccctcactccccagggctgcaggtcgtcgtggccaaatccgagcccgcccgtccaagcccagggagtcccagaggtcaacctcaggatcaggacgacgatgaggacgatgaagaggacgaggctgggaggcagcgggccagtgggaagccttctaatgtggggcatcggttaggccaccgccgtgcactgttcgaaaagaggaaaagactttctgactacgccctgatatttggtatgtttgggattgtggtgatggtaaccgaaaccgagctttcttggggcgtgtacaccaaggagagtctgtacagtttcgcactgaagtgcctgatttccctcagtacagcaattctgttgggcctggtcgtgctgtatcatgcgagggagatacagctatttatggtagacaacggtgctgacgactggaggattgcaatgacctgtgagcgagtctttttaatctctctcgagttggccgtgtgcgctatacaccccgtcccaggtcactacaggtttacttggactgctcggctggcctttacctacgctcccagcgtggccgaagcagacgttgatgtattgctgtcaatcccgatgttcctcaggctgtatttgctggggcgggtgatgctgcttcactcaaaaattttcactgatgccagttcccggagtattggcgcactgaataagattacctttaatacccgatttgtgatgaaaacactgatgaccatatgtcccggtaccgtgttgttggtcttcagcatatcaagttggatcatagccgcttggactgtgcgagtctgcgagagatatcacgataagcaggaggtgactagcaacttcctgggcgccatgtggctaatctccatcacatttctgtcgattgggtacggagacatggtccctcacacttattgcggaaaaggcgtttgcctgttaaccggcattatgggggccggctgcactgcgctggtcgtcgccgtggtggctcgaaagctggaactgaccaaggcagagaaacatgtgcacaattttatgatggatactcagctcaccaaaagagtcaaaaacgccgcagccaacgttctgcgcgaaacttggctgatctgtaagatgggctag

SEQ ID NO: 44959 - DNA, 1311 bp, Artificial Sequence
  Description of Artificial Sequence: Synthetic coding sequence
atgggcctggcccgggccctgcggcggctgagcggcgccctggactcaggcgacagcagggcaggggatgaggaagaggctggacccggactgtgcagaaatggatgggcccctgcccctgtccagtcgccagttggaagaaggcgtggtcggttcgtcaaaaaggatggacattgcaatgtgcgcttcgtgaatttgggcggacagggagcaaggtatctgagtgatctcttcacgacatgcgttgacgtgcggtggcggtggatgtgtctcctgttctcctgtagcttcctcgcgtcttggctgctctttggccttgcgttctggctgattgctagtttgcacggtgatctggccgcaccccctccacctgctccatgcttctcgcacgtggcttcatttctggctgcctttctcttcgccctggaaacacaaacctccatcgggtacggcgtcaggtcagtgactgaagagtgccccgcagccgtggctgccgttgtattacagtgtatcgcagggtgcgtattagacgctttcgtcgttggggcggtgatggccaagatggctaaaccgaaaaaacgaaacgaaacactggtattttcggaaaatgccgttgtcgcacttagggaccatcgcctgtgtctgatgtggagagtgggtaatttacgtcgcagtcatttggtcgaagctcatgtgagagctcagctgctccagcctcgtgtgacgcccgagggcgaatacattccattagatcatcaggatgtggatgtgggttttgatggcgggacggatcgtattttcctggtctctccgattacaattgtgcatgaaatcgattcagctagccctctgtacgaactaggcagggccgaactagcccgagctgatttcgagctggtggtgatccttgaaggcatggtggaggccactgctatgactacccagtgccgctcatcctatctgcctggcgagcttctctggggccacaggttcgagcccgtgctgttccagcgggggagtcaatatgaagtcgactatcggcattttcaccgcacctatgaggtgccgggcacgccagtgtgcagtgctaaagaactggacgagagggctgagcaggctagccattccctgaagagctccttccctggctctttaacagctttttgttacgagaatgagctcgcgctgtcctgctgccaggaggaggacgaggatgacgagacagaagaaggtaatggcgtcgaaacggaagatggggccgcatcccccagagtgctcactccgacactagctttaacgctccctccttag

SEQ ID NO: 44960 - DNA, 1311 bp, Artificial Sequence
  Description of Artificial Sequence: Synthetic coding sequence
atgggcctggcccgggccctgcggcggctgagcggcgccctggacagtggagatagccgcgccggcgacgaggaggaagcgggaccgggcttatgcaggaatgggtgggcaccggctccggtgcagtctccagtggggcggcgccgcggccgctttgtaaagaaggatggccattgcaatgtgcgcttcgtgaaccttggggggcaaggagctagatacctgagcgatctgttcaccacctgcgtggacgtgcggtggaggtggatgtgtttgttgttcagctgcagcttcttggcttcctggttgctattcggactagcattctggctgattgcttcactccacggagatctggccgcacccccacctcccgccccttgttttagccacgttgcttcctttcttgcagcattcctgttcgcactcgagacacagacctctatcggctatggggtccgttcagtgactgaggagtgtcccgctgccgtggcagcggtggtattgcagtgtatagcaggttgcgtcctagatgctttcgtcgtgggcgccgtaatggccaagatggcaaaacccaagaaaagaaacgagacactggtctttagtgagaacgcagtggttgccctccgggaccatcggctctgtctcatgtggcgggtcggaaacctgaggaggtcccaccttgtggaagctcatgtgcgggcccagctgctgcagccacgcgtcacgcccgagggggagtacatcccgcttgaccaccaggacgtcgacgtcggattcgacgggggcaccgaccggatttttttggtgagcccaataacaattgtgcacgaaatagattctgcatcacctctgtatgagctcggacgagccgagctggcccgcgctgattttgagctagtggtcatcctcgagggcatggtcgaggctactgccatgaccacccagtgtcgaagctcatacctccctggtgagctgctgtgggggcaccggttcgaacccgtgctgtttcagcgagggtctcaatacgaggtcgattatcggcattttcaccggacttatgaagtcccgggcacacctgtgtgttcagcaaaagaactggacgagcgagcagagcaggcctctcatagcttgaaaagcagtttccccgggtccctgaccgcattctgttacgaaaacgagctggctttgtcctgctgccaggaagaggatgaggatgacgaaaccgaggaaggaaacggcgtggaaacagaggatggggctgccagccctcgcgttctgactcccaccctggcccttacgctgccaccttag

SEQ ID NO: 44961 - DNA, 1182 bp, Artificial Sequence
  Description of Artificial Sequence: Synthetic coding sequence
atggcccaggagaacgccgccttcagccccggccaggaggagcccccgcgtcgtcgcggcagacaaaggtatgtcgagaaggatgggcgatgcaacgtgcagcaagggaatgtccgcgaaacgtacagatacctgaccgatctgtttaccacattggtagatcttcagtggaggctgtctctgctcttttttgtacttgcatacgctttgacttggctcttctttggtgctatatggtggctcatcgcctatggcaggggtgacttggaacaccttgaggacacggcgtggacaccgtgtgttaacaatctgaatgggttcgtggctgcctttctgttttcgatcgagacggaaacgactatcggctatggacaccgcgtgattactgaccagtgcccggaggggattgtgctcttgctgttacaggctattctgggatctatggttaacgcattcatggtgggatgcatgttcgtgaaaattagtcagcctaacaagcgagctgcaacattggtctttagtagtcatgctgtcgtctccctccgcgatggccgactgtgcctgatgttccgggtgggggatctgcgctcctcccatatcgtagaagccagtatcagagccaagctgatcaggtccagacagaccttggaaggtgaattcatacctttgcatcagactgatctctcagtcggcttcgacacaggagatgatagactgttcttagtgagcccactggtgatcagccacgaaatagatgcagcatcccccttctgggaggccagccgccgggccctcgagcgcgatgattttgagattgtggtgatccttgaggggatggttgaagcgacagggatgacctgccaggccagaagctcctatctcgtggacgaagtgctgtgggggcatcggttcacaagtgtgctgaccctggaggacggcttttatgaagtggactatgcctcatttcatgagaccttcgaggtgcccaccccaagttgctccgctcgcgaactggctgaggctgccgctcggctggacgcacatctgtactggtccatcccatctaggctcgacgagaaggttgaagaagagggtgcaggagagggcgcagggggggaggctggcgctgataaggagcaaaacggatgtcttcctccccccgagagtgagtcaaaagtgtag

SEQ ID NO: 44962 - DNA, 708 bp, Artificial Sequence
  Description of Artificial Sequence: Synthetic coding sequence
atgttcatctggaccagcggccggaccagcagcagctaccggcacgacgagaagcgcaacatttatcagaaaattcgcgatcatgatctgttggacaagcggaaaaccgttacagccctcaaggccggggaggatcgggccatattgttgggcttggctatgatggtctgtagtatcatgatgtactttttactcgggatcaccctcctgcggtcttacatgcaaagcgtctggactgaggaaagtcaatgcactcttctcaacgcttctatcacggaaacctttaattgcagtttttcttgcgggcccgactgctggaagttgagccagtatccctgcctccaggtgtatgtgaacctcacgtcctctggggaaaaacttctgctgtatcataccgaggagacaataaaaataaatcagaagtgtagctatattcctaaatgtggaaagaattttgaggagtcaatgtctcttgttaatgtggtaatggagaacttccggaagtatcagcacttctcatgctacagcgaccctgagggcaaccaaaaatctgtcattctgaccaagctctactcatcgaatgttcttttccattctctgttttggccaacatgcatgatggctgggggggtagcaatcgttgccatggttaagctcacacaatatctgtcgctgctttgtgaacgcattcaaaggatcaatcgatag

SEQ ID NO: 44963 - DNA, 708 bp, Artificial Sequence
  Description of Artificial Sequence: Synthetic coding sequence
atgttcatctggaccagcggccggaccagcagcagctaccggcacgatgaaaaaaggaacatttaccagaaaataagggaccatgacttactcgataagcgcaaaaccgtaaccgccctgaaggccggggaagatagagccattttgctcggactggccatgatggtgtgctcaattatgatgtactttctcctcggaatcaccctcctccgtagctatatgcagagcgtctggacagaagagtctcagtgtactctactcaacgcttctatcacagagacttttaattgctcattttcttgcgggccagattgctggaagttgtctcagtacccctgtctgcaggtgtacgtgaatcttaccagcagcggagagaagcttcttctttatcacaccgaggagactatcaaaatcaaccagaagtgcagctatattccaaaatgcggcaagaacttcgaagaatccatgagtctcgtcaatgtagtaatggagaatttccggaagtatcagcatttttcttgttactctgatccggaagggaatcagaaaagtgtcattttaactaagctgtactcttccaacgtgttgttccacagtcttttttggcccacatgcatgatggccggtggagtcgcaatcgtcgcaatggtgaaacttacgcagtatttgagtctcttgtgcgagaggatccagcgtattaatcgctag

SEQ ID NO: 44964 - DNA, 708 bp, Artificial Sequence
  Description of Artificial Sequence: Synthetic coding sequence
atgttcatctggaccagcggccggaccagcagcagctaccggcacgatgagaaaaggaacatttatcagaagattagagatcacgacctgctcgataaaaggaaaaccgtgactgccctcaaagctggtgaagatagggccatcttgttaggcctggccatgatggtttgctcaattatgatgtactttcttctgggaatcaccctgctacgcagttacatgcaatccgtctggacggaagaatcccagtgcactctgctcaatgcctccatcactgaaacctttaattgttcctttagttgtggtcctgattgttggaaacttagtcagtatccatgcctgcaagtgtatgtaaacctaacctcttccggcgaaaagctgcttctgtatcatacagaggagaccattaaaattaaccagaagtgctcctatatacctaaatgcgggaagaacttcgaagaaagtatgtcactagtaaacgtggtgatggaaaatttcagaaagtaccaacacttctcatgttactcagaccccgaaggtaatcagaagtccgtcatcctgaccaagctatactcctctaacgtgctgtttcatagtcttttctggcctacctgtatgatggctgggggagttgcaatagtggccatggtaaagctaacccagtacctgagcctgctttgtgagcggattcagcgcatcaatcgctag

SEQ ID NO: 44965 - DNA, 414 bp, Artificial Sequence
  Description of Artificial Sequence: Synthetic coding sequence
atgttcatctggaccagcggccggaccagcagcagctaccggcacgacgaaaagaggaacatttatcagaagataagagaccacgacttacttgataaacggaagacagtgacagccctgaaggcgggagaggatcgcgccattctactcggactcgccatgatggtatgcagcatcatgatgtactttctgttgggcatcaccctcttaagaagttatatgcaaagcgtgtggactgaggagtcacagtgcacattattaaatgcaagtatcactgagacatttaactgctctttttcatgcggccccgattgctggaaactctcccaatacccctgcttgcaggtttatgtgaacctcacatcctctggagaaaaactattgctttaccacaccgaggaaaccatcaagtag

SEQ ID NO: 44966 - DNA, 708 bp, Artificial Sequence
  Description of Artificial Sequence: Synthetic coding sequence
atgttcatctggaccagcggccggaccagcagcagctaccggcacgacgagaagagaaatatttatcagaaaattcgagaccacgacttgttggataagagaaaaacggttaccgccttaaaagctggagaggaccgcgccatactcctgggcttagcaatgatggtctgttctataatgatgtattttctgctgggcatcactttgctccgctcttatatgcagagcgtctggaccgaagagagtcagtgcaccctgcttaacgcaagcatcaccgagaccttcaactgttcattttcctgtggacctgattgctggaaactgtctcagtacccctgtcttcaggtttatgtcaatctgacgagctccggcgagaagctcctcctctatcatacggaagagaccattaaaatcaaccagaagtgttcctatatccccaagtgcggtaaaaatttcgaagaatcaatgtctctcgtgaacgttgttatggaaaactttcgcaaataccagcacttcagctgttattcagatcctgagggtaatcaaaagtccgtgatcctgaccaagctttatagttccaatgtgcttttccatagtttgttttggccaacttgcatgatggcgggcggggtggctatcgtcgcgatggtgaagctcactcagtatctgagcctcctctgcgagaggattcagagaatcaacaggtag

SEQ ID NO: 44967 - DNA, 303 bp, Artificial Sequence
  Description of Artificial Sequence: Synthetic coding sequence
atgttcatctggaccagcggccggaccagcagcagctaccggcacgatgagaaaaggaatatctatcagaagatccgggatcatgatttgctggataagcgcaagaccgtgactgccctaaaggctggagaggatcgagcaatcttattaggactggccatgatggtgtgcagtataatgatgtacttcctcctggggattaccctgctgaggtcgtatatgcagagcgtctggaccgaggagagccaatgcaccctgctgaatgccagcatcacagagacttttaattgttctttttcttag

SEQ ID NO: 44968 - DNA, 651 bp, Artificial Sequence
  Description of Artificial Sequence: Synthetic coding sequence
atgttcatctggaccagcggccggaccagcagcagctaccggcacgatgagaagcgtaatatttaccagaaaatccgagaccatgatctgttgggactcgcgatgatggtatgctccatcatgatgtattttcttctcgggattactctgctgagatcttatatgcagagcgtctggactgaggagagccagtgcactctgttaaacgcctcaataaccgaaacgttcaactgcagcttttcatgcggaccagattgctggaaactgtctcagtatccctgtctgcaggtctacgtgaatttgacttcgtccggcgagaagctcctgctgtaccatactgaagagacgatcaagatcaaccagaaatgcagctacatccctaagtgcggaaagaatttcgaagaaagtatgtcactcgttaatgtggtgatggagaatttccgtaaatatcagcactttagctgttactcggaccctgagggtaatcaaaagtctgttatcctcactaaactctacagctccaatgtgctcttccactctctgttctggcctacttgtatgatggccggaggtgttgctatcgtcgccatggtaaaactcacccagtacctgtccttgctctgtgagcgcattcagcgcatcaatcgatag

SEQ ID NO: 44969 - DNA, 2718 bp, Artificial Sequence
  Description of Artificial Sequence: Synthetic coding sequence
atgcccgtgcggcggggccacgtggccccccagaacacctacctggatactattatcagaaagtttgaaggtcaatctaggaagttcttaattgcgaacgcacagatggaaaattgcgccatcatatattgtaacgacggcttttgcgaactgtttggatactcaagggtggaagttatgcaacagccatgcacttgtgacttcttaactgggcccaacacaccaagctctgccgtgtctcgtctcgcccaggccttactgggcgcagaggagtgcaaggttgacatcttgtactatcgaaaagatgctagtagctttcgttgtctggtggacgtagtgcctgtgaaaaacgaggacggggctgttattatgttcattcttaatttcgaggacctggcacagctgcttgccaaatgtagttctagatctctgagccagcgactccttagccagtcctttctgggaagcgagggcagtcatggccggcccggcggccccggccctgggaccggacgtggtaagtacagaaccatatctcagatcccacagttcactctgaactttgtcgagttcaacttagaaaagcaccggtcatcatccaccaccgagatcgagatcatcgccccacacaaggtggtggaaagaacacaaaacgttacagaaaaggtgacccaggtcctttctctgggcgccgacgtcctgcctgaatataagctccaggctcctaggattcacaggtggacaattctgcactactcaccattcaaggccgtgtgggattggctcattctactccttgtgatatacaccgccgtgtttacaccttatagtgccgcctttctgctctccgaccaggacgaatctaggaggggtgcttgtagctacacctgcagcccccttacagtcgtggatcttattgtggatatcatgttcgtcgtcgatattgtgatcaacttcagaactacatatgtcaacactaacgatgaagtggtatcacacccaagaagaatcgcagtgcactatttcaagggatggttcctgattgacatggtcgccgccattcccttcgacctcctgatctttaggaccggaagcgacgagacaaccactctgataggactgttaaagaccgctcgactcctgcggctagtgcgcgttgctcgaaagctggatcgttattccgaatacggagcagccgtcctctttttacttatgtgtaccttcgccctgatcgcccactggcttgcctgcatttgttcacttaccagcgtgggctttggaaatgtgtcacccaatactaattctgagaaggtattcagcatttgcgtcatgcttattggctcgttgatgtacgcgtctatctttggcaacgtatctgctatcattcagaggctgtacagcggtactgctaggtaccacacccagatgttacgagtaaaggagttcattcggtttcaccagattccaaacccccttaggcagaggctggaagagtacttccagcatgcctggtcctatacaaatggcatcgatatgaatgctgtgctgaagggatttcctgagtgtttacaggcggatatttgccttcatttgcatcgcgcactgcttcagcattgcccggccttttccggagccggcaagggatgcctgcgagccctggcagtgaagttcaaaaccactcatgcaccccctggggatactctcgtccacttaggtgatgtgctctctaccctgtacttcatttctcgagggagcatcgaaatcctgcgagatgacgtcgtagtcgcaatcttgggaaagaacgacatcttcggggagcccgttagcttgcatgctcagccggggaagtcatccgcagacgtgagggcactgacttactgcgatctgcataagatccaacgcgccgatcttctggaggtccttgatatgtaccccgcatttgccgagagtttctggtccaaactggaggtgaccttcaatttacgcgacgctgctggaggactgcactccagtccacgtcaagctcccggctcccaggatcaccagggattttttctgagcgacaatcaatctgacgccgccccgcctctatccatcagtgacgcgagtgggctctggcccgaactgctccaggagatgccaccccggcacagcccacagtcaccccaggaggacccagactgttggcccctcaagcttggcagtaggttggagcagctgcaggctcagatgaatagactagaatctcgggtgtcgtcagatctatccagaattttgcaactactccagaagccgatgccgcaagggcacgcctcctacatcttggaggctcccgcttcaaatgacttggcccttgtgccgatcgcaagcgaaactaccagtcccggcccgagactccctcaagggtttctgcctcccgcacaaacacctagctatggagacctcgatgactgctctccaaagcatagaaactcatccccccgcatgccacatctggccgtagccaccgacaaaacacttgccccctcgtccgaacaagagcaaccagaaggcctctggccccctttggcttctccacttcaccccctcgaagtgcaaggattaatttgtgggccttgcttttcaagcctccccgagcacttgggctccgtacccaaacaactggactttcagcgccatgggtctgacccggggtttgccggctcgtggggccattag

SEQ ID NO: 44970 - DNA, 2985 bp, Artificial Sequence
  Description of Artificial Sequence: Synthetic coding sequence
atgcccgtgcggcggggccacgtggccccccagaacacctacctggatactattattcgtaagtttgagggtcaatctcgaaaattcctgatcgccaatgcacagatggagaattgcgctatcatttactgtaatgacgggttctgcgagttgttcggctacagtagagtggaggtgatgcagcagccttgcacgtgcgatttcctgactggaccgaatactccctctagcgcggtgtcccgactagcgcaggccctcctgggggctgaggagtgtaaagttgacattctgtattaccggaaggacgcctcctctttcagatgcctcgtggacgtggtgcccgttaaaaacgaagacggagctgtcatcatgttcattctgaacttcgaggatttagcccagctgctggcaaagtgtagctctcgctccttgtctcagaggctgttgagccagtcatttttggggtcggagggctctcacgggaggcctggtggtcctggcccaggaacgggtcggggcaaatatcggacaatttcgcagatccctcaattcacactgaactttgttgaatttaatctggaaaaacaccggtcttcttccacgactgagatcgaaattattgctccacacaaggttgtggaaagaacacaaaatgttaccgagaaggtcacccaggtgctgagtctgggagccgacgtcctgcccgagtacaaactccaggccccgcgcatccatcgttggaccattttgcattactccccttttaaagccgtatgggactggttgatcctgttgcttgtgatctataccgcagtttttaccccatattctgccgctttcctgctgagcgaccaggacgagagtcgccgcggtgcttgcagctacacatgtagtcccctgactgtcgtggacctcatagtggacattatgttcgtggtggatatcgtgatcaactttaggaccacttacgtgaatactaatgatgaggttgtgtcacacccccgaagaattgcggtgcactatttcaaaggctggtttctcatcgatatggttgcagccatcccgttcgaccttctgatttttcgtacagggtccgacgagacaacgactctgataggattgctgaagaccgcacggttgctgcgactcgttagagttgctagaaaattagatcgctacagcgagtatggtgccgctgtgctgtttctgctcatgtgtacatttgcgctgatcgcacactggttggcatgtatctggtatgccatcggcaatgtcgagagaccttacctggaacacaaaatcggctggctggactccttgggggtgcagctgggtaaacgctacaacgggtctgaccctgcttctgggcctagtgtccaggacaagtatgtcaccgccctgtatttcactttcagttctttgaccagcgtgggctttggtaatgtaagccccaatactaactctgagaaggtgtttagtatctgcgtcatgctcattggtagtctcatgtacgcgtctatctttggtaatgtgagcgcaatcatacagagactctacagcggaactgctcggtatcatacccagatgcttagggtaaaagaatttattcggttccatcagatccccaacccactcaggcagcgcctggaagagtactttcagcatgcctggagctacacaaacggcatcgacatgaacgccgtgctcaaaggatttcccgagtgcttgcaggctgacatctgtcttcacttgcaccgggcattactgcagcactgtccagcgttctctggtgccgggaaaggatgcctgcgcgccttagcagttaagttcaagaccacgcacgccccaccaggtgacaccctcgtgcatctgggcgatgtgctcagtacgttatactttattagtcgaggctcaattgagattctgcgggacgacgtggttgtagctatcctgggcaaaaacgacattttcggtgaacccgtgtcacttcatgcacagccaggaaagtcttctgccgatgtcagggccctcacatattgcgacttgcataagattcagagagctgacttgttggaagtgctcgatatgtacccagcttttgcagagtcattttggagtaagcttgaagtgacatttaatttgagggatgctgccggggggctacacagctcccctcgccaggcaccaggctcccaggatcaccaggggtttttcctgtccgataaccagagcgggagcccacacgagctgggaccccagttcccaagcaaggggtacagcctgctggggcctgggagtcagaactctatgggagccgggccgtgcgctcctggtcacccagatgccgcccccccactcagcatctctgacgcatcgggtctgtggcccgagctgctccaagaaatgcccccgcgccactctccacagtccccgcaggaagaccctgattgctggcctctgaaattgggaagtaggttggagcaacttcaggcccagatgaaccgtcttgaatctcgtgtctcatcagacttgtcccgtattctccagttgctgcagaaaccaatgccacagggtcacgccagttacatcttagaggctcctgccagcaatgacctcgccctggtccccatcgccagcgagacaaccagcccgggtccccgacttccccagggatttctgcctcctgcccagaccccctcgtatggggatctggacgattgttcccctaagcatcgcaatagttcgcctcggatgccccacctggctgtggctacagacaagactctggccccctcctcagagcaggagcagcccgagggactttggcctcccctcgcatctccactgcacccgctggaggtgcagggactaatatgcggaccctgcttcagttcactccccgaacacctggggtcggtgcctaaacagctcgacttccaaagacacggcagcgaccccggcttcgcagggtcctggggacattag

SEQ ID NO: 44971 - DNA, 1581 bp, Artificial Sequence
  Description of Artificial Sequence: Synthetic coding sequence
atgctgatgctgctggtgcggggcacccactacgagaacctgcggagcaaagtggtgcttcccaccccactcggcggacggtctacagaaacctttgtgtcagagtttccaggtccagatacaggcataagatggagacgaagtgacgaggcgctgcgcgtgaatgtgggcggagtcagaagacagctgtctgcccgagcccttgcccggttcccagggacacggttgggtcgtctccaggccgccgcaagcgaagaacaggcaaggcgtctctgtgatgactatgacgaggcagccagagagttttactttgacagacatcctggattcttcctaagtttactacacttctatcgcacgggtcacctacacgttttggacgagttgtgcgtgtttgcctttgggcaggaagcggattattggggccttggcgagaacgcactggccgcctgctgtagggcccggtatctcgaacgaaggctgacacagcctcatgcatgggatgaagattctgataccccaagtagcgtggatccatgtccagatgagatctctgacgtccagagggaattggcccgttacggcgctgcccgatgcggccgcctgcggcgtagattgtggctcactatggaaaaccctggctactccttgcccagtaaacttttctcctgtgtgagtattagtgtggtgttagctagtatcgcagccatgtgtattcacagcctgcccgagtaccaggcccgagaggcagctgctgccgttgcagccgtggccgccggtcggtcccccgagggcgtaagggacgatcctgtgcttcgacgtcttgagtacttttgtatcgcgtggttttcgtttgaagtgtctagtcgtctgctgctagcaccttccacgcggaattttttctgccacccactaaatttgatcgacatagtgagtgtgcttccattttacctgaccctgctggcgggcgtggctctgggggaccaggggggtaaggagtttggccacctgggcaaagtcgtccaggtctttcgcctgatgcggattttcagagtattaaaactcgccaggcacagtacaggactgcggagcttgggggcgaccctcaaacacagttaccgagaagtgggaatcctactcctctatctagcggtaggagtgtcagtttttagcggagttgcctatacggccgaaaaagaggaagacgtgggctttaacactattccagcatgttggtggtggggcactgtgagcatgacgaccgtgggatacggagacgtggttcctgtaacagttgcgggcaagctcgccgcttccggctgcatcctcggcggaatactagtggtcgctctgcccatcacaattatcttcaacaaattttctcacttctaccgtagacagaaagcgctcgaggctgctgtgaggaatagcaaccatcaggaattcgaggatttactgtcatcaatcgacggtgtctccgaagcttccctcgagacttcgagggaaacgtcccaggagggccagtccgccgacctcgagtcacaggccccaagcgagcctccacacccacaaatgtattag

SEQ ID NO: 44972 - DNA, 1581 bp, Artificial Sequence
  Description of Artificial Sequence: Synthetic coding sequence
atgctgatgctgctggtgcggggcacccactacgagaacctgcggagcaaagtggtcctgcccacccctctgggaggtaggagcacggagactttcgtatccgaattcccgggcccagacaccgggatccggtggcggcggtccgacgaggccctccgggtgaatgtgggcggggttaggagacagctttcggctagagccctggctagattcccagggacccggctcgggaggcttcaagcagccgcttctgaggaacaggctcggcgcctttgcgatgactatgatgaggccgctagagagttctattttgacagacatccagggttctttctgagcctgctacacttttataggaccggccaccttcacgttcttgacgagttgtgtgtatttgcctttggccaggaggccgactattggggtctcggtgaaaacgccctagcagcctgctgtcgagctcgctatttggagagacggctcacgcagccccacgcgtgggacgaggactcagacacacctagctccgtcgacccctgccccgatgagataagcgatgtccagagggaactggcccgctacggggcggccagatgtggacggctaagaagacgcctgtggttgactatggagaacccaggctatagcttaccctcaaaacttttcagctgcgtaagcattagcgtcgtgttggctagcatcgctgcgatgtgcattcactcactgccagaatatcaggcaagggaagcagcagcagcagtcgctgccgtcgccgccgggcgctccccggagggcgtgagggatgatccagtcctgagacgtctagagtacttttgcattgcatggttttctttcgaagttagctcacggctcttgctggctccttctacccgtaacttcttctgccaccccctcaatctaattgatattgtgtccgtgcttccattttaccttacactgttggcaggcgtggccctaggggatcaaggtgggaaggaatttggccatttgggaaaagtggtacaggtgttcaggttaatgcggatcttccgggtgttaaaactagcgcgccacagcacgggattgcggtccctaggggccacactgaagcacagctaccgcgaggtgggaattctcctgctctatcttgcggtgggggtctctgtgttttctggggtggcgtacaccgctgagaaggaagaagacgtgggttttaacactatcccagcttgttggtggtggggcacggtgtctatgacaacagtgggttacggggatgttgttcccgttacagttgcaggcaagctggccgcctctgggtgtattctgggtggtattcttgttgtggccctcccgatcacaatcatattcaataagtttagccatttctatcgtcggcaaaaagcattggaagccgcagtacggaattcaaatcaccaggaatttgaggatctgctgagctccattgatggggtcagcgaggcaagtctggaaacctctagagaaaccagccaggaggggcagagtgcagatttagaaagtcaggcgccaagcgagccacctcacccccaaatgtattag

SEQ ID NO: 44973 - DNA, 1500 bp, Artificial Sequence
  Description of Artificial Sequence: Synthetic coding sequence
atgaccgtggccaccggcgaccccgccgacgaggccgccgccctgcctggacatccccaggatacgtacgatccagaagcagatcatgaatgttgtgagcgtgttgttatcaacatctctggacttcgattcgagactcaactgaagacgctcgctcaatttccggagactctgctgggcgacccaaagaaacgcatgagatatttcgaccccctcagaaacgagtatttcttcgaccggaataggccctcattcgatgcaatactctactactaccagtctggcggaaggctgcgtcgtcccgtgaacgttcccctggatatctttagcgaagaaatcaggttctacgagttgggtgaggaggctatggagatgttcagagaggacgaaggctacatcaaagaggaggagcgccctttgccagagaatgagtttcagaggcaagtctggctgctctttgagtaccctgaatcctccggccccgctcgcatcattgctatagtatctgtaatggttattctaatctcaattgtcagcttttgcctagaaacattgcctatcttcagggacgagaatgaagatatgcacgggagcggagttaccttccatacctactcaaattctactattggctaccagcaatctacctcattcactgaccctttttttatcgtggagacgctgtgcattatctggtttagcttcgagttccttgtcagattcttcgcctgtccgtctaaagctgggttcttcaccaacattatgaatatcatcgacatagtcgcaatcatcccctacttcataaccctgggaactgaactggcggagaaaccggaggacgcccagcaaggacagcaggccatgagtctggcaatcctccgcgtgatacggctggtgagagtctttcggatctttaaattgagcaggcactctaaagggcttcagattctgggtcagactctgaaagctagtatgcgcgagctcggtctgcttatttttttcctgttcataggggttattctgttcagtagcgctgtgtacttcgctgaagccgatgaaagggagagtcagtttccatccattccggatgccttctggtgggctgtcgttagtatgacgaccgttggatatggcgacatggtccccactactatagggggcaaaatagtcggctcactctgtgccattgccggtgtattaaccattgcccttccagtgccggtgatcgtgagtaattttaattacttttaccaccgggagacagagggggaggaacaggctcagtatctgcaagttacgtcgtgcccaaagatccccagcagtcctgacctgaaaaagagcagaagcgccagcaccatctctaagtctgactatatggagatacaggagggcgttaacaactcgaatgaggactttagagaggagaacctgaagacagcaaactgtacactggctaatactaactatgtgaacattaccaagatgctgaccgatgtgtag

SEQ ID NO: 44974 - DNA, 1071 bp, Artificial Sequence
  Description of Artificial Sequence: Synthetic coding sequence
atgaccgtggccaccggcgaccccgccgacgaggccgccgccctgccaggtcacccacaagacacatacgacccagaggccgaccatgaatgctgcgagcgggttgtgatcaacatcagcggcctccgatttgaaacccagctgaaaacccttgcacagtttcctgagacactactcggcgatcctaaaaagcggatgcgctatttcgatccgctccggaatgaatactttttcgataggaatcgtccctcattcgacgctattctctattactatcagagcgggggacggctgagacgccccgtgaacgttcctctcgacattttcagcgaggaaatccgtttctatgaactgggagaggaagccatggagatgttcagagaggacgagggttacattaaagaggaagaacgacctctgcctgaaaatgaattccagcgccaggtgtggctgttgttcgagtatcctgagagctccgggccagcccggattattgccattgtcagtgttatggtaatacttatctccatcgtgtctttctgccttgagacattgccgattttcagggatgaaaatgaggacatgcatggcagtggggttaccttccatacctatagtaactccacgattggataccagcagtcgactagctttaccgatccatttttcatcgtcgagacactgtgtattatctggtttagctttgaatttctggttcgtttctttgcttgccccagcaaagccggctttttcacgaatatcatgaacatcattgatatcgtggctataattccctacttcattacgctgggcaccgagcttgcagaaaaacccgaagatgcgcagcaaggccagcaagccatgtccctcgctatcctccgtgtaattagactggagcgacggccactccaatcccagaagtcaaaaaggggaaggcagcatctgaacacctctcatgactgcactctcggaatcaacctggtggccggcatgactgtccagtggacccgagcctctggccctgatgataggcagacccctgccgtgacgacattacatagaatgtattag

SEQ ID NO: 44975 - DNA, 1500 bp, Artificial Sequence
  Description of Artificial Sequence: Synthetic coding sequence
atgaccgtggccaccggcgaccccgccgacgaggccgccgccctgcctggtcacccgcaggatacatatgatcctgaggccgatcacgaatgctgcgagcgcgtggtcatcaatatctcaggcttgcgtttcgagacgcagctgaagacactagcccagtttcccgaaacgctacttggagatcccaagaaacggatgcgatactttgatccgcttagaaacgaatatttcttcgataggaacagaccttcgtttgacgctatcctgtattattaccagtccgggggcaggctgaggagacccgtcaatgtgcccctggacatcttctcagaggagattcgattctacgagctgggcgaggaggccatggagatgttccgcgaagacgagggctacattaaagaggaggagagacctctgccggagaacgagttccaaagacaagtgtggttactcttcgagtaccctgagagctccggtccagccaggatcatcgccatcgtgagcgtgatggtgatcctgataagcatcgtgtccttttgccttgaaacattgcctatatttcgcgacgagaatgaagatatgcatggctctggggtgaccttccatacatattctaatagcactattggctatcagcaaagcactagctttactgatccatttttcatcgtggagactctctgcattatctggtttagttttgagtttctcgtgagattttttgcctgtccctccaaggccggatttttcaccaatataatgaacataatcgacattgtagcaataattccttattttattacccttggcacggagctcgcggaaaaaccagaggatgcccagcagggccagcaggccatgagcctggcaatccttcgggtaatcagacttgtgagggtattccggattttcaaattgtctcgacattccaaaggcttacagattctcggccagaccctcaaggcttcaatgagagaattaggtctcctcatcttcttcctgttcatcggcgttatcttgttcagctctgccgtttattttgcagaagccgatgagcgagaatctcaatttcctagtatacccgacgcgttctggtgggctgtggtgtcaatgacaaccgtcggctatggagacatggttcctaccactataggcggcaaaatcgtgggctcactctgcgctatcgcaggagtgttgaccattgccctcccggtgccagttatagtttcgaatttcaactacttctatcaccgcgaaaccgagggagaagagcaggcccagtacctccaggtgacatcatgccccaaaatcccaagcagccctgacttgaagaagagtcggtccgccagcaccatctcgaaatcagactacatggaaattcaggagggagttaacaatagcaacgaggacttcagggaggaaaatctgaagactgccaactgtaccctcgccaacacaaattacgtcaatatcactaagatgttaactgatgtctag

SEQ ID NO: 44976 - DNA, 1500 bp, Artificial Sequence
  Description of Artificial Sequence: Synthetic coding sequence
atgaccgtggccaccggcgaccccgccgacgaggccgccgccctgcctggacaccctcaggacacctatgatccagaggctgatcacgagtgctgtgaacgtgttgttatcaacatctctggcttgaggttcgaaacccaactaaagacgctagcgcagtttcccgaaacacttttgggagatcctaagaaaaggatgaggtatttcgacccactgcgaaacgagtacttctttgatcggaaccggccatctttcgatgctattctttattactatcaatcaggcggcagactgagaaggcccgtgaatgtacccttggatatcttttccgaagagattagattttacgagctcggtgaggaggcgatggagatgttcagggaagatgagggctatattaaagaggaggaaagaccccttccggaaaacgagttccagcggcaagtttggcttctctttgaatatccagagtccagcggcccagctcggatcatagccattgtcagcgtgatggtcattctgattagcattgtatccttctgtctggagactttgccaatcttccgcgacgaaaacgaggatatgcatgggtcgggcgtgaccttccacacctactccaattccaccatcggataccaacagtctacctcatttacagatccctttttcattgtagaaacactatgtatcatttggtttagtttcgaattcctggtaagattttttgcttgccctagcaaggctggcttctttacaaacattatgaatatcatagatatcgtggccataatcccctacttcatcacactggggactgagctggcagagaagcctgaggacgctcaacaagggcagcaggccatgtccctggcaattctccgggtcatccgactggtgcgagtgtttcgtatattcaaactgtcaaggcacagtaaaggtctgcagattcttggacagacactaaaagctagcatgcgggagctcggcctcctgatcttttttctcttcatcggagtgatactgttcagctctgctgtttattttgcagaagcggacgagagagagtcacagtttccttctatcccggacgccttctggtgggcagtggtctctatgacgacggtgggatatggtgacatggtacctaccaccatcggagggaaaatagtcgggtctctgtgcgccatcgccggtgtcctcaccatcgccttgccagtccctgtcatagtgtcaaatttcaattacttttatcatagagaaaccgaaggcgaagaacaggctcaatatctccaggtcacgtcatgccccaaaataccttcgtcaccagatcttaagaagtcgcgaagcgccagcactatcagcaagagtgattacatggagattcaggagggtgtaaacaatagcaacgaggacttccgagaagaaaacctcaagacggcaaactgtacactggccaacactaactacgtgaacattacaaagatgctaacagacgtttag

SEQ ID NO: 44977 - DNA, 1590 bp, Artificial Sequence
  Description of Artificial Sequence: Synthetic coding sequence
atgcggagcgagaagagcctgaccctggccgcccccggcgaggtgagaggacccgaaggggaacagcaagatgcgggggactttccggaagcaggcgggggcggcggatgctgttccagtgagcggctggttatcaatattagcggcttaaggttcgagacacaactcaggacgctttcattatttcctgacaccttgctgggggatcctgggaggagagtgaggtttttcgatccacttcgcaatgaatactttttcgatcgtaaccggccttcttttgacgcaatcctgtactactaccagagcggggggcgtctgcgccggcctgtgaacgtgcctttggatatctttctcgaagagataagattctaccagctcggggacgaggctctggcggcgtttcgggaggacgaagggtgcctgcccgagggcggagaggacgagaagcccctgccgtcacagccttttcagaggcaagtgtggctcctattcgagtacccagaatccagtggtccagcaagggggatcgcaattgtaagtgtcttggtgatcttaattagcattgttatattttgcctcgagactttgccacagtttcgagtggatggacggggcgggaacaacggaggtgttagcagagtgagcccagtgtcccgcggtagccaggaggaggaagaggacgaagacgactcttatacattccaccatgggattacccctggggagatgggaacaggaggctcttcttccctcagcactctggggggatctttctttaccgacccgtttttcctggtcgagacactgtgtatcgtgtggttcaccttcgaactgctagttcgatttagcgcctgcccgagcaaacctgctttcttccgcaatattatgaatatcattgaccttgtggctatatttccctacttcataacacttggaacagagctggtccagcagcaggagcagcaaccagcttctggaggcggcggacagaacggacagcaggcaatgtctctggccattctgagggtcattagactagttagagtgtttagaatcttcaaactgagccgccattccaaggggctgcagatactgggtaaaactctccaggccagcatgagggagctcgggcttttaatctttttcctttttatcggcgtgatactcttctcaagcgccgtgtacttcgccgaggccgatgatgatgattcattgtttcctagcatccctgacgctttctggtgggctgtggtcacgatgactactgtggggtacggggatatgtatcccatgacggtggggggaaaaattgtgggttctctctgtgctatcgcaggtgtcctgaccatcgcgcttcccgtacccgtcattgtgtcaaattttaattacttctaccaccgggagactgagcaggaagagcagggccagtatacacacgttacctgtggccagccagcacctgatcttagagccacagataatgggctcggcaaacctgatttccccgaagcgaatagagaaaggagacctagttacctcccaactccccacagggcttacgctgaaaagagaatgttgaccgaggtatag

SEQ ID NO: 44978 - DNA, 1590 bp, Artificial Sequence
  Description of Artificial Sequence: Synthetic coding sequence
atgcggagcgagaagagcctgaccctggccgcccccggcgaggtgcgcgggccagagggcgagcagcaggacgccggggatttcccagaggccgggggcggtggcggctgctgtagcagcgaacggctggtgataaatattagcggtctccggtttgaaacgcagctacgaaccctgtctctgtttcccgacacattactgggcgacccaggaaggagggtgcgcttctttgaccccctgcggaatgagtacttcttcgatagaaataggccgtcttttgatgcaattttatactactaccaatctgggggcagactgaggaggcccgtgaacgtccccctggatatcttcttggaagaaatccgattctatcaactgggagacgaggctctcgcggcctttcgcgaggacgaaggatgcctgcctgagggtggtgaagacgagaagccccttccatcccaaccctttcagcgccaggtctggctgctgtttgaatacccagagtcttctggccccgctaggggaattgccatcgtcagtgtgctagtcattttaattagcatcgttattttctgcctggagactctgccccagttcagagtcgatgggcgagggggcaacaacggtggtgtatcccgagtgtcaccagttagccggggatcacaagaggaggaggaggatgaggacgactcatacactttccaccatggtatcacacccggcgagatgggcactggtggaagctcttccctgagcacgctaggcgggagtttcttcaccgatcccttcttcctcgttgaaacactttgcatcgtatggttcacatttgaactgcttgtcagattctctgcctgcccctccaagccggctttctttcgcaatattatgaatatcattgatctggtcgctattttcccctatttcatcactctgggcacagagcttgtgcagcagcaggagcagcagcccgccagcggcgggggcggccagaatgggcagcaagcaatgtccttagcaatattacgggttatacggttagtgagagtgtttagaatctttaaactgtctcgtcacagcaaaggtcttcaaatcctgggcaaaacccttcaggcctccatgcgggagctgggactacttattttttttctgttcatcggagtgattctgttctcgtctgcagtctatttcgctgaggctgacgacgacgactcactgttcccatccatccccgatgccttctggtgggcagtcgtgactatgaccacagttggatatggcgacatgtaccccatgaccgtgggagggaagatcgtcggctccctgtgcgccatagcaggtgtgcttactatagctctgccggttccagtcattgttagtaacttcaattatttctatcaccgtgaaacagagcaggaggaacagggccagtacacgcacgtgacatgtggtcagccagctccagacctgcgagccaccgataatggtttagggaagccggatttccctgaagccaatcgcgagcgccgaccgagttacctccctacacctcatagagcttacgccgagaaacggatgctgactgaagtgtag

SEQ ID NO: 44979 - DNA, 2319 bp, Artificial Sequence
  Description of Artificial Sequence: Synthetic coding sequence
atggagaagagcgccagcaaggaggagaagcagcagcccaagcaggattccaccgagcaggggaatgccgattcggaggaatggatgtcatcagaatcagaccccgaacaaatcagtcttaaaagcagcgacaacagtaaaagctgtcagccacgggacgggcagttgaaaaagaaggagatgcactcaaagcctcataggcaattatgccgatccccttgtctggacaggccttcattcagccaaaaccatctgttgatgatgtactggcagagcttgagcgacctgggcactaaagtgatccagaagggatcatccagagaaatcgcttctcctgagcttagtctcgaggacgaaatcgacaactcggacaacttaaggcccgtggtcatcgacggtagtaatgtcgccatgagccatggtaacaaagaagagttttcctgtaggggcatccagctggcagttgactggtttctggataaaggacacaaagacatcacagtattcgtgcccgcatggagaaaggagcagtcccggcccgatgcacctatcaccgatcaggacatcctaaggaaattggaaaaggagaagatcctggttttcaccccttccaggcgagtgcaaggtagaagagttgtatgttacgacgaccgtttcattgttaagctcgctttcgactcggacggcatcatcgtctctaatgacaactacagagacctgcaagtggaaaagcctgaatggaaaaagtttatagaagagcgcctccttatgtattcattcgttaatgacaaatttatgcccccagacgatcccctgggacgccatggaccctctctggagaacttcctccgcaaacgaccaattgttcccgagcacaagaaacagccatgtccctacggcaaaaaatgcacctacggacataaatgtaagtattatcacccagaacgcgccaatcagccgcagcggagcgttgccgatgagctgagaattagcgccaaacttagtactgtgaaaaccatgtcggaaggaaccctggccaagtgcggtactgggatgtcctctgccaagggggagatcacaagcgaagttaagcgagttgcacctaagaggcagtcggatccctcaatccgctccgtagctatggagcctgaggaatggctcagtatcgccagaaaaccagaggcgagctcagtcccctcccttgtcacggctttgtccgtcccaactatacctcctcctaagtcccatgccgtgggcgccctgaacacacggtctgcgagctctcccgtccccgggagctcccacttccctcaccagaaggccagcctcgaacatatggcatctatgcaatacccgcccatccttgtcacaaatagtcatggcacccctatttcttatgctgagcagtatcctaaatttgagtctatgggagaccacggttattactctatgctgggcgatttcagtaagctgaacataaattctatgcacaacagggaatattacatggctgaagtggacagaggtgtgtatgcgcggaaccccaatctgtgttctgattccagagtctcccacactcgtaatgataactatagcagttacaacaacgtgtatctcgctgtagctgacactcatcccgaaggcaatttaaagctgcaccgatctgcatcacagaaccgcctccaaccatttccacatgggtaccacgaagcccttactagggtgcagtcttatggtcctgaggactccaaacagggtccacacaaacagtccgtgccccacttggcgttgcacgcgcagcacccatcaaccggaacccggagctcatgccctgcagattatccaatgccacccaacatccatcctggcgctaccccccaaccaggtcgagcactcgtgatgaccagaatggattctatttcggattctagactgtacgagagcaaccccgtacgtcagcgacgcccacctctgtgcagggagcagcacgccagttgggatccactgccatgcaccaccgatagctatggctaccacagctaccccttgtccaattcgctaatgcagccttgctacgagcccgttatggtgcgcagtgtgcctgaaaagatggaacagctctggcgcaatccttgggtgggcatgtgcaacgattcacgcgagcatatgattcccgagcatcaatatcagacgtataagaatttatgcaatatctttcccagtaatatagtcttggccgtgatggagaagaaccctcataccgctgatgcacagcagctggccgctctgatagtggccaagctccgggccgcaaggtag

SEQ ID NO: 44980 - DNA, 813 bp, Artificial Sequence
  Description of Artificial Sequence: Synthetic coding sequence
atggtgcccagcaccatcgccggcaagatcttcggcagcatctgctccctgtccggcgtcctggtgatcgccctacctgtgccggtgatcgtgtccaatttttccaggatatatcaccagaaccaaagagcagacaagaggcgggcccagcagaaagttcggttagctcggatccgactcgccaagtccggaaccactaacgcgtttctgcaatataagcagaacggcggcctagaagactctggttcaggggaggagcaggctttgtgtgtgagaaatcgctccgcctttgagcagcagcaccatcacctgctgcactgcctggagaagacaacgtgccacgaatttactgatgagcttaccttttctgaagccttaggggccgtcagcccagggggcaggacgtcgcgcagtacgtctgttagtagccaaccggtagggcctggctcactgctgtccagctgttgtccgaggcgcgctaagcgaagggccattaggctagctaatagcaccgcatccgttagcaggggatcgatgcaggagctcgatatgctggctgggctgcgtagatcccatgctccacagagtagaagctcgttaaatgccaaaccgcatgactcgctcgacttgaattgcgactctcgtgattttgtcgctgcgataatcagcatccccactccccccgctaacacgccagatgaatcccaaccttctagtccaggaggcggggggcgagcagggtcaacgctgcgaaattcctccttaggcaccccctgtttgtttcctgagactgtcaaaatctcgagtctatag

SEQ ID NO: 44981 - DNA, 402 bp, Artificial Sequence
  Description of Artificial Sequence: Synthetic coding sequence
tgaggccggggcctggaccgggtgggcgtgagccacaacggcgaggagggagcagcgctcatcgctctcctacacctgttgcaggactccggcagcggagaggaacaggctctctgcgtgcgtaatcgatccgctttcgagcagcagcatcatcacctgcttcattgcttagaaaaaacgacctgccacgaatttactgacgagcttacctttagcgaagcactgggggccgtgtcccctgggggtcgcacgagcaggagtacaagcgtttcctcgcaacctgtcgggcctggctctctgttgtcttcttgttgtccgcgaagagccaagcgcagggcaataagattagcaaattctaccgcgtctgtgtcgcggggctcaatgcaggaactggacatgtag

SEQ ID NO: 44982 - DNA, 1401 bp, Artificial Sequence
  Description of Artificial Sequence: Synthetic coding sequence
atggagccctggccctgcagccccggcggcggcggcggcacccgggcccggcacgtcattattaacgtcggtggctgtcgtgtacgcctggcctgggctgcactcgcaaggtgcccactggccagactcgagcgcctgcgggcttgcaggggtcacgatgatctcttgagggtctgtgacgattatgatgtgagtcgagacgaattcttcttcgatagatctccatgcgccttccgagctattgtcgcactattgcgagcaggcaagcttcgtttgttgcgcgggccctgcgctttagccttcagagatgagctggcctactggggaatagacgaggcaagactggaacggtgttgccttcgcagattaagacggcgggaggaagaggctgctgaagcccgtgcaggccccaccgagagaggcgcacagggttctcccgcaagggccctcggtcccagagggaggttgcagagaggccgccgcagactccgcgatgttgttgataatcctcactcagggttggccggaaaattatttgcctgcgtgagcgtatctttcgtggctgtgacagcagtaggcctgtgcctgagcaccatgccagacatcagggccgaggaagaacggggcgagtgctcaccaaagtgcagatccctgttcgtgttagaaacagtctgcgtggcatggttttccttcgagtttctcctgcgtagccttcaggccgaatctaagtgcgccttcctgagggctccgctgaatataatcgatattttggccttgctgccattttatgtgtctctactcctgggtctggccgcaggacccggggggacgaagttgcttgagagagctggtctagtgctgagactcctgagggctctgcgcgtgttatatgtgatgcgcctggcacggcattctttgggcctgcgaagtctgggcttaacaatgcgtcggtgcgctcgggagtttggactcctccttctgtttctttgcgtagctatggccttgtttgccccactggttcacttggccgagagagaattgggcgctcgacgcgatttcagcagcgtgccagccagttactggtgggccgttattagcatgacaaccgtgggctatggggacatggtcccgcgtagtctgcctggccaggtagtggctctgtcctcaattctgagcgggattcttctgatggcgtttcctgtcacttctatctttcatacatttagcaggagctactcggagctaaaggagcagcaacagagggctgctagcccagagcctgccctgcaggaggacagcactcactccgcaactgctacagaggatagcagccaggggcctgactcagcaggcctggccgatgattccgcggatgccctttgggtcagagccggaagatag

SEQ ID NO: 44983 - DNA, 3054 bp, Artificial Sequence
  Description of Artificial Sequence: Synthetic coding sequence
atgcccgtgatgaagggcctgctggccccccagaacaccttcctggacaccattgccactcggttcgacgggacgcacagcaacttccttttggctaacgcccagggaacaagaggcttccccatagtgtactgctctgacgggttttgtgaactgactggttatggcagaacggaagtgatgcagaagacttgctcttgcagatttctgtacggcccggagaccagcgagcccgctctgcagaggctgcataaagctctggaaggccaccaggaacacagggccgagatatgcttttatagaaaagatgggtctgccttctggtgcctcctagacatgatgcctattaagaacgagatgggggaggtggtgctgttcttgttctccttcaaggatatcactcagagtggcagccctggtctgggaccacagggagggagaggcgacagcaatcacgagaattccttgggcagaaggggtgccacatggaaatttcgttccgctaggcgtcgttctcggaccgtgttacacagactcaccgggcactttggaaggcgtggtcagggcgggatgaaagccaacaataatgtcttcgaaccaaagccctccgtgcctgagtacaaggtggccagcgtgggcggcagccggtgccttctgcttcattatagtgtctccaaggctatctgggatgggctgatactgctggctaccttttatgtagccgtcacggttccctacaatgtctgtttctccggagatgatgatactccaattaccagcaggcataccctcgtcagtgacattgccgtggagatgcttttcatcctggatataattctgaattttcgcacaacctacgttagtcagtcagggcaggtcattagcgcgcccaggtctattgggctacactacctggccacatggttctttatcgacctgattgccgcactcccgtttgacctgttatacatttttaacatcacagtcacctcgctggttcacttattgaagaccgtgcgcctcctgagacttctcagactactccaaaaactggaaagatattcccagtgctccgcagtggttcttactctgttgatgtcagtgttcgctctcctagcacactggatggcatgtatctggtatgtaatcgggcgccgtgaaatggaggccaatgaccctctgttgtgggacatcggctggctgcacgaattagggaagcgcctagaagtcccgtacgtaaatggaagcgtggggggccctagtagacgcagcgcatatatcgcagccttatatttcaccctctcttcccttaccagtgttggattcggtaacgtgtgtgccaacactgacgccgagaaaatcttttcgatctgcaccatgctgattggagccctaatgcatgctgtggtatttgggaacgttaccgctatcattcaacgcatgtactccaggcggagcctgtaccatagtagaatgaaggacctcaaggattttatcagagtccaccgcttaccgcggccactgaaacagcgaatgttggaatatttccagactacctgggccgtgaacagtggcatagatgccaatgaattgctgagagactttccagacgaactgcgcgctgacattgccatgcatctgaatcgtgaaattctgcagctgcctctgttcggggctgccagcaggggttgcctgcgtgccctgtccttacatatcaaaacatccttttgcgccccaggagagtacctccttagacggggagacgcattacaggctcactactatgtgtgtagtgggtcgttggaagtattaagggataacatggtcttggcaatcctgggaaagggggaccttataggtgctgatattccagaaccgggccaagagcccgggttaggagccgatccaaattttgtcctcaaaaccagcgctgacgtaaaagcgttaacttactgtggcctgcaacaactgtcctccaggggcctcgccgaagtgctgagattatatcctgaatacggggccgccttcagagcaggcctccctagagatctcaccttcaacctgcggcaggggtcagatacctcagggctcagtcgtttcagcagaagccctcggctgtctcagccacggtcggaaagccttggttcttctagcgataagaccctcccatctatcacggaggccgagagtggagccgaacccggtggaggccctcgacctcgtaggcccttgctactgccgaacctcagtccggcaaggcctcgcggcagcctagtctctttgttgggcgaagagcttcccccattctctgccctagtcagtagtccatcgctgagcccttccctttcaccagctctggccggtcaagggcattccgcctcaccacatgggcctccaagatgtagtgctgcatggaagccaccccagctcctcatcccacctcttggaactttcggaccccccgatttgagcccacggatcgtggatgggatagaagactccggcagtacggccgaggccccttcattccgcttctcccggagaccagaactgcctcgacctcgttctcaggcaccgcctaccggcacaaggcccagccccgaattagcttccgaggctgaagaggttaaggaaaaggtctgccggttgaaccaggagatctctcgcctgaatcaggaagtcagtcagctgtcacgggaactgcggcatattatggggcttcttcaagcgcgcctgggaccacccggacaccccgccgggtctgcatggactccagatcctccttgcccgcagctgcgcccaccctgcctgtcaccatgcgcatctcgccctcctccatcacttcaggatacaaccttggcagaggtccactgccccgcttccgtcggaacaatggagaccggaaccgccctcctcgatttgagaccctcgatattacccccttatccgtcagagccagatcctctgggccccagcccagttccggaagctagccctcctaccccatcactgcttcgccatagcttccaaagcagatcagacacattccactag

SEQ ID NO: 44984 - DNA, 2985 bp, Artificial Sequence
  Description of Artificial Sequence: Synthetic coding sequence
atgcccgtgcggcggggccacgtggccccccagaacacctacctggacaccattattagaaaatttgagggacagagcaggaaatttttaatcgccaacgcgcagatggagaattgcgctattatatactgcaacgatgggttctgcgagttattcgggtatagtagggtggaggtgatgcagcagccctgcacctgcgattttctcacgggcccaaacaccccttcttcagccgtgtccaggctcgcacaggccctccttggggccgaagaatgcaaagtagatatcctgtactataggaaagacgccagcagctttcggtgcttagtggacgtcgtcccagtgaaaaacgaagacggcgcagtaatcatgtttatactaaactttgaagatttggcccaactcctcgcaaagtgttccagccgcagcttaagccagaggctcctatctcagtcatttctcggctccgaaggttcccatggacgcccggggggaccgggtcccggcacagggcgcgggaaatatcgaacaatttctcaaattccgcagtttacgttgaattttgtggaattcaatttggagaagcaccggtctagttcaaccacagagatcgagattattgctccacacaaggtcgtggagagaacccagaacgtcactgagaaggttacgcaagtcctgagcttaggcgctgacgtgctgccagagtataagctccaggctcctcgaatccaccggtggactatactgcattattctccatttaaagcggtatgggactggcttatacttctattagtgatctataccgctgtcttcactccatactcggctgctttccttctgagtgaccaagacgaatcacggcggggagcgtgttcatatacctgctcgcctctcacagttgtcgatctaatcgtggatatcatgttcgtcgtggatattgtgatcaacttcagaaccacatacgtgaacactaatgacgaggtggtctcccatccacggagaattgccgtgcactacttcaaggggtggtttctgattgatatggtggccgccattccgttcgatctcttgatttttcgtacaggatccgatgagactaccaccctgattggactgctcaagaccgcccgccttcttagactagtgagggttgccaggaagctggaccggtactctgaatacggtgctgccgttctgtttctgcttatgtgtaccttcgccctcatcgcacattggcttgcctgcatatggtacgccattgggaatgtcgagcgcccttacctcgagcacaagatcggctggttagattctctgggggtgcagctgggaaaaaggtataacggtagtgatccagcatctggtccctccgtgcaggataaatacgtaaccgccctatatttcactttcagcagcctgactagtgtcggcttcggcaatgtgtccccaaacacaaattctgaaaaggtgttttcgatctgcgtgatgctcataggctcgctgatgtacgcctccatttttgggaatgtatctgccattattcaacggctttatagcggcacagccagatatcacacacaaatgctacgggttaaagaattcataagattccaccagatacccaacccgctgcggcagagattagaggaatactttcaacacgcatggtcttacacaaacggtatcgacatgaatgcagtgctgaaagggtttcctgagtgcttacaggccgacatctgtctacacctgcaccgggcactgctgcagcactgccccgccttttcgggggcaggcaagggctgcttgcgggctcttgctgtaaagttcaaaacaacccatgctcctcccggcgacacactggtccatttaggagatgtcctctccaccctgtacttcatctcccgcggctcgattgagattctaagagatgatgtggtcgttgccatcctgggaaagaatgacatcttcggcgagcccgtttccctccatgcccagcccgggaagtcctcagccgacgttcgggccctcacctactgtgatctccacaaaattcagagagcagatttgctggaggtactggatatgtatccagcattcgctgaatcattctggtcaaagctcgaggtaacctttaatttacgcgacgcagcaggaggcctgcactcatctcccagacaagcccctgggtctcaggaccaccagggctttttcctctcagacaatcagagcggctctccccatgaactgggtccacagtttccgagcaaaggatactctttgctgggccctggttcacagaactccatgggggcaggtccatgcgcacccggacaccctgacgctgcacctcccctttccattagcgacgcgagcggtctgtggcctgaactcttacaggagatgcccccaagacatagcccacagagcccccaggaggaccccgattgctggccactgaaactcgggtctcgtctggaacagctgcaggcccagatgaacaggttagagtccagggtttcgtctgacttgagcaggatacttcaactgctgcagaagcccatgcctcagggacacgcatcgtacatcctggaagctcccgccagcaacgacctggctttggtgccaattgcttctgagacgacctcccccggaccaagattaccacaggggtttctaccaccagcgcagacaccctcgtatggggacttggacgactgttcgccgaaacacaggaattcttccccccgcatgccacatctggcagtcgccactgacaagacgttggctccctcatcggagcaggagcagccagagggcctttggccaccgcttgcatcgcctttgcacccactcgaagtccagggtttgatttgtggcccatgtttctcctctctgccagaacatttgggttccgttcctaagcagctggatttccagcgccatggaagtgaccctgggtttgctgggtcctggggtcactag

SEQ ID NO: 44985 - DNA, 2718 bp, Artificial Sequence
  Description of Artificial Sequence: Synthetic coding sequence
atgcccgtgcggcggggccacgtggccccccagaacacctacctggacacaattataagaaaatttgaagggcagtctagaaaatttttgattgctaacgcccagatggaaaactgtgccatcatctattgcaatgatggtttttgcgagctgtttggatatagcagagtcgaagttatgcagcagccatgtacttgtgactttctaacgggacccaacacgcccagttcagccgtgagtagactggctcaggccctactgggggccgaggaatgcaaggtggatatcctgtattatagaaaggatgcttcttcctttagatgcctcgtcgacgtcgtgcctgttaaaaacgaggacggagctgtaatcatgtttattctgaactttgaggacctggcacagctgctggctaaatgcagtagtagaagcctttcacagcgccttctgtcccaatcattcctgggtagcgagggatctcatggtaggccagggggccccggccccggcactggaagaggtaagtatcgcacgatcagccagatcccacagttcactctaaactttgttgaatttaatctggaaaaacatagaagttcttctacaacagaaatagaaataattgcgccgcacaaggtcgttgagcgcacccaaaacgtcacagagaaggtgacccaggtcctgtctctcggtgccgatgtgctgcccgagtacaagctgcaggcccctaggatccataggtggacaattcttcactactctcccttcaaagctgtgtgggactggcttatactactgcttgtgatctataccgcggtctttaccccttactccgctgcctttttattgagtgaccaggatgagtcacggcgtggcgcatgctcttatacctgctcccccttaacggttgtggatctcatcgtggatatcatgttcgtagttgatatagtgatcaatttccgtacaacatatgtgaataccaatgatgaagtagtttcccaccctcggcgcatcgcagtccactatttcaaggggtggttcttaatcgacatggtggctgccatcccattcgatttgctgatcttccggaccgggtccgacgagacgactaccctgattgggttgctcaagactgcccgactgcttagacttgtaagagtagcccgcaagcttgataggtacagcgaatatggagcagccgtgctgttcctgctcatgtgcacatttgctcttatcgctcactggctagcttgcatctgttctctgacttccgtaggctttgggaatgtaagcccaaatacaaactccgagaaagtgttcagcatttgcgtcatgttaattggcagcctgatgtatgccagcatcttcgggaacgtaagtgccattattcagagattgtattctggtactgctagataccacacccaaatgctcagagtaaaggaatttataaggttccaccagataccaaacccgcttcggcagagactggaggagtactttcaacatgcatggagttacaccaacggcattgacatgaacgctgtcctaaaagggtttcctgaatgccttcaggctgatatatgtctccatctgcatagagcactactgcaacattgtccagcattctcaggtgctggcaaaggctgtttgcgagccttggccgtgaagttcaagacaacacacgccccacctggcgatactctcgttcatctgggcgacgtgctctcaacgctgtattttattagtcgggggtcgattgaaattttgcgggacgacgtggttgtggcaattcttggtaaaaatgatatcttcggagagccagtgagcttgcatgcacagcctggtaagagtagcgcggacgtccgggccctgacatactgcgacttacacaagatccagagggcggacctgcttgaggtccttgacatgtacccagcattcgccgaaagcttttggtcgaagctcgaagttactttcaatctccgcgatgctgccggcggtctccattcttcgcctcgtcaagctcccggaagccaggatcatcaggggttcttcctctcagacaatcagtctgacgctgcccccccattaagcatcagcgacgctagtggtctgtggcccgagttgctccaagaaatgccaccccggcactctcctcaaagtccacaggaggacccagattgttggccccttaaattaggtagccgtctggagcagttgcaggcgcagatgaacaggctcgaaagtcgggtttcgtccgatctatctaggattctgcagctcttacagaaaccaatgccccaggggcatgcatcgtatattctggaggcacccgcctccaatgacctggcgctcgtcccaattgcttctgaaacaacttcaccaggtccaaggctgccccaaggatttttgcctccagctcagacccccagttacggggatctcgacgattgcagtccaaaacatagaaatagctccccccgaatgcctcacctcgccgtcgcaaccgacaagaccctggctccaagctcagaacaagaacaaccagaaggactgtggcctcccctagcttcccctctgcacccactggaagtacagggactcatatgcggcccttgctttagctctctgcctgagcacctcggctctgttcccaaacaacttgacttccaacggcatgggagtgatccgggcttcgctggatcatgggggcattag

SEQ ID NO: 44986 - DNA, 3324 bp, Artificial Sequence
  Description of Artificial Sequence: Synthetic coding sequence
atgcccgtgatgaagggcctgctggccccccagaacaccttcctggacaccatcgctacacgttttgatggcacccatagtaattttattctggccaacgcgcaggtcgcaaagggattccctatcgtgtactgtagtgatggattctgcgagctcgcgggattcgcaaggacggaggttatgcagaagtcctgctcttgtaaatttctcttcggagtggagacaaatgaacaattgatgcttcagatcgaaaaaagtctggaagagaaaaccgaattcaaaggcgagattatgttttataaaaaaaacgggtcaccattttggtgcctcctggatattgtccctatcaaaaacgaaaagggagacgtggtattattcttagctagtttcaaagatatcactgatacaaaggtcaaaatcacccccgaggacaagaaggaggacaaggtgaaagggcgctctagggccggtacccatttcgacagtgcccgtcggaggagcagagcagtcctctaccacatcagcggccacctccagaggcgggaaaaaaacaagctcaagattaacaataacgtcttcgtagacaaacctgcttttccagaatataaggtgtcggacgcgaaaaaatcaaaattcattctgctgcacttttcaacatttaaggcggggtgggactggctgattctactagccaccttctacgtcgcagtgactgtcccatataacgtgtgtttcataggtaatgatgacttgtccactactagatccacaaccgtgagtgacatcgccgtcgagatcctgttcattatcgacatcattttgaattttaggacaacttacgtgtctaagagcggccaggtgattttcgaggctcgctctatctgcatccactatgttactacgtggtttattatcgacctgattgctgctctgcctttcgacttactgtacgctttcaacgtaaccgtggtgtcgttggtgcacctcctgaaaacagttagactccttaggttgctgcggctgcttcagaagctcgatcgctactctcagcattctaccatcgttctgacgctattgatgagtatgtttgccttattggcgcactggatggcttgcatatggtatgtcatcgggaagatggaacgtgaggacaactctcttctgaaatgggaagtaggctggctgcatgaactaggcaaacggctggagtccccatattatggcaacaatacattgggaggcccatctatacgtagtgcatatatcgccgccctgtactttacacttagctccctgaccagcgtgggctttggaaacgtctctgccaatacggacgcagaaaaaatatttagcatttgcactatgctcatcggcgccctgatgcacgcccttgtgttcgggaatgttactgctatcattcaaaggatgtattcaagatggagtctctaccatactcgcactaaagatctcaaggattttatcagagtgcaccatctcccccagcagctgaaacagcgaatgttggagtattttcaaactacttggagtgtgaacaacgggatcgactccaacgagctgctgaaggactttcctgatgagttgcggagcgatattaccatgcacctgaataaagagattctgcaattaagcttgttcgagtgtgcgagtcgggggtgcctgagatctttgtcacttcacatcaagacctctttttgtgcccccggagaatacctgctgagacagggggatgccttgcaggcaatctactttgtgtgctctggatctatggaagtgctcaaggactccatggtgttggcaatattgggaaagggagacctaattggagcaaacctctcaatcaaggatcaggtgatcaaaacaaacgccgatgtcaaggcattgacctactgcgatcttcagtgcatcatcttgaaaggcttgtttgaggtactggatctctatcccgaatatgctcacaaattcgtggaggatatccagcacgatttaacctacaatcttagggaagggcacgagtctgatgtgatatcccgattaagcaataaatccatggtgtcacaaagtgaacccaagggtaatggaaatatcaataagcgcctccctagtatcgtggaggatgaagaggaggaagaagaaggtgaggaggaggaagctgtgtccctaagccctatctgcacccgcggctcatcctctcggaacaagaaagttggatctaacaaagcgtacctgggtctaagcctcaagcagctggcaagcgggacggtaccattccattcacccatcagagttagccgttctaattctccaaaaacaaaacaggaaatcgacccacccaatcataataagagaaaggagaaaaacctgaaactccagctgagcacactgaacaacgcagggccaccagacctcagccctagaattgtggacgggatagaggatggaaactcgagcgaggagtcccagacttttgatttcggaagcgagcggataaggagcgaacctcgaatatcaccacccttaggcgaccccgagatcggagctgcggtgctctttattaaagctgaggaaacaaagcagcaaatcaacaagctgaacagtgaggtgaccacactgacccaggaagtttcccaactgggcaaggatatgcggaacgtcattcagctgctcgagaatgtactgtctccgcagcagcccagccgcttctgttccctccactctacgtcggtttgcccaagccgcgaatcactgcagacaagaactagttggtcggcccaccagccatgtctgcatctgcaaacagggggcgcagcatatacacaggcacaattatgttcatccaatatcacttccgatatttggtcagtcgatccctcgagcgtggggtcctcgccacagcggactggagctcacgagcaaaatcccgctgattctgagctctatcactcacccagcctcgattattccccatcacactaccaggtcgtgcaagagggccatctgcagttcctgaggtgcatttcccctcattcagattccactctgactcctctccagtccattagcgctacgctttctagctctgtgtgcagctcatccgagacttccttgcacctagtcttgcccagtcggagcgaagaaggcagcttcagccagggtactgtgtcgtccttcagtctcgaaaatctacctgggagctggaaccaagagggaatggcttcagcttctacgaaaccacttgaaaatctgcccctggaggttgtgaccagcacagccgaggttaaggataataaggccatcaacgtgtag

SEQ ID NO: 44987 - DNA, 558 bp, Artificial Sequence
  Description of Artificial Sequence: Synthetic coding sequence
atgagcatgttcgccctgctggcccactggatggcctgcatctggtacgtcatagggaagatggagagggaagacaactccctgctgaaatgggaagtcggctggctccacgagctggggaaacggctagaatcaccctactatggtaataataccctcggtggcccatcaattcggagcgcctacattgccgccctgtatttcaccctcagctcgctgacatcagtggggttcggaaacgtgtctgctaacacggacgctgaaaaaatattctcaatttgtactatgctcattggagtttcccagttccaggtctgtcctagacccagttggataatatgttggttcagaaatcacttcggtttcatcttgctgatgaccacactgatgcatgcattggtgtttgggaatgttacagccatcatccaacggatgtacagtagatggagcctgtaccatactcgaactaaagatctcaaggattttataagggttcaccacctgccacagcagttgaaacagcgcatgctggagtacttccagaccacctgcttctag

SEQ ID NO: 44988 - DNA, 399 bp, Artificial Sequence
  Description of Artificial Sequence: Synthetic coding sequence
atggaggccgagggcctggactggctgctggtgcccctgcaccagcttgtgtcgtggggggcagccgcagctatggttttcgggggggtggtgccctatgtgcctcaatacagagatattagaaggacacagaacgcagatggcttcagcacatatgtgtgcctggtgctcctggttgccaatattcttagaatccttttttggtttggtcgcagattcgagtcccctctgctgtggcaatccgcgatcatgattctcacaatgctgctcatgctgaagctttgtacggaagttagggtggccaatgaactcaacgccaggcggcggagcttcaccgctagtcgctggtgctcttgcggacccgtcgtcactccatctagacgacccacttcctgctag

SEQ ID NO: 44989 - DNA, 762 bp, Artificial Sequence
  Description of Artificial Sequence: Synthetic coding sequence
atggaggccgagggcctggactggctgctggtgcccctgcaccagctcgtatcctggggtgcagctgccgctatggtgtttggaggtgtggtcccgtacgtgccgcagtacagagatatccgcagaacacagaacgccgatggattttccacttacgtgtgcttggtcctgctcgtagccaatatcctacgtatactattttggtttgggagaaggttcgaaagcccgcttctttggcagagcgccattatgattctgaccatgctgctgatgctaaaactttgcacagaggtgcgggtggcaaatgagctgaatgcaaggagacggagtttcaccgacttcgaccctcaccatttctggcagtggagttccttcagcgactacgtgcagtgtgtgttagcctttactggggtcgccgggtacataacatatctgagcatcgatagtgctttatttgtggaaaccctgggctttttggccgtcttgaccgaggctatgctgggggtgccccaattataccgaaaccatcggcaccaaagtaccgaaggcatgtctattaaaatggtgctcatgtggacttctggcgatgcttttaagaccgcatatttcctgcttaagggtgccccccttcaattctcggtgtgcggtctgttgcaggtattggtcgatctggcaattctggggcaggcctacgcgttcgctcggcacccacaaaaacctgctcctcacgcagtccacccaaccggcactaaggccctttag

SEQ ID NO: 44990 - DNA, 816 bp, Artificial Sequence
  Description of Artificial Sequence: Synthetic coding sequence
atggaggccgagggcctggactggctgctggtgcccctgcaccagctggtgtcctggggtgctgcggctgcgatggtcttcgggggagttgttccttatgtcccgcagtaccgtgatatccggcggacacagaacgccgacggtttctcgacatacgtctgcttggtcctccttgttgccaacattcttcgaattctgttctggttcggtcgccgatttgagtcacctctgttatggcagtccgccattatgattttgacaatgctccttatgctgaaactgtgcacggaggtgagggttgcaaacgagctcaatgctaggcggcgttcctttacagccgccgatagcaaggatgaggaagttaaagtggcccctcgacgatcatttctagattttgacccccaccacttttggcagtggtcttctttcagtgattacgtgcagtgtgtacttgccttcactggggtagcaggctacatcacgtacctgagtattgattccgcgttattcgtagagaccttggggttcctggccgtgctcacagaagccatgcttggtgtgcctcaattatatcgcaatcaccggcatcaaagcacagagggaatgagcattaagatggtactgatgtggactagcggagatgcattcaagacagcctatttccttttgaaaggcgctccattgcagttttctgtctgtggtctgcttcaggttctggtcgatcttgcaatactgggccaggcctacgcttttgctcgtcatccccaaaagcccgctcctcacgccgtccatcccaccggcaccaaagccctttag

SEQ ID NO: 44991 - DNA, 399 bp, Artificial Sequence
  Description of Artificial Sequence: Synthetic coding sequence
atggaggccgagggcctggactggctgctggtgcccctgcaccagctagtcagttggggcgccgcagcagctatggtgttcggaggagtagtgccttatgtgccccagtatcgtgacatcaggcggacacaaaacgcagatgggttcagtacttatgtgtgccttgttctgttggtcgccaatatacttcgtatcttattctggtttggtagaagatttgaatcaccgctgctctggcagtccgcaattatgatactgaccatgctgctgatgttaaaactgtgcacagaggtgcgtgtcgctaacgagctcaacgcccggcgcagatcattcactgcctccagatggtgctcctgcggccccgtggtcacaccctcccgccgtcccactagctgctag

SEQ ID NO: 44992 - DNA, 876 bp, Artificial Sequence
  Description of Artificial Sequence: Synthetic coding sequence
atggtgtggaagaagctgggcagccggaacttcagcagctgcccctccgggtccattcagtggatctgggatgtcttgggggagtgtgcccaggatggctgggacgaggcaagcgttgggctaggcctgatttccatcctgtgtttcgccgcttccacatttcctcaatttatcaaagcctataagactggaaacatggaccaggctctcagtctctggttcttgttaggatggataggaggagactcttgcaacctgattggctccttcctagccgaccagttgcccctgcaaacctacaccgccgtctattacgtactcgccgatcttgttatgctaaccctgtacttctattacaagtttcggactcgtccgagcctgctgagcgctccaataaacagcgtcctgcttttcctgatgggtatggcctgtgccacccctctcctgagtgccgccgggccagtggccgctcctagagaggcctttaggggtcgtgccttactgtccgtagagtcggggtctaaaccttttaccaggcaagaagtgattggttttgtgatcggctccatctcctccgtcctgtacttactatcacgattgccacagattagaaccaattttcttaggaagtctacccaggggattagctactccctgtttgccctcgtgatgttaggaaacacgttgtacgggctctctgtgctgctgaagaaccccgaggaggggcagagtgaaggatcataccttttgcaccatctgccctggttagttggctcgctgggcgtgctgttgctggacaccatcattagcatacagtttctggtataccgccgcagcactgccgcctcagaactggagccactgctgccctcttag

SEQ ID NO: 44993 - DNA, 876 bp, Artificial Sequence
  Description of Artificial Sequence: Synthetic coding sequence
atggtgtggaagaagctgggcagccggaacttcagcagctgcccctctggtagtatccagtggatctgggatgtgctaggcgagtgcgcacaggacggctgggacgaggcttctgttggccttgggctgatatctatcctctgttttgcggcttcaacatttccccagttcattaaagcctacaaaacagggaacatggatcaggccctgagtctgtggtttctgcttggatggatcggcggcgattcctgcaacctgatcggatccttcctagccgatcagctcccgttacagacctacacagcggtgtactacgtgctggcggatctggtgatgttgacactgtatttctactacaaatttcggacacgcccttccctactcagcgcccctattaactccgtgctgttgtttctgatgggcatggcctgtgctactcctctcctgtctgctgctggtcctgtggccgcacctagggaggccttcaggggccgggctctcttgagtgttgaatctggcagcaaaccttttactagacaggaggttatcggttttgttatcgggtcaatttcgagcgttttgtatcttcttagcagactgccccagatcaggaccaactttctgcgcaaatctactcagggtatctcttactcactttttgccctagtaatgctcggcaacacgctgtatggattgagcgtgctgctgaagaatcccgaggagggccagtctgaagggtcttatcttttgcaccatctgccctggctcgtcggaagtctgggcgttttactgttagacacgatcatcagcattcaattcttagtgtatcgacggtctaccgcagcgtctgagcttgaaccactgcttccctcgtag

SEQ ID NO: 44994 - DNA, 681 bp, Artificial Sequence
  Description of Artificial Sequence: Synthetic coding sequence
atggaccaggccctgagcctgtggttcctgctgggctggatcggcggggactcctgcaatctgattggcagctttttagccgaccagttgcccctgcagacctataccgcggtctactacgtactcgccgacctcgtgatgctgacactctacttctattataaatttcgaacccggccgtccttgctgtccgctcctataaactctgttctcctatttcttatgggaatggcttgtgctacccccctcctgtccgccgctgggccagtggctgccccacgggaggcctttaggggacgggcgctgttgtctgtcgagtcagggtccaagcccttcacaaggcaggaggtgataggctttgtgatcggatcaatcagcagtgtgctctatttattgtctaggctgccccagatcagaactaacttcctgagaaagtcaacccaagggatctcctattcattgtttgcgttggtaatgctggggaacacactttacggcctttctgtgctgctcaagaatccagaagaagggcagtcagagggctcataccttctccaccatcttccctggctggtgggaagcttgggggttttgttattagacactattatttcgattcagttcctggtgtacagacggtccactgcggcttcagagctggaacctttgttaccctcgtag

SEQ ID NO: 44995 - DNA, 609 bp, Artificial Sequence
  Description of Artificial Sequence: Synthetic coding sequence
atggaggccgccctgctgggcctgtgcaactggagcaccctgggcgtttgtgcggctctcaaactgccacaaatatccgccgtcctcgctgctaggtccgccaggggcttgtccctgccctctctgctgttagaattggctggttttcttgtgtttttgcgataccagtgttactacggctacccaccattgacatacctcgagtatcccatactaatcgctcaggacgtgatacttctattatgcatcttccatttcaacggtaatgtgaaacaggccactccgtatatagccgtgctggtcagttcctggtttatcctagcattacagaaatggatcattgacctggccatgaacctgtgtaccttcatttcggccgctagcaagttcgcacagcttcagtgcctgtggaaaaccagggactctggtaccgtgtcggcgctcacctggtctctgtcctcctatacctgtgctaccagaattatcactacgttaatgacaaccaatgactttactattctgctcaggttcgtgatcatgttggcccttaacatctgggtgacagtcactgttctgcggtatcgcaagaccgcaattaaagccgaatag

SEQ ID NO: 44996 - DNA, 567 bp, Artificial Sequence
  Description of Artificial Sequence: Synthetic coding sequence
atggaggccgccctgctgggcctgtgcaactggagcaccctgggcgtgtgtgctgcactgaaactgccccagatatctgctgtgctggcggccagatccgcccgcgggctatcactccccagtctgcttttggaactggctggtttcttggtgtttctgcgatatcaatgctactatggttatccccccctcacgtatctggaataccctatccttatcgcacaggatgtgattctcctactgtgcatttttcactttaacgggaatgtgaaacaagcgacaccatacatcgccgttctcgtgtcatcttggttcatccttgcgctacaaaagtggattatagatctggcaatgaacctgtgtacctttatctcggcagcttcgaagtttgcccagctgcagtgtttgtggaaaacacgcgattcggggaccgtgtccgcactgacctggtccctttccagctatacttgtgcgattctcctccgcttcgtgatcatgcttgctcttaacatctgggtgactgtgacagtgcttagataccggaagaccgccatcaaagcagagtag

SEQ ID NO: 44997 - DNA, 2127 bp, Artificial Sequence
  Description of Artificial Sequence: Synthetic coding sequence
atgagccagtacaccgagaaggagcccgccgccatggaccaggagtccggaaaggccgtgtggcccaagccggccggcggctaccagaccattaccgggcgccggtacgggaggcgtcacgcttacgtcagctttaagccgtgtatgacccgtcacgagcggtcactgggccgagccggggacgactacgaggtcctggagctcgacgatgtgcctaaagagaatagtagcgggagcagtccgttggaccaggtggacagttcccttccatcagagcctatcttcgaaaagtcagagacagaaatcccaacctgtggcagtgccctaaatcaaacaacagagagttcccagtccttcgtcgcagtccaccattccgaagagggccgggatacactgggatcgagcactaatctccacaaccattctgaaggcgaatatatccccggtgcctgttctgcttcaagcgtgcagaacggcattgcacttgtccacacagactcatacgaccctgatgggaagcatggggaagacaatgaccacctgcagctcagcgcagaagtcgtcgaaggctccagatatcaagaatctctgggaaataccgtgttcgagctcgagaacagagaggccgaagcatacactgggctctcacctcctgtaccatcattcaactgtgaggtgagggatgaattcgaggaactggactctgttcctttagtcaaatcctccgccggcgatacagagttcgtccatcagaatagtcaggaaatccagcgatcaagccaagatgagatggtttctacaaagcaacagaacaatacctcacaggaaagacaaactgagcacagtcctgaggacgcagcttgcggaccaggccacatttgttctgagcagaatacaaacgatcgcgagaagaaccatgggagtagcccagagcaggtggtgaggcctaaagtccgcaagctcattagttcctcccaggtggaccaagagacgggtttcaatagacacgaagccaaacaacgttccgtgcagcggtggagagaagcgcttgaagtggaagagagcggatctgatgatctgcttatcaaatgcgaggagtatgatggagaacacgactgtatgttcctggaccccccatacagtcgagtgataacccagcgagagaccgagaacaaccagatgaccagcgagtccggtgctacagcaggcagacaagaagtggataacacattttggaacggatgcggagattattaccaactatacgacaaggacgaggattcatctgagtgttcggacggggaatggagcgcgagcctgcctcacagattttctgggaccgaaaaggaccagtcatcatcagatgagtcttgggagacactgcctgggaaagacgagaacgagcccgagctgcaaagcgatagcagcgggccagaggaggaaaaccaggaactgagtctgcaagagggagagcaaacctccctcgaagaaggcgagattccatggcttcagtacaacgaggtgaatgaatcatcgagcgacgagggaaacgagccagccaacgagttcgcccagccagcgtttatgttggacggcaacaataacctggaggacgacagcagtgtgtccgaggaccttgacgtagactggagtctgtttgatgggtttgcagacggactgggagtggccgaggctatttcgtacgtcgacccccagtttctgacttatatggcgttggaagaaaggctcgcgcaagccatggagactgctctggcacatctcgaaagcctggccgtcgacgttgaagtagctaaccccccagccagtaaagagagcatcgacgggttacccgagactctcgtgttggaagaccatactgccataggccaggaacagtgttgcccaatctgttgtagcgaatacatcaaagatgacatcgccaccgagttgccctgtcatcacttctttcacaaaccctgtgtgagtatatggctgcagaaaagcgggacttgccctgtctgtagacgacactttccgcctgctgtgattgaagcaagtgcggctcctagctcagaacccgatcctgacgcccccccttctaacgactccatcgcagaggcaccatag

SEQ ID NO: 44998 - DNA, 2127 bp, Artificial Sequence
  Description of Artificial Sequence: Synthetic coding sequence
atgagccagtacaccgagaaggagcccgccgccatggaccaggagagcggcaaggctgtgtggccaaaacctgccggagggtaccagactatcacgggaagaaggtacggaagacgacacgcctatgtgagttttaaaccatgcatgacccgtcacgagcggtccctcggaagagcaggggacgactatgaggtgctggagctggacgacgtccccaaggaaaattcctctggcagctctcccctggaccaggtagactcgtctctgccttcggagcccatttttgagaagtctgaaaccgagatacccacatgtggttctgccctgaaccaaacaactgagtctagtcagtctttcgtggctgtgcaccactcagaagaaggaagagatacactgggatcatcaacaaacctgcacaatcactcagagggtgagtacatccctggagcttgctccgcctcctcagtacagaatggaattgcgcttgttcatacagacagttatgaccctgacggtaaacacggagaagacaacgatcacctgcaactctccgccgaagtggttgaagggtcacggtaccaagagagcctaggcaacactgtgttcgaactggagaaccgggaggcggaagcctataccgggcttagtcctcccgtccccagcttcaactgcgaggtgagagacgagttcgaggaactagatagcgttcccctggtgaagagctccgctggagatactgaatttgtacatcaaaacagccaggagatccagcggagtagccaggatgaaatggttagtactaagcagcagaataatacctcacaggaaagacagactgagcactcaccagaagatgctgcttgtggacccggccacatatgcagtgaacagaatacaaacgaccgggaaaaaaaccacggctcatcgccagagcaggtcgtgcgacccaaggtgagaaaacttatctcgtccagtcaggtcgaccaggaaactggattcaatcgacatgaggcaaagcaaaggtctgtgcaaagatggagggaggctttggaggtggaagaaagcgggagcgacgacctgctaatcaagtgtgaggagtatgatggcgaacacgactgcatgttcctcgatcccccttatagccgggtcatcacccagagggaaaccgagaataaccaaatgacttcagaaagcggcgctacggctggccgccaggaagtcgacaacaccttttggaatggctgtggggactattaccagctctacgacaaagatgaagattcgagtgagtgttccgacggcgagtggagtgcatctctgccacataggttctctggaaccgagaaagatcagagctcctcagatgagtcctgggagacattacccggtaaagatgagaacgaacccgagctccagtccgatagctccgggcccgaggaagaaaatcaggagctaagcctgcaagagggcgagcagacctccctggaggagggcgaaattccctggctccagtacaacgaggtcaatgaaagcagttctgacgaagggaacgaacccgcgaatgagtttgctcagcctgcatttatgttggacggaaacaacaacctggaggacgattcctccgtgtctgaagatttagatgtcgactggagcctgtttgatggattcgccgacggcctgggagtcgcggaagccatatcttacgttgacccacagttcttgacttacatggccctggaggaacggcttgcacaggccatggagactgccttggcgcatttggagtccttggctgtcgacgtggaggtggccaacccaccggccagcaaagagagcattgatggattgcccgagacgttggtcctcgaagatcatacagctatcggacaggaacagtgttgtcctatttgttgtagcgagtatatcaaagatgatattgccacagagctcccttgccaccacttcttccataaaccatgtgtttccatttggctccagaagtctggaacttgtccagtatgccgccgccactttccccccgctgtgatcgaagcctccgcggccccctcaagcgagcccgacccagacgccccaccgtctaacgacagtatagcagaagctccttag

SEQ ID NO: 44999 - DNA, 570 bp, Artificial Sequence
  Description of Artificial Sequence: Synthetic coding sequence
atgggcgtgagcgtggacgtgcaccaggtgtacaagtaccccttcgagcaagtggtcgcaagctttcttcgcaagtaccctaatccaatggacaagaacgtcatcagcgtcaaaataatggaagagaagcgcgatgaatcgactggtgtgatctaccgtaagcgcatcgcgatatgccagaacgtggttcccgagatactcagaaaatcactgtcaacactcgtaatcctctgttggaagaaggtgtcaattctcaaggtgcccaacatacagctagaggaagaatcctggctcaatccaagggaacgaaacatggccataaggtcacattgccttacctggacccagtatgcctctatgaaggaggaaagtgtctttcgtgagagtatggaaaaccccaattggacggaatttattcagcgtggtagaatctccatcaccggcgtgggatttttgaattgcgtcctcgaaacgttcgctagtacattcttgcggcaaggggcgcaaaagggaattaggatcatggaaatgctgttgaaggaacagtgcggggcccctttggcggagtag

SEQ ID NO: 45000 - DNA, 534 bp, Artificial Sequence
  Description of Artificial Sequence: Synthetic coding sequence
atgggcgtgagcgtggacgtgcaccaggtgtacaagtaccccttcgagcaggtggtggcctctttcctaaggaaatacccaaatcctatggacaagaacgtgatctctgttaagataatggaggagaagcgagatgagtcaaccggcgtcatatataggaagagaattgcgatttgtcaaaatgtggtgcccgaaatcctcaggaaggtgtctatactgaaggtccccaatatacagctagaagaggagtcatggctgaacccaagagagcgcaacatggctattcgatcacactgtcttacatggacccagtatgccagcatgaaggaggagagtgtttttcgcgaaagtatggagaatcccaattggaccgaattcatccaaagggggaggatttctattacaggagtgggctttctcaactgtgtcctggaaactttcgcttcaacctttctgcgccagggagctcaaaagggcatccgtatcatggagatgttattaaaagagcagtgcggtgcaccactggctgagtag

SEQ ID NO: 45001 - DNA, 447 bp, Artificial Sequence
  Description of Artificial Sequence: Synthetic coding sequence
atggacaagaacgtgatcagcgtgaagatcatggaggagaagcgggacgagtccactggagtcatatatcggaagcggatcgccatctgtcaaaacgtcgttcccgagattctgcgcaaagtttctattctgaaggtacccaacatccagctggaagaagagagctggcttaatccgcgcgaaagaaacatggccatccgaagccattgcctaacttggacacagtacgcctcgatgaaggaagaatccgtgtttcgagaaagcatggaaaacccaaattggaccgaattcattcaacgcggacgcataagtattacaggagtcggatttttgaactgcgtgctggagacctttgcctctacctttcttcggcaaggggcacagaagggcattcgcattatggagatgctgctaaaggaacagtgtggcgcacctctcgccgagtag

SEQ ID NO: 45002 - DNA, 267 bp, Artificial Sequence
  Description of Artificial Sequence: Synthetic coding sequence
atgcaccagaagctgctgaagagcgcccactacatcgagctgggctcataccagtattggcctgttctggtcccccgtggaatcaggctttacacatacgaacagattcccggatccctaaaagacaacccatacataactgatggctaccgtgcctatctccccagtcggctgtgtattaaacgaagcgtatgctttgccctgtgggcgatcatttttttccctgcaatcggacagaaaaagcacgtggaggatgggtggcattag

SEQ ID NO: 45003 - DNA, 876 bp, Artificial Sequence
  Description of Artificial Sequence: Synthetic coding sequence
atgcaccagaagctgctgaagagcgcccactacatcgagctgggcagttaccagtattggccagtgctagtgcccagaggcatcagactctatacctacgagcaaatcccaggcagtcttaaagacaacccttacataacggacggatatcgcgcctatcttccaagccgtctctgtattaagtctctgtttatactgagtaacgaaacggtaaacatatggtctcacctcttgggattcttcctgttcttcacacttggcatctacgacatgacctctgttctgccgtccgctagcgcatcgcgagaagactttgtcatttgcagtatttgcctgttctgctttcaggtctgtatgctctgctccgtggggtatcacctgttctcttgccaccgttcagagaagacatgtcgcaggtggatggcactggattatgccgggattagcataggtattctggggtgctacgtctctggtgtcttctatgctttctactgcaacaattattggaggcaagtctacctcattacagtgctggctatgatcctcgccgtcttcttcgcacagatccatccaaattatctgactcagcagtggcagcgattacgttccatcattttttgttccgtaagcggttatggcgtcatccccaccttacactgggtgtggctcaacggtgggattggcgctcctatcgtccaggactttgcccctcgagtgattgttatgtatatgatcgccctccttgcgtttctgttttatattagcaaggtccccgagcgctatttccctgagaacatcttccgttggaaaatcacaaagcgaacattaggcggggtgaacaattcactgcagaacctgtatctgctggtgtag

SEQ ID NO: 45004 - DNA, 936 bp, Artificial Sequence
  Description of Artificial Sequence: Synthetic coding sequence
atgcaccagaagctgctgaagagcgcccactacatcgagctgggcagctatcagtactggcctgtgctggttccacggggaatccgtttatacacgtatgaacagatacccgggagtctgaaggacaatccatacatcactgatggctaccgagcctacttaccctcgcgcctgtgtattaagtccttattcattctttccaacgaaactgtaaatatttggagccatctgctgggcttcttcctgttcttcacgctcggtatttacgatatgacctctgtgttgccaagtgccagtgccagcagggaagactttgtgatatgcagtatctgtcttttttgcttccaggtgtgcatgttatgtagtgtgggatatcatctgttctcttgccaccggtctgagaagacctgccgccgttggatggccctggactacgcagggatctctattggtattctcgggtgctatgtgtccggggtgttctatgcattctattgcaataattattggcggcaggtgtacttaatcaccgtgctagcaatgatcctggccgtgttttttgcccagatacatccaaattatcttacccagcaatggcaacgactgcggtctattatcttctgttctgtgagcggttacggggtgatccctaccctgcactgggtctggctgaacgggggaataggtgcccctatcgtccaagatttcgctccaagagtcatcgtgatgtacatgatagctctcttagcctttctgttttacatatcaaaggtcccagaacgctacttccccggacaactcaactatttggggagcagccaccaaatctggcatatcctggccgttgttatgctgtactggtggcaccagagcacagtttatgtgatgcagtaccgtcatagtaagccatgtcccgactatgtgagccatctgtag

SEQ ID NO: 45005 - DNA, 936 bp, Artificial Sequence
  Description of Artificial Sequence: Synthetic coding sequence
atgcaccagaagctgctgaagagcgcccactacatcgagctgggcagctaccagtattggcctgttctggtgccccggggtatcagactgtacacatatgagcagatccctggaagcctaaaggataatccatatattacggatggctacagagcatacctgccctcccgtctgtgcattaagtcactgttcatcctctccaatgagactgtcaacatctggtcgcacctactggggttctttctgttcttcacactgggaatttacgacatgacttcagtactgcccagcgcatcggcctcccgtgaagacttcgtcatctgcagtatttgtctcttctgcttccaagtctgtatgctttgctccgtgggctatcaccttttcagttgtcacaggtccgagaagacttgccgccgatggatggcgctggactacgccggaatcagtatcggcatcctagggtgctatgtgtctggggttttttatgcattttattgcaataactattggagacaggtgtatctgatcacagtgctcgcaatgatcttggccgtgttctttgcacagatccatcctaactacctcacccagcagtggcagcggttgagaagtataattttctgtagcgtgagtggatatggagtgatccccaccctgcattgggtctggctgaacggtggaatcggcgcacccattgtgcaagatttcgcaccaagggtaatcgtgatgtatatgatcgcactcctcgccttccttttctacataagcaaggtgcccgagcgatacttccccgggcaattgaattatctgggttcctcccatcagatttggcacatcctggccgtggtcatgctctattggtggcaccagagcacagtttatgtgatgcagtacagacactccaagccatgtccggactacgtgagccacctctag

SEQ ID NO: 45006 - DNA, 600 bp, Artificial Sequence
  Description of Artificial Sequence: Synthetic coding sequence
atggccttcctggccggcccccggctgctggactgggccagcagccccccccacctccagttcaacaaatttgtattgaccggataccggccagccagtagcggatcaggctgtctgaggtcactgttctatcttcataacgagctgggcaatatttacacccatggcgcgctacccattatccactgcactctggcttgccgaccatggctgcgtcccgcagcactcgtcggttacacagtgctgtccggagtggcaggctggagggccctgacagcaccttctacctctgccaggctacgagcatttggctggcaggccgctgcacgactccttgtttttggcgccaggggcgtaggtctgggctctggcgccccaggctcgttgccatgctatctgcgaatggatgctctggccctcctcggcggcctggtcaacgtggcgcgactgcctgaaagatggggccccggcagatttgactactggggcaattcccaccagattatgcacctgctttccgttggtagcatcctccagttacatgccggtgtagtacccgacctgttgtgggctgcccaccacgcctgcccaagggattag

SEQ ID NO: 45007 - DNA, 822 bp, Artificial Sequence
  Description of Artificial Sequence: Synthetic coding sequence
atggccttcctggccggcccccggctgctggactgggccagcagccccccccatctgcagttcaataaatttgttttaactggatataggccggctagttccgggtcaggatgcctaagatcgctcttctatctgcataacgaactgggtaacatctacacccacggtctggcccttctgggcttcctggtgctggtacccatgaccatgccctggggacagctgggcaaagacggctggctaggtggaactcattgtgtcgcttgccttgctcctcctgccgggagtgtcctgtatcacctgttcatgtgtcaccagggaggcagcgccgtttatgcacgcctgctggcgctggatatgtgtggagtgtgtttggtcaatacacttggggctcttcctattattcactgtacacttgcctgtagaccttggttgcgccctgccgccctggttgggtataccgtcctgagcggcgtggccggatggagagccctgactgctccgagcacatccgcaagactcagagcttttggatggcaagctgccgctcggttgctggtcttcggcgctagaggcgtgggcttgggcagcggagcaccggggagtctgccttgctatttgcgaatggatgcactggccctgctgggaggcctcgtgaatgtggccaggctccctgaaaggtggggaccaggaaggtttgactattggggcaactcccaccagatcatgcatctgctgtctgtggggtctattctgcaactgcacgcaggtgtcgtccccgatctgctttgggctgctcatcacgcctgtccccgcgactag

SEQ ID NO: 45008 - DNA, 1134 bp, Artificial Sequence
  Description of Artificial Sequence: Synthetic coding sequence
atgccccggcggctgcagccccggggcgccggcaccaagggcccccccgcaccagcaccggcagcaagcggcgccgcccggaattctcacagtgccgccagcagggatcctccggccagcgctaaacctttgctccgctgggacgaggtaccagatgactttgtggaatgcttcattctctctgggtaccggaggcttccttgcaccgcccaggaatgtctggcaagtgtcctgaagccgactaacgagacgctgaatttctggacccattttatccctctgctgctcttcctatccaaattttgccggcttttttttttgagtggcggcgacgtaccattccaccatccttggctgttaccattatggtgttatgcatccggcgtgctcctcacattcgcgatgtcctgtactgctcatgtgttttcctgtctcagcctcaggctgcgtgctgccttcttctacttagattatgctagtatcagctactatgggttcggcagcaccgttgcctactactattacttattgccagggcttagtctcctggatgcacgagtgatgacaccatatctccagcagcggctaggatggcacgtagactgtactcggttaatagctgcctacagagccctggtcctgcctgtggcctttgtactggctgtggcatgcacagtggcatgctgtaagtctcggacggactggtgtacctaccccttcgctcttcgtacattcgtgttcgttatgcctctctctatggcttgcccaatcatgctggagtcctggctctttgatctcagaggagagaatccaacccttttcgtgcacttctacagaaggtacttctggctggttgtggctgctttctttaacgtctcgaaaattccagaacgcattcaaccagggctttttgacatcatagggcatagccaccagctgttccacatttttacatttcttagtatctacgatcaggtctactatgttgaggaaggactgcgccagtttctgcaagcccccccagcggctccaaccttcagcggcactgtggggtatatgttgttgctcgtagtgtgtctggggctggtaatccggaaatttctgaattcctccgagttttgctctaagaagtag

SEQ ID NO: 45009 - DNA, 993 bp, Artificial Sequence
  Description of Artificial Sequence: Synthetic coding sequence
atgctgagcctgaagctgccccggctgttcagcatcgaccagatcccacaggtctttcatgaacaggggatcctgtttggctataggcacccacaatcctccgccactgcctgcattctgtctctgtttcagatgaccaacgagacactgaatatctggacccatctcctcccgttttggttcttcgcatggcggttcgtgacagcactctacatgacagatattaagaacgatagctactcctggcctatgctggtgtacatgtgcacttcatgcgtctatcccctggtgtcgtcctgcgcccacacattctctagcatgtctaagaacgcccgccacatctgttactttctagattatggtgcggtgaaccttttctctcttggcagtgcaattgcatactccgcttacacttttccggacgctctcatgtgcactacgtttcatgattactacgtggccctggccgtgttgaacacaatcctgagcactggcttgtcctgttacagccggttcttagagatccaaaagcctcgcttgtgtaaggtgatcagagtcctcgccttcgcatatccctatacgtgggattcactccccattttctatcgacttttcctttttcccggcgagtctgctcagaacgaagcaacatcataccatcagaaacatatgatcatgacccttctcgcatcattcttatactcagcgcatctgcctgaacgcttggctccagggcgtttcgactatattggacactcccatcaattgttccatgtgtgtgtcattctcgccacccacatgcagatggaggcaatcttgctagataagacactgaggaaggaatggctgctggctacgtcaaagcccttcagtttttctcagatcgctggagctatcctcctgtgcatcatcttcagcttaagtaacattatttatttctcggcagccctgtacaggattcccaagcctgaactgcataaaaaggaaacttag

SEQ ID NO: 45010 - DNA, 993 bp, Artificial Sequence
  Description of Artificial Sequence: Synthetic coding sequence
atgctgagcctgaagctgccccggctgttcagcatcgaccagatcccacaggtgtttcacgaacagggaatcctcttcggttacagacatccgcaatcatctgccactgcctgtattttatcgctcttccagatgacaaacgagacgctgaacatctggacccacctattgcccttctggttcttcgcatggcgattcgtcactgctctgtacatgaccgatatcaagaacgactcttactcgtggccgatgctggtatacatgtgtacgtcctgtgtgtaccctctggtttcctcctgcgcacacacatttagtagcatgagcaaaaacgcgagacatatttgttatttcctagattacggggccgtgaacctgttcagtctgggcagcgccatcgcctacagcgcgtacacattccccgatgccctcatgtgtaccactttccatgactattatgtcgctctggctgtgcttaacacgattctctcaactgggctgtcatgctacagccggttcctggagatacagaagccccgactgtgcaaagtgatcagggtactggcatttgcctacccctatacatgggatagtctccccatcttctatcgcttgttcctcttccctggagagagcgcccagaatgaagccacaagctaccatcaaaaacatatgatcatgacactcctggccagcttcttgtactcggcccaccttcccgagagactggcacccggcagatttgattacatcgggcattctcatcagctgttccacgtgtgtgtgatccttgcgactcacatgcagatggaggcaattttacttgataagaccttgaggaaagaatggctcctggcaacctcaaagcccttcagcttcagccagattgcaggcgccatactgctgtgtatcatatttagtcttagtaatatcatctacttctcagccgccctgtatagaatcccgaaaccagaactgcacaaaaaagaaacatag

SEQ ID NO: 45011 - DNA, 993 bp, Artificial Sequence
  Description of Artificial Sequence: Synthetic coding sequence
atgctgagcctgaagctgccccggctgttcagcatcgaccagatcccacaggtgttccatgagcagggtattctattcggctataggcatccacagagcagtgccactgcctgcatcttgtccctgttccagatgacaaatgaaaccctgaacatctggactcacctgctgcccttttggttctttgcctggcgtttcgtcactgcactgtacatgaccgacattaagaatgatagctacagctggccaatgctcgtctatatgtgtacctcttgtgtctatcctcttgtgtccagctgtgcccacaccttttccagcatgtccaagaatgcccgacacatttgttatttcttggactacggagccgtaaacctgttttcactaggcagcgctattgcctactcagcatacacctttcctgacgcactgatgtgtaccacattccacgactattacgtggccctcgctgttctcaacaccatactttcgacaggcttgtcctgctactcccgctttctggagattcaaaagccccggctgtgtaaagtcatccgggtcctcgccttcgcgtacccgtacacttgggattcactgcctatcttttaccgcctgttcctgttccctggcgagagtgcccagaacgaagctacatcttaccatcagaaacacatgatcatgacgttgttagcgtctttcctgtatagcgcccacctgccggaaagacttgcccccggtcgattcgactacatcggccactcccatcagttatttcatgtgtgtgttatcctggccactcatatgcagatggaggccattctgcttgacaagaccctgaggaaggaatggctcctggctaccagtaaaccgttcagtttctcgcaaatagcaggcgccatccttctctgcattatcttcagcctgtctaacattatttacttttctgcagcactgtatagaatcccaaaacccgaactgcataagaaggaaacttag

SEQ ID NO: 45012 - DNA, 1035 bp, Artificial Sequence
  Description of Artificial Sequence: Synthetic coding sequence
atgctgagcctgaagctgccccagctgctgcaggtgcaccaggtgccgcgagtattctgggaggacggcatcatgtctggataccgtcggccgacaagttccgcacttgattgcgtgctgtctagcttccagatgacaaacgagaccgtgaacatctggacccatttcctcccgacatggtacttcctgtggcgtctgctggccctggctggaggcccaggcttcagagctgaaccttatcattggcctctgttagtcttcctgctgcccgcctgcctgtacccttttgcgtcatgctgtgcccatactttctccagtatgagcccgcgtatgaggcacatctgttacttcctcgattatggcgcccttagcctttatagccttgggtgcgctttcccctacgctgcttactccatgcccgcatcctggctgcacggccatcttcaccaattctttgtgcccgcggccgccctgaactcatttctctgcactggcctgtcttgctactcacgtttcctagagctagagagccctggcctctccaaggtcctccggacaggcgcctttgcgtacccattcctattcgataacttacccctgttctacaggctggggctgtgctggggacgcggacatggatgtgggcaggaagcgctgtccacttcccatgggtatcacttgttttgcgctctgcttactggcttcctgttcgcgtcccatctccccgagcggcttgcacctgggcggtttgattacatcggtcacagccatcagttgtttcacatctgcgccgtgcttggaacccactttcaacttgaggctgtcctggcagatatgggtagtcgccgcgcctggctggctactcaggaaccggcactgggtttggccgggaccgtcgccacactggtgctggctgccgcgggaaacctgctgatcattgccgctttcacggctacgctgttaagagctccctcaacatgtccactgctgcaaggaggtccactggaaggtggaacccaggccaagcagcaatag

SEQ ID NO: 45013 - DNA, 1056 bp, Artificial Sequence
  Description of Artificial Sequence: Synthetic coding sequence
atgagcccccggatgcggcacatctgctacttcctggactacggcgccctctctctgtacagcctcgggtgcgctttcccttacgccgcctactcaatgccagcttcttggctgcacggtcatctgcatcagttcttcgtgccagcagcggccctcaactccttcttgtgcaccggcctatcctgctacagccgctttttggagctcgaaagccccggactgtcaaaggttctcaggacaggggcattcgcctatcctttcctgttcgacaacctcccactcttctatcggctaggcctctgctggggacgaggccatggatgtggccaagaggcccttagcacttcccacggatatcatcttttttgtgcactcctgactgggtttctgtttgctagtcatcttcccgagcggttagctcctggacgtttcgactatatcggggaggggactcctgggcctgcaagggaggaggctggtgcggacgccttcccggagcacaggatgaactgggccaccgccacttcttactctacatcagtgcagtgctgggcgccaacctcgtcctggagacagtgctggctcatttgggatcatgcagaacctggttggccacacaggaatctcccatgggcttggcaggctcagtggccacattggtcttggctccagctcggaacttactctctgctgttacttagccagcctccatgcttcggcccacccgttcacgctctgtgttgcagggtggcccactggaggggcgtgccgcgtccaaataactccgaggcgccatcgctcacactttcctggcgtggacaacgtcccggacccagcgcggatgaggagcctcgattcggccccaatcaggttggcacgcacctgtccctcgagcccacgggtgcagaggaaagaggccaccgcagggaagggcgagaagaagagggctgcctaggtgggctcgccgagtgcgagcgggatcgagaaggcgcactcgacggaagcgggaggtcggctgaaggcttaaggggggaaatgcacgcgtgccctggatag

SEQ ID NO: 45014 - DNA, 1092 bp, Artificial Sequence
  Description of Artificial Sequence: Synthetic coding sequence
accctgccccccagcgcctggctggccgccgccctggacagcgcccgaggtgccctgggactcctcacccaccagctgcggagcacacatcaagctttgggtgtcctaggtcgctggcaccacgtgtggttgccccctccacatcagctgggctttggtctctgtccccagctgttaccggatgaccagcgcgatgggcagcacttggactccttgccagcccatctggtccgaggggggagcgccccaggcagaggcctagaactacgcggaggcacgcaagctggaagagatagaccgggaccccgcgcagccgctgctgtggctggagttcggggcggtctgagcactcgaccaccccaggtgctgcccgtcgctgctcccggggccggcggtaggccccggttaccctgcggggcagttccacttgctgccgccggtttgcctgcagcccgtctccctctgccactccgtgtggtcctaagggcccacctacagctccacgttgcaccacatgcaccccacctccttcttccccgactgcgtagagctcaaccattacaatcgggattcctggagttggagagcccgggcttgagcaaggttctaagaacaggcgcatttgcgtatcccttcctgtttgataatcttcctctattctatagacttggactctgctgggggcggggacacgggtgtggccaagaagcattgagtactagccatggctatcacttgttttgcgccctgctgaccgggttcctgttcgcgtcgcacctgccggaacggcttgcacctggcaggttcgactatataggacacagccaccagctttttcacatttgcgctgtgctggggacccacttccagctggaggctgtcctggccgacatgggcagcaggcgggcctggctcgccacacaggaacctgctttaggtctcgctggcacggtggccacgctcgtcctggctgctgccggcaacctgcttatcatagcagcctttacagccactctgctaagagctcctagtacatgcccccttctccagggcggccctttagagggggggacccaggccaagcagcagtag

SEQ ID NO: 45015 - DNA, 1056 bp, Artificial Sequence
  Description of Artificial Sequence: Synthetic coding sequence
atgagcccccggatgcggcacatctgctacttcctggactacggcgcacttagcctgtatagcttggggtgcgcgttcccatacgcggcgtattcaatgcctgcaagctggctccatggacacctgcaccaattttttgttccagcagctgccctgaacagctttctctgcaccggactttcctgttactcaaggtttctcgaactggagagcccaggactgtccaaggtgttgagaacaggcgcgtttgcatatcccttcctgttcgacaatttgccactattttaccgtttaggtctgtgttggggtaggggccacgggtgcgggcaagaggccctaagtacttcccacggctaccacctattctgcgccttgttaaccggattccttttcgccagtcacttaccggagcgattggctccaggccggttcgattatattggtgaaggcacacccggtcccgcacgggaagaagccggcgccgatgctttccctgaacaccgcatgaattgggcaaccgcgactagctacagtacctctgtgcagtgctgggccccaactagctcttggcgccaatgctggctcatctgggaccatgctgagcctggctggccacatcgcaatctgccttgggcttggcaagctcagtggccccactggtcgtggctccagctggggacgtactcactgctgctgctgtcgcagcctccttgcttcggtccacctgtgcatgctttgtgctgtcgcgtggcccactggaggggagtgcctagacccaataacagcgaagccccgtccttaacactaagctggagagggcaacgtcccggcccctcagccgatgaggagccgcggtttggacccaatcaggttgggacccacctgagccttgaaccgaccggtgctgaagagagagggcacaggcgggaaggccgggaagaggaggggtgcctgggcgggctggccgaatgcgagagagacagggaaggagctctggatggtagcggtagatcggctgaggggctgcgtggagagatgcatgcctgtcccggctag

SEQ ID NO: 45016 - DNA, 1056 bp, Artificial Sequence
  Description of Artificial Sequence: Synthetic coding sequence
atgagcccccggatgcggcacatctgctacttcctggactacggcgcattgtcgctgtacagtctgggctgtgcatttccctacgctgcctacagtatgccagcatcttggctgcatgggcatttgcatcaattcttcgtccccgccgcagctcttaacagcttcctgtgcaccggcttgagctgctattctcgtttccttgaattggaatcaccaggcttgtccaaggttctgcgaaccggggcattcgcataccccttcttgttcgacaacttacctcttttttatagattaggcttatgctgggggcgcggccatggttgtggccaggaagccctcagtacaagccatggatatcacctgttttgcgcgttgctcactggattcctgttcgccagtcaccttccagaacgccttgccccggggcggttcgattacattggagagggtaccccaggacccgcaagggaggaagcaggggcagacgcgttccccgaacacagaatgaattgggccaccgccacatcttacagcacatccgtacaatgctgggcccctacctccagttggcgccagtgctggttaatttgggatcatgccgagcctggctggccccatcgaaatctaccatgggcatggcaggcccaatggccccactggagctggctgcagttgggaacatactctctgttactgctgagtcaacccccatgtttcggtcctcccgtacacgctttgtgctgcagagtcgcccattggcggggggtccctaggccaaataatagcgaagctcccagcttaactctgtcctggagaggccagcgaccagggccttctgcagacgaggagccaaggttcggacctaatcaggttgggactcatctgtctctggaaccaaccggtgccgaagaaaggggccaccgcagagagggcagagaagaggaaggctgcttaggcggcctggcggagtgtgagagagacagggaaggcgcactggatgggtccgggaggagtgcagaaggtctgcgcggtgagatgcatgcctgccccgggtag

SEQ ID NO: 45017 - DNA, 963 bp, Artificial Sequence
  Description of Artificial Sequence: Synthetic coding sequence
atgagcggctaccggcggcccaccagcagcgccctggactgcgtgctgtcatcttttcaaatgactaacgagacggttaacatctggacccatttcttgcccacgtggtatttcctgtggcgtttactcgccctggcggggggacctggttttcgtgctgagccgtatcactggcctctgttggtgtttctcctgccagcgtgtttgtacccatttgcctcctgctgcgctcatactttctcctctatgagtccaaggatgaggcacatttgttattttttggattatggggccctgtccctatattcgttgggctgcgcgtttccgtatgctgcctatagcatgccggcctcctggcttcacggtcacctgcaccaattctttgtgcctgctgcggccctcaattcgttcttgtgcaccggccttagctgttactctcgattccttgagttagagagcccaggtctgagcaaggttcttcgaaccggagcttttgcttatccattcctctttgataacctccccctcttctatagactgggactgtgttggggacgcggtcacggctgcgggcaggaagctctgagcacaagtcacggataccatctcttctgcgcactcttgacaggcttcctgtttgcctcacatctgccagaacgcttggcgcctggcaggtttgattacatagggcacagccatcagctgtttcatatctgcgcagtgctgggaacacatttccagctggaggccgttctggctgacatggggtctcgccgcgcttggctcgccacacaggaaccagcccttggcctggcaggaacagtggcaaccctggtcctggcggcagctggcaatctactaatcattgccgccttcacagcgactctgctgagggctccttctacttgtccccttctgcaggggggacccctcgaaggcggaacacaggccaagcaacaatag

SEQ ID NO: 45018 - DNA, 381 bp, Artificial Sequence
  Description of Artificial Sequence: Synthetic coding sequence
ctgcccctgcccctgcgggtggtgctgcgggcccacctgcagctgcacgttgcgcctcacgctccgcatctgctcctgccccgtctgaggaggtttgattacattgggcactcccaccagttgtttcacatctgtgccgttctgggaacccatttccagctcgaagccgttctggcggacatgggatccagacgggcctggctcgctactcaagaaccagctctaggcctggccggtacggtggccaccctggtgctggctgcagctggaaatttacttatcatagccgcattcacagccacactcctgcgtgcccccagtacttgccccctgctccagggcggacccctggaagggggaacacaggccaaacagcagtag

SEQ ID NO: 45019 - DNA, 1026 bp, Artificial Sequence
  Description of Artificial Sequence: Synthetic coding sequence
atgctgagcctgaagctgccccagctgctgcaggtgcaccaggtgttctgggaggacgggattatgtccggctacaggcgcccaacatctagcgcgcttgactgcgtgctttcttcattccagatgacaaatgagacggtcaatatttggactcatttcctcccgacatggtattttctttggagactgctggctctagcagggggcccagggtttagagcagagccctaccactggcctttactggtatttctcctacccgcttgcctgtaccccttcgccagctgctgtgctcacacattctcgtccatgtcccctcgcatgaggcacatttgttactttctagattacggcgccctcagcctgtactcactggggtgtgcgtttccatacgctgcatatagcatgcccgcctcctggctgcacggccacttacatcagttcttcgtgcctgctgcagccttgaatagtttcctgtgcactggcctgtcctgttatagcaggttcctggagttggagagccccgggctgtcgaaagtcctgagaactggcgcctttgcataccccttccttttcgacaacctcccattgttttaccgcttgggactatgctgggggcgtggccacggctgcgggcaggaggccctgagcacatcccacggctaccacttgttttgcgccctgctgacaggcttcctgtttgcttcgcacctcccagaaagactcgcccccggtcgatttgattacatcggtcattcccaccagctcttccacatctgtgccgttctgggcacccattttcagctggaggctgtgctggctgacatgggttcacgaagggcatggcttgccactcaggaacctgcactcgggctcgcaggaactgtggccacattggtgctggccgccgcgggcaatctgctgattatcgctgcctttacagccaccttactgcgggcgcctagcacgtgcccactgctacagggcggcccactggaaggaggcactcaagctaagcagcaatag

SEQ ID NO: 45020 - DNA, 1065 bp, Artificial Sequence
  Description of Artificial Sequence: Synthetic coding sequence
atgaccaccgccatcctggagcggctgagcaccctgagcgtgagcggacagcaactgaggcggctgccaaagattctggaggacggcctgcccaagatgccctgcacagtgcctgagaccgatgtgccgcagctgtttcgagagccctatattcgcaccggctaccggccaaccggacacgaatggaggtattactttttctccctgttccagaagcataacgaagtggtcaatgtgtggacacacctgcttgctgccctcgcagtcctgttgaggttctgggcttttgctgaggctgaggcactgccctgggccagcactcactccctgcccctcctgctcttcattctcagttcgattacctaccttacctgctcgcttctcgcccacttacttcagagcaaaagcgagctttcgcactatacgttctactttgtggattatgtcggggtgtccgtgtaccagtatggcagtgccctcgcccactttttttatagctcagaccaagcatggtatgatcggttttggctgttttttctgcccgccgccgcgttctgcgggtggctgtcttgcgcaggctgctgctatgcgaagtatagataccgccggccctacccagttatgaggaaaatctgccaggtcgtgcccgcaggattagcctttatacttgacatcagtcccgtagcccatcgagtcgctctgtgccacctcgctggatgccaggagcaagctgcatggtatcatactctccagatcctgttcttcctcgtaagcgcctacttcttcagttgtcccgttccagaaaagtacttccccgggtcctgcgatattgtagggcatggtcaccaaattttccatgcctttctctctatctgcacactttcgcaactggaggctatactcctcgactaccagggccggcaggaaatcttcttgcagcgccacggcccactgagcgtgcatatggcttgtttgagcttctttttcttggccgcttgctccgcggcaaccgccgctctgctcaggcataaggtgaaggcccgactaaccaagaaagattcctag

SEQ ID NO: 45021 - DNA, 1065 bp, Artificial Sequence
  Description of Artificial Sequence: Synthetic coding sequence
atgaccaccgccatcctggagcggctgagcaccctgagcgtgagcggccaacagctccgaagactgcctaagatccttgaggacggactgccaaaaatgccttgcaccgtgcctgagacagatgttcctcagctgttccgtgagccatacatccgaacaggatacagacccaccgggcatgagtggaggtattactttttttcccttttccagaagcacaatgaggtggtgaacgtctggactcatttgcttgccgcccttgctgtactcttacgcttctgggcattcgccgaggctgaagccctgccgtgggccagcacccacagcctgccgctgctgctgttcattttgtcttccattacatatctcacatgtagcctcctggcccatctgctgcaatccaaatccgagttgtcccactacacattttactttgtcgactacgtgggcgtgtccgtttaccagtatggatctgccttggctcactttttctattcctccgaccaggcctggtatgatcgattctggctgttcttcttgccggctgctgccttctgcgggtggctgtcctgtgctggctgctgttacgccaagtataggtatcgacggccatatcctgtgatgcgcaaaatctgtcaggtggttcctgccggtttagcctttattttggatatcagccccgtggcccatagggtagctctatgccacctcgcgggctgccaagagcaggcagcctggtaccacaccttacaaattctgtttttcctcgtgtctgcctactttttctcgtgccccgtgccggaaaaatacttccctggaagttgtgatatagtgggccacggccaccagatttttcatgcttttctttcaatatgtactcttagccagctcgaagcaatcttgctggattaccagggcagacaagaaatatttttgcaaagacatggacccctgagcgtgcacatggcttgtctgtcttttttttttctggctgcttgttctgccgcaaccgccgccctgctgaggcataaggtaaaagcacggctgacgaagaaggattcctag

SEQ ID NO: 45022 - DNA, 339 bp, Artificial Sequence
  Description of Artificial Sequence: Synthetic coding sequence
atgaccaccgccatcctggagcggctgagcaccctgagcgtgagcggacagcaactcaggaggctgccgaagatcttagaggatggcctcccaaagatgccttgcacagtccctgagaccgatgtgccccagctcttcagggagccctatatccgcactggatatcggcctacaggtcacgaatggcgctactacttttttagcctattccagaaacataacgaagtggttaatgtgtggacccatctgctggcagcactggccgtcctgctaaggttctgggcattcgccgaagcggaagccctgccttgggcaagcacccatagtcttccattatag

SEQ ID NO: 45023 - DNA, 576 bp, Artificial Sequence
  Description of Artificial Sequence: Synthetic coding sequence
atggccgcctacagctaccggcccggccccggcgccggccccggccccgcagccggagccgctctgccagatcagagtttcctctggaacgtattccaacgtgttgacaaagatagaagtggggttatcagcgatacggagttgcaacaagccctgagcaacggcacatggaccccattcaatcctgtgactgttagaagcatcatctccatgttcgaccgggaaaataaagccggcgtgaatttctccgaattcactggcgtctggaaatacatcaccgactggcagaacgtgttccggacttacgacagagataatagtggaatgatcgacaagaatgagctgaaacaggcattgtctggattcgggtatcgcctgtctgatcagtttcacgatatcttgattagaaaatttgacaggcagggtagggggcaaattgccttcgatgatttcatccagggctgtatagtactccaacgcctgactgatatcttccgcaggtacgacaccgaccaggacggatggatccaggtgtcctacgagcagtacctctcgatggtttttagtatcgtctag

SEQ ID NO: 45024 - DNA, 210 bp, Artificial Sequence
  Description of Artificial Sequence: Synthetic coding sequence
atggccgcctacagctaccggcccggccccggcgccggccccggccccgccgctggcgctgcgttacctgatcagagttttctctggaatgtgtttcagcgtgtggacaaagacagaagcggcgtgatttcagatacagagctgcagcaagctttatctaatgggacatggaccccattcaaccctgtgaccgtcaggagtatcatctag

SEQ ID NO: 45025 - DNA, 222 bp, Artificial Sequence
  Description of Artificial Sequence: Synthetic coding sequence
atggccgcctacagctaccggcccggccccggcgccggccccggccctgcagccggcgccgcccttccggatcagagctttctctggaacgtgttccaaagagttgataaggatagatctggggtgatatcagacaccgagctccagcaagccttgtctaatggtacatggacacctttcaacccagtgaccgtgcggagcataatatgtagaggccgatag

SEQ ID NO: 45026 - DNA, 570 bp, Artificial Sequence
  Description of Artificial Sequence: Synthetic coding sequence
atggccgcctacagctaccggcccggccccggcgccggccccggccctgccgcaggagctgctcttcccgaccagagctttttatggaacgtcttccagagagttgataaagatagatccggggtgatctccgacacagagctccagcaggccctgtccaatggcacttggacccccttcaaccccgtcaccgtcagaagcattatatcaatgtttgacagggaaaacaaggcaggagttaacttctccgaatttactggtgtttggaagtatattaccgactggcagaatgtgttcagaacttatgaccgtgataattctggtatgattgataagaatgagctgaaacaggcactgtcaggatatagactcagcgatcaatttcacgatattctcattagaaagttcgataggcagggacgcgggcagatcgccttcgatgactttatccagggctgcatcgttctgcagaggctgactgatatctttcggagatatgacaccgatcaagatggctggatacaagtgtcctatgagcagtacctgtccatggtgttctcgattgtctag

SEQ ID NO: 45027 - DNA, 168 bp, Artificial Sequence
  Description of Artificial Sequence: Synthetic coding sequence
atggccgcctacagctaccggcccggccccggcgccggccccggcccagccgctggcgccgccctgcccgatcaatcctttctttggaatgtgtttcagcgcgtggataaggacagatcaggcgtcatctccgatactgagctgcagcaagccctgtcgaatggctag

SEQ ID NO: 45028 - DNA, 1182 bp, Artificial Sequence
  Description of Artificial Sequence: Synthetic coding sequence
atggagaccaccatgggcttcatggacgacaacgccaccaacacctccacaagctttctctcagtgctcaatcctcatggagcccacgctacttctttcccctttaatttctcatattctgactatgatatgcctctcgacgaggatgaggatgtgacaaactccagaaccttcttcgcagctaaaattgtgatcggaatggccctggtggggatcatgcttgtgtgcggtattggcaattttatattcatcgcggccctggtgaggtataagaaactgcggaacctgaccaaccttcttattgcaaatctagccatatcggatttccttgtagctattgtgtgctgtccatttgagatggattactatgtggtccgccagctctcatgggaacatggacacgtgctgtgcacatcggtaaactatctgagaacagtatccctgtatgtttctacaaatgctttactggccatcgccattgaccgctacttagctattgtgcatcccctgagaccaaggatgaagtgccagactgctactggactcatagccttggtgtggacggtgtcaatcttaattgctattcctagcgcttattttaccacagagaccgtgctcgtgatcgtgaaatcccaggaaaagatattttgcggccaaatctggcctgtggatcagcaactttactacaaaagttacttcctgtttatctttggcatcgagtttgtaggacccgtagttaccatgacactgtgttacgcacggatctcccgagagttgtggtttaaggcagtccctgggtttcagactgaacagatccgcaaacggctgcggtgccgccgaaagacggtgcttgtgctcatgtgcattttgacagcatacgtgctctgttgggcacctttctacggctttaccatcgtgcgcgactttttccccacagttttcgttaaggagaaacattacctaacagccttttatattgtcgaatgtattgctatgtcaaacagcatgatcaacacactgtgcttcgtgactgtcaaaaatgataccgtgaaatactttaaaaaaattatgctgcttcattggaaagccagctataatggcggcaagagctccgctgacttagacctaaaaacaattgggatgcctgcaacagaagaagtcgattgtattcgcctaaaatag

SEQ ID NO: 45029 - DNA, 1182 bp, Artificial Sequence
  Description of Artificial Sequence: Synthetic coding sequence
atggagaccaccatgggcttcatggacgacaacgccaccaacacctctacaagcttcctaagtgtgctgaatccccacggggcacatgcaactagctttcctttcaatttttcttactccgactacgacatgccactggatgaggacgaggacgttacaaactctagaaccttctttgctgccaagattgtgatcggaatggcgctagttggcatcatgctggtgtgcggtataggcaacttcatctttatcgccgccttggtgcggtataagaagcttaggaacctgacgaatctgctgatcgctaatttggcgatttctgatttcttggtggccattgtttgctgccccttcgagatggactactatgtcgtgcgacagttatcttgggagcacggacatgtgctctgcacatcagtcaactatctcaggactgtctcactttacgtgagtaccaacgcactcctggcaatagccatcgaccgatatctggccatagtacatcctttacgaccgagaatgaaatgccaaacagcaaccggacttattgccctagtgtggactgtgtctattttaattgccatccctagcgcgtactttaccacggagaccgttctcgtcatcgtgaagtcccaggagaaaatcttctgcggtcaaatctggcctgttgaccagcagctgtattataaatcttacttcctgttcatttttggcatcgaattcgtggggccagtcgttacgatgacgctctgttatgctagaatatcccgggaactgtggttcaaagccgtgcccggtttccagaccgagcagattaggaagcgactgcgatgtcgacgtaagacagtactcgtcctgatgtgtatcctgacagcctatgtgctgtgctgggctcctttctatggatttaccattgtgcgggactttttccctaccgtgttcgtcaaggagaaacactatctgacagcattctatatcgtcgagtgcatcgccatgtcaaactccatgattaacactttatgcttcgtgaccgtgaagaacgacactgttaagtatttcaagaagatcatgcttctgcactggaaggcctcatataatggagggaagtccagcgccgatttggacctcaaaaccattggaatgccagctaccgaagaggtggactgtatccggctcaaatag

SEQ ID NO: 45030 - DNA, 1113 bp, Artificial Sequence
  Description of Artificial Sequence: Synthetic coding sequence
atggccagcagcaccacccggggcccccgggtgagcgacctgttcagcggtttgcctccagccgtgacaacccctgcaaatcagtcggccgaggcctccgccgggaatggatctgtcgccggcgcagatgcacctgcagtgaccccattccagtccctgcaattggtgcaccagctgaaggggttgatcgtgctgctttactctgtcgtcgtggtagtgggcctggtcggaaactgcttgctagtcctggttattgcaagggtgagacggctgcataacgtcactaattttttgatcgggaatctagccctgtcagacgttttaatgtgcactgcttgtgtaccattaacactggcctacgccttcgagccaagggggtgggtgtttggtggcgggttgtgccatctggttttcttcctccagccagtgaccgtgtacgtctccgttttcactctcacaacaattgccgtggacagatatgtcgtgctcgttcaccctctacgccgccgtatatctctgcggctgagcgcatatgcagtgctcgccatatgggccctgtccgcggtgctggccctcccagccgctgtccatacatatcacgtggagctgaaaccgcacgatgtacgcctatgcgaggagttttgggggagccaggaacgccagagacagctgtatgcctggggtctcctcctggtcacttatctcctcccactgctggtaatcctgctgagctacgtgagagtctcagtgaaactgagaaatagggtggtccccgggtgcgtgacacagagccaggctgactgggatagagcgagacgcagaagaaccttctgcctcctggtggtgattgttgtggtcttcgccgtatgttggctgcctctgcacgtatttaacctgctgagggacctggatccgcatgctatagatccgtacgccttcggcctggtgcagttgctgtgtcactggttagcaatgagttctgcatgctacaatccgttcatttacgcttggctacatgattcctttcgggaagaacttcgtaagttattagtggcatggccccgaaagattgcccctcacggccagaacatgactgtaagcgtggtaatctag

SEQ ID NO: 45031 - DNA, 1113 bp, Artificial Sequence
  Description of Artificial Sequence: Synthetic coding sequence
atggccagcagcaccacccggggcccccgggtgagcgacctgttcagcggactcccaccagccgtaacgacccccgccaaccagtccgcagaggcttcggccggcaatggatctgtcgccggggccgatgcaccagcggtgacaccatttcagtcgctacagctagtgcatcagctgaagggcctcatcgttctgctgtattctgtcgttgtcgtagtaggcctggtgggaaattgcctgttggtgctcgtgattgcaagagtgagaagacttcataatgttactaattttctgatcggcaatcttgccctgagtgacgtgctgatgtgtaccgcttgcgtacccctgacactggcatacgcatttgagccaagaggctgggtgttcggtggaggcctgtgtcatctcgtcttcttcctccagcctgtgacggtttacgtctccgtattcactctgacaactattgcagtggatagatatgtcgtcctggtccaccctctgagaagaagaatctccctgcgactttcagcttacgccgtgcttgcaatctgggcattatcagccgtgcttgcgctcccagcagccgtacatacttaccatgtggagcttaaacctcatgatgtaagactttgcgaagagttctgggggagccaggagaggcaaagacaactctatgcgtggggcctgctcctcgtcacatatctcttaccccttttagtgattctgctgtcgtacgtccgggtgagcgttaagttgcggaacagggtggtgcctggctgtgtgacgcaatcccaggctgactgggaccgggctagaagacggaggaccttctgcttgctggtggtcatcgtggtcgtgtttgctgtttgctggttaccacttcacgtgtttaacctgctgagagacttagatccccatgctatcgatccttacgcgtttggcctggtgcagttactgtgccactggttagcgatgtctagcgcctgctacaatcccttcatctatgcctggctgcacgactccttccgggaggagttacggaaactgctggtggcatggcctcggaagatcgcgccccatggtcaaaatatgacggtctcggtggtgatctag

SEQ ID NO: 45032 - DNA, 888 bp, Artificial Sequence
  Description of Artificial Sequence: Synthetic coding sequence
atgcccttcccccccatgccccccccccccgcccccgcccccggcgcccaggctgctcgccagctgccacgacgcccgtgtgcagccggcgataaaaaaaaacggcctccccagagacctgagggacttctaagctcaagttggccgagcgccaccttaaagagaccccctgcgaggagaggacccggcctcgacaggacccaacctcctgctccccctggagtcagcccacaggccttaccctctagagcacgcgcccctgcaacatgcgcacccccacgtccagcgggctctggccattcaccagcacgcactacctacgctgcaacatccgcggggacgggaactaccgcggccggcacctcaagtggtgcgggtccttgtccagattccgctgcacgattctgtctcaacctcacccccgaagccgtcctggtgattcagaagcggcaccttgagaagcagctgctggcacggccccgtcggccatttccttcaccttcagccgagcctagacgcttattagccccatgcctgcccgccagggcggcagggcctaggagggggggccccgccagcgaccccgatgcgccacctacagccgggcaaggaagacgggctcccccgccaggcgcacagctgctgcacggaggtctgcaggtaccacagctctcccccagacccggggctttgagaccaatgctgaaggtttccctcctcaatgagagacatcgatatgatgacgtggagtacgaggaagaacccgaagcagtggacgaaggtctagtgagaaaatgtacagaatggctgaggggcgtcgagagcgccgccgcggcgcggggacgtgccggcgccctcgactccaggagacacctgtcaactctatag

SEQ ID NO: 45033 - DNA, 354 bp, Artificial Sequence
  Description of Artificial Sequence: Synthetic coding sequence
atgcccttcccccccatgccccccccccccgcccccgcccccggcgctcaggccgccaggcaattgcctcggaggccatgtgctgccggcgacaaaaaaaagaggcctccacagcggcccgagggactgttatcttcctcctggccatctgcaaccctgaaaaggcctcccgctaggcgtggtcctggacttgatcggactcaaccacctgcccccccaggtgtctcaccccaagccctgccatcccgggcaagagcacctgctacctgcgctcctccacgacccgccggttctggccactccccagctcgaactacatacgctgccacctctgctggcacagggacaacctag

SEQ ID NO: 45034 - DNA, 888 bp, Artificial Sequence
  Description of Artificial Sequence: Synthetic coding sequence
atgagcagccccgtgctgagcgacctgccccggttccaggccgccaggcaggctcttcagctatcttcatcctcggcctggaactctgttcagacggccgttatcaacgtgttcaaggggggcgggctgcagagtaacgagctctacgcacttaatgaaaacatccgcaggctgctgaagtcagaactcggtagtttcattaccgactacttccagaaccagctgctggccaagggcctgttcttcgtggaggagaagatcaagctctgcgagggagagaatcggattgaggtcttggctgaagtttgggatcacttctttactgagacactgcctaccctgcaagcaatattctaccccgtccagtccgtgcatgaaccaaccgggccttccgaatcctacctgcaactagaagagctggtgaaacaggtcgtctcgcccttcctgggcatttctggggaccgatccttctcaggcccaacttacaccctggcccgaagacactctcgagtgagacccaaggtcaccgtgttgaactatgcgtctccaattacggctgtaagcaggccattaaatgaaatggtcctgactcccctgaccgagcaggagggagaagcatacctagagaagtgcggatccgtgagacgacacacagtcgccaatgcgcattccgacattcagcttctggcgatggccaccatgatgcattccggtcttggtgaggaggcttctagcgagaataaatgtctgctccttcccccatctttccctccaccacatcggcagtgttcctcagagcctaacataaccgataaccccgatggtcttgaggagggagccagaggatcacaggagggcagcgagcttaactgtgcttccctgagctag

SEQ ID NO: 45035 - DNA, 1107 bp, Artificial Sequence
  Description of Artificial Sequence: Synthetic coding sequence
atgacccggggcttcgcccccatcctgcccgtggagttccacaagatggggtcattccgtaggccccgtccaagattcatgtcatcgcctgtcttgagcgacttgccacgtttccaggcagccaggcaagccctgcagctatcctcctcctcagcctggaacagcgtccagactgccgtgatcaacgtgtttaagggcggaggcctccaatccaacgaactttacgctctcaacgaaaatatcaggcgcctcctgaagtccgaactgggcagcttcataaccgactactttcagaaccagctgctggccaaagggttgtttttcgtcgaagaaaagatcaagctgtgtgaaggcgagaaccgaatcgaggtgttggccgaagtgtgggaccatttcttcactgagactttaccaacccttcaagcaatcttctacccagtacaggggcaagagctgactatccgccagatcagtctcctgggtttcagagacctggtgctgctgaaagttaaactgggggatctgctgctccttgctcagagtaagctcccatcgtctattgttcagatgctcctaatactacaatccgtccatgagcctaccggcccgagtgagtcatacctacagctagaggaactggtgaaacaggtggtcagcccattcctgggcatctccggtgaccggagttttagtggtccgacatacaccctggcgcgaagacactcaagagtgagacccaaagtcacagttctgaactacgcatccccaatcaccgcagtcagccggcccttgaacgaaatggtgctcactcctctgacggagcaggagggcgaggcttatctggagaaatgcgggtcagtcagaaggcacaccgtcgccaacgcgcactctgatatccagctcctggccatggcaacaatgatgcactcaggtctcggggaagaagccagttctgagaataagtgtctgttacttcccccgtcgttccctccgccgcataggcagtgctccagcgaacccaacatcacagacaatccagacggtcttgaggaaggagcgagaggtagccaggaggggagcgagctaaactgcgccagcctgtcctag

SEQ ID NO: 45036 - DNA, 147 bp, Artificial Sequence
  Description of Artificial Sequence: Synthetic coding sequence
atgacccggggcttcgcccccatcctgcccgtggagttccacaagatgggtagcttcagaagaccccgccccagattcatgagctcgcctgtgttaagcgatcttccaaggttccaggctgctagacaggccttgcaattatcttag

SEQ ID NO: 45037 - DNA, 243 bp, Artificial Sequence
  Description of Artificial Sequence: Synthetic coding sequence
atgacccggggcttcgcccccatcctgcccgtggagttccacaagatgggtagctttcgacggccacgacctagatttatgtcatctcctgtgctgagtgatctcccgaggtttcaggccgcccgccaggctttacagctgagcagtagtagcgcatggaacagtgtccagactgctgtgatcaacgtattcaaaggaggggggcttcaatcaaacgagctgtatgcgctcaacgagaactag

SEQ ID NO: 45038 - DNA, 192 bp, Artificial Sequence
  Description of Artificial Sequence: Synthetic coding sequence
atgacccggggcttcgcccccatcctgcccgtggagttccacaagatggggtccttccgaagacctaggccaagatttatgtcaagccccgtcttgtctgatctgccacgattccaagcagcacggcaagcgttgcagcttagtagttcttcagcttggaattccgttcagaccgccgttataaatgtctag

SEQ ID NO: 45039 - DNA, 231 bp, Artificial Sequence
  Description of Artificial Sequence: Synthetic coding sequence
atgacccggggcttcgcccccatcctgcccgtggagttccacaagatgggctctttccggcgtcccagaccacgatttatgagcagtcccgttctttcagacctgccgcgattccaggccgcgagacaggccttgcagctctcttcatcctccgcctggaactccgttcagactgcagtgatcaatgtgttcaaggggggtggactccagtccaacgagctgtacgcctag

SEQ ID NO: 45040 - DNA, 144 bp, Artificial Sequence
  Description of Artificial Sequence: Synthetic coding sequence
atgacccggggcttcgcccccatcctgcccgtggagttccacaagatgggctcgttccggcgtcctagaccaagatttatgagctctccggtgctgtccgacctcccccgtttccaggctgccagacaggcactgcagttgtag

SEQ ID NO: 45041 - DNA, 228 bp, Artificial Sequence
  Description of Artificial Sequence: Synthetic coding sequence
atgacccggggcttcgcccccatcctgcccgtggagttccacaagatggggtccttccgcaggccccgcccccgttttatgtcctcccccgtgctctcggacctgcctcgattccaggctgcgaggcaagcccttcaactgagctcaagctccgcttggaattctgtgcagactgctgtcattaatgttttcaagggcggcggcttgcagtccaatgagctgtactag

SEQ ID NO: 45042 - DNA, 150 bp, Artificial Sequence
  Description of Artificial Sequence: Synthetic coding sequence
atgacccggggcttcgcccccatcctgcccgtggagttccacaagatgggatcgttccgacggcccagaccccggtttatgagttccccggtcctatctgacctcccaagatttcaggccgctaggcaagcgttgcagctttcttcctag

SEQ ID NO: 45043 - DNA, 1107 bp, Artificial Sequence
  Description of Artificial Sequence: Synthetic coding sequence
atgacccggggcttcgcccccatcctgcccgtggagttccacaagatgggatcttttcgccgccctaggcccagattcatgtctagcccagtattatccgatctgcctcgttttcaggcagcccgccaggcgctgcagctcagcagtagttcagcctggaatagcgtccagaccgccgtgattaacgtttttaaaggaggcgggctccaatccaacgagctctacgccctgaacgagaatatcaggaggctgctgaagtccgagctagggtcattcatcacagattactttcagaaccagcttctggcaaaaggcctattcttcgtggaggagaagatcaagctttgcgaaggagagaaccggattgaggtgctggctgaggtgtgggaccacttcttcacggagaccctccctacactgcaagccattttctatccggtgcaaggacaggagctcacaattcgtcagataagtctattgggatttagggacctggtgcttctgaaagttaagctcggcgacctcctgttactcgcacagtcaaagctgcccagtagcatagtacagatgctgctgattttgcaaagcgtccatgagccaacaggtccctctgaatcctatctgcaactcgaggaacttgtgaagcaagtcgtaagcccgttcctgggcatctccggcgatcgcagcttcagcggccctacgtataccctggcccgacggcatagcagggtaagacccaaagttaccgtgctgaactacgcatctcctatcacagccgtgtctcggcccctgaacgagatggtgctgacccccctgaccgaacaggagggtgaggcttaccttgaaaagtgcgggtcagtgcggcgtcacactgttgccaatgcacattccgatattcagctgctggcaatggccacgatgatgcactcgggcctgggagaagaggcatccagcgaaaataagtgccttctgctacctcctagcttcccccccccccataggcagtgcagtagtgagccgaacattaccgataaccccgatggcttggaagagggtgccagaggcagtcaggagggctctgagttgaactgcgcgtcgctgagctag

SEQ ID NO: 45044 - DNA, 252 bp, Artificial Sequence
  Description of Artificial Sequence: Synthetic coding sequence
atgacccggggcttcgcccccatcctgcccgtggagttccacaagatgggctcgttcagacgtccccgaccccggtttatgagcagccccgtcctctccgatctgcctcgcttccaggcagctcggcaggccctacagctcagcagttcttccgcatggaacagtgtgcaaacagccgtgatcaatgtgttcaaggggggaggcttgcagtctaacgaactctacgccctgaacgaaaatataagacgttag

SEQ ID NO: 45045 - DNA, 618 bp, Artificial Sequence
  Description of Artificial Sequence: Synthetic coding sequence
atgacccggggcttcgcccccatcctgcccgtggagttccacaagatgggcagtttccgcagaccaagaccaagatttatgtcctcaccggtcctctcagacctgcctagatttcaggccgcccggcaggccctgcaattgtcctctagcagtgcctggaattcagtgcaaaccgccgtgatcaatgtctttaagggtggcggattgcagtccaacgagctgtacgccctcaatgaaaatattcgccgtttattgaagagcgaactcgggagctttatcacagactactttcagaatcagcttcttgccaaaggactgttctttgtggaagaaaagattaagttgtgtgagggagagaaccgcatcgaggtgttggcggaagtgtgggaccacttcttcactgagaccctgccaaccctccaggccatcttttaccccgtccagggtcaggaacttactattcggcaaatctcactcctgggctttagagacttggtgctcctgaaggtgaaactcggggacctcctgctcctggcacagtctaagttgccatcctccatcgtgcagatgctgcttatcctgcaacccggaggcactcccggatctggccccagatag

SEQ ID NO: 45046 - DNA, 825 bp, Artificial Sequence
  Description of Artificial Sequence: Synthetic coding sequence
atggtgatgagccagggcacctacaccttcctgacctgcttcgccggcttctggctgatttggggcttgattgtgttattatgttgcttttgtagctttttacgtaggaggcttaaacgacggcaggaggaaaggctgagggaacagaatcttagggcactggaattggaaccactggaactcgaggggtctctggctgggtccccccccgggctggctcctccccagccaccaccccaccggagccgcctcgaggccccagcccacgcacatagtcatcctcatgtccatgtgcaccccctgttacaccacggacctgcccagccacatgcacacgcccatcctcatccacatcaccacgccctgccgcatcctcctcccacacatctgagcgtgcctcccagaccatggagctaccctcgtcaagctgagagcgatatgagcaagcccccctgttacgaggaggccgtcctgatggcagagccacctccaccctacagtgaggtcctcactgacacaagagggctgtatcggaaaatagtgacaccgttcttgagtcgccgagattcagccgaaaagcaggagcagccacccccgtcctataagccactctttctcgaccgaggttacaccagtgccctgcaccttcctagtgcccccaggccagctccaccctgtccagccctatgcctccaggctgatcgcggtcgtcgggtgtttccatcatggactgactcagaactcagctccagagaaccgctggagcacggcgcttggaggctgccagtgagtatcccgctgttcggccgcaccactgctgtctag

SEQ ID NO: 45047 - DNA, 765 bp, Artificial Sequence
  Description of Artificial Sequence: Synthetic coding sequence
atggtgatgagccagggcacctacaccttcctgacctgcttcgccggcttctggctcatctggggtctgattgtgttgctatgttgtttctgcagctttctcagacgcagactgaagcgcaggcaagaggagaggttgcgcgagcagaatctgcgagcgctggagttggagccactggaactcgaaggatctttggccggaagcccaccaggtcttgctcccccccagcctcctccacaccggtcaaggctcgaagcgcccgcccatcatgcccacgcgcatcctcacccgcatcaccacgcgctcccacatcctccacccacacacctgtcagtgccccccaggccatggagttatccgagacaggccgagagcgacatgagtaagcccccctgttacgaggaagcagttctgatggccgagcctccccccccgtacagtgaggtattaaccgacacacggggactgtatcggaaaattgtgacccctttcctgtctcggagagattccgcagagaagcaggaacagcctcctcctagctataagcccctgtttctcgatagggggtacacttccgcgttacacctgccctctgcaccacgacctgctccaccatgtcccgcactgtgcctgcaagcagatagggggagaagagtatttcccagctggactgactccgaactgagtagtagggagccactcgaacacggggcctggcgattgccagtctcaatcccgctgttcgggcgcaccaccgctgtctag

SEQ ID NO: 45048 - DNA, 825 bp, Artificial Sequence
  Description of Artificial Sequence: Synthetic coding sequence
atggtgatgagccagggcacctacaccttcctgacctgcttcgccggtttctggctgatctgggggctcatcgtgttactgtgttgcttctgttctttcctgcgtaggcgcctgaaacgcaggcaggaagaaaggctgagggagcagaacctcagagctttagagctggagcccctggagctggagggcagtttggccggatcaccacctggcttagctccaccccaacccccaccgcatagaagtcgtctcgaggcacctgctcatgcccactcccacccacacgtgcatgtccacccactacttcatcacggtcccgcccagcctcacgcgcatgcccacccccacccccaccaccacgcactcccacaccctcctccgacccatctgtccgtgccaccccgaccttggagctatccccgacaagcagagtcagacatgtcaaagccaccatgctatgaagaagccgtcttgatggccgagcctccccctccctattctgaggtgctaactgacacacgcgggctataccgaaagatcgtgacacccttcctgagcagacgggacagtgctgagaagcaggagcagcctcctcccagctataaacccttgtttctcgatcgagggtacacaagcgcactccatctccctagcgcccctcggccagcccctccatgccccgccttgtgtctacaggccgacagagggagaagagtgtttccaagctggacagactccgagctgtcctcaagggagccattggagcacggggcttggagacttcccgttagcatacctttattcggccgcaccacagccgtgtag

SEQ ID NO: 45049 - DNA, 537 bp, Artificial Sequence
  Description of Artificial Sequence: Synthetic coding sequence
atggtgatgagccagggcacctacaccttcctgacctgcttcgccgggttctggctgatttggggtctgattgtgctcttgtgttgcttttgttctttcttacgacggaggctcaagaggcgccaggaggagaggttgagggagcagaacttaagggcgttggaactcgagccccttgagctcgaaggttctctcgctggctcaccacccggcctagctcctccgcagccgccacctcatcgatcaaggctagaagcccccgcccacgctcattcacacccccacgtccatgtacatccactcctgcaccacgggccagcacagccccatgcccacgcacaccctcatccccatcaccatgctcttccgcatccacctcccacccatttgtctgtacctcctagaccctggtcgtacccccggcaggccgagtccgatatgtccaaacccccttgctacgaggaagccgtgctgatggcagagccgccaccaccctattccgaggtgctcacagatactcgcggcctctatagatag

SEQ ID NO: 45050 - DNA, 825 bp, Artificial Sequence
  Description of Artificial Sequence: Synthetic coding sequence
atggtgatgagccagggcacctacaccttcctgacctgcttcgccggattctggctgatttggggcctgatcgtgctgctgtgctgcttctgtagttttttgagacgacgcctaaagcgccggcaagaagagagattacgcgagcagaatttgcgcgccctagaactagagcctttagagttagaaggctctctcgctggaagccctcccggactggccccaccccagcctcccccgcatcggtctagattagaagccccggcccacgcacactcccatcctcatgtgcatgttcacccacttttgcaccacggaccggcacaaccacacgcccatgcacacccccaccctcaccatcacgccttgccccaccctccgccaacccacctttcagtgccaccaagaccttggtcctatccacgtcaggccgagtcagacatgtctaaacccccttgctatgaggaagctgtattgatggctgaacctcctccaccctactcggaggtcttaacggacaccagaggcttatataggaagattgtgacaccattcctgtcacgccgggacagcgctgagaaacaggagcaaccccccccttcatacaagcccctcttcctggaccgtgggtacacatcggctctccacctgcccagcgcgccccggcctgcaccaccttgccctgccttgtgtctacaagccgaccggggcaggagagtattcccctcatggaccgacagcgaattatcttcacgcgagcctttggaacatggcgcttggaggctgcccgtttccattccgttgtttgggcgcacaaccgccgtctag

SEQ ID NO: 45051 - DNA, 1338 bp, Artificial Sequence
  Description of Artificial Sequence: Synthetic coding sequence
atgatggaggagagcggcatcgagaccaccccccccggcacccccccacccaaccccgccgggctggcggccaccgccatgagtagcactccagtacctttagcagcaacaagcagcttttcaagcccaaatgttagttccatggagagcttccctcccttggcgtatagcaccccgcagcctcccctcccgcccgtgcggcctagcgctcctctgcccttcgtcccgccaccggcagtgccgtccgtgccacccttagtgacttcaatgccacctcctgtcagtccctccaccgctgctgccttcggaaatcctcccgtctcgcatttccctccgtccacatccgccccaaacactctgcttccagcaccgccatccggccctcccatttcaggattcagtgtgggatctacttacgatattacaaggggccatgcagggcgggccccccaaacaccattaatgccatcattctctgcacctagcggcactgggctgttgcccactcccatcacacagcaggcctcactgacaagtctcgcccaggggaccggcaccacttccgccataacttttccagaggagcaggaggacccgagaattacgagaggtcaggatgaggccagcgccggaggtatatggggctttattaagggagttgccggcaaccccatggtgaaatccgttctggacaagaccaagcattctgtggaatcgatgataactacgctggatcctggaatggctccatacataaaaagcggcggggaactagacatcgttgttacatcaaacaaggaggtcaaggtcgcagcggtgagagacgccttccaggaggtcttcggcttggcagttgtcgttggcgaggccggacagagcaatattgcgccacaaccggttgggtacgcagctggcctgaaaggggcgcaagagcgaatagatagtctgcggcgcacaggcgtaatccacgagaaacagacagctgtgtcagtggaaaatttcatagcggagctgttgccagacaagtggtttgatatcgggtgtctagtcgtggaggaccctgtgcacgggatacacctagagactttcactcaagcaaccccagtgccgctcgaattcgtacagcaggctcagtcgctgaccccccaggactacaatctgcgttggtccggtttgctggtgacagtcggcgaagtgctcgagaagagcctgctcaatgtatccagaactgattggcatatggctttcaccggcatgtctaggaggcagatgatttatagcgccgctcgagccattgcaggaatgtataaacagagactaccccctcgcaccgtgtag

SEQ ID NO: 45052 - DNA, 1395 bp, Artificial Sequence
  Description of Artificial Sequence: Synthetic coding sequence
atgatggaggagagcggcatcgagaccaccccccccggcacccccccgcccaatcctgctggcctggctgcaactgctatgtcctccacgcccgtgccactcgccgccacctcgtcatttagttcaccaaatgtcagctccatggaatcatttcctccgctggcatatagcactcctcagcctcctctcccaccggtgagaccatccgccccactgccttttgttccccctcctgccgtgccaagcgtaccccctctagtgactagtatgccgccgccagtaagcccatcaactgccgctgctttcggcaacccgcctgtgtctcacttccccccctcaacttctgctcccaacacattactgccggctccaccatctggcccacccatttcagggtttagcgtcggtagcacgtatgatattacccgcggacacgccgggcgtgcccctcagaccccccttatgccaagttttagcgccccttctgggacgggcctgctcccaaccccaattacccaacaggccagcctgacctcactggcccagggtaccgggaccacgtctgccatcactttccctgaggaacaagaagatcctagaattacaaggggccaagatgaagcatcggccgggggaatctgggggtttatcaagggagtagccggcaaccctatggtgaaatccgttctggataagaccaagcacagtgttgagtctatgatcactaccctggaccctggcatggccccatatatcaagagtgggggggagttggacatcgttgtgacaagcaacaaagaggtgaaagttgcagctgtgcgagacgcctttcaggaagtcttcgggctcgccgtggtagtgggcgaagctggccagtcaaatatcgccccccaacccgtcggttatgcagctggtctgaaaggagcccaggagcggatcgattctctcaggcggacgggggtgatccatgagaagcagacggccgtgagcgtcgagaacttcattgccgaactgctgccggacaagtggtttgatatagggtgtctggtggtggaggatcctgtgcatggcatccacctggagacattcacacaggctacacctgtgcccctcgagttcgtacagcaagcccagtctctgacacctcaggattataacttacgatggtcaggactcctggtgactgttggggaggtcttggagaagagcttgctcaatgtcagccgtacagactggcacatggcatttaccggcatgagtcgccggcaaatgatctactccgcagcccgggctatcgctaatccgcaacgcgcggtggcagtgcacgggctggtggaggctcgaaatttcccagctcctggggatctggtaagtttgctcttggggacagtctag

SEQ ID NO: 45053 - DNA, 936 bp, Artificial Sequence
  Description of Artificial Sequence: Synthetic coding sequence
atgatggaggagagcggcatcgagaccaccccccccggcacccccccccctaaccctgctggcctggccgccaccgccatgtctagtacaccagtgcccctcgcagcaacctccagtttctctagccccaacgtgtccagtatggagtcatttcctccactcgcttatagtacacctcaaccacccctccccccagtgaggcctagcgcgcccctcccctttgtgcctcctcctgcagtgccctccgtcccccctctggtgactagcatgccacctcctgtgtcgccgagtacagccgccgcattcggtaatccaccagtgtcacacttcccaccttcaacgagtgcacccaatacccttctccctgcacctcctagtggacccccaatttccggcttttccgtggggagcacttacgatattacaaggggtcatgccgggcgtgccccacaaaccccacttatgccatcatttagcgcgcctagcgggaccggactgctgccgacccctataactcagcaggcatctctgacctcgctcgcccagggaacgggcaccacatctgccatcactttcccagaagagcaggaagatcccaggataactcggggccaggacgaggccagcgccgggggtatatggggcttcataaaaggggttgctggaaacccaatggttaaaagcgtgctggataagaccaaacattcagtagaaagcatgatcaccacactggatcctggcatggctccctatattaagtctgggggtgagctggatattgtcgtcacttctaacaaagaagtgaaagtggccgccgtgcgcgacgccttccaggaagtctttggactggcagttgtggtgggtgaggcaggacagtcaaacattgctcctcagccagtgggttacgccgctgggttgaagggggccaacagatag

SEQ ID NO: 45054 - DNA, 1257 bp, Artificial Sequence
  Description of Artificial Sequence: Synthetic coding sequence
atgatggaggagagcggcatcgagaccaccccccccggcaccccccctcctaatcccgccggtttagcagcgacagcgatgtcctccactccggttcctctcgctgctactagtagtttctccagccctaacgttagtagcatggagtccttcccccctctcgcttattcaacccctcagcccccccttcccccggtcagaccatctgccccgttacctttcgtgcccccccctgcagtcccatcggtcccgccattggtgactagcatgccaccccctgtgtcaccttccacagcggctgcctttggcaatccacccgtctcccactttcccccatcaaccagcgcacccaataccttactgcctgcacctcctagtggcccccccatatccggatttagcgtggggtccacatacgatataacacgaggacacgccggacgggcccctcagaccccactgatgccaagttttagtgcgcctagtgggaccggccttcttccgacccccatcacacaacaggccagtctcacatccctggcacaggggacgggtactacctctgccataacctttcccgaagaacaagaggatcccagaatcacgcggggacaagacgaagctagtgctggcggcatttgggggtttatcaaaggtgttgcgggtaatccaatggtaaagtcagtgttagacaagacaaagcattctgtggagtccatgataactacactggatcccggaatggccccctatatcaaaagtggtggggagctcgatattgtagtcacatcaaataaggaagtcaaagtggcagccgtgagagatgcctttcaggaagtatttggcctcgcggtggtggtaggagaggctggacagtcgaacatcgcccctcaacccgtggggtacgcagccggtctgaaaggcgcgcaggagaggatcgactccttgagacgcacaggcgtaattcatgaaaaacaaaccgccgtgtccgtggaaaactttattgcagaactgctaccggataagtggtttgatatcggctgtttggttgtggaagatcccgtgcacggtatacatttggaaactttcacccaggcaaccccggtgcccctagagtttgtccaacaagttggttttctattgtgttttttcattatgcttcaaaggaatcttcattactgtttccagaataagaacctatttggtttctttgtgcgcaacatgttcttgattctttttcagagcttttttttctag

SEQ ID NO: 45055 - DNA, 1338 bp, Artificial Sequence
  Description of Artificial Sequence: Synthetic coding sequence
atgatggaggagagcggcatcgagaccaccccccccggcaccccccccccgaatcccgccggactggcagccaccgctatgtccagcaccccagtgcccctggccgccacttcatcttttagtagccccaatgtcagtagcatggagtccttcccaccactggcctattcaacccctcagcctcctctgccaccagtgcgcccgtctgcccctctccccttcgtgcccccccccgcggttccctccgtgccacccctggtcactagcatgcctccccccgtctcaccatcaacagccgcagctttcggcaatcccccggtatctcattttccaccctcgacctccgcccctaacacgcttctcccagctcccccctctgggccacccatctcaggctttagcgtgggttccacttacgacataacacggggtcacgccggacgcgcaccacagaccccactcatgcccagcttctccgcccccagcggaacaggactgctgccaacacctatcactcaacaggcgtctctcacgagtcttgctcagggcaccggaaccacaagcgccataaccttccccgaagagcaggaggatccaagaattacacgggggcaggatgaagcttctgccgggggtatctggggattcatcaaaggcgtggcggggaacccaatggtgaaatcagtgcttgacaagaccaagcattctgtggagagcatgattactaccctcgatccaggaatggctccctatatcaaaagtggaggggagctggacatcgtcgtcactagtaacaaggaggtgaaggttgctgcggttagagacgctttccaggaggtgtttggactcgccgtggtggtgggtgaggcaggtcagtcaaacatcgcccctcagccagttggctatgctgcaggcctcaaaggcgcacaagagagaattgacagcttgcgccgcactggtgtgattcacgagaaacagactgccgtttcagttgagaattttatcgctgaattactgcctgataaatggttcgatatcgggtgcctggttgtcgaagatccggttcacggcattcaccttgaaacctttacacaggccacaccagttcccttggagtttgtgcaacaggctcagtccctgacccctcaggactataacttgcggtggtccgggctgctggtgactgtgggcgaagtgctggaaaagtccttactgaacgtatccaggactgactggcatatggcgttcactggcatgagccggagacagatgatttactctgccgctagagctatagcggagtcacccaagtcatcaggtagcccttggctaggctag

SEQ ID NO: 45056 - DNA, 1389 bp, Artificial Sequence
  Description of Artificial Sequence: Synthetic coding sequence
atgatggaggagagcggcatcgagaccaccccccccggcacccccccgcccaacccggctggattggctgctacagcaatgagcagcacccccgtgccactagccgcaacctctagctttagttctcccaacgtgagctcaatggaatctttcccccctctggcatattctactccccagccccctctcccacccgttcgcccatctgctccgctgccgtttgttccgcctcccgcggtgccaagtgtgcctccattagtgacctccatgcccccaccggtctctccaagtaccgctgccgcatttgggaacccaccagtaagccacttccctccctccacaagcgctcctaataccctgctgccggccccaccctccggtccacccatatccggattcagcgtgggctcaacctacgatatcacgcggggacacgcaggccgagccccgcagacccccctgatgcctagcttctcagcaccctcaggtaccggactcctcccaactccgatcacccagcaggcctcactgacttctctcgcccagggaactggtaccacctctgctatcacctttcccgaggaacaggaggatcctcggataacacgagggcaggatgaggccagtgccggggggatctgggggttcatcaaaggcgttgctggaaatccaatggtaaaaagtgtgctcgataagacaaagcattctgtagaatctatgattacgactctggacccaggcatggctccctatatcaagagcggcggagagctcgatatagtcgtgaccagcaataaagaagtgaaagtggctgcagtgcgagatgcttttcaagaggtcttcggccttgctgtggttgtaggggaggccgggcagtcaaacattgcccctcagcctgttggctatgcagcaggtctgaaaggcgctcaagagaggatcgactcactaaggcggaccggagttatccatgagaaacagacggcagtttctgtagagaattttattgccgagctgcttcccgataaatggtttgacattggctgtctcgtggttgaggacccagtccatggcatccacttggaaacgttcacccaggcaaccccggtgccactcgagtttgtgcaacaagcacagtcgctcaccccccaggactataatctgcggtggtctggcctgctggtcactgttggcgaagttctggaaaagtcactgctgaacgtttctcggacagattggcatatggcatttacgggtatgtcaaggcgacagatgatttactctgccgctcgggcaatcgcagacgactatttcccccgaattcctaaagaacagtggcagtctatggcatggcttaagctggagatattcttgcccctggtgacatggtag

SEQ ID NO: 45057 - DNA, 3795 bp, Artificial Sequence
  Description of Artificial Sequence: Synthetic coding sequence
atgagcaccctgtacgtgagcccccaccccgacgccttccccagcttgagggccttaatcgccgctcgctacggagaggcaggagaaggtccaggctggggaggcgcccacccaaggatttgcctccagcccccccccacctcccggactccattcccccctccccgtctgcccgccttagagcagggaccagggggtctctgggtctggggagccactgccgtcgctcaactactctggccagcagggctgggcggccctggtggctcacgagccgctgtcctagtccagcaatgggtttcctatgcagatacagagctcatccccgccgcttgtggcgcgacattgcccgctcttggccttcggtcctcggcacaagatccccaagcagtgttgggtgctctcggcagggctctgtccccactggaagaatggttgagattgcatacatatttagctggcgaggcccccaccctggctgatctcgccgctgttactgccctcctgttaccttttagatacgtactggacccccccgcgaggaggatttggaataacgtgactcgctggtttgtcacatgcgtcagacagccagagttcagggcagtgctgggggaagtcgtgctgtatagcggcgccagacccctgtctcaccagcccggacctgaggcaccagcactcccaaagactgctgcccaactgaagaaggaggctaaaaaaagggaaaaattggaaaagttccagcagaagcagaagatccaacagcagcaacctcctcctggggaaaagaaaccaaagccagaaaagcgcgagaagcgggacccaggtgttataacctatgatctcccaacaccccccggagagaagaaggacgtttccggccctatgcccgattcctacagcccacgatacgttgaagctgcgtggtatccctggtgggagcaacaaggtttttttaagccagaatacggccggccaaatgtgtccgccgccaatccgcgcggagtattcatgatgtgtattccgccccctaacgtgacgggcagtctacaccttggccatgccctcacaaacgccatacaggatagtctaacccgctggcaccggatgcggggcgagaccacgctatggaatcctggctgtgatcacgctggcattgcaacacaggtcgtcgtggaaaagaaattgtggagggagcaggggcttagcaggcaccagctggggcgcgaagcgttccttcaagaagtgtggaagtggaaggaggaaaagggagacaggatttaccaccaactaaagaagttgggaagttccctcgactgggatcgtgcttgttttactatggaccccaaactgagtgccgctgttacagaggcatttgtgagactgcacgaggagggcattatatacagatctaccagactggtgaactggtcatgcacattaaacagcgccatatccgacatcgaagttgacaagaaggagctcacagggcggactctgctgagcgtcccagggtataaagaaaaggtggagtttggggtgctcgtgagtttcgcctataaggtgcaggggtcagattccgacgaagaggtcgttgtggcaaccacgcgcatagaaacaatgctgggcgacgtcgctgtcgccgtccaccccaaagatactcgataccagcacctgaaaggcaagaacgtgatccacccatttctgtcccgctcactgcccattgtctttgacgaatttgtggatatggatttcggaaccggagcggtgaaaataacaccagcccatgaccagaacgactatgaggtcgggcaacggcacggcttggaagctatctctatcatggattcccgcggggctctgattaacgtcccccctcccttcctagggcttccccggttcgaagcaagaaaagcagtgctggtcgctctgaaagaaagagggctatttagggggatcgaagataatccgatggtggtgccactgtgtaaccggagtaaagacgtcgtagagccactgctgcgtccccagtggtacgtgcgctgcggtgagatggctcaggctgcaagtgccgctgtgacacgaggggacctgcggatacttccagaggcccatcaacgaacttggcacgcatggatggacaacattcgggagtggtgcatttcaagacaactgtggtggggtcatcgcatcccagcttattttgtcacagtctccgaccctgcagtgcccccaggagaagatcctgacgggcgctactgggtgtccggtcgtaacgaagcagaggcacgcgagaaagctgctaaagagtttggtgtttcccccgataaaatcagtctccaacaggatgaagacgtgctggacacttggttctctagcggtctcttccctctgtcaatcctggggtggcctaaccagtctgaagatctttcagtcttctatccaggaacattactagaaactggtcacgatattctctttttttgggtggcccgaatggtgatgctggggctaaagttgacgggccggttacccttccgggaagtgtatctccacgcgattgtacgggacgctcatggaaggaaaatgtccaagtccctggggaacgttatcgaccccctcgacgttatctacggaatcagcctgcaggggctgcacaatcagctgctgaacagcaatctagatcctagcgaggtcgagaaggccaaggagggtcaaaaagcagacttcccagctggtatacccgagtgtggcactgacgcactgaggttcggcctgtgcgcgtacatgagccagggcagggacataaatctggacgtgaatcgcatcttggggtacagacatttttgtaacaagctatggaacgccacaaaattcgccttgcgcggtctggggaaagggttcgtaccttctcccaccagtcagccaggcggccacgagtccctggttgatcgttggattcgatcaaggctcaccgaagcagtgcgactatctaaccagggttttcaggcctacgatttccctgccgtaacaacagctcagtactctttctggctctacgaactgtgcgatgtttatctggagtgtttgaagcctgttctcaacggagtggatcaggtggcggcagaatgtgctagacagaccctgtatacttgcctggatgtcggcctccgactcctgagtccattcatgcccttcgttacagaggagctctttcagcggctgcctaggagaatgccacaggcccctccttcattgtgtgtgactccatatccggagccttctgagtgtagttggaaagatcccgaggccgaagcagccctcgaacttgcgctgtcgatcactagggcggtgaggtcactcagggccgactacaatctgactcggataagacccgattgcttccttgaggtagccgacgaagctacaggggccctagcttctgcagtgtcggggtacgtgcaggcactagcctccgctggagtcgttgcggtgctagctcttggggctcctgcccctcaagggtgcgcggtcgcccttgcttcagaccggtgcagcattcatctgcagctccagggcctcgtagatcccgcccgggagctgggcaagctgcaagcaaaaagagtggaggcacagcgtcaggctcagagactccgagagcgccgggctgcttcagggtatccagtcaaggttccccttgaggtccaggaagctgatgaagctaagctgcaacagaccgaggccgaactccgcaaggtggacgaagctattgcactgttccaaaagatgttgtag

SEQ ID NO: 45058 - DNA, 678 bp, Artificial Sequence
  Description of Artificial Sequence: Synthetic coding sequence
atgcccggcacccagacccccgcccccgccgaggacccccacagcgggtgcagagaccccgtgcccgctcggccacaggcgtgccatcccaagtcccaagagaccaggtttgaggggcccctcccccccccccccccagcggccgccgcaccaccaccacctgccccagcccagaccgcccaagctccgggttttgtggtgccgacacatgctggaactgtcgggaccctgcccctcggagggtacgtagcaccaggatatcccctgcagctccagccttgtacggcctacgtgcccgtgtaccccgtcggcaccccttatgctggcggaacgcccggagggacaggcgtgactagcaccttgcctcctccacctcagggaccaggtctagcgctgctcgagccccgccggccacctcatgattacatgccaatcgctgtgctaactactatctgttgtttctggcccaccggcattatcgccatctttaaggcagtccaggtacggactgctctggcaaggggcgatatggtgtcagcggaaattgccagccgcgaggcccggaatttctcctttatcagcctcgctgttggtattgctgctatggtgctctgcaccattctcactgtcgtgattattatagccgcccagcatcatgaaaattactgggacccatag

SEQ ID NO: 45059 - DNA, 678 bp, Artificial Sequence
  Description of Artificial Sequence: Synthetic coding sequence
atgcccggcacccagacccccgcccccgccgaggacccccacagcggttgtagggacccagtacctgccagaccacaggcttgccatcccaaaagccaagagactagattcgaagggcccctcccaccaccaccacccgccgcagccgcccctccacctcctgcccccgcccagacagcccaggcgcctggctttgttgtgccaacccacgccggaacagtgggcaccctgcctttaggtggttacgtggcccccggttaccccctgcagctacagccgtgcacggcctatgtgcccgtataccccgtgggaactccttatgcgggtgggacccctggaggtacgggtgtcacctcgacccttcccccaccccctcagggcccaggattggccttgctggaaccgcgtagacctccgcatgactatatgcccattgcggttcttactacaatttgttgcttctggcccacaggaatcatcgccatttttaaagccgttcaggtgagaaccgccctggcaaggggagacatggtttctgctgaaatcgcctctcgcgaagctcggaacttcagcttcatctcactggctgttggaatcgccgcaatggtcctgtgtacaattctaaccgtcgttataattatcgccgcgcagcaccatgagaactactgggatccctag

SEQ ID NO: 45060 - DNA, 678 bp, Artificial Sequence
  Description of Artificial Sequence: Synthetic coding sequence
atgcccggcacccagacccccgcccccgccgaggacccccacagcggctgtcgggaccctgtgccagcacgcccccaggcatgtcatcctaaaagccaggagacccgcttcgaaggaccccttccgcctcctcctccggccgcagccgccccgccgccccccgcccctgcacagacagctcaggcacccggttttgtcgtcccaacacacgctggaactgtgggcacactccctcttggcgggtatgtggctccaggttacccactgcagctgcagccgtgtacggcctatgtgcccgtttaccccgtcgggacaccatacgccggaggaacgcccggcggaaccggtgtgaccagcaccttgccgcccccccctcagggacccggcctggcgctcctggagccgaggaggccacctcacgactatatgccaatcgcagtcctgacaactatttgctgcttctggcctactggcattattgctattttcaaggccgtccaggtacgtacggccctcgcccggggtgatatggttagtgccgaaatcgccagtcgagaagcgaggaacttttcttttatctcacttgcagtaggcatagcggcaatggtgttgtgtacgatcctaactgtggtgatcatcattgccgcccaacatcacgagaattattgggacccttag

SEQ ID NO: 45061 - DNA, 921 bp, Artificial Sequence
  Description of Artificial Sequence: Synthetic coding sequence
atgagcagcgagaagagcggcctgcccgacagcgtgccccacacctctcctcccccatataatgcaccacagccccctgctgaaccccctgccccccctccccaggctgcacctagctctcaccaccaccatcaccatcactatcatcaaagcggcacagccacgctgcctcgattgggtgcgggcggcctggccagtagtgccgcaacagcacaaagagggccgtcctccagcgctaccctgccccgtcctcctcatcatgctccccccggcccagctgctggcgcccctcctccagggtgcgcaacattgcctaggatgcccccagacccatatttgcaggaaactcgtttcgaaggacctcttcctcctcccccgcccgccgccgccgctccccctcctcccgcccccgctcagaccgcccaggcccccggttttgtggtccccacacacgccggaaccgtcggcactctgcctctcggcggttatgtggctccaggctatccgctccagctccagccctgcactgcctacgtccctgtgtatccggttgggacaccctacgccggcggcacgcctggcggtacaggcgttacaagcaccctgccacctcctccacagggccccggactcgcactgctggagcctagacgcccgccgcacgactacatgcccatagccgtcctgacaaccatttgttgtttctggccaaccggaatcattgccattttcaaggcagtgcaggtgcgaaccgccctggctaggggagatatggtctctgccgagatcgctagtcgggaagcacggaatttcagctttatcagccttgccgttgggattgccgctatggtcctgtgtactattctgaccgtagtgatcatcatcgcggctcagcatcacgagaactactgggacccttag

SEQ ID NO: 45062 - DNA, 678 bp, Artificial Sequence
  Description of Artificial Sequence: Synthetic coding sequence
atgcccggcacccagacccccgcccccgccgaggacccccacagcgggtgccgcgatcccgttccagcaaggcctcaagcttgtcatcccaaaagccaggaaactagatttgaaggaccactgcctccccccccgcctgcggctgcagcgcctccaccacctgcgcctgcccagaccgctcaggcccctggatttgtcgttccaacgcacgcgggtacggtcggcacactgcctcttggaggttatgtggcccccggctacccattgcagctacaaccatgtaccgcctatgttcctgtgtacccagtgggaaccccctacgctggcggaaccccaggagggacgggagttacttctactcttcccccaccacctcaaggaccaggtttggctctattggaacctcggaggccaccccacgactacatgccaattgccgtgctgaccaccatttgctgcttctggccaaccggcatcatcgccatttttaaggcagtacaggtgcgcacagcgctggccagaggcgatatggtgtccgctgaaatagcgagccgcgaagctaggaatttttccttcatttccctcgcggtgggtatagctgcaatggtcctgtgcacaatcctgactgtcgtaatcatcatcgcagcccagcaccatgagaactactgggacccatag

SEQ ID NO: 45063 - DNA, 921 bp, Artificial Sequence
  Description of Artificial Sequence: Synthetic coding sequence
atgagcagcgagaagagcggcctgcccgacagcgtgccccacaccagtccccctccttataacgcgcctcaaccacctgccgaaccacctgctcctcctcctcaagcggcaccctcatctcaccatcatcaccatcaccactaccatcaaagtggcaccgccaccctgccacgactcggagccggaggtctcgcctcctccgccgccacggctcagcgagggccctcatcctccgcaactctgccaagacctccgcaccatgctcctcctggaccagccgcgggcgcacctccacccggctgtgcgacattaccccggatgccccctgatccgtatctgcaagagacccgcttcgagggacccttaccacctcctcccccagccgcagcagcacctcctccgcctgcgcctgctcagacggctcaggcccctgggttcgtggtgccaacccacgctggcactgttggcacattaccactgggcggatacgtggctccgggctaccccctgcaattacaaccctgcacagcatacgtacccgtatacccagtcgggacaccctacgccggaggtacaccagggggcaccggggtgacatctactctgccacccccaccgcagggccctggtttagccttattggagcccaggcggccccctcatgattatatgcctattgcagtgctgacgaccatctgttgcttctggccaacgggcattatcgccatattcaaagcagtgcaggtgagaacagcactggcccggggcgacatggttagtgccgaaatcgcttcccgggaggccaggaatttctcttttatctccctggccgtgggcatcgcagccatggttttgtgtacgatcctgactgttgttattataatagccgcccagcatcacgagaactactgggacccctag

SEQ ID NO: 45064 - DNA, 192 bp, Artificial Sequence
  Description of Artificial Sequence: Synthetic coding sequence
atgcccggcacccagacccccgcccccgccgaggacccccacagcgggtgtcgggaccccgttccagctagaccacaggcatgccaccccaagagccaggagactcggttcgagggaccattgccaccccctcctcccgctgctgccgctcccccacctcccgcgcctgcgcagaccgctcaagccccgtag

SEQ ID NO: 45065 - DNA, 192 bp, Artificial Sequence
  Description of Artificial Sequence: Synthetic coding sequence
atgcccggcacccagacccccgcccccgccgaggacccccacagcggctgcagggaccctgtacccgcccgtccccaggcctgtcacccaaagagccaagaaacaaggtttgagggcccactgccgccacctcccccggcagccgctgctcccccccctcctgcccccgcccagactgcacaggccccctag

SEQ ID NO: 45066 - DNA, 678 bp, Artificial Sequence
  Description of Artificial Sequence: Synthetic coding sequence
atgcccggcacccagacccccgcccccgccgaggacccccacagcggatgcagagacccagtccctgctaggcctcaggcatgtcacccaaagagccaggaaaccagattcgaagggccactccctcccccaccacccgcagcagccgctcctccacctcccgcccctgcacaaacggcccaagcccccgggtttgtggtgcctacacacgcgggcactgtgggaacccttcctttggggggttatgtcgcaccaggttatcccctacagctgcagccctgcacagcatacgtgccggtttatccagtcggtacaccctacgctggaggaacaccaggagggaccggtgtcacatctacactcccccctccaccgcagggccctggacttgcacttctcgagcctaggcggccaccccatgattatatgcctatcgcagtcctgacaactatctgctgtttctggcccacaggcatcattgcaatttttaaggccgttcaggttagaaccgccctggccaggggcgatatggttagtgccgaaatagcttcaagagaagcaagaaacttttcttttatatcactggccgtcggcatcgctgcaatggtgctgtgcaccatccttacagtggtgatcatcatcgcagcccagcatcatgagaactactgggacccttag

SEQ ID NO: 45067 - DNA, 192 bp, Artificial Sequence
  Description of Artificial Sequence: Synthetic coding sequence
atgcccggcacccagacccccgcccccgccgaggacccccacagcggatgtcgtgaccctgtccccgcccggcctcaggcgtgccaccctaagtcacaggagacaaggttcgaggggccgctgcctccccctcctcctgccgcagccgctcccccccctccagcacccgcccagacagctcaggccccatag

SEQ ID NO: 45068 - DNA, 678 bp, Artificial Sequence
  Description of Artificial Sequence: Synthetic coding sequence
atgcccggcacccagacccccgcccccgccgaggacccccacagcgggtgcagagaccccgtgccagcaagaccccaggcatgccacccaaagagtcaggaaacaagattcgagggacctctgccgcccccacccccagccgctgccgccccaccacctccagcgccagcccaaaccgctcaggctccaggattcgtggttccaacccacgctggaaccgtgggaactttgccgctcgggggctacgttgcaccagggtatccactccaactacaaccttgtacagcctacgttcccgtgtatccggtcggtaccccgtacgctggagggactcccggcgggaccggcgtgacgagcactctcccaccaccaccccagggcccagggctggcactgctcgagcctcggcgtcctccacatgactatatgcctattgctgttctgacaacaatatgttgcttttggcccaccgggatcatcgccattttcaaggctgtgcaagtgaggactgctctggctagaggcgacatggttagtgcagaaatcgcatctcgcgaggccagaaattttagctttatctcattagccgtgggaatcgctgccatggtattgtgcaccattctgactgtggtgataattattgccgcccaacaccacgagaactactgggacccttag

SEQ ID NO: 45069 - DNA, 192 bp, Artificial Sequence
  Description of Artificial Sequence: Synthetic coding sequence
atgcccggcacccagacccccgcccccgccgaggacccccacagcgggtgtagagatcccgtaccagctagacctcaggcttgtcaccctaagtcacaagagacgagattcgaaggcccactgccgcctcctccaccagcagccgccgcacctccacctccagcacctgctcagactgcacaagccccatag

SEQ ID NO: 45070 - DNA, 192 bp, Artificial Sequence
  Description of Artificial Sequence: Synthetic coding sequence
atgcccggcacccagacccccgcccccgccgaggacccccacagcggatgtagggacccggtgcctgccagaccccaagcttgtcatcccaaaagtcaggagacaagattcgaaggcccactgcccccaccaccaccggcagccgcggcacccccccctccagcgcccgcccagacagcgcaggctccttag

SEQ ID NO: 45071 - DNA, 192 bp, Artificial Sequence
  Description of Artificial Sequence: Synthetic coding sequence
atgcccggcacccagacccccgcccccgccgaggacccccacagcggctgccgcgatccagtccctgctcgccctcaggcctgccacccaaaaagtcaggagactagatttgagggccccctaccgccgcctcctcccgccgctgctgcccccccaccccctgcccccgcacagaccgcccaggcaccttag

SEQ ID NO: 45072 - DNA, 678 bp, Artificial Sequence
  Description of Artificial Sequence: Synthetic coding sequence
atgcccggcacccagacccccgcccccgccgaggacccccacagcggatgcagagacccagtgcccgctagaccacaggcctgtcatcccaaatcacaggagacccgcttcgaaggaccactgcctccaccgcctcctgcggccgccgcccctcctcctccagctcctgcacagaccgcccaggccccaggattcgttgtgccaacacatgctgggacggtgggcactctgcccttgggcggatatgtggctcccggctatccgctgcaactacaaccttgcaccgcctacgttcccgtataccctgtaggaacgccctacgccgggggcaccccaggcggcaccggcgtcacctctacgctaccaccgcccccacagggccctggactcgccctgctcgagcctaggcgccctcctcacgactatatgcccatagctgtgttgactactatttgctgtttctggcctaccgggattatcgccatcttcaaggccgttcaggttaggaccgcactggctcgaggggatatggtgtccgctgaaatcgcgtcccgggaggcccgcaatttctcatttatttctctagccgtgggaatcgctgccatggtgctgtgtacgatcctgacagtggttattatcattgctgctcaacatcacgagaactactgggacccatag

SEQ ID NO: 45073 - DNA, 192 bp, Artificial Sequence
  Description of Artificial Sequence: Synthetic coding sequence
atgcccggcacccagacccccgcccccgccgaggacccccacagcggttgccgggatccggtcccagctcggcctcaagcatgtcaccctaagtcccaggaaactcgtttcgagggccctttacctccacctccaccagcggcagcagctcctcctcctcctgcaccagctcagaccgcacaggccccctag

SEQ ID NO: 45074 - DNA, 921 bp, Artificial Sequence
  Description of Artificial Sequence: Synthetic coding sequence
atgagcagcgagaagagcggcctgcccgacagcgtgccccacaccagcccacctccttataacgccccacagcctccagccgagcccccggcccctcctccacaggcagcccctagcagtcaccatcatcaccaccatcattaccaccagtccggcacggctacactgccccggctcggagcgggagggctggcatcaagcgccgccacggctcagcggggcccgtcctcctcggccaccctgccccgcccccctcaccacgcgcctcccgggccagctgcaggagcacccccccccggctgcgctaccctccctaggatgcccccggacccatacctccaggaaaccaggtttgagggcccccttcctccaccccctcccgccgccgctgcccccccacctcctgctcccgctcagaccgcacaggctcccggcttcgttgtccctacacacgccggcactgtgggaaccctgcctcttggcggatacgtcgcaccaggttatccattgcagctccagccttgtactgcttacgtgccagtatatcccgtgggaacgccttacgcgggcggcacacctggtggaactggtgtaacctcaacactgccacctcccccacagggcccgggattggcactcctggaaccacggaggcctcctcatgactacatgcctatcgccgtgttaaccaccatctgttgtttctggcccacgggcatcattgcaattttcaaggctgtgcaagttcgaacagccctggctcgcggtgatatggtgagcgccgaaatcgccagcagggaagcgcgaaacttcagtttcatttcattggccgttggcattgccgctatggttctgtgcactattctgaccgtggtgattatcatcgcggcacagcatcacgaaaactactgggacccctag

SEQ ID NO: 45075 - DNA, 678 bp, Artificial Sequence
  Description of Artificial Sequence: Synthetic coding sequence
atgcccggcacccagacccccgcccccgccgaggacccccacagcggctgccgcgaccctgtaccagctcggccacaggcttgccaccccaagtctcaggaaacgcgctttgaaggcccactacccccgcccccgcccgctgcagctgctcctccgcctccggccccagctcaaacagcacaggccccgggatttgtagtgcccacccacgccggtacagttggcacactgccgcttggtggatacgtcgctcccggttatcctttgcagctccagccttgtaccgcctacgttcccgtgtatcctgttggcactccttacgcaggcgggacgcctggcggtactggggttacatcaactttacccccccctccgcagggacctgggttggcattactcgagccccgtcgacctccccacgattatatgcctatagccgtgttaactactatatgttgtttttggcctactggaatcatcgccatctttaaagctgtccaggtccggactgccctggcaaggggcgatatggtctctgctgagattgcatctcgagaagctcggaatttttcctttatctctctcgcagtcggtatagcagccatggtgttgtgcactatccttactgtagtcatcataattgcagcccaacatcacgaaaattattgggacccgtag

SEQ ID NO: 45076 - DNA, 921 bp, Artificial Sequence
  Description of Artificial Sequence: Synthetic coding sequence
atgagcagcgagaagagcggcctgcccgacagcgtgccccacacctctccacccccatataacgctccgcaaccaccagcagaaccaccagcacctcctccccaggccgccccatcaagtcaccaccaccaccaccatcattaccaccagagtggcacagcaaccctccctagattgggtgcaggcgggttggcctcctctgccgccaccgcgcaaagggggccttcttcgagtgctacacttcccagacccccacaccacgctccccccgggcctgccgcaggcgcgccccctcccggctgtgcgacgcttccacgcatgccacctgacccttatctgcaggagaccagatttgaagggcccctccccccacccccccccgctgccgcggccccgcccccccccgcccccgcacagaccgcccaggccccggggtttgtagtccccacacacgcagggacagtgggaacactccccctggggggttacgttgcacccggctaccctctccaattgcagccatgcacagcatacgtgcccgtgtaccctgttggaactccgtatgccggcggaacccccggtggtaccggggtaacttctaccctccctcccccaccccagggccctggcctcgccctcttagagcctcgccggcctccacatgactacatgcccattgcagtgttgaccacaatatgctgtttctggccgaccggaattatcgctatattcaaagctgtgcaagtgagaaccgcgctggctcggggggacatggtgtccgccgagattgcttcccgggaagctcgtaacttctcattcattagcctggccgtcggaatagccgccatggtcctctgtactatcttgacagtggtgattatcatcgcagcccagcatcatgaaaattactgggatccttag

SEQ ID NO: 45077 - DNA, 678 bp, Artificial Sequence
  Description of Artificial Sequence: Synthetic coding sequence
atgcccggcacccagacccccgcccccgccgaggacccccacagcgggtgcagggatcccgtaccagcacgcccacaagcatgccatcctaaaagccaggagaccaggttcgaaggaccactaccccctcccccgccagcggccgccgcacctcctccacctgcccctgcacaaactgcacaggcaccagggttcgtcgtgcctacacacgccggtactgtaggaacgcttcctctgggcggttacgttgctcccggatatccgctgcaattacagccttgcacagcttacgttccagtctaccccgttgggaccccatacgccggcggcacgcctgggggcaccggcgttacaagcacactccctcctccacctcaaggaccgggtctcgccctcctggaacctagaagacctccgcatgactatatgccgatcgcggtgcttacaactatctgttgtttttggcccacgggaataatcgcaatctttaaggcagtgcaggtacggaccgccctggcacgcggcgacatggtaagcgccgagatagcctccagggaggctcggaatttcagcttcatctccttggccgtgggcatcgctgcaatggttttgtgcaccattcttacagtggtgatcataatagccgcacagcaccacgagaattattgggacccatag

SEQ ID NO: 45078 - DNA, 921 bp, Artificial Sequence
  Description of Artificial Sequence: Synthetic coding sequence
atgagcagcgagaagagcggcctgcccgacagcgtgccccacacctctccccccccctataacgcgcctcagcccccagcagaacctcccgcaccaccgcctcaagccgcaccctcatctcaccatcaccaccatcaccattatcaccaatctggaaccgccaccctacctagactcggcgccggcggactagcctctagcgccgcaacagcgcagagggggcctagcagctctgctactctgcctaggccgcctcaccacgcacccccggggcctgccgccggcgcccccccaccagggtgcgcaacactgccacgaatgccaccggatccttacctccaagaaacccgcttcgaggggcctctgcctccgcccccccccgccgccgctgctcctcccccccccgcgcctgcccagacagcacaggctcccggattcgttgtgccaacccacgctggtacagttggtacactcccgctgggcgggtatgtggcccccggatacccattacaactccagccgtgcacagcttatgtgccggtctatcccgtgggcactccctatgcaggaggcactcccggcggcactggtgtgaccagtacactgcctccacctccacagggacctggactggcgctcctcgagccccggagacctccccacgactatatgccaattgcagtgctgaccacaatctgctgtttttggcccactggtattatcgctatctttaaagccgtgcaggtcaggaccgctctggcaaggggggacatggtatcggccgagatagccagcagggaagccaggaactttagttttatcagcttggccgtagggatagcagctatggtcttgtgcacgattctgaccgttgtaataataatcgcagctcagcaccacgagaactattgggacccatag

SEQ ID NO: 45079 - DNA, 921 bp, Artificial Sequence
  Description of Artificial Sequence: Synthetic coding sequence
atgagcagcgagaagagcggcctgcccgacagcgtgccccacaccagcccaccgccatataacgccccacagcccccagccgaaccacccgccccaccgcctcaggccgccccatcatcccatcaccatcatcatcaccattatcaccagtcaggcaccgccaccctcccccgccttggggccggcggcctcgcgagttctgcggccacagcccagaggggccccagcagcagcgcgacactgcctaggccaccacaccatgcacctccaggccctgcggccggggcacccccacctggctgcgccaccctgccaagaatgccccccgacccctatctgcaggagacacgattcgaaggaccacttccacccccccccccagctgcagccgcgccccctccgccggcccctgcccagacagcccaggcacccggtttcgtggttccaacacacgccgggaccgtcggcacgttgccactgggcggctatgtggctcccggctaccctctacagttgcagccatgcactgcttatgttcccgtctatcccgttggtactccatacgcgggaggcaccccaggtgggactggagttacatcaaccctaccacctccgcctcaaggccctgggctggctctcctagaaccacggcgcccccctcatgattacatgcccattgcagtgttaaccaccatttgctgcttttggccgacggggatcatcgcaatattcaaagccgttcaggtccgcactgctctggccagaggagacatggtgagtgcagaaattgcaagccgtgaggctcggaacttctcattcattagcctggcagtgggaattgccgcaatggtcctgtgtacaatcctcactgttgtcatcatcatagcagctcaacaccacgagaactactgggatccgtag

SEQ ID NO: 45080 - DNA, 192 bp, Artificial Sequence
  Description of Artificial Sequence: Synthetic coding sequence
atgcccggcacccagacccccgcccccgccgaggacccccacagcggatgtagggacccagtcccagccaggccacaggcgtgccatccaaagtctcaagaaacaagattcgagggcccgttgcctcccccccctcctgccgccgccgccccaccccccccggcacccgctcagaccgcccaggcaccttag

SEQ ID NO: 45081 - DNA, 921 bp, Artificial Sequence
  Description of Artificial Sequence: Synthetic coding sequence
atgagcagcgagaagagcggcctgcccgacagcgtgccccacaccagcccccctccctacaacgccccacagccccctgccgagcctcctgctcctcctccacaagcggctccctcgtctcatcaccatcatcatcatcactaccaccagagtggcacagccactttgcctaggttgggcgccggtggccttgcctcttctgccgctactgctcagaggggaccgtccagctctgccactcttcctcgcccaccccaccatgctcctccaggccctgccgccggcgccccaccgcccggatgcgccactctgcccaggatgccacccgacccatacctgcaggagacgcggttcgagggtcctttacctccccccccccccgccgctgccgcaccacccccaccagctcccgctcagacagctcaggcacctggctttgtcgtcccaactcacgccggcactgtcggtaccctgcctttaggtggctatgtggcgcccgggtacccattgcagctgcagccgtgcacggcctacgtaccagtatatccggtggggaccccttatgctggtggaacacccggtgggacgggtgtgacgagcaccctgcctcctcctccgcagggcccaggcctggcgctcctggagcctcggaggcctcctcacgactacatgcctattgccgtactgaccacaatatgttgcttctggcccacaggcatcatcgccatttttaaggcagtacaggtgagaactgccttagccaggggagacatggtgagtgcagaaatcgcatctagagaggcacggaacttttcgttcattagcctggcggtcggtattgcggcaatggttctgtgcacaatactgacagtagtcattatcatagcggcacaacaccatgaaaattactgggatccctag

SEQ ID NO: 45082 - DNA, 678 bp, Artificial Sequence
  Description of Artificial Sequence: Synthetic coding sequence
atgcccggcacccagacccccgcccccgccgaggacccccacagcggctgtagagacccggtgccagccagaccccaggcctgtcacccaaagagtcaagagacaagattcgaaggcccactgccgcctccgccaccagcagctgcagccccccctcctccggcccccgctcagactgctcaggccccaggctttgtcgttcccacgcatgccggaaccgtgggcaccctaccattgggaggctatgttgcccctgggtaccctctccagctgcaaccctgcaccgcctacgttcccgtgtatcccgtgggtaccccctatgccggcgggactcccgggggaacaggggtgaccagcaccctgccacctccacctcagggtcccggccttgccctgctagaaccgcgcagaccgccacacgactacatgcccatcgcagttcttactactatatgttgcttctggccaaccggaatcatcgccatctttaaagcagtacaggtgcgaactgctctggcacgcggagatatggtaagcgcagagattgccagtcgcgaagcacggaacttcagtttcatcagtctggcggtgggtatcgctgccatggtgctgtgtaccattctgaccgtagttattataatcgcagcccagcatcacgagaactattgggatccatag

SEQ ID NO: 45083 - DNA, 678 bp, Artificial Sequence
  Description of Artificial Sequence: Synthetic coding sequence
atgcccggcacccagacccccgcccccgccgaggacccccacagcggatgccgcgacccagtacccgcaagacctcaggcctgtcatccaaaatcgcaggaaacccgctttgagggtccgttgccccctccgcctccggccgctgcggccccacctcctccggcacccgcgcaaaccgcccaagcgcctggcttcgtggtccccacgcatgccggtactgttggtacacttccactggggggatatgtggccccaggataccccctgcagctgcagccctgtactgcatacgtgccagtctaccccgtggggaccccatatgctggaggcacaccaggaggcacaggcgtgacttctaccttgccccccccaccgcagggccccggactagcgttactcgagcccagaaggccgccccacgattatatgccgatcgccgtgctcacaaccatttgttgtttttggccgacagggatcattgccatattcaaagccgtgcaggtgaggactgctctagcccgtggcgacatggtgtcagccgaaatcgccagccgcgaagccaggaatttttcctttatctcgctggctgtcggaatcgccgccatggttctgtgcaccattcttaccgttgtgatcatcattgctgcccagcatcatgaaaattactgggacccgtag

SEQ ID NO: 45084 - DNA, 678 bp, Artificial Sequence
  Description of Artificial Sequence: Synthetic coding sequence
atgcccggcacccagacccccgcccccgccgaggacccccacagcggatgccgcgacccagtgccggcccgtccacaagcctgtcatccaaaaagccaagagactcgctttgagggtcccctcccgcctcctccaccggcagccgcagctccacccccacctgctcccgcacagaccgctcaggctcccggattcgtagtgcctactcacgcaggaaccgtgggtacactgcctctcgggggttatgttgcacccggataccccttgcagcttcaaccatgtaccgcatatgtgcccgtgtatcccgttggcaccccttacgctggcggcacccccggcggaacaggtgtcacaagcactcttcccccgccgccccagggccccggactggccctcctggagccccggcgcccccctcatgactatatgcctatcgcagtgcttacaaccatctgctgcttctggccaacaggcataatcgctatcttcaaggcagtccaggtccgaaccgcattggccagaggcgatatggtcagcgctgaaatcgcaagcagagaagctaggaacttctcattcatcagcctggccgtcggcattgccgccatggtattgtgtaccattctcacggtagtgataatcattgccgcacagcaccacgagaactactgggatccctag

SEQ ID NO: 45085 - DNA, 678 bp, Artificial Sequence
  Description of Artificial Sequence: Synthetic coding sequence
atgcccggcacccagacccccgcccccgccgaggacccccacagcgggtgtagggaccccgttcctgcacgaccccaggcttgtcatcctaaatcccaggagacccgatttgaaggcccccttccccctcctcctcccgctgcagctgccccacctccgcccgctccagcccagaccgcccaggcccccggctttgtcgtccccacccacgccggcacagtcggaacactgcctcttggcgggtatgtcgcaccagggtacccactgcagctgcagccatgcaccgcgtatgtgcctgtctaccctgtgggcaccccttatgcgggcggtacccccggcgggactggtgttacatctacactccctcccccaccgcaaggaccaggcctcgcactattggagcctcggcggccaccacacgattatatgcctattgcagtgctgaccaccatttgttgtttctggccaacagggattatcgcgatctttaaagcagtccaggtaaggacagccctggctcgaggtgacatggtctctgccgagattgctagccgggaggctcgaaacttcagctttattagcctcgcggtgggaattgccgccatggtcctgtgcaccatcttaacagtagtgataatcatcgcggcgcagcatcacgaaaattattgggatccctag

SEQ ID NO: 45086 - DNA, 678 bp, Artificial Sequence
  Description of Artificial Sequence: Synthetic coding sequence
atgcccggcacccagacccccgcccccgccgaggacccccacagcggctgtcgcgacccagtgccagccagacctcaggcctgccatcccaagagtcaagaaacccgttttgaggggcctttaccccccccaccccccgcagctgccgcccccccccctcccgctcctgcccagacagcacaggctccgggatttgtggtacctacacatgcaggcaccgttggaacactccccctaggtggctacgtggctcccggttatcctctgcagctgcaaccgtgcactgcttatgttccagtttacccggtaggcactccgtatgccgggggtaccccaggagggacaggcgtgactagtacactccccccgcccccacaaggccccggtcttgccttgctcgaacctaggaggccaccccacgattacatgcccattgccgtcctcaccaccatttgttgcttctggccaaccggtatcatcgccattttcaaagctgttcaagtgcggactgccctagcccgtggtgatatggtgtcagcagagattgcctccagagaagcacgcaacttctcatttatatcccttgctgtcggtatcgcagccatggtcctatgtactatcctgactgtcgtcatcattatcgccgcccaacaccacgagaactattgggacccgtag

SEQ ID NO: 45087 - DNA, 678 bp, Artificial Sequence
  Description of Artificial Sequence: Synthetic coding sequence
atgcccggcacccagacccccgcccccgccgaggacccccacagcgggtgcagggatcctgttcctgctcgccctcaagcatgccaccccaagtcacaagagacccggttcgagggaccacttccccccccgccccccgccgccgcagccccaccgccgcccgcccccgcccaaacagcccaggcccctggctttgtggtgccgactcatgcaggcacagtgggtacactccccctcggaggctatgtagcccccggctacccattgcaactccagccctgtactgcctatgtcccagtatatcctgtagggactccttacgccggcggaacccccggcggcaccggtgtcacatccacactccctccaccacctcaagggcccggtctggcattgttggaaccacgcagaccgcctcatgactacatgcccattgcagttctaaccacaatttgctgtttttggcccactggcatcatcgcaatcttcaaagccgtccaggttcgcactgccctcgccagaggcgacatggtgtcagccgaaattgcgtccagggaggcccgcaacttctcatttatatcccttgcagtcggaatcgccgctatggtgctctgcaccatactgacggtggttatcattattgctgctcagcaccacgagaattactgggacccttag

SEQ ID NO: 45088 - DNA, 678 bp, Artificial Sequence
  Description of Artificial Sequence: Synthetic coding sequence
atgcccggcacccagacccccgcccccgccgaggacccccacagcggctgtcgcgatcctgttcccgctcgccctcaggcctgccatccaaagagtcaggagactcgctttgaggggccactccctcctcccccccccgctgccgctgctccccctccccccgcgcctgcacaaactgcccaggcacctggattcgttgtgccaacccacgcaggcaccgttggcacattacctctgggcggctatgtggcccctggttatcctctgcagttgcagccttgtacagcttacgtcccagtctacccagttgggacaccgtatgctggggggactccaggagggaccggagtgactagcacgctgcctccccccccacaaggtccaggcctggccctcctcgaaccacggcgacctcctcacgactatatgcctatagcagtgctaaccaccatttgctgcttttggcccacagggatcatcgccattttcaaggctgtacaagtgcgcaccgcacttgccagaggcgacatggtctccgccgaaattgctagccgggaagcccgtaacttctcttttatttccctggcggtgggcattgccgctatggttctatgcacaattctaactgtcgtcatcatcattgcggcccaacaccatgagaattattgggacccctag

SEQ ID NO: 45089 - DNA, 2946 bp, Artificial Sequence
  Description of Artificial Sequence: Synthetic coding sequence
atggccagcagcccctggggctgcgtgtgcggcctgctgctgctgctcctgcctctgctgggtacaggaccggctttggggagaggttttccaaggccattggagaattctgaaattcccatgatccccggggcccaccctaagggctcggttgggtcagagcctcaggccttcgacgtgttccccgaaaacccccgtgccgactcacataggaactccgacgtaaggcacgctccagccgaagagatgcctgagaaacccgtcgcctctccacttggacccgctttatacggccccaaggcagcccagggcgcccagcgcgagcggctgcccgtaactgacgacttgcagatggctcaagggccaagctctcatggatggactggccccctggacagccaggaactccttcaacaggaggctgtggccccccatccggtagggcacccacacctgactttcattcccacaactcctcgacgccagctccgagtggccaccgtgcctccatccctgcagcacgagggtcaggagggacagtggccacctcgagacgagggcttgaaggcaaaaactaagtctcgagtgccacctacctccccatctgaccaccagggcccaccccacacgctggtgagccatagtggaaccgtgaagaggccagtgctggagggacagggaggctttgaggagcacctgcaagaagccgcgcagggaccccattttacacagcaggatccggcagcccctgacgtgggaagcgtgcctccagtcgaagtggtttattcccaggaacctggcgcccaaccagacttggcacttgcacgctctcttcctcccgctgaggagctcccagtcgagacaccaaagagagctggagctgaggtttcctgggaagtcagcagcccaggccctcccccaaagcaggccgatctccccgatgccaaggactcaccaggaccgcagccgacggacccacctgcgtccgaagccccagaccgtcctagcaaacctgaacgggcggcaatgaatggtgccgatccaatctccccacagcgcgtaaggggggctgttgaggcgccagggacacctaagtccctcatcccaggtccgtctgatcctgggcccgccgtaaacagaacagaaagccccatgggagcactgcagccagatgaagcggaggaatggccagggagaccccagtcacaccccccagcgccgccagtgcaggcaccttcaacatccaggaggggcctgatccgggtgactacacagcgtgcactgggccagccgcctccccccgaaccgactgcttctagcatggcatctgcacctgcttccagcccgcccgcaaatgccacagcccctcccttgcggtgggggcctcttcggcgagtcttaagctttagttgggagctccatgtgtacggggttggggttcttttcctgcttccagctctgctcgccctggctgccttggctgccgcacctgccggacctcgcctggccctggtggcggctgtcctcgtgctcgtggctagcgccctgcggtcggcttacatgcttacagatccgtatggaagtcaagcaagactgggcgttagaggcggactcgtcttatataatctaccattccctctgctgcttaccgccctcgccgctctaacactcctgggcttaggcgccgggctgcccccacccctgcagaaccctctgttgttgggggccgtggccctcgtgcacggcgtcggcctcttagccacagatttgcttagtacgtggtcagtgctgaaccttctcactcaggggctttcatgcgcctggggagcagctgtggccttaggtacactctgcctctgccgtcggcgactgctggacggtccacggggatgggacgcaagtcccggtccaaggctgctggccgttgccggggctcttggactgctggcctccggccttcagttggccgccgctctgtggctttatcctggcccaggtcgggtcggccggttctcatgggcgtggtggggcgttcacttttggcttaggctcctagagctcacttgggcactagctctcgccctcgcggcggtggcggccgcaaggcccagacctccgacagagcacgcctgttgggccaaacttatgaggttagcctgccccgcccccagcggcaagtctgaagtcccggaacgacccaacaactgttatgccggaccgagtaacgtgggagcagggagtctcgatatttccaaatctctgattaggaaccccgctgagtccggtcagctggccactccctccagtggcgcttggggctcagcagcctcgcttggccgcggcccacaagggggacccggactgtcacggaatggcgtaggccccgcccctagcctctcagagctcgatctgagaccgccctcgccaattaacctatcgcgctccatcgatgcagcactgtttcgggaacacctagttagggattcagtttttcagagatgcggcctccgggggttggcgtcaccccctccgggcggggcactgagacctcgacgcggaagccatccgaaagcagaactggatgacgccgggtcctccctgctgcggggcaggtgtaggtctctatcagacgtgcgcgtcaggggtccagttccgcagcacgttgtggaggctcccgacggcgccgctgcagcagctagtgggagttcactggatagtttcagtcgggggtctttaaaaatctcttggaatccctggagacacgggttgagtagcgttgactccctgccactggacgagctcccaagcaccgtgcagctgctacctgcccctacccctgctcccgatagcaccgccgcccggcagggtgacgggcaaggcgaagtccagccaagagggaagcccggcgaaagtcgcagtgcctcatctgatactatcgagctctag

SEQ ID NO: 45090 - DNA, 2946 bp, Artificial Sequence
  Description of Artificial Sequence: Synthetic coding sequence
atggccagcagcccctggggctgcgtgtgcggcctgctgctgctgctgcttccccttttaggaaccggtcctgccctgggccggggttttcccaggcctcttgaaaactcagagattccaatgatcccaggcgcccaccctaagggctccgtcggtagcgagccccaggcatttgatgttttccctgagaatccacgggccgacagccatcggaattctgatgtgaggcatgccccagctgaggaaatgcctgagaaacccgtggcctcacctttgggaccagcgctatacggaccaaaggcggctcagggggcccaaagagaaagactgccagttaccgatgatctgcagatggctcagggaccatctagccacggatggacgggcccactggattcgcaggaactactgcagcaagaagccgtagcgcctcatcccgtgggccatccacatttgacttttatccccacgaccccccgacgacagctgcgggtggctacggtgccccccagtcttcagcacgaaggacaggaaggtcagtggccacccagggatgaaggcctgaaggccaagacaaagtcaagggtgccccccacatcaccaagcgatcaccagggtcccccccatactcttgtgagccacagcggaactgtgaagaggccagtgctggagggacaaggaggattcgaagagcacctccaggaggctgcccaaggccctcattttacacaacaggatccggccgccccagatgtcggatccgtgccaccagtggaagtcgtttactcgcaggaaccaggggctcagcctgacctggcactggcgcggtccctgcctcccgcagaagaactgccggtggagacaccaaaaagggccggcgccgaagtgagctgggaagtttcctccccgggaccaccgccaaagcaggcagatctccctgatgctaaggatagccctgggccacagcctacggaccctcctgcctccgaggcccctgataggcccagcaagccggaaagagcagctatgaacggcgcagacccaatttcacctcagagagtgagaggggccgttgaggcccctggcacacctaagtccctgatcccggggccgagtgacccgggcccagctgtcaatcgaacagagagtcccatgggtgcacttcagccagacgaggccgaagagtggccaggaagaccacaaagtcatcccccagcaccccccgttcaggccccgtccacatcccgccggggccttattagagtgactactcagagagctctggggcagccaccgcccccggaacccaccgctagctcaatggctagcgctccggcgtcctctcctcctgctaatgctaccgccccacccctgaggtggggccccttacggcgagtgctcagtttctcctgggagctgcatgtttatggtgtgggagtgcttttccttctgcccgccttgttggcactggccgctttagccgcagctcctgccggcccacgcttagctcttgtggctgccgtcctcgtgctcgtggccagcgcactccggagcgcatacatgctgacggacccttatgggtcacaagcgcggcttggcgtgcgtggtggcctggtgctttataacctcccgtttcccttgctcctgaccgctctggccgcactgactctgctgggattaggggcagggttgcccccgccccttcagaaccccctgctgcttggagccgtggcgctagtgcatggtgtgggactgctcgccaccgacctccttagtacctggtctgtgctcaacctgctcacccaaggattatcatgcgcctggggggccgcagtggccctgggaaccctgtgcctttgtagaaggaggctgttggatggtcccaggggatgggacgcctcaccgggacccagactgctcgccgtcgccggcgccctagggttgctggcaagcggccttcagctggccgctgcgctctggctctaccccggtccaggccgcgtcggccgcttctcatgggcctggtggggagttcacttctggctgagactgcttgagctgacctgggcactggccctggccctcgctgctgtcgccgccgccaggcctagaccacctactgagcatgcctgttgggcgaagttgatgagattggcgtgccctgcaccctcaggaaagagtgaggtccccgagaggcccaacaactgctacgcgggcccctctaatgttggggccggaagcttagacatctcaaagtctttaatacggaatcccgccgagagtggacagctggctacgcctagttctggcgcttgggggtctgccgcctccctgggaaggggcccacagggcggtcctggcttgtctcgtaatggagtcggaccggctccatcactcagtgagctcgaccttagacccccctctccaatcaacctctcccggagtatcgacgccgctctttttagggagcaccttgtccgggattcagtttttcaacgctgtggcctgcgggggttagcctctcccccacctgggggtgccttgaggcctagacgcggtagtcacccaaaagcagagctcgatgacgcaggttcttcgcttttgcgtggccgctgtcgttccctatccgacgttagagtcaggggaccagtgccgcagcatgttgttgaggcccccgacggggcagctgccgcagcgagcgggtcttcactggacagtttttcgagaggctcattaaagataagctggaacccttggagacacggactcagcagcgttgactcactcccattggacgagctgcctagcacggtgcagctgcttcccgcccctacccctgctccagacagcacagctgcacgccagggcgacggccaaggcgaggttcagcctagggggaaaccgggcgaaagccggtccgcttcatccgatactatcgaactgtag

SEQ ID NO: 45091 - DNA, 2082 bp, Artificial Sequence
  Description of Artificial Sequence: Synthetic coding sequence
atggcccggcacggctgcctgggcctgggcctgttctgctgcgtgctctttgctgctacagtggggccacaaccaacacccagtatccctggggcccctgccactacactaacgcctgttcctcagtctgaggcttccatgctcagcctcaacctcggacttaatttcaaattccacttaagaggaccagctgctgtgtggggaagccctgtcacagaaactcagcccctatcccttggccccggccaggagcccggggaggaagtcgcatctggcctgcggacggaccctctgtgggagttgctggtggggagctctggcaactcactgacagagtggggttccaccgaaggagggtcgaaaccaagagcctccagcctactgccagaaagcacatcccgtaggtcggggcctagtgatggaccaacggccccctatcagccacgtagatccactgtgacctgggacacggccctgatggtcacagccctcccatcctctgccccccgcccacaccaatccgagctcgagcttaaattcgatatggccttgagggccggcgctgcacccactcttggacatcgcacgctgcctttgctgccttctctccgggccagcctggctgagattgctgggcggctgggccccttcggctttttcggaacaacattgagccctctccgcaacttcagcggactttcacccccgggggagacaacctctacgtccagcgcaagcggcgtctcaggcagtctagggttcctgggaactacactctccctgcctccctattccctggagcgaaagctgtccagtcccagtcccctggaccctgccgcctccctctcctttgcttctatcgctaccacgtctcttgacccaaccgtcccaatctcagggcctgacgatctcagccccccagcatctctggggaacccctccggtcagccagagtgcggaccaggttcatgctccgtgggagaactccccgaaagagagggccagcctccggaggccccaagaccccttttcttcctgaccctggaggccgactgggcggaggccagggctcgatgggggctggcctgggaagcacacgtctacggcggttacgaggtgctgcatgcactgggctatggcggccagagtggcttggagggcccttggccttggtgggcctttcagctgggtttgcgacttggggaggtaggagttgcactaccactagccttgctaggcttatatccagcactgtgttcacccagggttcctccccgatgctgggcgaagctttttcggctgtccccagggcacgccgccccgctgctgccaggcggctgggtcaccgggcccccggacaaggaacccctcggttcagcaatcgctcggggggacgccgagctgctccaactatgtgctttggccgggcctggacctgatctgctcctgcaggggggaggatgtcgtggtttcgagggggctgctgccaatccagcaccaagtccagctagtagcccttgcagcgactatacggttgacttccggcctccttcacctatcaaccttcggaggtctattgaggaagcactgtgttcggaggcattactggccccaggacttttccagggcccggccttcgaagacgccttacctgggctgggactgtataggactgcctctctcggtaccggcggccgcgcttccgaacgctccggcgaagcaagtggaccagccgctccaccagagcttccgtccccaggagcctggcctgcagggagttccgtcagctcgggaagtttctgtggacttagtcgagactcatcatccatgcttctatgtagttcccctgaccgtccccccagatgcccgcttgtatgcgtgttgtcaccaccccgccctagcggctcatctcctagtctcccagcctcggggtcttaccaggccctgtcaccaccttccagggattcccccgagccagctagtgagcttcaggccgaggaagcgttattacaggaacagttcctggatgcatgtcgacagatagatgagttgtccgtgggaagtgatactatcgatttgtag

SEQ ID NO: 45092 - DNA, 2700 bp, Artificial Sequence
  Description of Artificial Sequence: Synthetic coding sequence
atggcccggcacggctgcctgggcctgggcctgttctgctgcgtgttgttcgcagctaccgtggggccgcagcccacacctagtatcccgggggccccggccactaccctgacacccgtgccacagagtgaagccagtatgctgagccttaacctgggtttaaattttaagttccacctaagaggaccagcggccgtctggggatcacccgttaccgaaacccaacccctttcactgggccctggccaggagcccggtgaggaagtggcatctggactcaggaccgacccactctgggagctgttggttgggtccagtggcaacagtctgacagaatggggcagcactgaaggtgggtctaaaccccgagcatcttctctcctcccagagagtacttcaaggcgatccggtccatctgacgggccaacagctccctaccagccaagacggtctaccgtaacgtgggataccgccttgatggttacagcgttgcccagtagcgcacccaggccccatcaatccgagctggagttaaaatttgatatggctctccgcgccggcgctgccccaactttgggacacagaactctgccactgttgccatccctgcgcgcgtccctcgctgaaattgccggcagactgggcccatttggcttttttggcaccaccctgtcccccctgagaaacttcagcggtttgagcccaccgggggagaccacatccacgtcaagtgcctctggggtatccggctccttggggttcctgggcaccactctctctctgccaccctattccctggagcgaaaactgtctagcccctcccctctggaccctgcagccagcctatcgtttgccagtattgcgaccacatccctagacccaactgttcccatctctgggcccgatgatcttagccctcctgcgagtttaggaaatcccagcggccagccggagtgcggtccagggtcctgcagcgtgggtgaactcccagaaagggaaggacagcctcctgaagcaccacggcccctcttctttctgactctcgaggctgactgggcagaggccagggcacgctgggggctcgcctgggaggcccatgtctatggcgtgggcgccttattcggcttagtggctttgctggccttgctggccctcgctttgctgccatggcgctgccctcctggcgcaccatgcttggccctgctcgatctgttgttgctgtccgctggaacgacccgagcctttccactgttctatgatgcctatggacatcgggataggcttccggccttggcctggctgctgctgcaagatctccctctgccctgcctcgccgcaggtcttggtctggcgtgcctgcttctagccagaccccgacctccaaggtgtccaactggcttggcagcattgttgctccttgggttaggactggcagcagcggcagccttagggtcagcggctcaccgccctctgaggccgctgcgcctcgcatcacgcggtttacatgcgtttcttgccgcatttctgagtggcttactgctcgctctttcctgttgggggggacgccgccggcgcgcaggcgctcctctgggtggttcaggcttcaagggagccaccccactcccccagggcagatcacctttcgcccccagagagagctggagaagagcagccaggaccgcccctgttgctggaacatttggcctgctcagcggtgcactccaggggtacgaagtgctgcacgcgctgggctatgggggccaaagtggtttagaaggaccctggccatggtgggccttccagctcggattaaggctgggcgaagtgggtgtggccctgcccttggctctgctgggcctgtacccagccctgtgcagtccacgggttccacctcggtgttgggccaagctgtttcggttaagccccgggcacgcagcacctctgctgccaggaggctgggtgaccggccctcctgataaggagcccctgggtagtgctatagctcggggggacgctgagctgctccaattgtgtgccctagctggacccggaccggacctactgctccagggggggggttgtcgggggttcgaaggagctgcagctaaccccgcaccatctccagcatcttcaccttgttctgactataccgtcgactttcgtccccctagccctataaatctcagacgttccatagaagaggccctctgcagcgaagctcttctggcgcccgggctgttccaggggccggcttttgaagatgcacttcctggcctgggcctataccgcacagcgtccctgggcacggggggcagggccagtgaacggtccggtgaagcttcagggcccgccgccccgcccgagttgcctagcccaggcgcttggccagctggcagctccgtctcatcagggagcttttgcgggctgagcagagactcttcttctatgttgctgtgctcctcacctgatcgcccacctcggtgcccactggtgtgtgtgctgtctcccccacgccctagcggcagcagcccaagtctccccgcgtcaggctcttatcaggccctctcccctcccagcagggattcacccgaaccagcctccgagctccaagccgaggaggcactcttgcaggagcagttcctagatgcctgtaggcagattgacgagctgagtgtgggctctgacacgattgacctgtag

SEQ ID NO: 45093 - DNA, 2700 bp, Artificial Sequence
  Description of Artificial Sequence: Synthetic coding sequence
atggcccggcacggctgcctgggcctgggcctgttctgctgcgtgttgtttgcggcaacagttggaccacagcccactcccagtatccccggggctcctgcaaccactttgacacccgttccacagagtgaggctagtatgctttcactcaatctggggttgaactttaagttccacttgcgcggccctgcagcggtgtggggctcaccagtcacagaaactcagcccctctcactggggccggggcaagagcccggcgaagaggtggcgagcggccttaggactgatccactctgggaactgctcgtcggttcctccgggaactccctgacagagtggggatcaaccgaaggagggtccaaacctagagcatccagtttgttgcccgagtccacgtccaggaggagcgggccatctgatggccccacagcaccctaccagcctcggagatctaccgttacctgggacacggccttgatggttactgctctgccaagttctgccccccgcccacatcaatctgagctagagctgaaattcgatatggctttaagggccggcgcagcccccactctcggccatcgtactctgcctctgctaccctcactaagggcgtccctggctgaaattgccggccgtctcggcccttttggattcttcggaacaacactgtctcccctccgcaactttagcggcttgtcaccgccaggtgagacaacatccacaagctctgctagcggagtgtctggtagccttggatttttaggaactaccctgtccctacccccctatagtctcgagcggaagttatcatccccctctccgctcgaccctgcagcctcgctttccttcgcgtctattgctactacctctttggatccgaccgtgccaatatcggggccagatgatctgagtcctcccgccagcctggggaacccatccggacagcccgagtgcggccccggcagctgttctgtgggagagctgccagagagggagggtcaacctcctgaagccccacgccctctattttttctaacactagaagctgactgggccgaggctcgggcgcggtgggggttagcctgggaggcacatgtctatggagtcggcgctctgtttggccttgtcgccttgctggcattgttagcactagctttactcccctggcgatgtcctccaggcgcaccctgtttggcgttgctggatctcctcctgttgtccgcaggtaccactcgggcatttccgcttttctacgacgcttacggacaccgtgaccgcctccccgcgctggcttggctgctattgcaggacctcccactgccctgcctagcagccggactgggtctcgcctgtctcctcctggctcgaccaaggccacctagatgcccaactgggttggcagcactgctgcttctcggcctgggtctcgccgcggcagccgcactgggctccgcagctcacagaccactaagaccattgcgcctggcgtcacgaggcttacacgctttcctcgccgcctttctttctggtctgctcctcgcgttaagctgctggggcggccgacggcgtcgcgctggcgcccccctcggagggtccggatttaagggggccacgccactaccccaagggcgcagccccttcgcgcctagagaaagctggaggcgagctgctcggacggccccagtagccggaacttttggcctcctttcaggagccctgcaagggtatgaagtgctccacgccctggggtacggagggcagagcggcctcgaaggcccatggccctggtgggcattccagttgggtctcaggctaggcgaggtcggcgtggccttacccctggcactgttgggcctctacccagcgctgtgctcacccagagtgccacctcgatgctgggctaagctgttccgattatccccgggccacgccgcccccctacttcctggcggctgggtgacaggcccccccgataaggagccgctgggatcagctattgcccgcggtgatgctgagttgctccagctctgtgctttggcggggcctggaccggacttgctattgcagggcggtggctgtagagggttcgagggagcggccgcaaatcctgccccctcccctgcgtcgagcccatgcagtgactacacagtcgattttaggcccccgtccccaatcaacctccgaaggagtatcgaggaagccctgtgctccgaggcactgctggctcccggcctctttcaaggcccagccttcgaggacgccctgcctggtctcgggttatataggaccgcatctctgggaacagggggacgggccagcgaacggtctggggaggcttctggacccgcagcccccccagaactacccagccccggagcttggccggctgggtcctcggtgagcagtggaagcttctgtggtttgtcgcgggattcgtcctccatgttgctgtgcagctctccagaccgcccaccccgctgcccgctggtgtgcgtcctgagccctcctaggcccagtggttcatcgccctccctgcccgcaagcggctcctaccaggcattgtcgcccccgtctcgggactcccccgaaccagccagcgagctgcaagccgaggaggctctgcttcaagagcagttcctcgatgcttgtcgtcagattgacgagctgtcagtgggtagtgatacgattgacctgtag

SEQ ID NO: 45094 - DNA, 1290 bp, Artificial Sequence
  Description of Artificial Sequence: Synthetic coding sequence
atggcccggcacggctgcctgggcctgggcctgttctgctgcgtgctcttcgccgccactgtgggaccacagcctacacctagcatcccaggcgccccagctacaacgctgactcctgtcccacagtccgaggctagtatgttatccctgaatctagggctcaactttaaattccatcttcgcgggcccgccgccgtgtggggaagccctgttaccgagacgcaaccgctgtcactcggcccaggccaggagcccggcgaagaagtggcctccggcttgaggacggatcccttatgggaactacttgtcggaagttccggaaatagtctcaccgagtgggggtcaactgagggaggctccaaacctcgggcttcttcactcctgcctgaatccaccagtaggcgcagcggaccttcagatgggcctacagccccttaccaaccccgtagatctaccgtgacttgggataccgccctgatggtgaccgcccttccaagtagtgcaccacgccctcaccagtcagagctagagctgaagttcgatatggccctgagggccggggcggcaccaactttgggtcaccgtactctcccactgttgccatccctgagggctagcctggccgagattgccggccggctaggcccatttggattcttcggaacgactctgagtcccctgcgaaatttttcagggctgagcccaccaggcgagactacctctacctctagtgccagcggggtcagtgggtccctgggcttccttggtactaccttgagtctgccaccttacagtctcgaacggaagcttagctcaccgtcaccattggatcctgctgctagcctgtcattcgcctccattgccacgacaagcctagaccccaccgtaccgatatctggacctgatgatctctccccaccggcgtccctaggcaatcccagtggccagccagaatgcggtcccgggagttgctccgtgggagagctgccagagcgggagggccagccccctgaggctccacgtccacttttcttcctgaccctcgaggccgactgggctgaagccagggctcgttggggcttagcctgggaagcccacgtatatggacgccttcaccgcggcctgccccccgccctccctaatcagcccgccacacaacataggggaggacctttgcagagagggccagcctgcgcttggccgctgcctgggccctgtttgcgagggcgaagcgcttgggcacggactctgccacaccgtctggctggggatcgagggcaggggcaatag

SEQ ID NO: 45095 - DNA, 1692 bp, Artificial Sequence
  Description of Artificial Sequence: Synthetic coding sequence
atggccgccgccgccgtgaccggccagcggcccgagaccgccgccgctgaggaagcgtcaagaccccagtgggctccaccggaccattgtcaggcccaggctgccgcgggactgggggatggagaggatgcccccgtgcgccccctctgcaaacccagagggatttgcagtagggcctactttttggttctgatggtgttcgttcatctgtatctgggaaacgtgctagcactcctcctgtttgttcactattctaatggcgatgaatctagcgacccaggccctcagcatcgcgcccagggccccggaccggagccaacattgggccctcttaccaggttagagggcattaaagtaggacatgagaggaaagtccagctggttactgatagggaccactttattagaacactgagcctgaagccgctgctctttgagatcccgggtttcttaactgatgaggagtgtcgcctgattatccacctggcacagatgaagggtctgcaacgaagccaaatcctcccaactgaggaatacgaggaggcgatgagcacaatgcaggtttctcaactggacctgtttcgccttttggatcagaaccgagacgggcacctccaactccgtgaagttcttgcacagacgcgactgggaaacggctggtggatgacacccgagtccattcaagaaatgtatgccgccattaaagctgatcctgatggggacggtgttctgtccttgcaggaattctctaatatggatctccgcgatttccacaaatacatgaggtcccataaagcggaaagcagcgagttggtgcgcaacagtcaccacacctggctttatcaaggtgaaggagcgcatcatatcatgagagccatccgacagagagttttgcgcctcacgcggttatcccccgagatagtcgagctgtcagaaccccttcaagtggtgagatatggagagggcggacattaccacgctcacgtcgattccggcccagtttatccagagaccatctgtagccacactaagctcgtcgccaatgaaagcgtgccatttgagacttcttgccgccaagtctccccaaattggggcctgccttcgattcttaggcctggaacgcccatgacacaagcacagccctgtactgtgggagttcccctgggaatggggcccggcgaccactgggtaataccggtgagcccctgggaacacccccagttgggaacctgctcagttcctccactaccatattcttatatgaccgtgcttttttatcttaacaacgtcacaggcggtggggaaaccgtatttcctgtggcagataaccgaacctatgacgagatgagtctgatacaggatgatgtggatttgagagatacacgtaggcattgtgacaaaggcaacctgcgagttaagccacagcaggggacagctgttttttggtataattacctccccgacggacaggggtgggtgggcgacgtggacgactatagtcttcatggcgggtgcctggttacccgcggcaccaagtggatcgccaacaattggattaacgtagatcccagccgggcgcgtcaggcactgttccaacaggaaatggcacgattagccagagaaggggggacagacagccagcccgaatgggctctggaccgtgcatacagagatgccagagtagagctgtag

SEQ ID NO: 45096 - DNA, 1509 bp, Artificial Sequence
  Description of Artificial Sequence: Synthetic coding sequence
atggccgccgccgccgtgaccggccagcggcccgagaccgccgccgcagaagaagccagtcggccacaatgggctccacccgaccattgccaggcgcaggccgccgctgggctgggggacggggaggacgctcccgtcaggcctttgtgtaaaccccgaggcatttgttcacgggcctatttcctggtattgatggtgttcgtccacctataccttggaaacgtgttggcactgctgttgtttgtacattactcaaacggcgatgaaagcagtgacccgggtccccagcatcgggcacaaggccccggacctgagcccacacttgggccgctgacccggctggagggtatcaaagtcgggcatgaacgaaaagtgcagctcgttacggatagggatcattttatcaggactttgtccttgaagccactgttattcgagatccccggattcctgaccgatgaggagtgccggctgatcatccatttggctcagatgaagggcttgcagcggtcccagatcctgccaaccgaagagtacgaggaggctatgtctacaatgcaggtgtcccagctggacctctttaggctgctcgaccaaaaccgggatgggcatttgcagctgcgggaggtcttggctcagacccgtttgggcaatggttggtggatgacacccgaatcgatccaggagatgtacgccgccatcaaggccgatcctgatggcgatggagttctatctttgcaggaattcagcaatatggaccttcgagacttccacaaatatatgcggtctcataaggccgagagttctgagcttgtgaggaacagccaccatacttggctgtaccagggcgagggcgcccaccacatcatgcgcgcaatcagacagcgggtgcttcgcctcacaagactcagtccggagatcgtcgagctttcggaaccattgcaggtcgttagatatggggagggaggtcattatcacgcacacgtggatagtgggcccgtctaccctgaaactatttgcagccatactaaactagttgcaaatgagtcagtgcccttcgagaccagttgccggtacatgacagtacttttttacctaaacaacgtaactggtggtggggaaaccgtgtttccagttgcagataaccgaacgtacgacgagatgagtctgatccaggacgatgtcgaccttcgcgacacccgcagacactgcgataaaggcaatctgcgcgtgaaaccccagcaaggaaccgcagttttttggtacaattatctcccagacgggcagggctgggtgggcgatgtcgatgactattcgctacatggtggctgcctcgtgacacgcggtactaaatggatcgccaacaattggataaatgtggatccatctagggccagacaggcgctgttccagcaggagatggctcgcctcgcccgggaaggcggaaccgatagtcagcccgaatgggctctcgatcgcgcctacagggacgcgagggtcgaattgtag

SEQ ID NO: 45097 - DNA, 2358 bp, Artificial Sequence
  Description of Artificial Sequence: Synthetic coding sequence
atgcccaagggccggcagaaggtgccccacctggacgcccccctgggcttacccacatgtctgtggctggaactggcaggcctgttcctgcttgtaccctgggtgatggggctggctggcacggggggaccagacggacagggcacagggggccctagctgggcggttcacctcgagtccctcgagggagatggggaggaggaaaccctggagcaacaggcagacgctttggctcaggccgctggccttgtaaatgctggcagaattggggaactccagggccactacctgttcgtgcagcccgcagggcacaggcccgctctggaggttgaggctattagacagcaggttgaggccgtgcttgccggccacgaagccgttaggtggcacagcgaacagaggctgctcaggagagccaagcgttctgtgcacttcaatgaccctaagtatccacagcagtggcacctgaacaacagacgaagtccaggtagagacattaatgtgactggggtgtgggaacgtaatgtaacgggaagaggcgtgacagtggtggttgtcgatgacggagtggagcatacgattcaggatatagcccctaattattcccctgagggtagttacgatctgaacagcaatgatccagatccaatgcctcatccagatgtcgaaaacggcaatcaccacggaaccaggtgcgctggcgaaatagcggcagttccaaacaacagtttttgcgccgtgggggttgcttacggctccaggattgcagggatcagagtgctagatggcccactgaccgactcaatggaagccgttgcctttaataagcattatcagatcaacgacatttacagttgcagttggggacccgacgacgacggaaaaactgtggacgggccccatcagctgggcaaagcagcccttcagcacggcgtgattgccggaaggcagggattcggcagtatcttcgttgtcgcttcgggcaacggcggccaacacaatgataactgtaactatgacggctatgctaacagtatctatacagttactatcggggctgttgacgaggagggccggatgcccttctatgctgaggaatgtgcatccatgcttgccgtaaccttcagcggaggtgataaaatgctaagatcgattgttactacagactgggacctacagaagggaaccgggtgtaccgagggccacacgggcaccagcgccgccgcgccgctggctgctgggatgatagcactaatgctgcaggtgcggccttgcctgacctggcgggacgtgcagcatatcatcgtgtttactgctacccggtacgaggacagaagggcagaatgggtgaccaatgaagcagggttttctcattcccatcagcatggctttggcctgttaaacgcttggcggctcgtgaatgccgccaagatttggacgtctgtcccgtacctggcatcatacgtgtcccccgtgcttaaggaaaataaggcaatcccccagagtccccgcagcctggaggtcctttggaatgtgtctcgcatggacttagagatgagcggtttgaagaccctcgagcatgtagcggtgactgtatctataacccatccccggaggggatccttagagctgaaactcttctgtccctcgggaatgatgtccctgattggggcaccccggagcatggactctgatcccaatggctttaacgattggaccttctcaactgtccggtgctggggtgaacgggcccggggcacctatcgccttgttattcgggacgtcggcgatgagagcttccaggtgggcatcctgaggcagtggcagctgaccttatacggaagcgtctggtctgctgtggacatccgggaccgccagagattgctggagagcgccatgtccggcaaatatctgcacgacgacttcgctctgccgtgcccacctggcttaaaaattcctgaggaagacggctacacaattactcctaatacgcttaagacacttgtcctggtgggatgcttcaccgtattttggaccgtgtactacatgcttgaggtgtatctaagccagcggaacgtggcctcaaaccaggtgtgcagaagcggtccatgtcattggccacacaggagtaggaaagccaaggaagaaggtaccgagttggaaagcgtgcccttgtgtagctctaaggatcccgacgaggtggagaccgaaagtagaggtccacctacgacatcagatttactcgctcccgacctgctggagcagggagactggtccctgtcccaaaacaagtccgcattggattgtccacaccaacatctcgatgtgccccacggaaaagaggagcaaatttgttag

SEQ ID NO: 45098 - DNA, 342 bp, Artificial Sequence
  Description of Artificial Sequence: Synthetic coding sequence
atgcccaagggccggcagaaggtgccccacctggacgcccccctgggactgccgacctgcctgtggctggagcttgccggcctttttttgctggtcccctgggtgatgggcttggccggaactgggggccctgatgggcagggtactggagggccctcctgggctgtgcatttggaaagcctcgagggggatggcgaggaagagaccctagagcagcaggccgatgctctcgcacaagcggcgggcctggtgaatgctggcagaatcggggaactccagggtcactacctctttgtgcagccggcaggacatagacctgccttggaggttgaggccatctag

SEQ ID NO: 45099 - DNA, 279 bp, Artificial Sequence
  Description of Artificial Sequence: Synthetic coding sequence
atgcccaagggccggcagaaggtgccccacctggacgcccccctggggttgcccacctgcttgtggctagaactggctggcctatttctactcgtaccctgggtgatgggactggcaggcaccgggggccccgatggacagggcacaggaggcccctcctgggcggtgcacttggagagcctcgagggcgacggagaagaagaaacgctcgagcagcaagccgacgcacttgcacaggccgcaggcctcgtgaacgccgggcgaatcggggaactctag

SEQ ID NO: 45100 - DNA, 279 bp, Artificial Sequence
  Description of Artificial Sequence: Synthetic coding sequence
atgcccaagggccggcagaaggtgccccacctggacgcccccctgggactgccaacgtgtctctggctggagttagccggcctgtttctgttagtgccatgggtgatgggactcgccggcaccggtggccctgacggccaagggacaggcggcccatcgtgggccgtgcacttagaaagtctcgaaggagacggagaggaagagacactggagcagcaggcagacgccctggctcaagccgccgggctggtaaatgctggcaggattggcgaactgtag

SEQ ID NO: 45101 - DNA, 714 bp, Artificial Sequence
  Description of Artificial Sequence: Synthetic coding sequence
atgcccttctacgccgaggagtgcgccagcatgctggccgtgaccttttccggaggggacaaaatgctaagaagcatcgtgacaacagactgggacctgcagaaggggactggatgtacggaggggcacactggcacaagcgcagccgctccgcttgcagcggggatgatagccctaatgctgcaggtacggccctgtctcacctggcgcgatgtgcagcacatcatcgtattcaccgccacacggtacgaagatcgtagggctgaatgggtgacaaacgaagccgggtttagtcatagccaccagcatggcttcggtctgctgaacgcttggcggctggtgaatgctgccaagatctggactagtgtgccctatctagcaagttatgtctccccagtactaaaggaaaacaaggccatcccgcagtctccccgctctctggaggttctgtggaatgttagccgcatggatcttgagatgtctggactaaaaacattggagcacgtggcagtcactgtctctataacccacccgcgccgaggatcactcgaactaaagctgttctgcccaagcggtatgatgtccctcatcggcgcccccaggtctatggacagtgatcctaacggcttcaacgactggactttctctacagtccggtgctggggcgaacgggctcgtggaacttatagacttgttatcagagacgtgggatag

SEQ ID NO: 45102 - DNA, 1776 bp, Artificial Sequence
  Description of Artificial Sequence: Synthetic coding sequence
atgcccaagggccggcagaaggtgccccacctggacgcccccctggggctccctacctgcctttggctggagctcgcaggactgttcctcctggtgccctgggttatggggctggctggcactgggggaccagacggacaaggcaccggaggccctagttgggctgtccatcttgaaagtctggaaggggatggggaagaggagacactggagcagcaggcagacgccctcgcacaggctgccggcctggtgaacgctggtcgaatcggggagttacagggtcactatctgtttgtccagcctgcgggccaccggcccgctctggaggtcgaggctatacgccagcaggtggaagccgttctcgctggccatgaggcggttcggtggcacagtgaacaacgccttttgcgacgggctaagaggtcagtacattttaacgatcccaaatatccccagcagtggcacctgaataacagacgctccccaggccgtgacataaatgtcaccggcgtttgggagagaaacgtgacaggaagaggggtaactgtggtggtcgtggacgacggagtggagcacactatccaggatattgcgcctaattacagccccgagggctcctatgacctgaatagcaacgaccctgatcccatgccgcaccctgatgtcgagaatggtaatcaccacgggaccagatgtgccggcgagatcgccgctgtacctaacaactccttttgtgccgttggtgtggcctacgggagtcgcatagcaggaatcagggtgctggacgggccactcactgatagtatggaagccgttgctttcaacaagcactaccagatcaacgacatttacagctgtagctggggcccagacgacgacggcaagaccgtagatgggcctcatcagctagggaaagccgctctgcagcacggtgtgatcgccggtcggcaaggcttcggcagcatcttcgtggtcgctagcggtaacggggggcagcacaatgacaactgtaattacgatgggtatgcaaactcaatttatacagtgacaataggcgccgtggacgaagagggcagaatgccattctacgctgaggagtgtgcttcgatgctggcagtgacatttagcgggggagacaagatgctccgttccattgtgacaactgattgggatcttcagaagggaacaggctgcaccgagggccatacagggacctccgccgccgcgcctctggccgctggaatgatagccctgatgctgcaagtgaggccatgtctcacgtggcgtgatgtccaacacatcatcgtctttactgccactcggtatgaagatcgccgagcagaatgggtgacaaacgaagccggattcagccatagtcaccagcatggctttggtctactgaacgcgtggagactggtgaatgctgctaaaatatggacttcagtgccttacctcgcatcttacgtctctccggtgctaaaagagaacaaagccatccctcaaagtcctcgcagccttgaagtgctttggaatgtgagtcgaatggacctagaaatgtctgggctgaaaactcttgaacacgtggccgtcactgtgagcattacacatcctcggagaggctctctggagctgaaactcttttgcccctctggaatgatgagcctgatcggagccccaaggagcatggactcctggctgtgcgtcgaatgcagcagacatcagggacaaacaaaagccgtccgagaatgccacgaatggaagattcctgcccggtag

SEQ ID NO: 45103 - DNA, 2022 bp, Artificial Sequence
  Description of Artificial Sequence: Synthetic coding sequence
atggccaagctggagaccctgcccgtgcgggccgaccccggccgggacccccttctggcattcgctcccagacccagtgagcttggcccccccgaccccaggctggccatgggcagtgtaggttccggtgtggcccatgcacaggagttcgccatgaaatccgtcgggacaaggaccggcggaggcggatcccaaggatcatttcccggcccccgtggttccggctccggtgccagcagagagcgacctgggcgctacccctcagaagacaagggtttggccaatagcctctatctcaatggcgaacttcgtggatcagatcacacagatgtttgcggtaatgttgttggaagcagcggggggagctcatctagcggcgggtctgataaggctcctccccagtatagagagcccagtcacccacctaagctactcgccacatccggcaagctggaccaatgctccgagcctctcgtgagaccttctgccttcaaaccggttgttcccaagaattttcatagcatgcagaatctgtgcccacctcagaccaacggcacacccgagggccggcagggaccaggaggcctgaagggaggcctggacaagtctcggactatgactcccgcgggtggcagcggtagcgggctgagcgactctggaagaaatagcttgacgagtttgccgacctactccagtagctactcccagcacctcgcaccgctatcggctagtacgtcacacattaatcgaattggtactgcttcctacggctccgggagtggtggctctagcgggggaggtagcggctaccaagacttagggactagcgattcaggccgtgcttcctcaaaaagcgggtcttcgtcatcaatgggccggcctggacacctggggagcggtgagggggggggaggcgggctgccctttgccgcttgcagtcctccgagtccctctgctctgatccaagagctcgaggaacggttatgggagaaggagcaagaagtggcagctctcaggagatctctcgagcagtccgaagcagctgttgcacaggtgctggaggagcggcagaaggcttgggagcgcgagctggctgaactgcgtcaaggttgctcgggtaagctacagcaggtcgcccgtagagcacagcgggcacagcaggggttacaactacaagtcctgaggttgcagcaagacaaaaagcagcttcaagaggaggctgccagactcatgagacagcgggaggagttggaggacaaagtcgcagcctgccagaaagagcaggctgattttttaccacgcattgaggagactaagtgggaggtctgccagaaagcgggcgagatcagcctgcttaaacaacagctcaaagattcccaagcagatgtgtcccagaaactcagcgaaatagtcggcctaaggagtcagctgcgggagggacgggcctcattacgcgagaaagaggaacagttgctgtctctgagggactccttttccagtaaacaggcctctttggagttgggtgagggtgagcttcccgctgcatgtctgaaacctgcgcttacacccgtggacccggccgagccgcaggatgcactggccacgtgcgagagtgacgaagcgaaaatgcgacgacaggcaggtgtcgccgcagctgctagccttgtcagcgttgatggggaagcagaagcaggaggtgagagcgggacgagagctttacggagggaagtgggccgtctacaggcggaactggctgccgagagacgggcccgagaacggcagggtgcctcctttgctgaagagcggcgggtatggctggaggagaaagaaaaggtcatcgaataccaaaagcaattgcaattgagctatgttgagatgtaccagagaaaccaacaacttgaacgaaggctgagagaacgaggagcagccgggggtgcatccacgccgacaccacagcacggagaagaaaagaaagcttggaccccatcgaggctggagcggattgaatccaccgagatatag

SEQ ID NO: 45104 - DNA, 1884 bp, Artificial Sequence
  Description of Artificial Sequence: Synthetic coding sequence
atggccaagctggagaccctgcccgtgcgggccgaccccggccgggacccgcttctggctttcgctccccggccgtccgaactgggaccaccagaccctagactcgccatggggtcagtggggtccggtgtggcccacgcccaggagtttgcaatgaagtctgtgggcacccgcactgggggcggagggtcccaggggtcattccctggcccccgcggcagtggctccggcgccagcagggagagacctggcagatatccatccgaggataagggattagccaatagcttgtacctgaatggagaactgagaggctccgatcataccgatgtctgtgggaatgttgtggggtccagcggtggctcatccagttctggcggctctgataaagcccctcctcagtatcgagaacccagtcacccacctaagttgctcgcaacatctggaaaattagaccagtgctccgagccactggtccgtccatctgccttcaaacccgtggtcccgaagaatttccactctatgcagaacctgtgccccccccaaacaaacggcaccccagaaggccgacagggccccggcggactgaaaggtggcctcgacaaatcacggactatgacgcccgcaggtggatctggaagcggcttatcagattcaggaagaaacagcctgactagtctgcccacctattcttcaagctattcccagcacctggcccctctcagtgcatccactagccatataaacaggatcgggacagcttcctacgggagcggctccggggggtcatctggcggaggctctggctatcaggacctgggaactagcgattcgggacgggcatcttccaagtcaggctcctcatcctccatggggcgccccgggcacctcgggtccggcgagggaggtggaggcggactaccgttcgcagcttgttctccccctagtccttccgcgttgattcaggagctggaggagcgtctttgggagaaggagcaggaagtggcggctctgcggaggtcattagaacagtctgaagcagctgttgcccagcaggataagaagcagctacaagaggaggccgctcgcctgatgcggcagcgtgaggaactggaggataaggtggctgcatgccagaaagagcaggcagattttctcccaaggatcgaggagacaaagtgggaagtctgtcaaaaggcaggcgaaatttctctgcttaaacagcagcttaaagattcccaggccgatgtgagtcaaaagctttccgaaatcgttggcctgcgatctcagctgcgggaagggcgtgcgtcactgagagagaaagaggaacagctactttccctgcgggattcgttttccagcaagcaggctagccttgagctaggcgaaggagaactgcctgccgcctgtcttaagcccgccttaacccccgttgaccccgctgagccgcaggatgccttggcaacctgcgaatccgacgaagccaaaatgcggagacaagctggcgtggctgccgctgcatctttggtgtcagtggatggcgaagcggaggccggcggtgagagcgggactagagctcttcggagagaagtcggaaggctgcaggctgaacttgcagcagaacggcgagccagagagcggcaaggagcaagcttcgctgaagagcgccgcgtgtggctggaggagaaagagaaagttattgaataccagaaacagcttcagctttcctacgtcgagatgtatcagagaaaccagcagctcgagagaaggctgcgcgagcgtggtgccgctggcggagcctccacaccaacaccacagcacggagaggaaaagaaagcttggacgcccagtcgcctggaacggatcgaatccaccgagatctag

SEQ ID NO: 45105 - DNA, 1884 bp, Artificial Sequence
  Description of Artificial Sequence: Synthetic coding sequence
atggccaagctggagaccctgcccgtgcgggccgaccccggccgggaccctctgttggcctttgcaccccgcccttcagagctggggcccccagatcccagattggcaatgggttcagtaggatccggcgtggcacacgcccaagaattcgctatgaaaagtgtagggactagaaccggggggggaggtagtcagggaagttttcccggaccaaggggaagcggtagcggcgcctcacgcgagagacctggccggtaccccagcgaggataagggactcgccaatagcctgtaccttaatggagaactgcggggatccgatcacaccgacgtgtgtgggaatgtggtcggcagttcaggcggctcaagttcttctggtggttcagacaaagcccctccccagtatcgcgagccatcccatcctcctaagctcctcgccacctccggcaagctggatcagtgctccgagcccctggtccgccccagcgcattcaagcccgtcgttcctaagaacttccatagcatgcaaaatctgtgtccaccccagacaaacggaacacctgaaggacgacagggtcccggggggttgaagggtggactggacaagtcccgaactatgacacctgccggcggcagcgggagcgggctcagcgactcgggaaggaactccctgacgtccctacctacctattcttcctcctactcacagcatttggccccactcagcgcaagcacatcccatatcaataggatcggtactgccagctacgggtctgggtccgggggatcgtccggagggggttccggttaccaggacttaggtacatccgactccggccgggcatctagcaaatctggctcatcttcctccatgggtcggccagggcatcttggaagcggcgaaggagggggcggaggcttaccctttgcagcctgttcacccccttctccctccgccttaatccaggaactggaggagaggttgtgggagaaagagcaagaagtggcagcattgcgccgcagtttggagcagagtgaggccgccgtcgctcagcaggacaagaagcagctccaggaggaggccgcgcgcctcatgaggcaaagagaggaacttgaggacaaggtagctgcttgtcagaaggaacaggccgatttcctgcctagaatagaagagaccaagtgggaagtgtgtcaaaaggcaggagagatttctctgcttaagcagcaactgaaggattcacaggcggatgtttcacagaagttgtctgagatagtcggtctgaggtctcaattgagggaaggaagggcttccctgagagaaaaggaagaacaactgttgtcactgagagactccttctcgtctaagcaggcctccctggaattgggggagggtgagctccctgccgcttgcctgaaaccagccttgacaccagttgaccccgcggaaccgcaagacgcactggcaacttgtgagtccgacgaggcaaagatgcgccggcaggctggggttgcagccgctgcttcactcgtcagcgtcgacggcgaggctgaagctggcggcgaaagtgggacaagggctctcaggagagaggtggggcggcttcaggctgaactggctgccgagcggcgcgcacgagaacgacagggggcttcgtttgctgaagagcgccgcgtatggttggaggaaaaggagaaagtgatcgaataccagaagcagctccagctaagttatgtggaaatgtatcagcggaaccaacaactagaaaggcggctccgggagcgaggcgccgctgggggagccagtactcccacaccacaacacggagaggagaagaaggcctggacacctagtagacttgagcggatcgaatctacagagatatag

SEQ ID NO: 45106 - DNA, 1188 bp, Artificial Sequence
  Description of Artificial Sequence: Synthetic coding sequence
atgagcgccaacgccaccctgaagcccctgtgccccatcctggagcagatgtctcgactccagtcccatagcaatacttccatccgatacatcgatcacgccgctgtgcttctgcacggtctcgcgtcactcctgggccttgttgagaatggcgtaatactgttcgtggtggggtgtcgaatgcgtcagacagtggtaactacctgggttttacatcttgcactgtctgacctgttggcttcagccagtctgccattcttcacttatttcctggctgtcggtcatagttgggagcttgggactaccttttgtaagttacatagtagcattttttttctgaatatgttcgccagcgggttccttttatctgctatctcccttgatcggtgcttgcaggtggtccggcctgtttgggctcagaatcatcgtaccgtggccgcagcgcataaggtatgtttggtgctgtgggctctggccgtactaaacaccgtaccctacttcgtcttcagggacaccataagccggctggatggtcggattatgtgctactacaatgtgcttttgttgaatcctggacctgaccgggacgcgacttgtaacagtcgccaggtggccctcgcagtctcgaagttcttactggcctttctggtcccgctcgccattatcgcctcatcacacgccgcagtatctctgcgtctccagcatcgtggcagaaggagacctggacgctttgtgaggctggtggcagccgtggtggcagcattcgctttgtgctgggggccctatcacgtgttttccctgcttgaagctcgcgcacacgctaatcctggcttgcgaccccttgtgtggcgtggcctgcctttcgtgacgtctctggccttttttaatagcgtggcaaacccagtcctttatgtcttaacttgccccgacatgcttcggaaattgagacgatcactgcgaactgtgctggaaagcgtgttggtggacgacagtgaactcggaggagctggatcctcccgtcgccgcaggacttcgtccacggcacggtccgcaagtcctcttgccctgtgctcgagacccgaggagccgcgcgggcccgcgagactgctcggatggcttctgggttcgtgcgccgcctctccacagacaggtccactgaatagagcgctttcaagcacctcctcctag

SEQ ID NO: 45107 - DNA, 933 bp, Artificial Sequence
  Description of Artificial Sequence: Synthetic coding sequence
atggtgtacaagaccctgttcgccctgtgcatcctgaccgccggctggagggtacagtctttaccgacaagcgctcccctgtccgtgtccctacccacaaatattgtcccacccactaccatatggacaagctctcctcagaacaccgatgccgacaccgccagtccttcaaatgggacccataataatagtgttctgccagtcacggcttcagcgccaacctctctgttgcctaagaacatttccattgaaagtagggaggaagaaatcactagtcccggctctaactgggagggcactaatacagacccatctccctcagggtttagcagtaccagcgggggagtgcatctgaccaccactctcgaggagcactcttccgggacccctgaagctggagtggcagctaccctgagccaaagcgcagcggagcctccaaccctcatctcgccccaggctccggccagctcaccatcttccctgtctacttcccctccggaagtcttctctgctagtgttacaacaaaccactcctccacggtgacaagtacacaaccgaccggagctccaacggccccagagtctcctacagaggagagttcttccgaccacaccccgacaagccatgctaccgcagagccagtgccccaggagaaaaccccgccaaccactgtgtcgggtaaggtaatgtgcgaattgatcgacatggaaactacaacaactttcccccgtgtcatcatgcaagaagtcgaacatgctcttagcagcgggtctattgctgcaatcactgtgaccgtgatagcagttgtactgcttgtttttggagtggcagcttacctcaagatcagacacagtagctacggaagactgctggacgatcatgactacggcagctgggggaactacaacaaccctctttatgacgattcctag

SEQ ID NO: 45108 - DNA, 1191 bp, Artificial Sequence
  Description of Artificial Sequence: Synthetic coding sequence
atgggcgagcggaagggcgtgaacaagtactacccccccgacttcaatcccgaaaagcacggtagccttaacaggtatcacaactcacacccgttaagagaaagagctcgaaaattatctcaaggcattctgatcatccggttcgagatgccctataacatttggtgcgatggatgcaagaatcacatcggcatgggcgtacgttataacgcggagaaaaagaaagtcggcaactactacacgaccccaatttaccggtttcgtatgaagtgccatctttgtgtcaattacattgagatgcaaaccgatcctgccaattgcgattatgtaattgtgtcaggggcacaacggaaggaggagcggtgggacatggcagacaacgagcaggtgctgaccactgaacatgagaagaaacaaaagttagagacagacgcaatgttcagactcgaacatggcgaagccgaccggtccaccctgaagaaagcgctgccaaccttatcacacatccaagaggcccagagcgcctggaaagatgattttgctcttaactctatgctgcggaggaggtttagggagaaaaaaaaagcaatccaggaggaggaggagagggatcaagccctacaggccaaggcttctctaaccatccctctcgtcccggaaaccgaagacgatcgcaagttggcagctcttcttaagtttcatacacttgactcttatgaagataagcagaaactgaagcgcactgaaatcatctcacggagctggttccccagtgcgcccgggtccgctagttcgagtaaggtctccggagtgctcaagaagctggcgcagagccgcaggactgctcttgccacctcccccatcacagtgggcgacttgggaattgtgagaagaaggtctagagacgtgcctgagagccctcagcatgctgccgatacaccaaagtctggcgagccaagagtgccggaggaagctgcccaagaccggcctatgagccctggggattgtcctcccgaaacaactgagacccctaaatgcagctctcctagagggcaagaggggagtcgccaggataaacccctgagccccgccggatcatcgcaagaggccgccgacacacccgacacccggcacccctgttccttaggttctagcctagtggccgactacagtgattctgagtctgaatag

SEQ ID NO: 45109 - DNA, 1251 bp, Artificial Sequence
  Description of Artificial Sequence: Synthetic coding sequence
atggtgcggccccggcgggccccctaccggagcggcgccggcggcccgctggggggaagaggacgtccgccgagacccctcgtggtcagggctgtccgaagcaggtcttggcctgcttctcccagagggcctcaaccacctagaatccgcgcgcgctcagcccctcccatggaaggggcccgtgtcttcggcgcgctcggcccgattggccccagcagtccgggtctaacactcggtggcctcgccgttagtgagcatcggctgagcaataagttactagcgtggtcgggagtgctggagtggcaagagaagagaaggccctactcggacagcactgctaagctgaagaggacactgccgtgccaggcctatgtgaatcagggagagaacctggagaccgaccagtggcctcagaaactcatcatgcagcttatcccacagcagctgcttaccactttgggccccctttttcggaatagtcagttggcccagtttcattttaccaaccgtgactgcgattccctcaagggtctctgtcgtatcatgggtaacggattcgctgggtgcatgctgttcccccacattagtccatgtgaagtgcgagtcctgatgcttctatacagctcaaaaaagaagatattcatggggctaatcccttatgaccagagtggatttgtgagtgccatacggcaagtcataacaacaaggaagcaggccgtgggaccaggtggcgttaattccggcccagtacagatcgtgaacaacaagtttctcgcatggtccggggtcatggagtggcaggagcccagaccagagccaaattcacgctcgaaacgatggctgccatcccatgtttatgtcaaccaaggggagattcttagaactgagcagtggcctcgcaaactctacatgcaactcatcccccagcagctgctaacaacgctggttccccttttccgcaattcaaggctggtgcagttccattttacaaaagacctcgaaacactcaagagcctgtgtcgcattatggataatggcttcgctggatgcgttcacttctcttacaaggcatcttgtgagattagagtgctcatgcttctttatagttctgagaagaagatttttatcggcctgatcccacatgatcagggcaattttgttaacggcatcaggcgcgttatcgctaatcagcagcaagtattgcagcgcaacctggagcaggaacagcaacagagggggatgggtggctag

SEQ ID NO: 45110 - DNA, 831 bp, Artificial Sequence
  Description of Artificial Sequence: Synthetic coding sequence
atgctgctgttcagcgtgctgctgctgctgagcctggtgaccggcacccagttggggccaaggacacccctccctgaggctggggtcgccattctagggagagcgcggggtgctcacaggccgcagcccccccatccccccagcccggtctcagagtgcggcgatcgcagcatctttgaggggcgcacccgttattcgcggattaccggtggaatggaggcagaagtgggagagtttccatggcaggtctctatacaggcgcgatcggagcctttctgcggaggttctatactcaataagtggtggattctcacggcagctcattgcctgtattcagaagagttgttccctgaggaactgtccgtagttctggggacaaacgacctgacctccccatcaatggaaatcaaggaagtggccagcattattctgcataaggactttaagcgtgccaatatggacaacgatattgccttgctactgctggcctcaccaataaaacttgatgaccttaaggttcccatatgcctgcccacacagcctggtccagccacctggagagagtgctgggtggccgggtgggggcagaccaacgctgcggacaaaaatagcgtgaagaccgacttgatgaaagctccaatggtgatcatggactgggaggaatgctctaagatgttcccaaaacttactaagaacatgctctgtgcagggtacaagaacgagtcatacgacgcctgcaaacaatcttacttccccactctgcagagaatgaacactggttccagtcagaccaagccccctgggtctcacacatttcatctgcagaattag

SEQ ID NO: 45111 - DNA, 1059 bp, Artificial Sequence
  Description of Artificial Sequence: Synthetic coding sequence
atgctgctgttcagcgtgctgctgctgctgagcctggtgaccggcacgcagttaggaccacgtaccccactgccagaagccggtgtcgccattctcggccgcgcccgcggtgcccacaggccgcagccccctcatccccccagtcccgtctccgagtgcggcgacagaagtatctttgagggccgtacccggtatagcagaatcacaggtggaatggaggccgaggtcggcgagttcccttggcaggtctcaattcaagctaggtccgaaccattttgcggggggtcgatccttaacaagtggtggatcctcacagcagctcattgtctgtacagtgaggaactattcccagaggaactgagtgtggtcctaggaaccaatgacttgaccagcccaagtatggaaattaaggaggtggcatccatcattctccacaaggactttaagagagccaacatggataatgacatagccctccttctgttagcttctcccattaagctggacgatcttaaagttccaatatgcttgccaacgcagccaggccctgcgacctggagggagtgctgggtcgctgggtggggacaaacaaacgctgctgacaaaaattcagttaagaccgacctgatgaaggccccaatggttatcatggattgggaggaatgtagcaagatgtttccaaaattaaccaagaatatgctttgcgctggctacaagaatgagtcatacgatgcctgtaaaggagacagtgggggtccgctggtgtgcacccccgagcccggcgagaagtggtatcaggtagggattatctcctggggtaaaagctgcggtgaaaagaatacaccaggaatctacacctctcttgtcaactacaacctgtggatagagaaggttactcaactggaggggcgaccctttaatgctgaaaagcgccggactagcgtgaaacagaagcccatgggttcccctgtcagtggcgtccctgagccaggatccccacggtcctggctgctattatgtccactctcgcacgtactgttcagagcgatactgtactag

SEQ ID NO: 45112 - DNA, 1185 bp, Artificial Sequence
  Description of Artificial Sequence: Synthetic coding sequence
atgggcatgaagcacagcagccggtgcctgctgctgcggcggaagatggctgagaacgcagccgaaagcacagaagtgaatagccctccatctcagccgcctcagccagtagtgccagctaaaccagtacagtgcgtgcaccacgttagtacccagccctcttgtcccgggaggggaaaaatgtctaaactcctcaacccagaggagatgacatccagggactactacttcgacagctacgcacactttggtattcatgaagagatgctcaaggatgaagtccggacactgacataccggaattcaatgtaccataacaaacacgtgtttaaggacaaagtagtgctcgacgtcggaagcggcacgggaatcctgtccatgtttgcagccaaagcgggggcaaagaaagttttcgggatcgagtgtagtagtatttctgattattcagaaaaaatcattaaggcaaaccatttggataacattataaccattttcaaaggtaaagtagaggaggtggaattacccgtggagaaggtagacattatcatttctgagtggatgggttattgtctcttttacgagagcatgttgaacacagtgatctttgcaagggataagtggctgaaaccggggggtctcatgtttcctgatagggcagctctgtatgtggtggctatcgaagatcgccagtataaagactttaagatccactggtgggagaatgtgtacgggtttgatatgacatgcatacgcgacgtggcgatgaaggaacctctggtggacatcgtggaccccaagcaggtggtaactaacgcttgtctcatcaaagaggtggacatttacaccgttaagactgaggagttgagtttcactagtgctttttgcctacagatccagcggaatgactacgtgcacgctcttgtcacttattttaatatcgagtttacaaaatgtcataaaaaaatgggcttctcaactgctccagatgcgccctatacccattggaagcagacagtcttctacttagaggactacctgacggtgagaaggggtgaggagatctatggtacaatctctatgaagcctaacgcaaagaatgtcagagaccttgacttcacggtggacttagatttcaagggccagttgtgtgagacgtctgtaagcaatgactacaagatgagatag

SEQ ID NO: 45113 - DNA, 1158 bp, Artificial Sequence
  Description of Artificial Sequence: Synthetic coding sequence
atggagagcctggccagcgacggcttcaagctgaaggaggtgagctccgtcaacagcccaccctcacagccaccccagccagtggtcccggccaaacctgtgcagtgtgtgcaccacgtgagcacacagccctcctgtcccggaaggggcaagatgagcaaactgctgaatcctgaggagatgacatcacgcgattattattttgatagctacgcccatttcgggatacatgaagaaatgctcaaagacgaagtgcggactttgacatataggaactcaatgtaccataataaacacgtgttcaaagataaggtcgttctcgatgtcggctccggcaccggcatcctctccatgttcgccgccaaggccggcgccaagaaagtgtttggaatagaatgcagttctatttccgactactctgagaagatcattaaggccaaccacttggataatataattaccatcttcaaggggaaagtagaggaggtcgagctgcccgtggaaaaagtggacattatcatcagcgagtggatggggtactgtttattctacgagagtatgctgaatacagtcatttttgccagggacaagtggctcaaacccggcggcctcatgttcccggatagagccgcactatacgtagtcgcgatagaggatagacagtataaggactttaagatccactggtgggagaacgtttatggcttcgatatgacctgtatccgggacgttgctatgaaagaaccactggtggatattgttgaccccaagcaagtcgtcacaaatgcttgcctgattaaggaggtggatatctatactgtgaaaacagaggagctgagctttacgtccgcgttttgtctccagatccagagaaacgattatgtgcatgcccttgtcacctactttaatatcgagttcacgaaatgccataagaaaatgggattttcaactgcacctgacgctccctacacacattggaaacaaaccgtgttttacctcgaggattatcttactgttcgccgcggcgaggagatctatggaaccattagcatgaagccaaatgccaaaaacgtgagagatctcgactttaccgtggaccttgacttcaaaggtcagctgtgcgagacatcagtgagtaatgattacaagatgaggtag

SEQ ID NO: 45114 - DNA, 3498 bp, Artificial Sequence
  Description of Artificial Sequence: Synthetic coding sequence
atgtacttcctgagcggctggcccaagcggctgctgtgccccctgggatcaccagccgaggctccctttcacgttcagtcagatccacagcgcgcctttttcgctgtcctggccgccgctcgtctgtctatttggtattcaagaccgagcgttctgatcgttacgtataaggagccggcaaaaagttctacacaatttgggtcatacaaacaagcggagtggcgcccagacagtacaatgatagccgtgagtacagctaacggttatattcttttttttcacataacctctacccgaggggacaagtatctgtatgaacccgtgtacccgaagggctcacctcagatgaaaggcactcctcacttcaaggaggaacagtgtgcacccgccctgaacttggaaatgaggaaaatcttagacttacaagcccccatcatgtcgctgcagagcgtgctggaagatctgctcgtggcaacatcggacgggctcctgcatctgatacactgggaaggtatgaccaatggcagaaaagccataaacttatgcacagtgccctttagcgttgatctccagagtagcagagttggctccttcttgggcttcaccgatgtccacattcgagatatggagtactgcgccacactcgacggttttgctgtcgtcttcaatgacggcaaagtcggcttcatcacgcctgtctcctcaagattcacggcggagcagctgcatggcgtgtggccgcaggacgttgtcgacgggacatgtgtggcggtcaataacaaatacagactcatggcattcgggtgtgtgagcggctcagtccaggtatacacaattgacaactctaccggagccatgttactatcacacaagctcgagttgacggcaaaacagtatccagatatttggaataaaacgggggctgttaagttgatgcgatggagccccgataatagcgtcgtcatcgtcacctgggaatacgggggtctttccctctggtctgtattcggtgcccagctgatatgtactctcggtggggactttgcctacaggtctgacggtactaagaaggacccattgaagatcaatagtatgagttggggggccgaggggtaccacctttgggttatctcggggtttgggagccagaacacagagattgagagcgacctccgtagtgtcgtgaaacaaccaagtattctcctgttccagtttatcaagagcgtcctcactgttaatccgtgtatgtccaaccaggaacaggtgttgttacaaggggaggaccgactctatctgaactgtggcgaggccagccaaacccagaaccctaggtcttcaagcacccactctgaacataagccttctcgcgagaagagcccgttcgccgacggcggcctagagagccagggactgtcaactttgttaggccaccggcattggcacgtggtgcaaatctcatcaacctatctggaatctaattggcctatccgtttctcagcaatcgacaagcttggccagaacatcgccgtggtcggaaagttcggctttgctcactactccctgctgacaaaaaagtggaagctgttcgggaacatcacgcaggaacagaatatgatcgtgactggaggccttgcgtggtggaatgactttatggtcctggcctgctataatataaacgacagacaggaggagcttcgggtctacctgcggacgtcaaacttagataacgcttttgcacacgtgactaaggctcaggcggagacactcttgttgtccgtgtttcaggatatggtcattgttttcagggccgattgctccatctgtctgtacagcattgagcgaaagtccgacggccccaacactaccgccggcattcaggtcctacaagaggtgtctatgtcccgatatattcctcacccattcttggtcgtgagcgtgactctgactagcgtgtcaaccgagaacgggatcacgcttaagatgccccagcaggcccggggagccgagagcattatgcttaatctggccggtcagttaatcatgatgcagcgggacaggagtggaccccagatcagagagaaagactctaacccaaataaccagaggaaacttttgcccttctgcccccctgtcgtcctcgcccaatcggtcgaaaacgtgtggaccacatgtcgggcaaacaaacagaagcgccatttattggaagccttgtggctgtcatgcgggggtgctggtatgaaagtttggctgccactctttcctcgagaccacaggaagccacatagctttcttagccagagaatcatgctcccattccatataaacatttacccactggctgttctgtttgaagacgccctggtgctgggggccgtaaacgatacccttctgtatgactccctgtacacacgtaacaacgcccgcgagcagctcgaagtgctttttcccttctgcgtggtcgagcgcacaagtcagatctatctgcatcatatcctgcggcaactactagtaaggaacttgggcgagcaggctctccttttggcacagtcatgcgcgactctcccttacttcccgcacgtcctcgaactcatgctgcacgaagtcttggaagaggaggctacgtctcgggagcccatccccgatcccctgctgccaactgtggcaaagttcataaccgaattcccccttttcctccagactgtggtgcactgcgctcgcaagactgaatatgcgctttggaattacctatttgctgcagtcggaaatcccaaagacctcttcgaggagtgcctcatggctcaggacctggatacggccgcctcctatctaattattttacagaacatggaagtgcctgcagtgtcacggcaacacgcaacacttttgttcaatacagccctggaacagggtaagtgggacctgtgtcgccacatgataagatttttgaaggctattggatcaggcgaatccgaaacccccccatccaccccgaccgcccaggagccgagcagttctgggggattcgagttttttcgaaatcgaagcattagcctttcccagagcgccgagaacgttcctgcatccaagttttccctgcaaaagactttgtcaatgccaagcggcccaagcggtaagcgctggtctaaggactcggactgtgccgagaacatgtatattgatatgatgttgtggcggcacgcccggaggcttctcgaagatgttcgccttaaagatttgggctgtttcgccgcgcagttaggtttcgagctcatttcatggctctgcaaagagcgtaccagggctgccagagtggacaacttcgtcattgctctcaagcggttacataaggacttcctgtggccccttcccattatccctgcctccagcatctcttctccattcaagaatggaaagtacagaacaggtaatgtagacttcatgtcgcttgtgcagggagaactgtacttcacaccctgcatctatacgttttgctactag

SEQ ID NO: 45115 - DNA, 2043 bp, Artificial Sequence
  Description of Artificial Sequence: Synthetic coding sequence
atgtacaccttcctgcccgacaacttcagccccgccaagcccaagccatccaaagacctcaaacctttgctgggaagcgcagtgttaggccttctactcgttctggccgccgtggttgcgtggtgttattattcagtaagcctgagaaaggcagagcgactgcgagccgagctcttagatctgaaagcaggcggcttttctatacggaatcaaaaaggagagcaggtgtttcggttagcctttcggagtggagcactggaccttgattcatgcagtcgggatggcgcactcctgggatgttcactgacggccgatggcttgcccctgcatttctttatccagacagtgcgccctaaagacacagtgatgtgctatcgggtaagatgggaggaagcggcccctggcagagctgtcgaacacgccatgtttcttggggacgcagctgcccactggtatggcggagccgagatgcgcacccagcattggcctatccgccttgacggccagcaagagccgcagccgttcgtgacctccgatgtttattccagtgatgccgcttttgggggcatccttgagcgatattggctgtccagtcgagccgcggcaataaaagtgaacgacagcgtccccttccacctgggatggaattctacggagaggagtctgagacttcaggcaaggtaccatgacaccccctacaagcccccagccgggcgggctgccgctcccgagctgtcgtatcgcgtatgtgttggcagcgatgtgacctctatccataaatatatggtcagacggtatttcaataaaccgagccgagtgcccgcacccgaagcatttcgggatcccatttggtctacttgggccttgtatgggcgggcagtggatcaggacaaggtgctgcgctttgctcagcagattaggttgcatcactttaattcttcacaccttgagatcgatgatatgtacacgcccgcctacggagactttgactttgacgaggttaagttccctaacgcatctgacatgtttaggcgactgagggatgccggcttccgggttacactttgggttcacccattcgtaaactacaattctagtcgctttggggaaggggtcgaacgggaattatttgttagggaaccaacaggcagattaccggcactggtgaggtggtggaacggtatcggcgctgtactggactttactcatcccaaggcccgcgactggttccagggacacctccgaagacttaggtcccgttacagtgtggcctcttttaagtttgacgctggtgaggttagctacctcccccgcgattttagcacttatcggcctttgcctgatccaagtgtgtggtcaaggagatatacagagatggccctgcccttcttcagtctggcggaggtccgcgtgggctaccagtcacagaacatctcatgctttttccgtctggttgatcgggactccgtgtgggggtatgacctcggcctcagatcattgatccccgccgttcttaccgtgtctatgctgggctatcccttcatcttgcctgacatggttggaggaaacgcagtacctcaaagaactgccggaggagacgtgcctgagagggaactctatatcaggtggttggaggtcgcagcatttatgcctgctatgcaatttagcatcccaccttggaggtatgacgcagaggtagtggccatagcccagaaatttgccgcactgcgcgcctccctggtggctcccttgctgctcgagctggcaggggaggtcacggatacgggcgatcctatcgtcagaccgctgtggtggattgcccctggagacgagacagctcacagaatcgattcccagttcttaattggagacaccctgctggtagcccctgtcctcgagccaggtaaacaggaaagagatgtttatctgccggccgggaagtggcgcagctataagggagagctgtttgataagactccagtgctgctgacagattatccagtggatcttgacgaaattgcttacttcacatgggcgagctag

SEQ ID NO: 45116 - DNA, 228 bp, Artificial Sequence
  Description of Artificial Sequence: Synthetic coding sequence
atggccgccgagtgggccagccggttctggctgtgggccaccctgctaattcctgccgctgcagtgtacgaggatcaagtcggtaagttcgactggcgccagcagtacgtgggaaaagtcaagttcgcctcgcttgagtttagccctggcagtaagaagctagtcgtggccacagagaaaaacgtcattgctgctttgaacagtaggacaggagaaatttgtgaatag

SEQ ID NO: 45117 - DNA, 1665 bp, Artificial Sequence
  Description of Artificial Sequence: Synthetic coding sequence
gcccccaccggccgggccgacctgagcggcaaccagggcaacgccgccgggcggcttgcaaccgtgcatgagccagtcgttacacaatgggctgtgcaccctccagcacccgctcatccctccctacttgataagatggaaaaagctccaccccagcctcaacacgaggggctaaaaagtaaggagcatctgccccagcagcctgcagagggtaagacagccagccgtagggtccctcgcctgcgcgctgtcgtggagtcacaggcttttaagaatatactggtggacgaaatggatatgatgcacgcgagggctgctaccctgattcaagccaattggagaggctactggttaaggcagaagctgatctcccagatgatggccgctaaggccatccaggaggcttggagaagatttaataaaagacacatactgcacagctcgaagagcctcgtgaagaagacccgagctgaggagggggacattccctaccacgctccccaacaggtgaggtttcagcaccctgaggaaaaccgattgctctctcccccaatcatggtaaacaaagaaacccagttcccaagttgcgataacttagtgctctgcagaccccaaagcagcccacttcttcagcctccagccgcacagggtacacctgaaccatgcgtgcagggtccccatgcagccagagtgcgaggactcgcctttttgccccaccagacagtgacgatccgtttcccatgcccagtgagcctggacgccaaatgtcagccctgccttctgacccgcaccatcaggtcaacttgcctcgtgcacatcgagggtgacagtgtaaagactaaacgggtcagcgcacggactaacaaagcccgtgcacctgaaacgcctctgtcgaggagatacgatcaggccgtgacacggccaagcagggcccagactcaggggcctgtgaaggccgaaacacccaaagcccccttccaaatttgccctgggcccatgataactaagacacttcttcagacataccccgttgtgagcgtgaccctgcctcagacctaccccgcctcaaccatgacaacgacgccccccaagacgtcccccgttccgaaagtgacaatcattaaaactcctgcccagatgtaccctgggcccactgtcaccaagactgccccacacacatgtcccatgccaaccatgaccaaaattcaggtacacccaacagcatcgagaaccggcactccaagacagacctgtccggccactatcactgccaaaaaccggccacaggtgtctctgttagcatccatcatgaagtcaccgcctagcgtggttatgctggtgggttcaagccctagaacctgccacacctgcggcaggactcagccaacgagggtggtccagggcatggggcaaggtacagagggcccaggggctgtgtcttgggcttcagcttaccagctggcagccttgagtcctcggcagccccaccgacaggacaaagccgccactgccatccagtccgcttggagaggctttaagatccggcaacagatgcggcaacagcaaatggcagccaagatcgtacaagctacatggtggcacctggggccatggcttcccgcagtaggtacgagctgggaagcactgatggctctttgggtgtag

SEQ ID NO: 45118 - DNA, 657 bp, Artificial Sequence
  Description of Artificial Sequence: Synthetic coding sequence
caggtgaagaaggtgctgttcgaggacgacgagcggagcaccgacagcagccagcagtgtagttccgaggacgaggacatatttgaggaaacagcccaagtaagccctcctagaggcaaagaaaagcggcagtggagagcccgtatgcctctgctgtctgtccaaccagtaagtaatgctgattgggtgtggctggtgaagagactccacaagctgtgcatggaattgtgtaacaactacatccagatgcacctggacttggagaattgtatggaagagcctcctattttcaaaggtgacccattctttattttgcctagttttcagtctgagagcagcacgccatcgactggcggcttttcagggaaagaaaccccaagcgaggacgatcggtctcaaccaagatcaggaagcacgggttccagcctcagcgtaagcgtcagggatgccgaagcacagatccaggcatggactaacatggttttgacagtgctgaatcagatacaaatactgccagatcaaactttcacagccctgcagcctgcggtgtttccctgcatcagccagctgacatgccacgtgacagatattagagtgcgccaggccgtcagagagtggctcggcagagtcggacgggtttacgatatcattgtctag

SEQ ID NO: 45119 - DNA, 1035 bp, Artificial Sequence
  Description of Artificial Sequence: Synthetic coding sequence
atggagaagcggctgggcgtgaagcccaaccccgccagctggatcctttctgggtattactggcagacctctgcaaaatggctacgtagcctgtatctgttttacacatgtttctgttttagcgttctgtggctgtccacagacgcttccgagtcaaggtgccaacagggcaagacccagttcggagtcggcttgcgatcgggaggagaaaaccacctgtggctgttagaggggaccccttctttgcagtcttgctgggctgcttgttgccaggattcagcgtgtcacgttttttggtggttggagggaatgtgtattcaggcggattgcagcagacctcagtcttgccgcgcgtttagaactcatagctctaacagcatgctcgtcttcctgaaaaaatttcagacggcagacgacctgggcttcctgccggaagacgatgtcccccaccttctgggactcggctggaactgggccagctggagacagtcccctccccgagccgcactccgtcctgccgtcagcagttccgatcagcagtcactgatacgcaagttgcagaagagaggatccccctccgatgtggtgacaccgatcgtaactcaacattccaaggtcaacgatagcaatgagctgggcggcctgaccaccagcggaagcgctgaggtgcataaggctattaccatttcttcccctcttacaaccgatctaacagccgaactctctggcgggccgaagaatgtctcagttcagccggaaatatctgagggcctggccaccacacctagcactcagcaagtgaagtcttcagagaaaacacagattgctgtgccccagccagtggctccaagctactcctatgctaccccgacgccacaggcgagtttccagtctacatctgccccgtatcccgtcattaaggaactcgtggtgtctgccggcgaatcagtgcaaatcactctcccaaagaacgaagttcagcttaacgcgtatgtccttcaggaaccccctaaagctcacagtagaccagtgtag

SEQ ID NO: 45120 - DNA, 2979 bp, Artificial Sequence
  Description of Artificial Sequence: Synthetic coding sequence
atggccgccgagtgggccagccggttctggctgtgggccaccctgctaatcccagctgcagcggtgtacgaggaccaagtgggcaagttcgactggaggcagcaatatgtcggaaaagtcaagttcgcctccctcgagttcagcccaggttctaagaagttggtagtagctaccgagaaaaacgtcatcgcagcccttaacagtaggaccggtgagatcctctggaggcacgtcgataaggggaccgcggagggggccgtggacgccatgctgttgcacggccaggacgtgattacagtcagcaacggtggccgtatcatgagaagttgggagactaatatcgggggactcaattgggagataaccttagattctggcagtttccaggctcttggattggtgggcctccaagaatcagttcggtacattgctgttcttaaaaaaaccaccctggcccttcaccatctgtccagcggtcacctgaagtgggtagagcatttacccgaaagcgacagcattcactatcagatggtgtatagctatggaagtggtgtcgtgtgggcgctgggcgtagttccgtttagtcatgtgaacatcgtgaaattcaatgttgaggacggggagatcgtgcaacaggtgagggtgagcaccccctggttgcagcacctgagcggggcctgcggcgtggttgatgaggcagtcctggtttgcccggatcccagctctaggtccctgcagacgttggcactggaaaccgaatgggagctgaggcagatccccctccagtcactcgatctggaatttggctcaggattccagccccgcgtgctgcccacacagcccaatcctgtagatgcttctcgcgcgcagttttttcttcatctgagcccttcacattacgctttacttcaatatcactatgggacacttagccttctaaaaaatttcccccagaccgctcttgtctcctttgccaccactggcgagaagacggtggccgcggtgatggcctgtaggaatgaggtgaaatcttcgtcatccgaagatggctccatggggtctttctctgagaagtcatccagcaaagacagtctggcatgctttaatcagacttataccatcaatttgtatttagtggagacgggaagacggcttttggacacgacaattaccttctctctggagcaatcgggcactcgtccagagaggttatacatccaggtctttctcaagaaagatgacagcgtgggatacagggcgcttgtacagacagaggatcatctgctgctgtttctgcagcaacttgctgggaaggtggtgctttggagccgcgaagaaagcctagccgaggtggtgtgtctggaaatggtggacctgcccctgacgggcgcacaggccgagctggaaggagagtttggcaagaaggccgacgggctgctcgggatgttcttaaaacggttgtcaagccagcttatcctgctgcaggcttggacctcgcacctttggaaaatgttttacgacgccaggaagccccgtagtcagatcaaaaacgagatcaacatcgatacattagcgcgggatgaattcaacctgcagaagatgatggtaatggtcacagcctccggaaaattattcggcattgagtcttctagcgggactatcctttggaagcagtatctccctaacgtcaaacccgactcatcatttaaattgatggtacagcggactacagcacacttcccacacccccctcagtgcacattattggtcaaggataaggaaagtggcatgagctcactatacgtattcaaccctatctttgggaaatggagccaggtggcccctcctgttctgaagagacccatcctccaatctctactgctccccgtgatggatcaggactacgccaaagtactgctgctgatcgatgacgagtacaaggtgactgctttccccgccacgcgaaacgtcctcagacagctgcacgagcttgcgccaagcatttttttctatctagtggacgccgagcaggggcggctgtgtggttacaggctacggaaagatctgaccacggagttaagctgggagctgactattccacctgaggtgcaacgtatcgtgaaggtaaaggggaagcggtcctctgagcacgttcattcgcagggaagagttatgggagaccggtccgtcttgtataaaagtttgaatccaaatcttctagccgttgttactgagagtactgatgcccatcatgagagaacatttatcggtatcttcctgattgatggcgtcacagggcgaatcattcatagctcagtgcagaagaaagccaaggggcctgtccatattgttcacagcgaaaattgggtggtgtaccagtactggaacactaaggccagacgcaatgaatttacagtgcttgaactatacgaaggcactgagcagtataatgctacagctttctcaagtttggatcgaccacagctcccccaggtgctccaacaatcatacatttttccatccagcatcagcgcaatggaggcaactattactgaacggggtatcaccagccgacacctgcttattggactgcctagtggagcgattctatccttgcctaaggccctgctagacccccgccggcccgaaatcccaacagaacagtctagagaggagaacctcattccctactcccctgatgtgcagattcatgctgagagatttatcaactacaaccagaccgtgtctcggatgcggggtatttacaccgccccaagtggcttggaatcaacttgcctggttgtggcttatggactcgacatttatcagacccgggtttacccttccaagcagtttgacgttcttaaagatgattatgattacgtgctgatcagtagcgtgctattcgggctggtgtttgccactatgataactaaacggctagctcaggtaaagctcctcaacagagcatggcgttag

SEQ ID NO: 45121 - DNA, 2916 bp, Artificial Sequence
  Description of Artificial Sequence: Synthetic coding sequence
atggccgccgagtgggccagccggttctggctgtgggccaccctgcttatccccgccgccgccgtttatgaagaccaggtcgggaaattcgattggaggcagcaatacgtggggaaggtgaagttcgcatcactggaattctctcccggcagtaagaagctggttgtggcaaccgaaaaaaacgtcatagcggccctcaactcgcggactggagagatatacgtgatcaccgtgtctaatggaggtcgaattatgaggagctgggaaaccaatatcgggggtctcaattgggaaatcaccctggactcaggatctttccaggctctgggcctggtgggtctacaagaaagcgttaggtacatcgccgttcttaagaagacaacactggccctgcaccacctctcatcggggcacctcaagtgggtcgaacacctccctgagtccgacagcatacactaccagatggtctactcgtatggtagcggggttgtttgggccctgggggtagtcccattcagccacgttaatattgtgaaatttaacgtcgaagatggagagattgtgcagcaggtgcgcgtaagcactccatggttacagcacctgagtggggcatgcggagtggtggacgaagctgtactggtatgccccgacccatcctcccggtccctacagactctggccttggagaccgaatgggaactgagacagattccgctgcaatctcttgatctcgagttcggctccggcttccaaccacgcgttctgcccacccagccgaacccagtggatgcttcaagagcacaattttttctgcatctctcaccatctcactatgccctgctacaatatcattacgggactttgagcctactgaagaactttccacagactgctttggtgtcttttgcaacaacaggtgaaaaaacagtggcggctgtgatggcatgtcgtaatgaagtgcagaagagctcgagctctgaggatggtagcatgggatcattctctgaaaagtctagcagcaaagactcactggcatgcttcaaccaaacttacaccattaacttgtatttggtggagacaggccggcggctccttgacacaacaataacattctccttggagcagtcaggcactaggccagaacgtctatacatacaggtcttcctgaaaaaagacgactctgtcggatacagggctttggtgcagacggaagatcacctattgctgttcttacaacagctcgccgggaaagtcgtgctctggagcagagaggagagcctggcagaagtagtttgcctcgagatggtagaccttccactaacaggcgctcaggctgagctcgaaggagagtttggtaaaaaggcggatggtctgcttggaatgttcctaaagcgtctgtccagtcagctcatccttctgcaggcctggacctcccatctttggaaaatgttttacgatgctaggaagcctcggagccagattaaaaacgagattaatatcgatacactggcacgcgatgagttcaatttacagaagatgatggtaatggtgactgcttcaggaaaactatttggcattgaaagtagctcgggcacaatcctctggaagcagtatctgccaaatgtaaaaccagacagctcgttcaaactaatggtgcaacgcacaacagcccattttccgcatccccctcagtgcacattactcgtgaaggataaggaatccggcatgtcttcactgtacgtattcaatcctatctttggcaagtggagtcaggtggcccctcctgtgctgaaaaggccgatactccagagtcttctgctccctgtgatggatcaggattacgctaaggttctccttctgattgacgatgagtacaaagtaaccgcttttcccgcaacacggaatgtcctgaggcagttacacgaactggccccatctatattcttttacctggtcgacgctgagcaaggacgtttatgcggatacaggctccggaaggatctgactacagagctgagttgggagctgactattcccccagaggtccagaggatcgtcaaggtaaaaggcaagaggagcagcgagcatgttcactcccagggcagggtgatgggcgataggtcagtgctgtacaagtcgctcaaccccaacctgttggctgttgtcacagagagcaccgatgcccaccatgaacgcactttcattggaatctttttaatcgacggggttaccggtcggattatccattcctctgttcagaagaaagccaagggtccagttcatattgtccattcagagaattgggtggtatatcagtactggaacacaaaggccagacggaatgaatttacggtcctcgagctgtacgagggcacagaacagtacaacgccactgccttctcttcactggatcggcctcagctcccacaggtgctgcagcaaagttatatctttccttcctccatctctgctatggaggctaccatcacagaacggggcatcaccagtagacatttattgattggcctcccctccggcgccatcttatctttgccaaaggcgctgttggatcccagaaggcccgaaatcccaactgagcagtcacgcgaagaaaacctgattccttatagccccgacgttcaaatccatgccgagagattcatcaattataatcaaacggtaagcagaatgaggggtatctatactgcaccctcgggactcgaaagcacatgtttggtggttgcttacggcttggacatctatcagaccagagtgtatcccagtaaacagtttgacgtacttaaggacgattatgactacgtgctgatatcgtcagtgctcttcggtctcgtttttgccacaatgatcactaaaagactcgctcaggtgaagctgctaaaccgtgcttggcgatag

SEQ ID NO: 45122 - DNA, 4101 bp, Artificial Sequence
  Description of Artificial Sequence: Synthetic coding sequence
atgctgttcaagcaggccgagctgtggatgccccaccagggcaagggtaacaagggtgaacctccttcggcactgggactgtcaactaggaaagccctgagcgtcctgaaagaacaattagaagcagttttggaaggtcatctccgggagcgtaagaaatgcctcacttggaaggaagtttggcgcagttctttcctccaccacagcaataggtgctcctgcttccactggccgggagccagcttgatgctcctcgctgtcctgctcctgctcggttgttgtggaggtcaacctgctgggtccagaggggtgggcttagtgaacgcctctgccttgttcctactgctcctgctcaatttggtgctcatcggaaggcaagacagattaaaaaggcgggaggtggagagacgcttacgtgggatcatcgaccagatacaagatgcgctgcgtgacggacgggaaatccagtggccttccgccatgtaccccgacctacacatgccatttgctccaagctggtccctgcattgggcttaccgggatggccatctcgttaacctgcccgtctccttgttggtggagggagacatcatagcacttagacctggacaagaatcctttgccagcctgagagggattaaagacgacgagcatatcgtgcttgagccgggcgacctgttcccccctttttcccctccaccttccccgcgcggcgaggtggaaaggggcccccagagtcctcagcaacatagactctttagggtgctggagacccccgtgatagacaacatccgctggtgtcttgacatggccctcagccggcccgttaccgctctggacaacgaaagattcaccgttcagtctgtcatgctccactacgccgtccccgtggttctggcaggcttcctcatcactaacgcattgaggtttatcttctcagcccccggcgtcacctcttggcagtatacattactgcagctccaagtaaacggggtcctgcctattttaccacttcttttccctgttctgtgggtgttagccactgcctgcggcgaggcccgggtcctggctcagatgagcaaagcgtctccttcaagtctgctcgccaaattcagtgaggatactctgtcgtcctatacagaggccgttagttcgcaggagatgctgagatgcatatggggtcacttcctcagggtcctcggaggcacctcgccaactctgtctcacagctcttcccttctgcattcactggggtccgttaccgtcctgtgttgcgtggacaaacaggggatcctgagttggccaaaccccagccctgaaaccgttctgttcttcagcggtaaagttgaacccccacactccagccacgaagaccttaccgatgggctgtctacgagatcattctgtcatcctgagccacacgagagagacgctctgttggctggcagccttaacaacacactacacctttccaacgaacaggagagaggtgattggcccggagaagcacctaaacctccagagccttactcacaccacaaagcacacggaagatctaagcacccttctggctccaatgtgagcttcagtagagatacggaaggcggcgaggaggaaccctctaaaacacagccagggatggaaagtgacccctatgaagctgaagatttcgtgtgcgactatcatttggagatgctgtcactgagccaggaccagcagaaccccagttgcatccagtttgacgacagtaactggcagctgcatctgacctcgctgaaacctctgggattgaatgtgctactgaatctgtgtgatgctagtgtgacagaaaggctgtgccgcttttccgatcatctctgcaacatcgccctgcaggagtcacacagtgctgtcctgcctgtccatgtgccttggggattgtgcgagctggctagactgatagggtttaccccgggagctaaagagctgttcaagcaggagaaccaccttgctttgtaccgactccctagcgccgagaccatgaaggaaactagtttgggcaggctgtcgtgtgttactaagcgcaggccaccactatcacacatgatttccctgtttattaaagacacaactacatctaccgagcagatgctaagtcatgggacagcagacgtggtattagaggcttgtaccgacttttgggacggagcagatatatatcctctatctggtagtgaccgcaagaaagttctggacttttaccaacgcgcatgtctaagcggatattgtagcgctttcgcctataaaccaatgaactgcgccctgtcatcccagctgaatggaaagtgtatcgagctcgtgcaggtgccgggccagagtagtatattcaccatgtgcgaactgccatcaaccatccctattaagcagaacgcccgaagaagcagctggagttccgatgagggtatcggagaagtcttggagaaggaggattgtatgcaggcgctgtccggccagatcttcatggggatggtgagctcacaatatcaggcacggttggatatagtgaggctcattgacggcctggtcaacgcctgcataagattcgtgtatttcagcctggaggacgaattaaagtccaaggttttcgccgaaaagatgggattagaaaccggatggaactgccacatatccctgactccgaatggagacatgcccggaagtgaaatcccaccatctagcccttcccacgccgggagcttacacgacgacctgaaccaggtcagccgggacgacgcagaaggactgcttctgatggaggaggaggggcactctgacttgatctcatttcagcccactgattcggatatcccctcttttcttgaggactctaatcgggccaagctgcctcgaggcattcaccaggtcaggccccacctccagaatatagataacgtgcccctgctggttccattatttacagattgtacccctgagaccatgtgcgaaatgatcaagattatgcaggaatacggagaggtgacctgttgtctggggtcctcagctaatttgaggaactcgtgcctgtttctgcagtctgatatcagcatcgctttagaccctctgtatccaagcagatgctcctgggagacattcggatatgcgacaagcatttccatggcccaggcatctgatggactttcccccctgcagctgagcggccagctgaattccctgccatgtagccttacattcaggcaagaggaaactatcagcattattcggctcatagagcaggcccggcatgcgacctacgggatacgaaaatgctttctctttctgttgcaatgtcaactaactctggtcgttattcaattcctgtcttgtctggtgcaactgccacccctgcttagcaccactgatattctttggctgtcgtgcttctgctacccgctgctctctatttctctgctggggaaaccacctcactcgtctattatgagcatggcgacgggcaaaaacctacagtcaattcctaagaagacacaacactattttctgctatgcttcctgctgaaattttcgctaaccatctcttcatgcttaatttgttttggctttaccctccagtctttctgcgacagctctcgcgatcgcaacctgaccaattgttcatctgtgatgctcccatcaaatgacgaccgggcccccgcctggttcgaagacttcgcgaatggcctgctgtctgcccagaaacttactgcggcgctcatcgttttgcacaccgtattcatcagcattacgcacgtccacaggacaaaacccctctggagaaaaagcccccttactaacctgtggtgggccgtgacagttccagtggtcttactgggtcaggtggtgcagacagctgtggacctgcagctttggacccaccgagactctcatgttcacttcggtctcgaagacgtgcctttgctgacttggctgttaggttgcctttctctggtccttgtagtggtaacaaatgagattgttaaattacatgagatcagagtcagagtgcggtaccagaagcgccagaaattgcagttcgaaaccaaactagggatgaactcccccttctag

SEQ ID NO: 45123 - DNA, 2004 bp, Artificial Sequence
  Description of Artificial Sequence: Synthetic coding sequence
atgtggctgcagcagcggctgaagggcctgcccggcctgctgagcagctcttgggcccgcagactattgtgcctcttgggtctgctgctcctgctactctggtttggtggcagcggcgccaggagggctgccggtggcctgcaccttctcccctggtccaggggcgagcctggcgcagcggagccaagtgcctgtctggaagccgcgactcgggcctggaggggacttcgcgaaaggggcgaagttgtgccacttggacctggtgttcccgcccttgtggccaacggattcctagccctggatgtcgccgcaaacaggctgtgggtgactccgggggagcgtgaaccagctgtggctcctgactttgtcccattcgtgcagttacggccgctcagtgctctggcagaggcaggcgaggccgtgctcctgctgcgagagggacttcttagaagagttcggtgcttgcagctggggagccccggaccagggcctgtcgctgctggccccgggcctgcttcagtctctggactggccgctggttcgggtagggattgcgttctgctccaggaggattttttagcacaccgcggccggccccacgtgtatttacagcggattcagctgaataaccctacagagagggttgcagcactgcaaacagtcggtccgacagcaggaccggcccccaaagctttcactagcaccctggaaaaggtaggcgaccatcagtttctgctctatagcgggcgctctcctcctacccccacaggactagtacacctggtggtcgtggcggctaagaagctggtgaacaggttacaggttgcgccgaagacccagctcgatgagactgtcttgtgggtcgtgcacgtctctggcccgatcaacccccaggttcttaagtctaaagctgcaaaagagcttaaagctcttcaggatctggctcggaaggagatgctggaactgctagacatgccagcagctgaactgcttcaggaccaccaactcttatgggcccagctgttttcaccgggcgtagaaatgaagaagatcaccgacacccacacaccctccggattgacagtcaaccttaccctgtactatatgttaagttgctctcctgccccattgttatccccgtcgctttcgcacagggagagagatcaaatggagtctacccttaattacgaagatcactgtttctcaggacacgcaaccatgcacgcagaaaacctttggccagggaggctcagctcagtgcagcagatcttgcagctgagcgacctgtggcgactgactctgcaaaagagagggtgtaagggcctcgtgaaggtgggggcgcccggcatattgcagggcatggtcctcagctttggcggcctccaatttactgaaaatcatctgcagttccaggccgatcccgacgtcttacataactcctacgcattgcacggcatccggtacaagaatgaccatataaatcttgcagttttggctgatgcagaaggcaaaccgtatttgcacgttagcgttgaatccagaggacagccggtcaaaatctatgcttgtaaagcagggtgcctggatgaaccagtggagctcacctccgcccctactggccataccttctccgtgatggttacccagccaatcacacctcttctctacattagcaccgacctaacccatcttcaagatctgaggcacaccctgcatctgaaggccattctcgcgcacgacgaacacatggcccaacaggatccaggcttgccttttctgttctggttttccgtagcatcgctgataacattgttccatctttttcttttcaaactgatttacaatgaatactgcgggccaggcgctaagcctctgtttaggtctaaagtcggctcaaggcatctggtcgaaaccagaggcctgggtctagcattaagccccgtgagcagaaaaggcttagcatggagaggtggtgtccgcccggggcaggagtgggtgtcctag

SEQ ID NO: 45124 - DNA, 483 bp, Artificial Sequence
  Description of Artificial Sequence: Synthetic coding sequence
ttcctgcccgacaacttcagccccgccaagcccaagcccagcaaggatctgaagcccctcctgggcagtgcggtgctgggcttgttgcttgtgctggccgccgttgtggcttggtgctactactccgtgtctttgcgcaaggccgagcggctacgggccgagctgctggacctcaaagccggaggcttttccattcgtaatcagaaaggtgaacaagagccccagccattcgtaacctctgacgtctactcttccgatgcagcttttggcggtatcctggaaagatactggctgtcatcaagagccgcagcgatcaaggtgaatgatagcgtcccattccacctgggttggaattcaaccgaacggtctttacgcctgcaggctaggtatcatgacaccccttacaaacctcccgctggtagggccgccgcaccagagctgtcctaccgggtctgtgtcggatctgatgtcacttccatctag

SEQ ID NO: 45125 - DNA, 3261 bp, Artificial Sequence
  Description of Artificial Sequence: Synthetic coding sequence
atgatcgccgtgagcaccgccaacggctacatcctgttcttccacatcaccagcaccaggggcgataaatatctctatgaacctgtgtatcctaaaggatctccccagatgaaagggaccccacatttcaaggaagagcaatgcgcgccagcgctcaatctcgaaatgagaaagatactggaccttcaggcgcccattatgtcactgcagtctgtgctagaagatctcctcgtcgcaaccagcgatggccttctgcatctgattcattgggaagggatgactaatggtcggaaagccataaatctttgtactgtgcctttttccgtggacttgcagtctagtagagtaggcagttttttaggctttactgacgttcacatcagggatatggagtactgtgctaccctggatggattcgccgtggtgtttaacgacggaaaagtgggttttatcactcctgtgtcgtcacgattcacagctgagcagctgcacggggtctggccccaagacgtggtcgatggcacatgcgtagcagtgaataataaatatcgtttgatggcctttggctgcgttagcgggtctgtgcaagtctacactatcgataacagcacaggcgcaatgctgctttcgcacaaacttgagctaactgccaagcagtatccagacatttggaataagacaggagctgttaaattaatgaggtggtctcccgataactccgtggtgatagtgacctgggagtacggaggcctctccctctggtctgtgttcggagctcaactaatctgtacactcgggggcgacttcgcttaccggagtgacggcactaaaaaggaccccctgaaaattaacagcatgtcctggggagccgagggctaccacctgtgggtgatttctgggtttgggagtcagaacactgagatcgagtctgacctgaggagcgttgtgaaacaaccctctatcctgctgtttcaattcattaagtctgtgctgaccgttaacccgtgtatgtctaatcaggagcaggtgctgctgcaaggagaggatcggctctacctgaactgtggagaagcatcccagacccaaaatccacggtcaagcagcacacattctgaacataagccttctagggaaaaaagtccatttgccgatggtggcttggagagtcagggtctgagtacccttctggggcatcggcactggcatgtggttcagatctcctctacgtatctcgagtctaactggccaattaggttttctgctatcgacaaattgggccagaacattgctgttgtgggaaaattcgggttcgcccactacagcctgttaacaaaaaagtggaaactatttggcaacataacgcaggagcagaacatgatagttaccggcggcctggcgtggtggaatgactttatggtgctggcctgttataacatcaatgatagacaggaagagctcagggtctatctgcgcacctcaaatcttgacaatgcatttgcccatgtgacaaaggcccaggcggagacgctgctgctctctgtattccaggatatggtcatcgtattccgcgcagactgctctatatgcctgtattctattgaaagaaaatccgacggccctaatactactgccggaatacaggtgcttcaagaggtcagcatgtcgagatacattccccatccttttttggttgtgagcgtcaccttgactagcgtcagcaccgagaacggtatcacactgaagatgccccagcaggctcgaggtgcagagagtattatgctcaacctggctgggcaacttattatgatgcagagagaccgaagtggccctcagatcagagaaaaggatagcaaccccaacaaccagcgcaaactactgccgttttgccctccagtggtcctggcccagtccgtcgagaacgtttggaccacatgcagagcgaataaacagaagcgacatcttctggaggccctttggttgtcctgtggaggcgcaggaatgaaggtctggctgcctttgttcccgcgcgatcacagaaagccccacagctttcttagccagcggattatgctcccattccatattaatatttaccccctggcagtgttgtttgaggacgcactggtgcttggagccgtgaacgatactttactctacgactctctgtatacccgcaacaacgctcgagagcagcttgaggtgttgtttcctttctgtgtggtggaaaggaccagccagatctacctgcatcatatcctaagacagctgctggtcagaaatctgggcgaacaggcactgctccttgctcaatcctgcgctacactcccttatttccctcatgtgttggaattaatgctccacgaggtgttagaggaagaggcaacaagccgggagcccatccccgatcctttgctaccaacagtcgccaagttcataaccgagtttcccctcttcctgcagactgtggtgcactgtgcacgtaagacagagtatgccttgtggaactatctattcgcggcggtaggaaacccaaaagatttgttcgaggagtgtctgatggcacaggacctggataccgccgcatcctacctgattattttgcaaaatatggaggtgcccgctgtcagcagacagcatgccacccttcttttcaacacagcactggagcagggcaaatgggatctatgcaggcatatgatccgctttctcaaagctattgggagtggcgaatcagagacgccaccgtccaccccgactgctcaggagccctcctctagcggcggatttgaatttttccggaatcggagtatttctttaagccagtcagctgagaacgtgcccgcctctaagttttctttacagaaaactctgtcaatgccaagtggacccagtggcaagaggtggtcaaaagattcagattgtgccgaaaatatgtatatcgatatgatgctctggcgacatgcaaggcgcctattggaggacgtgcgcttaaaggacctgggttgctttgccgcccagctgggtttcgaactcatctcctggctgtgtaaggagcgcactcgagcggcacgagtggacaatttcgtgatcgcgttgaagagactccacaaagatttcctttggcctctgcccattattccagccagcagtatctcttcaccttttaagaatggcaaataccgtactggtaatgttgactttatgtctctcgtgcaaggagagctatatttcacaccatgcatctacactttttgttactag

SEQ ID NO: 45126 - DNA, 1335 bp, Artificial Sequence
  Description of Artificial Sequence: Synthetic coding sequence
atggcccccagcagccggtgggacgccatgggccccaagaacagctatcggtccgtgcatggcagaatagtgcctgagctgcttgagagcagcgtggcgcgagtcagaccgttgcagtacgtgcaacggcagccaagccaggcctcagctaggtctggagcaaacccaacccatagaccttccgccgaagtcagacctgtcattcggacaggagagatgacccactccagtgtcattccaccgctggctcccggagtgcgaagagtatctttaggatatgagtcctctcccagtggatctctgcctcccctctttaaccaagaatccccatggcgtcggcaggattcctattcaccccagaatcctgctgtgtcccataaagccagtttaaactctaccattttgcagggaccagcagatgcaggagtggtggggggacaatcttggaatcgagcctgggagccagcccggggtgcagcttcctgggacacctggcgcaacaaagcagtggtaccacctcggcgcagtggtgaacctatggtaagtatgcaagctgcggaggaaatcaggatcctcgccgtgatcaccattcaagctggcgtgagggggtacctggcccgcagacggattaggttgtggcatcgcggcgcaatggtcattcaggccacctggcgcggctaccgcgtaagacgcaacctggctcatctgtgtagagccactacgaccatccagtcagcatggagaggctacagcacaaggagggaccaggctagacactggcagatgctgcatcctgtcacatgggtggaactgggaagtcgagctggggtgatgtcggatcgtagttggttccaggacggtcgtgccagaaccgtaagcgatcaccgctgctttcaatcttgccaggcccacgcctgttctgtttgtcattctcttagctctcggatcgggtcaccgccttccgtggtgatgctcgttggcagctcgccccgcacctgtcatacttgtggccgaacacagcccacaagagtggttcaggggatgggtcaaggtaccgaagggcccggcgctgttagctgggcaagcgcgtaccaactggcagccctgagtccacgccagcctcaccggcaagataaagccgctacggcaatccagtctgcatggcgcggctttaagattcgccaacagatgcgacagcagcagatggctgctaagattgttcaggctacctggcgcgggcatcacactcgtagttgcctcaaaaacactgaagcgttattggggcccgcggacccgagcgcgtcctcgcgccatatgcattggccagggatctag

SEQ ID NO: 45127 - DNA, 4104 bp, Artificial Sequence
  Description of Artificial Sequence: Synthetic coding sequence
atgaccctgcagggccgggccgacctgagcggcaaccagggcaacgcagccggaaggctggccacagttcatgaacctgtggtgacacaatgggctgtgcacccccctgcacctgctcatccttcacttcttgataaaatggaaaaagcgccacctcagccccaacatgagggtctgaaatctaaggagcatctcccccagcagccagccgagggcaagactgcctctcgcagagttccgagattgcgggcagtggtggaatcccaggcgtttaagaatatactcgtagacgagatggacatgatgcacgcgcgagcagccaccctgatccaggccaattggcgcgggtattggctacgacaaaagcttatttctcagatgatggcagccaaggccatccaggaagcttggcggcgcttcaacaaacgtcatatcttacactcttccaaatccctggttaagaaaacgagagcagaagagggcgatataccgtatcacgctccacagcaggtgcgattccaacatccagaggaaaataggctcctttcaccaccgatcatggtgaataaagaaacccagtttccttcatgtgacaatttggtactgtgccggccccagagcagtccactactccagcctcctgcggctcaaggcacacccgaaccatgtgtgcagggcccgcacgctgccagggtgcgcggcctcgcgttcctacctcaccagacagtgactatacgctttccctgccccgttagcctcgacgccaagtgtcagccttgcctactcacgcgtactattcgttcaacctgtctcgtgcatatagagggtgatagcgttaaaacaaagcgggtctccgctcggactaacaaggcacgcgcacccgaaactccactcagtcggcggtatgatcaagccgttaccagacccagccgcgcccagactcagggacctgttaaggccgaaactcctaaggcaccgtttcagatctgccctggtcctatgatcacaaaaaccctactgcagacttaccctgtggtttccgtgaccttgccccaaacctaccccgccagtactatgaccactactccacctaaaacaagtcccgtcccgaaagttacaattattaagacgcctgctcagatgtatcccggcccgacagtcaccaaaaccgctccacacacttgtcctatgcccacaatgactaaaatccaggttcaccctaccgcaagtaggactgggaccccacggcaaacatgcccagcgaccattactgctaaaaacagacctcaggtgtccctactggctagcatcatgaagagcctgccccaggtttgtcctggaccagccatggccaagacacccccccaaatgcatccagtgactaccccagcaaaaaatcccctccagacctgcttgtctgcgaccatgtctaagactagctcacaaaggagccccgtgggggtgacaaagccgagtccccagactcgattgcctgctatgatcactaaaaccccagcccagctacgaagcgtggctaccattctgaaaactctgtgtctggcttcgcccacagtggcgaacgttaaggctcccccccaagtggccgtcgctgccggaaccccaaacaccagcggcagcattcacgagaatccgcccaaagctaaagcaaccgttaatgttaagcaggctgctaaagttgttaaggctagcagtccaagctatctggctgaaggtaaaattcgatgccttgctcagcctcatcccggaactggagttccgagggcagctgccgagctcccattagaggccgaaaagattaaaactggaactcagaagcaggcaaaaactgatatggcttttaagaccagcgttgcggtagaaatggccggcgccccctcatggacaaaagtggcagaggagggggacaaacccccacacgtttacgtaccagtcgatatggctgtgaccctgccccgaggacagttagcagctcccttaaccaatgcttcctcccaacgccaccccccctgccttagtcagcgcccacttgctgcaccgctgaccaaagcgtcgtcacagggccacctgcccacggaacttacaaaaaccccttccctggcacatcttgacacctgcctgagtaagatgcactcccaaactcacctcgccaccggtgctgtgaaagttcagagccaagccccccttgcgacttgtctgaccaagacacaaagccgtgggcaaccaatcacggatatcactacatgtcttatcccagcccaccaggccgccgatctgagttcaaacactcattcacaggtgcttttgaccggctccaaagttagtaatcacgcctgccagagactgggcggcttgtctgctccaccctgggctaaaccagaggataggcagacacagccgcagcctcatgggcatgttccaggaaaaaccacacagggtggaccctgtccagctgcgtgcgaggtccaggggatgcttgtgcctcccatggcccccactgggcactctacttgcaacgtggaatcttggggtgacaacggagcaaccagggctcagccctctatgcccggccaagccgtgccctgccaggaggacacagtgggttccttgctggcttcactatgtgctgaagttgctggggtcctcgcttctcaagaagaccttaggactctgctggccaaggcactatctcagggtgaagtctgggccgccctaaaccaggcccttagtaaggaagtgttgggcgctactgtgactaaggccctgcctcagagcatgctgtcgatggctttagtgaaagccctgtcttggagcgaattgcgactgacactctcccgagccctgtccagaggagagctgcgcgccgagctaactaaagttatgcagggtaagcttgccgaggtgttgtcaaaagcactgactgaagaggaatgggttgctctgagtcaggccctgtgtcagggggagctcggagccctactgagccagtcatggtgtagagtcgccctgagaaccggcacaattcttcctaaggccgcatccaagtctacaggatccggagtgactaaaacccctgcattagtgaaggtggcatgccgccgctccccgtccgctgcttgggggccttccctcggcccagtgagacctcaaactagtaaggggccagcagatgctggtgtggttggtggtcagtcatggaaccgggcttgggaaccagcgaggggtgctgcgagttgggatacctggcgcaacaaggcagttgtgcccccccggcgttccggggagccaatggtgagtatgcaagctgcagaggaaatccgcatccttgctgtgattactatccaggctggcgtgcgaggttatctcgctaggagaagaatcagactctggcatcgcggtgctatggtgatacaggcaacttggcgaggctatagagtaaggcggaaccttgcacacttgtgcagggcaaccactaccattcagtccgcctggagggggtacagtacccgccgtgaccaggctcgccactggcagatgctccacccggtgacgtgggtggagctggggagccgcgccggggtcatgtctgaccggagctggtttcaggatggcagggctcgcaccgtttctgatcatagatgttttcagtcatgccaagctcacgcttgttctgtgtgtcactctctttcaagtagaataggttcaccccccagtgtagtgatgctcgttggctctagtccacggacttgtcatacctgcggtcgtacccagcccactcgagtggtgcagggtatgggacagggaactgaggggccaggtgccgtgtcctgggccagcgcctaccagctggccgccttatcgccgaggcagccccatcgacaggataaagccgctactgcaatacagtccgcatggcggggctttaaaatccgacaacagatgagacaacaacagatggcagcaaaaattgtacaagccacttggagaggtcatcatacgaggtcatgcctgaaaaatacagaggcgctactgggccctgcggacccctcggcttcttcgcggcacatgcattggcctggcatatag

SEQ ID NO: 45128 - DNA, 4833 bp, Artificial Sequence
  Description of Artificial Sequence: Synthetic coding sequence
atggccggcctgcggcggccccagcccggctgctactgccggaccgctgccgccgtgaacctcttgttgggcgtgtttcaagtgctcctgccctgttgtcggccaggtggggcgcaggggcaggccattgaacctctgcctaatgtggtggaactgtggcaagctgaggaaggggagttgctgctacctacccagggcgatagtgaggagggattggaagaaccatcacaagaacagtccttctctgataagctcttctcggggaagggcttacactttcagcctagcgtgctggatttcggcatacagtttctggggcacccggtggccaagatacttcatgcctacaaccccagtagggatagcgaagtggtcgtgaatagtgtcttcgcagcggcggggcattttcacgtgccacctgtcccatgtagagtcatccctgcaatgggtaaaacatcattccggatcatcttcctgcccacggaggaggggtctattgaatcatccctcttcataaatacgtcatcttacggagttctcagctaccacgtgtcagggattggcacccggaggatttccaccgaggggtctgctaagcagttgccgaatgcctacttcctgttacccaaagtccagtctatacagctgtcacagatgcaagcagaaactacaaacacgtccttactacaggtacagctggagtgctctcttcataataaagtctgccagcaactaaaaggatgctacctggaatccgatgacgttcttcggttacagatgtcaatcatggttaccatggagaatttcagcaaagagttcgaggagaacacacagcatctcctggaccacctgagcatcgtgtatgtggctactgacgagtccgagacaagcgacgactcagccgtcaacatgtatatccttcattcgggaaacagccttatctggatccaggacatccgacacttcagtcagcgcgacgctctctctttgcaattcgaacccgttctattacctacatccacaaccaacttcacaaaaattgcctccttcacatgtaaggccgcaaccagctgtgattcaggaatcatcgaggatgtgaagaaaaccacccacacgccaaccttaaaagcttgtctgtttagttcagtggcgcaaggatacttcaggatggattcatccgcaacccaattccacatcgagactcatgagaacacatctgggctctggtccatctggtacagaaatcatttcgaccggtccgtggtcctcaacgacgtgtttctcagcaaagagactaaacatatgctaaagattcttaattttacaggacccctatttctccccccgggatgctggaacatcttttctctgaagctggcggtgaaggacattgcaatcaatctatttaccaacgtgtttctcaccaccaatataggcgctattttcgcaattcctctgcaaatctattcagcacccaccaaggaaggttctcttggattcgaagtaatcgcccactgcgggatgcactacttcatgggcaaaagcaaagccggtaaccctaattggaatggatcactcagccttgaccagtcaacctggaacgtggactcagaattggcaaataaactgtatgagaggtggaaaaagtacaagaatggggatgtctgcaaacgcaacgtgcttggcactacaagatttgcccacctcaagaaaagcaaagagagcgagtccttcgtgttcttccttcccagactgattgctgagccaggccttatgttgaattttagcgcgaccgccctcagatcccgcatgatcaagtattttgtggttcagaaccctagctcctggcccgttagtctgcagctgctgccactgtctttatatccgaagccagaggctctggtccacttgctccatagatggttcggcaccgacatgcagatgattaattttacgactggggaattccagttgactgaagcctgtccttatctgggcactcactccgaggagagtagattcggcatactgcacttgcaccttcagcctcttgagatgaagcgggtgggcgtggtgttcactccagcagactatggaaaagtgacgagcctgatcctgataaggaacaatcttactgtaatcgatatgatcggagtcgaaggattcggtgctagggaactcctgaaggttggtggccgcctgcccggggctggaggaagcctcaggtttaaagtgcccgaatcaaccctgatggactgcagacggcagctaaaggacagtaagcaaatcctgtccataactaaaaactttaaagttgaaaacatcggccccttgcccattactgtgtcatctctgaagataaacggttataattgtcagggatatgggtttgaggtgcttgactgccaccagttctctctcgatcctaatacgagtcgcgacattagcatcgtgttcacaccagacttcacgtccagctgggtcattcgggacttaagtttggtcaccgcggccgacctagagtttaggtttacactcaatgtgactttacctcaccacctcctgccactttgcgccgacgtggtgcccgggcccagttgggaggagagcttttggagactgactgtgttttttgtctccttaagcctcctcggtgtaattctcatagcttttcagcaggctcaatacattctgatggaatttatgaagacacgacagaggcaaaatgcaagcagctcctcccagcagaataacggccccatggatgtcatatccccgcactcctataagagcaactgtaaaaacttcttagatacatacgggccttccgataaggggcgggggaagaattgcctgccagtgaataccccccagagtcgtattcagaacgccgcgaagcgttcgcctgccacatacgggcactcacagaagaagcacaaatgcagcgtgtattattctaagcataaaacctcgacagctgccgctagttctacttcaactacaaccgaggaaaagcagacctccccacttggaagtagtttgccagcagcaaaagaggacatctgtaccgatgctatgagggaaaactggattagcctgcgctatgcttcaggcataaacgttaatttgcagaagaaccttactctccccaagaacctgcttaacaaggaggagaataccctgaagaacaccatagttttttctaacccaagctcagaatgttccatgaaagaagggattcagacgtgtatgttccccaaagaaactgatatcaagacctccgaaaatactgcagagttcaaggagagggaactgtgcccactgaaaacatcgaagaagctgcctgagaatcacttgcctcggaacagtccccagtatcaccagcctgatcttccagaaattagcagaaagaacaacgggaacaaccagcaggtgcccgtcaagaacgaagtcgatcactgcgagaatctgaagaaggtcgacactaagcccagcagtgaaaaaaagattcataaaacgtctagggaggatatgttcagcgagaaacaagatatccccttcgtagagcaggaggatccttatcggaaaaaaaaactgcaggaaaaaagagagggtaacctgcagaaccttaattggagtaagtccagaacctgcagaaagaacaagaagcgcggcgtggcgccggtgagccgaccacccgagcagagcgatctgaagcttgtttgttccgactttgaaaggagcgagctgtcgagcgacattaatgttcggagctggtgcatccaggaatccacaagagaagtgtgtaaagcagatgcagagatagcgtcaagtctacctgccgctcagagagaagcagagggatactatcagaaacccgaaaaaaagtgcgtggataaattttgctcagacagctcttctgattgcggtagtagctctggcagcgtccgagctagcagaggctcctggggtagctggtcatcgacgtcctccagtgacggcgataagaagccaatggtggatgcacaacatttcctgccagctggtgactctgtgtcccagaatgatttccccagtgaagcacccatttccctgaacctcagccataatatttgtaacccaatgactgtcaacagtctgcctcagtacgccgaacccagttgcccgagcctgcctgcaggaccgacaggcgttgaagaggacaagggtctgtattcaccaggagatctgtggcctacccctccagtctgtgtaacctcttctttgaattgcacgctcgaaaacggagttccctgtgtgatccaagagtcagctccagtgcataatagttttattgattggtccgccacctgtgaaggccagtttagctccgcctactgcccccttgaactgaacgactacaatgcgttccctgaggagaatatgaattatgccaatggctttccttgtcccgctgatgtgcagacagattttatagaccacaatagtcagagtacgtggaacacgccaccaaacatgcccgccgcctggggtcacgcgagctttattagctcccccccgtatttaacttccacccgctcacttagcccgatgagtgggctcttcggctctatttgggccccccagtccgacgtgtacgaaaattgttgccccattaatccaaccaccgagcacagcacccacatggagaatcaggcagttgtctgcaaggaatactatcctggcttcaacccctttagggcatacatgaatttggacatttggactactactgccaataggaacgctaacttcccgttgagcagggactcctcttactgcggaaatgtgtag

SEQ ID NO: 45129 - DNA, 2385 bp, Artificial Sequence
  Description of Artificial Sequence: Synthetic coding sequence
atgaccctgcagggccgggccgacctgagcggcaaccagggcaacgcggccggacggctcgctaccgtccacgaaccagtggttacgcagtgggcggtgcatcctcctgcacccgctcacccttcactgctggataagatggagaaagcaccccctcagccacagcatgaaggcctcaagtcgaaagaacatcttccccaacagccagctgaaggaaagaccgccagccgtagagtgccgcgcctgcgggccgtggtggagagccaggcctttaaaaacattctggtcgatgagatggacatgatgcatgcacgggcagccaccctaattcaggctaactggaggggctactggctccgccagaagttgatctcccagatgatggccgcgaaggctatccaggaggcttggcgtcgtttcaacaaaaggcacatcctgcactcatccaagtcactcgttaaaaagacgagagccgaagaaggcgatatcccgtaccacgccccgcagcaggtcagatttcagcatcctgaggagaacagactgctgtctcccccaattatggttaataaggagacacagttcccctcctgtgataacctcgttctttgtaggccacagagtagtccacttctccagcccccagccgctcagggaacccctgagccctgtgttcagggcccccacgccgcccgcgtcaggggactggcatttctgcctcatcagactgtgactattaggttcccatgcccagtttccctggatgccaaatgccagccatgcctcctgactcgaaccattcgcagtacctgcttggtacacattgaaggagactccgtgaagaccaacgctagcagtcagcggcacccaccgtgcctttctcagagacccttagcagccccccttactaaagcctcatctcaaggacatttgcctaccgagctgaccaagactccatcactagcccatctggatacctgcctgagcaaaatgcacagtcagacgcacctcgctaccggcgccgtcaaggtacaaagccaggctccactggcgacctgcctgaccaagacacagagtagaggacagcctatcacagatatcacaacatgtctgataccagcccatcaggcggctgatttatcatcgaacacacactcccaggtactcctgacaggatcaaaagtctcaaatcatgcctgccagagattgggaggcctcagtgctccaccttgggccaaaccagaagatcgacaaacccagccccagccgcacggccatgtgccagggaagactacacagggcggaccatgtcccgccgcctgtgaggtgcagggcatgctggtgccccccatggccccaacgggacacagcacctgtaatgtggagtcgtggggtgataacggcgccaccagagcccagcctagcatgcccgggcaggcggtcccttgtcaggaagacaccggccccgccgacgccggggttgtgggtggacagagttggaacagggcatgggagccggcacgcggagcagcctcctgggacacctggcgcaacaaagccgtggtgccgccaaggcgcagtggcgagccaatggtgagcatgcaggcggccgaggagatccggatcctagctgtgattaccatccaggccggtgttaggggttacctggctaggcgccgcatccggctgtggcatcggggagccatggtgattcaggccacttggagaggctatcgcgtacgtagaaatttggcccacttgtgtagagccaccacaacaattcagtccgcctggcgcggatacagcacgcgtcgggaccaggcaaggcactggcaaatgctacaccctgtcacctgggttgagttgggaagtagagcgggggtaatgagtgaccggtcgtggtttcaggatggtagagctcgcaccgtgagcgatcaccggtgttttcagtcctgccaggcacatgcttgttccgtgtgtcactcactctcctcaaggattggatcccctccatcagtagtgatgctcgtgggatccagcccccggacctgtcacacctgcgggagaacacagcctaccagagtcgtgcaaggcatgggacagggaactgaagggcctggggcagttagctgggcatccgcataccaactcgctgcactgtctccacgacagccacatagacaagataaggccgcgacagctatccaatctgcctggagaggctttaagatcaggcagcagatgaggcaacagcaaatggcagcgaaaatcgtccaggcgacctggcgcgggcaccacacgaggagttgcctgaagaataccgaagctttgctgggccccgctgatccctctgcctcaagtcggcacatgcattggccaggcatctag

SEQ ID NO: 45130 - DNA, 4272 bp, Artificial Sequence
  Description of Artificial Sequence: Synthetic coding sequence
atgtacttcctgagcggctggcccaagcggctgctgtgccccctgggctcacctgctgaagctccctttcacgtccagtctgaccctcagcgcgcttttttcgcagtattggccgccgcgagactgtccatctggtactctagaccgagcgtcctcatcgttacttacaaggaacctgccaagtcgagcactcagttcgggtcttacaagcaggctgagtggaggcctgatagcaccatgatcgcggtgtctactgctaatggttatatcctcttctttcatattacaagcacccgcggggacaagtacttgtacgagcccgtttaccccaaaggaagccctcagatgaaaggtacaccgcatttcaaagaggagcagtgcgctccggccttaaatttagaaatgcggaagatactggatctccaggctcctatcatgtcattgcagtccgtgcttgaggaccttcttgtggctacatcagatgggttgttgcacctcatccactgggaaggcatgactaacggacggaaggcaatcaatctgtgtacggtaccgttttctgtggatctgcagtcatcacgcgttggctcattccttggttttactgatgtccacattagagacatggaatattgtgctacactggatggttttgccgtggtctttaacgatggaaaggtcgggttcatcacgccggtgtctagtaggttcactgccgagcagctgcatggagtgtggccacaggacgtggtggatgggacttgtgtcgccgtgaacaacaagtaccgcttgatggcctttggatgcgtttctggctctgttcaggtatacacgatcgacaattccacaggggctatgctgctgtcacacaaactggagctgacagcaaaacaataccccgacatctggaacaagacaggggccgtgaagctcatgcgctggtcccccgacaacagcgtggtgattgttacttgggaatacgggggcctatccctgtggtctgtcttcggtgcacagctcatatgtactttgggaggcgacttcgcctataggagcgacgggaccaagaaagaccctttgaagattaactctatgtcttggggggccgagggatatcacctgtgggttattagtggcttcgggagccagaacaccgagatagaaagtgacctgagaagcgtcgtgaagcagcccagcatactcctttttcagttcatcaagtctgtacttacagtgaacccctgcatgtcgaatcaagaacaggtcttgctgcagggtgaggaccggctctacctcaattgcggcgaagctagtcagacgcagaatccaagaagcagttcaacccactccgagcacaaaccgtcgagggaaaagtcccctttcgctgacggcggcctggaaagtcagggactgtctacactgctgggccacaggcactggcacgtggtgcaaatttccagcacctaccttgaaagcaattggcccatccgattcagcgcaattgataaactcggtcagaacatcgctgtcgtgggaaaatttggattcgctcactactctctgctgactaaaaagtggaagctgttcggtaacatcacccaggagcagaacatgatcgtcaccggcggactggcctggtggaacgatttcatggtattagcctgctacaatataaacgaccgtcaagaggaattgagggtctatcttcgtacaagcaacctagacaacgcatttgcgcacgtaactaaggcacaggccgagacattgcttcttagtgtgtttcaggatatggtgatcgtatttcgagccgactgtagtatttgtttgtacagcatcgagagaaagagtgatggcccaaacaccacagccggcattcaggttttgcaggaggtaagtatgtcgcgatatatcccacatccattcttggtggtgtccgtgacattgacaagcgtgagcacggaaaacggcataactcttaagatgccccagcaggctaggggcgccgaatctatcatgctcaacctggccggccaattgatcatgatgcaaagggatcggtctgggccacagatcagggagaaagacagcaatcctaacaatcagaggaaactcctccctttctgtcccccagttgtgctggcacagtccgtcgagaatgtgtggacgacgtgtcgggcgaataagcagaagcgacaccttctcgaggccctctggctgagttgtgggggagctggaatgaaggtctggttacctctgtttccaagggaccacaggaaaccgcactcatttttatctcagaggatcatgttgccctttcatattaacatctatccacttgccgtattgttcgaggacgccctcgtcctcggagcggtgaacgatactctgctctatgactccctgtatacacggaataatgctagggagcaactggaggttttgtttcctttttgcgttgtcgaacgcacttctcagatttatttacatcacatccttcgtcagctcttggtccgcaatctgggcgagcaggcgttgctgctggcccagtcatgcgcaacgctcccctacttccctcacgtgttggagctgatgttgcatgaggtcctggaggaagaggccacctctcgggagcccatccccgatccactgctaccaacagtagctaagtttattaccgagtttccactattcttacagactgttgtgcattgcgctaggaaaacagagtacgcattgtggaattatctgttcgcagcagtgggcaaccccaaagacctgtttgaagaatgccttatggcacaagatttggacacagctgcgtcctatctcattattctccagaacatggaagtgcccgccgtgtcccgtcaacatgcaactctgcttttcaataccgcattagaacagggcaagtgggatctttgtcgccacatgatccggtttttaaaagcaatcggatccggagaaagtgagacccctccgtcgacccccaccgcacaagaaccaagtagcagcggagggtttgagttcttcagaaaccgcagcatttctttgtcccagagtgctgaaaacgtgccagcatccaaatttagcctccagaaaaccctcagtatgccgtccggtcccagtgggaagcggtggtcaaaagactctgactgcgcggagaatatgtacattgacatgatgctgtggagacacgctaggagactgctggaggatgtgcgactgaaagacctcggctgcttcgccgcccagcttggctttgagctgatttcatggctttgcaaagagaggaccagggccgcaagggtggataacttcgtcatagcactcaagcgcctccataaggatttcttgtggcctctcccaatcatacccgcctccagtatttcatcacccttcaagaacggcaagtacagaacagtaggggaacaactcctgaaaagtcagagtgccgatcccttcctgaaccttgagatggatgcaggcatctctaatattcagaggtctcaatcatggctttcaaatattgggcctacccatcatgagatcgataccgcttcatcccatggaccgcaaatgcaggatgcctttttgtctccgctgtccaacaagggggatgaatgctctataggaagcgctacggacctcacggaatcttcaagcatggtggatggagactggacaatggtcgacgagaacttcagtactttgagtctgacccagagcgaactggagcacatcagtatggaactggcctctaagggacctcataagtcgcaagtgcaactgcggtatctgctgcacatctttatggaggccggctgcctggattggtgcatcgtcattggtctgatcctcagggaatcctccatcatcaatcaaattttggtaatcacccaaagtagcgaagtggatggcgaaatgctgcaaaatattaaaaccggtctgcatgccgtcgatcgatgggcctcaacagattgtccggggtacaaaccatttcttaacattattaagccccagctgcaaaaactgtcagaaattaccgaggagcaggtacaaccagatgcattccagcccataactatgggcaagaccccggaacagactagccctcgtgcggaagagtcccgaggatccagtagccacggctctattccacaaggggaggtcggcagcagcaacatggtgtcgaggaaagaggaggacactgcacaggccgaagaggaggaacctttccaagacggtacttacgactgtagcgtgtcctag

SEQ ID NO: 45131 - DNA, 4035 bp, Artificial Sequence
  Description of Artificial Sequence: Synthetic coding sequence
atgatcgccgtgagcaccgccaacggctacatcctgttcttccacataacatctaccaggggtgataaatacctgtatgaaccagtgtatcccaagggatcccctcagatgaagggtactccccactttaaagaggaacagtgcgcgcctgccttgaacctcgaaatgcgaaaaatcttggatcttcaggctccaatcatgtccctgcagtcagtgcttgaagacctactggtggccacatctgatggtctgctccatctgatccattgggagggcatgaccaacggtagaaaagctataaatctgtgcaccgtgcctttctcagttgacctgcagtcatcccgcgtcggatcgttcttggggtttaccgatgttcatataagggatatggagtactgcgcgacactggatggattcgctgtcgtcttcaacgatggcaaagtggggttcatcacgccagtctcgtccaggttcacagcagagcagcttcatggggtgtggcctcaggacgtggtggacgggacttgtgtggctgttaacaataagtacagattgatggctttcggatgcgtgagcggaagcgtgcaggtttacaccatcgacaatagcacaggcgctatgctcttaagccacaaactggagcttaccgctaaacagtatccggacatatggaacaagaccggcgccgtaaaactgatgcgctggtcacccgataatagtgtcgtgattgtcacttgggagtacggaggactcagtttgtggagtgtgttcggggcacagctcatctgcactctgggcggagactttgcctatagatcagatggcaccaagaaagacccattgaagattaacagcatgtcttggggcgccgagggctatcacttatgggtgatctctgggttcggcagccagaataccgaaatagaaagtgatctgcggtccgtcgtcaaacagccaagcatactactttttcagtttatcaagtcagtgcttactgtgaacccatgtatgagcaaccaggagcaggtattgctgcaaggggaggaccgcctgtacctgaactgtggcgaagcttctcagacacagaatcctcgatcatccagtacacattccgagcacaaaccttcgcgagaaaaatcgccgttcgcagacggaggcctcgagtcgcaggggctgtcaacattactgggccaccggcactggcatgtagttcagatttcaagtacctacttggagtctaattggccaatacgatttagtgccattgacaaacttggccagaatattgccgttgttggtaaattcggttttgcccactacagcttgctgactaagaagtggaaactgttcgggaatattacccaggagcagaacatgattgtaaccggcggcctcgcgtggtggaacgattttatggtgttggcttgttataacataaacgataggcaggaagagctacgggtgtacctgagaacctccaacctggataatgccttcgcgcatgtgactaaagcgcaagccgaaacgctgcttctatcagtgttccaggacatggtgatcgttttcagagcggactgttctatttgtctgtactctatcgagaggaaatcagatggaccaaataccacagcggggatccaggtgctgcaggaggtgagtatgtccaggtatatcccacacccctttctggtagtgagcgtgactcttacatctgtctctacggagaacggcatcacacttaagatgccccagcaggcccgcggtgccgaatctatcatgttgaatctcgcagggcagctgataatgatgcaacgcgatcgttccggccctcagattagggagaaggattccaacccaaataatcagcgaaaactcctgcctttctgccccccagtggtgctagcacagtctgtagaaaatgtgtggacaacgtgccgagcaaacaaacaaaagagacatctgttagaggccctgtggctgagctgtggcggggctggaatgaaagtgtggctgccgcttttcccacgcgatcaccggaagccccatagcttcctctcccaacgaattatgctgcctttccatatcaatatctacccattggcggtgttatttgaagacgcactggttctgggcgccgtcaacgacaccttgctctacgactctctatataccaggaataacgcccgcgaacagctagaggtgttattccccttctgtgtggtggaacggaccagtcagatttacttacatcacattttaaggcagctcctggtgaggaatctcggggaacaggctctcctgttagctcagtcctgtgctacgctcccttacttcccacatgtgctcgagttaatgctccatgaggtgctcgaagaggaagccacctcacgtgaaccaatcccggaccccctccttcctactgtcgcaaagttcattacagaattccccctgtttttacaaaccgtcgttcactgcgctcgcaaaacagagtacgccctctggaattaccttttcgccgccgtgggcaaccctaaagatctgtttgaagagtgcttgatggcccaggatcttgacacggctgccagctacctgattatcctgcagaacatggaggtgcctgcagtgagccgccaacacgccacactgctgttcaacacagccttagagcaaggaaaatgggatctatgccgtcacatgatccggtttctgaaagctattgggagtggtgaatctgaaacgcccccgagcaccccgacagctcaggagcctagcagttctgggggattcgaatttttcagaaaccgatcaatcagcctgtcccagagcgccgaaaatgttcctgcttcaaaatttagcctgcagaaaaccctgtccatgccgtcaggccccagcggaaagaggtggagcaaggactcagactgcgccgagaacatgtacatcgacatgatgttgtggcgccacgcccgccggctgctggaggacgtgagattaaaggacttaggttgctttgcagcccagctcggctttgaactaatcagctggctgtgtaaagagcgcacacgagctgctagggttgacaatttcgtgatagccctcaagagattgcacaaggactttctgtggcccctgcccatcatccccgcttcctctataagcagtccgttcaagaacggaaagtaccgcactgtgggggagcagctgcttaagagtcaatcagccgacccttttctcaacctcgagatggatgcaggcatctctaatatccagcgttcccaaagttggctgtccaatattggcccgacacaccacgagatagatactgccagttctcacggcccacaaatgcaggacgcatttctgtctccccttagtaacaaaggggacgaatgttcaataggcagcgctaccgatcttacggagtctagcagtatggttgatggtgattggactatggtggatgaaaacttctcaaccctctcactgacccagagcgagcttgagcacatcagtatggagctcgccagcaaaggtcctcataagtcccaggtgcagcttcgctacctgctgcacatattcatggaagcggggtgcctagactggtgcattgtgatcggcctgatcttgagagaaagttctatcatcaatcagattctggtcatcacccagagctccgaggtggatggcgagatgctgcagaatattaaaacaggtctccatgccgtcgaccgctgggcaagcactgactgtcccggctataagccattcctcaacataattaaaccacagttgcagaaactcagcgagataactgaggagcaggtgcagcccgacgccttccaaccaatcaccatgggcaaaacgcctgaacagacaagtccccgcgcagaggaaagcagaggctcatcatctcatggctccataccacagggtgaagtcggatcttccaacatggtgtcaagaaaggaggaggatacagcccaggccgaggaagaggagcctttccaggatggtacttacgactgctccgtttcttag

SEQ ID NO: 45132 - DNA, 3081 bp, Artificial Sequence
  Description of Artificial Sequence: Synthetic coding sequence
atggagaagcggctgggcgtgaagcccaaccccgccagctggatcctgtctggctactactggcaaacgagcgccaaatggctgcgatcgctgtatctgttctacacttgtttttgcttctccgtgctctggctcagcaccgacgcctccgagtcccgctgccaacaagggaaaacccagtttggcgtgggtctgagatccgggggtgagaaccacctctggctgctcgagggcacccccagtttgcaatcctgttgggcagcatgctgccaagatagcgcctgccatgtgttttggtggttagagggaatgtgtatccaggccgactgcagtcggccacagtcttgccgggccttccggacgcatagtagcaatagtatgctggtatttcttaaaaagtttcagacagctgatgacctgggttttctccctgaagatgacgttccacacctcttggggctgggatggaattgggcctcctggcgacaaagtcctccacgggctgccctgcgaccagccgtgagctcgtccgatcagcagtccctgattcggaagctgcaaaagcgaggttccccatccgacgttgtgacccccattgtgacacagcactctaaagtgaatgacagcaatgagctggggggcctgactacatccggcagtgccgaggtgcacaaggctatcactatttcttccccactgactacggacctcacagccgagctctcaggaggaccaaaaaacgtgtctgtacaacccgaaatctctgaaggccttgccaccactccctcgacccaacaggtcaagtcctcagagaaaacacagatcgcagtaccccaaccagtggccccttcttatagctatgcaactcctaccccgcaggcttccttccaaagcactagcgcaccataccccgtgatcaaagaactcgtggtgagcgcgggcgaatccgtgcagatcacactccccaagaatgaggtgcagttaaacgcatatgttctacaggagccgccaaaaggagagacctacacttacgactggcagttaattactcatccccgggactattctggggaaatggagggaaaacacagccagatcctcaagctttctaaactgacacctggcctctatgagtttaaagtaatcgtggagggtcaaaacgctcacggcgaaggatacgtaaatgttacagtcaagcctgagcctcgcaagaatcggccaccaattgcgatcgtatccccccagtttcaggagatctcactgcctacaacatcaactgtgattgacggttctcagagcacagacgacgacaagatcgtgcaatatcactgggaggagctcaagggccccttacgggaggagaagatctctgaggatacggcaattcttaagctatctaagctcgtacctggaaattacacattttctttgaccgtggtagacagtgacggagccactaactcaaccaccgctaatttgaccgtgaataaagcggtcgattacccgcccgtggccaatgctggcccaaatcaggtgatcaccctgcctcagaacagcatcacgctttttggtaatcagtctaccgacgaccacggcattacttcctacgagtggtctttatcacctagttccaagggaaaggtggttgagatgcagggggtgcgcactccaactttgcagttatccgccatgcaggaaggggactacacataccagctgaccgtcacggatacaatcgggcagcaagccaccgcccaggttaccgtgatcgttcagcccgaaaataataagccccctcaggctgatgctggaccagacaaagagctgacccttcctgtagactcaacaaccttagatggaagcaagagctccgatgatcagaaaatcatctcctacctatgggagaagactcaggggcctgacggagtgcagttggagaacgctaatagtagcgttgctaccgtgaccggcttacaggtggggacatacgtcttcacactcacagtaaaagacgagaggaacttacaatcccaaagctcagttaatgttatcgtgaaagaggagattaataagccaccaatagctaagattacaggcaacgtggtcataaccctccctacttcaacggccgagctcgacggcagtaagagctctgatgacaaaggcattgtgtcttatctgtggaccagggatgagggctctcccgccgcgggagaagttctgaatcactccgatcatcatcctatcctgttcctctctaatctggttgaagggacttatacgtttcatctcaaggtaacagacgcgaagggagagtcagacaccgaccgtaccaccgtagaagtgaaaccagacccgaggaagaacaacctggtagaaatcatcctggatattaacgtctcccaactaacagagcgactaaagggaatgttcatccgtcaaatcggggtcttgttaggagtcttggacagcgatattatcgtccaaaagatccagccctatacggagcagagcacgaaaatggtgtttttcgtccagaatgagcctccgcaccagatttttaaagggcacgaggtcgctgcgatgctgaagtccgaactgcgcaagcagaaggctgatttccttatttttagggccttggaagtcaataccgtgacatgccagctgaattgttcagatcatgggcattgcgattcctttaccaagcgctgcatatgtgatcctttctggatggagaacttcataaaagtacagctgagagacggcgattctaattgtgagtggagtgtgctgtacgtaatcattgctaccttcgtaattgtggtggcacttggaatcctctcctggacggtgatctgctgttgcaaacggcagaagggtaagcccaagcgcaaaagcaagtacaagatccttgatgctacagaccaggaaagtctcgaactgaagcccacctcgagggcagggataaagcaaaagggactcctgctgtctagctcactgatgcattccgaaagtgagctagattccgatgacgccatattcacttggcccgatagggagaagggaaagctcctgcactag

SEQ ID NO: 45133 - DNA, 3405 bp, Artificial Sequence
  Description of Artificial Sequence: Synthetic coding sequence
atggagaaggcccccccccagccccagcacgagggcctgaagagcaaggaacaccttccccagcagccagctgagggaaagaccgccagcaggagagtcccgcgactgagggcagtcgtggagtctcaagccttcaagaacatcctcgtcgatgagatggacatgatgcatgctagggcagcaacactgatccaagctaactggagggggtactggctgcgacagaaactcatctcacagatgatggcagctaaagccatccaggaagcctggaggcgtttcaacaagcggcatatcctccattcgtctaaaagcttggtaaaaaagaccagagccgaagagggggacatcccctatcatgccccacagcaggttcgatttcagcacccagaagagaacaggctgctttctcctccaatcatggtgaataaagagactcagttccctagctgtgataacttagtgttatgtcgaccacagagctcgcccctgctgcagccacccgcagcacaggggacaccggagccttgtgtgcagggaccccacgctgctagagtgagagggctagccttccttccccatcaaacagtcactattagatttccatgccctgtgtctctcgacgctaaatgccagccgtgcctccttactagaaccattaggagcacatgcctggtccatatcgaaggcgacagtgtcaaaacgaagcgcgtgtcggcccgtaccaataaggcaagagctcccgagacccccttgtcccggcggtatgaccaagctgtcacccgtccctcccgggcccaaactcagggcccggtaaaggctgagacccccaaagcaccattccagatctgccccgggcccatgatcactaagacactgctgcaaacatatcctgtggtgagtgtgaccctccctcagacttaccccgcttccaccatgaccacgactccccccaaaacgtctcccgttccgaaggtaactatcatcaaaacaccagcgcagatgtatccggggccgacagtgaccaagacagccccacacacctgtcctatgcctactatgaccaagatccaggtccaccccaccgcgtcccggacaggtacaccgcgacagacctgtccagccactatcacggctaaaaaccgccctcaagtatctttactggcctccatcatgaaatccctgccccaggtgtgtcctgggccggccatggccaagaccccaccccagatgcaccccgtcactactccagctaaaaaccccttgcaaacttgcctcagcgcaacaatgtccaaaacctcctctcagcgtagtcccgtaggcgtgacaaaaccctcccctcagacacgactccctgccatgattacaaagacccccgcccaactaagaagcgtggccacaatcttgaaaacactttgtctggcgagccccaccgtagccaacgttaaggctcctccacaggtggcggttgccgcaggcacaccaaatacgagcggtagcatccatgagaaccctccaaaagcgaaggccaccgtcaatgtaaagcaggccgccaaggtggtgaaagcctcttctccttcttaccttgcggaaggcaaaatacgatgtctcgcacagccccaccccggtactggggttccaagggctgcggcagaactccctttggaggccgagaaaataaagactggaacgcagaagcaggctaaaacagatatggcctttaagacttcagtggccgtggaaatggctggggcaccttcctggactaaggtggccgaagagggcgataagcccccgcatgtctatgtgccagtggatatggcagtaacgctgcctcgtggacaacttgccgctccgctgacaaatgcctctagccaacggcatcctccatgcctgtcccagcgtcctttggccgcaccgctcaccaaggccagctcacaaggccacctgcccaccgaacttaccaagacccccagcctagcccacctggacacctgtctaagtaaaatgcattctcagactcatctggccactggagctgtcaaagtgcaatctcaggctccccttgcaacttgcttaacgaagacgcagtccagaggacagcctataacagacattaccacgtgtctgatacctgcacatcaggccgccgacctgagcagcaacacccacagccaagtactgcttacggggagcaaggtgtccaatcacgcctgtcagaggttaggcggattaagcgcccctccttgggccaagcccgaagaccggcagacccaaccacagccacacggtcatgtcccaggcaaaaccacccaggggggaccgtgtcccgccgcctgtgaagtgcaggggatgctcgttccacccatggctcctaccggccacagcacttgcaacgtggaatcgtggggggacaatggggctacaagggcccagccatctatgcccggacaggccgttccgtgccaggaggacaccgggcctgccgacgctggagtggtgggggggcaaagctggaatagagcgtgggagcctgcacgcggggccgcatcttgggatacatggaggaacaaggctgtcgttcccccacggcgatccggcgagcctatggtgtccatgcaggccgctgaagagatccgcatcctggcagttatcacgatccaagctggagttcggggctacctcgcccggagaaggatcagactgtggcacaggggggccatggtgatccaggcaacatggagagggtatagagtcagacgcaacctggctcacctgtgcagagctacaacaacaattcaatcggcatggcgtggatattccacacgccgcgaccaggcccgccattggcagatgctgcaccccgtaacctgggttgagctcggatctagggcaggcgtcatgtcagaccgctcctggtttcaggatggacgagccaggactgtttcagaccatcgatgtttccagagctgccaggcccacgcctgcagcgtgtgccactcccttagttctaggatcggatcccccccctccgtggtgatgctcgttggttcctctccccgaacttgtcatacctgtggccgcacccagcctactagagtcgtccaggggatgggtcagggcactgaagggcctggtgccgtgtcttgggcaagcgcctaccagctcgccgcattaagtccgcggcagccgcatcgccaggataaagcggcaacagcaatacaaagtgcttggcgggggtttaagatacgccaacaaatgcggcagcaacagatggccgctaaaatcgtgcaggctacctggcgcggacaccatacaaggagttgtctcaagaacaccgaggccctgctggggcctgcggatccaagtgcctcatcacgacatatgcactggccaggcatctag

SEQ ID NO: 45134 - DNA, 2058 bp, Artificial Sequence
  Description of Artificial Sequence: Synthetic coding sequence
atggagaagcggctgggcgtgaagcccaaccccgccagctggatcctgtcgggctactactggcaaacatctgccaaatggcttcgttcactgtacctgttttacacctgcttctgttttagtgtcctgtggctgtctaccgacgcttctgaatcaaggtgccagcagggcaaaacccagttcggagtgggtctgcgcagtgggggagaaaaccacttgtggctgttagaggggacaccttcactgcagagctgctgggctgcttgctgtcaggatagcgcttgtcatgtattttggtggctagagggaatgtgtatccaggctgattgtagccggccacaaagctgccgggcatttcggacccatagctccaactccatgcttgtctttcttaagaagttccaaactgccgacgacttgggcttccttccagaggacgatgtgcctcaccttttaggactcggatggaactgggcctcctggcggcagtccccaccccgggcagctcttcgtcccgcagtcagttcttcagatcagcaatccttgatacgaaagttgcagaagagaggaagtcccagcgatgtcgtcactcccatagtgacacagcattccaaagtgaatgactcgaatgagctcggaggacttaccactagcggatctgcagaagtacataaagcgattacgatctcaagcccgctgaccactgacctgactgctgaactttctggcggtcctaaaaacgtgagcgtgcagccagaaattagtgagggcctcgctacaaccccatccacacagcaggtcaaatccagtgaaaagactcagattgccgtgccccagccagtcgccccttcttactcctacgccactccaacaccccaagcctcttttcagtctacttctgccccctacccagtgatcaaagaactggtggtttctgctggcgaatcggtgcagatcactctgcccaaaaacgaggtccagcttaacgcatatgttctgcaggagcctccaaagggggagacctatacctacgattggcaactgatcacccatcctagggactacagcggggaaatggaggggaagcatagccagattctgaagctgagcaagttaacccccggcctttatgagtttaaagtgatagtggaggggcagaatgcacacggagagggatatgtgaacgtcacagtgaagcctgagccacggaagaatcgtcctcctattgcgattgtgtccccccagttccaagaaataagcctgccaaccacttcaaccgtgattgatgggtcccagagtaccgatgacgacaaaatcgtccagtatcactgggaggagctaaagggtcccctgcgcgaggaaaagattagtgaagacacggctattcttaaactttccaagctggtaccggggaactacaccttctcccttaccgtggttgatagcgacggcgccacgaattctactactgctaatctgacagtgaacaaagcagtcgattatccgcccgtggcaaatgcaggacccaatcaagtcatcactctgccccagaactccataactttgttcggaaatcagtccacagacgatcacggcattaccagctacgagtggtccctctcaccaagcagtaaggggaaagttgtcgaaatgcagggagtgcgcactccgacactccaactgagcgcaatgcaagagggcgactacacataccagctgactgtgacagataccattggacagcaagcgactgcgcaggtaaccgtgattgtgcagcctgagaacaacaaaccacctcaggccgatgcaggcccagacaaggagctgactttgccagtagactctacaacgctagatggaagtaagtcgtctgatgaccagaaaatcattagttatctgtgggagaaaactcagggacctgatggcgtgcagctggagaatgctaacagctcagttgctacagtgactggattgcaggtaggaacttatgtgttcacactgacagtcaaggatgagcgcaacctgcaaagccagtcctccgtgaacgtgattgtctag

SEQ ID NO: 45135 - DNA, 4581 bp, Artificial Sequence
  Description of Artificial Sequence: Synthetic coding sequence
atggccggcctgcggcggccccagcccggctgctactgccggaccgccgcggccgtgaacctcttattaggcgtgtttcaagtgcttcttccatgctgtcggcccggaggagcccagggacaagcaattgaacccttacctaatgtggtggagctttggcaagcagaagaaggtgaactgctacttcccacccagggtgactcagaagaagggctcgaggagccttctcaggagcagagcttctctgacaaattatttagcggaaaggggctccattttcaaccctctgtacttgacttcgggattcaatttttaggccacccagtagccaagatcctgcacgcatataaccccagcagagacagcgaagtggtcgttaattcagttttcgccgctgctggccacttccacgtgccccctgtgccctgtcgggtgattcctgcaatgggcaagacgagttttcgaattattttcctgccaactgaggagggatcgatcgagtcttctctgtttataaatactagttcctatggcgtcctcagttaccacgtgagcggcataggcacgagaaggatttcgacagagggctccgctaagcaactacccaatgcatacttcctcctaccgaaggtgcagtccatacagttatcgcagatgcaggccgaaactaccaataccagtctcctgcaggtacagcttgaatgttcgctgcacaacaaggtatgccagcaacttaaaggatgctacctcgaatcggatgacgttcttaggctgcaaatgtccattatggtaaccatggaaaacttctccaaggagttcgaggagaatacccagcatctgctggaccatctctctattgtgtatgtggccacagacgagtccgaaacttcggacgattcagctgtaaacatgtacatcctccacagcggaaactctttgatttggatacaggacatcagacactttagtcagcgggatgccctgagcctccagttcgagccagtgctgctgcccacaagcacaactaactttaccaagatagcttctttcacttgcaaggctgctacatcctgtgacagtgggatcatcgaggacgtgaagaagaccacgcacaccccaaccctcaaggcatgcctgttcagtagtgtcgcacagggatacttccgcatggactcttctgcaacacaattccatatcgagacacatgagaacacttccggcctgtggtcaatttggtatcgaaaccatttcgatagatccgtggtgctcaatgacgttttcttgagcaaagagaccaagcacatgctgaaaatcctgaatttcactggacccctattcttgcccccggggtgttggaacatatttagtttaaaacttgctgtaaaggatatagctattaaccttttcaccaatgtattcttgaccaccaacataggagccattttcgccatccctcttcagatttactcagccccaaccaaagaaggatcccttggcttcgaggttatcgcccattgcgggatgcactatttcatgggtaagtccaaagccggaaaccccaattggaatgggtcactatcactggaccaatctacttggaatgtcgattccgagcttgccaataaactttatgagcgctggaagaaatacaagaacggggacgtatgtaaatttgggaccgacatgcagatgatcaattttactactggcgagtttcagctcaccgaggcctgtccttacctgggcacccactctgaagaatccagatttgggattcttcacctccatcttcagcctttggaaatgaaacgtgtgggggtcgtgtttacccccgctgactatggcaaagtcacatcattgatactcattcgtaacaatctgacggtcattgacatgattggggttgaagggttcggggccagagaattgttgaaggtcggcggccgacttccaggcgctgggggctctttgcggttcaaggtgcctgagtcaactctcatggactgtcggcgccaattgaaagacagcaaacaaattctgagcatcactaaaaacttcaaggtggagaatatcggacccctgcctatcacggtctcttccctgaagattaatggatacaattgccagggctacggtttcgaggttctggactgccaccagttctcccttgaccccaacacaagcagggatatcagtatagtcttcaccccagacttcactagtagttgggtcattagagacctgtcgctggttaccgctgctgacctagaatttcgattcaccctgaatgtgacactgcctcaccaccttctacccctatgcgccgacgtggtgcccgggccaagttgggaggagagtttttggcgcctgactgtctttttcgtgtctttaagcctactgggggtgattttaatcgccttccaacaagctcagtatatcctgatggagttcatgaaaacaaggcagagacaaaacgcaagtagctcctcccagcaaaacaatggaccgatggacgttattagtccacactcttacaaatcaaattgtaagaactttttggacacttatggaccatctgataagggccgggggaaaaattgcctccctgtgaatactcctcagtctagaattcaaaatgccgctaagcgcagtcccgctacttatggacacagccaaaagaaacataagtgtagcgtgtactactccaaacacaagacttccacggccgccgcttcgtccacatcaacaaccaccgaagaaaagcagacatctcctcttggctcctctctgcctgccgctaaggaggacatttgcaccgacgcaatgagggagaattggatctccctgcgctacgcttctggcatcaatgtgaatctccagaagaatttgaccctacctaagaacctgctcaacaaagaagagaatacacttaagaataccatcgttttcagtaacccatcatccgagtgttccatgaaggaaggaattcaaacatgtatgttccccaaggaaacagatattaagacttccgaaaacaccgccgaattcaaagagcgcgagttgtgccccctgaaaacgtccaagaagctgcccgaaaatcatttacctcgtaacagcccacaataccaccagccagacctcccagagataagtagaaaaaacaatggtaacaaccagcaggttcctgtcaaaaatgaagtagaccactgcgagaacttaaaaaaggtggatacaaaaccttcttcagagaagaaaattcacaaaactagcagagaagatatgttctccgaaaagcaggacatccctttcgtagagcaggaagacccttaccgcaagaagaagctgcaggaaaagcgtgagggcaacctacaaaacctgaattggagtaagtcccgtacctgtcgcaaaaacaagaagaggggtgtcgccccggtatcgcgacccccagagcagtcagacctgaaattagtgtgtagcgatttcgaacggtctgagttgagcagtgatatcaatgttaggtcttggtgcatccaggaatcaacgcgggaggtctgtaaagccgacgccgagattgcttcatctctaccagccgctcagcgggaagccgaggggtattatcagaaacccgaaaaaaagtgtgtagacaagttctgtagtgactccagttcagactgcggctccagttcagggtctgttcgggccagccggggaagttggggctcctggagttcgacaagcagctcggacggtgacaaaaagccaatggtggacgcacagcactttttaccagctggggacagcgtcagccagaacgatttccccagtgaagccccaatttccctgaatctgtctcataacatctgcaatcccatgactgtcaattccctgcctcagtatgccgaaccctcttgcccctctctgcctgccggcccaaccggagttgaagaagataaggggctgtactccccaggagatttatggccaacacctcctgtttgtgtgacctcctcactgaattgcactctggaaaatggcgtcccctgcgtcattcaggagtctgctccggtccacaactccttcatagattggtctgccacctgcgagggccagttctcctctgcatactgccctctggagctcaacgattacaatgccttccccgaggagaatatgaattacgcaaatgggtttccctgccccgcagatgtgcagactgacttcatcgatcacaattcccagtctacttggaacacaccacctaacatgcccgctgcttggggccatgcctctttcatttcttctcctccctatctcacttctacccgatcactcagcccaatgagcggattattcggatctatctgggcccctcagtctgatgtgtacgagaattgctgccctatcaaccctacaactgaacacagcacacatatggaaaaccaggccgtggtttgcaaagagtattatcccgggttcaatccgttccgcgcttacatgaatctggatatctggacaaccacggcaaatagaaatgcgaatttcccgctgtccagggactcaagttactgtggcaacgtgtag

SEQ ID NO: 45136 - DNA, 3924 bp, Artificial Sequence
  Description of Artificial Sequence: Synthetic coding sequence
atgatcgccgtgagcaccgccaacggctacatcctgttcttccacataacttccacgcgaggagataaatacctctacgagccagtatacccaaaaggctcgccacagatgaaaggaaccccacatttcaaagaggagcagtgcgcccccgccctgaatctggagatgcgtaaaatcctggatctccaggctccaattatgtccctccagtccgtactagaggacttattggtagcgacaagtgatggtttgctgcacctcattcattgggagggtatgacaaatggaagaaaggcaatcaatctctgcactgtgccgttcagtgtggaccttcagtcatcccgggtagggtctttcctcggcttcacagacgtgcatattagggacatggaatattgcgcaaccctggatggctttgccgtggtgtttaatgacgggaaagttgggttcatcacacctgtctcgagtcggtttactgccgaacagctgcatggtgtttggccacaggacgtagtcgatggtacatgcgtagccgtcaacaacaagtacagactgatggcatttggttgcgtgagcggtagtgtgcaggtatacaccatagataacagcactggagccatgctgctatcccacaagctagagctgactgctaaacagtatcccgatatctggaacaagaccggggccgtgaagctgatgaggtggtctccggacaacagtgtcgtgatcgttacatgggagtacggcggactgagcttatggagcgttttcggggcacaactgatttgcactctgggtggggacttcgcctatcgctctgatggaaccaaaaaggacccactgaagatcaattccatgagttggggagccgaaggataccatttgtgggtcatctccggctttggcagccagaacactgaaatcgaatctgatctacgaagcgttgtgaagcagccttcaatactcctctttcaatttattaagagcgttttgacagtgaatccatgcatgagcaaccaggagcaggtcctactccagggagaggaccggctctacctgaattgtggtgaagcctctcagacccagaatcctcggtcctcgagtacccattctgagcataagccttccagggaaaagagccccttcgcagacggcggcctggagagccaaggcctgtcgaccctgctcggccatcgtcattggcatgtcgtgcaaatcagctccacctatctggaaagtaattggccaatcagagaacagaacatgattgttaccggcggcctcgcctggtggaatgacttcatggtgctcgcctgttacaacatcaacgatcgccaggaagaattgagagtttatctcagaactagcaacttggacaatgccttcgcccacgtcactaaggcgcaggcagagacgctgttgttatcggtattccaagatatggtgattgtgtttcgagctgactgcagcatttgcctctattccattgaacgcaagtctgatgggcccaacacaacagccggcatccaggttctccaggaggtgtcaatgtcccgatatatcccccatccctttcttgtagtgtcagtgactttgacctcggtatcgaccgaaaatgggattaccctcaaaatgcctcagcaggcccgtggcgccgagtcaattatgctaaatctggctggccagctgatcatgatgcagcgtgaccgcagcggcccacaaatccgcgaaaaggactccaacccgaataatcagcgcaaattgttgccattttgtcccccagttgttcttgctcagagcgtcgagaatgtgtggacgacctgtagggccaacaaacagaagcggcacctgctggaagctctttggctaagctgcggtggggccggcatgaaagtgtggttacccctatttcctagagaccacaggaaacctcactcgttcctgtcacagcgaataatgttgccgttccacatcaatatctacccccttgccgttctatttgaagatgcgttggtcttgggggccgtcaatgatactcttctgtacgatagtctctacacgaggaacaacgctagagagcagcttgaggtcctgttccctttttgcgtcgtggaacgcaccagccaaatctatctgcaccacatcctgagacagctgcttgtgagaaatctcggggagcaggcacttcttttggctcagagctgcgccacactaccttacttcccacacgtcctcgagctcatgctacatgaagtgctcgaagaagaagccacatcaagagagcctatccccgatcctctgctcccaacagttgcaaaatttatcaccgaatttcccctgtttctccagactgtcgtgcattgcgctaggaaaaccgagtatgcgttgtggaactacctgtttgctgcagtgggcaatccaaaggatttgttcgaggaatgtctcatggcacaggatctggacacggccgcaagttatctgatcatcctgcagaacatggaagtaccggctgtatcacgccagcacgccaccctactcttcaacaccgcactggagcagggaaaatgggacctgtgcaggcacatgatccgctttctgaaagccattggctctggggagagcgagacacctccaagtacacccaccgcccaagagccgtctagcagcggggggttcgagttctttcgcaaccggtcaatttcactgtcccaaagcgccgagaatgtcccggcaagtaagttttcactccaaaagactctctcgatgcccagcggcccatccggaaagaggtggagcaaagactcagactgtgcagaaaacatgtacatcgacatgatgctgtggcggcatgcccggcggctgcttgaagatgtccggctcaaggatttaggttgctttgccgcacagcttggcttcgagttgatttcttggctctgtaaagagcgaacgcgtgcagccagagtcgacaacttcgtcattgccctgaaacgcctacataaggatttcttatggccgctccccatcatccccgcttcatccattagctcacctttcaagaacggcaagtatcggaccgtcggagaacagctgctgaagagccaaagcgctgatccattcctcaatttagagatggatgcaggcatctctaacattcagcgatcacagtcgtggttatctaacatagggcccacccatcatgagatcgacacggctagttcccacggtccgcagatgcaggatgccttcttgtctcctctttctaacaagggcgatgagtgctccattgggagtgcaacagatttaaccgagtcttcttcaatggtggacggagattggactatggttgacgaaaactttagtacactgtccctaactcagtccgagctggaacatatctcaatggaactcgcgagcaagggcccccataagagtcaggtccagctgcggtacctgctacacatctttatggaggcaggatgcctggactggtgcattgttattggactgatactcagagaatcttcaataatcaaccaaattctcgtgatcactcaatcatctgaagtggatggagaaatgctccagaacatcaaaactggcctccatgccgtggaccgttgggcctccaccgactgtcctgggtacaagccgtttctgaatatcatcaaaccccagttacaaaagctgtccgaaattaccgaggaacaagtccagcctgacgccttccagccaatcacgatggggaagactccagaacagacctccccgcgtgcagaggaaagcaggggctcatcttcacatggaagtattcctcaaggcgaagttgggtcctctaacatggtgtcccggaaggaggaggatacggcccaagcagaggaggaagaacccttccaggacgggacctacgattgttctgttagttag

SEQ ID NO: 45137 - DNA, 822 bp, Artificial Sequence
  Description of Artificial Sequence: Synthetic coding sequence
atggagaagcggctgggcgtgaagcccaaccccgccagctggatcctttctggatattattggcagacaagcgccaagtggctacgctcactgtacctgttctatacctgtttctgcttctccgtgctttggctgagcaccgatgcatctgaatctcggtgtcagcaagggaaaacccagttcggcgttggccttagatcaggcggggagaaccatctgtggcttctcgaaggaaccccctcgctacagagctgttgggcagcttgctgtcaagatagcgcctgtcacgtattttggtggctggagggcatgtgtatccaggccgattgttctagacctcaatcttgtagggcttttcggactcatagttcgaacagtatgctcgtctttctcaaaaagtttcaaactgccgatgacttggggtttctgccagaggacgacgttccccacttactgggcctaggatggaactgggctagctggaggcaaagtccaccacgcgctgccctcagacccgcggtgagttcctctgatcaacagtcattgatccgtaagctacagaaaagaggttccccgtcagacgtggtcaccccaattgtaacacagcattcgaaagttaatgattcaaatgaacttggcggccttacgacctcggggagtgccgaggtgcacaaagcaatcactatctcatctcctctgaccaccgatcttacggcggaacttagcggcggccctaaaaacgtgagtgttcaacctgaaatttctgagggtctagccacgacaccttccacacagcaagtgaagtccagcgagaaaacttag

SEQ ID NO: 45138 - DNA, 540 bp, Artificial Sequence
  Description of Artificial Sequence: Synthetic coding sequence
atggagaagcggctgggcgtgaagcccaaccccgccagctggatcctctcagggtattattggcagacgtccgctaaatggcttcgaagcctttacctattttacacatgtttctgcttttcagtgctctggctgagcacggacgccagcgagtcacggtgtcagcaggggaaaacgcagttcggtgtcgggcttcgtagcgggggcgaaaaccatctctggttgttggagggcaccccgtcattacagtcctgttgggccgcctgctgtcaagactctgcctgccatgtattctggtggctcgagggaatgtgtatccaggcggattgttcccgaccacagagttgccgagcattccggactcattcttccaactcaatgctggtgttccttaagaagttccagactgctgacgacttgggattcctgcctgaggatgacgtccctcacctgctgggattagggtggaattgggcctcttggaggcaatcacctccccgtgccgccctgcggccagccgtgagctcttcagatcagtag

SEQ ID NO: 45139 - DNA, 471 bp, Artificial Sequence
  Description of Artificial Sequence: Synthetic coding sequence
atggccgagcccggccacagccaccacctgagcgcccgggtgcggggcaggacggaacggcgcattcccaggctgtggcggctcctgttgtgggcgggcaccgcttttcaggtaacacagggcacaggacctgaactccacgcttgcaaggagtccgaataccactacgagtatacagcctgcgactccactgggagccgctggagggtcgctgtcccacatacccccggactctgcacaagcctaccggaccctattaagggcacagagtgttccttttcgtgtaacgccggagagttcttggatatgaaagaccagtcttgcaagccttgtgccgagggaagatattctcttggcactggcatccgctttgatgagtgggacgagttgccacatggcttcgcgtcgctatccgctaacatggagctggatgactcagcggccgaatcaacgggcaattgtacaagctag

SEQ ID NO: 45140 - DNA, 2781 bp, Artificial Sequence
  Description of Artificial Sequence: Synthetic coding sequence
atggccgagcccggccacagccaccacctgagcgcccgggtgcggggccggaccgaacgacgcatccctcgattgtggcggctcttactgtgggccgggactgcttttcaggttacccaagggactggtcctgagctgcacgcctgcaaggagtcagagtatcactacgaatacactgcttgcgattccactggtagccgatggcgtgtggcagtacctcacacccccgggctgtgcacatctctaccagaccccattaaagggacggagtgcagcttcagctgtaacgcaggggagtttctggatatgaaagatcagagctgtaaaccatgcgctgaggggagatactctctgggaacgggcatacggttcgatgagtgggacgagctgccccacggattcgcctctctgagcgccaatatggagttagacgacagtgctgccgaatccactggcaattgtacttcaagcaaatgggttccaagaggagactatatagcttcaaacaccgacgagtgtacagcgacacttatgtacgccgtcaatctcaaacagtccgggacagttaactttgagtactactatccagattcatccatcatcttcgagtttttcgtgcagaacgatcagtgccagccaaatgctgacgactctaggtggatgaaaactacggagaaaggctgggaatttcatagcgtggaattgaatagagggaataatgtcctctactggagaacaaccgcattttctgtttggactaaggttccaaagcccgttctcacacagcttatgtataagtgggccaagcctaagatttgctctgaggatcttgaaggggcagttaagctgcctgcttccggtgttaaaactcactgtcccccatgcaacccagggttttttaaaacgaacaacagcacttgccagccatgcccttacggaagctactcaaacggatccgattgcactcgctgcccagccggaaccgagccagccgtcggattcgagtacaagtggtggaataccctcccgaccaatatggagactacggtgcttagtggcattaactttgaatataagggtatgaccggttgggaggtggccggcgatcacatttacaccgccgctggcgcttcagacaacgactttatgatccttaccctcgtagtcccaggctttcggccaccacagagcgtgatggcggatacagagaataaagaggttgcaaggataacattcgttttcgagactctctgctctgtgaattgcgaattgtacttcatggtcggcgtgaacagcagaacaaacactccagtcgagacatggaagggtagcaagggcaagcagtcttacacctatattatcgaggaaaacaccacaacatccttcacatgggccttccagcgtaccacctttcacgaagccagtagaaaatataccaatgacgtcgctaagatatatagtatcaacgtcactaacgtgatgaatggggtggcttcgtattgccgaccttgcgccctggaagcctctgatgtggggtcttcgtgcactagctgtcccgccgggtactatatcgaccgcgacagcggcacctgtcatagctgcccaactaatacaatcctcaaggcgcatcagccatacggtgttcaggcgtgtgtgccatgcggaccaggcacgaagaacaacaagatccattctctttgctacaatgactgcaccttctctaggaacaccccaacacgcacgttcaattataactttagtgcgctggcgaacaccgtcacgttagcgggcggcccttctttcacctcaaaggggcttaagtacttccaccacttcacgctcagtctttgcgggaatcagggcaggaagatgagcgtgtgcactgataatgtcacagacctgaggatcccggagggcgagagcggcttttcaaagtcgattaccgcatatgtgtgtcaggccgttattatcccacctgaagtgaccggttacaaagcgggtgtgtcttcacagcctgttagtttagctgacaggctgattggcgttaccacagacatgactctggacggaataaccagccccgccgagctgttccatctggagagccttggcatcccagatgtgatatttttctatcgctctaatgacgtgacacaatcatgctcctccggccgtagtacaacaattcgggtgcgatgctcaccacaaaaaacggtcccaggtagcctgttgctaccaggcacctgttcggacggaacatgtgacggctgtaacttccattttttgtgggaatctgccgctgcctgtccactgtgcagtgttgctgactaccatgccatcgtatcctcttgcgtcgcagggatacagaagactacatatgtctggagagagcctaagctgtgtagcggcggaatcagcctcccggaacaaagggttactatttgtaaaaccatcgacttttggctcaaggtggggatcagtgcgggtacatgcaccgccattcttttaaccgtgttgacttgctacttctggaagaaaaaccagaaactggagtataagtactccaagctcgtgatgaatgctacactcaaagactgtgacttgcctgctgcagactcctgtgcgataatggagggagaggatgtagaagatgatctaatctttactagtaaaaaatctctgtttgggaagatcaaatccttcacaagtaagcgaacccctgatggttttgacagcgtgcccctgaagacatcctcaggtggtctagacatggatctgtag

SEQ ID NO: 45141 - DNA, 618 bp, Artificial Sequence
  Description of Artificial Sequence: Synthetic coding sequence
atggccgagcccggccacagccaccacctgagcgcccgggtgcggggtaggacagagaggaggatcccccgcctttggagattactcttgtgggcaggcacagcctttcaagtcacacaagggacgggcccagagctacatgcctgcaaggagtctgagtaccattatgagtacaccgcttgcgacagcacggggagtaggtggagggttgcggtgccccacacacccggactgtgcacatctttgccagatccaattaagggtactgagtgtagctttagctgtaatgccggggagtttctcgatatgaaagaccagtcttgcaaaccatgcgccgagggtaggtattctctaggtactggaatccgtttcgacgagtgggatgagttgccgcatggttttgcaagtctgagcgccaacatggaactcgatgactctgcagcagaatctacagggaactgcacctcaagcaagtgggtccctaggggagactacatagcatcaaatacagacgagtgtactgctaccctgatgtacgcagtgaacctaaaacagtcagggactgttaacttcgaatattactacccggactcatctattatttttgagtttttttag

SEQ ID NO: 45142 - DNA, 276 bp, Artificial Sequence
  Description of Artificial Sequence: Synthetic coding sequence
atggccgagcccggccacagccaccacctgagcgcccgggtgcgggggcgtacagaacggaggattcccaggctgtggagactcctgctgtgggcggggactgccttccaggtgacccagggcactggccccgagctgcatgcttgcaaggagtccgaataccactacgaatatacagcctgtgattccactgggtctaggtggagggttgccgtgccacacacaccaggcctgtgcacctctttaccagacccgattaaaggcaccgagtgttag

SEQ ID NO: 45143 - DNA, 459 bp, Artificial Sequence
  Description of Artificial Sequence: Synthetic coding sequence
atggccgagcccggccacagccaccacctgagcgcccgggtgcgggggcggacagagcggcgtattccaaggctgtggcggctgttactatgggctggaaccgcattccaggtgacccaaggtacgggtccagaacttcatgcctgcaaggaatcagagtaccactacgaatacactgcttgcgatagcaccggctctcggtggcgggtggccgttccacacactcccggcctgtgcacatcgctgccagatccaattaagggaaccgagtgctccttcagctgcaatgccggcgagttcctggacatgaaagaccaatcatgcaaaccttgcgccgaaggcaggtacagtctgggaacagggatacggttcgatgaatgggatgaactgcctcatggttttgccagccttagcgccaatatggaactggacgactcagcggccgagtctactggctag

SEQ ID NO: 45144 - DNA, 1923 bp, Artificial Sequence
  Description of Artificial Sequence: Synthetic coding sequence
atggtggtgcccagcaagaccaagatcgtgtgccacttcagcaccctcgtgctgacatgtggccagcctcatactttgcaaatcgtgccaagagacgagtatgacaaccctactaataactcaatgtctctgcgagatgagcacaattatactctgagtatccacgaactgggaccgcaggaagaagagtccaccggagtgagcttcgagaagagcgttaccagcaaccgacagacattccaggttttcctgaggctgactcttcacagccggggttgtttccacgcctgcatttcataccagaaccagcccatcaataatggagaatttgacattatagtgctttccgaggatgagaagaacatagtcgagcgtaacgtgagtacatcgggtgtgtcaatctactttgaggcttacctatataatgcaactaactgctctagcaccccatggcatctcccccctatgcacatgaccagttcccaacgaaggcccagtaccgctgtcgacgaagaggacgaggacagccctagcgagtgccacacccccgaaaaagtgaagaagcccaagaaggtctactgttacgttagtccgaaacaattcagtgtaaaggagttttaccttaagataattccttggcgcctgtacacgtttcgagtctgtccaggaacaaagttctcgtacttgggccctgatcctgtccacaaattgctcaccctggtggtggacgatggaatccaaccacccgtggaactcagctgtaaggaaaggaatattttagccgccacttttatccggtctctgcataagaatattggggggtccgagacctttcaggacaaggttaacttttttcaacgggagcttcgacaagtgcatatgaagcggcctcactctaaggtgactcttaaggtctccaggcacgccctgctggagagctcactgaaagccactaggaatttcagcataagtgactggtcgaaaaactttgaagtcgtgtttcaggatgaagaagcccttgactggggtgggcctcggcgagagtggttcgagttaatctgcaaggcattgttcgacactaccaatcaactgttcacccgatttagtgacaataatcaggcacttgtacacccgaaccccaatcgccccgcccatctgagactcaagatgtatgaattcgccgggcggctggtggggaagtgcctttacgagagctccctgggtggcgcctataaacagttggtgagagcccgattcacacgcagctttctagctcagatcattggcctccggatgcactataaatatttcgaaactgacgatccggaattctacaaatcaaaagtttgtttcattctgaacaacgacatgtcggaaatggaactggtttttgctgaggagaaatataataaatccgggcaactggacaaggtggtggagttaatgactggaggagcccagacccccgtaacaaatgccaataagatcttctatctgaacttgctcgcccagtatagactcgcctcacaggtcaaagaagaggtcgaacactttttgaaaggtcttaatgagctcgtgccggagaacctccttgctatttttgatgaaaatgagctggagctccttatgtgcggtactggggatatttcagtgagcgacttcaaggcccacgcagtcgtcgtgggcggcagctggcacttccgggagaaagttatgcgttggttttggaccgtagtctcttccttgactcaggaggagctggctagactcctgcaatttactacaggtagcagccagttgcctccaggcgggttcgccgctctctgtccaagctttcaaataattgcagcacccacgcattccacactgcctaccgcacacacttgctttaatcaggttaagggacctggttcttgttcttag

SEQ ID NO: 45145 - DNA, 390 bp, Artificial Sequence
  Description of Artificial Sequence: Synthetic coding sequence
atgttctacgtgatcggcggcatcaccgtgagcgtggtggccttcttcttcactatcaagttcctttttgagctagcagcgcgagtcgtctcgtttcttcagaacgaggacagggaacgcaggggcgataggacaatctacgattatgtccgaggaaattatctggacccgcgcagctgtaaggtgtcatgggactggaaagacccttacgaggtgggacactcaatggctttcagagtgcatctcttttataaaaacgggcagccctttcccgcccacaggcccgtcgggctgcgggtccacatctcccacgttgaactcgctgtggagattcctgtcacccaagaggtcctgcaggagcccaactctaatgttgtgaaggtggcctag

SEQ ID NO: 45146 - DNA, 1548 bp, Artificial Sequence
  Description of Artificial Sequence: Synthetic coding sequence
atgtggcggctgcccggcctgctgggccgggccctgccccggaccctgggcccttccctctggagagttacaccaaagagcacctctccagacggtccacaaacgacttcgagcaccctccttgtccccgtgcccaaccttgatcgcagcgggcctcacggccccggaaccagcgggggaccgcgttctcatggttggaaggatgcatttcaatggatgagtagccgggtctcaccaaataccctttgggatgccatcagttgggggaccctggccgttttagctctacagctggcgagacagatccattttcaggcatctttgcctgcgggcccacagcgcgtagagcactgttcatggcatagccccttggatcggttctttagcagtcctctctggcatccttgcagctcccttagacaacacatcctgcccagtcccgacggccctgcgccaaggcacaccggcttaagagaaccaaggctggggcaggaggaagcttctgcccagccacgcaactttagtcacaatagtctgcggggagcccggccccaggaccctagcgaagaagggccaggggactttggtttcctgcacgcctccagcagcattgagagtgaagccaagcccgcgcagccacagcctacgggtgaaaaggagcaggataagtcaaagacgctgtccctggaagaagctgttacctctatacagcaactctttcagctgagtgtgtctatagcgttcaacttccttggtacggagaacatgaagagtggtgatcacactgctgctttctcctattttcagaaggccgccgctcgaggatattccaaagctcaatataatgccggtctgtgccatgaacatggccgcggcaccccccgcgacatatccaaagctgtcttgtattatcagctagccgctagtcagggacatagcttagcacagtacaggtacgcaagatgtctgctccgggaccctgctagttcatggaacccggagagacagcgggctgtgagcctgctgaagcaggccgcagactctggactgcgggaagctcaggcttttctgggcgtgctatttactaaggaaccgtatcttgacgagcagcgcgccgtcaaatatctttggctagctgctaacaatggcgattcacaatcaaggtatcacctgggtatctgttacgagaaaggcctcggagtacaacggaatctgggggaggctcttcgatgttaccagcagtccgccgctctgggcaatgaagccgcccaggagcgacttcgcgccctcttttcaatgggtgccgccgccccaggcccatccgatcttactgtcactggcctcaagagcttttcatcaccctccctttgcagcctgaatactttattagcaggaacatcacgccttcctcatgcttcatctactggcaatctgggcctgctttgcaggagcgggcacctgggggcttcactcgaggcgtcatccagagcgattcctccacacccttaccccttagagaggagcgtggtgagactagggttcggctag

SEQ ID NO: 45147 - DNA, 1548 bp, Artificial Sequence
  Description of Artificial Sequence: Synthetic coding sequence
atgtggcggctgcccggcctgctgggccgggccctgccccggaccttgggccccagcctgtggagagtcacgcctaagagcaccagccctgatgggcctcagaccacgtctagtaccctgctggtccctgtcccaaacctggatcgatcaggccctcatggtccgggtacatcaggtggcccaaggagtcacggctggaaggatgctttccagtggatgagcagccgggtatcacctaatactttgtgggacgccatttcatggggcactctggctgtgctggccttacagttggccagacagattcattttcaggcctccctccccgctggaccccagagggtcgaacattgttcctggcatagccctctcgaccgtttcttctcttccccgctgtggcacccttgctcctctttgcgtcaacacatcctgccgtctccagatggacctgctccacggcacaccggattgagggaaccccgccttgggcaggaagaagctagtgcccagcctcggaattttagtcacaactctcttaggggcgctcgcccacaggatccatcagaagaaggcccaggcgacttcgggttcctgcatgcatcatcttcaatagaatcggaagcaaaacccgcacaaccccagccaaccggcgaaaaggaacaggacaaatctaagacccttagcctggaggaagcggtgacctcaatccagcagctgtttcagctgagtgttagtattgcattcaattttctgggtactgagaacatgaaaagtggtgaccatacagccgcattcagctatttccaaaaggcagctgccaggggttactctaaggcccaatataatgccggactttgccacgagcatggccgcggcacgcctagggacatatctaaagccgtgctctactaccagctcgctgcatcccaggggcacagtctggctcagtatcgctacgcccggtgtctcctgagggatcctgcctcctcgtggaatccagagcggcagcgcgcagtcagcctgcttaaacaggcagcagattctggattgagggaggctcaagccttcctgggtgtcttatttaccaaggaaccatacctggacgagcaacgtgcggttaaatacctgtggctcgcagctaacaatggagactcgcagtctcgataccacctcggtatctgctacgaaaaaggactgggtgttcaacgcaatttgggcgaggcgctgcggtgctaccagcagtcagcggcactggggaacgaagctgctcaagagcgcctccgagctctattttcaatgggagctgcagcacccgggccctcagatctgacggttacaggactcaaatcgttttcatctccttcgttgtgtagcctaaacacgttgctggccggcacttcccgattgcctcatgctagtagcaccggaaacttggggctcttgtgtcgcagtggccacctgggcgcaagcttggaggcaagcagtagggccataccacctcatccatatccccttgagcgctctgtggtacgcctggggttcggttag

SEQ ID NO: 45148 - DNA, 654 bp, Artificial Sequence
  Description of Artificial Sequence: Synthetic coding sequence
tgagccgtgctgtactaccagctggccgccagccagggccacagcctggctcagtaccgctatgccaggtgcctgcttcgggaccctgcttcaagctggaaccctgagagacagcgagccgtatctctgctgaagcaggcagccgacagtggcctacgtgaagcacaagccttccttggcgtcctgttcacaaaggagccttacttggatgaacagcgcgccgttaaatatctgtggcttgcggccaacaatggggatagccaatcgaggtaccaccttggtatctgctatgagaaaggcttgggggtgcagcgcaatcttggcgaggccttgcggtgctaccagcagagcgcagccctcgggaatgaggctgctcaggagcgactgagagccttgttttccatgggcgcagctgccccaggacccagtgacctcacagtgaccggtctgaaaagcttctcttctccttctctctgtagtctcaataccctgttggccgggacctcccgcctgcctcacgctagctccactggaaatctgggactgctttgccgctccggtcatttgggtgccagtctggaagcctcttcccgcgccatccctccccatccatatcctcttgagcgaagcgtcgtgcgactgggattcgggtag

SEQ ID NO: 45149 - DNA, 1560 bp, Artificial Sequence
  Description of Artificial Sequence: Synthetic coding sequence
atggcccgggccggccccgcctggctgctgctggccatctgggtggtgctcccctcttggttaagcagtgcgaaggtgtcgagccttatcgaaaggatcagtgacccgaaggaccttaagaagctgcttagaacacgaaacaacgtgctggtcctgtactccaaatccgaagtggctgcagagaatcacttgcgcctcctctcaaccgtcgcccaggccgtgaaggggcaagggacaatctgctgggtcgactgcggcgatgccgagtcccgcaagttgtgtaagaagatgaaagttgatttatctccgaaagataaaaaggtagagctctttcactaccaggacggagctttccataccgagtacaacagagctgtgacattcaaaagcatagtggcattcttaaaggacccaaaagggccaccactgtgggaagaggatcctggggccaaggatgtggttcacctggacagcgagaaggatttccgacgactgcttaagaaggaggaaaagcccctattaattatgttctacgcaccctggtgttcaatgtgcaaacgtatgatgcctcatttccagaaggcagccacccagctgcgggggcacgccgtgctggccggaatgaatgtgtacagcagcgaattcgaaaacataaaagaagagtattccgtgcgagggtttccgaccatctgttattttgaaaaaggacgatttctttttcagtatgacaattacggctcgacagcggaagacatagtggaatggctgaaaaatccccagccaccccagcctcaggtccctgaaacaccctgggctgatgaggggggcagcgtgtatcacctcaccgatgaggatttcgaccagtttgtgaaggagcacagcagtgtgctggtgatgttccacgccccttggtgcggccattgcaagaagatgaaaccagagttcgagaaagcggctgaggctctgcacggggaagccgattctagtggcgtcctggcagccgtggacgctacggtgaataaagccctggccgagcgatttcacataagcgaattccccacactgaaatattttaagaacggagaaaagtatgcagtgccagtgctgcgaaccaaaaagaaattcttagaatggatgcagaacccagaggcaccccccccacctgaaccaacttgggaggaacagcaaacctcagtgcttcacctggtgggtgacaacttccgcgagaccctgaaaaagaagaagcacactctcgtgatgttttatgcaccctggtgcccccactgtaaaaaagtgattccacacttcacggcaaccgccgatgcgttcaaggacgatcggaaaatcgcctgtgctgcggttgattgtgttaaagataagaatcaggatttgtgccagcaggaggccgtcaaggggtatcccacgttccattattaccactacgggaaattcgctgaaaaatacgattcggacagaacagagctcggcttcacgaactacatcagagctctgcgagaaggtgatcatgagaggttggggaaaaaaaaggaggagctttag

SEQ ID NO: 45150 - DNA, 1755 bp, Artificial Sequence
  Description of Artificial Sequence: Synthetic coding sequence
atggacctgctgtggatgcccctgctgctggtggccgcctgcgtgtcagccgtgcacagctcacctgaggtcaacgctggcgtttcctctattcacatcaccaagcctgtccatattctagaagaaagaagtctgttagtgctgacccctgcaggcctgacgcagatgctgaatcagactcgctttttgatggtcttgtttcacaacccttcctcaaagcagagcagaaacctagctgaggaactaggcaaggctgtagagatcatgggcaagggtaagaatggcatcggattcggcaaggtcgacattactattgagaaagagttgcagcaagagttcggaattactaaggctccagaattgaagttgttttttgaaggaaacagatccgagcccatctcgtgtaagggagtggtagaaagtgccgctctggtggtgtggctgcgtcggcagatttctcagaaggcgttcctgttcaattcatctgaacaggtcgcggagttcgtaatatctcgcccattggtgatagtcggcttcttccaggatctggaggaagaggtagctgaacttttttatgatgtgatcaaggactttccggaactaaccttcggggtcattaccatcggcaatgtgataggccggttccacgtaactctcgactcggtgcttgtgtttaaaaagggaaagattgttaatcggcagaagctgatcaacgattccactaataagcaggaactgaatagagtcatcaaacaacacttgacagacttcgttatcgagtataacaccgaaaacaaagacctgatcagcgaattgcacatcatgtcacacatgctgctatttgtcagcaaatccagcgaaagctatggaattattattcagcactataagttggcctcaaaggaattccagaacaagattttgtttatccttgtcgacgccgatgagccaaggaacggtagagtattcaagtacttcagggtgactgaggtggatattccgagcgtgcagatcctgaatttgagctcagatgctagatacaagatgccatctgacgatatcacatacgaaagccttaagaaatttggcagatctttcctaagtaaaaatgccacgaaacaccagagtagcgaagagatccccaagtattgggatcagggtttagttaaacagctggtgggaaaaaattttaacgttgtagtttttgataaggagaaggacgtgtttgtcatgttctacgcgccttggagcaagaagtgtaagatgctgttccccttgcttgaggaactcgggcggaaatatcagaaccactccactatcattatagcaaaaattgacgtgacagcaaacgacattcagctgatgtatctggatcgctaccccttttttcgactgttccccagtggaagtcagcaggccgtgttatacaagggagagcacaccctgaagggattcagtgacttcctggaaagtcatattaagaccaagattgaggatgaagatgagctgctcagcgttgagcaaaatgaggtgattgaggaagaggtgctcgccgaagaaaaggaggtgcccatgatgcggaagggcctgccagaacaacaaagccccgagctggaaaatatgaccaagtacgtgagcaagttagaagaacctgcaggaaaaaaaaagacttctgaagaggtggtggttgtggtggcaaagcccaaaggccctccagtacagaaaaaaaaaccaaaagtaaaggaggagttatag

SEQ ID NO: 45151 - DNA, 819 bp, Artificial Sequence
  Description of Artificial Sequence: Synthetic coding sequence
atgggcaacaccaccagcgaccgggtgagcggcgagcggcacggcgccaaagctgctagatccgagggcgccggcggacacgcccctggcaaagagcataaaatcatggtgggctctaccgatgacccttccgtcttcagccttcccgattctaaactgccaggggataaagaatttgtgagttggcagcaggatctggaggacagcgttaaacctacccagcaggctcggccgaccgtgatcaggtggagcgaggggggcaaggaggtgtttatttctgggagttttaataactggtcaactaaaatccctctgattaaaagccacaatgatttcgtggctattctggacctacccgagggcgaacatcaatacaagttcttcgtcgatgggcagtgggtccacgacccttcagaacctgtggtgacctcgcaactaggaacgatcaacaacctgatacacgttaagaagtcagactttgaggtcttcgatgcactcaaactcgacagcatggagtccagcgagacctcatgccgagatctctcgagcagtcctccgggaccctatggccaagaaatgtacgccttccgctccgaggaacggtttaagtccccccccatcctacccccccatcttttacaggttatcctaaataaggatacaaacatcagttgcgaccctgctttgctgcctgagccaaatcacgttatgctgaaccacctgtatgccttgtcgattaaagattcagtcatggtgctgagcgccacccaccgttataaaaaaaagtacgtaaccaccctgctgtataagccaatctag

SEQ ID NO: 45152 - DNA, 573 bp, Artificial Sequence
  Description of Artificial Sequence: Synthetic coding sequence
atgccccggggccggagcacccggagctggtggggcgtgcggaccactcctgcttgtagtgccagcttaaccccatcccataacgatttcgtcgccatccttgacctgcctgaaggcgagcaccaatacaaattctttgtggacgggcagtgggtccacgacccatccgaaccagtcgtcacaagccagctcggcacgattaacaacttaatccatgtcaagaagagtgacttcgaggtgttcgacgctctcaaactagatagtatggagagctccgagacaagctgtcgcgatctgtcctctagtccaccggggccttatgggcaggaaatgtacgcattcagaagcgaagaacgctttaaatcccctccaattcttccaccacacctgctgcaagtcatcctaaataaggacaccaacatctcatgtgatccagcgctccttcccgagccaaatcatgtcatgcttaaccatttgtatgctctatcaatcaaggactcggtcatggtgctgtccgctacccatcggtataaaaagaaatatgttaccactctgctgtataagcccatctag

SEQ ID NO: 45153 - DNA, 1053 bp, Artificial Sequence
  Description of Artificial Sequence: Synthetic coding sequence
atggagaagcagccccagaacagccggcggggcctggccccccgggaagtccctccagccgtcgggctgctactgattatggcccttatgaatacactgctatatttgtgtctggaccatttcttcatcgccccccgccaatccacagtggaccccacacactgtccctacggccactttcgcataggccaaatgaaaaattgtagcccatggttgagttgtgaggaacttcgcaccgaggtcagacaactcaaaagagtaggcgaaggagccgttaagcgcgttttcctctccgagtggaaggagcacaaggtggcgttaagccagctaacttctctcgagatgaaagatgattttctacacggtttacagatgttgaaatcattgcagggtacgcatgtggtgactcttctaggatactgtgaagacgataataccatgttaacagaataccacccacttggcagcttgagtaacctggaggaaacactcaacttaagcaaatatcaaaacgtcaacacttggcaacacaggttggagctggctatggactacgtctccatcatcaattatctccaccattcccccgtaggcaccagagttatgtgcgatagtaacgacctcccgaagaccctgtctcagtacctgctgacgtccaatttcagcatccttgctaacgatctggacgctctccctctggtcaatcatagttctgggatgttggtgaaatgcggccaccgcgaactgcacggtgatttcgtggcccccgaacagctgtggccttacggagaggacgtgccattccacgacgatctaatgcccagctacgacgagaagattgacatctggaaaatcccagatattagctcattcctgcttggccatatagagggctcagacatggtccgattccatctcttcgatattcataaggcgtgtaagagccaaacaccatccgagcggcctactgcccaggatgttctggaaacgtatcaaaaggtcctggataccctgcgggacgctatgatgagccaagctcgcgagatgttatag

SEQ ID NO: 45154 - DNA, 585 bp, Artificial Sequence
  Description of Artificial Sequence: Synthetic coding sequence
atgggcgccgccgcctgggcccggcccctgagcgtgagcttcctgctgttgctgctgcctttgcctggtatgcctgccgggagctgggacccagccggctacctgctgtactgtccctgcatggggagattcggaaatcaggctgatcactttttgggttcactggcatttgccaagctgctcaacaggaccctggcggtcccaccctggatagaataccagcaccataagccacccttcactaacctccacgtttcctaccagaagtactttaagttggaacctctgcaggcctatcaccgtgtcatcagtttagaagactttatggagaagctggccccgacgcactggccacctgaaaagagagtggcctattgcttcgaagttgccgcacaacgttctccggacaaaaaaacttgtcctatgaaagagggaaatccattcggtcctttttgggaccagtttcatgttagctttaacaagagtgagctgttcacaggcatctctttctctgcgtcctatcgcgaacaatggagccagaggcgcgagaaccactcttgtgtcaccctcttatttccccggtag

SEQ ID NO: 45155 - DNA, 1167 bp, Artificial Sequence
  Description of Artificial Sequence: Synthetic coding sequence
atgggcgccgccgcctgggcccggcccctgagcgtgagcttcctgctgctgctccttcccctccctggcatgcctgctgggagctgggaccctgccggttatctgctgtactgcccttgcatgggtagatttggaaatcaggccgatcattttctggggtctcttgcattcgccaaactgctgaatcggaccttggccgtgccaccgtggatagaatatcagcaccacaagcccccgtttaccaatctccatgttagctaccagaagtatttcaagctggaaccattacaggcataccatcgcgtgatcagtcttgaggattttatggaaaagctcgcaccgacacattggccccctgaaaaaagggtggcctattgcttcgaagtggcagcgcagagatccccggacaagaaaacatgcccaatgaaggagggtaacccttttgggcccttctgggatcagtttcacgtatcctttaacaagagcgaactgtttactggtattagctttagcgcttcctatagggagcagtggtcccagaggttctcccctaaagaacaccctgtcctcgcattgccaggcgcccccgcacagtttcccgtcctggaagaacatagacccctgcagaagtatatggtgtggagcgacgagatggtcaaaacaggtgaagcacagatccacgcccacctggttcgcccctatgttggaatccatctgcgaataggctctgattggaaaaatgcgtgcgcgatgctcaaggacggtacagctggttcacattttatggctagccctcagtgcgttggttatagcagaagcactgctgcacccttgaccatgaccatgtgtctccccgatctgaaagaaatacaacgggcagtgaagttatgggtacgcagtctggacgcgcagagcgtgtatgtggcaactgactcagagagttacgtgcccgaactccagcaactatttaagggaaaggtgaaggtggtgtcccttaagccagaggtggcccaggtggacctttacatattgggccaggctgaccactttatcggcaattgtgtgtcttcctttaccgctttcgttaagagagaaagagacctgcaagggcgcccttcctctttcttcggaatggacagacctcccaagctgcgcgacgaattctag

SEQ ID NO: 45156 - DNA, 534 bp, Artificial Sequence
  Description of Artificial Sequence: Synthetic coding sequence
atggtgtggagcgacgagatggtgaagaccggcgaggcccagatccatgctcacctcgtgaggccatatgtgggcatccacctgaggatcggctccgattggaagaatgcctgcgccatgctcaaagacggcactgccggaagccactttatggcctccccacagtgcgtgggatattctcgatccaccgcagcacccttaaccatgactatgtgcctaccggacctgaaggaaatacaaagggccgtgaagctatgggtgcggagtctggacgctcaaagcgtctatgtggctaccgacagcgagtcctatgtacctgagctgcagcagctcttcaaaggtaaagtgaaagttgttagcctgaagccagaggtggcccaggtggacctgtacatacttgggcaagccgaccattttatcgggaattgcgtttcaagctttactgcctttgtgaagcgcgagagggacctacaggggcgaccgtcttcctttttcggtatggaccgcccaccaaaactcagggacgagttctag

SEQ ID NO: 45157 - DNA, 1275 bp, Artificial Sequence
  Description of Artificial Sequence: Synthetic coding sequence
atggccaccctgagcttcgtgttcctgctgctgggcgccgtgagctggccccccgccagtgcctccggccaggagttttggccaggccagtctgccgcagacatcctgtcaggcgctgcaagccgccggcgctatctcctttacgatgtgaatccacctgaaggtttcaatctgaggcgcgatgtgtacatcagaattgccagcctactaaaaacactgttaaaaactgaagagtgggtattggtgttgccaccatggggccgcctctaccactggcagagtcccgacatacaccaagtgcgaataccctggtccgagtttttcgacctgccttccctaaacaagaatatccctgttattgaatatgaacagtttatcgccgagagcggcggcccttttattgaccaggtatacgtcctgcagagttacgcagaaggctggaaggagggaacctgggaggaaaaggtcgatgaaaggccttgcatcgatcagctcttgtattcacaggacaaacacgagtactatcgaggctggttttggggctacgaagagactaggggtcttaacgtgagctgtctttccgtgcaggggtctgcttcaattgtagccccgctcttgcttcggaatactagcgccaggagtgtgatgcttgatcgcgccgaaaaccttctccatgatcactatggggggaaggagtactgggacacacggaggtcaatggttttcgcccggcatctcagggaagttggtgacgaattccgttcccgccacctgaattctacagacgacgctgataggattccatttcaggaagactggatgaaaatgaaggtcaagctcggctctgcccttggcggcccatacttaggggttcatctgagacgaaaggattttatttggggtcacagacaggatgtgccatcattagaaggcgcggtacgcaaaatcagaagcctcatgaagacccacaggcttgataaggtatttgtggcaaccgacgccgtgcggaaagaatacgaggaattaaagaaactgctgcccgaaatggtgagatttgagcccacctgggaggagctagaactttataaggacgggggcgtcgcgatcattgatcagtggatctgtgctcatgctcgctgtctgccgacttcccttagcgctgaatcaggatccggaggcttccagaggttcttctgtccaaaatattcagtgtcggagcagatggtggcatgtgtgcactccgggcacttccacaccgtatgcctgctcgtgtag

SEQ ID NO: 45158 - DNA, 1290 bp, Artificial Sequence
  Description of Artificial Sequence: Synthetic coding sequence
atggccaccctgagcttcgtgttcctgctgctgggcgccgtgagctggccccctgcctctgcctctggtcaggagttctggcccggacagagcgcagccgatatcctttcgggcgccgctagcaggcgcagatatttattatacgatgtgaacccaccggagggctttaacttgcggcgggatgtgtacatccgcattgcaagcctactgaaaacgctgctaaagacggaggaatgggtgctggtgctacccccgtggggccggctgtaccactggcagtcaccagatattcatcaggtgaggattccctggtcggagttctttgacctgccaagtctaaacaagaatatcccggtgatagaatatgaacagttcattgctgagtccggaggccctttcatcgaccaggtctacgtgttgcagagctatgccgaagggtggaaggaaggaacttgggaggagaaggttgacgagcggccctgcatcgaccagctcttgtactcgcaagataaacacgaatattataggggctggttctgggggtatgaggagacaagaggtctgaacgtgagctgcttgagcgttcaaggctctgcctccattgtggcgccactcctgctgaggaatacttctgcccgctccgtgatgcttgatcgcgccgagaacctcctccatgaccactacggcggaaaggaatactgggacacccgccgctccatggttttcgccaggcatctgcgcgaagtgggcgatgagttccgaagcagacacctgaattccacagacgatgccgaccgaatacccttccaagaagactggatgaagatgaaggtcaaattaggctcagccttgggcggcccttatttaggcgtccatctgagacgtaaagattttatttggggccacaggcaagacgtgcccagccttgagggcgctgtacgaaagatacgaagtctcatgaagacacaccgattggataaggtgtttgtcgctaccgacgccgtgcggaaagagtatgaggagctgaagaaactgctccccgaaatggtgcgattcgagcccacctgggaagagttggagctttataaggacggcggtgtggccattatcgaccagtggatctgcgcccatgcaaggttttttatcggcacaagcgttagcacatttagcttcaggatccacgaggagagggagatcttgggcttggatccaaaaacaacctataatcgattttgtggggaccaggagaaagcatgcgagcagcccactcattggaaaatcacatattag

SEQ ID NO: 45159 - DNA, 1179 bp, Artificial Sequence
  Description of Artificial Sequence: Synthetic coding sequence
atggagtggtgggccagcagccccctgcggctgtggctgctgctgtttctcctgccaagtgcccaaggtaggcagaaagagagcggctcaaagtggaaggtgttcatcgatcagatcaacagaagcctggagaattatgagccatgtagctctcagaactgctcatgctaccatggggtcattgaggaagatctaaccccttttcgcggcggcatttctcgtaaaatgatggccgaagtggttagacggaagcttggaacacattaccaaatcactaagaacagactctacagagagaacgattgcatgtttccttccaggtgctcaggcgtagagcatttcattctggaggttatcggaagactgcccgatatggagatggtgatcaacgtccgcgactacccacaggttccgaaatggatggagccagcgatcccagtgttcagcttcagtaagacttcagagtaccatgacataatgtaccctgcctggactttttgggagggaggccctgccgtgtggcccatttacccgactggcttgggccgatgggacctcttccgcgaggatctagtgcgttccgcagctcagtggccatggaagaaaaagaactcaacagcatactttagggggtctaggacctcaccggagcgtgatccattgattctgctctcccgcaagaaccccaaactcgtggacgccgagtacacaaaaaaccaggcctggaagagcatgaaggataccctgggaaagccggccgctaaggatgttcacctggttgaccattgcaagtataaatatctgttcaactttcgaggcgtagccgccagcttcagattcaaacatctattcctttgtggcagtttggtgttccatgtgggcgatgagtggcttgaattcttttacccacagttgaaaccatgggtgcattacatccctgtgaaaaccgatttgagcaatgttcaagaactgctgcagtttgtcaaagctaacgatgacgtggcccaggaaattgccgagcggggctcccaatttatccgaaatcatctgcagatggacgacattacctgctactgggagaacttgctgtctgagtactctaaattcctgtcctacaatgtgacaagaagaaaggggtacgatcaaatcatccctaaaatgctaaaaactgagctgtag

SEQ ID NO: 45160 - DNA, 3273 bp, Artificial Sequence
  Description of Artificial Sequence: Synthetic coding sequence
atgatgcccatgatcctgaccgtgttcctgagcaacaacgagcagatcctcacagaggtgcccataacacccgaaactacatgtcgtgacgttgtagagttctgtaaggaacccggcgaggggtcatgtcatctggccgaggtgtggagggggaatgagcgccccatcccttttgaccacatgatgtatgagcacctccagaagtggggcccccgcagggaagaagttaagttcttccttagacatgaggattcgcccactgagaactccgaacaaggaggacgccagactcaggaacaacgaacccaaagaaacgtcataaatgtgccaggtgaaaagcgtactgaaaacggagtaggcaatccgcgcgtggagctaactttgtctgaattacaggacatggctgcacggcaacagcagcaaatcgagaaccagcaacagatgctggttgctaaagaacaaaggttacacttcctcaaacagcaagagagacgccagcagcagtcaatatcggaaaatgaaaagttacagaagctgaaggaaagggtggaagcacaggagaataagttaaaaaagataagggccatgcggggccaggtggattattccaaaattatgaatgggaaccttagtgcagagattgagagattttcagctatgttccaggagaaaaagcaggaagtccaaacagccatcctccgcgtcgaccagttgtctcagcagcttgaagatttaaaaaagggaaaactgaatggatttcagtcttacaatggaaaattgacgggtcccgccgcagtggagctgaagaggttataccaggaactgcaaatcaggaaccagctcaaccaggaacagaatagtaagttgcagcagcagaaagaactgctgaacaaacggaatatggaggtcgccatgatggataagcgaatttcagagctgcgggaacggctgtacggcaagaagatacaactcaaccgcgtgaacgggacctcatcaccacaatcacccttaagcacttctggtagagttgccgctgttggcccatatatccaggtgccctcagctgggtctttcccggtgctgggagacccgatcaagccacaatccctgtctatagcttcaaatgccgcccatgggaggtccaagtcggcaaatgacgggaactggcccactttaaaacagaacagcagctcttctgtgaagccagtgcaagtggctggagcggactggaaggatccctccgtagaaggctctgtgaaacaggggaccgtctcctcccagcccgtgccgtttagcgccctgggtccaacggagaaaccaggtattgaaatcggtaaggtgccaccaccgattcctggcgttggcaagcaattgccgccgagctacggcacttatccctctcctacaccccttggcccgggctccactagcagccttgaacggcgcaaagaaggttctctgcctaggccttcagcgggcctgccaagccgccagcggcccactctcctgcccgcgactggatcaacccctcaaccggggtcaagtcagcagatacagcagcggatttccgtgccacccagtccaacctacccacccgcaggccctccggctttccccgcaggggactccaaacccgaattgccactcaccgttgcaattcggccatttttggctgataagggatctcgcccacagtcacctcggaaggggcctcaaactgtcaactcgagcagtatctactctatgtacctccagcaggctaccccccctaaaaattaccaacctgctgctcattcagctctgaacaaatccgttaaagccgtctacggcaaacctgtcctgccgagtggatcaacctccccaagtccactacccttcctacatggatcactctccacagggacgccgcaaccccaacctccgtctgagtctacagagaaggagcccgagcaggacggtcccgcggctcccgccgacggatccacagtggaatcacttccgcgccccttgagccctactaaattaaccccgatagtccacagtcccctacgctatcagtccgatgcggatctggaggccctcagaagaaagctggcgaatgctccccggccccttaaaaaacgaagcagtatcaccgagccggaaggaccaggcgggcccaatatacagaagctcctgtatcaacgatttaacacgttagctgggggcatggagggaaccccgttttatcagccctcaccgagtcaggatttcatggggaccttggcagatgttgacaacggaaacactaatgctaacgggaacttagaagagttgcctccagctcagccgacagccccccttcccgcagagcccgccccgagcagcgacgctaatgataatgagttaccctccccagagccagaagaactaatttgccctcagacaacccaccagaccgccgagcccgccgaggacaacaacaacaatgtcgctacggtgccaaccacagagcaaattccctcgccagttgctgaggctccttctcctggcgaggaacaggtaccccccgccccacttccgccagcatcacacccacctgcaacctctaccaataagcgaactaacttaaagaagcccaactctgagcggaccggtcacggactgcgggttagattcaacccgctcgcccttcttctcgatgccagcctggagggggaattcgacctggttcaacgaataatttacgaagtcgaagacccctcaaagccaaatgacgagggcattacgcccctacacaacgccgtctgcgctggacaccatcacatcgttaaattcctgcttgattttggcgttaatgtgaacgcggccgactccgacggctggacgccgttacactgcgcggcgagctgtaattcagtgcacctttgcaagcagcttgtggaatcaggcgcggccatattcgcttcaaccatttccgatatcgaaacagcagccgataaatgtgaggaaatggaggaaggatacattcaatgctctcagttcctgtacggtgttcaggagaaactgggggtaatgaacaagggggtagcatacgccctgtgggattacgaggctcagaactcagacgaactctcctttcacgagggggacgctttaaccattttgagaaggaaagatgagagtgaaaccgagtggtggtgggcgcggttaggtgacagggaggggtacgtaccaaagaatctgcttggcctgtacccgagaattaaacccaggcagaggacacttgcatag

SEQ ID NO: 45161 - DNA, 1884 bp, Artificial Sequence
  Description of Artificial Sequence: Synthetic coding sequence
atggccgcccggcagcagcagcagatcgagaaccagcagcagatgctggtagccaaggagcagcgacttcactttttaaaacaacaggaaagacgtcaacagcaatcaatttcagagaacgaaaaattacagaaactcaaagaacgggttgaggctcaagaaaacaaacttaagaaaattcgtgcgatgcggggacaagttgattatagcaagattatgaatggcaatttgtcggcagagatagagaggttctcagcaatgttccaggagaagaagcaagaagtacagaccgcaatcctcagagtcgaccagctttctcagcagctggaggacctgaaaaagggtaaactcaacggattccaatcatacaatggtaagttaaccggacctgccgcagtcgagttgaagcgtctgtaccaggaattgcagatccgcaaccaattgaaccaggagcagaactcgaaactccagcagcagaaggagctgcttaataagagaaatatggaggtggcgatgatggataaaagaatttcagaattacgggaacggctatacggaaaaaagatccaactgaacagggtgaacggcacctcgagccctcaatcaccattaagcacctccggacgggttgccgcagtcggaccatacatacaggtcccttcagccggctcctttcctgtattgggggaccctatcaagcctcagtccctatctatagccagcaacgcagcccacgggagatctaagagcgctaacgacgggaattggccaacccttaagcagaattcaagttcatctgtaaaacccgtccaggttgccggtgctgattggaaggatcccagcgtagaggggtctgttaaacaaggcactgtgagcagccagcccgttccgtttagtgccctcggtccaaccgaaaagccaggaattgagatcgggaaggtgcctcctcccatccctggtgtgggaaaacagctccctccatcttacggaacatatccatccccgaccccgttgggccccgggagcacatcttccctcgagcggaggaaggagggaagcctgccccgtccgagcgccggactgccaagtagacaaaggcccaccctacttcctgccaccggcagtactcctcaacctggctcctcccagcagattcagcagcgaatttccgtgcccccatctccaacgtatcccccagctgggccacctgctttccctgctggggattctaagcccgagctgcccctgacagtggctatccgtccattccttgccgacaaggggtcacggccccagtcgccacgaaaaggaccccagactgtgaacagcagtagtatttatagcatgtacttgcaacaggcaacgccccctaaaaactatcagcccgcggcacactctgccttgaataagagtgtaaaggcggtctatggaaaacctgtgctgccctccggatctactagcccatcccctctgccctttctccacgggtcattgtccacagggactccgcaacctcagccgccctctgagagcactgagaaggagccagagcaggacggacccgcagcccccgcagatggctccacagtcgagagtttacctaggcctctgtcaccaacgaaattgacaccaatagttcacagccctctcagataccaatccgacgccgaccttgaggccctgcgtcggaagctggctaacgccccaaggccccttaagaagaggtcaagcataaccgaacctgagggccctccctttctcccagcacagcctctacccgggcttcatggacacctcgggcgatgtgggcagtggaagcatcagtgccaatggaagcctggccgcgctcccccttgtcccgcccacagtcccacccctcgatag

SEQ ID NO: 45162 - DNA, 1197 bp, Artificial Sequence
  Description of Artificial Sequence: Synthetic coding sequence
atgtacctgcagcaggccaccccccccaagaactaccagcccgccgcccatagcgccctgaataagtccgtcaaggcagtgtatggcaaacccgtgctgccctccggaagtacttcccccagtccactgcccttcctacacggctcactgagcaccggtaccccacaaccccagcctccttccgagtcaactgaaaaagaacccgaacaggatggccccgcggcacccgccgacggatctaccgtggaaagcctgcctaggccgctctcacctacgaagttgacgcctatcgtgcacagtcccttaagataccagagtgatgctgacctggaagccttgcggaggaagctggcaaatgccccccgacctcttaagaaacgatcttcaataacagaaccagaaggcccaggagggcctaatattcagaaactgctgtaccagcggtttaatactctcgccgggggaatggagggcacgccgttctaccagccaagtccatctcaggactttatggggacgctcgccgatgtcgataacggcaatactaacgctaacgggaatttggaggagcttccccctgctcagcctacggcccctctaccagccgagcccgccccatcctccgatgcaaatgacaatgagctgccgtcccctgagccagaggagctgatttgcccgcagacaacacaccaaacagccgagcccgctgaagataacaacaacaatgtggccaccgtgcccacaactgagcagatccctagccccgttgccgaggccccatcccctggggaggagcaagtccctccagcccccttgcccccggcatcccacccccccgcaactagcaccaacaaacgtaccaacttaaagaaacctaactccgagcggaccggccacggactccgcgtgcgctttaaccctctggccctgttgctagacgcttctctcgagggagagttcgatctggtacagcggatcatctacgaggtcgaggatcccagcaagccaaatgacgagggaatcacccctctacacaatgctgtctgcgcaggtcaccaccacattgtcaaatttctcctcgatttcggagtgaatgtcaatgctgccgactccgacggctggggggcagggaaggctggatgtgatgaacaacggtgtggggtttgctccgtaggactccgcggacccgagcagtag

SEQ ID NO: 45163 - DNA, 1908 bp, Artificial Sequence
  Description of Artificial Sequence: Synthetic coding sequence
tgagtgggcccctacatccaggtgcccagcgccggcagcttccccgttctcggggaccctattaaaccccagtcgttatccatcgctagcaatgcagcccacggtcggagtaaaagcgccaatgacggaaactggccaactctaaaacaaaacagttcttctagtgttaaacccgtccaggtggcaggcgcagactggaaggatccctcagtggaaggttcagttaagcaaggcacagtgagctcccagccagtgcctttcagtgccctggggcccactgaaaagccagggattgaaatcggcaaggtgccaccacctatccctggcgtaggcaagcagctaccaccctcctacgggacctatccaagtccaactcccttgggtcccggtagcacgagttccttggagagacggaaggaaggatcccttccacgtccatcggctggccttccaagccggcagcggccaacactgttacctgctaccggcagcacccctcaaccaggaagttcccagcagatccagcagcgaatctcggtgcctcccagcccaacgtacccaccggcgggaccaccagcatttcccgcaggagacagcaagccagagttgccactgactgttgctatcagaccattccttgctgacaagggttctcgcccacagagtcccaggaagggaccgcaaacagtgaattcctcaagtatctacagcatgtacttgcaacaggccactccacccaaaaactatcagcccgccgcccactcagctctgaacaaatcagtgaaggcggtttatggtaaaccagtcctgcctagtggcagtacctcgccttctcctctgccgttcctgcatgggtctctctcaaccggcacaccccagccgcagccaccaagtgagtccacagagaaggagcctgagcaggacggccctgcggcccccgcagacggaagtactgtagaaagtctcccccgcccactgtccccaactaagctgacacccatagtccatagccctctacgataccagtccgatgccgatcttgaagcgctccggcgaaagctggcaaatgctcctagacccctgaaaaagcgttcctcaatcaccgaaccagaggggccaggcgggccaaatatccagaagttgctgtaccagagattcaatacactcgcggggggtatggagggaacccctttttaccaaccatccccatcccaggactttatgggaactcttgcagatgtggacaacggaaataccaacgcgaacggaaaccttgaagaactgccccctgctcagcctacggccccgctccctgccgagcctgctccatcttccgacgccaatgataacgagttaccctcccctgagccagaggaactgatttgtccccagaccacacaccaaacggccgaaccagctgaagataataacaataacgtggcaactgtgccaacaactgaacaaatccctagccccgtggctgaggccccaagcccaggagaagagcaggttccgcccgcacccctcccacctgcaagccatccgcccgctaccagtacaaataagaggacaaatctcaagaaacccaattctgaacggacaggccacggattgcgcgtccgcttcaaccctcttgcgctgctgttggatgcctccctggagggcgagtttgacctggtgcagagaatcatctatgaagtcgaggatccctcaaagccaaacgacgaaggcataaccccattgcacaacgcagtgtgtgcagggcaccaccacattgtgaagttcctcctggacttcggggtgaacgtaaacgcagcagattcggacggttggggggctggcaaggctggttgtgacgagcaacgctgcggagtgtgttcagtgggactaaggggaccagagcaatag

SEQ ID NO: 45164 - DNA, 1587 bp, Artificial Sequence
  Description of Artificial Sequence: Synthetic coding sequence
atggccgagcacctggagctgctggccgagatgcccatggtgggccgaatgtccacacaggagcggctgaagcatgcccagaagcgccgagcgcagcaggtaaaaatgtgggcacaagctgaaaaagaggctcaagggaaaaaagggccaggggagcgcccacggaaggaagccgcttctcagggtctgcttaaacaggtgttatttcctccctccgtagtgctgctggaggccgcagcacgaaatgacttggaggaggtacgacagtttttaggctccggggtttcaccagacctggcgaacgaagatggtttaaccgcgttgcaccagtgttgcatagatgatttcagagaaatggtgcagcagctgctggaggccggcgctaatattaatgcatgtgatagcgaatgttggactcctctacacgcggctgcaacgtgtgggcacttgcacctggtggagctcctgattgccagcggagcaaacctcctggccgtgaacacagatgggaacatgccatacgacttgtgcgacgacgagcagacactggattgcttggaaactgccatggccgaccgggggattacgcaggattcaattgaggcagccagggccgtcccagagctgcgcatgctggacgatattcggagcaggctgcaggccggcgccgacctccacgctcctcttgatcacggagcgacactactccacgttgcagccgcaaacggatttagtgaggccgctgccctgctactggaacaccgcgcgtcactgtcagcgaaggaccaggatggatgggagcccctccacgctgctgcttactgggggcaagtgccccttgttgagctcttggttgcccatggggcagacctgaacgctaagtcactgatggacgagactccactggacgtgtgtggagacgaggaggttcgtgctaagctgcttgagcttaagcataaacatgatgccttgctacgagcccagagccgtcagcgttccctgctccgccgaaggacctccagcgccggttcccgaggcaaagtggttcgaagggtctctctgactcaaaggactgacctataccgcaaacagcatgctcaggaggcaatagtatggcagcaacctccccccactagtcccgaaccgccagaagataatgacgaccgccagaccggcgccgaacttcggcctccccctcctgaggaagacaaccccgaagtcgtcaggccccataatgggcgcgtgggagggagccccgtgcgccacttgtacagtaagcgcctggaccggtctgtgagctaccaactctccccactggacagtacaaccccacacacactcgtgcacgacaaagcacaccacactcttgctgacctgaagaggcagcgcgctgcagcaaagttgcagcggcctccacccgaggggcccgagtcacctgagactgctgagcccggccttccaggcgacacagtgactcctcagccagactgtggttttcgggcaggcggtgatccccctctcctgaagctgaccgcccctgcagttgaggccccggtggaaagacgcccctgctgtttgctgatgtag

SEQ ID NO: 45165 - DNA, 1587 bp, Artificial Sequence
  Description of Artificial Sequence: Synthetic coding sequence
atggccgagcacctggagctgctggccgagatgcccatggtgggcaggatgtcaactcaagagagactgaaacacgcccaaaagcggcgcgcacaacaggtgaagatgtgggcccaggccgagaaggaagcccaagggaaaaagggccccggggagcgacccagaaaggaggccgcaagtcagggtctgttgaagcaagtcttgttccctccctcagtagtactcctcgaagccgccgcgcgaaacgatctggaggaagttaggcaattccttgggtcgggggtctctcccgatctagcaaatgaggacgggctcactgctttgcaccagtgctgtatcgacgactttagggaaatggtgcagcagctgctggaggctggcgcaaatattaatgcctgcgattcagaatgttggacgccattgcacgctgccgctacctgcggccatctgcatctggttgagctgttaattgccagcggcgccaatctgctggccgtgaataccgatggcaatatgccttatgacctgtgcgatgacgaacagaccctggactgcctggaaactgccatggccgatagaggcatcacccaggattctatagaggcggcaagggcagtgcctgaactgcgaatgctagatgatatacggtcccggctgcaggctggtgcggacctgcacgccccattagatcacggagcaaccctgctccacgtggccgctgcgaacgggttctccgaggccgcagcactgttactcgagcaccgcgcaagtctttcagcaaaggatcaagacggatgggagcccttgcatgccgccgcgtactggggccaggtgccacttgtggaactgctggtggcccacggagctgatctgaacgcaaagtctcttatggatgagacacctctagacgtgtgtggggacgaagaagtgcgggccaaactgctggagctaaagcacaagcacgacgcattgttgcgagcccagagtaggcagcggtcactgctgaggcggcgtacctccagcgcaggtagccggggcaaggtcgttcgcagagtgtcattgacgcaacggaccgatctgtatagaaagcagcacgcacaggaggctatcgtatggcagcagcccccacccacaagccctgagcctccagaagataacgacgatcggcagactggtgctgagctgaggcctcctccgcctgaggaagacaatcctgaagtcgtgagacctcataacggcagggttggtggctctcccgttcgccacttgtattcgaaacgactggacagatcagtgtcttaccagctcagtccacttgattccacgaccccccacacgctggtacacgataaggcacatcacactctcgctgatttgaagcgacaacgggccgctgcgaaactacagcggccccctcccgagggacctgagagcccagagaccgccgaaccaggcctgcctggcgacactgttaccccacagcctgattgcgggttcagggctgggggggatccgcctctgctcaaactgaccgcacctgcggtggaggcaccagtggagagaaggccttgctgcctcttgatgtag

SEQ ID NO: 45166 - DNA, 840 bp, Artificial Sequence
  Description of Artificial Sequence: Synthetic coding sequence
atgagccgggagcggccccccggcaccgacatcccccggaacctgagttttatcgcagctctcaccgaaagagcctactacagatctcagaggccgtctctggaggaagagcccgaagaagagccaggagaggggggaactcgtttcggagcacggagtcgggcgcacgcccctagccgcggaagaagggcgcggagtgcacccgcggggggaggcggagctcgtgcgccacggagcaggagtcccgacacccggaagcgggtgcggtttgcagacgcccttggcctcgagctcgccgtggtccgtcgtttccgcccaggcgagttacctcgagtgcctcgacatgttcagatacagctacaaagggatgccctgaggcatttcgcaccgtgtcagccacgcgcccgggggctgcaggaggcaagggcagctctcgagcccgcctcagaacccgggttcgcagcccgtttgttgacccagcgcatatgtctggaacgagctgaggccggacctctcggcgtggcaggaagtgcccgcgtggtggaccttgcatacgagaaacgagtgagtgtgcggtggagtgctgatgggtggcggtctcaacgtgaagccccagccgcatatgcaggcccagcccctcctccccccagggccgacagatttgccttcagactgcccgccccccctatcggaggcgctctgttattcgctctccgctacagggtgaccggccacgagttctgggataacaatgggggacgggactatgcactacgcggcccagagcatccagggagtggcggcgcacccgagcctcaaggatggatccactttatctag

SEQ ID NO: 45167 - DNA, 150 bp, Artificial Sequence
  Description of Artificial Sequence: Synthetic coding sequence
tgaggcgccctgctgttcgccctgcggtaccgggtgaccggccacgaattttgggacaataacggcggtagagattatgcgctgagagggccggagcatccaggctcaggtggtgctccagagccccagggctggattcacttcatttag

SEQ ID NO: 45168 - DNA, 105 bp, Artificial Sequence
  Description of Artificial Sequence: Synthetic coding sequence
tgattctgggacaacaacggcggccgggactacgccctgcggggcccagagcatcctggctccgggggcgcccccgagccacaagggtggattcatttcatctag

SEQ ID NO: 45169 - DNA, 57 bp, Artificial Sequence
  Description of Artificial Sequence: Synthetic coding sequence
gagcaccccggcagcggcggcgcccccgagccccagggctggatccactttatttag

SEQ ID NO: 45170 - DNA, 90 bp, Artificial Sequence
  Description of Artificial Sequence: Synthetic coding sequence
aacggcggccgggactacgccctgcggggccccgagcaccccggcagcggaggggccccggaaccacaaggttggatccattttatatag

SEQ ID NO: 45171 - DNA, 42 bp, Artificial Sequence; identical to SEQ ID NO: 21207
  Description of Artificial Sequence: Synthetic coding sequence

SEQ ID NO: 45172 - DNA, 2400 bp, Artificial Sequence
  Description of Artificial Sequence: Synthetic coding sequence
atggcccggaccgcccccgtggagccccccctgcggcacagcgccccaccttcccccgcggccggtgagcccaggacaagcgtcgaggctgctgtggccccacgcagagtcctgtttgcagatgaagctctcggcctccccctggcacagctccgtaggtatcgcccctggggaggccctggcgccggcaagatggccgcagctgccgggcaggacggaggcggagggggcggggccgacgaggatgatgatggcgaggatggcgacgagggtgaggaggaagaagaagcgtgtcccgaaccatctccactgtgtcccgttcctgccggcggcggattttacttagtgcctacgttttctctgccacctgcaccgggaaggcttgagaggctgggaagagtgatggtggagctagaggcactcctgcccccaccaggggccgtaccgggtggtgcaggagtgtgggtacccggcggaagacctcctgtgctgagggggctagtaagagtcttgaacagatcctttgagaaggccgtgcacgtccgtgcaagccacgacgggtgggcctcattctgtgaccatcccgcccggtacgtgccccgatccccaccttgggccggggctggtggtacaggtgctggggacccaatcctcgatccgggtttgggcctgggacccggccaggcatcagcttcaagccccgacgatggaggtcggaccgataggttcgctttccagcttccctttgccgaaggcgccggagatggcgccagattggactttgtcgtgcggtacgaaacacccgagggcacgttttgggctaacaatcacggtcggaattacacagtgctcctaagaatcgccccagcaccgacccccactgacgcagaaggccttccccaacagcagcagctgccccagcttgagccacagcctgagtgtcaaggaccggtggaagccgaggcccgccagttaaagtcttgtatgaaaccggttagacgtcgccccgcagaggaagagctgaagactaaaaatatggatgacaatacctttgctatggctgagcaccccgatgtccaagagtccgttggtcccctcgttgcccccacccctctgcgaccttggccgcagatgacactccaggtgtcagacgtgcctatgactgggaatccggccgaagaaggcgacgtgcctagaagctcaccacctgtggctttcacagaggtgctgcaggccccggctattcggataccacctagctcacccctgtgcggactggggggaagtccacgcgaccaggcctctggcccagatgctagcgaaggggccacgggaccgtttctagagccgtcgcagcagcaagccgaagccacctggggagtgagctctgaaaatggaggaggactggaagcggtcagtggatccgaagaactgctcggtgaggatacaatcgatcaagagcttgaacagctctatctgagtcacttgtctcggctgcgcgcagccgttgcagctggcggcgccggcgggggaggcgagggctctaccgacgggggcatgtctccgagccaccctttaggaattctcactgacagggacctgatcctgaagtggccggggcccgagagggcactcaactcagcgctagccgaggagattacacttcactacgcccggttgggaaggggggtggaactaattaaagacactgaggacccagacgatgagggggaaggtgaagagggcctgtccgtcacacccagcagccccgagggagactctcctaaggaatcaccaccagagatcctgagcggcgcccggagtgtcgtggcaaccatgggggatgtctggctcccctgggctgaggggtccgggtgtgatgggcccgttgtgctcgggacagagggccaatttataggagaccccgagaaagggatgggaaaggacacttcgtccctacacatgaatcgagtgatcgccggagtcaccgaaagccttggggaggctggcaccgaggctcagatcgaggtgaccagcgaatgggccggctccctggatcccattagcggtaaggaacccgcatcaccggtccttcttcaggggcaaaatcccaccctattatctccccttggggccgaagtctgcctaagttctgtggctcgaccacacgtcagctcgcaagacgagaaagacgccggcccctcactggaaccccctaagaagtcgccgaccctggcggtgccagctgagtgcgtttgtgctctgccgcctcaacttcgcggtcctctcacacagactctcggcgtcctcgccggactcgttgtggtaccagtggcactaaattcaggcgtttcgctgctcgtgctggccctatgtctgtcactcgcttggtttagctag

SEQ ID NO: 45173 - DNA, 1413 bp, Artificial Sequence
  Description of Artificial Sequence: Synthetic coding sequence
atgaagcccgtgcggcggcggcccgccgaggaggagctgaagaccaaaaacatggatgataacactttcgccatggagcacccagacgtccaagaatccgtcgggccactggtggcgcctacacctctgcgcccctggcctcagatgactctgcaggtgagcgatgtcccaatgaccggcaatcccgcagaagaaggcgatgtcccacggtcctccccaccagtggcctttacagaggtactccaagcgcccgccataaggatccccccgagttccccactgtgcggattgggcggctcgccaagggaccaggcttccggccctgatgctagcgagggagcaaccggtcccttcctggagccaagccagcaacaggcagaagccacatggggcgtatctagtgaaaatggaggaggactggaggcggtgagcgggtctgaagagttactgggcgaagatacgattgaccaagagttggagcagttatacctctcccatttgagtcggcttagagcagcagtggcagctggcggagccggtggtggaggagaagggtccacagatggaggaatgtcaccttcacatcctcttggcatcttgacagatagggatctcatacttaaatggccaggccccgaaagggccctgaattctgccctggcagaagagatcaccctccattacgcccggctggggcggggagtcgagctcataaaagacacagaagaccctgatgatgagggggaaggagaggagggtctttcagtgacacctagctctcccgagggagacagtccaaaggagagccccccagagattctttctggtgccagaagtgttgtggcaacaatgggcgatgtctggctaccctgggccgaggggtctggttgcgatgggcccgtcgttctgggaactgaaggccagtttatcggcgaccctgagaaggggatgggcaaggacacctctagcctgcatatgaatcgcgtcattgcgggggttacagagtccctgggcgaggcaggcacggaggcccaaattgaagtaacctccgagtgggccggaagcctggaccccatctctgggaaagagccagcaagccccgtgctgctccagggacagaacccgacactgctgtccccgctcggcgcagaagtgtgcctgtccagtgttgcccgaccccacgtgagctcccaggatgaaaaggatgctggcccatccctggagccgccaaagaaaagtcccacactcgcagttccagctgaatgcgtctgcgccctgccacctcagttgcgggggccgcttactcagacgctcggcgtactggctggactggtggttgtaccggtggctcttaactctggcgtgtccctgctggtactggcactctgcctcagtctggcgtggtttagctag

SEQ ID NO: 45174 - DNA, 1368 bp, Artificial Sequence
  Description of Artificial Sequence: Synthetic coding sequence
atgttctgcagcggccggaagtgggtggccgaggccaccatctgcacaaaactgatgaaaagagagaagcgacgtatgggtaaacgccgagcaaagaaggcaaagcgggaggaaaaaaagaagggtggagagaggcgaaggaacgagaaacgaggaaaccagatgaaaagaatgtgcgaaagaaagaaatacgagacggatctggaagaccaggacataatgggggcttttctcgataagcccaagatggaaaaacataatgctcagggacagggtaatggccttagatacgggcttagttcaatgcaaggatggcgagtggaaatggaggatgcccatactgctgtcatcggcctaccaagtggactggagagctggagcttctttgcagtatatgacggacacgccggtagccaggtggccaagtattgttgtgaacacttgttggatcatataacgaacaaccaggattttaaaggcagcgcgggggccccatctgttgaaaacgtgaagaacggcatccgcactggctttctggaaatagacgaacatatgagggtcatgtccgaaaagaaacacggcgctgacagaagtgggtccaccgccgttggtgttctgatatctccacagcacacatactttattaactgcggagactctaggggcctgttgtgccggaatcggaaagttcatttcttcactcaggaccataagccctcaaaccctttggaaaaggaacggatacagaatgccggagggagtgtgatgatacagcgggtgaatgggtctctcgccgtctcccgagcactcggcgactttgactataagtgcgtacacgggaaggggcctaccgaacagctggtttcccctgagccagaggttcatgatatcgagaggagcgaggaagacgatcaatttattatcctcgcctgtgacggcatctgggacgtaatggggaatgaagaattgtgcgattttgtccggagcagactcgaggtgacagatgacctggaaaaggtttgcaatgaggtggtggatacgtgtttgtataaagggagtagagacaacatgagtgtaatcttgatctgctttccaaacgcccccaaggtgagtccagaggccgtgaagaaagaggcggagctggacaagtatctagagtgtcgagtggaagaaattatcaagaagcagggcgagggcgtaccagacctcgtgcacgtgatgcgtaccctggcatccgagaatatcccctcattaccacctggaggggagctggcttccaagagaaatgtgatcgaggctgtgtacaaccgcttaaatccatataagaatgatgacacagattctacatcaaccgacgatatgtggtag

SEQ ID NO: 45175 - DNA, 975 bp, Artificial Sequence
  Description of Artificial Sequence: Synthetic coding sequence
atgggcgccttcctggacaagcccaagatggagaagcacaacgcccaaggccaagggaatggcttacgctacggtctttcttccatgcagggctggcgtgtcgaaatggaagacgcacacaccgccgtgataggactgcctagtggcttagaaagctggtctttttttgctgtttacgatggtcatgctggaagtcaagtcgccaaatactgctgcgagcaccttctggaccatatcactaacaaccaggacttcaagggctctgctggggctccctcggtcgagaacgtaaagaacggtatccgaacagggtttttggagatcgacgaacacatgcgagtgatgagcgagaagaagcatggcgctgaccgtagcggtagcactgctgtgggtgtgcttatttcgccacagcatacatacttcatcaattgcggcgattctaggggactgctctgcagaaatcgcaaggtccactttttcacccaggaccacaagccaagtaatccactggagaaggagaggattcagaacgctggcgggtccgttatgattcaacgagtgaatgggtcgctcgcggtaagcagagcactgggagatttcgattataaatgcgtccatggaaaaggacccacggaacagctggtgtctcccgagccggaagtccacgacattgaaagaagtgaggaagatgaccaatttatcattctggcatgcgacggcatttgggatgtcatgggaaatgaagaactgtgcgactttgtgaggtctcgactagaggtgactgatgacctggagaaagtctgcaatgaggtggtggacacctgcttgtacaaaggctccagggataacatgtctgttatactgatatgtttccccaatgccccaaaagtctcccctgaagcagtgaaaaaggaagccgaactagataaatatctcgagtgcagggtcgagggaggatctttcaataagaagtag

SEQ ID NO: 45176 - DNA, 1149 bp, Artificial Sequence
  Description of Artificial Sequence: Synthetic coding sequence
atgggcgccttcctggacaagcccaagatggagaagcacaacgcccaaggccagggaaacgggttgcggtacggactcagcagcatgcagggctggcgggtcgagatggaggatgcccacaccgccgtgatcggcctgccctcagggcttgagtcctggtccttttttgccgtttatgacggccatgccggaagccaggttgcaaagtattgctgcgagcacctgctcgaccacatcaccaataaccaagattttaagggaagcgcaggggcccccagcgtggagaatgtcaaaaacggtatacgcacagggtttctggagattgatgaacatatgagagtgatgtccgaaaaaaaacacggggcagacaggagcggctctacagctgtgggggtcctcatttctccgcagcatacttatttcattaactgtggagatagcagggggctgctctgccgaaataggaaagtgcacttcttcactcaagaccataaaccgagcaatcctctagaaaaggaacggatacaaaatgctggggggagtgtgatgatccagagggttaatggtagtctggccgtcagtcgggccctgggggattttgactacaagtgcgtccatggaaagggccccacagagcaactcgtgagtccagagcctgaagtgcacgacatagagcgatcagaggaagatgatcagtttataattctggcatgcgatggaatttgggatgtgatggggaacgaagagttgtgcgattttgtacgcagtagactggaagtcaccgatgacctggaaaaggtgtgtaatgaggtggtcgacacatgcctgtataagggttcacgtgacaacatgtctgtaatcctgatctgctttcctaacgcacctaaggtttcccccgaggcagtcaagaaggaagccgaactcgataagtacctggagtgtagagtggaagagataattaaaaaacagggcgaaggggtgcccgacctggtgcacgttatgcgaacacttgcctctgagaatattccttcattgcccccaggcggagagctggcgtccaaacgaaatgtgatcgaagcagtatacaatagactcaacccctacaaaaatgatgatacagatagtaccagcaccgacgacatgtggtag

SEQ ID NO: 45177 - DNA, 564 bp, Artificial Sequence
  Description of Artificial Sequence: Synthetic coding sequence
atgggcgccttcctggacaagcccaagatggagaagcacaacgcccagggacagggcaacgggctcagatatggcctctcctcaatgcaagggtggagagtggagatggaggacgctcacacagcagtgattggactgccatcgggactggagtcctggagctttttcgcggtttacgatggacacgccggtagccaggtggccaaatattgctgtgaacacttactcgaccacattacaaataatcaagattttaaaggctccgcaggtgccccatccgttgaaaacgtgaagaatggcatcaggacaggctttttagaaatcgacgaacacatgagagtgatgagtgagaaaaagcatggggccgatcggagcggctctactgcagtgggagtgctcatctctccacaacacacctactttatcaattgtggcgatagtcggggactcctgtgtaggaaccgcaaagtccacttctttacacaagaccataagccctcaaatccgctagaaaaggagcgcattcagaatgccggcgggagtgtcatgattcagagggtgtag

SEQ ID NO: 45178 - DNA, 390 bp, Artificial Sequence
  Description of Artificial Sequence: Synthetic coding sequence
atgggcgccttcctggacaagcccaagatggagaagcacaacgcccagggacagggcaatggcctgagatatggtctctcttctatgcaggggtggcgcgttgagatggaggatgcccatacagccgttatcggcctgccaagcggattagaatcctggtcctttttcgcagtctacgacggccacgccggatcccaagttgctaagtattgttgcgagcatctcctggaccatatcacgaataatcaagactttaaggggtctgcaggcgcacccagtgtggaaaacgtgaagaacggcatccggaccgggtttctggaaatagatgagcatatgagggtgatgagcgagaagaaacacggcgcggaccgcagcggttccacagcttag

SEQ ID NO: 45179 - DNA, 1149 bp, Artificial Sequence
  Description of Artificial Sequence: Synthetic coding sequence
atgggcgccttcctggacaagcccaagatggagaagcacaacgcccaaggccagggcaacggactgcgttacggtcttagtagcatgcaaggatggagggtcgagatggaggacgcacatacagccgttatagggcttccaagcgggctcgagagctggagcttttttgccgtgtacgatgggcacgccggctctcaagtggcaaaatactgctgcgaacacctgcttgatcacatcactaataaccaggattttaaaggctcagctggcgcaccctctgttgagaacgtcaagaacgggatcaggaccggcttcttagaaatcgatgaacatatgcgggtcatgtcagagaagaaacatggagctgaccgatctggatccacagcagtcggcgttctgatctcaccccagcatacatacttcattaattgcggggactcccgcggtctgctctgccgtaatcgaaaagtgcatttcttcacacaggaccataaaccttccaatccactggaaaaggagaggatccagaacgcaggaggttcagttatgatacagcgggtcaacggatccctcgccgtgagtagagccctcggtgacttcgactacaaatgcgtgcacggtaagggacccacggagcagttagtgtcccctgagcctgaagtccatgatatagagaggtcggaagaggatgatcagtttatcattttggcatgtgatggaatatgggatgttatgggcaacgaggaactgtgcgacttcgtccgcagcagactagaagtcactgatgatttagagaaagtttgtaatgaagtcgttgatacttgcttatacaaaggatcaagggataatatgtcagttattttgatctgcttccccaacgctcctaaagtctcccctgaagccgtgaagaaggaggctgaactggataaatatctagagtgcagggtggaagagataataaaaaagcagggcgaaggagtgccagatctagttcatgtcatgcgaaccttggcgagcgagaatatcccttcactgccaccggggggggaacttgcctctaagagaaatgtgatcgaggccgtttacaaccgcctgaacccctacaaaaatgacgacaccgactcaacatctacagacgacatgtggtag

SEQ ID NO: 45180 - DNA, 447 bp, Artificial Sequence
  Description of Artificial Sequence: Synthetic coding sequence
atgggcgccttcctggacaagcccaagatggagaagcacaacgcccaggggcagggtaatggccttcgatacggcctcagttccatgcagggctggagggtcgagatggaggacgcccatacggctgttattggactcccctcgggccttgagtcctggagcttttttgcagtttacgacggacacgctggaagtcaagtcgctaaatattgctgcgagcacctgttggaccacatcactaacaaccaggactttaagggatctgccggcgcaccctctgtcgaaaatgtcaaaaatggaatcagaacaggatttctggagatcgatgagcacatgagggtcatgtcagaaaagaagcacggggccgacagaagcgggagcactgcggtgggcgttctgattagcccacagcacacatacttcataaattgtggagatagtcggtag

SEQ ID NO: 45181 - DNA, 2367 bp, Artificial Sequence
  Description of Artificial Sequence: Synthetic coding sequence
acccactacctgagccccggcctgagcgacttctacctgaaccacagccctgctagtacatgcactctaaggcggtctctggggagtgagactggcaagtgcctgcctgcgcactcccttttgcccaagttcttcccctgcagagaggatgtacataaggttgatatcatgaccttttgtcaacagaaggcagcccagtcctgtaagagtgagactctcggctcccgtgacagcgccctgctgtggcagttactcgtgctgctctgccgacaaaacggctccatggtgggttctgatatcgcggagttactgatgcaggactgtaagaaactcgagaaatataagcggcagcccccagttgccaatttgataaatctgaccgatgaagattggcccgttctgtcctccggcactccgaacctgctgactggtgagatccccccctcggtggagacccccgcacagatcgtagaaaagttcaccagactgctctattacggaaggaaaaaagaggccctcgaatgggctatgaagaatcatctctggggtcatgccctgttcttgtcaagcaaaatggaccctcagacttacagctgggtgatgtctgggttcacttcaaccctcgcactgaacgaccccctgcagacactgttccagcttatgtctgggcgtattccgcaggcagctacctgttgcggcgagaagcaatggggagactggaggccacacctagctgtgattctatcgaaccaggcgggagatccggaattataccagagagcgatcgtggcgataggggatacgctagcaggcaaaggtttagttgaggccgcccacttctgctatctcatggcgcacgtgccctttggtcattataccgttaagaccgatcatctcgtgctcctgggtagttcacattctcaggagtttctcaagttcgcgacaactgaggcaattcagaggaccgaaatctttgaatattgccaaatgctggggagacctaagtcttttatcccttccttccaggtctataaacttttgtacgcatctcgccttgccgactacggcctcgtgtcccaagcactccactattgcgaggcaataggcgccgcagtgctttctcaaggcgagtcttcgcaccctgtcctcctagtggagcttatcaaactggcggagaaattgaaacttagtgatccactggtcctcgagagaaggagtggggaccgagacctggagccagactggctcgctcagcttcgccgacagctggaacagaaggtggcaggtgatattggcgatccacaccccacgcgctctgatatctcaggcgctggcggaaccactaccgagaatacattctatcaagatttttccggctgccagggatatagcgaagccccaggctatagatctgctctctggctgacccctgagcagacatgtttactgcagccttcgccccagcaacccttccccctgcagcctggtagctacccagcaggcggcggagcgggacagactggcactccccggcctttttattccgttcctgagactcacttgcccggaactggatcctccgtcgcagtcactgaggcaactggaggaactgtttgggaagagatgctgcaaacccatctggggccgggtgagaacaccgtgtcccaggagacttctcagccgcctgatggccaggaggttatttctaagccgcagactccccttgctgctcgcccgcgatctatcagtgagtccagtgcaagcagcgccaaggaggatgaaaaagagagtagtgacgaagctgacaagaactcaccacggaatacagcccagagggggaagctgggcgacggaaaggagcacactaaatctagcgggttcggatggttttcttggtttcgaagtaagcctacgaaaaatgcttccccagcgggggacgaagattcctccgatagtcccgactcagaacaggagacgcctcgcgcgagctccccacaccaagcaggattaggacttagtcttaccccttcacccgaatccccaccgctgccggatgtgtcagccttctccagaggaaggggcggcggcgagggacggggcagcgcaagctcgggaggagcagccgccggggccggggttggaggattaagcggccccgagtcggtcagctttgagttgtgttccaacccaggagtgctgttaccgccccctgccctaaagggtgccgtgcctctctacaacccctctcaagtgccccagctgccaaccgccacatccctgaataggccaaacagactgagtgcatctctttcacatcctgcaatgctgagaatcaacacgaggcctcgactgatttcccaggattag

SEQ ID NO: 45182 - DNA, 3183 bp, Artificial Sequence
  Description of Artificial Sequence: Synthetic coding sequence
atggagctgtgggccccccagcggctgccccagacccggggcaaggcgacagctccgagtaaagaccccgacagaggatttaggagggacgggcaccaccggcccgtacctcattcctggcataatggggaacgattccatcaatggcaggataatcggggctcccctcagcctcagcaggagcccagagcagaccatcagcagcagccacattatgcatctcgacccggcgactggcaccagccagtaagcggcgttgattattacgaagggggttaccggaaccagctatattctcgccccgggtacgagaacagttaccaaagctaccagtccccaaccatgcgggaagagtacgcctatggatcatattactatcatggacacccccaatggcttcaggaagagagggttccccggcaaagatccccttatatctggcacgaagactaccgcgaacagaaatatctggatgaacaccactacgagaaccaacacagcccctttggcactaattccgagacacatttccagtccaacagtagaaacccatgcaaggattcacccgcatctaattcaggccaagaatggccaggagaacttttccccggcagtctactcgcggaagctcaaaagaataagccgtcactcgcatctgagtccaacttgctgcaacagcgcgagtccgggcttagtagcagctcctatgaattatctcagtatatcagggatgcgccggaaagagatgacccgccagccagcgctgcatggagcccggtgcaagcggatgttagttcagcaggaccaaaggcccctatgaaattctatattccacatgtgcctgtctcctttggcccaggaggtcagcttgtgcacgtaggtccgagctcaccaacagatggccaggctgccttggtggaactccattctatggaagtcatacttaacgattccgaggagcaggaggagatgagaagcttcagcggtccactgattcgcgaagatgtgcacaaggtggacattatgaccttctgtcagcagaaggcagcccagagttgcaaaagcgagactctggggagccgggatagtgcgctgctttggcagctgctcgtgctgttatgccgccaaaatgggagtatggtggggtcagatatcgctgagttgctgatgcaggactgtaagaaattggagaaatataaacggcagccgccagtggccaatttgatcaatctgacagatgaagattggccagtcctcagcagcggtacccccaacctcctgactggcgaaatcccaccaagcgtagaaacccccgctcagattgtggaaaagtttacccggcttctgtattacgggcggaaaaaggaggccctggaatgggctatgaagaatcacctgtggggacatgcacttttcctctctagtaagatggacccccaaacctactcgtgggtcatgtccggcttcacaagtacactagccctgaatgaccccctgcaaactctcttccagctgatgtcaggacgcatacctcaggcagcaacttgttgtggcgaaaagcaatggggagactggagacctcacctcgcagtcatcctgagtaaccaggccggtgacccggaactgtaccagagagccatcgtcgccatcggagacacgctggcgggcaaaggtctggtcgaagcagcgcacttctgctatctgatggcacatgtaccattcgggcattatacggttaaaaccgatcatttagtcctgctggggagtagtcacagtcaagaattcctgaagttcgccactactgaagccatccagagaacagagatatttgaatactgtcagatgctgggacggcctaaaagttttatcccctcctttcaggtgtacaaactcctgtatgcctcccggttggcggactacggcctcgtgtctcaggccttgcattactgtgaggctatcggtgcagccgtcctgtcccagggtgaaagtagccaccctgtacttttagtggagctgattaagctggcggaaaagttaaaactgtccgacccacttgtgctggagcgccgctctggcgatcgggacctagagccagattggctagcacagcttagacggcaattggaacaaaaggttgccggagacatcggggacccccatccaaccagatctgatatctccggagctgggggcaccactactgagaatactttctaccaggatttttccggctgccaggggtactcagaggccccaggttataggtccgcactctggctgacccctgagcagacatgtctcctgcaacctagcccacaacagccctttccgcttcagcccgggtcctatccagcgggaggcggggcagggcaaacaggtaccccgcgcccattttacagcgtgcctgagacccacctcccaggtactggatccagcgttgccgtgaccgaggcaaccgggggaactgtttgggaggaaatgcttcagacacatctgggcccaggcgagaataccgtaagtcaggaaacgtcccagccccccgacggccaggaagtaatcagcaaaccccaaacacccctggctgcgcgcccacgttcgatctcagaatcttcagcttctagcgcgaaagaagacgaaaaggagagcagcgacgaggcagataaaaactccccacgcaatactgcccagcgagggaagctgggggatggaaaggagcacacgaagagtagcgggtttggttggttcagctggttcagaagcaagcctacaaagaacgcaagcccggctggagatgaggacagctcagatagccccgatagcgaagagacccccagagcctcttccccccatcaagcaggtctcggcctgtctttaactcccagcccagagagtcctcctctccctgacgtttctgccttcagtaggggcagaggcggtggggagggtaggggctctgctagctccggcggggcggctgctggggctggtgtggggggcctgagcggaccagagagcgtttcctttgagttgtgcagcaatcctggggttctgctgcccccccccgctctgaaaggtgcagtaccgctgtacaacccctcacaggtgccgcagttacccacggctacctccctcaaccggcctaatcggttggctcaacggaggtatccgacgcagccgtgctag

SEQ ID NO: 45183 - DNA, 2238 bp, Artificial Sequence
  Description of Artificial Sequence: Synthetic coding sequence
atggagctgtgggccccccagcggctgccccagacccggggcaaggccacggcaccctctaaagaccccgacagagggttccggagagatggacaccaccgcccagtgcctcattcttggcacaacggcgaacggtttcatcagtggcaggataatcgaggctccccccagccccaacaggagccacgggctgaccaccagcagcagcctcactatgccagtagaccaggtgactggcatcagcctgtgagcggagtggattactacgaggggggctatcggaaccaactctactctcgacctgtgctcagttccggtactcccaacttgctaaccggggaaattcctcctagcgtcgaaacacccgcacaaatcgttgagaagttcacaaggctgttatattacgggagaaaaaaggaagctctggaatgggcaatgaagaaccacctttggggtcacgccctgtttctaagttcaaagatggacccccaaacctactcttgggttatgtcagggttcacctccaccctagcgttgaacgaccctctgcagactctctttcagctgatgtcaggccgaatcccacaagccgctacctgctgcggcgaaaagcagtggggagactggagaccacacctggctgtgattctgtctaaccaggctggggatccagagttatatcagagggcaatcgtagcgataggggacaccctggctggtaaagggctggtggaagcggctcacttttgctacctgatggcgcatgtgccttttggacattacaccgttaagacagatcaccttgtgctgctgggtagtagccacagccaggagttcctgaagttcgccacaaccgaggccatccaacggaccgagatctttgaatattgccagatgctggggcgaccaaagtcttttatcccaagctttcaggtttataaattactgtacgcctcaaggctcgccgactatggactcgtgtcccaggccctgcactattgcgaggcaatcggcgccgcagtgttgtcacaaggcgagtcgtcacatccagtactcttggtggaattgatcaaactggcagaaaaactgaaacttagcgatccactggtgctcgaacgccgcagcggggatcgcgatctggagcctgactggctagcccaactccgccgccagctggaacaaaaagtcgccggggatatcggagatccccaccctactcgcagtgacatcagcggagctgggggcaccaccaccgagaacaccttctatcaggacttttctggctgtcagggctactccgaggcgcctgggtataggagcgccttgtggctgacgcccgagcaaacctgcttattgcagccctctccccagcaacccttcccactccagcccggctcgtatcctgctggcggcggggcagggcagaccgggaccccgagacccttctatagcgtccccgagacccatcttcccggcacggggtcatctgtagcagtcacggaagcaacaggggggactgtgtgggaggaaatgcttcagacacatttaggcccaggtgagaacacagtgtcacaggaaaccagtcaacccccagatggtcaagaagttatctctaagccacagacacctctcgctgcccgccctcgctctattagtgagagctctgccagttccgccaaggaagacgagaaagaatcatcagacgaggctgataagaattcacctcgcaataccgcccagcgggggaagctaggtgacggcaaagaacacaccaagtcgtccggtttcggctggttctcctggttccgcagcaagcccaccaaaaacgcctcaccagcaggcgatgaggacagcagcgacagcccagattctgagcaggagactccccgagcctctagccctcaccaggccggcctcggactgagcctgaccccatcccctgagagccctcccttgcccgacgtgagtgctttttccagaggcagggggggtggagaaggtagaggtagtgcctcttccgggggggccgccgctggtgccggggttggcggactcagcggcccagaatctgtatctttcgagttatgctcgaacccaggcgtcctactgccgcctcctgcgctgaagggcgctgtacccctctataacccctcccaggttccccagttaccaacagccacttcacttaataggccgaatcggcttgcccagagaaggtatcctacccaaccctgctag

SEQ ID NO: 45184 - DNA, 456 bp, Artificial Sequence
  Description of Artificial Sequence: Synthetic coding sequence
atggccgccaccgccctgctggaggccggcctggcccgggtgctgttttacccaacactgctttataccctatttcgcggaaaggttccagggagggcacatcgagactggtaccatcgcatcgatccaaccgtactcctgggtgccttacctcttcggagccttacccgacaagtgtcccgagccggcgaaccgggtcctttacctcgccctcgcaggagtgtaccagtaggacccctgggaagccctcctagcctgctaagtcacctcttcgcctctgccgcagggactgggcgggagcgggctcggggcgaccaccacgagaggggtgtacgggatgaagtgccggtacagcttttcacgggggcccagatggaatccaggggtggatgcaaatcccaccgacaggatcccgtcatccatccccaccaagcctggccagccggctgttcctag

SEQ ID NO: 45185 - DNA, 3459 bp, Artificial Sequence
  Description of Artificial Sequence: Synthetic coding sequence
atgatcttcagcgacatgaacaccgtgagcggcagccccaaggtgcacccgcctaacggcaccaggttctatactttccaagagtttgcagcccttactaaagaattaaacgcctgtagagagcagttgctggagaaagaggaggagatttccgaactgaaagccgagcgcaacaacaccagactcctactcgaacatctcgagtgcttagtctctagacatgagagatctttgcgtatgactgttgttaaaagacaggcgcagagtccgagtggggtcagctccgaggtggaggttctgaaggcactgaaatcgctcttcgagcatcataaggcactggatgaaaagatcgttgcactgcgggagcaaaacgtgcacatacaacgcaaaatggcctccagcgaaggaagtaccgagtccgaacatctcgagggcatggagcccgggcagaaagttcacgagaaacgactgtcaaatggctccatcgacagcacggacgagacatcccagatagtcgaactgcaggaattgctagaaaagcaaaattacgaaatggcacagatgaaggagagactcgctgccctgtcctctcgtgtgggtgaggtcgagcaggaagctgagacagcaaggaaggacctcatcaaaactgaggaaatgaatactaagtaccaaagggacatcagagaagcaatggctcagaaagaggacatggaagagcgcattactacgctggagaaacgatatttatctgctcagcgggaatctacgagcatccacgatatgaatgacaaacttgagaacgagttagctaacaaggaagcaatcctgcggcagatggaagaaaagaaccggcagcttcaggagcgacttgaactcgccgagcagaaattgcagcaaacgatgcgcaaggcagaaaccttaccagaggttgaggccgagctcgcccagcgcatagccgcgttgacaaaggccgaggaacggcatgggaatatcgaagagcggatgagacatttggagggacagttggaggagaagaaccaggaactacagcgtgcccgtcagagggagaaaatgaatgaagagcataacaaacggttgtccgacactgtcgatcgcctgttaacagaaagtaacgagcgactgcagttacacttaaaggagcgcatggcagctttagaggaaaaaaatgtgttaatccaagaaagcgaaacatttcggaagaacctcgaggagagcttgcacgataaggagagactggctgaggagattgaaaaacttagatctgaattggaccagctgaaaatgcgaactggcagcctgatcgaaccaaccattcccaggacacacctggacaccagcgccgaactgagatattccgtgggatcacttgtcgatagtcagagtgattatcgcacaaccaaggtgatccggaggccgaggagaggtcgtatgggcgtgaggagggatgagccaaaagtaaagtcccttggcgatcatgagtggaatcgcacacaacagataggcgtcttgtctagccaccctttcgagtccgacaccgagatgtctgatatcgacgatgatgatcgagagacaattttctccagtatggacttgctttccccgagtggccatagcgacgcccagacgctggcaatgatgctgcaggaacagctggacgctattaacaaagaaatccgccttatccaggaagagaaggagagtactgagctgcgtgcagaagaaatcgagaatcgagttgcaagcgtgtcactggagggcctcaatttggcgcgtgtacacccagggaccagcattaccgcttccgtgacggcctcctctctggcgtcgtcctcccctccctcaggccacagtacacctaagcttacccccaggagtcctgctcgagaaatggaccgtatgggggtcatgactctgccaagcgacttgcgaaaacatagacgcaagatcgcggtggttgaagaagacggaagggaggataaggcgaccatcaagtgtgagacgagtccgccccctactcctcgcgcgctccgcatgacccatactctgcccagcagctaccataacgacgcacggagctcactgtccgttagtctggagcccgaaagcctcggcctcggcagcgcaaactcctcgcaggatagcctacacaaggccccaaagaagaagggaatcaagagctctatcggaaggctgttcgggaagaaggaaaaggctcggctgggccagctgcgcggattcatggaaactgaggctgccgcgcaggagagtcttggcctggggaagctggggacgcaggcagagaaagatcggaggttgaagaagaagcacgagttactggaggaagcaaggagaaagggcctcccttttgcccagtgggacggccctactgttgtggcatggttggagctttggctgggaatgccagcctggtacgtcgccgcatgtagagccaacgttaaatccggagccatcatgtcggcactctctgatacagagatccagagagagatcggaatctctaaccctcttcatcgtttaaagctcaggctcgcgatacaggaaatggttagccttacctcaccttcggccccccccacctcccggacaccctctggaaatgtttgggtaacccatgaggagatggagaatctggcagcacctgccaaaacaaaggaatctgaagaggggagctgggcgcagactctggcctatggtgatatgaaccacgaatggataggtaacgaatggctcccctccctcggccttccccagtatcgctcctactttatggagtgtctcgtggacgcaaggatgctggaccacttaactaagaaagacctaagggtgcatttgaagatggttgattcctttcatcgaacctccctccagtatggcataatgtgcttgaaacgattaaattacgataggaaggaactcgagaggaggcgcgaggctagccagcatgagataaaagatgtattggtttggtccaacgatcgggtgattaggtggatacaagctattggactgagggagtatgcgaataacattctcgagagcggggtacacggcagcttgattgcactggacgaaaacttcgactatagctccctggcactcctactgcagatccccacccagaacacccaggccagacagattctcgagcgcgaatacaataatctgctcgctctcggcacagaaaggcgccttgacgaaagtgatgataagaattttaggcgaggttccacatggagacggcaatttccaccacgggaagtgcatgggatttccatgatgcccgggagttctgaaaccttacctgcaggattccgcctgactactacctctgggcagtctcggaagatgaccaccgacgtcgcctcctcacgtctgcaacgcctcgacaattcaaccgtccgaacgtacagttgttag

SEQ ID NO: 45186 - DNA, 2352 bp, Artificial Sequence
  Description of Artificial Sequence: Synthetic coding sequence
atgcggcacctggagggccagctggaggagaagaaccaggagctgcagcgggcgcggcagagagagaaaatgaacgaggagcacaacaaacgcttaagcgacacagtcgaccgcctccttaccgagtcaaatgagcgcttgcagctccacctaaaggaaagaatggcggccctggaagagaaaaatgttctaatccaggaatcagagacttttagaaagaatctggaggagagtctgcatgataaggaaaggctggcagaagagatagaaaaacttcggagtgagttggatcaattgaaaatgagaacaggctcactaatcgaacccacaatcccccgaacccacctggacacatcagcagagctgaggtactcagtcgggtccctggtggattcccagtccgattaccggaccacgaaagtgattcggcgcccccggagggggcgaatgggcgttaggcgggacgagcctaaggtgaagtccctgggtgaccacgagtggaaccgaacacagcagatcggagtgcttagctctcacccattcgaaagtgatactgagatgtccgatattgacgacgatgatagggaaaccatcttctcttccatggatcttctcagtccctcagggcacagtgatgcccagactctcgcaatgatgttgcaggagcagttagatgctattaataaagaaatccggttaattcaggaagaaaaagaatcaaccgagcttcgggccgaggaaattgaaaaccgcgtggccagtgtaagtttggaagggttgaatctggcacgcgtgcacccagggacttccattactgcatcggttacagcaagctccctggcaagttcatcccccccctccggtcactctactcctaagctgaccccaaggtctcccgctagggagatggatagaatgggagtgatgactttaccttcggacctgcgaaagcatcggcgaaaaattgcagttgtggaagaggatggacgggaagataaagcaaccatcaaatgtgagaccagtccccctccaactccaagagcattgcggatgacccacaccctgcctagctcctaccataatgatgcacgctcaagcctgagcgtctcactcgaacctgaatcactcggcctgggatccgcaaatagttcacaagatagtttgcacaaggcaccgaagaaaaaagggatcaagtcctccattgggaggttattcggaaagaaagaaaaagctaggcttgggcaactaagagggttcatggaaacggaggctgctgcgcaggagtcactcggactggggaagctgggcacccaggctgagaaagatcggcgcctcaaaaagaagcacgaactgctggaagaagctaggcgaaagggattgccatttgctcagtgggatgggccaaccgtcgtggcgtggctcgagttatggcttggaatgccagcctggtatgtcgctgcctgccgcgcgaacgtgaagtcaggtgccatcatgagcgcactcagcgacaccgagatccagcgtgaaattgggatctcaaaccctctccaccgcctgaagctacgactggcaattcaggagatggtgagcctcacaagtccgagcgccccccctacgtcccgcacctgccccgttttcctccagaccttggcgtacggagatatgaaccatgaatggatcggaaacgaatggctgcctagcctaggactacctcagtatcgctcatatttcatggagtgcctggtcgatgctagaatgctcgaccacctgactaaaaaagatcttcgtgtacacctgaaaatggtagatagcttccatagaacatccctccaatacggaatcatgtgtctgaagagactcaactacgacaggaaagagcttgagcggcgtcgcgaggcatcccagcacgagataaaggacgttctcgtgtggtctaatgatagagtcattaggtggatacaggcgatcggactgcgggagtacgccaacaatatactagagtcaggcgttcacgggagtctgatcgcacttgatgagaacttcgactacagttccttggcactcctgcttcagatccctacgcaaaatacgcaagccaggcagatccttgagcgcgagtacaataaccttctggccctgggaacggaacgcaggttggatgagagtgatgataagaatttcagacgcggatctacttggcgaaggcagtttccccctcgggaggtgcatgggatctccatgatgcctggttcctcagagacactgcctgctggcttccgtctgaccaccacctccggtcaatcacggaaaatgacaaccgatgatggagtattttcagtctattctacctag

SEQ ID NO: 45187 - DNA, 3756 bp, Artificial Sequence
  Description of Artificial Sequence: Synthetic coding sequence
atgatgtgcgaggtgatgcccaccatcaacgaggacacccccatgtcacaacgggggagtcagtctagcgggtccgactccgactcacattttgagcagctgatggttaatatgctggatgagcgcgatcgcctcctggatactctgagggagactcaggagagtctgtctttggcccaacagaggctccaggacgttatttacgaccgcgatagcctgcagcggcaactgaactccgcccttccccaggatatcgaatcgttgacggggggtctggccggcagcaagggagctgacccacccgaattcgctgctttgaccaaggaactaaacgcctgtcgcgaacagctcctggagaaggaagaggaaatttccgagctcaaagcagaacgtaataatacgagacttctgcttgagcaccttgagtgtctggtttcaaggcacgagagatcattgagaatgacagtagtgaaaagacaagcccaaagtccctctggggtctctagcgaggttgaagtcttgaaagctctcaaaagtcttttcgagcaccataaggcccttgacgagaaggtgagggagcggcttagagtttctctggagcgagtcagcgcgttagaagaggagcttgcagcagctaaccaagaaatcgtggccctaagggaacagaatgttcacattcaacgtaagatggccagtagcgagggttccaccgagagcgagcacctcgagggaatggaaccgggccagaaagtacacgagaaacgcttgagtaatggctccattgacagtacagatgagacatcacagatcgtggaactacaagaactgctggagaagcaaaactatgagatggcgcagatgaaggagagactggccgccctcagctcacgcgtcggcgaagtggaacaggaagcagaaacagcgagaaaggacctaataaaaaccgaggagatgaataccaaatatcagcgcgacattcgcgaagctatggctcagaaggaagacatggaggagaggatcactaccttggaaaaacgctacttatcagcacaacgtgagagcacctctattcatgatatgaatgacaaactggagaatgagcttgccaataaggaggcgatcctgcgtcagatggaagaaaaaaaccgccagttacaagagagactggaactggccgaacaaaaattacagcagactatgagaaaagctgagactctgcctgaggttgaagccgagttggcacagcgcattgccgccctgaccaaggccgaggagcggcacgggaatatagaagaaaggatgaggcacttagagggtcagttagaagaaaagaaccaggagctgcaacgggcacgacaacgtgagaaaatgaacgaggagcacaacaaaagactgagtgacaccgtggaccgcctcttgactgaatccaatgaacggcttcagctgcacctgaaggagaggatggccgcattggaggaaaagaacgtgctcattcaagaaagcgaaacctttcgcaagaatctggaggagtccctacatgacaaggagcgccttgcagaggaaatcgaaaaattgagaagcgaactggaccaattaaagatgcggaccggatcgctgattgagcccacaataccacgaactcacctggacacgtccgcagagctacgctacagcgtcggttctctggtcgattctcagagcgattatcgcacaactaaagtgattcgccgaccccgaaggggacgcatgggggtccggcgcgatgagcccaaggtaaagagcttaggagaccatgagtggaacaggacccaacagatcggggtgctcagttcgcaccctttcgagtcggatacggagatgtccgacattgacgatgacgaccgcgagaccattttcagttccatggacctgctcagccctagcggccacagtgacgctcagacccttgccatgatgctgcaggagcagctcgacgcaatcaataaagagatacgactgatacaggaagaaaaggaatccacagagttgcgggccgaggagattgaaaaccgtgttgcgagtgtctccctggaggggttgaacttggcgcgcgttcaccctggtacttcaattaccgccagcgtcacggcgtccagtttagctagttcctcaccaccctctggccacagcacgcctaagctgacacccaggagtccggccagagaaatggaccgcatgggcgtaatgaccttaccttccgatctccggaaacatagaagaaagattgctgtggtggaagaggacggtcgagaagataaggcaactataaagtgtgaaacctcccccccgcccacacccagagcgctgagaatgacccacacgcttccttccagctaccacaacgacgcgcggtcctccctaagcgtcagcctggagccggagtctctaggattggggtctgccaattcatcccaggactcgctgcacaaggctcctaagaagaaggggattaagtccagcataggccgcttattcggaaagaaggagaaagcccgactgggacagctgagaggctttatggaaactgaagcggcagcacaggagtcccttggactgggaaaactcggaacccaggcagaaaaagatcggcggttgaagaagaagcatgaactgctggaggaagcgcgccggaaggggctgcccttcgcccagtgggacggtccaacggttgtagcttggttagaactctggcttggtatgcccgcttggtacgttgccgcctgccgcgcaaacgtaaagagcggagccatcatgtcagcactctctgatacagagatccagagggaaattggaataagcaaccccttacatcggctcaaactgaggctggccatccaggaaatggtcagtctcacaagcccctcggccccccccactagtagaaccccttcggggaacgtgtgggtgactcacgaagagatggagaatttggcagcgcccgccaagacaaaagaatcagaggagggatcctgggctcagaccctcgcgtacggtgacatgaatcacgagtggattggcaatgaatggctgccttctcttggtcttccgcagtaccggtcatactttatggagtgtctcgtcgatgccaggatgctagaccaccttactaagaaggacctacgcgtccatctgaagatggtagacagcttccaccggacatcactgcagtacggaattatgtgcctgaaacgactgaactatgataggaaagagctcgagcgccggcgagaagcaagtcagcatgaaataaaagacgtcctcgtctggagtaatgacagagtcattaggtggatacaggccatcggtctgagggaatacgcaaacaatatacttgagagcggtgtgcatgggtcccttattgccctggacgaaaacttcgactactcatcgctggctcttctgttacaaatccctactcagaacacccaggcccgtcaaattttggaaagggaatataacaacctgcttgccttggggacagagcgacgccttgatgagtctgacgataaaaacttccgtagaggttcgacctggcgcaggcagttcccccctagggaagtacatggaatcagtatgatgcccggcagctccgaaaccctgcctgctggattccgcctgactactacgtctggccaatctcgcaaaatgactactgatgttgcgtcctcgcgtttacagcgcctcgacaatagcactgtccgtacatactcatgctag

SEQ ID NO: 45188 - DNA, 3699 bp, Artificial Sequence
  Description of Artificial Sequence: Synthetic coding sequence
atgatgtgcgaggtgatgcccaccatcaacgaggacacccccatgtcacagcggggatctcagagttccgggtctgactccgattctcacttcgagcagttgatggttaatatgctggacgaaagggatcgtctcctcgataccctgagggaaactcaggaatcgttgagcttggcccaacaacggctgcaagacgtgatctatgatcgcgattcactgcaaaggcagctgaatagcgcactgccacaggagtttgcggctcttacaaaggaactgaatgcgtgtagagagcagcttctggaaaaggaggaagagattagtgaactgaaagccgaaagaaataatacccgtcttctgctagagcatctcgaatgcctcgtgagccgccatgagcggtctttaagaatgactgtcgtaaaacggcaagcacagtctccctctggggtgtcaagcgaggttgaagtgcttaaagcactcaaatcactgttcgagcatcacaaagctttggatgaaaaagtgagagaaagactgagagtcagtctagaaagggtttctgcactggaggaagaattagctgccgcgaaccaggagattgtcgctctgagggagcaaaatgtgcacatccagcggaaaatggcatcaagcgaaggcagtacagagtccgagcaccttgaaggcatggaacccggacaaaaagtccacgagaaacggctgtccaatggctccattgacagcaccgacgagaccagccagattgtagaacttcaagaactgctggaaaaacagaattacgaaatggctcagatgaaggagagactcgccgcactttcgtcccgggtgggtgaggtggaacaagaagctgagacggcgaggaaggaccttatcaaaactgaggagatgaatacgaagtatcagagagatatccgggaagcaatggcacagaaggaggacatggaggaacgaatcaccacactggaaaaaagatacttaagtgcacagagggagtctactagcatacacgacatgaacgataagcttgaaaacgaactggcgaataaggaagcaatactgcggcagatggaggagaaaaatagacagctgcaagagcgtttagagctagcagagcagaaactgcagcagaccatgaggaaagccgagactctacctgaggttgaggcagagctcgcccagagaattgccgctctcactaaagccgaggagcggcacgggaacatcgaggaaaggatgagacacttggaaggccagctagaagagaagaaccaggagctgcagagagcccggcagcgcgagaaaatgaacgaggagcacaataaaaggctgtctgacactgtggatcggcttctcactgaatcgaatgaacggctgcagctgcacctcaaggagaggatggccgccctcgaagagaaaaacgttctgattcaagaaagcgaaaccttcagaaagaacttggaggaatccctgcatgacaaagagagactggccgaggagatcgagaagctgcgcagcgagctggaccagcttaagatgaggactggttctttaatcgagcccactattcctcgaacacatttggacacctctgctgagctccgatattcggtgggttccctggttgacagtcagtctgactacagaactacaaaggtcatacggagaccccgcagaggacggatgggtgtaagaagagacgaacccaaggttaaaagtcttggcgaccacgagtggaacagaactcaacagatcggggtgctgagttcccatcctttcgaaagtgatacagagatgagcgatatagatgacgatgatagagaaaccatcttctcttccatggacttgctgtcacctagtgggcatagtgacgctcagacactcgccatgatgctccaggaacagctggacgcaattaacaaagagatccgcctgatccaagaggaaaaggaaagcacagaattgagagcggaggaaatcgaaaatcgggtggccagcgtttcgctggagggactcaacctggctcgggtacatcccgggacctctattacggcttcggtgacggcaagttccctcgcatcatcttctccgcctagcggtcattcgacaccaaagttgacccctcggtccccagcgcgcgagatggaccgcatgggggtgatgaccctcccttcagatctcaggaaacacagacgcaagattgcagtggtcgaagaggatgggagggaggataaggcaacaatcaagtgcgagacaagtcccccacccacgccacgcgcccttaggatgacgcatacattgccctcaagctatcacaatgatgctagatcaagcctgagcgtctctcttgaacctgagagtttagggctaggatccgccaatagctcacaggactccctgcacaaagcccccaagaaaaagggaatcaaatcctcaattgggaggctttttggtaaaaaggagaaggcacgattggggcagctgcgtggcttcatggaaaccgaggcggccgcacaggaatcgctgggccttggtaaacttggaacccaggctgaaaaggatcggaggctgaaaaaaaatacaagcgggcatgagcttctcgaagaagccaggaggaaggggctcccgttcgcacaatgggatggtcctaccgtggtggcctggctggagctctggcttggcatgcccgcatggtacgttgccgcttgtcgggctaatgtgaaatcaggagcaatcatgtccgcactgagtgacactgagattcaacgcgaaatcgggatcagtaacccgctgcaccgcctaaagcttaggcttgccatccaggagatggtgtcactcactagcccctcagcaccccctacgagtcggacacccagtgggaatgtgtgggtgacccatgaggaaatggagaacctagctgcccctgctaaaactaaagagtcagaagagggctcctgggcgcagtgtcccgtttttcttcagaccttggcctatggggacatgaatcacgaatggattggtaacgaatggctgcctagcctcggactgccccagtacagatcttacttcatggaatgtttagtcgacgcccgtatgcttgatcatctgaccaaaaaagacctgagggtgcatctgaagatggtagacagctttcaccgtaccagtctccaatatggtattatgtgtctcaaacggttgaattacgataggaaggagctcgaacgccggcgcgaagccagtcagcatgagattaaagacgtgctcgtgtggagcaacgaccgtgtgattcggtggattcaggcgattggcttacgcgagtatgccaataatatactggagtcgggggtgcacgggtccctcattgcacttgatgagaattttgattatagctccctggccctcttgctccagatacctacccagaatacccaggcacggcagattctggagagagagtacaacaacctgcttgcactcggtaccgaaagacgtctagatgaaagcgatgacaagaacttccgaaggggttccacatggcgaaggcagtttccaccaagggaagtacacggcatctcaatgatgccagggtccagtgagacactccccgcaggcttccggctgaccacaacgagcggccagtcccggaagatgaccactgatgacggagtgtttagcgtgtacagcacttag

SEQ ID NO: 45189 - DNA, 3633 bp, Artificial Sequence
  Description of Artificial Sequence: Synthetic coding sequence
atgatgtgcgaggtgatgcccaccatcaacgaggacacccccatgtcacagaggggcagccaatctagcggtagtgacagtgattctcactttgaacagctcatggtgaacatgctagacgagcgtgatcgcctgctcgacaccctgcgtgaaacgcaggagtccctatctctcgcacagcagaggctccaggatgtcatctacgaccgggattccctgcaaaggcaactcaactccgccctgccccaggacatcgagagtctgaccggcgggcttgccgggagtaagggcgccgatccccccgaattcgccgctctgacgaaagagctaaacgcttgtcgcgagcagttgctcgagaaggaggaagagataagtgagctgaaggccgagagaaataacactaggcttctgctagagcaccttgaatgtctggtgagcaggcacgagcggagtctgcgaatgacagtggtcaagcgccaggcccaatcaccctccggagtttctagtgaggttgaagtcctgaaggcacttaaaagcttattcgaacaccataaagcattagacgaaaaagtccgagaaagactgcgggttagccttgagcgagtgagcgcgctagaagaagagcttgcggcagccaaccaagagattgtggctcttcgcgagcagaacgtgcatattcagcgcaagatggcctctagcgaaggaagcactgagtccgaacacctggaaggcatggaacctggacagaaagttcacgagaagaggctgtctaatggcagcatcgatagcactgacgagacttctcagattgttgagctgcaggaattgctggaaaagcagaattacgagatggctcagatgaaggagagactcgctgcactctctagccgggtgggagaggtagagcaagaggctgagactgcgcgaaaagacctgattaagaccgaggaaatgaatacgaagtaccagcgtgacattcgggaggctatggcccagaaagaggatatggaggagcgaattacaacactcgagaagagatacttgtcggcacagcgagaatccacatccatccacgacatgaacgacaaattggagaacgagttggcgaacaaagaggccatcttaagacaaatggaggagaaaaacaggcaactgcaagagaggttagagctggccgagcagaagctccagcaaacaatgcggaaggctgaaaccctcccggaggtagaggcggagttggctcaacggatcgcggctctcactaaagccgaagaaagacacggcaatatcgaggagagaatgcgccacctcgaagggcagttagaggagaagaatcaggaattgcagcgagcccggcagagagaaaagatgaatgaagaacacaataaaaggttgtctgatacagtggatcgcctgctgacagagtctaacgagagactgcagcttcatctcaaagaaagaatggccgcactggaggagaagaacgtgctgatacaggagtcggaaacttttcgcaaaaatctggaggaaagtctgcatgataaggagagactggcagaggagattgaaaaactgcggtctgagctggatcaactgaagatgagaactggtagccttatcgagccgacaatccctaggacacatctggatacttcagcagagctgagatatagtgtggggtctcttgtcgacagtcagtctgactaccgaacaaccaaggtgataagaaggccccgtaggggcagaatgggcgtcaggcgagacgaacccaaagtaaagagccttggcgaccacgagtggaataggacacaacagataggagttctttctagccaccctttcgagagtgatactgaaatgtctgacatagatgatgatgacagggaaacgattttcagcagtatggatttgctgtctcccagtggccactctgacgctcagacactggccatgatgctgcaggaacagctggacgcaatcaacaaagaaatccgcctgattcaggaggagaaagagtctaccgaattgcgtgcagaggagatcgaaaatcgcgttgcgtctgtgagcctggaagggctcaacttggcccgcgtccaccccggcaccagcatcaccgcatctgtcacggcctcctcgctagcctcttcaagtccaccatctgggcatagcacacccaagttgacccctaggagcccggcccgggagatggacaggatgggagttatgactctgccgtctgacttacgtaagcaccggcggaagatcgctgtggttgaggaggatggcagagaggataaggctactatcaagtgtgagacgtctcccccacccacacctcgagctcttaggatgactcatactctgccaagtagttatcacaatgatgccagaagtagcctcagcgtgtcattggagcccgagtctctgggattggggtcagcaaacagctcgcaggattcgctccataaggctcccaagaaaaagggcatcaaaagcagtatcggtaggcttttcggcaaaaaagagaaggcaaggctgggacagctgagaggctttatggagaccgaagctgcagcccaagaaagcttgggcctagggaagctaggaacgcaggctgaaaaggaccgtcgcttaaagaaaaaacatgagctactggaggaggctagaaggaagggactgcccttcgctcagtgggacggacctacagttgttgcttggctggagctctggttaggcatgccagcatggtatgtggccgcctgtcgagcaaacgtgaagtccggggctatcatgtctgcgctgtccgacaccgagattcagcgggagattggaatttcgaaccccttacatagactgaagctgagactggccattcaggaaatggtgtccctgaccagccccagcgcaccacccacctcccgtactccatctgggaatgtgtgggtcacacatgaggagatggagaacctcgctgcccccgcaaagacaaaggagagcgaggagggctcatgggcccagtgtccagtattcctgcagaccttagcatatggagacatgaaccacgagtggatcggtaacgaatggttaccaagtctgggccttccgcaatacaggtcctactttatggagtgcctcgtggatgcacgaatgctggatcacctgacaaagaaggatttacgcgtgcatctgaagatggtagatagcttccatagaacctccttgcagtacggcattatgtgcctgaagagactcaactacgacaggaaagagttggagcggcggagagaagctagccagcacgagattaaggacgtgctggtttggtccaatgacagagtcatccgatggatccaggcaatcggactcagggagtacgccaacaatatcctcgagtccggggtgcacggctcacttatagccctcgatgagaactttgactattcaagcctggcactgctactgcagatccccacacaaaacactcaagcctctcgcttcctgaaagagaacacgattactagctggccttgggagcttaagggagactggatgaaagtcatgacaagaaccagcgacgtagatcagccaggcgaaggaagctttctccttgtgaagtatatggagtccgcttag

SEQ ID NO: 45190 - DNA, 3711 bp, Artificial Sequence
  Description of Artificial Sequence: Synthetic coding sequence
atgatgtgcgaggtgatgcccaccatcaacgaggacacccccatgagccaaagggggagccagtcatcaggatccgactccgacagccacttcgaacagctcatggtgaacatgctggacgaaagggacaggctgttggacaccctcagagagactcaggagagtctaagtctggctcagcagcggctccaggatgtgatatacgatagggactccctgcaacgccagcttaatagcgcgctgccacaagatattgagagtctgaccggaggcctggccggctctaagggcgccgatcctcccgagttcgcagccctcaccaaagaactaaacgcctgtcgcgagcagttgcttgagaaagaggaagagatttctgagctgaaggcagagcgaaataatacacggctcctactggaacatctagagtgcctcgtgtctcgccacgagcggtctcttcgcatgacagtcgtcaagaggcaggctcagtcaccctctggggttagcagtgaagtggaagtgttgaaggctctcaaaagcctgtttgaacaccacaaggccctggatgagaaggtccgggaacggctgcgagtgagtctagagagagtgtcagcacttgaggaagagctggctgccgcaaatcaggaaatcgtagccctgagggagcaaaacgtgcatatccagcgtaagatggcctcctcagaaggctcgactgagtctgagcacttggagggcatggaacccggccagaaggtgcacgagaaacggctaagcaatgggagcattgattcgaccgacgagacatcacaaatagtcgagctccaggagttgttggagaagcagaactacgagatggcccaaatgaaagaaaggctggctgccttatcttcaagggtcggggaggtcgaacaagaagccgagaccgcccggaaagatctgatcaaaaccgaggaaatgaatactaaatatcagagagacatcagagaggccatggctcaaaaggaggacatggaggagcggattactacactcgaaaagagatatttatctgcccaaagagagagtacctccattcatgacatgaacgataagcttgaaaatgaactggcgaacaaagaagctatcctccgccagatggaggagaaaaacagacaactgcaggagcggctcgagttagctgagcagaagcttcagcagacaatgcggaaagctgagaccttacccgaagtggaggctgagctggctcaacggattgcagcccttacaaaagcagaagagcgtcatggaaacatagaggaacgtatgcggcacctggagggccagctcgaggaaaaaaaccaggagcttcagcgcgctaggcagagagagaaaatgaatgaggaacataacaaaaggctgagcgacacggtcgaccgattactcacagaaagcaacgagaggcttcagctgcacttaaaagaaaggatggccgccctcgaggagaagaatgtcctgatccaggaaagcgaaacttttaggaaaaacctggaggagtctctgcatgacaaggagcgcctcgccgaagagatagaaaagctcagaagcgaacttgaccagcttaagatgcggaccggctccctcattgagcccacaatcccaagaacccatctggacacctcagcagaactcagatactctgtcgggagcctggtagatagtcagtccgattatcgcaccactaaggtgatccggaggcctcggagggggcgaatgggtgttcgaagagacgagcctaaggtcaagagtctaggggaccatgagtggaaccggactcagcaaatcggtgtattgagttctcaccctttcgaatccgacactgaaatgagtgacatagacgacgatgacagggagactattttttcatccatggacctgttgtcccctagcggacattccgacgcccagaccctggcaatgatgcttcaggaacagcttgatgctattaataaagaaattcggcttattcaagaggaaaaggaatctactgaactccgagctgaggaaatagaaaatcgggtagcaagtgtttccctggaaggattgaatctggcccgcgtccaccctggaacatcaataacagcctctgttacggcgtcatcgcttgctagttcctctcctccctctggccatagcacccctaaactgaccccccgcagccctgctcgcgaaatggaccgtatgggagtaatgactttaccttctgacctaagaaagcacaggcggaaaattgctgtggtggaggaagacggtcgagaggataaagccaccataaagtgtgagaccagcccgccccccacaccgcgcgcattgcgcatgacacataccctaccttctagctaccataacgacgctagaagcagtttaagtgtttctcttgaacctgagtccttgggcctgggctctgctaatagcagtcaggacagcctgcataaggcccccaagaaaaaggggataaaatccagtataggccggttattcggaaagaaggagaaggccagactgggacagctgcgcggctttatggagaccgaagctgcagctcaggagtcgcttggactggggaagctgggcacccaagccgaaaaagatcgacggttgaaaaagaaacacgaattattggaggaggccagacggaagggtctgcccttcgctcagtgggatgggccaaccgtggtcgcttggctcgagctatggctgggcatgccagcgtggtatgtggccgcctgccgagcgaatgtgaaaagcggggcgataatgtccgccctgtccgatacggaaattcagagagaaatcggaatatccaatccattgcaccgcttaaagttaaggctggccattcaggaaatggtctcgctaacaagtccatcagcacctcctaccagccggaccaaggaatcagaagaggggagttgggcgcaatgccctgtctttttacagactctagcttatggtgacatgaaccacgaatggattggaaacgagtggctcccctcccttggacttccccagtaccgctcttatttcatggagtgtctggtggatgctcggatgcttgatcatctgacaaagaaggacctgcgtgtgcatttgaagatggttgactctttccaccggaccagtctgcagtacgggattatgtgccttaaacggcttaactacgaccgcaaagaactcgagcggagaagggaagcttcacagcacgagattaaggacgtgctggtttggtcaaacgaccgggttatccggtggattcaggccattggcctgcgcgaatacgctaataacatcctggagtcaggcgtccatggctctctgattgccctggatgagaattttgactattcatccctggctctcctgttgcagattcccacccaaaacacccaggcccggcaaatcctggagagagagtataataacctgctagccctggggaccgaacgaagacttgacgagtcggatgacaagaattttagacgcgggagtacctggcggaggcagtttcccccacgcgaggtgcacggcatcagcatgatgcctgggtccagcgaaactcttccagccggatttaggcttaccaccacttcagggcagagtcgaaaaatgactaccgacgtcgcctcatctagacttcagcggctggacaactcaacggttcgcacgtactcttgttag

SEQ ID NO: 45191 - DNA, 1638 bp, Artificial Sequence
  Description of Artificial Sequence: Synthetic coding sequence
atgcagagcatcagcaagcagaccctgcagatggacgtgaacaagctcaatataactctgctccgcatctttcgccaaggcgtagctgcagccctgggcctattgccccagcaggttcacatcaatcggcttatcggaaaaaagaatagcattgaactgtttgtcagcccaatcaatcggaagactgggatctcagatgctttgccgagcgaggaggtgctgcgctccctgaacatcaatgtcctgcatcagtcactaagccagttcgggattactgaggtgagtccagagaaaaatgtgctacagggtcaacacgaggccgacaaaatctggtcgaaggagggattctacgcagtcgtaatctttctctccatcttcgttattatagtgacttgcctcatgatcttgtaccgcctgaaagaaagatttcagcttagcctgcgtcaagacaaggagaaaaatcaggaaatccacctctcaccgatcaccttgcagccagctctgagtgaagccaaaacagtccactcaatggtgcaacccgagcaggcaccaaaagtgctgaacgtcgtagttgacccccaggggcggggcgccccggaaattaaggctacaaccgccacttctgtgtgtccaagtccttttaagatgaaacctattggattacaggaaagacggggaagtaacgtgagcctgacactggacatgtccagcctcggaaatatcgaaccattcgtgtcaatccctacccctcgcgagaaagttgccatggagtacttgcaaagcgccagccgtatactgactagaagtcagcttcgcgatgttgtcgcgtcctcccatctgcttcaaagcgagttcatggagatcccaatgaacttcgtggaccctaaggagatcgacattccaaggcacggcactaagaatcgttataagacaattctgcccaaccccctaagccgggtctgtctgcgcccaaagaacgtcactgacagtctgagcacgtatattaacgcaaattacattcgaggttacagcggaaaagagaaggctttcatcgccacgcaaggtcccatgatcaacactgtagacgatttctggcaaatggtgtggcaggaagactccccagtcattgtcatgatcacgaagctgaaggaaaaaaatgagaagtgtgtgttgtactggccagagaaacggggaatttatggtaaggtcgaggtgctggtgatttctgtaaatgagtgtgataattacactatccggaatttagttctcaagcaaggttcccacacccaacatgtcaagcattactggtatacctcatggccagatcacaaaacccccgacagcgcccagccactgctgcagcttatgttagacgtcgaggaggaccgcttggccagtcagggacgcggccctgtggtggtccactgttccgccggcatcggtcgaacaggctgcttcatagccacctccataggttgtcagcaattgaaagaggagggcgtggtggacgccttgtcgatcgtctgtcagctgaggatggatcgtggagggatggtgcagacctcggaacagtacgaatttgttcaccacgccctgtgcctctacgaatcccgcctgtcagcggagaccgtgcagtag

SEQ ID NO: 45192 - DNA, 606 bp, Artificial Sequence
  Description of Artificial Sequence: Synthetic coding sequence
atggccgccaccgccctgctggaggccggcctggcccgggtgctgttttatcccactttgctctataccctctttaggggcaaggtcccagggcgggctcaccgagattggtaccaccgaatcgatcccacagtacttctgggcgccctgcccttgcgctcactgacgcggcagctggtgcaggacgagaacgtcaggggagtgattactatgaatgaagaatatgaaaccagattcttgtgcaatagtagtcaagagtggaaacggcttggcgtcgagcagctcaggctttccactgtggacatgacaggaatccctacactcgacaaccttcaaaaaggagtgcaattcgccctaaaataccagtcattaggtcagtgcgtttacgtgcactgcaaggccggaaggagcagaagcgccaccatggtggcagcctacttaatacaagttcacaaatggagcccagaggaagcagttcgggctatcgccaaaatccggtcctatattcacattcgtcctggtcagttggacgtcctgaaagaatttcacaagcagattactgcgagagctacaaaagacgggacgttcgtcatctctaaaacctag

SEQ ID NO: 45193 - DNA, 2280 bp, Artificial Sequence
  Description of Artificial Sequence: Synthetic coding sequence
atggccggcagcaagcagagccaccaggaggccgtgaagcggcacctgtactttcttcagcttaagatggacatatgcgaaggaaggttgacctgtcccctcaactcggctgtcgtgctggcatcctacgccgttcaaagtcactttggcgattacaacagcagtatccaccaccctggttacttatctgattctcactttataccggatcaaaacgaggacttcctgaccaaggtcgaatctttacacgagcagcacagcggtcttaagcagagcgaggcagagtcatgttatattaacatagcacgcacgctcgacttctacggggtcgaactgcattccggccgggatctccacaacttggacctcatgatcggcatagcgagtgcaggggtggccgtataccggaaatacatctgtacaagtttttatccatgggttaatattcttaagatctcattcaagcgcaaaaagtttttcattcaccagcggcagaaacaggccgaatcgagagaacacattgtagcctttaatatgctgaactaccgaagctgcaaaaacttgtggaagtcctgtgtcgaacatcatacgttctttcaagctaagaagctgctaccccaggagaagaatgttctgtctcagtattggaccatgggttctagaaatactaagaagcggtcaccgcgccttcggcacgaaatacgaaaacctcggcatagttccgccgacaacttggctaacgagatgacatatatcacagaaacagaggatgtcttctacacctacaaaggctctctcgctccacaggactctgacagtgaggtgtctcagaaccgtagcccccaccaggagagcctgtctgaaaataacccagcccaatcatacctaacccagaagtctagttcctccgtgtctccatctagcaacgccccagggagctgcagtcctgatggcgtggatcaacagcttctggatgatttccacagggtcacaaaaggaggatcaaccgaggatgcctcacaatactactgcgataaaaacgacaacggggattcctacttagtgttaatccgtattacacccgatgaggatgggaaattcggatttaatcttaaagggggagtggatcagaagatgcccctcgtagtatcccggattaaccccgagagccctgctgacacttgtataccgaagctgaacgaaggggatcagatcgtccttataaacggtcgagatatctcagagcacacacacgaccaggtggttatgttcattaaggcttccagggaatcacacagcagagaactggctttagtgattaggcgaagggccgtgcggtccttcgccgacttcaagagcgaagatgaactgaaccagcttttcccagaggctatctttccaatgtgccctgaaggaggggatacacttgaaggatccatggcgcagctaaagaaaggcctggagagcggcacagtgttgattcagtttgaacagttgtacaggaaaaagccaggtctggctattaccttcgccaaactgcctcagaacttggataagaatcggtataaggatgtgctgccctatgatactacgcgcgtgcttctgcaggggaatgaggattatattaacgcaagctacgttaacatggagatcccagccgcaaacctggtgaacaaatacatagcgacacagggaccactgcctcacacctgcgcccagttttggcaagtggtgtgggaccaaaaactcagtcttattgtgatgttaactacactgaccgagcggggaagaaccaagtgccaccagtactggccagatccgccggacgtgatgaaccatggggggttccatatacagtgccaatcagaggactgtacgatcgcatacgtttcaagggaaatgctggtgaccaatacccagaccggagaggaacacaccgtgacacatttacagtacgtcgcttggccagatcacggcgtccctgatgacagctcagactttctggagtttgtaaactacgttaggtcactgagagttgacagcgaaccggtgctggttcactgcagcgctggcatcgggcgcaccggagtgctggtgactatggagactgctatgtgtcttaccgagagaaatcttccaatatatcctctggacatcgtgcgcaagatgagggaccaaagagcaatgatggtccagactagctctcagtataagtttgtgtgcgaagcaattcttagagtttatgaagaaggacttgtgcagatgcttgacccaagttag

SEQ ID NO: 45194 - DNA, 2742 bp, Artificial Sequence
  Description of Artificial Sequence: Synthetic coding sequence
atgaccagccggctgcgggccctgggcggccggatcaacaacatcagaacgagcgaattgcccaaggaaaaaaccagatcggaggtcatttgctcgatccactttctggacggcgtcgtgcagacctttaaggtgaccaagcaagacactggacaggttctcctggacatggtgcacaaccacctaggcgtgaccgaaaaggagtatttcggcttgcagcatgatgacgactccgttgattcacccagatggttagaggcgagtaaagccattagaaagcagctgaaaggtggcttcccttgtactcttcatttcagggtaagattcttcatccccgaccctaacactctccagcaggagcagacaaggcatctgtattttctccaactcaaaatggatatatgtgagggcaggttgacgtgtccactgaactccgcggttgtgctggcaagctatgcagtgcagagtcattttggggactacaatagcagtattcaccatccaggttacctttccgactcccatttcatacctgaccagaacgaggactttctcactaaggtggaatctttgcacgagcaacatagcggactgaagcaatctgaggccgagtcatgctacataaatatcgcaaggacattggatttctacggcgtcgagctccatagcggccgggacttacataacttggacctgatgatcggcatcgcatcagcaggagttgctgtctatcggaagtatatttgtacatccttttacccctgggtgaacatcctgaagatttccttcaaacggaaaaaattcttcattcaccagagacagaagcaagctgagtccagagagcatatcgtcgcattcaacatgctcaactatcgctcatgtaagaatctctggaagtcatgtgtggaacaccacactttctttcaggcgaagaagcttcttccccaggaaaagaacgtgctgagtcagtactggacaatgggcagccgaaacacaaagaagtcagtcaataaccaatactgtaagaaggtgatcggggggatggtgtggaacccggccatgcggaggtccctgtccgttgagcatctggagaccaagtccctacccagccgaagccccccaatcacgccaaactggcgctctcctcgcctgcgccacgaaattcggaagcccagacactcatctgccgataacctggctaatgagatgacttacattaccgaaactgaagacgtattttacacgtataaaggtagtttggcccctcaggattcagatagcgaggtgtcacagaaccggagcccgcatcaggaatccctgtctgagaacaatccagcccaatcctatttgacgcagaagtcttcatcctccgtgagcccctcgtctaatgcccccggcagttgttcacccgatggagttgatcaacagctgctggatgattttcatcgagtgaccaaaggcggatctaccgaggacgcatcacagtattattgcgacaaaaatgataacggtgattcctacctggtgctgatacgcattactcccgatgaggacggaaaattcggcttcaatctcaagggaggagtcgatcagaagatgccgttagtggtgagccgcatcaatcccgaaagcccggctgatacctgtattcccaagttgaacgaaggcgaccagatagttctcataaacggccgcgacataagcgaacacacacacgatcaggttgttatgttcattaaagctagccgggagtctcatagtcgcgagttggctctggtcattcggcgtcgggccgtgcgcagttttgcagacttcaaatctgaggatgaactcaaccagctgttcccagaagctatctttcctatgtgtccagagggcggagacacactggaaggtagcatggcccaactgaagaaagggctggagagcggaaccgtgctaattcagttcgagcagctgtaccgtaaaaaaccggggctggctattaccttcgctaagctccctcaaaatctggacaaaaatcgctacaaggacgtgttgccttatgacaccaccagggtgttactgcaggggaatgaagactatataaacgcttcttacgtgaacatggagataccagccgcgaatctggtgaataagtacatagccacgcagggtcctctgcctcatacctgcgcacagttctggcaggttgtttgggatcagaagctcagtctgatagtcatgctgacaacgctcacagaaagaggaaggactaagtgtcaccagtactggcctgatcctccggatgttatgaatcacggggggtttcatatacagtgtcagtccgaggattgtacaatagcttacgtatctcgagagatgctggttaccaacacccagactggtgaggagcacacggtgacccacctgcagtatgtggcctggcctgatcatggtgtaccagatgactcatccgatttcttagaattcgtgaactacgtccgcagcctgagagtggattccgagccggtactggtacattgctctgccggcattgggcgaactggagtgctggtgacaatggagactgctatgtgcctgacggagaggaacctgcctatctatcccctcgacattgtcaggaagatgagggaccagcgcgctatgatggtgcagacctctagccagtacaagttcgtgtgcgaggctatacttagggtttacgaagaaggccttgttcagatgctggatccaagctag

SEQ ID NO: 45195 - DNA, 1146 bp, Artificial Sequence
  Description of Artificial Sequence: Synthetic coding sequence
atgcccctggtggtgagccggatcaaccccgagagccccgccgacacctgtataccgaagttgaacgaaggagatcagatcgtactcatcaacggccgggatatctcggagcatacccacgaccaggtggtgatgtttatcaaggctagccgggagtctcatagccgggagctggcgctggtgatcaggaggagggctgttaggtctttcgctgacttcaagagcgaagacgagctgaaccagctttttccggaggctatcttccctatgtgccccgaagggggagacacacttgaagggtccatggctcagctgaaaaagggactggagtccggaaccgtcctgatccagtttgagcagttatatcggaaaaagccaggccttgcaatcacattcgctaaactgccccagaatctggataaaaaccggtacaaagatgtactgccatatgacacaaccagggtgctgcttcaaggaaatgaagactacatcaatgcatcgtacgtgaatatggaaatcccggccgccaacctcgtgaacaagtatatcgctacacagggtcctctgccccatacatgtgcacaattctggcaggtcgtttgggatcagaaactgagcttgatcgtcatgctgaccacactgaccgagagagggcggactaaatgccatcaatattggcccgatccaccggacgtaatgaaccatggcggatttcacatccagtgtcaatccgaggattgcaccattgcctatgtgtctagggaaatgctggtgacaaacactcagaccggggaggagcatacagtgacgcacctgcagtacgtggcctggcccgatcatggagtacccgacgactcctccgactttttggagtttgtcaactatgtccggagccttcgcgtcgattcagagcccgttctggtacattgttctgccggaattggaaggactggagttttggtcaccatggagacggccatgtgtctcaccgaacgtaatttgcctatttatccgctggatatcgtgagaaaaatgagagaccagagggcaatgatggtgcagacgagctctcagtataaattcgtgtgcgaagctatattgagagtttacgaggagggtctagtacagatgttggatccttcatag

SEQ ID NO: 45196 - DNA, 2742 bp, Artificial Sequence
  Description of Artificial Sequence: Synthetic coding sequence
atgaccagccggctgcgggccctgggcggccggatcaacaacatccggacttccgagcttccaaaagagaagaccagatccgaagtgatatgctctatccactttcttgatggagtggttcagacctttaaggttacgaagcaggacaccggacaggtcttgctcgatatggttcacaaccatctgggcgttactgagaaagaatacttcggcctgcagcatgacgatgacagcgtcgactcaccccgctggttggaagcaagcaaggctattaggaaacagttgaagggcggatttccctgtactttacatttcagagtccgattttttatacccgaccccaacacgctccaacaggagcagacacgtcatttatatttcctgcaactgaagatggacatctgtgaaggccgcctgacctgccccttgaatagtgctgtcgtgctggctagctatgcggtgcagtcacattttggagattacaattcctctatccaccatcccgggtatctctcggatagccactttataccagaccagaacgaggattttctgacaaaggttgagtctctgcatgaacagcattctggcctgaaacagagcgaggcagaatcctgctatatcaatattgctagaacactggatttttacggggtggagcttcacagcggaagagacctgcataatctagacctgatgatcggaatcgcttcagccggagtagccgtttacaggaagtacatctgcaccagcttttacccttgggtgaacatcctcaaaatctcctttaagaggaaaaaattctttatccaccagcggcaaaagcaggcagagtcacgtgagcatattgtggcatttaacatgcttaactatcgctcgtgcaagaacctttggaaatcatgcgtcgaacatcatacattcttccaagccaaaaaactgttgccacaggagaagaacgtgcttagtcaatactggacgatgggtagccgcaatacaaaaaaatcagttaacaaccagtactgcaagaaagttattggggggatggtctggaatcctgcgatgaggcggtccctgagcgtggagcatctggaaaccaagtcgctgcctagccgttccccccctatcacacccaactggcgctcccctaggctgcgccacgaaatccgcaagcctcgccactcctcggccgacaatctcgcaaatgagatgacttacattaccgaaacagaggacgtgttttatacctataaaggctctttggctccacaggatagtgatagcgaggtcagccagaaccggtccccccaccaggaaagtctctcggagaataaccctgcgcagagttatctcacccagaaatcatccagctcagtctcacctagtagcaatgcgccagggagctgcagccccgacggcgtggatcagcagctgctggacgatttccacagagtgacaaaggggggctccactgaagacgccagccagtattactgcgacaagaatgacaacggagactcttacctcgttctaattaggataacgccagacgaggacggcaagtttgggtttaatctcaagggtggagtggaccagaagatgcctttagtcgtcagccgcattaacccggagtcaccagcagacacatgtattccgaagctgaacgaaggcgatcagattgtgctgattaacgggagggacatatccgagcacacccatgatcaagttgtgatgttcataaaggcatcgagagaaagccactcccgcgagttggccctggtgatcagacggagagcagtacggagctttgcggactttaaaagcgaggacgagctgaatcagctcttccccgaagctatcttccccatgtgtcccgaagggggcgatactctggaagggagtatggctcagctgaaaaagggcttagagtctggaaccgtcctgattcagtttgaacagctttataggaaaaagcctggtctcgcaatcaccttcgctaaacttcctcagaatttagacaagaaccgatacaaagatgtcctgccttacgacacgacgcgtgttctgcttcaaggtaatgaggactacataaacgcatcttatgtgaatatggagatacccgcggcaaaccttgtgaataagtacattgctacccagggacccctccctcatacctgtgctcagttctggcaggttgtatgggaccagaaactctctttgattgtcatgctgaccactcttactgagcgcggcaggacaaagtgccatcagtactggcccgaccccccagatgtcatgaatcatggaggcttccacattcagtgtcagtcagaagactgtactattgcttacgtaagccgcgaaatgctggtgactaacactcagaccggagaagagcacacagtgactcatttgcaatatgtggcctggcctgatcatggcgtccccgatgacagctctgacttcctggagttcgtaaactatgtcaggtctctcagggttgatagcgagccggtcctggttcactgctctgccggaataggacggaccggagtcttagtcaccatggagacagccatgtgccttacagaacgcaatttaccgatctacccgctggacatagtccggaagatgcgtgatcagcgggccatgatggtgcagaccagctcccagtataagtttgtatgtgaggccatcctcagggtgtatgaagaagggctggtgcaaatgttagatccttcatag

SEQ ID NO: 45197 - DNA, 2349 bp, Artificial Sequence
  Description of Artificial Sequence: Synthetic coding sequence
atggacatctgcgagggccggctgacctgccccctgaacagcgccgtggtgctggcctcgtacgctgtgcaaagccatttcggcgactacaacagttcgatccaccaccctggatacctgagcgattcccacttcattcccgaccagaacgaggatttcttgactaaggtcgagagtctccacgagcagcactcgggattgaagcagagcgaagcggagagctgttacatcaatattgcccgaacccttgacttctatggtgtggagctgcacagcggcagggatctccacaacctcgatttgatgatcggcatcgcctcggctggggtggccgtctacagaaagtacatctgtactagtttctacccgtgggtgaacatcttgaagatctcatttaagcggaagaagttcttcatccatcaaaggcagaaacaggcagaaagtcgcgagcacattgtggcgtttaatatgcttaactacaggtcatgtaagaacctctggaagtcatgcgtcgagcatcacaccttcttccaagccaaaaaattactgcctcaggagaaaaacgtgctgtcacagtactggacaatgggttcgcggaataccaaaaagagcgtgaataatcaatactgcaagaaagtgattggcgggatggtatggaatcctgccatgcgccggagcctgtctgtggaacacctcgagactaagtcactgcctagccggtcacccccgattacacctaattggcgctctcctcgcctgcgccacgaaattaggaagccacggcattcgagcgccgacaacctggccaatgaaatgacgtacatcactgaaaccgaggacgtgttttacacttataagggcagcctagccccgcaggatagcgactcagaggtgagccagaaccgatctcctcaccaggaaagcctgtctgagaacaaccccgctcaatcatacttaacgcagaagagtagctcttctgtgtctccttcaagtaacgccccaggctcttgttctcccgacggagtagaccagcagttactggatgattttcatcgggtgactaaggggggttccaccgaggatgcctctcaatactactgcgacaagaatgacaacggcgactcctacctggtgctgatccgcatcactccagatgaagatggaaaattcggctttaacctgaaggggggagtggatcaaaaaatgcctctagtcgtgtcacgtataaatcccgagtcacctgcggatacatgtatccccaagttgaacgagggagatcagatcgtactgataaatggcagggacatcagcgaacacacccatgaccaagtggttatgtttattaaggccagccgggagtcccattccagggagctggcactggtgattagacgcagagcagtgagaagtttcgccgattttaaatctgaggatgagctgaatcagctattcccagaggccatctttccaatgtgccccgagggcggggatacgctggaaggctctatggcacaattgaagaaaggactagaatctggcacagttctgatccagttcgagcagttgtatcgcaagaagccgggattagctatcacatttgccaagcttccacagaatctggacaaaaatcgatataaagacgtgttgccttatgacactaccagagtgctcctacagggcaatgaggactatattaacgcatcttatgtcaacatggagattccagcggcaaacctcgtgaacaaatatattgctacacaggggcctctgcctcacacatgtgctcagttttggcaggtcgtatgggaccagaagctctccctcatcgttatgctgacaactcttacagagcggggaagaaccaaatgccaccaatattggcccgacccgcctgatgtcatgaaccacggcgggttccacattcagtgtcaaagtgaggattgtaccatcgcctatgtgagtagggaaatgttggtcacgaacactcagactggggaagagcacaccgtgacacatctccagtacgttgcctggcccgatcatggagtgcctgacgatagtagcgattttctcgagtttgtaaattacgttagaagtcttcgagtagacagtgagcctgtcttggttcactgctccgccggcattggccgcaccggtgtgctcgtcacaatggagacagctatgtgccttacagagcgcaatttaccgatctaccccctggatattgtccgaaaaatgcgggatcagcgcgcaatgatggttcaaaccagcagccagtacaagtttgtctgtgaagccattttgcgagtctacgaggaaggactagtacagatgcttgacccctcctag

SEQ ID NO: 45198 - DNA, 2214 bp, Artificial Sequence
  Description of Artificial Sequence: Synthetic coding sequence
atggacatctgcgagggccggctgacctgccccctgaacagcgccgtggttctcgccagttacgcagtccaatcccattttggagattataatagctcaattcaccacccaggttacctttcagacagtcactttatacctgaccaaaatgaagattttctcacaaaggtcgaatcgttacatgaacagcattcaggcctgaaacagagcgaggctgaatcctgctacattaacatagcccggaccctggatttctacggtgtggaacttcattccgggagagatcttcataacttagacttgatgatcgggatcgcctcagccggagttgcagtgtatagaaagtacatatgcacatccttttatccttgggtgaatattctcaaaatcagcttcaaacgcaaaaagttttttatccatcagcggcagaagcaagcggagagccgtgaacacatcgtagcttttaacatgctcaactacagatcctgcaagaatctgtggaagtcttgcgtggagcatcacaccttttttcaggcaaagaagctcctcccccaggaaaaaaacgtattatcacagtattggacaatgggaagccggaacacgaaaaaaaggagccctcgcttgagacacgaaattaggaagccccgccactcatccgctgataacctggcaaatgaaatgacctacataaccgaaactgaggacgtgttttacacttacaaaggaagcctggctccgcaggattccgattcagaagtgtcccagaaccggtcacctcaccaggaaagcctaagcgagaataatccagcccaaagctacctcacccagaagagttccagcagcgtaagtccatcgtcaaatgctcctggtagttgttcacctgatggggtggatcaacagttgctggacgatttccatcgagtgactaaaggcggatcgacagaggatgccagccagtactattgtgacaaaaatgataacggcgacagctacctcgtcttgattcggatcacaccggacgaggatggaaaattcgggttcaacctgaaggggggggtggatcaaaagatgccattggtcgtatcaagaataaatcccgagtctcctgctgacacatgtatccctaagttgaatgagggggaccaaatcgtgctcatcaatgggagagatatttctgagcacactcacgaccaggttgtgatgttcatcaaagcttcaagggaaagccactcccgggaattggccctggtcatcagaagacgggctgtgcgatcatttgccgatttcaaaagcgaagacgagttaaatcagttattccctgaggccatattcccgatgtgtcccgagggtggcgacacacttgaaggcagtatggcacagcttaagaagggcctcgagtcaggtacagtgctgatccaattcgaacagctctatcggaagaaaccaggcctcgccatcacatttgccaaactaccccaaaatctcgacaagaaccggtacaaggatgttctgccttacgacacaacgagagtcttgcttcaggggaatgaagattacattaatgcctcctatgtaaatatggagatcccggcagctaacctcgtaaacaaatatatcgctacccaaggtccgcttcctcatacttgtgcccagttctggcaagttgtgtgggatcagaagctgtccctgattgttatgctcactactctgaccgaacgagggcgtaccaagtgtcatcagtattggcctgacccacccgatgtgatgaatcacggaggattccacattcagtgccagtctgaggattgtacaattgcgtacgtaagtcgggagatgctggtgacaaacacacagacaggcgaagaacacacagtgacacatcttcagtatgtcgcatggccagaccatggcgtgcccgacgactcctcagattttctagaattcgtgaactatgtccgaagcctcagggtcgactccgaacccgtacttgttcactgctccgccggcataggtcggaccggggtcctggtaacgatggaaacagcaatgtgcctcaccgagagaaacctgcctatttatccactggacatagtgcgcaagatgagggaccaaagagctatgatggttcagacttcttcgcagtacaaattcgtttgtgaggcaatcttaagggtgtacgaagagggtctagtgcagatgctggatccctcatag

SEQ ID NO: 45199 - DNA, 2781 bp, Artificial Sequence
  Description of Artificial Sequence: Synthetic coding sequence
atgaccagccggttccggctgcccgccggccggacctacaacgtgagagcctctgagttggcccgggatcggcagcatactgaggtagtgtgtaatattcttctgctggacaacacggtccaggcgtttaaggtgaataagcacgaccaagggcaagttctcctcgatgtggtcttcaaacacctcgacttgaccgagcaggattattttgggcttcaactggccgacgatagcaccgataacccccggtggctcgaccccaataagcctatcagaaagcagctgaagcgagggagtccatacagtctgaatttccgggtgaagttttttgtttcagaccccaacaaattacaggaagagtatactcgataccagtacttcctgcagatcaagcaggacattctcaccggccgcctgccctgcccctccaacaccgccgccctgttagcttccttcgccgtccagtccgagctcggcgactacgatcagtctgagaacctgtcaggatacctgagcgactacagcttcatcccaaaccagccccaggattttgaaaaggagattgccaagctccaccagcagcacatcggcctgagtccagctgaagcggaattcaactacctaaacaccgctcgaaccttagagttgtatggcgtggagtttcattacgcacgagatcagagtaacaatgaaatcatgataggcgtcatgtcaggagggatcctgatttataaaaaccgcgttcgaatgaatacatttccgtggttgaaaatcgttaagatttccttcaaatgtaagcaattctttattcagttgagaaaagagttacatgagtccagggagactttgttgggcttcaacatggtgaactatagagcatgcaaaaacctctggaaggcatgcgtggaacatcacacattcttccgactggaccggcccctgcctcctcagaaaaattttttcgctcattactttacgttaggctctaagtttaggtactgtggacgcacggaggttcagagtgtacagtacggaaaagaaaaggccaacaaagaccgcgtttttgctaggtcacctagtaagccactggccagaaagctgatggactgggaagtggtgtcaaggaatagcatttccgacgaccgattagaaacacaatcactgccaagtagatctccacccggcacaccaaaccatagaaactccacctttacccaggagggcaccagactcaggcctagcagcgtgggacatctggttgaccatatggtgcacactagtccaagcgaggtgtttgtcaaccagagatccccaagcagtacacaggctaactccatagttctcgaatcttccccttcacaggagactcctggagacggcaagccaccagccttaccacctaagcaatctaaaaaaaatagctggaatcagatccattattctcacagtcagcaagatctggagtctcacattaatgaaaccttcgatatcccgagttcacctgaaaagccaactcctaatggtggtattccacatgacaacctggtgctcatcagaatgaagcctgatgaaaatggcaggtttggcttcaatgtcaagggtggctatgaccagaaaatgcccgttattgtcagcagagtagctcccggaacacctgctgatctatgcgtcccgaggctgaacgagggcgaccaggtggtgttaattaacggacgcgacattgccgagcacactcacgaccaagttgtcttattcattaaagccagctgtgagcggcactccggagagttgatgcttctggtaagacctaacgccgtgtacgacgttgttgaagagaaactcgaaaatgaacctgactttcagtacatcccagagaaggctcctctagattctgtacatcaggatgatcacagccttagggaatcaatgatccagctggccgagggtctgatcactggcacagtgctcactcagttcgaccaattgtatagaaagaagccaggaatgaccatgtcttgcgccaaactgccacagaacatcagcaagaacagataccgggacatttccccttacgacgctacgcgggtgatcctgaaaggtaacgaagattatatcaatgcaaattacatcaatatggagatacccagctcctctatcataaaccaatacatcgcctgccagggacctctccctcatacttgtaccgacttttggcagatgacctgggaacagggatccagcatggtggttatgcttaccactcaggtagagcggggccgcgtcaagtgccaccaatattggcctgagcccacaggatcttcatcctatgggtgttatcaggtaacatgtcactcagaggagggcaatacagcatacatctttcggaagatgaccttatttaaccaagagaaaaacgagtcccggcctctcacacaaatccagtacattgcttggccagaccatggagtgcctgacgactccagtgatttcttggattttgtgtgtcatgttcggaacaagcgagcgggcaaggaagaaccggtcgtggtgcattgctcagcaggcatcggtagaactggggtgctgatcacaatggaaacagctatgtgtctgattgaatgcaatcagccagtgtatcccttagatattgttcgcaccatgagggatcagagggcaatgatgatccagacaccaagccagtaccggttcgtgtgcgaagcgattctcaaggtttacgaggagggctttgttaaaccgctaaccaccagcactaataagtag

SEQ ID NO: 45200 - DNA, 228 bp, Artificial Sequence
  Description of Artificial Sequence: Synthetic coding sequence
atgaccagccggttccggctgcccgccggccggacctacaacgtgcgggcaagcgagctggccagagatagacagcacacggaagtggtttgcaacattctcctgctggataacaccgtgcaggcctttaaggttaataaacacgaccagggacaagtgctgctcgacgttgtgttcaagcacttagatctcacagaacaagactatttcgggctgcagctggcctag

SEQ ID NO: 45201 - DNA, 486 bp, Artificial Sequence
  Description of Artificial Sequence: Synthetic coding sequence
atgaccagccggttccggctgcccgccggccggacctacaacgtgcgggcaagcgaattggcccgggacaggcagcatacagaggtggtttgtaacatcctactgttagataacacagtgcaggctttcaaggtaaacaaacacgaccagggacaggtgctgcttgatgtggtgttcaagcacctggacctgactgagcaagactacttcgggttgcaattggctgatgattcaactgataatccaagatggctggatcccaacaagccgattcgcaagcagctgaagaagctcctgctcctgatcctgggagggtccccgtattccttaaacttccgagtgaaattctttgtgtcagaccccaacaagctccaggaagagtatactagatatcaatacttcctacaaatcaagcaggatatacttactggacgcctgccttgtccttctaacaccgcagctctgctcgcctcattcgcggtttag

SEQ ID NO: 45202 - DNA, 1680 bp, Artificial Sequence
  Description of Artificial Sequence: Synthetic coding sequence
atggactgggaggtggtgagccggaacagcatcagcgacgaccggctcgaaacccagtcattaccatcccgatcccctccgggtacccctaatcaccgaaacagcacgttcacacaggagggaacgcgactgcgaccctccagcgtcggacacttggtggatcatatggtccacacaagccccagtgaggtttttgtgaatcagaggagtccgagctctacacaggccaacagcattgtcttagagtcctccccaagtcaagagactcccggcgatggtaaacctcccgcactgccccccaagcaaagcaaaaaaaatagctggaatcagatacactactctcactctcagcaggacctggaaagtcatataaacgaaactttcgacatcccctcctccccagaaaagcccacccctaatggtggcatcccccatgataacctggtactgatcagaatgaaaccagacgagaacggccgcttcggcttcaacgtaaaggggggatacgatcagaagatgccggtcatcgtgtcccgagtggcccctggaacccccgcggatctctgtgttccccgcctgaatgagggagatcaagtagttttgatcaacggacgcgacattgccgagcatacacacgatcaggttgtactcttcatcaaggcaagttgcgagcgccactctggtgagctcatgctgctggtgcggcctaatgcggtctatgatgtcgtggaggagaaattggaaaatgaacctgactttcagtacattccagagaaggcgcccctcgattctgtgcatcaagatgatcatagcctccgggaatccatgatacagctggccgagggactcattactggcaccgtgctgacacagtttgatcagctgtatcgaaagaaacctgggatgacgatgtcttgcgctaagctgcctcagaacattagtaaaaatagataccgtgatattagcccctatgacgcaacccgtgtaatcctgaagggaaacgaggactacattaatgccaattacataaacatggagatcccctccagtagcatcattaatcagtacatagcctgtcaggggcccctgcctcacacttgcactgacttctggcaaatgacgtgggaacaggggtccagtatggtggtcatgttaaccacacaggtcgagagagggcgggtgaagtgccaccaatactggcctgagcccacgggaagttctagctacggatgctatcaggttacctgtcactctgaagaaggcaacacagcttatatattccgaaagatgaccctgttcaaccaggaaaagaacgagagccggcctcttacccaaatccagtatattgcttggcccgatcacggcgttcccgacgacagctctgatttcctcgatttcgtctgtcacgtacggaacaaaagagccggtaaggaggaaccagtggtcgtgcattgctcggctgggattgggcggaccggagttctgattacaatggaaacagctatgtgtctaatcgagtgtaaccagcccgtgtacccattagatatcgttcggaccatgcgggatcaaagagccatgatgattcagaccccgtcccagtatcggtttgtgtgtgaagccatattaaaagtctatgaagaaggttttgtgaaacctcttaccaccagcactaataagtag

SEQ ID NO: 45203 - DNA, 3708 bp, Artificial Sequence
  Description of Artificial Sequence: Synthetic coding sequence
atgatgtgcgaggtgatgcccaccatcaacgaggacacccccatgagtcagcgcgggagccagtcaagtggatctgacagtgattcccactttgagcagctcatggtgaacatgcttgacgagcgggataggttgctggataccttgcgcgaaacccaggagtcgctgtcactggcacagcaacgccttcaagacgtgatctatgacagagattcgctgcagcgccagcttaatagcgcgttgccacaagaattcgcggcgctcacaaaggaactcaacgcctgccgtgaacagctcctcgaaaaggaggaagaaatttctgaactcaaggccgaaaggaacaatacccgcctccttctggagcacctggaatgcctggtctcccggcacgagagaagtcttcggatgacggtggtgaaaagacaggcacagtcgccttccggtgtttcgtccgaggtagaggtactgaaagccctcaagtcacttttcgaacatcacaaggcgctcgacgagaaagtaagagagcgtctgagagtgtctctggagcgcgtgagcgctctcgaggaagaattagcagccgcaaatcaagagatcgtcgcactgcgcgaacaaaatgttcacattcagagaaaaatggcatcctcagagggctcaaccgaatccgagcacctggaggggatggagcccggccaaaaagtccatgaaaaacggctcagcaatgggagcatcgatagcaccgatgagacgtctcagattgttgaactgcaagaattgctggagaagcagaactatgaaatggctcaaatgaaggaaagattggccgctctcagcagccgggtgggcgaggtggagcaggaggccgaaacagcccgcaaggatcttattaaaacggaagaaatgaatacaaagtatcaaagggacatcagagaggctatggctcagaaggaggacatggaagagcgtattaccactctggaaaagagatacctttctgctcagcgcgagtctacaagcatacacgacatgaatgataaattggagaatgagttagcaaacaaagaagccatcttaaggcagatggaggagaaaaacaggcaactacaggagcgcctggagctggcagagcagaagctccagcaaaccatgcgaaaggcggagaccctgcctgaagtggaagccgagttggcacagaggattgccgctctaactaaagccgaggaaagacatggaaatatcgaagagagaatgagacatctggaaggccagctagaagagaaaaaccaggaactgcagagggctcgccaaagagagaaaatgaacgaggagcataataaacgtctgagcgatacggtagacagattactgacagagtcaaatgagcgactccagctgcatctgaaggagcggatggccgccctggaggaaaaaaacgtactaattcaggagagtgagacgtttcggaagaacctggaagaatcccttcacgataaggagaggctcgcagaggagatagagaagcttagaagcgaactcgatcagcttaagatgagaacaggctctctgattgagccgaccattcctaggacccacctggatacctctgctgagcttaggtattctgtaggctctttggtcgattcccaatccgattacaggactacaaaggtgatacggaggccaaggaggggaaggatgggtgtcagacgcgatgagcccaaggtgaagtccctcggcgatcacgagtggaatagaacccagcagattggcgtgttatcgagccatcccttcgagtcagacactgagatgtcagatatcgatgacgatgatcgtgagacaattttctccagtatggatctcctcagcccaagtggccacagtgatgcacagaccttagcaatgatgctgcaagaacagcttgatgcaatcaataaggagatccgcttaattcaggaggaaaaggaatccacagagctccgggctgaagagatagagaatcgcgtcgccagcgtgagtctggaaggccttaatctggcacgcgttcaccctgggacctcaattacagcgtctgtgactgccagctcactggcatcaagcagcccacccagcgggcattcaaccccgaagctaaccccaagatctccggcgagagaaatggaccgaatgggtgtgatgactctgccatctgacctgaggaagcataggaggaagattgcggtcgtggaggaagacgggcgagaagataaagccacaattaagtgtgagacaagccctccccccacaccgagagctctgcgcatgacccacaccctgccttctagctaccacaacgacgcgcggtcctcgctgagcgtgagtctcgagcccgagtcattgggcctcggcagtgctaactcaagccaagattccctgcacaaagccccaaagaagaagggcatcaaatcttcaatagggagactgttcggcaaaaaggagaaggctagacttggacagctaagagggttcatggagaccgaggccgctgcccaagagagtctgggtctgggcaagctcggaacccaagctgagaaggatagacgtctgaagaaaaaagttatcaggcacgagctgctcgaagaggctagaagaaagggactcccctttgcccagtgggatggtcccacagtcgtggcatggttggagctatggcttggcatgcctgcatggtatgtggccgcatgcagagccaatgttaagagcggcgcgataatgagcgcattgagcgataccgagattcaaagggaaattggaatctccaacccactccacagactcaagctccggctggctatccaagagatggtgtcccttacatcaccaagcgccccacccacttcacggactccgagtgggaatgtttgggtcacacacgaggaaatggagaatttagcagctcctgccaagaccaaggaaagcgaagaaggatcatgggctcaatgccctgtgtttctccagaccctcgcctacggggatatgaatcacgaatggataggaaatgagtggctccccagtctcggtctaccgcagtacagaagctactttatggagtgtctggtggacgcccggatgttggaccatctgaccaagaaagacctgcgcgtccacctgaaaatggtggattctttccataggaagaagcggacgagtctgcagtacggcatcatgtgtctcaagagacttaactacgatagaaaagagctcgagagacgacgggaagcctcccagcatgagatcaaggacgtactggtgtggtcaaatgacagggtcataagatggatccaagcaataggtcttcgagagtacgctaacaatattctcgaatccggagtccacggtagcttaatcgcccttgatgaaaactttgattatagcagcctggctcttcttctacagatccctactcagaatacacaggctcgtcagatcctggaaagagaatataacaacctgctagctctgggcactgaaagacgactagacgagtctgatgataaaaactttcgcaggggaagcacgtggagacgccagttcccgccaagggaggtgcacgggatcagtatgatgcccgggagtagtgagaccttacctgcaggatttagacttaccacaacatccgggcagagcagaaagatgacgacagacgatggcgtgttttctgtatactccacttag

SEQ ID NO: 45204 - DNA, 3471 bp, Artificial Sequence
  Description of Artificial Sequence: Synthetic coding sequence
atgatcttcagcgacatgaacaccgtgagcggcagccccaaggtgcaccccccaaatggtacaaggttttacacgtttcaagagtttgctgcactaaccaaggaacttaacgcatgtcgggagcaactcctggagaaggaagaagagatcagtgaactgaaagctgaaaggaacaacacccggctgttgcttgagcaccttgagtgcctggtctcccggcatgaacggtcacttagaatgactgtcgttaaacgccaggcccagagccccagtggggtatcttccgaggtggaggtgctgaaagctctcaaatctttgtttgagcaccataaagccctggacgagaaagtgcgggagcgtctccgcgtgtctctggagagggtgtcagccctggaagaagagctcgccgctgccaatcaggagatagtggctttgagggagcagaacgttcacatacaaaggaagatggcatcgagtgagggtagcacagaaagcgaacacctggaggggatggaacctggccagaaagtacacgaaaaacgcttatccaacggctctatcgacagcaccgatgaaacatctcagatagtggagctccaagagcttttggagaaacaaaattatgaaatggctcaaatgaaagaacggctggccgccctctcctctcgggtgggggaagtggagcaggaggctgaaaccgccaggaaggacctgatcaagacggaagagatgaacactaaatatcagcgggatatccgggaggcaatggcgcaaaaagaggacatggaagaacgaattacaacccttgagaagaggtacctgagtgcacaaagggaaagcacatcaattcacgatatgaatgacaagctggaaaatgaactggcaaacaaagaggccatcctcaggcagatggaagagaagaataggcagctgcaggagcggctcgagctggccgaacagaagctgcagcagaccatgcgtaaagcggaaaccctgcccgaggtcgaggcggaactggcacagcgcattgctgcattgactaaagcggaagagcggcacggcaatatcgaagaacgaatgaggcatctggagggccaactcgaggaaaagaaccaggaactgcagagagctaggcagagagagaagatgaacgaggagcataataaacggctgtcagacacagtggatagattgctgaccgagagcaatgagagattgcaattgcacttgaaggagcgtatggcagccttagaagaaaaaaacgtactaatccaggagagcgagaccttcaggaaaaatcttgaggaatctctgcacgataaggagcgactggccgaagaaattgaaaaattacggtctgaactggatcagctcaagatgagaaccggaagcttgatagagcccaccatcccacggacccacctggatacgagcgcagaactccgttatagtgtgggaagtttggtggactctcaatccgattacagaactacaaaggtgatacgacgcccccgacggggcagaatgggggtgcgcagggacgagcccaaggttaagagcctgggcgaccacgagtggaataggactcagcaaattggagtcctgagttcacaccctttcgagtccgacaccgagatgtctgatatcgatgacgacgatagggaaacaatcttcagctcgatggacctcctgtccccaagcggacactcagacgcccagacactggcaatgatgctgcaggaacagcttgatgcaatcaataaggagatcaggctcatccaagaggagaaggagagcaccgaactgagagctgaagaaatcgagaatcgagtagcctccgtatctctggaaggcttgaatctcgcccgcgtgcaccccggtacctcaataacagcatctgtcacagcctcgtctcttgcctcttcctctcccccatctgggcacagcacacctaaattgactcccagaagccctgccagggagatggaccgcatgggcgtgatgactctgcccagcgacctgcgcaaacataggcggaagattgccgttgtagaagaggatggtcgggaggataaggcaaccatcaaatgtgagacgtcaccccctccaacccctagagccctgcgcatgacgcacacgctgccaagcagctatcacaacgacgcaagatcttctctgagcgtatccctggagcccgaaagcctcgggctcgggagcgctaattcctcacaggattctctccataaagcacctaaaaaaaagggcataaagtcttccatcggccggctgttcggaaagaaagagaaggctagactcggacagctgcgggggttcatggagactgaagcagcggcacaggagagtctcggattaggcaaactgggcacccaggcggagaaggatcgcagactgaaaaaaaaacacgagctgttggaggaggcccgaagaaaaggcctgccgtttgctcaatgggatggtccaactgtcgtggcctggctagaactttggctgggcatgcccgcatggtacgtggcagcctgccgggccaatgtcaagagcggagcaattatgagcgctctgtcggataccgaaatacagcgggaaataggtatctctaacccgctgcatcggttgaaacttcggttagctatccaggaaatggtgtcactcacctcaccatctgccccccccacttcccggactaaagaatcagaagaggggagttgggcccagacacttgcgtacggagatatgaatcacgagtggattggtaacgagtggcttccttctctgggtcttccccagtatcgctcctacttcatggagtgtctggtggacgccaggatgttggaccaccttaccaaaaaggacctgagggtgcatttgaagatggtagacagcttccaccgaacctccctgcagtacggcattatgtgccttaaacggcttaattatgatagaaaagaactggagcggcggagggaagccagtcagcacgagattaaggatgtgctggtttggtcaaacgatagggtcatccgatggatccaggcgattgggctcagagagtatgccaacaacatactcgagagcggggttcatggttcgctcattgccctggacgaaaacttcgattactcatccctcgcgctgctcctgcagatccccacccaaaacactcaggcgcggcaaatattagaaagggagtacaacaatctactggctttgggcaccgaaagaaggctcgatgagtctgatgacaagaacttccggcgggggtcgacttggcggcggcagtttccccctcgagaggtacacggcatttccatgatgcccggtagctctgagaccctccctgccggcttccggctcactaccacctccggacagagcagaaagatgactactgatgtggcatcttcccgtctgcagcgtctcgacaatagcactgtgagaacatacagctgctag

SEQ ID NO: 45205 - DNA, 1332 bp, Artificial Sequence
  Description of Artificial Sequence: Synthetic coding sequence
atgacccacaccctgcccagcagctaccacaacgacgcccggagctcgttgagcgtgtctttggagcctgagtcccttgggctgggctccgccaattcttctcaagattcactgcataaggcacctaagaagaagggtatcaagtccagcataggaaggctgttcggtaaaaaagaaaaggcacggctgggccagcttagagggtttatggagactgaggctgctgcccaggagagcctaggcctgggaaaactgggaacccaagctgagaaagataggcgcctgaaaaagaagcacgagctgttggaagaggctcgccgcaagggcctgccctttgcacagtgggatgggcctactgtcgttgcctggctagagttatggttggggatgcccgcatggtatgtggcggcatgtcgggcaaatgtaaagagcggggccattatgtcggctctgagcgacaccgagatccagagggagatcggcatttcaaatcctcttcatcgtctgaagttgcgcctggccatccaggagatggtgagtctcacctcgcccagtgcacccccaaccagtcgtacctgcccagtattccttcagacgcttgcctacggggacatgaaccacgagtggatcggcaatgagtggctgcctagtctggggctcccgcaatacagaagctacttcatggaatgtttggtcgatgctaggatgctggaccatttaacaaaaaaggatcttagagttcatcttaagatggtcgactcctttcacaggaccagcttgcagtatgggattatgtgcttgaagcgcttaaactacgatcggaaagagttagaacgccggcgcgaggcctcgcagcatgaaattaaggatgttcttgtttggtctaacgaccgggtgataaggtggattcaggccataggccttagggaatacgccaacaacattctagagagcggggttcacgggtccctcatcgcgttggacgaaaacttcgactactcttccttggcactcctgctacagatacctacccaaaacactcaggctcgccagatcctggagcgcgagtacaacaacctgctggctctcgggacagaacgccggctggatgagagtgacgacaaaaactttagaagagggagcacttggcgcaggcagttcccaccacgtgaggttcacggtatcagtatgatgcccgggtcttccgaaactctgcccgccggatttcggctgaccacaacgagcggccaatctcggaagatgacaaccgatgtcgcctccagccgcctgcagaggttggataactccactgttcgaacctactcgtgctag

SEQ ID NO: 45206 - DNA, 3783 bp, Artificial Sequence
  Description of Artificial Sequence: Synthetic coding sequence
cggagcaaggaccccaagagccagaccctggccatgatgtgcgaggtgatgcctaccattaatgaggatacgcctatgagccagaggggtagccagagctctggcagtgatagcgactcacacttcgaacaactgatggtgaatatgctggacgaacgagaccgtttgcttgatacactgagagagacgcaggagtctctgtctttagcccaacagcggttacaggacgtgatctatgaccgagacagcttgcagagacaactaaacagtgctctcccccaggacatcgaaagcctgacaggcgggctagcgggctctaaaggagccgacccgcctgaattcgccgccctgaccaaggaacttaatgcttgtagggaacagctgctggagaaggaagaggagatcagcgagctgaaagccgagcgcaataatacacggctgctgctagaacacctcgagtgtctggtatcacgacatgaacggtctctgagaatgactgtggtgaagcgtcaggctcaaagtccttccggcgtgagttcggaggtcgaagtgttgaaggctctcaagagcctttttgagcaccataaggccctggatgaaaaggttagggagcggctgagggtatcacttgaaagagtgtccgcgctggaagaagagctcgccgccgccaaccaagagatcgtggcccttagagaacaaaacgttcacatccaaaggaagatggcctccagcgagggcagtacagagtccgagcatctggagggtatggagccaggacaaaaagtgcatgaaaagcggctcagcaatgggagcatcgacagcaccgatgagacctcacaaattgtggagctccaggaactcctcgaaaaacagaattatgaaatggcacagatgaaagagaggctcgccgcactctcgtccagagtcggcgaggtggagcaggaagccgagaccgcgaggaaggacctgatcaagacggaagagatgaatacaaaatatcagagggacattagggaggccatggcgcagaaggaggacatggaggaacggataactactcttgaaaagcggtacctgtcagcccaacgggagagcacttctattcatgacatgaacgataagttagagaacgaactcgctaataaggaggccatcctgaggcaaatggaggaaaaaaatagacaactgcaggaacgtcttgaactcgcagaacagaagctgcagcagacaatgcgtaaagcagagaccctacccgaggtggaggctgagttagcccaacgcatagccgccttgacaaaggcagaggagcgacatgggaatatcgaagagcgaatgagacacttggaggggcagttagaagaaaaaaatcaggaactacaacgagcaaggcaaagggagaagatgaacgaggaacataacaaaagactttcagacacggtggaccggctgctaacagaatctaatgagcgcctgcagcttcatttaaaggagcgtatggcagctttggaagaaaaaaatgtgctcatccaagagagcgagactttccgcaaaaacttggaggagtccctccacgacaaggaacgactggcagaggagatagaaaagctccgctccgagctggatcagctgaaaatgcgtaccggatcgctaatcgagccaactattccacgaacacatttggacacatcagctgagctacggtactccgtcgggtcattagttgattcccagagtgactatcgaacgacaaaagtgatccggcggcccaggaggggacggatgggggtgcgccgtgatgagcctaaggttaagagccttggagaccacgaatggaatcgcacgcagcagattggagtcctcagctcccacccattcgagtctgacacagaaatgtccgatattgacgatgatgaccgcgaaaccatcttcagctccatggacctgttatccccatctggtcattccgacgctcagacgctggctatgatgctacaagagcagttggatgccattaataaggaaataagattaatccaggaagagaaggagtcgacagagctgcgagccgaggagattgagaacagggtagcctcagtgtcactggaggggctcaatctcgcacgtgtgcacccaggaacatctatcaccgcttccgtcacagccagctcattggcttcatccagccccccaagtggtcattcaactcctaagctcacacctcgctcaccagcccgagaaatggatcggatgggcgtaatgacactaccatcagatctgagaaaacatcggcgaaagatcgccgtagtcgaggaggatgggcgcgaggataaggcaacgattaagtgtgagaccagcccgccaccaactccaagagcgctgagaatgacccacacactgccctcatcctatcataatgatgctagatcttctctgtcagtcagtttggaacccgagtccctcggactcggatctgcgaactccagccaagatagtctacacaaagcaccaaagaagaagggaataaagtctagtatcggaaggttgtttggaaagaaggaaaaggccagactgggccaactccgtggattcatggagacagaagccgcggcacaagaaagtcttggtctggggaagctggggactcaggcggaaaaagatcgaagattaaagaagaagcacgaactgctggaagaggctaggaggaagggcctgccctttgcacagtgggatggacccaccgtggtggcatggctggagctgtggttggggatgcccgcctggtatgtggcagcttgtcgcgctaacgtgaagtctggcgctattatgtccgctctctccgacaccgagattcagagggagatcggcatctctaatccccttcataggctgaagttgcggctagcaattcaagagatggtgtcattgacctctccgagcgctccacccacctcccggacccccagtggtaacgtttgggtaactcacgaggaaatggagaacttggccgctccagcaaagacaaaagagtctgaagaggggtcctgggcacaatgccctgtgttcctgcagaccttggcctacggagatatgaaccacgagtggatcggcaacgagtggttaccaagccttggtctgccccagtatcgctcttatttcatggagtgcctcgtggacgccagaatgttggatcatctgactaagaaggatctgagagtccacttaaaaatggtggactccttccacagaacctccttgcagtacggtatcatgtgcctgaaacgcttgaattacgatcgcaaagagctcgagcgacgcagggaagctagtcaacacgaaataaaagacgttctcgtgtggtcaaatgatagagtgatccgttggattcaggccattggacttcgtgagtacgccaacaacatccttgagtccggggtacacggcagtctgattgcgctggacgagaatttcgattactcaagcctggcactcctgcttcagattcctactcagaacacccaagctaacgctcgtcagattctggagagggagtataataatttgttggcactgggcaccgagcgccggctggatgagagcgatgataaaaatttcagacgaggatctacttggcgccgccagttccctcctagggaggtccatggcataagtatgatgccggggtcgtccgagacgctgccggcaggttttcggctgacgacaactagcggccagtcccgtaaaatgaccacagacgacggggttttttcagtgtactcaacatag

SEQ ID NO: 45207 - DNA, 366 bp, Artificial Sequence
  Description of Artificial Sequence: Synthetic coding sequence
atgatgtgcgaggtgatgcccaccatcaacgaggacacccccatgagtcagagaggtagccagtcttcaggctccgattccgacagtcacttcgagcagctgatggttaacatgttagacgaaagagaccgcctccttgatacactgagggaaacacaggagtccctgagcctggcacagcagcgattacaagacgtcatctatgacagggactctctgcagagacagctgaatagcgccttgccacaggatatagaaagtttaactggagggctggcgggttcaaagggtgcggaccccccagagttcgcggcattaacaaaggaactcaatgcttgtagggagcagctgttagagaaagaatag

SEQ ID NO: 45208 - DNA, 3774 bp, Artificial Sequence
  Description of Artificial Sequence: Synthetic coding sequence
atgatgtgcgaggtgatgcccaccatcaacgaggacacccccatgtcacagagagggtcccagtcgtctggctccgattccgactcccactttgagcagctgatggtgaatatgctggatgagcgtgaccgactgctggacactctgagggagacgcaggagagcttgagtctggcacagcagagactgcaggacgtaatctatgacagggacagtttgcaacgacaactgaattccgcgctcccccaagatatcgaaagtctcactggcggccttgctggttcgaaaggtgccgacccgcccgaatttgccgctctgacgaaagagcttaacgcgtgtcgcgagcagttgctggaaaaagaggaggaaatctcagaattgaaggccgagagaaataacacgcggctgttgctggaacacctggaatgcttagttagccgtcacgagcgctctcttcgaatgactgtggtgaagcggcaggcccagagcccatctggcgtctcctcagaagtagaggtgctgaaggcgttgaaatcactgtttgaacaccacaaggcccttgatgagaaagtacgggaacgactccgcgtatccctggagcgcgtctctgccctggaagaagagctggccgcagcaaaccaggagatagtcgctctgcgtgagcagaacgtgcatatccagcgaaaaatggcatccagcgagggttctactgaaagcgagcacctggaggggatggagccgggacagaaagtgcacgaaaaaaggctctccaatggttccattgactccacggacgaaacatctcagatcgtggaactgcaggagttgctggaaaaacagaattacgagatggcacagatgaaggaaaggttagctgcgttgtcaagccgtgtgggcgaggtggagcaagaggctgaaactgcgcgcaaagatttgatcaaaacagaggagatgaatacaaaatatcagagggatattcgtgaagccatggcccaaaaggaggacatggaggaacggataactaccctcgagaaaagatacctgtccgcacaacgcgagagcaccagcatccacgatatgaacgataaacttgagaacgaactggccaataaagaggcaattctcagacagatggaagagaagaatcggcagctgcaggaaaggttggaactagctgagcaaaaactgcagcagacgatgaggaaagccgaaaccctcccagaagtggaggctgagctagcccagagaatcgctgcactgaccaaggccgaagaacgccacggcaatatagaggagcgcatgaggcatttagaggggcagttggaagaaaagaaccaggagctgcaacgggcccggcagagagaaaagatgaatgaagaacacaataagcggctgagcgacacagttgacaggttacttacagagagtaatgagcggctccagcttcaccttaaggaacgtatggccgctctcgaggagaagaacgtgctcatccaggagagtgagacctttcgaaaaaacctagaagagtccttgcatgacaaagagaggctggcagaggagattgaaaagctgcggtcagagcttgatcagctcaagatgcggaccggatccctcattgaaccaactataccacggacgcatctcgatacctcggctgaacttcgctattccgtgggcagtctggtggattcacagtctgattacagaacgacaaaagtgatccgtcgtccgcgtcgcggaaggatgggagtacggcgcgacgagccgaaagtgaaaagcctgggtgaccatgagtggaaccgcacgcagcaaatcggtgtgctgtcctctcacccctttgagtccgatacggagatgtcagacattgatgatgatgatagggaaacgatcttttctagcatggatctgctttcgccatccggtcacagcgacgctcagaccctagccatgatgctccaggaacaactggatgcaatcaacaaagagatccgactgattcaggaggagaaggagtctactgaactgagggctgaggaaattgagaacagggtcgcaagcgtgagtttggaaggcctgaacttggcccgagttcaccccgggactagtataaccgccagtgtgactgccagtagtctggcatccagttctccgcctagtggtcatagtaccccaaagcttactccaagaagcccggcaagggaaatggaccgtatgggagtgatgacactgccgtctgacctgcggaaacatagacggaagattgcagttgtcgaggaggacggccgagaagacaaagccaccattaaatgcgagactagcccgccaccaacaccccgggcactgagaatgactcataccctcccgagcagctatcacaatgacgcccggtctagcctcagcgtgtctctggagcccgaatccctcggcctggggtctgccaacagtagccaagacagtctccacaaggcacccaaaaagaaagggatcaagtcatccatcggccgtcttttcggtaaaaaagagaaggctcgacttggccaacttcgcgggtttatggaaaccgaggctgcagcacaggagagcctgggtctgggaaagttaggaacacaagctgagaaagatagacgattaaagaagaagcatgagctattggaggaagctaggcgaaaggggctgccctttgcacagtgggatgggccaaccgtggtggcttggttggaactgtggcttggaatgcccgcttggtacgtggccgcctgtcgtgcgaatgtcaagagcggcgcaattatgtcggcactcagcgacactgaaattcagagggagattgggatttcgaatcccttgcaccgcttgaagctgagactggctatccaggagatggtttctttgacgtctccttcagccccacctacttcacgcaccccatcaggaaatgtctgggtaacacatgaagaaatggagaaccttgccgcgccagccaagactaaagagagtgaggagggctcttgggctcaatgtcccgtgttcttgcaaaccctggcgtatggagacatgaatcacgagtggatcggcaatgagtggctgcccagcctgggactgcctcagtaccgaagttattttatggagtgccttgtcgacgcccggatgttagaccatcttaccaaaaaagacctgagagtgcacctgaaaatggtggatagttttcataggacaagtttgcaatatggtatcatgtgtctgaagcggctgaactacgatcgcaaagaacttgagcgcaggcgcgaggccagccagcacgagatcaaggatgtgctcgtttggtccaatgatagagtaattcgctggattcaggccatcggcctgcgggaatacgctaacaacatcctcgaatcgggcgtccatggttccttgattgcgttagacgaaaacttcgactactcttcactggccctgctactgcagatcccgacccagaatacccaggcccggcagatactggaaagagagtataataaccttctcgctctgggtaccgaaaggcggctggacgagtctgacgacaagaatttcagaagaggatccacatggcggcgccaattccctccaagagaggtccatggaattagcatgatgccagggtcatcagagaccctgcccgccggcttccgcctgaccactactagcggccagagtcggaagatgaccacagacgtcgcctcgtctcgtttacaaaggttagacaattcaaccgtgcgtacatacagttgttag

SEQ ID NO: 45209 - DNA, 1974 bp, Artificial Sequence
  Description of Artificial Sequence: Synthetic coding sequence
atgcggcgggccgtgtgcttccccgccctgtgcctgctgctgaacctccatgcggccgggtgtttttccggaaacaacgaccactttctggctatcaaccagaaaaagagcggcaagcccgtatttatatataaacactcacaggatatcgagaaatccctggatatagccccccagaagatctaccgccacagttaccacagcagctcagaggcccaagtttccaaaaggcatcagatcgtcaattcagcctttccccgcccagcgtacgatcccagtctgaacctgcttgcaatggacggccaagatctagaagtggagaatcttccaattcctgcagccaatgtgatagttgtaaccttgcagatggacgttaataaactgaatataaccctgctgagaatcttcagacagggggtggccgccgccctgggcttgctgcctcaacaggtccatatcaaccgcctgatcggcaagaaaaacagcatagaactattcgtttctcccatcaataggaagaccgggatatctgacgccctcccctctgaggaggtgctccgtagcctgaatattaacgttttacaccagtccctctcacaatttggtatcactgaagtcagtcctgaaaagaacgtcctccagggccagcacgaagctgacaaaatctggtctaaagaagggttctatgcagtggtgatctttcttagcatttttgtgattattgtaacttgccttatgatcctctatcgcctaaaggaaaggtttcagctgtcactgaggcaagacaaggaaaagaaccaggaaattcatctttcccctatcacgcttcagcccgcactgtctgaagccaaaaccgtgcacagcatggtgcagccagagcaggccccgaaggtgttgaacgtggttgtagatccacagggacgcggcgcccctgagatcaaagcaacaactgctacttctgtctgtccctcgcctttcaaaatgaagcctatcgggctccaggagcgcagaggctcaaacgtgtctctgacgttggatatgagcagcttgggaaacatcgagccttttgtctcaatccccacaccccgcgagaaggtggccatggaatatctccaatctgctagcaggattcttacacgctcacaactgcgggatgtggtggcttcttcacacctgctgcagtccgagtttatggagattcctatgaactttgttgatccaaaagagatcgacatcccaaggcacggaacgaagaacaggtacaaaaccattttaccaaatcccctttctagggtatgtctgcgcccaaaaaatgtgacggactctctgtctacgtacatcaacgcgaattacattagaggatattccggtaaggaaaaagccttcattgccactcaggggccgatgattaacaccgtggatgacttttggcagatggtttggcaagaggattctccggtgatcgtcatgatcactaaactaaaagagaagaacgagaaatgcgtgctctattggccggaaaagaggggaatctacggtaaagttgaggtgctcgtcattagcgttaacgaatgtgacaattacacaatcaggaatctggtgctgaagcaaggaagccacacacagcatgtgaaacactattggtacacttcatggccagaccataagactccagatagtgcccagccattgttacagttaatgctggacgttgaggaggaccgtcttgcctcacagggccggggtcctgtagtggtacattgttccgcgggtatcgggaggaccggatgcttcatcgcaacatctataggctgtcaacagctcaaggaggaaggagtggtcgatgctttaagcatagtttgtcagctgcgtatggatagaggagggatggtgcagactagcgagcagtacgagttcgtgcaccacgctctgtgcttatacgaatcccgtctgtccgctgaaacagtccaatag

SEQ ID NO: 45210 - DNA, 1356 bp, Artificial Sequence
  Description of Artificial Sequence: Synthetic coding sequence
atgaaccagaagaacgtgctgcagggccagcacgaggccgacaagatttggagcaaagaggggttctacgctgtggtgatcttcctctctattttcgtcattatagtaacgtgcttgatgatcctgtacagacttaaggaaaggtttcagttaagccttaggcaggacaaagagaagaaccaggagattcatctcagtcccattacattgcagccagccctgtccgaagccaagacagtccacagtatggtgcagccagaacaggcccccaaagtgctgaacgtggtagtggatccacagggaagaggggcccccgaaatcaaggcaactaccgccaccagcgtctgcccctcaccattcaagatgaaaccaatcggcctccaggagagacgtggctccaacgtgtccctgacattggacatgagctctcttggtaacatcgaaccattcgtttccattccaactcctcgggaaaaagtagccatggaatacttacaatcggcatctaggattctcacacgcagccagttgagggacgttgtcgcatcctcccatctgctgcagagcgagtttatggagattccaatgaattttgtggatcccaaagaaatagacataccacgacacggcaccaagaaccgttacaaaaccatccttcccaacccgctgagtcgcgtctgcctgcggcccaaaaatgtgactgatagcctctcaacgtacattaatgctaactatattcggggatactccggtaaagagaaagcttttatagccactcaggggccaatgatcaatactgtggacgacttttggcagatggtgtggcaggaggactctcctgtcatcgtgatgatcactaagctgaaagaaaagaacgagaagtgtgtgttgtattggccggagaaacgcggcatttacggtaaagtggaggtattggtgatttccgtgaatgaatgtgacaattataccatccggaatctggtcctgaagcagggcagccatacccaacacgtaaaacactattggtatacttcttggcccgaccacaagacgccagactcagcccaacccctcctacaacttatgctggacgtcgaagaggatcggctggcctctcagggaaggggtcctgttgtcgtccactgttccgctggcattggccgtacaggttgtttcattgctacctctatcgggtgtcagcagctgaaggaggagggggtggtcgatgccctgagcattgtttgtcagctccggatggacaggggcgggatggtgcaaacctctgaacagtatgagttcgtccatcatgctctgtgcctgtatgaaagtcgactttccgccgagacggtgcagtag

SEQ ID NO: 45211 - DNA, 1239 bp, Artificial Sequence
  Description of Artificial Sequence: Synthetic coding sequence
atgatcctgtaccggctgaaggagcggttccagctgagcctgcggcaagacaaagagaagaaccaggagatccatttgagcccgatcactcttcagccagccctcagtgaggcgaaaacagtccattccatggtccaacccgagcaagctcccaaggttttaaatgtggtggtggacccccaaggcagaggtgccccagaaattaaagccaccaccgccacttcagtatgcccatctcccttcaaaatgaagcccattggtctgcaggagcgccgggggtccaacgtgtctttgacactggacatgtcttctctgggtaacattgagccattcgtgtctattcctaccccccgagagaaggtggcaatggagtacctgcagtccgccagccggatccttacccggtcacagctacgggatgtcgttgccagcagtcacctgttgcagagtgaatttatggagatccctatgaacttcgtcgaccccaaagagatcgacatcccacggcacggcacaaaaaaccgctacaagacaattttgccgaaccctctgagccgtgtgtgcttacgacccaagaatgttactgactccctctcaacctatatcaacgcaaactacatcagaggatacagtgggaaggaaaaagcgtttattgctactcaaggccccatgataaacacagtggatgacttctggcaaatggtttggcaggaggactccccggtaatcgtgatgatcactaaactcaaagagaaaaacgagaaatgcgtgctgtattggcctgagaaacgtgggatttatggtaaggtggaggtcctggtaatctcagtcaacgagtgcgataactacaccatccgtaatctcgttctgaaacaagggtcgcacacacagcacgtcaagcattattggtacacttcttggccagaccataagacccccgacagtgcgcagcctttacttcaacttatgcttgacgttgaggaagataggcttgcatcacaggggcgtggtcctgtggtcgtccactgttccgccggaatcggcaggaccggatgcttcatcgccacctctattggctgccagcaactgaaggaggagggagtcgtagatgccttgtctattgtatgccagctgcgcatggacaggggaggtatggttcagacatctgagcagtacgagtttgtacaccatgcactgtgtctgtacgagagtcggctgtctgcggagacggttcagtag

SEQ ID NO: 45212 - DNA, 1239 bp, Artificial Sequence
  Description of Artificial Sequence: Synthetic coding sequence
atgatcctgtaccggctgaaggagcggttccagctgagcctgcggcaggataaggagaaaaaccaggagatccacttgagtcccatcaccctgcagcctgctttaagtgaggccaaaactgtccattcaatggtacagcctgagcaggcccctaaagtgctcaacgttgtggtggatccccagggccgcggtgccccggaaataaaagctactacagccacatctgtatgtccgagccccttcaaaatgaagccgataggactgcaggagaggaggggatctaatgtgtctttgacgttggatatgagctcccttggaaatatcgaaccattcgtgagcatcccgacaccacgcgaaaaggtggccatggagtacctgcaatccgcatccagaattctaacccggagtcagctccgcgacgtagtggcatcgtcacacctgcttcagagcgaattcatggagatccctatgaattttgtggatccaaaggaaattgacattccacggcacggaacaaaaaatcggtataagactatcttgcccaaccctctgagcagagtctgtctgcgaccaaagaacgtgaccgattctctatcaacgtatatcaatgccaattacattaggggctattcaggcaaggaaaaagctttcattgccacacagggtcccatgattaataccgttgatgatttctggcagatggtctggcaagaagacagccctgttatcgtgatgatcactaagctaaaagagaaaaatgaaaagtgcgtattgtactggccagagaagagagggatctatggaaaagtggaggtcctcgtgattagcgtcaacgagtgtgataactataccatccgcaaccttgttttaaaacagggatcccacacacagcatgtcaagcattactggtacacaagctggccggatcacaaaactccggatagcgcccagccactgctccagctcatgcttgacgtggaggaggatcgtctggcatctcaaggccggggtcctgttgtcgtgcactgctccgctggcattggacgcacaggatgcttcatcgctacctccatcggctgccagcaactcaaggaagagggcgtggtcgacgctctgagcatcgtgtgccaactgagaatggacagaggggggatggtgcagacttcagagcagtacgagttcgttcatcatgccctctgtctctacgaaagtaggctgtcagcggagaccgttcaatag

SEQ ID NO: 45213 - DNA, 597 bp, Artificial Sequence
  Description of Artificial Sequence: Synthetic coding sequence
atgatcctgtaccggctgaaggagcggttccagctgagcctgcggcaggacaaggaaaagaaccaggagatccacctctcacccatcaccttgcagccggccctgtccgaagccaagactgtccattcaatggtgcagcctgaacaggctcctaaggtcctaaacgtcgtggtagaccctcagggacggggcgccccggaaattaaggccacaacagcaacgtctgtgtgcccgtccccattcaaaatgaaaccgattgggcttcaagagaggaggggtagtaacgtctccctgaccctggacatgtccagcctgggcaatattgagccattcgtcagtatccccactccacgggagaaagttgccatggagtatctccagtcagcctcacgtattctgacccgctcccaacttcgggatgtagtggcctccagccatctgctgcagtcagaatttatggagatcccaatgaattttgtggatcccaaggagattgacatccctcggcatggtaccaagaaccggtacaagacaattctgcccaatcccctcagtcgggtgtgtctccgccccaaaaacgtgacagactcactgtag

SEQ ID NO: 45214 - DNA, 4353 bp, Artificial Sequence
  Description of Artificial Sequence: Synthetic coding sequence
atggccagcctggccgccctggccctgagcctgctgctgcggctgcaattaccacccctccccggagctcgcgcccagtctgccgcgggcggttgcagttttgacgagcactattctaattgcggatactccgtggcactgggaacaaatggattcacctgggagcagatcaatacctgggaaaaaccaatgctcgatcaggcagtccccaccggatcctttatgatggttaacagcagcggacgggcaagtggacagaaggcccacttgctgctgcctacactaaaagagaatgatactcattgcatagacttccattattacttctcaagccgcgacaggtcttccccaggcgccctgaatgtttacgttaaggtgaacggtggtccccaagggaatcccgtatggaacgttagcggcgtggtaacggaagggtgggtcaaggcagagctggccatcagcaccttctggccccacttttatcaggtaattttcgaaagcgtgtccttaaagggtcaccccggctatattgcagtagatgaggtgcgcgttctagcccacccctgcaggaaggcaccacattttttacgcctacaaaacgtggaggtcaacgtcggccagaacgccactttccagtgtattgcaggtgggaagtggtcacagcacgacaaactgtggttacagcaatggaatgggagggacaccgccctgatggtgacgagggttgttaaccatcgaaggttttccgcgacagtctctgttgccgacaccgcacagagaagcgtttcaaagtaccggtgtgtgattagatcagatgggggatcaggtgtcagcaactacgccgaactcattgtgaaagagccgccgacgcccatcgcgccccccgaactgctcgcagtcggcgcgacttatctgtggattaagccgaatgccaattcaattatcggggacggccccattatcctcaaagaagtggagtaccgaacaactactgggacgtgggcagagacacatattgtggacagccctaactacaagctgtggcacctagatcccgacgtcgaatacgagattagggtgctgttgactcgtccaggagagggaggcactgggccgccaggacctccgctcacaaccaggactaagtgtgccgatcccgtacacggcccgcagaatgtagaaattgtggacatacgggccaggcaactgacactccagtgggagcctttcggctatgcagtgacgaggtgccactcctataatctaacagtccagtatcagtacgtgttcaaccagcaacagtacgaggctgaggaggtgattcagacgtcttcgcattatactctacgcggtttaaggccttttatgaccatcaggctgagactgctgttgtcaaaccctgaaggacgaatggagagcgaggagctggtcgtccagacagaggaggacgtaccaggcgctgtgccgcttgagagcatccagggcggacctttcgaggagaagatctacatccagtggaaacctccaaatgagaccaacggggtgatcaccctgtacgagattaattacaaggctgtagggtccctggacccgtctgccgatctgagctcccaaaggggaaaagtgttcaaactccggaatgagacccaccacttgtttgttggcttgtaccccggaacgacatattccttcaccatcaaggccagcaccgccaaaggatttggtccccccgtgactaccagaatcgcaacaaaaatatctgccccctcaatgccagaatacgacactgacacccctcttaatgagactgacaccacaatcactgtgatgcttaagcctgcccagtcccgtggcgcccccgtctctgtttatcagcttgtggtgaaggaagagaggctccaaaaatcccgcagagctgccgacatcatcgagtgtttcagtgtcccggtctcttaccggaatgcctcaagcctggactcgctgcattatttcgccgctgagctgaagcccgcgaatttgcccgtcactcagccctttactgttggtgacaacaagacatacaacggatactggaatcccccactgtccccattgaagtcctattccatttatttccaggccctttcaaaggcaaatggcgagaccaaaattaattgtgtgcggctggccacaaaggctccgatggggtcagctcaggtgactccaggcacgcctctctgcctgcttactacaggagctagcacgcagaactccaacacagtcgagcctgagaagcaggtggacaacactgtgaagatggctggagttatagctggtcttcttatgtttatcattatcctattaggtgtgatgctgacaattaaaagacgtaagcttgccaaaaagcagaaagagacgcagtcaggggcccagagagagatgggccctgtcgcctcagccgataagcctactacaaagctttctgccagtaggaacgacgaggggttcagctcgtcttcccaggacgtgaatggcttcaccgacggcagccgcggtgagttaagccaacctaccctcaccattcaaacacatccctatcggacttgtgacccagttgagatgagttacccaagagatcagttccagcccgctatacgggtcgccgacctgcttcaacacattacccaaatgaagcgggggcaagggtacggcttcaaagaagaatacgaggctctccccgagggacagactgcctcgtgggacaccgcaaaggaagatgagaacagaaataagaaccggtacgggaatatcatcagctacgaccatagccgggtgcgtctcctggtgctggatggtgacccccactctgattacattaacgccaattacatagatggttaccacagacctagacactacatcgctacacagggcccaatgcaggaaactgttaaggatttctggcggatgatctggcaggaaaactctgcttccatcgtcatggtgaccaatctggtcgaggtcggcagggtaaaatgcgtcagatactggcccgacgacactgaggtgtacggagacatcaaagtaactctgatcgagactgagccgttagcagagtacgtaatccgcacattcactgtgcagaaaaaaggctatcacgaaatacgggaactaagactgttccatttcactagctggcccgatcatggagtcccctgctatgccaccggactgcttgggtttgttcgacaggtgaaatttctgaaccctccagaagccgggcccatcgtggtgcactgctcagccggggcaggccggaccggatgctttatcgcgatagataccatgctggacatggccgaaaatgaaggagtcgtcgacattttcaattgcgtgagagaattacgtgctcagagggtgaacttggtccagacagaagaacaatatgtgttcgtgcacgacgcgatccttgaggcttgtctatgcggtaacacagctatcccagtgtgtgagtttcggtcgctctattacaacatttctaggttggaccctcagacgaattcatcacagattaaggacgagttccagactttgaacattgtcacaccgagagtgagacctgaggattgcagtatcgggctcctgccaaggaaccatgataaaaacagatctatggatgtgctgcccctagacagatgcctgccattcctgatttctgtggatggcgaaagctccaactatattaacgccgcgctgatggatagccacaaacaaccagccgctttcgtagtaacacagcaccctcttcctaacaccgtggcggacttttggcgtcttgtctttgattacaattgttcaagtgtagtcatgctaaacgagatggacacagcgcaattctgcatgcagtactggccagagaaaacctcaggctgctatgggccaattcaggtagaatttgtgtctgctgatattgatgaggacatcattcaccggatatttaggatctgtaacatggcccgcccccaggatggttataggattgttcaacacctccagtatatcggttggcccgcctatcgcgacacaccaccctctaaacggtccctcctcaaagtggtgaggagactggagaaatggcaggagcagtatgatggcagagaaggccgtacggtcgtgcactgtctgaacgggggcggacggagcggcacattttgcgccatttgcagcgtgtgcgagatgatacagcagcagaatattatcgatgtgttccacatagttaagacattgcgcaataataagtcaaatatggtggagactctggaacaatataaatttgtttacgaagtcgctctggaataccttagctccttttag

SEQ ID NO: 45215 - DNA, 4356 bp, Artificial Sequence
  Description of Artificial Sequence: Synthetic coding sequence
atggccagcctggccgccctggccctgagcctgctgctgcggctgcagcttccaccccttcccggcgcccgcgctcagtccgctgctggcggctgcagttttgacgagcattacagtaactgtggttattcagtggcgctcggcaccaacggcttcacttgggagcagatcaacacttgggagaagccgatgctcgatcaggctgtgccaactggcagttttatgatggtgaactccagcggacgcgcatcaggccagaaggcccatctcctgctgccaacactcaaggagaacgacactcactgcatcgatttccattactatttttcttcccgcgaccggtcgagtcctggagctctgaatgtctatgttaaagtgaatggtggcccacaggggaatccagtctggaacgtctccggggtggtcaccgaaggctgggttaaggcggagctggctatcagcactttttggccacatttttaccaggttatctttgaatccgtcagtttaaagggccacccagggtacatagccgtcgacgaggtacgcgtgctggcacatccttgcaggaaggctccccactttctccgtctgcagaatgtcgaagtgaacgtaggtcagaatgcgacttttcaatgcatagcaggaggtaagtggtcacagcacgacaaattgtggttacagcagtggaacggcagggacacagccttaatggtcacgcgggtagttaaccatcgtcgattttccgctacggtaagtgtcgcagatacggctcaaaggagcgtctcaaaatatagatgtgtcattcgttccgacggggggagtggtgttagcaattatgcagagctgatagtcaaagaacctcccacacctattgcaccccctgagctgctggccgtcggggcaacttacctgtggatcaaaccaaacgccaacagcattattggcgacggacccatcattctcaaagaggtcgaatacagaacgaccaccggcacatgggctgagacccacatcgtcgattcacctaactataagctttggcatttagacccagacgtcgagtatgagatccgagtgctacttacccgacctggggagggaggtaccggcccacccgggcctcctttaactactcgaactaagtgcgccgatccagttcacggcccacagaacgtggaaatcgtcgatatccgtgccaggcagcttacacttcaatgggaaccttttggctacgcagtgaccagatgtcatagctacaacttgacagttcagtaccaatacgtgttcaatcagcagcaatatgaggcagaagaggtgatccagacatcctcgcattatacactgaggggcctgagaccatttatgaccatcagattgagactgctattatccaacccagagggcagaatggagtccgaagaattggtcgttcaaaccgaagaggatgtgccaggcgccgtccctctggagtcgatccagggcggccctttcgaggaaaaaatatatatacagtggaagccccccaatgaaacgaacggcgtgattaccctgtatgaaatcaattacaaggcggttggcagcctagatccttcagcagacctctcgtcccagagagggaaggttttcaagcttagaaatgagactcatcatctgtttgtcggtctgtaccctggtacaacctacagtttcactatcaaggcttcaactgccaaaggctttggcccccccgtgacaactcgtattgccacaaaaatttctgcccccagcatgcccgaatatgataccgatacaccactcaacgagacagatacgactatcacggttatgctaaaaccagcccagagcaggggggcgcctgtcagcgtgtaccagttggttgtgaaggaggagaggctgcagaagtctcgaagggccgccgacataattgaatgcttctcagtaccggtgagctaccgcaatgcttcctctctagacagtctccactactttgcagctgagctcaagcccgcgaacctcccagtgacacaacccttcacggtcggggacaataagacatacaacggttactggaacccacctctgtctccactgaagtcttactcaatctatttccaggcactctccaaggctaacggcgaaaccaaaatcaattgcgtcagactggccactaagggagcctccacccagaattccaacaccgtggagccagaaaagcaagtcgacaacacagttaagatggctggcgtgatcgcaggactgctcatgtttatcataattcttctgggcgtgatgcttaccattaaacggcgcaagttggccaagaaacagaaagagactcagagcggcgcgcagagagaaatggggccagtggcctccgcggacaagcccaccacaaagctgagcgctagccgcaacgatgaagggttctcatcttcatcccaagatgtgaacggcttcactgatgggagccggggcgaactgtcccagcctacattgaccatacagactcacccctatcgcacgtgcgacccggtggaaatgtcctaccccagggaccagtttcagcccgccatccgggtcgccgatctgttgcagcatatcactcagatgaaacggggccagggatacgggtttaaggaagaatatgaggccttgcctgaaggtcaaactgcaagttgggatactgccaaagaggacgaaaatcgtaacaagaatcgatacggcaatatcatcagctatgaccattcaagggtgcgtctactggtgctggacggcgacccgcattccgactacataaacgctaactatatcgacggataccaccggccacgacactatatcgccacacagggccctatgcaagaaacagtcaaagatttctggcgcatgatttggcaggaaaactcagccagtatcgttatggtgaccaacctggtcgaggtgggaagacatccagccgaacatacggtaggaaacgccaccctgggacgggccgcgtcaccagggatggtgaaatgcgtgcggtactggcctgacgacaccgaggtctacggggacataaaagtaacactcatagaaaccgagccactcgccgagtacgtcatccgcacgtttacggttcagaagaaaggctatcatgaaatcagagaattaagactctttcatttcaccagttggcccgatcacggcgtcccctgctacgctaccggccttctgggattcgtccggcaggttaagttcctcaacccacctgaagctgggcctattgtggtacactgctccgcaggagcggggcggaccgggtgcttcatagctattgatacaatgctcgatatggcggagaatgagggtgtagttgatattttcaattgcgtacgcgagctcagagcccaaagggtgaatctcgttcagaccgaggagcagtatgttttcgtgcacgatgctattttagaggcctgcctgtgcggcaacaccgctatccctgtgtgtgaattccgcagtctgtactacaatatatctcgcctcgacccccaaaccaactccagccagattaaagatgagtttcaaacattgaatatcgtcaccccaagagtccgaccggaagattgtagcattggcctgttaccaagaaatcatgataaaaaccgctccatggacgtactccccctagaccgctgcctgccttttctgatctcagtcgacggcgagtcaagcaattacatcaatgccgcgctcatggatagccacaagcagccggccgctttcgtggtcacccagcatccccttcctaatactgtggcggacttttggcgcctcgtgtttgactacaattgttcttccgtggttatgctcaacgagatggacacagcccagttttgcatgcaatattggcctgagaaaacttccggatgctacgggcctattcaagtcgagtttgtgtccgcggacatagacgaggacatcattcatcgcatcttccgcatctgtaatatggcgcggccccaggacgggtatcgcatagttcaacacctgcagtatattggctggcccgcctacagggacaccccccctagtaaacggtctctcttaaaggttgtgagaaggctcgagaagtggcaggaacaatatgatgggcgagagggtcgtacagtcgttcattgcctcaatgggggaggaaggtccgggacgttttgcgctatctgttccgtctgtgagatgatccagcagcagaacattatcgatgtgttccatattgtgaagacactgagaaacaataagtctaacatggtagaaactctggagcaatacaagtttgtgtacgaagtcgccttggagtatttgagttccttctag

SEQ ID NO: 45216 - DNA, 4326 bp, Artificial Sequence
  Description of Artificial Sequence: Synthetic coding sequence
atggccagcctggccgccctggccctgagcctgctgctgcggctgcagctgcctcctttacccggcgccagggcacagagtgctgctgggggatgttcgtttgacgaacactactccaattgtggatactctgtggcattggggactaatggtttcacctgggagcaaattaacacttgggaaaaacctatgttggaccaagcagttcctactggctccttcatgatggtgaattctagcgggagggcatccgggcagaaggcccatctcctattaccaactctgaaagaaaacgatacacactgcatcgatttccactattattttagttctcgtgacagatctagccctggggctctgaacgtttatgtgaaggttaacgggggcccccagggcaatccagtttggaacgttagcggcgtggtcacagagggttgggttaaagccgagctagccatatcaacattctggccccacttctatcaggtcattttcgaaagcgtctccctgaaaggacaccccggttacatcgctgtggatgaggtgcgagtgctggcacacccttgtcgcaaggctcctcacttcctccgtttacagaacgtcgaggtaaacgtaggccaaaacgctacctttcagtgtattgccggaggaaagtggtcccagcatgacaaattgtggttgcagcagtggaacggtcgtgatactgcattgatggtgactcgggtggtgaaccaccgtagatttagcgccactgtgtcagtagccgacaccgcccagcgttcagtgagcaaatatcggtgtgtcatccggtcggacggcggtagtggagtttccaactatgctgagctaattgtcaaagaaccgccaacgccgatcgccccccccgaacttttagccgttggggccacctacctctggattaagccaaacgccaattccatcatcggcgacggaccaattatattgaaggaagtcgaataccgaacaactactggtacatgggcagaaacacacattgtggactctcccaattacaaactctggcatcttgacccggatgtagaatacgagattcgcgtactgttgacacgacccggagagggcgggactggtccccctggccccccactgacaacaaggacaaagtgcgccgatcccgtgcacggcccgcagaacgtggaaatagtggatatccgagctagacagctgaccctacagtgggaacccttcgggtacgcagtgacccgttgtcacagctataacctaacagtgcaataccagtatgtgttcaaccagcagcaatatgaggcagaagaagtgatccagacctcctcacactacacactgcgagggctgcgccccttcatgacaatccgcctcagactgttgctcagcaatcccgagggaaggatggaatcagaagagctggtggtccagaccgaggaagacgttcccggtgcggtgcctctagaatcaattcagggaggaccctttgaggagaagatttatattcagtggaagcccccgaacgagaccaacggtgttataactctctatgagatcaactacaaagctgtgggctcactggatcctagcgccgacctctcaagccagcgaggaaaagtcttcaaactgaggaatgagacccaccacctcttcgttggtctataccccggaacaacttactccttcaccatcaaggcctcaactgccaaggggttcggaccccctgtcaccactaggatagctacaaaaataagcgccccctctatgcccgaatacgacaccgatacgccactgaatgagacggataccacaattaccgtgatgctaaagccagcccagagccgaggcgcacctgtctccgtatatcaactggtggtgaaagaggaacggctgcagaagagtaggagagctgccgatatcatcgagtgcttttcagttcctgtctcctatcgaaatgcctctagcttagactccctgcactattttgccgccgagctgaaacctgccaacctaccagtcacacagccctttaccgtgggcgacaacaagacgtacaacggatattggaatcccccattatctccacttaagagttactccatttacttccaggccttaagcaaagctaatggtgaaactaaaataaactgcgtcaggctggccactaagggagcatccacacagaacagcaataccgtggaacctgagaagcaagtcgacaacacagtcaagatggcaggcgtcattgctggactgctcatgttcataataattctgcttggagtcatgctgaccattaagagacggaggaatgcctactcatattcctattatttaaagttagcaaagaaacagaaggaaacccagagtggagcccaaagggaaatggggcctgtggcctctgccgacaagcctactacaaagcttagtgcatctcggaatgatgaggggttttcctcatcgagccaagacgtcaacggcttcacagacggttcccgcggtgaattgtctcagcctacactgacgatccaaacgcacccttaccgcacatgcgacccagtggagatgtcataccctcgcgaccagttccagcccgccatccgtgtggccgatctgctgcagcatatcacgcagatgaaacgcggccagggttatgggttcaaggaggagtatgaagccctgccagagggacagacagccagctgggacaccgctaaggaagacgagaatcgaaacaagaatcggtatgggaatatcatttcttacgaccattcaagagtccgattattggtgctcgacggcgacccccacagtgattacatcaacgccaattacatcgatgggtatcaccgcccccgccattacattgcaacgcagggtcctatgcaggaaacggtcaaggatttctggaggatgatttggcaagaaaacagcgccagcatcgtgatggtcacaaatctggtcgaggtagggcgagttaagtgtgtgcgatattggccagatgataccgaggtatacggcgacatcaaggtgaccctgatcgaaaccgaacccctcgccgaatacgtgatcaggaccttcaccgtgcagaagaaaggatatcacgagattagggaacttcgactgttccacttcacatcttggcccgaccatggggtgccgtgctacgccaccggtctcctgggctttgttaggcaggtcaagttccttaaccctcccgaggccggcccaatagtggttcactgctcagcaggggcaggacgcacggggtgtttcattgccatagacaccatgcttgatatggccgaaaacgaaggcgtcgtggacatcttcaactgcgttcgagaactccgtgcccagagagtgaatcttgtgcagacggaggaacaatatgtgttcgtacatgacgccattttggaggcgtgcctctgtggaaatactgcaattccagtttgcgagtttcgcagtttgtactataatatcagccgccttgacccccagaccaattcgtcccagataaaggatgaatttcaaacgctcaacatcgttacgccccgcgtccgcccggaggactgctccattggcctgctccctcggaaccatgacaagaatagaagcatggacgtgctgccactcgaccggtgcctgcccttcctcatctccgttgacggtgagtctagtaattatatcaatgccgccctgatggacagccacaaacagcctgctgcttttgtggtcacccagcaccccctacctaacactgtcgccgacttctggaggctggtattcgattacaactgctcttccgtggtgatgctgaacgagatggacacagctcaattctgcatgcagtactggcccgagaaaactagtgggtgttatggtcctatccaggtcgagttcgttagtgctgatattgacgaggacatcattcacaggatttttcgcatttgtaatatggccagacctcaggacgggtacagaatagtgcagcacttacagtatattggatggccggcgtatcgcgatacccctccaagtaagagatcattactgaaagtggtgcggcgtctggagaaatggcaagagcaatatgacggccgcgagggtcggaccgtggtgcattgtctcaatgggggtggcagatctgggactttttgtgctatatgctccgtgtgcgaaatgatccagcagcaaaatatcatcgacgtgttccacatcgtgaaaacactgcgcaataataaatcgaatatggttgaaaccctggagcagtacaagttcgtatatgaggtcgctctcgagtatttgtcctcattttag

SEQ ID NO: 45217 - DNA, 4323 bp, Artificial Sequence
  Description of Artificial Sequence: Synthetic coding sequence
atggccagcctggccgccctggccctgagcctgctgctgcggctgcagttacctcctctgcccggggcccgggcccagtccgccgcaggcggttgctcattcgatgagcactactcaaactgcggatactctgtcgctctagggactaatggtttcacctgggagcagataaacacgtgggagaagccgatgttagaccaggccgtgcccactggaagttttatgatggtgaacagttctggccgggctagcggccaaaaagcacaccttctgctcccaactctgaaggaaaatgatacccattgcatcgacttccactactacttttcctccagagatagatcttcgcctggcgccctaaacgtctatgtgaaggtgaacggggggcctcagggtaatccggtttggaatgtgagcggagtcgtgaccgaggggtgggtgaaggctgaactggctatctccaccttttggccgcatttctaccaggtgatctttgagtcggtgtctcttaaaggccatcccggctacatcgcggttgacgaggtcagggtgctggctcacccctgccgaaaggccccacattttttgcgactgcagaatgtcgaggttaacgtggggcagaatgcaacgttccagtgtatcgctggtggaaaatggtcccagcatgacaagctgtggttacagcagtggaatggacgggataccgctctgatggtgacacgtgtagtcaatcacaggcggtttagtgcaactgtcagtgttgctgataccgcacaacgtagcgtgtctaagtaccgatgcgtgatcaggtccgacggaggatccggtgtcagtaactatgccgagttaatcgttaaggagcctcccactcctatcgcacccccggagttactggccgttggcgctacgtacctatggattaaacctaacgccaattccattataggcgatggccccatcatccttaaagaggtggaatacagaaccacaactggcacatgggccgaaacgcacatagtggactctccaaactacaagctgtggcacctggatcctgatgtggaatacgagattagggtcctcttgactcggcctggcgagggaggcaccggccccccaggaccccccctcactacccgcacgaaatgcgccgacccagtgcatgggccccagaacgtggagatagtggacattagggcccggcaactaaccctgcagtgggagccatttggatacgcagtgaccagatgtcactcctacaatctcacagtacaatatcaatacgtctttaatcagcagcagtacgaagccgaagaagtgattcaaacttcctcgcattacactttgaggggcctgaggccttttatgactattcgcttgcgcctgctcctgtcaaatcccgaaggacggatggagtccgaggagttggtggtacaaaccgaagaagacgttccaggagccgtgcccctggagagtattcagggaggtcccttcgaggaaaagatatatatccagtggaaacctcctaacgaaaccaacggcgtcattacactgtacgagatcaactataaggccgtgggaagtctggacccttcagcagacttgagcagccagcgcggaaaagtcttcaagctaaggaacgaaacacaccacctgttcgttggactgtaccccggaaccacctactcttttacaattaaagcctctaccgcgaaagggttcggcccaccagtgacgacccgcatcgctactaagatctccgcccccagcatgcctgagtacgatacagacactcctctaaatgaaacagacaccacgataacggtcatgctgaaaccagcccaatcaagaggcgctcccgtttccgtgtaccagctggtcgttaaggaggagaggcttcagaagagtagacgtgctgcagacattattgagtgtttctcggtccccgtgagctaccgaaatgcatcatcactcgattctctccattacttcgcggccgagcttaaaccagccaacctacctgtgacccagcccttcactgtgggtgacaataaaacatacaatggttattggaaccctcccctgtcaccactcaaatcatactccatctattttcaagcgttgtcaaaggcaaatggtgagacgaagataaattgtgttagactggcgaccaagggcgctagcacccagaattcgaacaccgtagagcccgagaagcaggtggataacaccgtgaaaatggccggggtgatagccggccttttgatgtttattattatattactgggggttatgctgaccatcaaacggagacgcaacgcctattcatactcctattacctgaagcttgcaaagaaacaaaaggaaactcagtccggagctcaaagggagatgggacccgttgcttctgccgacaagccaactactaagctttctgcaagtcgcaacgatgaaggcttcagttcaagctcacaggatgtaaacgggtttaacggatctaggggagagttgtctcaaccgacccttacgattcagactcacccctatagaacatgtgatccggtggaaatgtcatacccacgcgatcagttccagccggctattagggttgcagacctgctccagcacattacacagatgaaacggggccagggctatggattcaaggaagagtacgaggcgcttcccgaggggcagaccgctagttgggacactgcaaaagaagatgagaacagaaataagaatcgttatggtaatatcatctcttacgatcatagcagggtcagacttctggtgttggacggtgatccacactctgattacataaacgccaattatattgatgggtatcacagacctagacactacattgctacccagggacccatgcaggaaaccgtgaaggacttctggagaatgatctggcaagagaattcagcttccatcgtgatggtaacgaacctggttgaggtaggcagagttaaatgtgtgcggtactggcccgacgatacagaagtgtacggcgatattaaggtcactttgatagagaccgagcctttagctgagtatgttattcggactttcacagttcagaaaaagggctatcacgagattagagagctgaggctcttccactttacaagctggcccgaccacggggtcccatgctacgccacaggactacttggctttgtcaggcaagttaaatttctcaacccacccgaagccggccctattgtggtgcattgttccgcgggtgctggcaggactggatgttttatagccatcgacactatgctggatatggccgagaacgagggagtcgtcgacatatttaactgcgtcagggagcttcgtgcccagagagtgaacctggttcagaccgaagagcagtatgtgtttgtccatgacgcaatcctcgaggcctgcctctgtggaaacaccgccatccccgtgtgtgagttccggtccttatattacaacattagtcggctagatcctcagaccaattcttctcaaattaaagatgagtttcagacgctgaatatcgtcactccccgcgtgcgcccagaagactgctctattggtctgctgccccgcaatcacgacaagaacaggtctatggacgtgctgcccctggacagatgcttgcctttcctcattagtgtggacggtgagtcgagtaactacattaacgccgcccttatggacagtcacaagcagcccgccgcctttgtggtcacccagcatccattaccaaataccgtcgccgatttttggcgcctggtctttgattataactgctcttccgttgtaatgctaaacgagatggacaccgcgcaattctgcatgcaatattggcctgagaagacttccggatgctacggcccaattcaagtggaatttgtttcagccgacatcgatgaggacattattcacagaatttttcgcatctgtaatatggccagaccccaggacggttatcgcatcgttcagcacctgcaatatataggctggcccgcgtaccgggacactcctccttcaaagcggagcctcctgaaagttgtacgccggctggaaaagtggcaagaacaatatgacgggcgggaaggcaggaccgtcgtgcattgccttaacggcggaggtaggtctggtactttttgcgctatctgctctgtgtgcgagatgattcagcaacagaacatcattgatgttttccacatcgtcaaaacattacggaacaacaagagcaacatggtggaaacgcttgagcaatataaattcgtctatgaagtggcactggagtatctgtcttccttttag

SEQ ID NO: 45218 - DNA, 4335 bp, Artificial Sequence
  Description of Artificial Sequence: Synthetic coding sequence
atggccagcctggccgccctggccctgagcctgctgctgcggctgcagctaccccccctgccaggcgcacgagctcaatccgccgccggcggctgtagtttcgatgaacactacagtaattgcggttatagcgtagcacttgggaccaatggcttcacatgggaacagattaatacttgggagaaacctatgctagatcaggccgtccccactggaagcttcatgatggttaatagctccgggagagcatcaggacagaaggcacatctgttactgccaactcttaaggagaatgatacacactgtattgattttcactattatttctcatctagagacagaagctcacccggagccctaaacgtttacgtgaaagtgaacggcggaccacagggcaatcccgtttggaacgtctctggcgtcgtgaccgaggggtgggttaaagccgagctggccatttccaccttctggcctcacttctatcaagtgattttcgagtctgtctcgctaaaagggcatccgggatacattgcagtggacgaagtcagggtcctcgctcatccttgtaggaaggctccgcactttctgcgcctccagaacgtcgaagtgaatgtaggccagaatgccacattccagtgtattgctggaggaaaatggagtcaacacgacaaactgtggctgcaacaatggaacggtcgggacaccgctctcatggttacacgggtcgtcaaccaccggaggtttagcgccacagtctctgtagccgacacggcccagagatctgtctctaaatatcggtgtgtgattcggagcgatggcggcagcggcgtgtctaactacgccgaactgatagttaaggagccaccaactcccatagctcctcctgagctgttagcagtgggagctacatatctgtggattaaacctaacgccaatagcatcatcggcgacgggccaattattctgaaggaggtggaatacaggaccaccacgggcacttgggctgagacgcatatcgttgacagcccaaactataagctttggcacctggatccggatgtcgaatacgagattagggtactactcacccgtcctggtgagggtgggacagggccccctggcccacctctcacaaccagaaccaaatgtgctgatcctgtgcacggcccccagaacgtcgagattgttgacatccgggctcgacagcttaccctgcagtgggaaccattcgggtacgctgtgacaaggtgccatagctacaatctgacagtccaataccaatacgtgttcaaccaacagcaatacgaggccgaagaagtgatacagactagcagtcactatacactgagaggacttaggcccttcatgactattaggctgcggctgctgctcagtaaccccgagggccgtatggaaagtgaagagctcgtggtgcagaccgaagaggacgtcccaggtgcagttcctttggaatctatccaggggggccccttcgaagaaaaaatttatattcagtggaagccccctaatgaaacaaatggcgtaatcacattatacgaaatcaactacaaagccgtggggagtctggatccttctgccgacctcagttctcagcgcgggaaggtcttcaagctcaggaacgaaactcatcatctatttgtgggtttgtaccccggcacgacctattctttcaccatcaaggctagcacggccaaaggctttggaccccctgtcacaacacgcatcgcaacaaagatcagcgctccatcaatgcctgaatatgacacagacacacctcttaacgagacagacaccaccattacagtaatgctgaagcccgcccagtcacgcggagcacccgtaagtgtataccagttggtcgttaaggaggaaagactccagaagtctaggagggccgcagatattatcgaatgctttagcgtacctgtctcctaccgcaacgcttcgtcactggacagcttgcactactttgctgctgaacttaagccagccaatctgcctgttacacagccttttactgtgggagataacaaaacctacaatgggtattggaacccaccgctcagcccacttaagtcttacagcatctacttccaggctctgagtaaggccaatggagagacaaaaatcaattgcgttcggctggccactaaaggcgcctctacccagaatagcaataccgtcgagccagagaagcaggtcgacaataccgtcaagatggctggcgttatcgccggactgctgatgttcataatcatcctgttgggcgtcatgctaacaattaaacggaggaggaatgcgtacagttatagttactatctgtctcagcgaaaattggcaaagaagcagaaggaaacacaaagcggcgcacagagagagatgggtccagtggcttccgccgataagcccacaacaaagctctccgcatctagaaacgacgaaggattcagcagctccagccaggacgtcaacggatttaccgatggaagcagaggggagttgtctcagccaacacttaccatccagacacatccctacaggacctgtgatcccgtggagatgagttacccgagggatcagttccagccagcgatccgtgttgcggatctgttacagcacatcacccagatgaaaaggggacaaggatacggcttcaaagaagagtacgaagcactgcccgagggacagacggcaagctgggacacggcgaaagaggatgagaaccgcaataagaatcggtatggaaatatcatttcctacgatcactcacgcgtgaggctcctggtgcttgacggcgatccccatagcgactacatcaacgcgaactatatcgacggctaccataggccacgccactacatcgccactcaagggcccatgcaggagacggtcaaagatttttggcgaatgatttggcaggagaattccgcatcaatcgtgatggtcacgaacctcgtcgaggtcgggcgtgtgaaatgcgtcaggtactggcctgacgataccgaagtctatggggatatcaaagtcacattaatagagacagaaccactcgcagagtacgtcattcgcacctttaccgtccagaaaaaagggtatcacgagattcgcgagctgcgcttattccatttcacatcctggcctgatcatggagtgccttgttatgccactggcttgcttggattcgttaggcaggttaaatttttgaatccacctgaagcgggtccaatcgttgtgcattgtagtgccggcgcagggcgcacaggctgcttcatcgccatcgatacgatgctagatatggccgagaatgagggagttgtcgatatcttcaactgcgtgcgagagctgcgcgcgcagcgcgtaaatctggtacaaaccgaagagcaatacgtgttcgtccacgacgccatccttgaggcatgtctatgtggtaacaccgcaatacccgtgtgtgagttcagatccctctactacaatatatcacgcctagatccgcagactaattcatctcagatcaaggatgagttccaaaccctgaatattgtgacaccacgcgtgcggccagaggattgtagcatcggactgctgccacgcaatcacgacaagaaccggagcatggacgtgctgcccttagacagatgtctgccgttcctcatctccgtagatggggagtcctccaactatatcaatgctgctctgatggacagtcataaacagcccgcagcctttgtggtgacacagcaccctttacctaatacggtcgccgacttctggagactggtgtttgattataactgtagctctgtggtgatgcttaacgagatggataccgcccagttttgcatgcagtactggcctgagaagacatctggttgctacggccccattcaggtggagtttgtgagtgcagacatcgacgaagatatcattcaccgtatttttagaatttgtaatatggcgcggccccaggacggctatagaatagtacagcacttgcagtacataggctggcctgcctatcgtgatacccctccctctaaaagaagtcttctcaaggtagtgaggaggctagagaaatggcaggaacagtatgatggaagggagggcagaactgtggtgcactgcctgaacggaggcgggcgcagtggtactttctgcgcaatctgctcagtgtgtgaaatgatccagcagcaaaacatcatcgacgtatttcacattgtcaaaacattgagaaataataagagcaacatggtggaaactttggaacagtacaagtttgtgtacgaagtggccttagagtacctgtcatctttttag

SEQ ID NO: 45219 - DNA, 4392 bp, Artificial Sequence
  Description of Artificial Sequence: Synthetic coding sequence
atggccagcctggccgccctggccctgagcctgctgctgcggctgcagctccctcccctgcccggggcgagggctcaaagcgctgctgggggctgtagttttgatgagcactattccaattgcggctatagcgtggctctgggaactaatggcttcacttgggaacagattaatacgtgggaaaaaccaatgctggaccaggcggtacccacagggtctttcatgatggtgaattcctccgggagggctagcggccagaaggctcatctgttactgcccactctgaaagagaatgacacccactgcattgacttccactactattttagttctcgagaccggagtagccccggcgctctgaacgtctacgtcaaagtgaacgggggcccgcagggtaatccagtttggaacgtgtccggcgtggtcaccgagggatgggtgaaggccgaactcgcaattagcacgttctggccgcacttttaccaggtgatttttgaatctgtttcgctgaaaggccacccaggttacattgccgttgacgaggtgcgtgttctcgcccatccctgccgcaaggccccacattttcttaggttgcagaacgtggaagtgaatgtagggcagaacgccaccttccagtgcattgctggtggaaagtggtcgcagcacgataaactatggcttcagcagtggaacgggcgcgatactgcccttatggtcacgcgagtcgtgaaccatcgaaggttctctgccaccgtgtctgtcgccgacacggcacagaggtcggtgagcaaataccgctgcgtaattagaagcgatggagggtcaggagtgtctaattatgctgaactcatcgtgaaggagcctccgaccccaatcgcccctcccgagctgcttgccgtaggtgctacttacctgtggatcaaaccaaatgctaattcaatcataggagacggccccattatccttaaggaggtggaatatcggacaaccaccgggacatgggctgagacacatatcgtggactcccctaattacaaactctggcatctggacccagatgtagagtatgagattcgggtcctgctcacccgccctggggaaggcggtaccggaccacctggaccccctttaacaacacgcactaagtgcgcagatccagtccatggcccgcaaaatgtcgaaatcgtcgatatacgggcacggcagcttaccttacagtgggagcccttcggatacgcagttacaaggtgccacagttacaatttgactgtgcaataccaatacgtctttaatcagcagcaatacgaggcagaggaggtaatccagacgagctctcactatacattgcgcggtctgcggccgttcatgaccatccgtcttcggctccttctgagtaaccccgagggccgtatggaatctgaggaactagttgttcagacagaagaggatgtgccaggggctgtcccacttgaatcaatacaggggggccctttcgaggagaagatttatattcaatggaaaccccctaacgagactaatggagtcatcacactgtacgaaataaattacaaagctgttggatccctggatccctccgccgacctgagcagccagcggggcaaggtgtttaagttacgtaatgagactcatcatctgttcgtcgggttgtacccgggtaccacttacagtttcacaatcaaggcttccacagcaaagggcttcggaccccccgtgacaactcggatcgcaaccaaaatctcagcaccctctatgccagaatacgacaccgatacacccctgaacgagactgataccacaattaccgtgatgctcaagccggcccagtcccgtggtgcgccagtctccgtgtaccagctggtcgtcaaggaagaaaggttgcagaaatcccgccgtgcagccgacatcattgagtgctttagtgtgccagtgagctacaggaacgcctcttccctggactctctgcactatttcgccgcagagctgaagccagccaacctgcctgtgacccaacctttcaccgtgggagacaataaaacctacaacgggtattggaacccccccctcagtcctctgaagtcctactccatttatttccaagctctatctaaggccaacggggagaccaagattaactgcgtccggctggccaccaaagcccctatgggctccgctcaagtcacccctggaaccccgctgtgcctattaacgaccggcgccagcactcaaaattctaacactgtagagcctgagaaacaggttgacaacactgtcaagatggctggggtgattgcgggattgcttatgttcatcatcatcctccttggcgtgatgcttaccatcaagcggaggcgtaatgcttattcatattcgtattatcttagccagcgtaagctggccaaaaagcaaaaggagacccaaagcggtgcacagcgtgagatgggccccgtcgcttcagcagacaaacctacaacaaaattaagcgcctcacggaatgacgaagggtttagctcgagttcccaggacgtgaacggctttaccgatggctcccggggggagttgagtcagcctaccttgaccatccagactcacccctatagaacttgtgatcccgtggagatgagttatccacgggatcagttccagccagctatacgagtggccgatctgctccagcacataacccagatgaagaggggccaagggtacggcttcaaagaggagtacgaagcactccctgagggccagacagcttcttgggacactgcaaaggaagacgagaaccggaataaaaacaggtatggtaacatcatcagctatgatcactcaagagtgcgtctgctggtactcgacggcgacccacactccgactatattaacgcgaactatattgacggttaccaccggcccagacactacatcgcgacccagggcccaatgcaagaaacagtgaaagacttctggaggatgatctggcaggagaattcagccagcattgtcatggtcacaaatctggtggaagtcggacgggtcaaatgcgtgagatactggcccgatgatactgaggtgtacggtgacatcaaggtcactctgatcgagactgaacccctggccgagtatgtcattaggacttttacagtgcagaagaagggataccatgagatacgcgaactgagactgtttcattttacctcatggcccgatcatggcgtcccctgctacgccactggcttactaggctttgtgagacaggtgaaatttctgaatcctcctgaagcaggccccatcgtggtgcattgctccgccggcgcaggccggacaggatgctttatcgccatcgatactatgctcgatatggccgagaatgagggcgtggtggatatcttcaactgtgtccgggagctcagagcccaacgagtgaatctcgtccagaccgaagagcaatatgttttcgttcatgacgctatactcgaggcttgcctttgcggaaacaccgccattcccgtttgcgagttcagatccctgtactacaacatttcgcgcttggatccacagaccaacagtagccagataaaggatgaatttcaaacgcttaacatcgtgactccccgcgtgcggccggaggattgctcaatcggcctgttgccccgcaatcatgacaagaatcggagtatggacgtccttcctctcgatcgatgtctcccatttctaatcagtgtggacggggagagtagtaactatattaacgcagctctgatggattctcacaaacagcccgcagcctttgtcgtgacccagcatcccttgcctaacacagtggctgacttctggagattagtgttcgactacaactgttcatcggtggtcatgctgaacgagatggatacagcccagttttgtatgcagtattggcccgaaaaaacttccgggtgctatggtcccattcaagtggagttcgtgagcgctgacattgacgaagacattatccaccgtatttttaggatctgtaatatggctagacctcaggacggctacagaatagtgcagcatttgcagtacatcggatggcctgcataccgcgatacccctcctagcaaaaggagcttattgaaggtcgttaggcgcctggaaaaatggcaagaacagtatgacggcagagagggccggacggtcgtccactgcttgaacgggggaggtcgctcggggactttttgcgcgatctgctccgtgtgcgagatgattcagcagcagaacattatcgatgtgtttcatatcgtcaaaaccctcaggaataacaaaagtaatatggtggagacgctcgagcagtataagtttgtgtatgaggtagcccttgagtacctgagttcattctag

SEQ ID NO: 45220 - DNA, 4296 bp, Artificial Sequence
  Description of Artificial Sequence: Synthetic coding sequence
atggccagcctggccgccctggccctgagcctgctgctgcggctgcagctgccgccactgcccggagctagagctcagtccgctgctggcggttgctctttcgacgaacattactcaaactgcgggtacagcgttgctctgggtaccaatgggtttacctgggagcagattaatacgtgggagaagccaatgttagatcaggccgttccgaccggatcattcatgatggtgaattcttccggaagggcgagcggccagaaggctcacctgctcctcccaaccctgaaggaaaacgatacgcactgtatcgattttcactactacttctcctcccgcgatcggtccagtcctggcgcactcaacgtttacgtgaaagttaatggcggtccacagggcaacccagtttggaatgtatcaggcgttgtcacagaaggatgggtgaaggcagaactcgcgatcagtaccttctggccccatttctaccaggtgatttttgaatccgtatcgctaaaaggtcatcctggttacatcgctgtggatgaagtcagggtactagctcacccatgtcgcaaggccccacacttcctccgattacaaaacgtagaggtaaatgttggccagaacgctactttccagtgcattgccggcggaaagtggtcccagcatgataaactatggttgcagcagtggaatggtcgagacacagcgctcatggtcacacgggtcgtcaatcaccggcgattctcggctactgtgtctgtggcagacacagcacagcgatccgtgtcaaaatataggtgtgttatcaggagtgacggcggaagcggagtcagtaactacgccgagcttattgtgaaggagccacctactccaattgcccccccggagttactcgccgtaggagccacctatctctggattaaaccaaacgccaattccattattggcgatggaccgatcatcctcaaggaagtagaatatagaactactacaggtacctgggccgaaactcacattgttgattcgcccaattacaagttatggcatctggaccccgacgtggagtacgagattcgtgttctccttaccagacctggcgagggaggcactggtcctcctgggcccccacttactactcgtacaaaatgtgctgacccagtccacgggccacagaatgtcgaaatagtggatatcagggcaaggcagctcactctgcagtgggaaccgtttgggtacgcggtgactcgctgtcattcctataacttaaccgtgcaataccagtacgtttttaaccaacagcagtacgaggccgaggaggttatccagacatctagtcattataccttgagaggcttgcgcccattcatgaccatccggctgcgtctgcttttatccaatccggagggacgcatggaatcagaggagcttgtagtgcagaccgaggaggacgtgcccggggctgtgccactcgaaagtatacagggagggccttttgaagagaagatttatatccagtggaagcctccaaatgaaactaacggagtcattaccttatacgaaattaattataaagcagtcggtagtctggatccaagtgcggatctgtcctcacaaagaggcaaggtatttaagttacgtaatgaaacacaccacttgtttgtgggcttgtaccccggaacaacctatagcttcaccattaaggctagcaccgcaaaggggtttggaccacctgtaactacgaggatagccactaagattagcgcacccagtatgcccgaatacgacaccgatacacctctgaatgagactgacacaacaatcacagttatgctcaagcccgcccagtcccgtggggctcctgtttctgtgtaccaactagtggttaaagaggagagactgcagaagagccggagggcggccgacataatcgagtgctttagcgtcccggtctcttatcgcaacgccagcagtctagatagtcttcactatttcgctgctgaattaaaacccgccaaccttccggtaacccagccgtttaccgtgggggacaataagacttacaatggatactggaatccccctctgtcaccactcaagtcgtatagcatctattttcaggcactgagtaaagccaacggggagacaaagatcaactgtgtgcggctagctacgaagggagcctctactcaaaattccaataccgtggaacccgaaaagcaggtcgacaacaccgtgaagatggcgggagtcatagccggcctgctgatgttcattataatccttctcggggtgatgttaacaatcaaacggcgcaaattggctaagaagcagaaggaaacgcagtcgggcgcacaacgcgagatgggccccgtcgccagcgcagacaaaccaacaacaaagctgtccgcaagtagaaatgatgaaggtttcagtagcagctcccaagacgttaacggattcacagatgggagtagaggcgagttgagtcagcccactctgacaattcaaacccacccataccgcacatgtgaccccgttgagatgtcttatcctagggaccagttccagccagccattagggtggccgatcttctgcagcacataactcagatgaagaggggtcaggggtacggattcaaggaggagtatgaagcactgcccgagggccaaaccgcaagttgggacacagccaaagaggatgaaaatcggaataaaaatcgttacggaaatataatatcgtacgatcattccagagtgcgattgcttgttttggacggagacccccatagtgactatataaatgccaattacatcgacggctaccaccgcccaagacattatattgccacacagggacccatgcaggagaccgtgaaagatttttggagaatgatttggcaggaaaatagcgcatccatcgtaatggtcacaaatctggtagaagttggccgggtgaagtgtgttcggtactggccagacgataccgaggtctatggagacataaaggtgacactgatcgaaacagagcccctggcagagtacgtgatacgaactttcactgtacagaagaagggttaccatgaaattcgtgagcttcgtctgttccattttacaagctggcctgaccacggagtaccatgttatgccacaggtctgctcggtttcgtccgccaggtgaaattcctgaatcccccagaggctgggccaatcgtggttcactgcagtgcaggcgctggccggacgggatgcttcatcgccatcgacacgatgcttgatatggccgaaaacgagggggtcgtggatattttcaactgtgttcgagaactgcgcgcacagagggtgaacctcgtccagacggaggaacagtacgtgtttgtacatgacgctatcttggaggcctgcctctgcggtaacacagccatccctgtttgtgagtttcggtctctgtattataatatctcacgcctcgacccccagaccaactcttcccagatcaaagacgaattccagaccctcaatattgttacccccagggtgcggccagaggattgttccattggcttactgcctaggaaccatgataagaacagaagcatggacgtgctcccacttgataggtgcctgccatttctaatttctgtagacggcgaaagctctaattatataaacgccgccctgatggatagccacaaacagccggccgccttcgtggtgactcaacaccccctgcctaacactgtcgccgacttttggcgacttgtttttgactataattgttcttccgtggtgatgctgaacgaaatggatacggcacagttctgcatgcagtattggcccgagaagacctcgggttgctacggccccattcaggtggaatttgttagtgctgacatcgatgaggacatcatccataggattttccgaatctgcaatatggctcgcccacaggacggctataggatcgtgcaacacctgcagtacatcggctggcctgcctatagggatactcccccctcaaagaggtcattgttaaaggtggtgcggcgtttggagaagtggcaggagcaatacgacggccgggaaggtagaaccgtggtccactgcctgaacggaggcgggcggagtggtacattttgtgccatttgttccgtttgtgaaatgatccagcagcaaaacatcatcgacgtgtttcacatagttaaaaccctgcggaataataagagcaacatggtggaaactctcgaacaatacaaattcgtgtacgaggttgccttggagtatttgagttcgttctag

SEQ ID NO: 45221 - DNA, 765 bp, Artificial Sequence
  Description of Artificial Sequence: Synthetic coding sequence
atggccgccgtggccgccaccgccgccgccaagggcaacggcggcgggggcggcagagccggggcaggggatgcctcaggcacacgaaaaaagaaaggccccggccccctagcaacagcctatctggtgatatacaatgttgtaatgaccgcgggctggctggtcattgccgtagggctggttcgcgcctatctggctaagggctcttatcacagcttatactatagtattgaaaagcccctgaagttctttcagacaggtgcacttctggaaattctgcattgtgcgatagggatcgtgccgtcttccgttgtgctgacttcttttcaggtgatgtctagggtcttcctaatctgggccgtcacccacagcgtgaaagaggtccagtccgaagactccgtgctgttgtttgtgatcgcttggactataactgagattattcgctatagtttttatacattctccctgctgaatcatcttccttatctcatcaagtgggcccggtatacactgtttattgttttatatccaatgggggtctccggcgagctgctgacaatatatgcggcactgcccttcgtccgacaggcaggcctgtactctatttccttgcctaataagtacaacttcagctttgattactacgccttccttattttaatcatgatctcttatattcccatctttccccaactttacttccatatgatacaccagagacgaaagatcctcagtcacacagaggaacacaaaaagtttgagtag

SEQ ID NO: 45222 - DNA, 1089 bp, Artificial Sequence
  Description of Artificial Sequence: Synthetic coding sequence
atggagaaccaggtgctgaccccccacgtgtactgggcccagcggcatcgtgagctgtacctgagggttgagctttcggacgtccaaaatcccgctatatctatcacagaaaacgtgctccacttcaaagcccaaggccacggagccaagggagataacgtgtacgaatttcacctggaatttttggatttagttaagccggagccagtgtataagctgactcaacgacaggtcaatataacggtgcagaaaaaagtctcacagtggtgggagagacttacaaagcaggagaaacgccccctgtttctggccccagatttcgacagatggttggatgagtcagatgccgagatggaacttagagccaaggaagaggaacggttgaacaagctgcggctagagtccgaaggttcacccgaaacactgaccaacctgagaaagggctacctgtttatgtacaacctggttcagttcctgggattctcatggattttcgtgaaccttacggtgaggttctgcatacttggaaaggagtccttctacgacaccttccatacagttgcagacatgatgtatttctgccagatgctggccgtagtcgagaccatcaatgctgctatcggcgtcaccacctcccccgtgctgccatcactgattcagctgcttggcaggaatttcattttattcatcatcttcggcaccatggaagaaatgcagaacaaggccgtggttttttttgtgttctacttgtggtccgccatcgaaatcttccgctacagtttctacatgctgacatgcatagatatggactggaaggtgctgacttggcttcggtacactctgtggatccctctatatcctcttgggtgtctcgctgaggccgtttcagtgatccagagcataccaatttttaacgagaccggccggttcagcttcacactgccataccctgtgaaaattaaagttagattctcatttttcctacagatatacctgattatgatattccttggactgtacatcaacttccgacatctctacaaacagcggcggcggagatacggacagaagaagaagaagatccactag

SEQ ID NO: 45223 - DNA, 699 bp, Artificial Sequence
  Description of Artificial Sequence: Synthetic coding sequence
atgggccccctggccctgcccgcctggctgcagccccggtaccggaagaatgcctatttgttcatttactacctcatccagttctgcgggcactcttggatctttaccaatatgaccgtccgcttcttcagcttcggcaaggactccatggtcgacaccttctacgcaatcggactggtcatgcggttgtgtcaatctgtaagtttactggagctgctacatatatacgttggcattgaatctaatcacctcttaccgcgattcctgcagttgactgagcgtatcatcatcctgtttgtggtgatcactagccaagaagaagtgcaggagaagtacgttgtgtgtgtgctattcgtgttctggaaccttctagatatggtgcgctatacatattccatgttgagtgtgataggaatctcatatgccgtccttacctggctaagccaaaccctgtggatgcccatttatcctctttgcgtgctggccgaagctttcgccatctaccagagcctgccctatttcgagtctttcggcacctacagcacaaaactcccattcgacctcagcatttacttcccctatgtgctaaaaatctacctcatgatgctctttattggcatgtatttcacatattctcatctgtattccgaacgtcgcgacattcttggcattttccctattaagaaaaagaagatgtag

SEQ ID NO: 45224 - DNA, 699 bp, Artificial Sequence
  Description of Artificial Sequence: Synthetic coding sequence
atgggccccctggccctgcccgcctggctgcagccccggtaccggaagaatgcgtacttgttcatctactatctgatccaattttgcggacattcctggattttcaccaacatgacggtgaggttcttttcgttcggcaaggatagtatggtggataccttctatgccatagggcttgtcatgcgattgtgtcagtcagtcagcctcttagagctcttgcacatatatgtaggaatcgaaagcaaccatctcctcccacggttcctacagcttactgaacggattattatcctgttcgtggtaatcactagccaggaagaagtacaggaaaaatatgtcgtgtgtgtgctcttcgttttctggaacctactagacatggtaagatatacatattcgatgctctctgtgatcggaatatcttacgccgtgctgacctggttgtctcagaccctgtggatgcctatatatcctttgtgcgttttggccgaggcctttgccatttatcagtctctgccttatttcgaatcattcggaacatattcaacaaaattgccattcgatctgtccatctacttcccttacgtcctaaaaatctacctgatgatgctgttcattgggatgtatttcacttacagtcacctctattccgagcggcgcgacatattgggtattttccctatcaaaaagaaaaagatgtag

SEQ ID NO: 45225 - DNA, 2397 bp, Artificial Sequence
  Description of Artificial Sequence: Synthetic coding sequence
atggagttcagctggggcagcggccaggagagccggcggctgctgctgttgttgctgctcctcgctgcgtgggaggcgggaaatggacagttacactattccgtctccgaggaggccaaacacggcactttcgtaggcagaattgcccaggacctcggcctcgagctggcggagttagttcctcggctgttcagggtcgcttcaaaaggccgcggaggcctgttagaggttaacctacagaatggaattttgtttgttaattctagaatcgaccgggaagagctatgtaggcgctctgctgagtgttcaattcacttggaggttattgtggataggcccttacaggtttttcacgtcgatgtggaggtgagggacatcaacgacaatccccctgttttcccagcgactcaaaagaacttatccatcgccgaatcacgaccactcgatagtcgcttccccctggagggcgcctcagacgccgatataggagagaacgccttactgacctacaggctgagccctaatgaatacttctccctcgaaaagcctcccgacgacgagctggtgaagggcctcgggctcattttgagaaaaagtcttgatcgggaggaggcacctgagatctttttagtgctgacagctacagacgggggcaagcccgagctcacaggaactgtccaattgctaatcactgtgctcgatgccaatgacaatgcacccgcatttgacaggacgatctacaaggtgcgtctgctagagaatgtgccaaatggcacattggttatcaagctgaacgcgagtgatctcgatgagggactcaacggagatattgtgtatagcttcagcaatgatatcagcccgaatgtgaagtctaaatttcacatcgatccaataactgggcagatcatcgttaaagggtacattgattttgaggagtccaaatcatacgagatcattgtggagggcatcgacaagggacagttaccgctgagcggacactgccgagtaatcgtggaggtggaggacaacaacgacaatgttcctgatctcgagttcaaaagcttgtccctccccataagggaggatgccccattgggaacagtcattgctcttatcagtgtctctgacaaggacatgggtgtgaacggactggtgacgtgctctctgacctcccatgtcccctttaaactagtgagtacattcaagaactattattcactggtgttagattcggccctcgatagggagtctgtgagtgcctacgaactggttgttactgcccgggacggagggtctccatcactgtgggctactgcttccgtatctgtagaggttgccgatgtaaatgacaatgcgcccgcatttgcccaaccagaatacacagtcttcgtgaaggagaacaacccacccgggtgccacatatttaccgtgagcgcctgggatgccgacgcacaggagaacgcccttgtcagttactcactggttgagagaagggttggtgagcgagctctctcctcttacgtttccgtccatgcagagagcggtaaggtctatgctctccagcccttagatcacgaggagttggagctgcttcagttccaagtgaccgcccgcgacgccggcgtgccgcccttagggtccaatgtgacgcttcaagtgtttgtcctcgatgaaaacgacaacgctcccgcccttctagccccacgggcaggcggaactggcggcgcagtttctgagctggtcccttggtcggtgggagttggccacgttgtagccaaggtgcgggcagttgatgccgactccggttacaacgcctggctcagctacgaactacagcccgggacgggcggggccaggattccgttccgggtgggactgtacacaggagagatctccaccaccagggccctcgacgagaccgacgccccccggcatagactcttagtgctggtaaaagatcacggagagcccgctttaacagccactgctaccgtcctggtgagccttgttgagtctgggcaggccccaaaagccagtagccgagcactggtaggagcagtgggcccagatgccgctctggttgacgtgaatgtgtacttgatcattgctatttgcgccgtgtctagtttattggtgctaactctgctactttacaccgctctacgctgctccgctctcccaaccgaaggcgcctgcgcccctggtaagcccaccttagtgtgctctagcgccgtggggagctggtcttacagccaacaaaggaggccacgagtctgctcaggagagggaccacctaagactgacctgatggccttttcaccatctcttcctgatagccgcgaccgcgaggaccagctgcagacaactgaagaatcatttgctaaggtgagtgtatag

SEQ ID NO: 45226 - DNA, 2706 bp, Artificial Sequence
  Description of Artificial Sequence: Synthetic coding sequence
atggagttcagctggggcagcggccaggagagccggcggctgctgctccttcttttactgctggctgcatgggaagccggaaatggacagctgcactactctgtgtctgaagaggcaaagcatgggactttcgtcggaagaattgcccaagacctcggactcgagcttgcagaactggtgccacggttatttcgtgtggcttctaaagggcggggcggcctgttagaggtgaacctccagaatgggatcctgtttgtaaactcgcggattgatcgggaggagctttgtcgtcgcagcgcagagtgcagcatccatctcgaggtgatcgtcgaccgaccactccaggtgtttcacgtagacgtggaggtgcgtgacattaatgataatcctcccgtcttccccgctacacaaaagaacctgagcattgctgaatcacgccctctggatagtcgttttcccctcgaaggggcgagcgatgctgacatcggagagaacgcactgctgacttaccggcttagtcctaacgagtattttagcctggagaagccccctgacgacgaacttgtgaaagggttaggccttatcctcaggaaatccctcgatcgggaggaggctccggagatcttccttgtcctgaccgctactgacggcgggaagcctgagctcactggaaccgttcaactactcattacagttctggacgccaatgacaacgccccagccttcgatcggaccatctacaaggtgcggttacttgagaacgtaccgaatggcaccctggtaattaaacttaatgcttctgacttagacgaagggcttaacggcgacatcgtgtactcattctccaacgacattagcccaaacgtcaaaagcaagttccatattgatccaatcaccggacagattattgtgaagggttacatcgacttcgaagagagtaagagttacgaaatcatcgttgaaggcatcgacaaaggacagctcccgctgtcaggacattgtcgggtcatcgtcgaggtagaggataacaacgataatgttcccgacttggagttcaagagcctatcactgcccatcagggaggatgcccccctcggaacagttatagcactgatcagcgtaagcgacaaggacatgggagtcaacggcctggtaacatgttcgctcacctcccacgtgcccttcaagcttgtgtccacttttaaaaactactatagtctggtcctggacagcgctcttgacagggagtctgtgagcgcttacgaactggtggttacggcacgagatggcggctctccgtctttgtgggcaactgcgtccgtgtctgtcgaagttgctgacgtgaacgacaacgcacccgcatttgctcagcccgagtatacggtttttgtgaaagaaaataatccccccggctgccatatattcacagtcagcgcatgggatgcggacgctcaggagaacgcattagtctcctattcactggtggagagacgcgtgggagaacgtgcactgtcctcatatgtctccgttcatgcagaatctggcaaggtttacgccctgcaaccactggaccacgaagagctcgagcttcttcaattccaggtgaccgcccgcgatgcgggtgtgccccctctggggtccaacgtaacacttcaggtttttgtgctggatgagaacgacaatgcccccgccctgctcgcccccagagcagggggtaccggcggggcagtctccgagctggtaccatggagcgttggggtggggcatgtcgtggccaaagtcagggccgtcgatgccgattcaggctataacgcttggctgtcctacgaattgcaaccagggactggcggagctcgtattccatttagagtcgggctctacactggtgagatttctacaactcgagctcttgacgaaaccgacgccccaagacaccgcctgcttgtgctggtgaaggaccatggcgagcctgcgctgaccgcaacagccacagttctggtctcgctggtagaatcagggcaggctccaaaagcaagcagccgcgcgctcgtcggcgccgtgggtcctgatgccgctctcgtcgatgtcaacgtgtatctcatcattgctatctgcgcggtgtcctcactgctggtgctaactctcttgctgtacaccgctttgcgttgcagcgctctccctaccgaaggggcctgcgctcctggcaagccaacactcgtctgttcaagtgcagttgggagctggagttactcccagcagagaaggccgcgagtgtgcagcggcgagggacctcccaaaaccgatctaatggctttctccccttccctgccagactccagagaccgcgaggaccaattgcagacaacggaggagtctttcgctaagccacggcagccaaatccagattggcgctatagcgcaagcctcagagctggcatgcactctagtgtgcacttggaggaggcgggaatactgcgggccgggcctggaggccctgatcagcagtggcccaccgtgtcttccgccacccctgaacccgaagcaggagaggtgagtcctccagtaggagccggagtgaacagcaatagctggacttttaagtatggaccaggcaaccctaagcagtccgggccagagcctaaaaagcagactcaggtcagctttttgttaagacgaaagggcgaagcaagtcagccccggcagtag

SEQ ID NO: 45227 - DNA, 2844 bp, Artificial Sequence
  Description of Artificial Sequence: Synthetic coding sequence
atggagttcagctggggcagcggccaggagagccggcggctgctgcttctcctccttctactggctgcatgggaagccggtaacggccagctgcattattcggtcagtgaggaggccaaacacggcacttttgttggccggatcgcgcaagatttgggccttgagcttgctgagctggttccacgtttgttcagagtcgctagcaagggccgaggcggcttgctggaggtcaacctccagaacgggatcctcttcgtgaattcacgcatcgatagagaggagttgtgtcgtaggagtgccgaatgctctattcatttagaagtaatcgtcgatcgccctctgcaagtctttcatgtcgatgtggaggtacgcgatatcaacgacaatccccccgtgttccctgccacacagaaaaatctctcaatagccgagtcgcgaccactggacagcaggtttccgctggagggtgcttcagacgctgacatcggtgagaatgccttgctgacgtacagactgtcccccaacgagtacttctccctcgaaaaaccgcccgacgacgaactggttaaaggcctaggcctcattttgcggaaatcattggaccgggaagaagctcctgagatcttcctggtgctgacagccacagatggaggaaagcccgaacttaccggcaccgtgcagctacttatcaccgtgctggatgcgaacgataatgctcccgctttcgacagaacgatttacaaagtaaggttactagaaaacgtgcccaatggaaccttggtgattaagctgaatgcctcagacctggatgaaggtctgaatggcgacatcgtgtatagcttctcaaacgacatttcacctaacgtgaagtccaagttccacattgatccaataacaggccagattatcgtgaagggctacatagattttgaagaatccaagtcctacgagattatcgtcgaaggaattgacaaggggcagctgccgcttagcggccattgtcgggtcattgtagaagtggaggataataacgacaatgttccagacctcgagtttaagagcctgtccctccctatccgggaagatgcccctctgggaactgtgattgccctcatctccgtctcggacaaagatatgggagtcaacgggctggttacatgtagcctgacctcacatgttccattcaaactcgtaagcaccttcaagaactattactccctagttctcgactccgccctggatcgagagagtgtgagcgcatatgagcttgtggtcacagctcgagacggcgggtccccttccttgtgggccactgcatcagtctcagtcgaagtggccgacgtcaacgacaacgctcccgccttcgcccagccagaatacacggtgttcgttaaggaaaacaacccacccggctgccatatttttacagtctctgcttgggatgccgatgctcaagagaatgccttggtctcttatagtttagtggaaaggcgtgtgggcgagcgcgcgctcagttcttacgtctcagtccatgcagaatcaggaaaggtatacgcactgcaacctcttgatcatgaggaactcgaactgctccagttccaggtgaccgccagggatgctggagtacctccattaggcagcaacgtgaccttgcaggtgttcgtgctcgacgagaatgataatgctccagcattgctggctccccgggccggtggcactggtggagctgtcagtgaactagtgccatggagcgtgggagttggacacgtcgtcgcaaaagtcagagcagttgacgccgatagcggatacaatgcatggctctcatacgaactgcagcctggaacagggggtgcccgcatcccgtttagagtgggactgtatacaggggagatctcaaccactagagcactggacgaaaccgacgccccacgacacagattgcttgtgctcgtcaaagatcacggggaacccgcactaaccgctaccgccacggtcttggtgagcctcgtggagtcagggcaggctcctaaagcgtcttccagagccctcgtgggcgctgttggtccagacgcagcccttgttgatgtgaatgtctatctgatcatcgccatatgtgcagtttcatctctgctcgtcctgaccctgctgctgtataccgcactgagatgttcggcattaccgaccgaaggcgcgtgtgcacccggcaagccaacactggtatgctcttcagccgtgggctcctggagctattcccagcagaggcggccccgggtctgctctggcgaagggcctccaaaaaccgatctcatggcattttcccccagtcttccggacagtcgggatcgagaagatcagctgcagacaaccgaggagagctttgcgaagccgcggcagcctaatccagactggcggtacagtgcctctctgcgcgctggaatgcactctagcgtgcatctggaagaggccgggatcctgagggccggtccgggaggtccagaccagcagtggcctaccgtgagctctgccacaccagagccggaagccggtgaggtgtcacctcctgtcggcgctggcgtaaactccaattcatggacctttaaatatggccccggtaacccaaaacaaagcggcccaggtgagctccccgataagtttatcataccaggatcccctgcgattatttccatcagacaggaaccaacaaattctcagattgacaaatccgatttcattacattcggcaagaaagaagagaccaagaagaaaaagaagaagaaaaagggtaacaagacacaagagaaaaaagagaagggaaatagtacaactgacaacagcgatcagtag

SEQ ID NO: 45228 - DNA, 2403 bp, Artificial Sequence
  Description of Artificial Sequence: Synthetic coding sequence
atggccgtgcgggagctgtgcttcccccggcagcggcaggtgctgttcctgttcctcttctggggggtgtcattggcgggctctggattcggtcgttatagcgtcaccgaggagactgaaaaagggtcatttgttgtgaacctggcaaaggaccttggactggctgaaggtgagctggcggccagagggacacgggtggtgagtgatgacaataaacagtacctgctcctggattctcacaccggtaacctcctgacaaatgagaagctcgatcgagaaaagctctgtgggcctaaggagccttgcatgctttacttccagattctcatggatgaccccttccagatttatagggcagaactgagggtgagggatataaatgatcacgctcccgtctttcaggacaaggagactgtgctcaagatctctgagaatacagctgaaggcacggcatttcgcctggagagagcccaggatcctgacgggggtttaaatggtatacaaaactacaccatatccccgaactcattctttcatataaatatatcaggaggggatgagggaatgatttacccagagcttgtgctggacaaggcactcgaccgcgaagagcagggggaattatctctgacattgacagcgctggatggtggctctccctcccgttctggcactagcactgttagaattgtcgtgcttgatgtgaacgataatgcaccccaatttgcccaagccctgtatgagacccaagctcccgagaactctcccattggctttttgatcgttaaagtttgggctgaggatgtggacagcggtgtaaatgccgaggtctcctattccttcttcgacgcctccgaaaatattcggaccacttttcaaatcaaccctttttccggcgagatcttcttgagagaactgctggattacgagttagttaattcatataagatcaatattcaggccatggatggaggaggtttatccgcgcgctgtagagttctggtagaggtgttggatacgaacgataaccctcctgaactcatcgtgtccagcttcagcaacagtgtcgccgagaatagccccgagactccattggctgtgtttaaaattaatgatcgcgattctggagagaatggaaaaatggtgtgctacattcaggagaacttaccattcttgctcaagccttccgtcgaaaacttttacatccttattacggaaggcgctctggacagagaaattagagctgagtacaacataacaatcacagtgactgatctgggtactcccaggcttaagacagaacacaacataaccgtcctggtgagcgacgtgaacgataacgcacccgcgtttactcagacaagttatacactgtttgttcgcgagaataactctcctgctctgcacatagggagcgtctctgccacagatagagatagcggcacaaacgcgcaggtcacatactccctcctaccaccacaagatccacaccttcctctggcctctctcgtttcaataaacgcagacaatggacatctctttgcactgcgcagccttgattatgaggccctccaggctttcgagttccgggttggagcaacagataggggcagccctgccctgagcagggaggctttagttagagtcttggtcctagacgctaatgacaactcgccatttgtcttatatccactgcagaacggctcagctccatgtacagagctagtgccccgggcagccgaacctggatacttggtcactaaagtcgtggctgtggatggagattccggccagaatgcttggctaagttatcagctcctgaaagcaactgagcctggtctcttcggcgtgtgggctcacaacggagaggtgaggaccgcccgcctgttatccgaacgggatgctgcaaagcacagactcgtcgtcctggtgaaggacaatggagagcccccacgaagtgcgaccgccaccctgcacctgctactggttgatgggtttagccaaccctacttaccactccccgaagcagcccccgcccaggcacaagccgaggccgaccttttgacggtgtatcttgtggtggcattggctagcgtttctagcctatttctgcttagcgtcctgcttttcgtggcagtgcggttgtgccgacggagccgagccgctagtgttggacggtgtagcgtgcccgagggtcctttcccgggtcatttggtcgacgtgcgaggggctgaaactttgtcccagtcatatcaatacgaggtgtgtctcaccggaggacctggaacctcggaattcaaattcctaaagccagtgatatctgacattcaggctcaggggcctggtcgcaagggcgaagagaattctacgtttagaaattctttcggcttcaatatccaatag

SEQ ID NO: 45229 - DNA, 1764 bp, Artificial Sequence
  Description of Artificial Sequence: Synthetic coding sequence
atgatggagacccccctgcccaaggcccccgagaagcggcaggtgaccgctattattttcctgctccttttgtgggaggcaggctctgctactattaaatactccgtgttggaggaacgcgactctggttcctttgtagcgaatctcgccaaagacttaggactcggcgtgggtgagcttgctgctcgaggcgcacgcatcctgtctaagggtaataaacagtatctccaactcgagaggaaatccggaaatctgcttctcaaggagaaactggacagggaagagctttgtggcgacatcgatccatgtattctccactttcagatgcttcttaaaaaccccgtccagtttatccagggagagttacagctgcaggatgtgaacgatcacgccccggagttcttagagaatgaaatcctcctcaagatcagcgagggctctcaccccgggactagcttccctctgaaaattgctcaggacctagatgtcgggagcaacaccgtgcaaaactatagcataagcacaaactcctactttcacctcttcacaagaaatcacagtgatggaaagaaataccccgagcttgtgctggatcaggccctggatcgtgaggagcaaccccaactgcggctgacccttacggcgctggacgggggatcccccccgcggacgggcacttcccaagtcctaattgtgatcgtggatattaacgacaatgtccctgagttcgcccagagacggtacgaggtgcaggtcccagagaatacccccataggttctttggtgattactgtcagtgcccgagatctggatgctggcactcacggggaactgtcctactcttttttccaatattccaatcagattattcaggcctttgagatcaattccattactggtgaaattcgcttcaagaaagccctggatttcgaggagatccaatcctaccacatggaagttgaggcgagcgatggaggtggattaagtggcaagtgcactgttgctatagaggtgatggacattaatgataacgcgcctgaacttactatgagcctcctgatctctgacatcctggaaaactcccccgagaccgtcgtagccgtcttcgggatttccgatcccgattccgggaataatggaaaaatgatgtgcagcattcaagatcacctgccctttttgctaaagcccacgttagagaatttttacaccctgctgacagagggcgccctcgaccgtgagagcagggctgagtacaacatcacaataacggtcacggacctggggacgccgagactgaagaccgagtataatattactttacgcgtttccgatgttaatgacaacgcccccgccttcacacagacctcctacaccttattcgtgcgcgaaaacaacagtccagcgctccatatcgggagtgttagcgctactgatcgcgactctggcactaacgcccaagtcacctacagcctcctgcccccacagaacccccacttgcctctcgcctcacttgtcagtatcaatactgacaatgggcatctttttgcactgcggagtttagactacgaagcactccaggagttcgagtttagggtgggcgcgagtgatagggggtcacccgcactgtcatccgaggctctggttcgcgtccttgtttgctggaccccaaccaccacaaggccatcatgttgtacccgatgccgcacggccccgaggccagccccatcctggtgccccggcaggccatcaagggctacttggtag

SEQ ID NO: 45230 - DNA, 726 bp, Artificial Sequence
  Description of Artificial Sequence: Synthetic coding sequence
atggaggactacctgcagggctgccgggccgccctgcaggagcggactatcatcctggattgtgtaaacatggatcttaaaatcggaaaagctacccccaaagactccaagtacgtcgagaagctggaggccctgtttccagatctgccaaaaaggaacgacatcttcgactctctccaaaaagccaagttcgacgtgagcggcttaacaacggaacagatgttacgcaaggatcaaaaaacaatctaccgccaaggagtgaaagtcgccattagtgctatttatatggacttggagatttgcgaggtattggagcgctcccacagcccacccctcaagctgactcccgcgagctcgacacacccaaacctgcatgcatacctgcagggtaatacccaggtgtcccgcaagaagttgttgcccctgctgcaggaggccctgtcggcatattttgattctatgaagattccctcaggccagccggagacagcagacgtctcgcgtgagcaggttgacaaggagctcgacagggccagcaactcacttatttctggactctcacaggacgaggaggaccccccattgccccccacaccaatgaacagcttggtggacgagtgccccctagaccaaggtcttcctaaactgtccgccgaagctgtgttcgaaaaatgttcacagatttccctgagtcagagcactacggcgagcttgagtaagaagtag

SEQ ID NO: 45231 - DNA, 1362 bp, Artificial Sequence
  Description of Artificial Sequence: Synthetic coding sequence
atggaggactacctgcagggctgccgggccgccctgcaggagagccggcctttgcacgtggtgctagggaacgaagcatgcgacctggactccactgtgagtgccctggccctggccttctacctggccaagaccacagaggccgaggaagtgttcgtgcccgtgcttaatatcaaaaggtccgaactgcccctccgaggagacatcgtcttcttcctgcagaaggtgcacatccctgagtccattctgatcttcagggacgagatagacctacacgccttgtaccaagctggccagctgacattgatcctcgtcgaccatcatatattaagcaagtctgacactgctctcgaagaggcagtagccgaggtcctggatcaccgtccaattgaaccaaagcattgccccccttgccatgtctcggtggaactggtgggcagctgtgccacattggtgactgagcggattctgcaaggcgcaccggaaattctggaccggcaaactgctgctctgctccacggcacaatcattctggattgtgttaatatggatttaaagattggcaaagccacaccaaaggattcaaagtacgtggaaaagttggaggcgctctttccagacctgccaaagagaaatgacatctttgattctctccaaaaggccaagtttgacgtctccggcttaaccactgagcagatgctgagaaaggaccagaaaaccatttaccgtcagggcgtcaaggtcgctattagcgctatttatatggatcttgaggcatttttacagcggagcaacctgctggccgatctccatgcgttctgccaggcgcactcgtatgacgtcctggtcgccatgacgattttctttaacacacacaacgaacccgtgagacaactggctatcttctgccctcatgtagctttgcagacaacaatctgtgaagtgctcgagcggagccatagccctcctctgaaactgacacctgcctcaagcactcaccccaatttgcacgcatacctccagggcaatacccaggtgtcacggaagaagctcttgccactcctgcaggaggcactctctgcatactttgacagcatgaagatcccttctgggcagcctgaaactgctgacgtgagtcgagaacaagtggacaaggagctcgacagggcttcaaacagtttgatcagcggcctgtctcaggatgaggaagatccacctctcccccctaccccaatgaatagtctggtggatgaatgtcccctcgaccaggggctgcctaagctctcggccgaggcagttttcgaaaagtgctcccagataagtctgtcccagtcgacgaccgcctcactgagcaaaaagtag

SEQ ID NO: 45232 - DNA, 1161 bp, Artificial Sequence
  Description of Artificial Sequence: Synthetic coding sequence
atggaggactacctgcagggctgccgggccgccctgcaggagagcagaccgctacatgtcgtgcttggcaatgaggcctgtgacctggacagcacagtaagcgctctggcactggcattttacctagcaaagcggagcgataccgctctggaggaagccgtcgcagaggttctggatcaccgaccaattgagccaaagcactgcccaccatgccacgtaagtgtggaactggtggggagttgcgcaaccctcgtgaccgaaagaattctacagggagcccccgagatactggataggcagacagcagccctactacacggaacgataatcttagattgcgtgaacatggacctcaagataggcaaagccacccccaaggacagcaaatatgtggaaaagcttgaagccctcttccctgatttaccaaagagaaatgacatttttgactcacttcagaaggccaagttcgatgttagtggattgacaacagagcagatgctgagaaaagatcagaaaacgatctataggcaaggggtcaaagtggccatttctgccatctacatggacttagaagcctttttgcagcggtccaatctgctcgccgacctgcatgctttctgccaagcacactcatacgatgtcctcgtggctatgacgatcttttttaatacacacaacgaaccagttaggcagttggctatcttttgtccacatgttgctctacaaactacgatctgcgaagttctggagcgctcacattctcctccacttaagttaactccagccagcagcacccaccccaatcttcacgcctacctacaggggaacacacaggttagccgcaaaaagctactgccactcctgcaggaggccctttctgcttatttcgactccatgaagatcccttccggccagcctgagactgcggatgtgagcagggagcaggttgacaaggagttggatagagcctcgaattcacttatcagcggactgtcccaggacgaggaggatccgcctctcccaccgacgccgatgaattccctcgtcgatgaatgtccactggatcagggcttgccgaagctctcagccgaagctgtgttcgagaagtgttcacagatcagtctctcccagtctactacagcatccctgtccaagaagtag

SEQ ID NO: 45233 - DNA, 657 bp, Artificial Sequence
  Description of Artificial Sequence: Synthetic coding sequence
atggacctgaagatcggcaaggccacccccaaggacagcaagtacgtcgagaagctcgaggccctctttccagacctgccaaagcgtaacgacattttcgatagcctgcaaaaagccaaatttgacgtgtccggccttacgactgaacagatgctcagaaaggaccaaaaaaccatttacagacagggggtgaaagtggccatctccgctatttacatggatctagagatttgcgaagtgctggagcgctcacactcaccacctctcaaactaacccccgccagttctacacacccaaatctgcacgcctacctccagggtaacacccaagtaagtcggaaaaaactattacctctcctacaagaggctttaagcgcatactttgattccatgaaaattccttccggccaacctgaaaccgcagatgtcagcagggaacaggttgacaaggaactggatagggcgtcgaacagcttgatatccggcctgagccaggatgaagaggatccgccactgcctcctactcccatgaattctctggtagacgaatgccccctcgaccagggactcccaaagctaagcgctgaggccgtgtttgagaaatgttcacagatttcactgtctcagtccaccaccgcctccctgtctaaaaaatag

SEQ ID NO: 45234 - DNA, 507 bp, Artificial Sequence
  Description of Artificial Sequence: Synthetic coding sequence
atgctgcggaaggaccagaagaccatctaccggcagggcgtgaaggttgctatctccgctatctacatggatctcgagatctgtgaggtgcttgagcgaagccactcaccgcccctcaaactgaccccggctagtagcacgcatccaaatctacacgcgtacctccagggcaatacccaggttagtaggaagaaattattgcctttactccaggaagcactgtccgcatatttcgatagcatgaagatcccaagcggtcagcctgagacagccgatgtgtctcgcgaacaagtggacaaagagctcgatcgagcctccaacagccttatctccggtctttcccaggatgaagaggatcccccactgccacctaccccaatgaatagtctagtggacgaatgtcctctcgaccagggcctcccaaaactgagtgcggaagcagtattcgaaaagtgttcccagataagcctgtcacagtcaacgaccgcctcactgtctaagaagtag

SEQ ID NO: 45235 - DNA, 816 bp, Artificial Sequence
  Description of Artificial Sequence: Synthetic coding sequence
atggacctgaagatcggcaaggccacccccaaggacagcaagtacgtggagaaacttgaggccttgttcccagacttaccgaaacggaacgatattttcgattctctgcaaaaggctaaattcgatgtgtcaggcctgacgacagagcagatgctgagaaaagaccagaaaaccatataccgtcagggcgtaaaggtggccataagtgcgatttacatggatctcgaggcattccttcaaaggtctaacctgttagccgacctgcacgctttttgccaagctcatagctacgacgtgcttgtggcaatgaccatttttttcaatacccacaacgaacctgtaaggcagctggccatcttctgccctcatgtggctttgcagacgacaatctgtgaagtgctcgaacggtctcatagtccacccctcaagctgacaccagcatcctctactcaccccaatctccacgcctacctgcaaggcaacactcaggtttcacggaagaaattgttacctctccttcaggaagctctgtcagcttacttcgactctatgaagatcccatcgggccaacccgagacggccgacgtatccagagaacaggttgacaaggagcttgatcgagcctccaactcactgatctccggtctcagccaagacgaggaggatcctccccttccccctactccaatgaactctcttgtcgacgagtgccctctggaccaggggcttccaaagttgtcggcagaagcggtgttcgagaaatgctcacagatctctctatctcagagtaccacagcgtccttaagtaagaagtag

SEQ ID NO: 45236 - DNA, 657 bp, Artificial Sequence
  Description of Artificial Sequence: Synthetic coding sequence
atggacctgaagatcggcaaggccacccccaaggacagcaagtacgtggaaaagttagaggccctgtttcccgacctgccaaagagaaacgatatcttcgactccttgcaaaaagccaagtttgacgtcagtggcctgacgacagaacaaatgctgcgaaaggaccagaagaccatatatagacaaggcgtgaaggtggctatctctgccatctatatggacttagaaatttgcgaagtgctcgaacgttcgcacagtccccctctgaagttaactcctgcctcttccacccatccaaacctgcacgcctacctgcagggtaacacccaggtgtcccggaagaaacttctgcccctactgcaagaggctctctcagcgtattttgattctatgaagattccttctggacaaccggaaactgccgacgtaagtcgggagcaggtagataaagagctggatagggcctcaaacagccttattagcggccttagccaggatgaggaggatcctcctctcccaccaacgccaatgaactcactggtcgacgaatgccccttagatcagggcctcccaaagctgagcgcagaggccgtttttgaaaaatgttctcagatctctctaagccagagcaccacggcctccctctcaaaaaagtag

SEQ ID NO: 45237 - DNA, 537 bp, Artificial Sequence
  Description of Artificial Sequence: Synthetic coding sequence
atggacctgaagatcggcaaggccacccccaaggacagcaagtacgtagaaaagttagaggccctgtttccagacctaccaaagagaaacgatatcttcgactccctgcagaaagccaaattcgatgtgtccgggctcaccacggagcaaatgctgaggaaggaccaaaagaccatatatagacagggcgttaaggtcgcaataagcgcaatctatatggatctggagatctgcgaggtgctcgagcggagtcacagtcctccgctcaagcttacaccagcgtcgagtactcatcccaatttgcatgcctatctgcaggggaacacacaggtatccagaaaaaagctgttgccactcctgcaggaggccctgtcagcctattttgactcaatgaaaatcccgtctggccagcccgaaacagctgacgtcagcagggagcaggttgataaggaactcgaccgggcgtctaactcactcatttctggtctcagtcaggacgaggaagacccccccctgccccctaccccaatgaactag

SEQ ID NO: 45238 - DNA, 423 bp, Artificial Sequence
  Description of Artificial Sequence: Synthetic coding sequence
atggacctgaagatcggcaaggccacccccaaggacagcaagtacgtagaaaaactggaggctctattccccgacttgcctaaaaggaatgacattttcgatagcctgcagaaagccaagttcgacgtgtcagggctaaccaccgaacagatgctccgaaaggaccagaagacaatttaccgtcagggcgtaaaggtcgccatctccgccatctatatggatctcgaggccttcttacagcggagcaaccttctggccgacctgcatgcattctgtcaggcccactcttatgacgtactagtggcaatgactattttctttaatacacataatgagcctgtgcgccagctggcgatcttttgtccgcacgtagccctacaaaccaccatttgtgaggtcctagaaagatctcattcaccgtag

SEQ ID NO: 45239 - DNA, 5241 bp, Artificial Sequence
  Description of Artificial Sequence: Synthetic coding sequence
atgagcgcctgcaacaccttcaccgagcacgtgtggaagcccggcgagtgcaaaaactgctttaaacctaagtcactacatcagctgccaccagatccggaaaaggcccccatcacgcacgggaatgttaaaaccaatgctaatcacagcaataaccaccggataaggaataccggtaactttcgccccccagtcgcaaaaaagccaaccatcgccgtgaagcccacaatgatagtagcggacgggcagtcaatttgcggggagctgagcatccaggaacactgtgagaataaaccggttataatcgggtggaatcgaaatcgagccgcgttgtctcagaaaccacttaacaataataatgaggatgacgaaggcatatcccacgtgcccaagccttatgggaacaacgactcagcaaaaaagatgtccgataataataacggactcactgaagtgttaaaagagatcgctggcctggatacagcgccacagatccgcgggaacgagaccaactcacgcgagactttcctgggtaggatcaacgactgctacaagcggtctctcgaaagaaagctgccaccatcgtgtatgatcggcgggatcaaagagactcaggggaaacacgtgattctgtccggatcaacggaggtcattagcaatgagggtggacgattctgctacccggaattcagctctggcgaggagtctgaagaggacgtcctttttagcaatatggaagaagagcatgaatcgtgggacgaaagtgacgaggagctgctggccatggaaattagaatgcgcgggcagcccaggttcgcaaatttcagagcaaatacgttaagccccgttcggtttttcgtcgacaagaaatggaatacgattccgttaaggaacaagagcctgcagagaatttgtgcagtggattacgacgattcctatgacgaaattttgaatggctatgaggagaactcagtcgtaagctacggccagggctctatccagtctatggttagcagtgactccacctccccggactcctctctgacagaggagtctaggtcggaaaccgccagctccttgtcccaaaagatttgcaacggagggctgtcccctggcaaccctggggacagcaaggacatgaaagagattgagcctaattatgagtccccatcttccaataaccaggacaaagactcctcacaggcatctaagtcgtctataaaagtgccagaaactcataaagccgtactcgctctgcgcctcgaagagaaggacggtaagatcgcggtgcagaccgaaaaagaggagagcaaggcgtctactgatgtcgccggacaggccgtgaccataaatctggtcccgactgaagagcaggccaaaccctatcgggtcgtcaacctggaacaaccgctgtgtaagccctacaccgtggttgatgtctcggcagccatggcctctgaacacctcgagggtcccgtcaactcccctaagaccaaatctagcagctccaccccgaattctcccgtgaccagcagcagcctaacccccggccagattagcgcccactttcaaaagtcatccgctattcgctatcaggaagtctggaccagctctacgtcacctagacagaaaattcccaaggtggagctgatcaccagcggcacgggcccaaacgtgccccctcgcaaaaattgccacaagagtgctcccacaagccctactgctaccaatattagctccaaaaccatcccagtgaagagcccaaatctgtccgagattaagttcaattcctacaacaatgcaggaatgcccccctttccgattattatccatgatgaacccacctacgccagatcctcaaagaatgcgattaaggtacctatcgtaatcaatcccaatgcctatgacaacctcgcaatttacaagagctttctgggcacgtctggcgagcttagcgtcaaagagaagaccacgagtgtgatcagtcacacttacgaggagatcgagactgagtccaaagtgccagataacacaacctcaaaaactaccgactgtttacagaccaaaggcttctccaactccactgaacataaaaggggatcagtcgctcagaaggtccaagaattcaacaattgtctgaacagaggacagtcgagtccccagcgatcctactcgagcagccatagcagccccgccaaaatccagcgcgcgacacaggaaccagtggcaaagatagagggcacccaggagtcacaaatggttggcagtagctctacccgcgagaaggcctctacggtgttatcccagatagtggcgtctatccaacctccacagtcccctcccgagaccccacagagcggccccaaggcctgttcggtggaagagctctacgctatccccccagatgccgatgtagccaaatctacccccaagtccaccccggtaaggccaaagtccctgttcacaagccaaccctcaggcgaggcggaagccccacagacaactgattccccgacaacgaaggtgcagaaagatcccagtattaagcccgtgactcctagtcctagcaagctggtcacatccccgcagagcgagccaccagccccctttcctcccccacgctctacctcttctccatatcacgccggtaaccttcttcagcgccatttcacgaattggactaaaccaacctcccccacccgtagcactgaagcagagtccgtcttgcactccgaagggagcagaagagccgccgacgccaagcccaagagatggatttcctttaagagtttctttcggcggcggaagaccgacgaagaggacgataaagaaaaggaaagagaaaagggcaaacttgtaggcttagacggaaccgtgattcacatgctgcctccaccacctgtccagagacaccactggtttacagaggccaagggagagtcttctgagaaacccgctatcgtattcatgtatcggtgcgatccggctcagggacagctgtctgtggaccagtcaaaggcgcggacggatcaagcggctgtgatggagaagggacgggctgagaatgccttgctgcaagactccgaaaaaaaaagatctcattcctcaccatcccagattcccaagaagattctctctcacatgactcacgaagttaccgaggacttttccccacgtgacccacgaaccgttgtggggaaacaggacggcaggggttgcacaagtgttacaacggctctcagcctgccagagctcgaaagggaagatgggaaggaggacataagcgaccccatggatcctaatccatgcagtgctacgtacagcaatttggggcagtcaagagcagcaatgataccccctaaacaaccgaggcagcccaagggagctgtggacgatgctatagcgtttggcggtaaaacagatcaggaggcgccgaatgcttcccagccaacaccccccccgttgccgaagaagatgattattagagccaatactgagccaataagcaaagacctacagaagagcatggagagctctctgtgtgtgatggcaaacccaacttatgatatcgaccccaattgggacgcttcctccgcaggtagctctattagctatgagctgaagggtctcgacattgagtcgtatgactcattggagcgccccttgcgcaaagagaggcccgtgccgtctgcagctaatagcatttcttctctgaccaccttatccattaaagaccggttcagcaactccatggagtccctgtcttctcggcgcgggccaagctgcagacagggcaggggaatccagaagccacagcggcaggcactgtatcggggactggagaaccgggaagaagttgtgggaaaaatcagaagtcttcatacagacgcccttaaaaagctggcagtaaaatgcgaagatttattcatggccggacaaaaagatcagctccgtttcggggttgattcctggagcgatttcagactgacatccgacaagccgtgctgtgaggcaggggatgcagtatattacaccgcaagctacgcaaaggaccctttaaacaactacgccgtaaagatctgcaaaagcaaggccaaggagagccagcagtactatcatagcttggccgtccgtcagagtttagctgttcattttaacatccagcaagattgcgggcactttctcgccgaggttccaaatcgtctcttaccatgggaggaccccgacgacccagagaaggatgaagacgacatggaagagaccgaggaggatgctaaaggtgagacagatggcaagaaccctaaaccctgctctgaagccgcctcttctcagaaggagaaccagggcgtaatgtccaagaaacagcgcagtcatgtggttgtgattacccgtgaggttccttgcctaaccgttgctgacttcgttagagactcgctggcccagcatggaaaaagcccagatctgtacgagagacaagtgtgtctactgttgcttcagctatgcagcggtctcgagcatctaaagccttatcatgtcacccactgcgatcttcgattggagaacctcctacttgtccattaccaacccggagggactgcacagggcttcggtcccgcagagcccagtcctaccagcagttacccaacaagactgatcgtgagcaatttcagtcaggcaaaacaaaaatcccatctggtggacccagagattctgcgggaccaatctagacttgctccagaaatcattacggctacacagtataaaaaatgtgatgaatttcagacaggcatcctaatttacgaaatgctacacctgccgaatcccttcgatgagaacccagagctgaaggagcgagagtacacgcgggccgatctccccaggataccttttcgcagcccctacagccgggggctacagcaacttgcttcttgcctgctgaatcccaatcctagtgagaggatacttattagtgacgctaaagggatcttgcagtgtttactttggggcccaagagaagacctgtttcagacttttacagcatgcccttcattagtgcagagaaacacactgctgcagaattggctggatataaagagaactctcctgatgatcaagttcgcagagaaatcactagaccgcgaaggtggcatctcattagaggactggctgtgtgcccagtatctggcttttgctactactgattcactgtcttgcatcgtgaaaattctgcagcataggtag

SEQ ID NO: 45240 - DNA, 5241 bp, Artificial Sequence
  Description of Artificial Sequence: Synthetic coding sequence
atgagcgcctgcaacaccttcaccgagcacgtgtggaagcccggcgaatgcaagaattgtttcaagcccaaatctctccatcaactgccgccagatccagagaaggctccgattacccatgggaatgtcaaaaccaacgccaatcatagcaacaaccacagaataaggaatacgggaaactttaggccgccggtggctaaaaagcctactattgcagtgaagccaacgatgatagtagccgacgggcaatctatctgcggcgagctgagtattcaagagcactgcgagaataaacctgtaatcatcggctggaatcggaatagagcggcattatctcaaaaacccttgaataacaacaacgaggacgatgagggaatttcccacgttcccaagccctatggaaacaacgattcagccaagaagatgagcgataataataacggcttgaccgaggtccttaaagaaatagcaggcctggacactgccccacagatcaggggcaacgaaacaaatagccgagagacattcctcggccgcatcaatgattgctataagagaagcctggagcggaagctgccccctagctgtatgattggagggatcaaggagacccaaggtaagcatgtgatcctcagcggatcaaccgaagtcatctccaacgaaggcggccgcttttgctatcccgagttctcaagtggagaagagtccgaggaggatgtcttgttttccaatatggaggaagagcacgagtcttgggacgaaagtgatgaggagttactcgctatggaaattagaatgcgtggtcaacccaggttcgctaatttcagagccaacaccctctccccagtgagattctttgtggataagaagtggaataccatccccctccgtaataaaagcctgcagagaatctgtgcggtggactacgacgactcctatgatgagatcctgaacggctacgaggaaaattctgtggtaagctatgggcaggggagcatacaatccatggtgtcctccgacagcactagccctgatagttccctcaccgaggagtcccgatctgaaactgcgtcctcgctttctcagaagatttgcaacggcgggctatctcctggaaatccaggagactcaaaagacatgaaggaaatcgaaccaaattacgagtctcccagctccaacaatcaggataaggactcctcacaggctagcaaatcttcaatcaaggtacctgagacgcataaagccgtgctggctctacggttggaggagaaagatggcaaaatcgccgtccagacagagaaagaagagtctaaggccagcaccgatgtggctggtcaggcggttactataaacctagtgccgaccgaggaacaagccaaaccttaccgcgttgtcaatctagaacagcccctgtgtaagccatatacagtagttgacgtgtctgcagccatggcctccgagcacctagaggggcccgtgaattccccaaagacaaagagcagtagctccacccctaattcgccggtgacaagctcttctctgacacccgggcaaatctcagcacatttccaaaagagttccgcaattcggtaccaggaagtgtggacttcttcaacttcaccccgccaaaaaatccccaaagtggagctgatcacgtcagggaccggccctaacgtgccgccaaggaaaaactgccataaaagcgcgcctacatctccaactgctactaatatctctagcaagactatccctgttaagagcccgaatctctcagaaattaaatttaatagttataacaacgcgggcatgccaccgttcccaatcatcatccatgatgagcccacgtacgctcgtagctctaagaacgccatcaaagtgccgatcgtgatcaatccaaacgcctacgataacctggcaatttataagagttttctgggcactagcggcgagctgtctgtgaaggagaaaacaacgtccgtcatctcacatacctatgaggaaatcgagacagagtcaaaggtccctgacaacacgacgtcaaaaactaccgactgtctccagacaaaaggtttttccaactctaccgagcacaagcgtggatctgtcgcccagaaagtccaggaatttaacaattgtctcaacagaggtcagtcatcaccacaacgcagctacagcagtagccattcctcacccgctaagatccagcgcgctactcaggaacctgtggcaaaaattgagggaacccaggagagccagatggtgggatctagcagcacaagagagaaagcttcgaccgttctgagccagatagtggcttccattcagcctccccagtctccccccgagactccccagtcaggaccaaaggcttgcagcgttgaggagctgtacgcgatcccccccgatgccgatgtggcaaaaagcactccaaaaagcacacctgtcagacctaaatctctgttcacatcacaacctagtggagaggctgaggccccccagaccaccgactctccaacaaccaaggttcagaaagatccaagtatcaagcctgtcacacccagtcccagtaagctcgtgacctctcctcagtccgaacctcctgccccgtttcctccccctcgcagcaccagttcgccttaccatgctgggaatctgttgcagagacacttcaccaactggaccaagccgacctcccctacgagaagcactgaggcagagagcgttctgcatagcgagggctctagacgggcagcggacgcaaagcccaaacgttggatttccttcaagtctttcttcaggcggcgaaagacagacgaagaagacgacaaagaaaaagaacgtgagaagggcaagttggtgggcttggacggcacagtgattcacatgcttcccccgcctcctgtgcagcggcaccactggttcaccgaggccaagggggagtcctccgagaagcccgccatcgtattcatgtacagatgtgaccctgctcaaggccagctgtctgttgatcagtctaaagcccggactgaccaggcggctgtcatggagaaaggccgtgcggaaaacgccctcctgcaggattctgaaaagaagcgctcacactcctccccatcccagatcccaaaaaagattctgtcccacatgactcatgaagttactgaggacttcagcccaagagacccccggactgtcgttggcaaacaggacgggcggggttgcacctcagtgacaaccgccctgagtctgcccgaactggaaagagaggacggcaaggaggacatttccgaccctatggatcctaacccgtgttctgctacttactccaatttaggccagtcccgggccgctatgattccccctaagcagccacgacaacccaagggagccgtagacgacgcaatcgcatttggtggaaagacggaccaggaggcacctaatgcatcacagcccacgcccccgcccttaccaaagaagatgattatcagggccaacacggaacccattagtaaggacctgcagaagagcatggagagcagtctgtgcgtcatggccaaccccacctatgatatcgatcctaattgggacgccagctcagccggctccagtatctcttacgagctcaaaggactcgacatagaatcatacgactccctggaacgccccctccggaaggagcgtccagtgccatcagccgccaactcaatctcctccctgacaaccctgagcattaaggacaggttctcaaacagcatggagagcctctcgtccaggcgtggccccagctgtaggcaggggaggggtatccagaaacctcagaggcaagccctctatcggggactggaaaatcgggaggaggtcgtgggaaagattcggagcctgcacacagatgcattgaaaaagttagcagtcaagtgcgaagatctgttcatggccggacaaaaagatcaacttcggtttggcgtagattcatggtccgatttccggttaacctccgacaaaccttgctgtgaggctggcgatgcagtctactacactgctagctacgccaaagatcctctgaataattatgctgtgaaaatatgcaaatctaaagcaaaagagagccagcagtactaccattctcttgccgtgaggcagtcactcgcggtgcatttcaacatacagcaggactgcggccactttttggctgaggttcctaacagattactcccctgggaagacccagatgaccccgaaaaggacgaagacgatatggaggagacagaggaggacgccaagggagaaactgatggcaagaatcctaaaccatgcagtgaggcggccagtagccagaaggagaatcagggcgtaatgtctaaaaagcagcgaagccatgtcgtcgtgattactcgggaagtgccctgtctcacagtggcagattttgtccgagactctttggctcagcacggcaagtctcctgatctgtacgagcgccaggtatgtcttctcttactgcagctgtgcagtggattggagcacctgaaaccatatcacgtcacacactgcgaccttaggctcgaaaatctgctgctcgtgcactatcaacccggaggtactgcccagggcttcggtcctgccgaacccagcccaacgtcaagttaccctacacgcctgatcgtgtcaaactttagtcaggctaaacagaaatctcaccttgtcgaccccgaaattctcagagatcagtctcggttggcacccgagatcataacagctactcagtataaaaagtgcgacgaatttcagactggcatcttgatttacgagatgttacacctccctaatccgttcgacgaaaatcccgaactcaaggagagagaatacactcgagcagatctcccaagaatccccttccgatccccttacagtcgggggctgcagcagcttgcatcctgcctcctgaatccaaacccatccgagcgcattctaatcagcgatgctaaaggaattctgcagtgtcttctgtggggccccagggaggatctgttccagacttttacagcatgtccaagcctcgtacagcggaatacactgctccagaattggctggacattaaacgtaccctgctgatgattaagttcgctgagaagtctctagatcgggagggaggtatctccctggaggactggctgtgcgcacagtatttagcttttgcaacaaccgatagtctgtcttgtatcgttaaaattcttcaacaccgctag

SEQ ID NO: 45241 - DNA, 3402 bp, Artificial Sequence
  Description of Artificial Sequence: Synthetic coding sequence
atggacgtgctggccgaggagttcggcaacctgacccccgagcagcttgcagctcctattccaacagtggaagaaaagtggcgtttgctgccggcctttctcaaggtaaaaggccttgtcaagcagcatatcgattcttttaactacttcatcaacgtggagattaagaaaataatgaaagccaatgaaaaagtgacttccgacgcggatcccatgtggtatctaaagtacctcaacatctacgtgggactgcctgacgtggaagaaagcttcaacgtgaccaggccggtctccccgcacgaatgtcgcctgcgggatatgacatactccgccccgatcaccgtagacatcgagtacactcgaggctcccagagaatcatccggaacgcactgccaatcggtagaatgcctatcatgctgaggagctctaattgcgtgctcactggcaagacacctgcggaatttgcaaagctgaatgagtgccccttggatcctggcggctattttatcgtgaaaggagtggaaaaggtaatcctgatccaagaacagctatccaagaatcgcatcatcgttgaagccgaccgcaagggggccgttggtgctagcgtgacctccagtacccacgaaaaaaaaagccgcaccaatatggccgttaagcaaggaagattctatctgcgacataataccctttctgaggatatccctatcgtgattatcttcaaggcaatgggggtggaaagtgaccaggaaattgtgcagatgattggcacagaggaacacgttatggcagccttcggacccagcctcgaagagtgtcagaaagcccagatctttacacagatgcaggcactcaagtatattggtaacaaggtgaggagacagaggatgtggggaggtggccctaaaaaaacaaaaatcgaggaagcgcgagagcttctggcgtccacgatactgactcatgttcctgttaaagagttcaacttccgcgccaaatgtatctacacggcagtaatggtgcgccgagtgatccttgcacagggcgataataaagtggatgaccgcgactactacggcaataaacggctcgagctagcaggtcagctgctctcccttctgttcgaggatctgttcaagaaatttaacagtgaaatgaaaaaaatcgccgatcaggtgataccgaagcagagggcagctcaatttgatgtcgtgaaacacatgagacaagatcagattaccaatggtatggtgaacgcaattagtacaggcaactggtctctgaaacgattcaagatggatcgccagggcgtgacccaagtgctctctcggctgagttacatctctgccctggggatgatgacgaggatcagctcccaatttgaaaagacgcggaaagtctctggacctcgcagtctccagcccagccagtggggcatgctctgtcccagtgataccccggaaggagaggcctgcgggctggtcaaaaatctagcgctgatgacacatattacgactgatatggaagatgggccgatcgtgaagttagcctccaatctgggcgttgaggacgtcaatctcctctgtggcgaggagctctcctaccctaatgtcttcttggtcttccttaatggaaacattctaggcgtcatacgagaccacaaaaagctggtcaacacctttcggctgatgaggagagccgggtacattaatgaattcgtttcaatcagtactaaccttacggaccgctgcgtttacatcagctccgatggagggcgcctgtgcagaccctacataattgtgaaaaagcagaagccagccgttacgaataaacacatggaagaactggctcagggatatcggaactttgaagattttctccatgagagcctagtcgagtacctggacgtgaacgaggagaacgattgtaacatagccctttatgagcacaccatcaataaggacacaacacacttagaaatcgaaccgtttaccctgctgggagtctgtgctgggttgattccctacccccaccataatcagagccctagaaatacctaccagtgtgccatggggaagcaggcgatgggcacaatcggctataatcaacgcaataggatcgacaccttgatgtacctgctggcctatccgcagaagccgatggttaagacaaagacaatcgagctgattgaatttgaaaagctacccgctggccagaatgctaccgtggcagtaatgagttattctgggtatgatatcgaagacgcactggtgctaaacaaagctagtttggacaggggtttcggacggtgcctcgtttataaaaatgctaagtgcacactgaagcggtacactaaccagacttttgataaagttatgggcccgatgctggacgccgccacacggaagccgatctggaggcatgaaatcctggacgccgacgggatctgcagtccaggtgagaaagtggagaataagcaggtactcgtaaacaaatctatgcccaccgttacccagatacccctggaagggagcaacgtgccccagcaacctcagtacaaggatgtcccaatcacctacaagggcgctacagactcctacatcgagaaggttatgatctccagcaatgctgaggatgctttcctgatcaaaatgctcctgcgccaaacccgtcgcccggagatcggagataagttttctagtcgacacggccagaagggagtttgcggcctcattgtgcctcaagaagacatgcccttttgtgactccggcatctgccccgacataattatgaacccccatgggtttccctcacgcatgacggttggcaaactaatcgaattactggccggaaaggctggggtgctggacggacggttccattatggcactgccttcggaggatcaaaagtcaaggacgtgtgcgaggacctagttcggcacgggtacaactacctgggcaaagattacgtgacgtcgggcatcaccggcgagcctttagaagcgtacatttattttggtccggtctactatcaaaagcttaagcatatggttctggataaaatgcatgcaagggcccggggcccacgagcggtgttgacgcgacagcctactgaaggccgcagcagggacggcggtttgagactcggcgagatggagagagattgcctcattggttatggggcttccatgctcctgctggaaagacttatgatctcatccgatgctttcgaggtggacgtgtgtggccaatgcggactcctcggctatagcggctggtgccattattgtaagtcttcgtgccacgtcagttctttacgcattccgtatgcctgtaaacttctgtttcaggaactgcaatccatgaacataatcccccggctgaagctgagcaaatacaatgagtag

SEQ ID NO: 45242 - DNA, 3036 bp, Artificial Sequence
  Description of Artificial Sequence: Synthetic coding sequence
atgatgagcgacgccagcgacatgctggccgccgccctggagcagatggacggaattatcgctggcagtaaagccctggagtattctaacggaatctttgactgtcagagcccaacctcaccctttatgggatctctgagagcactccacttggtagaggatctgcgcggactattggaaatgatggaaacagacgagaaggaagggctgagatgccagattcccgattcaaccgcagagactttggtggaatggctgcagtcacagatgactaacggccatcttcctggcaacggagacgtgtaccaagagcgcctggctaggctcgaaaacgacaaagaatcactcgttctgcaagtcagcgtgttgacggaccaggtggaggcccagggcgagaaaatccgggatttggagttctgcctagaagagcatcgggaaaaggtgaatgccacggaggaaatgttgcaacaggagctgctatcacgaaccagcctcgagactcaaaagctagatctcatggccgagattagcaacttgaagctaaaactgactgccgtggagaaggataggctggactacgaggataaattcagggacactgaaggccttatccaagaaataaacgatttacggttaaaagtgagtgagatggattcagagcgtctgcagtacgaaaagaagctcaaatctacaaagtcattaatggcaaagcttagttcaatgaagattaaggtaggccagatgcagtatgaaaagcaacgaatggagcagaaatgggagtcactaaaagatgagctggctagccttaaggaacaactggaggagaaagaatccgaagtaaaacggctgcaggaaaagctcgtgtgcaagatgaagggcgagggggtggagattgtcgacagagacatcgaggtgcaaaaaatgaagaaagctgttgaatctctgatggcagctaacgaagaaaaggaccggaagatcgaggacttgagacagtgtctcaatagatacaaaaaaatgcaggataccgtggttcttgcccagggcaaggacggtgagtacgaggagctcctgaacagtagctccattagctcactgctagatgctcaaggcttttcagatctggagaagagcccatctcccacccccgtgatgggttccccctcatgcgatcctttcaatacatccgtgcctgaagagttccataccaccatccttcaagtcagcataccctccctgctgccagcaactgtctctatggagactagcgagaagagcaaactgactccaaagcctgagacttcatttgaggagaacgatgggaacattattctgggcgccaccgtggatacgcaactttgtgacaagttgctaaccagctcgctgcagaaatcctccagtctcggtaatctcaagaaagaaacttccgacggcgagaaggaaaccattcagaagactagcgaagatcgggcccccgctgagagccggccatttgggaccctccctcccaggcctcccgggcaggatacatcgatggatgacaacccttttggaacgcgtaaggtgcgttcaagctttggacgcggcttttttaaaataaagtccaacaagcgaactgcatccgcgcccaatcttgccgagaccgaaaaagagacggccgaacatttggatctggccggcgcctccagcagacccaaggattcccagcgtaatagcccctttcagatcccaccgcccagccctgacagtaaaaagaaaagcagaggaattatgaagctgtttggcaagctgaggaggtcacagtctaccactttcaacccagatgatatgagtgagcccgagtttaaaagaggtgggacgcgagccaccgcggggccacgcttgggatggagtagggatctagggcaaagcaactcagatctggatatgccctttgccaaatggaccaaagagcaggtgtgtaactggctcatggagcaggggctgggaagttatctgaactccggcaagcattggattgcctcagggcagacattattacaagcatcccagcaggatctggagaaagagctgggcattaagcattcgctccatcggaaaaagctacagctggccttgcaggctcttgggtccgaagaggagacaaatcatggaaagcttgatttcaattgggtcacaaggtggctggacgatattgggcttccgcagtataaaactcagtttgacgagggcagagtcgatggaagaatgcttcactacatgacagtcgacgacctgctgagcctcaaagtggtgtccgtgctacaccatctgagcatcaaacgggcaattcaagtcctgcgaatcaataattttgaacccaattgtcttagacggcgcccttcggatgaaaatacaatcgcaccaagtgaggtacagaagtggaccaatcaccgggtgatggagtggctgaggtctgttgatctggcagagtacgcccccaacctacgagggagtggagtgcatggaggcctcatggttctggagcctaggttcaatgtggagaccatggcacagttgctgaatatccctccaaataagacccttctgcgccgacaccttgccacgcacttcaacctgctgatcggcgccgaggctcaacaccagaaaagagatgcgatggagttgcccgattacgttctccttactgccacggccaaagttaaacctaaaaaattggcatttagcaactttggtaatctgcggaagaagaagcaggaggatggtgaggagtatgtgtgcccaatggagctcgggcaggctagtgggtccgcctcaaaaaaaggcttcaagccagggctcgatatgagattatacgaggaggatgacctcgacagactcgagcagatggaagattctgaaggtactgttagacagataggagcattctctgaaggtattaataacttgacacacatgctgaaggaagatgatatgtttaaagattttgccgccaggtctcccagcgcttcaattactgatgaagacagcaatgtctag

SEQ ID NO: 45243 - DNA, 513 bp, Artificial Sequence
  Description of Artificial Sequence: Synthetic coding sequence
atgatgagcgacgccagcgacatgctggccgccgccctggagcagatggatggaatcatagctgggtccaaggcactagaatactccaacggcatctttgactgccagtcacccacatcacccttcatgggctccttacgcgcactgcatctcgtcgaagacttgaggggactcttagaaatgatggaaactgacgaaaaagagggcttgcgttgccagatcccagacagcactgccgagaccctagtggagtggctgcaatctcagatgacaaacggacatctgccaggtaacggcgacgtctatcaggaaaggctggcgcgcctagaaaatgacaaagagtctctagtgttgcaggttagtgtgctcaccgatcaggttgaggcccagggggagaaaattagggacctagaattctgcctggaagaacaccgtgaaaaggtcaatgccaccgaggagatgctgcagcaggtgtgcgccgaggccagaaccaagatgggcttcccatgttag

SEQ ID NO: 45244 - DNA, 261 bp, Artificial Sequence
  Description of Artificial Sequence: Synthetic coding sequence
atgatgagcgacgccagcgacatgctggccgccgccctggagcagatggacgggattattgccggcagcaaggccctcgaatattcaaatggtatctttgattgtcaatctcctacaagtccattcatgggcagccttcgggccttgcatttggtagaggatcttagggggctcttggagatgatggagacagatgagaaagaggggctgagatgccagatccctgacagcactgccgagacacttgttgaatggctttag

SEQ ID NO: 45245 - DNA, 2577 bp, Artificial Sequence
  Description of Artificial Sequence: Synthetic coding sequence
atgctgcagcaggagctgctgagccggaccagcctggagacccagaaactagacctgatggccgagattagcaacctgaagttgaagctgaccgcagtcgagaaggacaggctggactacgaagacaaatttcgagataccgaaggtttgatccaggagataaatgacttgagattaaaagtttcggaaatggactcagagcgcctgcaatacgagaagaagttgaaaagcaccaaatccctgatggcaaagctgtctagcatgaagattaaggtcgggcaaatgcagtatgagaagcagcgcatggagcaaaagtgggagtcactgaaggatgaactggcatctctcaaggaacaactcgaggagaaggaatccgaagtcaagcgactgcaggagaaactggtgtgtaagatgaaaggagagggcgtggagattgtggaccgggacatcgaggtgcagaaaatgaaaaaagctgttgaaagcctgatggccgctaatgaggaaaaagatcgtaagattgaggacctgaggcagtgcctcaatagatataaaaagatgcaggatacggtcgtcctcgcacaagggaaggacggagaatacgaggagctgctgaattccagctccatctcctctctgcttgacgctcagggcttttccgacttggagaaaagtccatcaccaacacctgtaatgggatcgccctcctgcgatccgtttaacacttcagtgccggaagaattccacacaacaattttacaggtaagcatcccctctctcttgccggccaccgtgtccatggaaacctctgagaagtcaaaactcaccccgaagcccgagacatcatttgaggagaatgatgggaatataattcttggcgcaacggtagacactcagctgtgtgacaagctgttgacatcgtctcttcagaagtctagctcactgggaaatttaaaaaaggaaacatctgacggagaaaaagagacaatccaaaaaacttcggaagacagagctcccgctgagtcaagaccattcggcactctgcccccacggccaccaggacaggatacatcaatggacgacaatccattcgggacacgcaaagtaagatcaagcttcggccgggggttttttaaaattaaatcgaataagaggaccgcgagtgcacccaatctggctgagaccgaaaaggagactgccgagcacctcgatctggcaggagcctccagccgtcctaaggactctcagaggaatagtccatttcaaattccgcctccctccccagattccaagaaaaagtcccgcggaatcatgaaactctttggtaagctgaggaggagccagagcaccacattcaatccggacgacatgtcagaaccagagttcaagcggggtgggacacgtgcgaccgccggcccacggttgggatggtctagagatctgggacagtctaattcggaccttgatatgccttttgccaaatggacgaaggagcaggtgtgcaactggctcatggagcagggtctgggaagttacctgaactctgggaagcactggattgctagcggccagaccctgttacaggcttcccaacaagatttggagaaggaactgggaattaagcattccctacacagaaagaagctccagctggctttacaggcactgggtagtgaagaagagaccaaccatggcaaactggatttcaattgggtaacccggtggctggatgatattggtttacctcagtataagacccagtttgacgaggggagagtggacgggagaatgctccactatatgaccgttgacgacctcctgtcgcttaaggtggtgagtgtgctccatcaccttagtattaagcgggccattcaggtcctgcggatcaataactttgagccaaattgtcttcggcggaggcccagcgatgagaacacaatagccccatccgaagttcaaaagtggacgaaccatcgggtcatggaatggctccgctccgtggaccttgcggagtacgccccaaacctccgggggtcaggggtgcatggcggcctgatggttctggagcctcgctttaacgtggagaccatggcgcagttactcaacatccccccgaataagacactgcttcgtcgccatctggctactcatttcaatctcctcatcggagctgaagcacaacaccagaaacgggacgccatggaattgcccgactacgttctgttaacggcaactgccaaagtgaagcccaaaaagctggctttctctaactttggcaacctccggaagaaaaaacaggaggatggggaggagtatgtctgtcccatggagctgggtcaggcaagcggatcggcttccaagaaggggttcaaaccaggcttggatatgagattgtacgaagaagacgacctggataggttagagcagatggaggacagtgagggtactgtgcgccagataggcgccttcagcgaagggatcaataacctcacccatatgcttaaggaggacgatatgttcaaggacttcgccgctcgatctcctagcgccagcataactgacgaggacagtaacgtgtag

SEQ ID NO: 45246 - DNA, 57 bp, Artificial Sequence
  Description of Artificial Sequence: Synthetic coding sequence
atgctgcagcaggagctgctgagccggaccagcctggagacccagaaactcgattag

SEQ ID NO: 45247 - DNA, 2943 bp, Artificial Sequence
  Description of Artificial Sequence: Synthetic coding sequence
atgatgagcgacgccagcgacatgctggccgccgccctggagcagatggacggcatcatagccggcagcaaagccctagaatactccaatggcattttcgactgtcagtctccaacctcacccttcatgggctccctccgtgccctgcatctcgtagaggatctgaggggactactggagatgatggaaaccgacgaaaaggaggggctccgttgccagattcctgactcgactgccgagaccctcgttgagtggctacagtcacagatgaccaacggccatcttcccggaaatggcgatgtgtatcaggagaggctggcccgcctggagaacgacaaggagagtctggtcttgcaagtgtctgtgctaactgaccaggtcgaggctcagggcgagaaaattcgagaccttgagttctgcttggaagagcacagagaaaaggttaacgcaactgaggagatgctacagcaggaattattaagtcgtacttcactcgagacacagaaactggatctgatggctgagatttccaatctaaagctgaagctgacggccgttgagaaggacaggctcgattacgaggataaatttcgcgacacagaaggcctgatccaggagatcaatgatctccgcctgaaagtgtccgaaatggactctgagagattacagtacgaaaaaaaattaaaaagcactaaggatgagctggcgtcgcttaaagaacagttggaggagaaagagagcgaagttaagaggctgcaagaaaagttagtttgcaagatgaagggagagggggtcgagattgtcgacagagacattgaagtacagaagatgaaaaaggccgtggaatcattgatggccgccaacgaagagaaagacagaaagattgaagacctgagacagtgcctaaaccgatacaaaaagatgcaggatactgtcgtgctggctcaggggaaagatggggagtatgaggagctgctgaattcctcctcaatcagctcccttctggatgcccagggctttagcgatctcgagaagagtccctctcccacacctgtaatgggaagccccagctgcgacccattcaacacatcagtgccggaggaattccataccacaatcttgcaagtctccattccctcccttcttccagctactgttagcatggaaacttcggagaagtccaagctcacccccaaaccggagacctcatttgaggaaaacgatggcaatattatccttggcgctactgtggatacccagctctgcgataaactgttgaccagctctctccagaaatcctcaagtttgggcaatctgaagaaggaaacaagtgatggggagaaagagaccattcagaagacgagcgaagatcgcgcacccgccgaaagtcggccttttggcaccttgccgcccaggccacccggccaggacacaagcatggatgataacccgtttgggactcgaaaggtcaggagctcttttgggcgaggcttctttaagatcaagagcaacaagagaacagcgtccgcaccgaacctggctgaaaccgagaaggagaccgccgagcaccttgatcttgccggtgccagttctcgccccaaggactctcagcgcaattcgccattccaaatcccacccccaagccctgactcaaagaaaaagtctagggggattatgaagctgttcggcaagctgaggcgatcccagtccaccaccttcaatcccgatgacatgagtgagccagagttcaagcggggcgggacccgcgccacggccggtcctcgactagggtggtctcgggatctgggccagtcaaacagtgatttggacatgccatttgctaagtggacaaaggagcaagtgtgcaattggttgatggagcagggcctcggttcttatctcaactctggtaagcattggatcgccagcggacagacactcctacaggccagtcagcaagacttggaaaaggagctcgggattaaacactccctgcacagaaaaaagcttcaacttgcacttcaggccctgggctctgaagaagagactaaccacggaaaactggattttaattgggttactcgttggctcgacgatatagggttgccacagtacaaaacacagtttgatgagggccgggtagacggccggatgctgcattatatgactgtagatgacctcctgagccttaaggtggtcagcgtactacatcacctgagcattaagagggcaatccaagtgctccgaatcaataatttcgagccaaactgtctccgcagaagaccctccgacgagaatactatagctcctagtgaggttcagaagtggaccaaccatcgggtgatggagtggctcaggtcggttgatctggctgagtacgcaccaaatctccggggttcaggggtgcatggtggcctgatggtcctcgaaccaaggttcaacgtagagacaatggcccagctcctcaatataccaccgaataaaaccctgctgcgccggcacctcgctactcacttcaacctattgatcggagccgaggctcaacaccagaagcgcgacgctatggaactgcctgattacgttctgctgactgccacagcaaaggtgaaaccaaagaagctagctttctccaattttggaaacctgaggaaaaaaaagcaagaggacggagaggagtacgtgtgtccaatggaactgggacaggctagtggtagcgcttccaagaaggggtttaaacccggcctggacatgcggctctatgaagaggacgatttggaccgactcgaacagatggaggattccgaaggcacggtgcggcagataggtgcattctccgaaggaatcaataacctgactcacatgctgaaagaggacgacatgtttaaagactttgccgcaaggtccccatccgctagtattactgatgaagactcaaatgtttag

SEQ ID NO: 45248 - DNA, 852 bp, Artificial Sequence
  Description of Artificial Sequence: Synthetic coding sequence
atgatgagcgacgccagcgacatgctggccgccgccctggagcagatggacggcataattgcaggaagcaaagcactggagtactcaaacggcatctttgactgtcagagtcctacctcccctttcatgggcagcctccgggcactgcatctggtcgaagatttgcgaggactgctcgaaatgatggaaaccgacgagaaagaaggactccgctgccaaataccagacagtaccgcagagacgctggtggaatggcttcagagccaaatgaccaatggtcacctaccaggcaacggcgacgtctatcaagagagactggcgaggctggaaaatgacaaggaaagtctggtcctccaggctatggttagcgtcctaaccgaccaggtggaggctcagggagaaaagatacgcgacttggagttctgcctcgaggagcatagagaaaaggttaatgcaaccgaggagatgctgcagcaggagttactgagccgtacaagtctggagacgcagaagctggatcttatggctgagatttcaaatctaaagcttaaactgaccgcagttgaaaaagatcggttggattatgaggataaatttagagatacagaaggcctgattcaggagatcaatgatctgcggctaaaagtatcagaaatggactcagagcgcctgcagtacgaaaagaagttaaaaagcaccaaagatgaactggcttctttgaaagagcagctcgaggagaaagagtctgaggtgaagaggttacaggagaagctggtatgcaagatgaagggagagggcgtcgaaattgtggatcgtgatgagaacttcaaaaaaaaactaaaggagaaatag

SEQ ID NO: 45249 - DNA, 846 bp, Artificial Sequence
  Description of Artificial Sequence: Synthetic coding sequence
atgatgagcgacgccagcgacatgctggccgccgccctggagcagatggatggtatcatagctggcagtaaggctctggagtactcaaatgggattttcgattgccaaagccctactagcccattcatggggtcactgagggccctgcatctggtcgaggatttgagaggacttctggagatgatggaaacagacgagaaagagggactgagatgccagattccagactctaccgccgagacactcgtcgaatggttacaatcacagatgactaacggtcacctacccggtaatggagacgtctaccaggaaagactggcacggcttgagaacgataaagaatccctggttctgcaagttagcgtactaacagaccaagtggaggctcagggcgaaaagatcagggatttggagttttgtctggaagagcaccgggaaaaagttaacgcaaccgaggagatgttgcagcaggagctcctgagtcgcactagcctggagacccagaagctggatcttatggccgaaatctcaaacctcaaactgaagctgactgccgtggagaaggacaggttagactatgaggataaatttagagacactgaaggcttaatccaggagatcaacgacttaaggctgaaggtctctgaaatggactccgaacggctgcagtatgagaagaaattgaagagtacaaaagatgagctcgcctctctcaaggagcagctggaggagaaagaatcagaagtaaagcgtctgcaggaaaagttggtttgtaagatgaaaggcgagggagtggaaatcgtggacagggacgagaacttcaaaaagaaattgaaggaaaaatag

SEQ ID NO: 45250 - DNA, 1197 bp, Artificial Sequence
  Description of Artificial Sequence: Synthetic coding sequence
atgggccaggccggctgcaagggcctgtgcctgagcctgttcgactacaagaccgagaaatacgtaatcgccaagaataagaaagtcggcttactctatcggctcctccaggcctccatactggcctacctggtggtgtgggtatttctgattaaaaagggctatcaggacgtagataccagcctgcagtccgctgttataactaaagttaagggagtggccttcaccaacacctcagacctcggacagcggatctgggacgtcgcggactacgtaataccagcccagaacgagggaattcccgatggtgcctgttctaaagatagtgactgtcacgcgggggaagccgtgacagccggaaacggggtgaagaccggcagatgtttgcgacgcgaaaatctggccaggggaacctgtgaaatttttgcgtggtgtccactcgagacatcctcgagaccagaggaacctttcctgaaagaggccgaggactttaccattttcattaaaaaccacattcgattcccaaaattcaatttctctaagagtaatgtgatggacgtcaaggacaggagcttcctgaaatcttgccattttggccccaaaaaccattactgtccaatctttaggcttgggagtgtgatccgttgggccggaagtgactttcaagacattgcactcgaaggcggcgtcattggtatcaatatcgagtggaattgcgatctggataaagccgcatcggagtgccatcctcactattcttttagccgactcgacaacaagttgtccaaaagcgtcagctctggttataactttcgattcgcgcgctattatagagacgccgccggggtcgaattccggacgctgatgaaggcctacggcattagattcgacgtaatggtgaacgggaagggtgcctttttttgtgacctggtattgatctacctgattaagaaaagggagttctaccgcgataagaaatacgaggaagtcagagggctcgaggacagctcccaggaggctgaagatgaggcgtccggcctggggctctctgaacagcttacatcaggccctggattactcggaatgccagaacagcaggagttgcaggaaccccccgaagcaaaacgaggaagttcctcacagaagggcaacggctcagtgtgcccccagctgttggaaccccaccgcagcacctag

SEQ ID NO: 45251 - DNA, 1248 bp, Artificial Sequence
  Description of Artificial Sequence: Synthetic coding sequence
atgtgcccccagctggccggcgccggcagcatgggcagccccggcgcaacaactggttgggggctcctggattacaaaactgaaaagtgggcgcttctggccaagaaaggctaccaagagcgggacctggaacctcagttctctatcatcaccaagctcaaaggggtctccgttactcaaatcaaggagcttggaaatcgactgtgggacgtcgctgatttcgtgaaacctccccagggagagaacgtgtttttcctggtgactaactttctagtgacacccgctcaggttcagggtagatgtccagagcaccctagcgtcccactagctaactgctgggttgatgaggactgccccgagggagaaggtggtacacacagccatggggtcaaaactggtcagtgcgtcgtttttaacgggacacaccgaacatgtgagatctggagttggtgtccagttgaaagcggggtggttccatctcggccgctgctcgcacaggcgcaaaacttcacgttgtttataaagaacaccgtcacattttcaaaattcaacttctccaaatccaacgccttggaaacgtgggatcctacttacttcaagcactgccgatacgaaccacagttcagtccatattgtcccgtctttcggataggagatctggtggctaaggctggaggcacctttgaagacctcgccctcctcggcggcagcgtgggtatccgggttcattgggattgtgatctggacactggggactccggctgctggccacactattcattccaactgcaggaaaaatcctataatttcagaacagctacccactggtgggaacagcccggagtcgaagccagaacacttcttaagctgtacggcatccgcttcgatatattggtaaccggccaagctgggaagtttggcctcattcccacagctgtaactctgggaactggagcagcctggctgggcgtggtcacctttttctgtgacctgctactcttatacgtcgacagggaagcacacttttactggcggactaaatatgaggaagccaaggcgccaaaagccacggccaatagcgtgtggagggagcttgccctcgcatcacaggccaggctggctgagtgtctccggagatctagcgcgccagcccccacagccactgcagctgggtcccagactcagactcctgggtggccttgcccttccagcgacacccatctgccaacacattccggaagtctttag

SEQ ID NO: 45252 - DNA, 1494 bp, Artificial Sequence
  Description of Artificial Sequence: Synthetic coding sequence
atggccgccgcccagcccaagtaccccgccggcgccaccgcccggagactggcaagaggatgctggtctgctctgtgggattacgaaacaccaaaagtcattgtcgtgaggaatcgcaggttgggcgtgctgtatcgggctgttcaacttctgatattactctatttcgtatggtacgtgttcattgtgcaaaaaagctaccaagaaagtgagacagggcccgagtcctctattattactaaagtgaaaggtatcaccactagtgaacataaagtctgggacgtggaagagtatgtcaaaccccccgaaggaggcagtgtgtttagcatcatcactcgggtggaagctacacattcacagacccagggcacctgtcccgagagtatacgcgtgcacaacgccacctgcctctccgacgcagactgcgttgctggggaactggatatgttaggaaacggcctcaggacaggcagatgcgtgccatactaccagggaccatccaaaacctgcgaggtttttggatggtgtcctgtggaagacggcgcctctgtgtctcagtttctggggacgatggcaccaaatttcaccattcttataaagaattccatccactatcccaagttccatttttcgaaggggaacattgccgatcgcaccgatggatacctcaagcgttgcactttccatgaggccagtgacttatactgccctatctttaaactgggcttcatcgtggagaaggccggagaaagttttacggagttggcccacaaaggcggcgtgataggcgtcatcatcaattgggactgtgatctggacctacctgcatccgaatgtaaccctaagtacagtttccgacgactagacccaaagcatgttccagcatcctccggatacaactttcggtttgcaaaatattataaaataaacggtacaactacacgtactctcatcaaggcctacggcattcggatcgacgtcattgtgcatgggcaggcaggcaagtttagcctgatacctactatcatcaaccttgcgacagctctgacatcagttggcgttgtgcggaatccactgtggggaccatccggctgcggcggctccacaagacccttgcatacaggtctgtgttggcctcaggggtcttttctttgcgactggattctgctgacatttatgaacaagaacaaagtgtattctcataagaagttcgataaggtgtgcacccccagccatccctctggcagctggcctgtgacactcgctcgggttctgggtcaggctccccctgagccaggacataggagcgaagatcagcatccatcacctccctcaggtcaagagggacagcaaggtgcggaatgcggacctgcctttccaccattgcgcccctgccccatcagtgctccttccgagcagatggtagatactcctgcgagcgaacccgcacaggctagcacccccactgatcccaaaggactggcccagttgtag

SEQ ID NO: 45253 - DNA, 1215 bp, Artificial Sequence
  Description of Artificial Sequence: Synthetic coding sequence
atggccgccgcccagcccaagtaccccgccggcgccaccgcccggagattagctcgtggatgttggtcggctctttgggactacgaaacacccaaagttatcgtggtaagaaataggaggctgggagtattgtatcgagccgttcaactgctgatcctgctgtatttcgtctggtacgttttcattgtgcaaaaaagctatcaggaatcagagaccggcccagaatcctctatcattacaaaagtcaaggggattactaccagcgagcacaaggtgtgggacgtggaggaatatgtgaaacccccagaaggagggtctgtgttctccattattaccagagttgaagccactcatagccagacccaggggacatgcccagagtccataagggtacacaatgcaacctgtctgtcagacgctgactgtgtagcaggcgagctcgatatgctcggcaacgggctccgaacaggtaggtgcgtgccttattaccagggcccctctaagacatgcgaggtgttcggatggtgtcctgtagaggatggggcatctgtgagccaatttcttggtacaatggcccctaattttactattctgattaaaaattcaatacattacccaaagtttcacttttctaaaggcaacattgccgacaggaccgacggctatttgaaacggtgcacgtttcatgaagcatcggatctgtattgcccgatttttaagctgggtttcattgtcgagaaggccggcgagtctttcaccgaattggctcacaaaggcggggtgataggcgtcatcataaactgggattgcgatctcgacttacctgcctcggaatgtaacccaaaatactcatttaggcgcctagacccaaagcatgtgcccgctagttcaggatacaatttccggtttgctaagtactacaaaattaacgggaccaccacaagaactcttattaaagcttatggcatccgaatcgacgtcatcgtgcatggacaggccggtaaattcagtttgatccccaccattataaatcttgctactgcgctgacaagcgtcggggtaggcagtttcctctgtgattggatccttctgacattcatgaacaaaaataaggtctattctcacaaaaaattcgataaaatggtcgatacgcctgctagtgagcccgcccaagcctctacccccaccgaccccaaaggcctggctcagctctag

SEQ ID NO: 45254 - DNA, 1344 bp, Artificial Sequence
  Description of Artificial Sequence: Synthetic coding sequence
atggccgccgcccagcccaagtaccccgccggcgccaccgcccggcggttggcccgtgggtgttggtctgctctgtgggattatgagacccctaaggtgatagtggtgcgtaaccggagactaggcgtgctctacagggccgtgcagcttttaatcctgctgtactttgtgtggtatgtgttcatagtccaaaagtcttaccaagaaagcgagaccgggcccgagtcctcaatcatcacaaaagtaaaggggattaccacttctgagcacaaggtttgggacgttgaggaatacgtcaagccaccggaatccattcgggtacacaacgccacttgtctcagtgacgctgactgcgtggccggtgaattggatatgctcggcaatgggttgagaacaggcaggtgcgttccctactaccaaggcccttccaaaacctgcgaggtgttcgggtggtgccccgtggaggatggcgcttccgtctctcagttcctgggaactatggccccaaatttcactattttgattaaaaatagcatacattaccctaagttccacttcagcaaagggaatatagcggatcggacagatggatacctaaagcggtgcacatttcatgaggcatcagacttatactgccccatctttaaactggggttcatagttgagaaagccggcgaatccttcaccgaattagcacacaaaggcggtgtcataggtgtgattattaattgggattgcgatttggatttgcctgcctcagagtgcaaccctaagtactctttccgtagattggatccaaaacacgtccctgcttcctccggctataactttcggtttgcaaagtactacaagatcaatggaacgacaacccggactctgatcaaagcttatggaatccggatcgatgtgattgtgcacggccaggcgggtaagttctctcttatcccaaccataattaacctggctacagcccttaccagtgtcggcgtcggtagttttctgtgtgactggatactcctgacttttatgaataaaaacaaggtgtactcacacaagaagtttgacaaggtctgtactccgtcgcatccgtcgggatcttggccggtgacactggcacgggtactgggccaggcccctccagagccagggcacagaagtgaggaccagcacccttctccccctagcgggcaggagggacagcaaggggctgagtgcgggcccgcttttccacctctgcgtccctgcccaatttcagcacctagtgagcagatggtggatacaccagcttccgagccagcacaggcctcaacccctaccgaccctaaaggcttggctcagttatag

SEQ ID NO: 45255 - DNA, 1140 bp, Artificial Sequence
  Description of Artificial Sequence: Synthetic coding sequence
atggccgccgcccagcccaagtaccccgccggcgccaccgcccggcgtctcgcccgaggttgttggtctgccctctgggattacgagacacccaaggttattgtgtctatcagagttcacaacgctacttgtctgagtgatgctgattgtgtggccggggaacttgatatgctcggaaatggactccggacaggaagatgtgtcccttactatcaggggccatccaagacgtgtgaagtgttcgggtggtgtcctgtcgaggacggcgcttcagtctcgcagttcctcggtactatggcacccaacttcactattctgattaaaaactctatacactaccctaagtttcacttttcaaagggtaatatcgccgaccgcaccgatggctatctcaaacgctgcacattccatgaggcctcagatctgtactgtcccattttcaaacttggcttcattgtggaaaaggccggagaatccttcaccgaacttgctcacaagggaggcgtaattggagtaatcattaactgggattgcgacctcgatcttcccgcctctgagtgcaaccctaagtacagctttcggaggcttgaccctaagcacgtaccagcaagcagcgggtacaactttagattcgctaaatactacaaaattaatgggacaacaacccgaacactcataaaggcttacggtatcaggatcgatgtgattgtgcatggacaggccgggaaatttagcctgatccccacaattatcaatttggccacggcattgaccagcgttggtgtcgggtctttcctctgtgactggattctgctcaccttcatgaacaagaataaggtctactcacacaagaagtttgacaaggtgtgcacgccaagccatccttctggctcctggcccgtaacgttggcaagggtgttgggtcaggccccaccggagcccggacacagatccgaggatcagcatccttccccccccagtggacaggaaggccaacagggtgccgaatgtgggcctgccttccccccactgcggccctgcccaatctccgctcccagtgaacagatggtcgacacccctgctagcgaaccagcacaggcttccactccgacagatcctaagggcctggcccagctgtag

SEQ ID NO: 45256 - DNA, 1200 bp, Artificial Sequence
  Description of Artificial Sequence: Synthetic coding sequence
atggccgccgcccagcccaagtaccccgccggcgccaccgcccggcgattggctcgagggtgttggtctgccctgtgggactacgagactcccaaggtgatcgtggtgcgcatacatcgggctgaaaaactccccggcgagagagacgggccacgagaactccaccaccaccagggtcagggcgaccatcacgtgagggctcaaagcgtcggaagggggggagtgcgcgaggcgccacgtggcttacggaccggacggtgtgtcccgtattaccagggtcctagcaagacctgcgaagtctttgggtggtgtccagtggaggatggggccagcgtgagtcagttccttggcaccatggctccaaacttcacgatcttgattaagaacagcatccactatcccaagttccacttctcgaagggcaacattgccgataggacagatggctacctcaagcggtgcacattccacgaggcttccgatctatattgccccatcttcaaactggggttcatagtggaaaaggctggggagtcctttaccgaactcgctcataaaggaggcgttataggggtcatcattaattgggattgtgacctggatttaccagccagtgaatgtaatcccaaatacagtttccgccgacttgaccctaaacacgtgcctgcatcctcaggctataatttcaggttcgctaagtactacaaaattaacggtactacaacccgcacactcatcaaggcatacggcattagaattgatgtaatcgtgcatggtcaggctggcaagtttagtctcatccctacgatcatcaacctcgcgacggcactgaccagcgtaggtgtggggtcttttctttgcgactggattcttctgaccttcatgaacaaaaataaagtttatagtcacaaaaagtttgacaaggtgtgtactccttcccacccatctggtagctggcccgtgactcttgctagggtgctcggccaggcacccccggagcccggtcaccggtcagaagatcagcatccctcacccccgagtggccaagagggccagcaaggagccgaatgtggccccgcgttccccccattgagaccctgcccaataagtgccccgagcgagcaaatggtggacacgcccgcctcagagccagcccaggcaagcaccccgacagaccctaaaggactagcacaactttag

SEQ ID NO: 45257 - DNA, 1416 bp, Artificial Sequence
  Description of Artificial Sequence: Synthetic coding sequence
atggccgccgcccagcccaagtaccccgccggcgccaccgcccggcgcttagcaagagggtgctggtctgctctgtgggactacgagactccaaaagttattgtggtacggaaccgaaggctgggggtcctgtacagggccgtccagcttcttattctcctatatttcgtgtggtacgtgttcatagtgcaaaagagctaccaggaaagtgagacaggtcccgagtcatctattattaccaaagttaagggtatcaccaccagtgagcacaaggtgtgggacgtggaagaatacgtaaaacctcctgaaggcggatccgtattttcaattatcactcgcgtagaagccactcactcacaaacacagggcacatgtcctgaatcaatacgtgtccacaacgcgacatgcctgagcgacgccgactgtgtggcaggggagctggatatgctggggaatggattgagaaccgggcgttgcgttccctattatcagggaccatccaagacatgcgaggtctttggctggtgcccagtggaggatggagcatctgtttcccagttcctgggcacaatggcccctaacttcacaattctgatcaagaactctattcattacccgaaattccatttttcaaaggggaacatagccgataggaccgatggctacctaaagaggtgcactttccacgaagcctccgacctgtattgtcctatcttcaagcttggattcattgttgagaaagcaggagagtccttcactgagctcgctcataaagggggcgtgatcggcgtgatcataaactgggattgtgacttagatttgccggcctccgagtgcaatccaaaatatagtttccggcggttagatccaaaacatgtaccagccagttcagggtataatttcagatttgctaaatactataagatcaacgggactaccacacgcaccctaatcaaagcatacgggatcagaatcgacgtgattgtacacggccaggctggcaaattctctctgataccgactatcattaacctggccaccgctctaactagcgtgggggtgggctccttcctttgtgactggatcttactcactttcatgaacaagaacaaagtgtatagccacaagaagttcgacaaagtttgcactccctcacatccatcaggttcttggcccgttacgctcgcaagggtgctggggcaggcccccccagagcccgggcataggtcggaggaccaacatccaagccctccgagtggccaagagggtcaacagggtgcggagtgtggtccggcgttccccccacttagaccctgtccgatttctgcaccctcagagcagatggttgacactccggcatcagaacccgcccaagcttccacacccactgaccccaagggcctggcccaattatag

SEQ ID NO: 45258 - DNA, 1113 bp, Artificial Sequence
  Description of Artificial Sequence: Synthetic coding sequence
atggccgccgcccagcccaagtaccccgccggcgccaccgcccggagactggcaaggggctgttggagtgctctgtgggactacgagacccccaaagtcattgtggtgcggaacagacgcctaggtgtgctttatagagccgtgcagctgctgattctgctgtacttcgtctggtacgtcttcatcgtacagaagtcttaccaggaatctgagaccggaccagaaagttccattataactaaagtgaaagggatcacaaccagcgaacacaaagtatgggatgtagaggaatacgtcaagccccctgagagtatacgcgttcacaacgccacttgtctgagtgatgcagattgtgtggcgggggagctggacatgctgggcaacggtgccttacaggatctccggggcgttaggttggtgccaggggggaggtggggcttatgccagcctatttcagggtacgacggcccaaaattccatcacccacatcaagagcagcacccacttcctcagataccgttgcttcaagggcagcacaggcggccgcacagacgcgtgccggaagccctgcacgtcccaagaggactccggcccttgttgcctcatctccaggccggcctctatcgcggcgaagggtggggcgagctgcatcgggccaggacccagggacgcggtggcgtgatcggggtgattattaattgggactgcgaccttgacctccctgcctccgagtgcaaccccaagtatagcttcagaaggctggatcctaagcatgtcccagcgtcatctggttataactttagatttgccaaatactacaagatcaacggcaccactacccgcactttgatcaaagcatacggaattcgcatcgacgtcattgtacatgggcaagccggtaagttttcccttatcccaacgattatcaacctggcaacagcacttacctccgtaggggtgggctcattcctttgcgactggattctgctcaccttcatgaataagaacaaagtgtattcccacaagaagtttgacaagatggttgatacccccgcgagcgaacctgctcaggcgagcacccccactgatcccaaaggcctggctcagctatag

SEQ ID NO: 45259 - DNA, 1056 bp, Artificial Sequence
  Description of Artificial Sequence: Synthetic coding sequence
atggccgaccaggaccccgccggcatcagccccctgcagcagatggtcgcctctggaaccggggctgtcgttacctctttgtttatgactcctttggacgtggtgaaggtacgactgcaatcccaacggccctcaatggcatcggagctgatgccgtccagccggctctggtcacttagttacactaagtggaaatgcctcttgtactgcaacggcgtactggagcccctatacctttgccctaacggcgcccgatgtgccacctggttccaagacccaactaggttcaccggaaccatggatgccttcgtgaagattgtccggcacgagggaactcggacgctctggtccgggctgccagccacactggttatgaccgtccctgccaccgcaatctatttcacggcgtatgaccaactgaaagccttcctgtgcggcagggctctgaccagtgacttgtatgcgcctatggtggcaggcgcacttgcacggttgggtacagtgacagtaatatcccctctcgagctgatgaggactaaactgcaagctcaacacgtctcttaccgggaactgggcgcttgcgttcggacagccgtggctcagggggggtggcgctccctgtggctcggctggggacctacagccctgagggacgtaccttttagcgccttgtactggttcaactatgagctcgtcaaatcatggctgaacggtttcagacctaaggaccagacatccgtgggaatgagctttgtggcaggagggatatccggcactgtggcagcagttctcacgctccctttcgatgttgtcaaaacccaaaggcaggtggcgctcggggccatggaggcagtgcgggtgaatcctctgcacgtcgacagcacatggcttctcctacgccgaatccgggccgaatcagggacgaagggcctgttcgcggggtttctgccacggattataaaagcagctccatcttgtgcgattatgatttctacatacgagttcggaaagtccttcttccagaggcttaatcaggataggctgcttggggggtag

SEQ ID NO: 45260 - DNA, 1299 bp, Artificial Sequence
  Description of Artificial Sequence: Synthetic coding sequence
atgggccaggccggctgcaagggcctgtgcctgagcctgttcgactataaaactgaaaagtacgtgatcgctaagaacaagaaggtggggttgctttacagactgctccaagcgtccatcctggcctatttagtggtctgggtgttcctgatcaaaaaagggtaccaggatgttgacacaagtctgcagtctgcagtgatcactaaggtgaaaggggttgccttcaccaatacctccgacctcggccagcggatttgggacgtggcagactatgtcatcccggcccagggcgagaacgtattttttgttgtgacaaatctgatagtgacgccaaatcagcggcagaacgtatgtgccgagaatgagggaattcctgatggagcctgctctaaagactctgactgccacgcaggagaagctgtgacggctggcaacggggtcaaaacaggccgttgtctgaggcgcgagaatctggcacgaggaacatgcgaaatcttcgcctggtgcccgctcgaaacgtcctcacggcccgaggaaccgttcctgaaagaggccgaggactttacaattttcattaagaaccacattcgatttccgaaattcaatttctcaaaatccaatgtaatggatgtcaaagatcggagtttcttaaagagctgtcattttgggccaaagaaccactactgccccatcttcagactgggctctgtcatcaggtgggctggaagtgacttccaggacatcgccctggaagggggggtgataggaatcaatatagagtggaactgcgacctggacaaggccgcgagtgaatgccatccacactactccttttcgagactggacaacaagctgtctaaatctgtctctagcggctacaatttcagatttgccagatattatagagatgcggccggggtggaattcaggactcttatgaaggcctatggaattcggtttgacgtgatggtgaacggcaagggcgcattcttctgtgacctcgttttaatctatttgattaaaaagagagaattctacagggacaaaaagtacgaagaggtacgaggactggaagatagttctcaagaagcagaggatgaggcctcaggacttggtctcagtgagcagctcacttcaggtccgggtctgcttggcatgccagagcagcaagagctccaggagcccccggaagcgaaaagagggtccagtagccaaaaaggcaatggaagcgtgtgtccacaactcctggaaccccaccgactgcgcacaccaagcgctagccctctgcaccaggaatag

SEQ ID NO: 45261 - DNA, 1266 bp, Artificial Sequence
  Description of Artificial Sequence: Synthetic coding sequence
atgggccaggccggctgcaagggcctgtgcctgagcctgttcgactacaaaacagagaagtatgtcatcgcgaaaaacaagaaggtcggcctgctgtatagactgcttcaggctagtatattggcctatcttgtggtgtgggtattccttattaaaaaaggctatcaggacgtggacacctccttacaaagcgcggtcattacaaaagttaaaggagtggctttcacaaacacgtccgacctgggtcaacggatttgggatgttgccgactatgtaatccctgcgcaaggtgagaatgtgttctttgttgtcactaatttaattgtgaccccaaaccagcggcagaacgtctgtgcagaaaatgagggaatcccagacggggcatgctctaaagacagcgactgccacgccggcgaggctgtgaccgctgggaacggagtgaagaccggcagatgcttacgcagggaaaacttggcgagagggacttgcgagattttcgcttggtgtcctcttgagacttctagtagacccgaagaacccttccttaaagaggccgaggatttcactatttttatcaagaaccatatccgattccccaagtttaattttagcaacaatgtcatggatgtaaaggataggtcctttctgaagagctgccacttcggccctaaaaaccattactgcccaatcttccgactaggttcagtgatccgttgggctggcagcgacttccaggacattgctctggagggcggcgtgataggcatcaacatagagtggaactgtgacttggacaaggcggcaagcgagtgccaccctcattacagtttcagccgcctggataataagttatctaagtctgtcagctccgggtataactttcgcttcgcaaggtattacagagacgccgctggcgtggagtttcgcacactgatgaaagcttatggcatcaggttcgacgtgatggtgaacggtaaaggcgcctttttctgtgatctcgtgctgatctatttaatcaaaaaaagggaattttaccgggacaagaagtacgaagaggtccgcgggctggaggattcatcacaggaagcagaagacgaggctagtgggctcggactgagcgaacagctgaccagcgggcccgggctattagggatgccagagcaacaggagctgcaggagccccctgaggccaaacggggtagctcatcccagaagggcaatggatccgtgtgccctcagttattagaaccacacagatccacctag

SEQ ID NO: 45262 - DNA, 1194 bp, Artificial Sequence
  Description of Artificial Sequence: Synthetic coding sequence
atgggccaggccggctgcaagggcctgtgcctgagcctgttcgactacaagaccgaaaagtacgtgattgctaagaacaagaaggtcggtctgttatatcggctgttgcaggcgtccattctcgcctatttggtggtatgggtcttcctcatcaaaaaaggataccaagacgtggatacctctctccagtcagctgtgattacaaaagtgaagggcgtggcattcacaaatacctcagacctcggacaacgtatttgggatgttgcagactacgtgattcctgcacaaaatgagggcattcctgacggagcctgttcaaaggattccgactgtcacgccggagaggctgtgacggccggtaatggtgtgaagacaggcagatgcctgaggcgcgagaacttggcgagggggacgtgcgaaatcttcgcgtggtgtccgctggagacctcatctcgacctgaagaaccattccttaaggaagcagaagattttaccatctttataaaaaaccacatcaggtttccaaaatttaatttttcaaacaatgtgatggatgtgaaagataggagttttttgaaaagctgtcacttcgggccgaagaaccactactgtcccatatttagactaggcagcgtgatccgatgggccggctctgactttcaggatattgctttagaaggcggggttattggcatcaatattgaatggaattgtgacctggacaaagctgcctcggagtgccacccccattacagtttctccaggttggataacaagttgtcaaagtcggtgtcttccggatataacttccgctttgccaggtattatagggacgccgcgggtgtcgagtttaggaccttgatgaaagcctatgggatccggttcgatgtcatggttaacggcaaaggggccttcttttgtgatttggtcctcatttacctgatcaagaagcgggaattttaccgcgataagaaatatgaagaggtgcggggactggaggactcctcccaggaagctgaggacgaggctagcggccttggtttgagcgagcaattaacctcaggaccagggcttctaggcatgccggaacagcaagagctccaggagccacccgaggccaagagaggctcctcttcacaaaagggaaatgggagcgtctgcccacagttgctcgaaccgcataggtccacctag

SEQ ID NO: 45263 - DNA, 1089 bp, Artificial Sequence
  Description of Artificial Sequence: Synthetic coding sequence
atgcccacctaccggccccccagccaccggtgggtgttcctgatcaagaagggttaccaggatgtggatacgtctctgcagagcgcagtaataaccaaggtgaagggggtcgcgttcactaatacttcagatctggggcagagaatctgggacgtcgcagactatgtgatccccgcccagaacgagggaatcccggatggagcgtgtagtaaagactcagactgccatgccggagaggccgtgacagctggcaatggagtcaagactgggagatgcctgagacgagagaatctggccagaggcacatgtgagatttttgcctggtgcccacttgaaacctctagcagacctgaagaacctttcttaaaagaggctgaagactttaccatctttatcaaaaaccatattaggtttcccaagtttaacttttccaaaagtaatgtgatggatgttaaggacagatctttcctcaaatcatgtcacttcgggcccaaaaatcactactgccccattttccgcctggggtctgtgatacgatgggccggaagcgactttcaggacattgctctcgaaggaggggtaatcggtattaacattgagtggaattgtgacctggacaaggcggcctccgaatgccatcctcattacagcttttcccggcttgataacaaactgtcaaaatctgtgagttccggctataactttaggttcgcccggtattacagggacgcagccggcgtggaattcaggacgctcatgaaagcatacggcatcaggtttgatgttatggttaacggtaagggggctttcttctgcgatctggtactgatatatctcatcaaaaaacgagagttttatcgagataagaagtacgaggaggtccggggtttggaggatagctcccaagaggctgaggatgaagcgagcgggctcggactgagcgaacagctcacttcgggtcccggtctgctcgggatgccggagcagcaggagttgcaagagccgcccgaagccaagcgcggatcttctagccagaagggcaatggcagcgtgtgcccacaactcctggagccgcatcgcagcacctag

SEQ ID NO: 45264 - DNA, 1296 bp, Artificial Sequence
  Description of Artificial Sequence: Synthetic coding sequence
atgggcagccccggcgccaccaccggctggggcctgctggactacaaaacagagaagtacgtcatgactcggaattggagagtgggcgccctccagcgactcctccaatttgggatcgtggtctatgtcgttggatgggccttgctcgcaaaaaaggggtaccaggagagggacctggagcctcaattttcgattatcactaaactgaagggcgttagcgtgacccagattaaagagttggggaataggttgtgggatgttgctgatttcgtgaaaccccctcagggcgagaatgtattctttctggtgacaaactttctggtcacacccgctcaggtgcagggcaggtgtccagagcacccgtcagtcccactcgccaattgttgggtggatgaggactgtccagagggcgaaggaggcacacatagccatggcgtcaaaaccggccagtgcgtggtatttaatggtactcatcgcacatgtgaaatatggagctggtgccccgtggagtcaggtgtcgtaccatcaaggcctttattagctcaggctcagaattttaccttgttcatcaaaaatactgtgacattttctaaattcaatttctccaaatccaacgccctggagacgtgggatcctacctattttaagcactgccgttatgaaccccagttctcgccatattgccctgtattcaggattggagacctggttgctaaggcaggcggcacattcgaagaccttgctctccttggcggctctgtgggaattagagttcactgggactgcgacctcgacaccggagattcaggctgctggccccactactcattccagctccaggagaagtcttacaactttagaaccgcgacacattggtgggaacagcctggggtggaagcgcgaacactgttaaagctgtatggtatcaggttcgacattttagtgaccggccaagccgggaaattcggactgatccccaccgcagtaactctggggaccggtgctgcgtggctgggagttgtaactttcttttgcgacctgctattattgtatgtagatagggaggcacacttttactggcggactaagtatgaagaagctaaggctccgaaggctaccgccaattctgtttggcgggagctggcactggccagtcaggcaaggctcgccgaatgcttacgtagatcaagcgcacccgcacccactgctacagctgcgggtagccagacacagacaccgggatggccctgcccgtcgtcagacacacacttgccaacccacagcgggagcctctag

SEQ ID NO: 45265 - DNA, 213 bp, Artificial Sequence
  Description of Artificial Sequence: Synthetic coding sequence
atgggcagccccggcgccaccaccggctggggcctgctggactacaagacagagaagtgggctctgctggctaagaaaggatatcaggagagggatctcgagccacagttctccatcatcaccaagttaaagggcgtgtcagtcacccaaattaaagagctcgggaatcgcctctgggatgtggccgacttcgtcaagcccccacaggtttag

SEQ ID NO: 45266 - DNA, 1326 bp, Artificial Sequence
  Description of Artificial Sequence: Synthetic coding sequence
atgtgcccccagctggccggcgccggcagcatgggcagccccggcgcaacaaccggctggggcctcctggactacaagaccgaaaagtatgtcatgactcgtaactggcgagtgggggcattgcaacggttactccagttcggcatcgtggtgtatgtcgtgggctgggccttgttagcaaaaaaaggttatcaggaacgggaccttgagccccaatttagtatcattaccaaactgaagggggtgtctgtcacgcaaattaaagagctgggcaatcggctgtgggacgttgctgactttgttaaaccgccccagggcgagaacgtgttcttccttgttacaaatttcttggtgacccccgcacaggtacaaggccggtgcccagagcacccctctgtcccacttgctaactgctgggtggacgaggattgtcccgaaggagagggaggaacgcattcccatggcgtgaagaccggtcaatgtgtggtattcaacggcacacacaggacctgcgaaatctggtcttggtgcccagttgaaagcggcgttgtaccttcccgccctctgctggcccaggctcagaacttcaccctcttcattaaaaatacagttactttcagtaaattcaatttttcaaagtcaaatgcccttgagacttgggatcctacatacttcaaacactgtcgatatgagccacagtttagtccttattgccccgtcttcagaattggcgacctggttgcgaaggccggggggacattcgaagatctggcacttctcggaggaagtgtcggcattcgggtgcattgggactgcgatctggatactggcgattctggatgttggcctcattactcttttcagctgcaggagaaatcctacaacttcagaacagccacgcattggtgggagcagcctggcgtcgaggcacgcactctcctcaaactctacgggatccgattcgacatactagtgacagggcaggctggaaagttcggcctgatcccaaccgctgtgaccctgggaacaggcgccgcatggctcggcgtggtgacgttcttctgtgacctactgctgctctacgtcgaccgggaagcccacttctactggcgaacaaaatacgaggaagccaaggcaccaaaagccactgctaactctgtttggagagaattggcattagcatcgcaggctcgtctggccgagtgcctgaggagaagcagtgcccctgctccgaccgcaaccgcggccggtagccagactcagactcctggatggccatgccctagctctgatactcatttgcctacacattccggatcactgtag

SEQ ID NO: 45267 - DNA, 243 bp, Artificial Sequence
  Description of Artificial Sequence: Synthetic coding sequence
atgtgcccccagctggccggcgccggcagcatgggcagccccggcgccactactggatggggtctgctggactacaaaactgagaagtgggccctactggcaaagaagggataccaagagcgagatctcgagcctcagtttagtattataaccaaacttaaaggcgtgagtgtgacgcaaattaaagagcttgggaatagactctgggacgtcgccgactttgtgaagccacctcaggtttag

SEQ ID NO: 45268 - DNA, 1167 bp, Artificial Sequence
  Description of Artificial Sequence: Synthetic coding sequence
atgtggtgggccctgctggccaagaagggctaccaggagcgggaccttgagcctcagtttagcatcatcaccaaattgaaaggggtgtctgtgacacagatcaaagagttagggaaccggttgtgggacgtggctgactttgtgaagccaccccagggcgagaacgtgttcttcttagtcacaaattttctggtaaccccagcacaggttcagggaaggtgtccggaacacccctctgtgcctctggcaaactgctgggtagacgaagattgtcctgaaggagaaggcggcacacacagccacggcgttaaaactggccaatgcgtcgtatttaatggaactcatcgtacatgtgaaatttggagttggtgtcccgtagaatcgggggtggtgcccagcagacccctactggcccaggcccagaactttacactgtttataaagaataccgtgacctttagtaagttcaatttctccaagagtaatgcccttgaaacctgggatcccacgtacttcaaacattgcagatatgagccacagttctccccctactgcccggtgtttagaatcggggacctggtggccaaagccgggggaacgtttgaggacctcgccctcttagggggttcggtgggcattagggtacactgggactgcgacttggacaccggcgactccggctgctggcctcattactcatttcagcttcaagaaaaatcttataatttcagaacagccacccattggtgggagcagccaggagtcgaggctagaacattgttgaagctctatggcatccgctttgacatattggtgacaggccaggccggcaaatttggcttgataccaaccgccgtgaccctggggaccggagctgcttggctgggtgtggtgactttcttttgcgacctcttactcttgtatgttgacagggaggcccatttctattggaggaccaaatatgaagaagcaaaggcgcccaaggcgacggcaaactcagtgtggcgagaactcgcgctggctagtcaggccaggctggctgaatgtctacgcagaagctcagcccctgcaccaacagctactgccgcagggtcccagacccaaacacctgggtggccctgcccaagctcggatactcacctgccaacacacagcggtagcctctag

SEQ ID NO: 45269 - DNA, 1020 bp, Artificial Sequence
  Description of Artificial Sequence: Synthetic coding sequence
atggccaacctggacaagtacaccgagaccttcaagatgggcagcaatagcacatccaccgccgagatctactgtaatgtcactaacgtcaagttccagtactcactgtacgccaccacttatatcctcatcttcatcccaggcctgctggcaaacagtgccgctctatgggtcctctgtaggttcatctctaaaaagaacaaggccatcatctttatgatcaacttgagcgtggcggacctggctcacgtcttgagcctgccgctacggatatactattacattagccaccactggccttttcagagagctttatgtctactgtgcttttacttgaagtacctgaacatgtacgccagcatctgtttccttacctgtatctctttgcagcgttgcttttttctgctgaaaccctttcgggcaagggactggaagaggagatatgacgtaggtataagcgccgcaatttggatagttgtggggacagcatgtctgccattccccattctgagatctaccgacctgaataataacaagtcatgcttcgcagaccttggatataagcagatgaatgccgttgctctcgtgggcatgattaccgttgcagaattggccggtttcgtgattccggtaattatcatagcctggtgtacatggaaaactactataagcttgcgccaacctcctatggctttccaggggatatccgagaggcagaaagcactgaggatggttttcatgtgcgccgcagttttctttatctgcttcactccctatcacataaattttatcttctataccatggtaaaagagaccatcatttcctcctgtcctgtggtacgaatcgccctctattttcatcctttctgcctttgtcttgccagtctgtgctgtctgctggacccaatcctgtactattttatggcttcggagtttcgagatcaactttctagacatggctcctccgttactagatcccggttgatgagtaaagaatccggttcatctatgatcggctag

SEQ ID NO: 45270 - DNA, 1020 bp, Artificial Sequence
  Description of Artificial Sequence: Synthetic coding sequence
atggccaacctggacaagtacaccgagaccttcaagatgggcagcaattccaccagcaccgcggagatctactgtaacgtcacaaacgtgaagtttcaatactcgctctatgcaacgacctacatcctgatctttatcccagggttgctggccaattctgcagccctgtgggttttatgtagatttatctcaaaaaaaaataaagccataatcttcatgatcaatctctccgtagcagatctcgcccatgtactgtctttgcctcttcgcatctactattacatctcacatcattggccttttcagagagccctgtgtttactgtgcttttaccttaagtacctgaatatgtatgccagtatctgctttctaacttgtatttccctgcaaagatgtttttttttgttaaagccctttcgggctagagattggaaacggagatacgacgtggggatttccgccgccatttggatcgtggttggtactgcctgcctgcccttcccgattcttcgaagcacagatctgaacaataacaaaagttgcttcgctgacttaggctacaagcagatgaacgccgtcgcacttgtgggcatgataacagtggccgagctggctgggttcgtaatccctgttataatcatagcatggtgcacatggaagacaacaatcagcttgcggcaaccgcccatggcatttcaaggaattagtgaaaggcaaaaggctcttagaatggtcttcatgtgtgctgcggtgttttttatttgtttcacaccgtatcatattaatttcatattctacacaatggtcaaggagaccatcatcagcagctgtcctgtggtgcgtatagccctatatttccatcctttttgcctctgcctcgccagcctgtgctgtcttctcgacccgatcttatattactttatggcttcggagtttagggaccagctgagtcgccacggctctagcgtcacaaggtcaagactcatgagtaaagagtccggctctagtatgattggatag

SEQ ID NO: 45271 - DNA, 1065 bp, Artificial Sequence
  Description of Artificial Sequence: Synthetic coding sequence
atgaccgccgccatccggcggcagcgggagctgagcatcctgcccaaagttaccctggaggccatgaacaccacagtgatgcaggggtttaatcgcagcgagcggtgcccacgtgacacccgcatagtgcagctggtgttcccagctctctacacagtcgtgttccttactgggatacttctgaacacactggcactgtgggtttttgtgcatattccctcttccagcacctttattatttacctgaagaataccttagtggccgacctcattatgaccctgatgctgccatttaagatcctttctgatagccacttggccccatggcagctccgggcctttgtatgtcgattcagctcggtcattttttatgaaactatgtatgtgggcatagtgctgctgggactgatcgcctttgatcgctttctcaaaatcattagacccctccgaaatatatttctcaaaaaaccagtgtttgcgaaaactgtgtctatcttcatctggtttttccttttctttatttcattacccaacactatcctgagcaacaaggaagcaactccaagttccgtgaaaaaatgtgcctcactgaagggcccactcgggctgaaatggcaccagatggtgaacaacatctgtcagtttatcttctggacagttttcatcttgatgttggttttctacgtcgtcatcgccaaaaaggtctatgactcctaccgcaagtccaagtcaaaagaccgaaaaaataacaaaaaactcgaaggcaaggtgtttgtggtcgtggcagtctttttcgtgtgctttgccccgttccactttgcccgcgtgccatatacccacagccagactaataacaagacagactgccgcctgcaaaatcaactctttattgcaaaggagactacactgtttctcgccgcaaccaacatttgcatggatcccttaatctacatttttctctgcaaaaaatttacagaaaaactcccttgtatgcaggggagaaagacgactgctagcagtcaggagaatcactcaagccagacagataatattacgttaggatag

SEQ ID NO: 45272 - DNA, 1017 bp, Artificial Sequence
  Description of Artificial Sequence: Synthetic coding sequence
atgatcaacagcaccagcacccagccccccgacgagagctgcagccagaacctgcttatcacgcagcagatcatccctgtgctatactgtatggtcttcatagccggcattctccttaacggggtgagcgggtggatttttttttatgtcccatctagcaagtcatttatcatttaccttaagaacatcgtcatcgccgacttcgtgatgtccttgacttttccctttaagatcttaggggacagcgggttgggtccctggcagcttaatgtttttgtctgccgggtctccgccgtgctgttttatgtgaacatgtacgtgtccatcgtttttttcggcttgatctcatttgacaggtattacaaaatcgtcaagccattatggacttcattcatccagtccgtcagctattccaagttgctgagcgtgatcgtttggatgctcatgctgctgttggcggtccctaacatcattctgaccaaccagtctgtgagggaggtcacccagatcaagtgcatcgagttgaagagtgagctgggaaggaagtggcacaaagcctccaattatatcttcgtggctattttctggattgtgtttctcctgcttatcgtcttttacacggcgatcacaaagaagatatttaagagtcatctgaagtccagtagaaacagtacaagcgtgaaaaaaaaatcttcgcggaacatcttttcgattgtatttgtgttcttcgtgtgttttgttccctatcacattgcacgaatcccctatacaaaatcacagacagaggctcattactcctgccagagtaaggaaattcttagatacatgaaggagttcacactgctccttagcgctgctaacgtgtgcctcgacccaattatctattttttcctgtgtcagcccttcagagaaattttatgcaaaaagctgcacatccctttgaaggcacagaatgacttggacatttccagaattaaacgcggaaataccactctggagagcacggacacactgtag

SEQ ID NO: 45273 - DNA, 1017 bp, Artificial Sequence
  Description of Artificial Sequence: Synthetic coding sequence
atgatcaacagcaccagcacccagccccccgacgagagctgcagccagaatctgctcatcacccagcagattatcccggtactgtactgcatggtcttcattgccggcatcctgcttaatggagttagcggttggatatttttctacgtgccaagcagtaagtcattcatcatttacctgaagaatatcgtgatcgccgattttgtgatgagcctgactttcccttttaagatcctgggagactctggtctgggcccatggcagttgaacgtgttcgtatgccgagtatccgccgtgttattctacgtgaatatgtacgtaagtatcgtgttctttggtctgatcagctttgacaggtactacaagatagtcaaacctctctggacatcttttatccagagcgtgtcatactctaaactcctgtcagtgattgtttggatgctcatgctgctgctggccgtccccaacatcattctgactaaccagtccgtgagggaggtgacccagattaagtgtatcgaactcaaatcagagctgggacggaagtggcacaaggcgtcaaactacatctttgtggcaatcttctggatcgtcttcctcctactaatagtgttctacaccgccattaccaagaagatctttaaatcacacctgaagagctcccgaaacagcaccagcgtgaagaaaaagtcgagtcggaacattttcagcattgtcttcgttttctttgtgtgctttgtaccttatcacatagcacggattccatataccaaatcacaaacagaagcccattactcctgccaatctaaggaaattttacgatacatgaaggagttcactctactgctgtcagccgctaatgtgtgccttgatccaatcatttatttcttcttgtgccaacctttccgcgagatactctgcaaaaaactgcatattccactgaaggcccagaatgacctggacatctctcgcattaagcgggggaataccactctcgaatccacagatacactgtag

SEQ ID NO: 45274 - DNA, 291 bp, Artificial Sequence
  Description of Artificial Sequence: Synthetic coding sequence
atgatcaacagcaccagcacccagccccccgacgagagctgcagccagaacctcttgataactcagcaaataatacctgtcttatactgtatggtgtttatcgccggaatcctgctgaatggtgttagtggatggatttttttttacgttccgtccagcaagtctttcataatctacctcaagaacattgtaattgcggactttgtaatgagcctcacctttcccttcaagatcctgggcgatagtggattgggcccctggcagcttaatgtgttcgtttgccgggtgtag

SEQ ID NO: 45275 - DNA, 2358 bp, Artificial Sequence
  Description of Artificial Sequence: Synthetic coding sequence
atggccagcaaggtgaccgacgccatcgtgtggtaccagaagaaggagtttttgtcagttgccacaaccgccccgggacctcagcaggtacttccaggctattgtcagtgttctctgaaggatcagggtttgttcatccagtgtctgatcggcgcgtatgaccagcagatctgggagaaaagcgtggagcagagagaaatcaagtttattaagctgggcctcaggaacaaaccgaaaaagacagcccatgtaaagccagacctaatcgacgtggatctcgttaggggctccgcctttgctaaggccaagcctgagagcccctggactagcctgacaagaaagggaatagtgcgggttgtcttctttcctttctttttccgttggtggctacaggtaacatccaaggttatatttttttggctgcttgtgttatatttgttgcaggtggccgcgatcgtgctcttctgttcaacttccagtcctcattccattccgctgacagaagtcattgggcctatttggttgatgcttctgcttgggacggtccattgtcaaatagtgagcactagaacccctaagccccctctcagtaccggaggcaagaggcgcaggaagctgaggaaggccgcccacctggaggtgcaccgggaaggggatgggagctcaacaactgataatacccaggagggggccgtgcaaaatcacgggacttcaacgtctcactcagttgggactgtttttagagacctgtggcatgctgctttctttctgtccggatcgaagaaggccaagaacagtattgataagagcactgaaacagataacgggtatgtgtctctcgacgggaaaaagactgtgaagagtggggaggacggtattcagaaccacgagccacagtgcgaaactataaggccagaggagaccgcttggaacaccggaaccttgcgtaatgggcccagcaaagacacacagaggactataactaacgtttctgatgaggtgtctagtgaagaggggccggagacaggctacagcctgaggcgccatgtggacaggacatcggaaggtgtgctgagaaatcgcaagtcacaccactataagaaacactatcctaatgaggacgctcctaagagcggcacatcatgcagtagcaggtgctcctccagcagacaggactcagagtccgcgcgacctgagagcgaaactgaggacgttctgtgggaggacctgctgcactgcgctgagtgtcacagctcatgcacaagcgagacagatgtggaaaaccatcaaatcaacccctgcgtgaaaaaggaatatcgtgatgaccccttccaccagagccatctgccatggcttcacagtagccacccgggactggagaagatctcagccatcgtgtgggaggggaatgactgtaagaaagctgatatgagtgtgttggagatctcaggaatgatcatgaacagggttaatagccacatacccgggattggataccagatctttggcaatgcagtgtcccttatactgggactgacaccttttgtgttcaggctctcacaggccactgatctggagcagctcacagcccactctgctagtgagctatacgtgatagcttttggtagcaacgaggacgtgatcgtcctttctatggtgatcataagcttcgtggtaagagtgagcctggtgtggatattttttttcttgctttgtgtcgcggagcgcacctacaaacagagactgttgttcgccaaactgttcggacacctcacgagtgctaggcgcgcaagaaagtctgaggtgccccactttaggctgaagaaagtccagaatattaaaatgtggctcagccttcgttcgtacctgaagaggcgcggaccccagaggagtgttgacgtcatcgtgtcatccgccttcttactgactatctcggtcgtgttcatttgttgcgcccagctcttgcacgtgcatgaaatattcttggattgtcattacaactgggaacttgtgatctggtgtatctccttgacattgtttcttctcagatttgtgaccctaggatccgaaacctctaagaaatacagcaacacctccatcctgttaacggaacagatcaatctgtatctgaagatggagaagaagcccaataagaaagaagaactcaccttggttaacaacgtgcttaaacttgccaccaaactgctgaaggagctggactcccctttccgactgtatgggcttactatgaacccactcttatataacattactcaagttgtgatactcagcgccgtaagtggagtcattagtgacctcctcggttttaatctgaagttatggaagatcaagagttag

SEQ ID NO: 45276 - DNA, 2088 bp, Artificial Sequence
  Description of Artificial Sequence: Synthetic coding sequence
atggccagcaaggtgaccgacgccatcgtgtggtaccagaagaagataggggcgtatgaccaacagatctgggagaagagcgtggaacagcgcgagatcaaaggattgcgtaacaagcccaagaagaccgctcacgttaaacctgatttgattgacgtggatctcgtgcgtgggagtgcctttgccaaggctaagcctgagtccccgtggacgtctctcacgagaaagggcattgtgcgcgttgtgttctttcccttcttcttccgctggtggctgcaggtcacttccaaggtgatttttttctggctgctggtgctgtaccttttacaggtggcggctattgtgctcttttgctccaccagttccccacactcaatcccacttaccgaggtgattgggcccatttggctaatgttgctgttgggtaccgtccattgccaaattgtttccaccaggactccaaaacccccattaagcacaggcggaaagagaagacgaaaactgagaaaagcagcacacctagaggtgcatagagagggagacggaagctcaaccacggataatactcaggagggagccgtccaaaaccacgggacaagcacgagccactctgtggggacagtatttagggatctgtggcatgctgccttcttcctcagtggttcgaaaaaagctaaaaactcaatcgataagagtacagagacggacaatggatatgtgtctctagatggaaaaaagacggtcaaaagtggggaagacggcatccagaatcatgagccccaatgtgagaccatccgtcccgaggaaacggcctggaacacaggaacgctacgcaatggtccaagtaaggatacccaacgcaccatcactaatgtttccgacgaggtctcatcagaggagggaccagagacaggatattcactgaggcggcacgttgaccggacaagcgagggcgtcttgcggaacagaaaaagccatcactataagaaacactacccaaatgaggacgctccaaaatccggtacgtcatgtagttctcgatgtagctcctctcgccaggactccgagagcgctagacctgaaagtgagacggaagacgtgttgtgggaagatcttctgcattgcgccgagtgccactcaagttgcacctcggaaacggatgtggaaaaccaccagatcaatccttgtgtcaagaaagagtacagagacgatccctttcatcagtcccacctgccctggctccactccagccaccctgggctggaaaagatttccgctatcgtctgggagggcaacgactgcaaaaaggctgacatgtcagtgctggaaattagtggtatgatcatgaatcgggtcaactcacacatccctggcatcggctaccagatcttcgggaatgctgtgagtttgatcctggggctgactcccttcgttttcaggctgtcgcaggcaactgatctggaacaacttacggctcacagcgcttctgagctgtacgtgatagcttttggtagtaatgaggacgtgatagtattgtccatggtgataattagttttgtcgtccgcgtctctctagtttggatatttttctttctgttgtgcgtagccgagcgtacttacaaacagcgtttacttttcgcaaagctgtttggccaccttacctctgctaggcgggccagaaagagcgaggtccctcattttcgtctgaagaaggtgcagaacataaagatgtggctgagtcttcgaagttacctaaagagacgtggcccacagcggtccgttgatgtgattgtatcaagtgccttcctgctcaccatcagtgtggtctttatttgctgcgctcaaattaatctgtacctgaaaatggagaaaaaacctaataaaaaggaggagcttactctggtgaacaatgttctaaagctggctactaagctcctgaaagaactagactctccttttcgcctctacggcctcactatgaatcccctgctctataacatcacccaggtagttatcttgtctgcagtgtctggggtgatttctgatctactgggatttaacctgaaactgtggaaaatcaaatcttag

SEQ ID NO: 45277 - DNA, 2244 bp, Artificial Sequence
  Description of Artificial Sequence: Synthetic coding sequence
atggccagcaaggtgaccgacgccatcgtgtggtaccagaagaagatcggcgcttatgatcagcagatttgggaaaagtccgtagaacagcgggaaattaaagggttgcggaacaaacccaagaaaactgcgcacgttaagccagatcttattgatgtggacctggtccgcggtagcgcatttgcaaaggccaaacctgagtccccctggacctctttaacaagaaagggaattgtcagggtcgtgtttttccccttttttttcagatggtggcttcaggtaacaagcaaagttattttcttttggttgctagtgctctaccttcttcaggtggccgcgatagtgctattttgctccactagttccccacattctattcccctcaccgaagtaattggtccaatctggcttatgcttctccttgggaccgtccattgccaaatcgtctcgacccgaacccctaaaccccccctgtctactggcgggaagagaaggcgtaaactgcgtaaagccgctcatttagaagtgcatagggagggagatggcagctcaactaccgacaatactcaagaaggtgccgtgcagaatcacggaactagcacctcccacagcgtaggtaccgttttcagggacctatggcacgccgcgttctttctgagcggatccaagaaggccaagaattctatcgataaatctactgagacagacaacggctacgtgagcttagatggcaaaaagacagtcaaatccggagaggacggcattcagaatcacgaacctcagtgcgagacaatccggccggaggagaccgcttggaatacaggtaccttgcggaacggcccctctaaagatactcaacgaacaatcacaaacgtgagcgatgaagtgagttctgaggaagggcctgagacaggatactccctgcgtaggcacgtcgaccgtactagcgaaggagttctgcgcaatagaaagagtcatcattacaagaagcactacccaaatgaggatgctcccaaaagcggcacttcctgttcttctaggtgctctagctcccggcaggattcagagtcagctcggccagaatccgaaacagaagacgtattgtgggaggatttgttgcattgcgcagagtgccacagttcctgtacatcagaaacagatgtggagaatcatcagataaatccatgcgtgaagaaggagtacagggatgacccgttccaccagtctcacctgccctggctgcacagctcccaccccggacttgaaaagattagtgccatcgtctgggaaggcaatgactgcaagaaagcggatatgtcagtgctggagatttcaggaatgattatgaatcgggttaatagtcatatcccaggtatcggttaccagatcttcggcaatgccgtgtctctgatcctgggattaacaccattcgttttccgcctgtcacaggccacagacctcgaacagctgaccgctcattccgctagcgaactctacgtcattgcttttggcagcaatgaggacgttatcgtgctgtccatggttatcatttcctttgtggtgagggtttccctcgtctggatcttcttctttctgctgtgtgttgcagaacgcacctacaaacagcgcctgctatttgcaaaactatttgggcatctcaccagcgctagacgggcgcggaagagtgaagtcccccatttccggctcaaaaaggtacagaacatcaagatgtggttgagcctacgtagctacctgaagcggcgcggcccccagagatccgtggacgtaattgtgtctagcgcttttctgcttacaatcagcgttgtcttcatatgctgcgcccaactccttcacgtgcacgaaatctttctggactgtcattacaattgggaactggtcatttggtgtatttccttaaccctattccttctgcgatttgtgactcttggttcagagacaagcaaaaaatatagcaatacctctatactgttgactgaacagattaatctgtatcttaagatggaaaaaaagcctaacaagaaggaagagcttacactcgttaacaacgttctgaaactggctaccaagctcctgaaagaattagatagtcctttccgactgtatgggctgaccatgaacccattattatacaacatcactcaggttgttatcctatcagccgtctccggggtgatttctgacctgcttggttttaacctcaagctgtggaagattaaatcatag

SEQ ID NO: 45278 - DNA, 2256 bp, Artificial Sequence
  Description of Artificial Sequence: Synthetic coding sequence
atggccagcaaggtgaccgacgccatcgtgtggtaccagaagaagatcggggcttatgatcagcagatctgggaaaagtctgtggagcaaagggagatcaaatttattaaactgggcctccgcaataaacctaaaaaaacagcccatgtgaagccagatctgattgacgtggatctggtgagaggctcggcctttgccaaagccaaacctgagtctccatggacttcacttaccaggaagggcatcgtgagggtggtatttttcccctttttctttagatggtggctccaggtgacttccaaagtaattttcttttggttgctggtgttgtatttgctccaggtcgccgctattgtgctattttgctcaacaagcagtcctcattcaatcccgctcaccgaggtaatcggccccatctggctcatgctgctccttggtacagttcattgccaaatagtttccacacgaacccccaagccacctctgtctacagggggcaaacgacggaggaagctgcgcaaagcagcccacctggaggttcaccgggagggagacggctcgagtacaacagacaatactcaggagggagccgtacagaaccacggtacttcaacgagtcattccgtgggcacggtgtttagagatctctggcacgccgccttctttctttcagggtctaagaaggcaaaaaattccattgacaaaagtaccgagaccgacaacggatatgtctccctcgacggaaagaaaactgtcaagagcggggaggatggcatccagaatcatgagccccagtgcgagaccataaggcctgaagagactgcctggaatacaggaacactcaggaatggaccctcaaaagatactcagcgaactatcaccaatgtgagtgatgaggtgagctcagaagaaggccctgaaactgggtactcgctaaggcgacacgtggatcgcacatctgaaggcgtgttacgtaatagaaagagccatcactacaagaagcattacccgaacgaagacgcccccaagagtggcacctcatgtagctcccggtgttcttcttccagacaggacagcgagagtgcacgcccggagagtgaaaccgaagacgtgctgtgggaggacctgctacattgtgccgagtgccactcatcctgcacgtcagagaccgatgtggaaaaccaccagattaatccttgcgtaaagaaggagtacagagacgatccgttccatcagtcgcatttgccatggctgcattccagccaccctggcctcgaaaaaatctcggcaatcgtgtgggagggaaatgactgtaagaaggctgacatgagtgtacttgaaatcagcggtatgatcatgaatagggtgaattcccacatcccaggcatcggctaccagatcttcggtaacgccgtgtccctaatcttaggcctaacgccgttcgtttttcgactgtcgcaggccaccgatctcgagcagctcaccgcccatagtgcaagtgagctgtacgtcatagccttcgggtctaacgaagacgttatagtactgtccatggttataattagttttgtcgtccgagttagtctcgtttggatatttttcttcctgctttgcgtggcagaacgtacgtacaagcaacggttactgttcgccaagctgttcggccacctgacgagcgcaaggagagctaggaagagtgaggtcccccattttcgcctgaagaaggttcaaaacatcaagatgtggctgtctctgaggtcatatctcaaacggaggggtccccagcgcagtgtcgacgttatcgtttcgtccgcattcctgctgacgatcagcgtggtgttcatatgttgtgctcagttgctgcacgtccatgaaattttcttagactgccattataattgggagcttgttatctggtgtatctccctgacattatttctgctgagatttgtaaccttggggtcagagacttctaagaaatattcaaacacgtctatcctgcttaccgagcagatcaatctctatctaaaaatggaaaaaaagccgaataagaaagaggaactgactctggtgaacaatgtgttgaagctggctaccaagttactcaaagagttagactcaccattcagactctatggtctgactatgaaccccttgctatacaacatcactcaggtcgtgattttgtccgctgtctccggagtgatcagtgacttactcgggttcaacctcaagctctggaaaatcaagagctag

SEQ ID NO: 45279 - DNA, 2256 bp, Artificial Sequence
  Description of Artificial Sequence: Synthetic coding sequence
atggccagcaaggtgaccgacgccatcgtgtggtaccagaagaagattggagcgtacgaccagcagatttgggaaaaatctgtggagcagagggaaatcaagttcatcaagctcggcttacgcaacaagcctaagaagacagcccacgtaaagcccgatctgattgatgtcgatctggtgcgcggtagcgcttttgccaaagcgaaacccgagagcccttggacttctttaacccggaaagggattgttcgagtggtgttctttcctttcttcttcaggtggtggctgcaagtgacctcaaaagtgatctttttctggcttctggtactctatctgttgcaggtggccgctattgttctgttttgctccactagcagcccccatagcattccgttgactgaagtcatcggaccaatttggctcatgctcctgctagggacggtgcattgtcaaatagtttcaacacgtactcccaagcccccactgtcaaccggcgggaagagaaggcgcaaactccggaaggcagcacaccttgaggtgcaccgcgaaggtgacggcagcagcactaccgataatactcaggaaggagcggtgcagaaccacgggacaagcacatctcattccgtggggacagtctttagggacttgtggcacgccgcattctttttgagcggcagcaagaaggccaagaactctatcgataaaagtactgagaccgataacgggtacgtgtccctggacggtaagaaaacggtgaagtcaggggaagatgggattcagaatcatgagccacagtgcgaaaccattagacctgaagaaacagcttggaacactggcacactgagaaacggaccatccaaggatacacagagaacaatcacaaacgtgtccgacgaagtttcctctgaagagggaccagagactggttattcgttgagaaggcatgtggatcggacgtccgagggtgtgctgcgcaaccggaagagccatcactacaagaaacattaccccaacgaagacgctcctaagagtggaacctcatgtagcagccggtgcagctcctcaaggcaggattcagaaagcgctagaccagagagtgagacagaggacgtcctgtgggaagatctgctacattgcgcagaatgtcattccagctgcacttctgaaaccgacgtggagaatcatcagattaacccctgcgtaaagaaagagtatagagatgaccctttccaccaatcacatttgccatggctccattcctcacatcctggtctagagaagatttccgctatcgtgtgggaaggcaatgactgcaagaaagcagacatgagcgtgctggagatctccggcatgataatgaaccgggtaaattctcacatcccgggaattggctaccagatctttgggaatgctgttagccttattttgggcctcacccccttcgtcttccgccttagtcaggctacagatctggagcagttaacagcccactctgcaagtgaactctatgtcatcgctttcgggtccaacgaggatgtaatcgtgctgagcatggtcatcatctctttcgtggtgagggtctccctcgtatggatcttcttttttctcctctgcgtggctgaacgaacatacaaacaaaggctgctctttgccaagctttttggccacctcaccagtgcacgccgcgctcggaaatctgaagtgccacacttcagactgaagaaagtgcaaaatataaaaatgtggctgagcctgcgctcctatctcaaacggcggggacctcagagatctgtggacgtgattgtttcaagcgcattccttcttacaatttccgtcgtttttatatgctgcgctcagcttctgcacgtacacgagattttcctcgactgtcactacaattgggagcttgtaatatggtgtatctcattaacgctgtttctactccgctttgtgacgctcggcagcgaaacctcaaaaaagtacagcaatacatcaatcctgctgacagagcagatcaacctttaccttaagatggaaaaaaagccaaataaaaaagaagaactgaccttagtgaacaatgttctgaaactggctaccaagcttctaaaggagttagactcccctttccggctgtatggactgactatgaatccacttttgtataacatcacccaggtggtaatcttatctgccgttagcggagtgattagcgatcttctgggttttaatctcaaattatggaaaatcaagagctag

SEQ ID NO: 45280 - DNA, 2256 bp, Artificial Sequence
  Description of Artificial Sequence: Synthetic coding sequence
atggccagcaaggtgaccgacgccatcgtgtggtaccagaagaagataggggcttacgaccagcagatttgggagaaatcggtggagcagcgcgaaataaaatttataaagtatggtctgcgtaataagcccaaaaaaaccgcacacgtgaagcctgatctcatcgatgttgatctcgtccggggtagtgcttttgcgaaggcaaagccagagagcccctggactagcttaacccgcaagggcatagtgagagtggtgtttttccccttctttttcagatggtggctccaggtcacctccaaggtcatcttcttttggcttttggtcctgtatcttctccaagtagctgctattgtgctcttttgttctactagctctcctcattccatccctctcacagaagtaataggacctatctggcttatgctgctgctgggaaccgtccactgccagatcgtttcaactcggactcccaagccacctctttccacaggaggcaaacgcaggcggaagctgaggaaggccgcacaccttgaagtgcatcgagaaggagacggctcctctacaacagacaatacacaggaaggtgcagtgcagaatcacgggaccagcacatcacatagtgtcggcactgtgtttcgggacctctggcatgcggcttttttcctgtcagggtctaaaaaggcgaagaacagtatcgataaatcgacagagaccgataatgggtacgtgtctctggatggtaaaaaaaccgtgaagagcggagaggatgggattcagaatcacgaaccacagtgcgaaaccataaggccagaagaaaccgcctggaacacagggactctgcgcaacggtccatctaaagatacccagagaaccattaccaacgtgtctgatgaggtgtcgtctgaggagggccccgagactggatactcactgcggagacatgtcgatcggacctccgaaggagtgctcaggaacagaaagagtcatcactataagaagcattatccgaatgaagatgctcccaagagcgggacgtcatgctcctcacggtgtagctcttctaggcaagattcagaatccgctcgccctgaaagtgaaacagaggacgtcctctgggaagacctgctacactgtgcggagtgtcactctagttgcacatcggagaccgacgtcgaaaaccaccagatcaatccctgtgtgaaaaaagagtacagggatgaccccttccatcaatctcatttgccttggttgcattcaagtcacccgggcctggaaaagatttccgctattgtgtgggagggtaatgattgcaaaaaggcagacatgagcgtgctggagatctcaggcatgatcatgaatagagtgaatagccacattcccggaatcgggtaccagatcttcggcaacgctgtcagcttgatcctgggtctaactccttttgtgttcaggctcagccaggcaacggatttagagcagctgaccgcccacagtgctagcgaactctatgtcatagcgttcggctccaatgaggacgtgatagtcctgagcatggtgatcatatcttttgtcgttcgagtttctttggtgtggatctttttttttcttctgtgcgtggctgagcgtacctacaagcagcggttgcttttcgctaaactctttggacatctgactagcgctcgtagagccaggaaaagcgaagtgcctcattttcgtttgaagaaggtccagaacattaaaatgtggctgtctcttagatcttacctgaagcggaggggtcctcagcggtcagtcgacgtcatcgtgagtagtgcattccttttgactatctcagtggtttttatctgttgcgcgcagctacttcacgtgcatgaaatctttctggattgccattataactgggagttagtcatttggtgcatatctctcaccctttttctcttgcgctttgtcacacttgggagtgaaacaagcaagaagtacagcaatacttccatcctgctgacagagcagatcaacctttatctaaaaatggagaagaagcctaacaagaaagaggaactgaccttggtcaacaatgtgctgaagctggctactaagcttctgaaggagttggacagtcccttccgactatatgggctcactatgaatccactgctgtacaatatcactcaggtcgtcatcctgtcggcggtctcaggcgtgatttcggaccttcttggctttaacctcaagctctggaagatcaaatcctag

SEQ ID NO: 45281 - DNA, 1059 bp, Artificial Sequence
  Description of Artificial Sequence: Synthetic coding sequence
atggccagcaaggtgaccgacgccatcgtgtggtaccagaagaagattggtgcatacgatcagcagatctgggagaagagtgtagaacaacgcgagattaaggggcttcgaaacaagcccaagaaaacagcacacgtgaaacctgacctaatagatgtggacctcgtaagagggagcgctttcgctaaagccaagccggagagcccatggacttccctcacaaggaagggcatcgtgagagtcgtgttcttcccattttttttccgctggtggctgcaagtcacatcaaaggtgatatttttctggctgctggtcttgtacctgctacaagttgctgccatcgtcttgttttgctcgaccagcagtcctcattctattcccctgacagaagtgatcggaccaatttggttgatgttgcttcttggtactgtgcattgtcagattgtgtctacccggacacccaagccacccctgtccaccggagggaaaaggcgacggaagctccgcaaggccgcgcaccttgaggttcatagggagggggacgggagttccaccactgacaatacccaggaaggagccgtccagaaccacgggacatctacttcccatagcgtgggtacagtgtttcgggacttatggcacgcagccttcttcctctcaggtagcaaaaaggcaaagaactccatcgataaatccaccgaaaccgacaacggatacgtgagtctagacggcaagaaaacagtaaagtcaggcgaagacggcatccagaatcacgaaccacagtgcgaaactattaggccagaggagactgcctggaacacagggactctgcgaaacgggccaagtaaagacacacagcgaactattaccaatgtaagcgacgaggtctcaagcgaggagggacctgagaccggctactcgctccgacgccacgtcgacaggaccagcgagggcgttctacgaaatcggaagagtcaccactataaaaagcactatcccaatgaagtgtacaccctgagtttaagtgtgtacatcaggatctacttcatatgctactag

SEQ ID NO: 45282 - DNA, 1071 bp, Artificial Sequence
  Description of Artificial Sequence: Synthetic coding sequence
atggccagcaaggtgaccgacgccatcgtgtggtaccagaagaagatcggggcgtacgatcagcaaatttgggaaaagtccgtggaacagcgggagattaaatttatcaagctgggcttacgtaataaaccgaaaaagactgcccacgtaaaacctgatctgatcgatgtcgacctggtaagaggctcagcctttgccaaggctaagccagagtccccttggacatcactgacacgtaagggtattgtcagagtggtatttttcccattttttttccgctggtggctgcaggttacgtcaaaggtcatattcttctggctgctggtgttgtacctgttgcaagtggctgctattgtgcttttctgcagtacgagcagtccccatagcatccccctcaccgaggtcatcggaccaatttggctaatgttgctgttaggcactgtgcactgtcaaatcgtaagtacaaggacaccaaaacccccactcagcaccggcggaaaaaggcgccgcaaactgcggaaggctgctcatctagaggtgcaccgcgagggcgacggaagctccactacggataacacccaagaaggagcagtacagaaccatggcaccagcacgtctcattccgtcggcacggtctttcgcgacctgtggcacgccgcattcttcttgagtggcagcaaaaaggccaagaacagtattgacaaatccacggagaccgacaatggttacgtgtccctggatggcaaaaaaacagtgaagtcaggtgaggatggcattcagaatcacgagccacagtgtgaaacaatacggcccgaagagactgcatggaacactgggactttgagaaatggccctagtaaagatactcagcgcacgataactaacgtgtcagacgaggtgtcctccgaagagggtccagaaacagggtactctttgagacgccatgtggaccggacatccgagggtgttctccggaaccgcaagtctcaccattacaaaaagcactaccctaatgaggtctacactcttagcttgagtgtctatattcggatctattttatatgctactag

SEQ ID NO: 45283 - DNA, 1449 bp, Artificial Sequence
  Description of Artificial Sequence: Synthetic coding sequence
atggcccggaagctgagcgtgctggaggtgctgctgatcatcttctgtctcattgtggtgactatcgacatcctgctactgctccttgtgcttgaagagacctcagacacctccttcacgcctgagtgtccagagatcccgcagtctgagagaattgattgcacgcctgatcaagaagtgactgaggacatctgccggtggcaatataagtgttgttggtcacccgtcgccgatgcaaatgttcctcgctgcttctttccgtggaactggggctatgaggctagcaacgggcacactaacacctctaccgggtttaccgcacaactgaagcgcctccccagcccttcactgttcggtaatgacgtggcaactaccctgttcaccgctgagtaccagacttctaacaggtttcacttcaagatcactgatttcaataatatccggtatgaagtgagccacgaaaacataaacctcgtggacggtatcgccgacgctagtaacttatcctattatgtggaggttactgataaaccctttagcattaaaatcatgcgaaccagcaaccgcagggtgcttcttgacaccagcatcggtcccctgcagtttgcacagcaatacttgcaattatcatttcgtctgccatcagctaacgtgtacggtctgggcgagcacgtgcaccagcaatacagacacaatatgacatggaaaacctggcccatcttcacccgtgacgcgacacccactgaaggaatgataaatctgtatggcgcacatactttttttctttgcctcgaggacgcgagggggtccagtttcggggtgtttctgatgaactctaacgctatggaggtgactctccaaccagcgcccgccatcacctacaggactatcggtggcattttggatttctacgtgtttctgggcaacaccccggagcaggtcgtgcaggagtacctggaactggtgggacgccctttctttcccccgtactggtctctaggcttccaactaagtcggcgcgactacggtggcatcaacaaacttaaggaagtggtgtctaggaatcggcttgctgaaatcccatacgatgtacagtactctgatatcgattacatggacggcaaaaaggacttcactgtggacgaagtcgcatactccggcctccctgacttcgttaaggagcttcatgacaatggacagaaatatttaattataatgaatcccggtatcagtaagaactccaattatgagccctataataatggttctctgaagcgcgtttggatactcggcagtaacggatttgctgtgggtgagggttatccaggtcccactgtgttccccgactacacaaatccagtatgcaccgagtggtggaccgaccaggtagctaaatttcacgaccacctggaatttgatggggtttggatcgtgtcgtactactcctag

SEQ ID NO: 45284 - DNA, 1941 bp, Artificial Sequence
  Description of Artificial Sequence: Synthetic coding sequence
atgttcctgagcatcagcacccggctgcccagccagtacatctacggcttcggagaaaccgaacacacaaccttccgtcggaacatgaattggaatacgtggggaatgttcgctcacgacgagccccctgcctataagaaaaattcctacggtgtgcacccatattacatggcccttgaggaggatggtagcgctcatggagtgttacttcttaatagcaatgcaatggacgtcacactccagcccaccccggccttgacctatcgtacaactggcggtatactggacttctacatcgtgttggggcctactcctgagctggtgactcagcaatataccgaactgattggacggcccgctatgataccctattgggcactgggatttcatctctctcgctacggatatcagaatgatgcagagatctcaagcctgtatgatgccatggtagctgcccagatcccgtacgacgtgcagcatgtggacatcgattacatgaacagaaagctggactttacccttagtgccaatttccaaaacctgagcctgctgatagaacagatgaagaagaatggcatgcgctttatcctgatcctagatcccgctatctctggcaacgaaactcagtatctgccttttatccgaggccaggaaaacaacgtcttcattaagtggcccgacactaacgatattgtctgggggaaagtgtggcccgacctccctaatgttatcgtggatggaagtctggatcatgaaacgcaggttaaactgtaccgcgcctatgtggcatttcccgattttttcagaaatagtacggccgcttggtggaaaaaggaaatcgaggaactgtacgctaatccacgcgagcccgaaaagtccctgaaattcgacggactgtggatcgacatgaatgaaccgtccaactttgtggacggcagtgttcggggctgcagtaatgaaatgttgaataatccaccatacatgccatacctagagagtagagataaaggcctgtcatcaaagactctctgcatggagtcacagcagatcctaccggactccagtccggtggaacactataatgtgcacaatctctacggctggtcgcagactcgccctacctacgaagcagtacaggaagtgacagggcagaggggcgttattatcactaggagcacttttccttccagtgggaggtggggaggccataggttgggaaacaacactgcggcgtgggatcagttgggtaagtccattatcggcatgatggaattctcattattcggtataccatacaccggagcggatatctgcggcttttttggtgacgcagaatatgagatgtgcgtccgatggatgcagctgggagcattctatccattctctagaaatcacaacaacataggcactaggcgccaggacccggtagcctggaattccacattcgagatgttgtcccgaaaggtactcgagaccaggtatactttactgccctacttgtatacactgatgcataaagcccatgtagaggggagtaccgtagtgaggccgctgttacatgagtttactgatgaccggaccacctgggatatcgataggcagttcatgctgggacccgctatcctcatttccccggtacttgagaccagcacttttgaaatttctgcctattttcctcgagctcgctggtacgattattcaaccgggacatcgtcgacctcaacagggcaacgtaagatcctgaaggcgcctctggatcacattaacctccacgttcgcggtgggtatatattgccatggcaagaacctgcaatgaacacacacagcagcaggcagaatttcatggggttgattgtggcgctggacgataacggtactgcagaggggcaggtattttgggacgacgggcaatccatcgtttttaacaccactgcaatgtag

SEQ ID NO: 45285 - DNA, 3381 bp, Artificial Sequence
  Description of Artificial Sequence: Synthetic coding sequence
atggtgaagctgagcatcgtgctgaccccccagttcctgagccacgatcaggggcagctgacaaaggaactgcagcaacacgtgaagtctgtcacctgcccctgcgaatacctcagaaaggtgattaatactctggctgaccaccaccaccgcggtactgactttgggggcagtccttggctgcacgtaataatagcttttcctactagctacaaagttgtgataactctttggattgtttacttatgggtaagtttgctcaaaactattttttggagcagaaatggtcacgacgggtcaaccgacgtgcagcaaagggcgtggcgcagcaaccggagacggcaggaagggctgaggtccatttgcatgcacacgaagaagagggtatcatcatttagaggcaacaagataggcctgaaagacgtcatcacgctccgcagacacgtggagaccaaagtacgggctaagatcagaaagagaaaagtgaccactaaaatcaaccaccacgacaagataaacggaaagaggaaaaccgcaagaaagcagaagatgttccagcgcgcacaggaacttcgccgcagagccgaggattaccacaaatgcaagataccaccctcagctaggaaagcactgtgcaactgggttaggatggctgctgccgagcacagacattcttcaggattgccctactggccatacttgaccgctgaaacgctgaaaaatagaatgggccatcagcctcctcccccgactcagcagcactccatcaccgacaattcgctgtccttaaaaacacccccagagtgtctgctgacccctcttccccctagtgccgacgacaatcttaagacccctccggaatgcgtgttaacgccgctgcccccaagtgcggatgacaacctcaaaacaccgcccgaatgcgtcctaacccctttaccaccgtccgccgatgataacctgaaaaccccacccgaatgtctgcttactcctcttccacccagtgccgacgacaaccttaaaactcccccggaatgtctgctcacccctctcccacctagtgccctgccttccgcccccccatccgccgatgacaaccttaagacacgggcagagtgcttgcttcatccactcccaccatcggccgatgacaacctgaaaactccatccgaacgacagctgacgccactcccaccatccgcccccccgtctgccgacgacaatatcaaaacgcctgcagaaagattgaggggtcctctgcccccttccgcggacgacaacctgaaaacgccaagcgagaggcagctgacgccgctcccgcccagtgcgcctccttccgcagacgacaatataaagacacccgccgagaggctgcgcgggccattgcccccaagtgccgacgataacctaaagacaccctcagagagacagcttacaccgctccccccaagcgcccccccttcagctgatgacaatattaaaactccggccgagcggctcagagggccgcttccgcccagtgccgatgacaacttaaaaacaccatcagaacggcagctgactgctctcccaccttcagccgacgacaatatcaagacgccagccgagcgactcagaggccctcttccaccaagcgccgatgacaacttgaagactccatccgagcgccagttgacacctctgcctcctagcgccccaccgagcgccgacgataatataaaaacccccttgccccccagcgccgacgatctcaaaacaccaagcgagcggcaattaacacccctaccccctagcgcaccgcccagcgccgatgataatattaagataccaggatttcaccatcagccaatgattatttcgcggcaccttccatccgtctcttctctgccatttcatcctcagctgcatccacaacagatgatcatatcccggcacctcccaagtgtttgtgggggccgattccaccctgagcgtatgataatctctaggcatctgccaagtgtgtcatcactcccgtttcatccacagctgcaccctcaacaaatgattatatctaggcatcttcccagtgtctgcgggggaagattccacccacagcagatgataatctcccgacacctgccgagcgtctcctcactcccctttcacccacaactgcaccctcagcagatgattatcagtagacacctgccttcagtttgcggcggcaggttccatccgcaaagaatgatcatctcacgccacctcccctccgtcagtagcttgccatttcaccctcagctgcatccccagcagatgatcattagccggcacttgccctccgtctgcggcgggagattccacccacagcaaatgataatctctcggcatctcccttcggtgtccagtctcccttttcatccacagctgcacccacagcagatgataatatccagacacctcccatcggtgtgtggcgggagattccacccccagaggatgataatttcccgacacctgccatccgtgtcatccctaccctttcaccctcaactgcacccccagcagatgataatttcaagacacctcccgagcgtgtgcggcgagaggttacgaggtcccctgcctccctctgccgatgacaatcttaagactccaagtgagagacagcttaccccacttcctccaagcgcaccccccagcgctgatgataacatcaaaacccccgcggagcgtctgcggggacctcttcccccatccgcggatgacaatctgaaaactccatccgaaaggcaactgaccccattaccacctagcgcaccaccctcagcagacgataatattaagaccccagccgaacgcttacggggcccgctgcccccctcggctgacgacaatctgaagactccttcagagaggcagttaactccgctgccgccatccgcccctccctcagccgacgacaacattaagacccccgccgagcgccttagaggacctctcccgcccagcgccgacgataatcttaaaacaccccccttggctacccaggaagcagaagcagagaagcctcgtaagccaaaacggcaaagggccgcagagatggaacccccaccagagcccaagaggaggcgagtcggcgacgtcgagccctcaagaaagcctaaacgacggcgggccgccgacgtggagccctcctcaccggagccgaaacgccgacgggttggcgatgtagaaccctcgcgcaaacccaaacgccgtcgggcagcagacgtggagccgtctagccccgaacctaagcgcagaagggtcggggacgtcgagccatctcgaaagcccaaaagacgacgggcggctgacgttgaaccaagcctccccgagccaaagagaaggagactgtcttag

SEQ ID NO: 45286 - DNA, 2220 bp, Artificial Sequence
  Description of Artificial Sequence: Synthetic coding sequence
atgttctgctgcctgggctacgagtggctgagcggcggctgcaagacctggcacagtgcttgggtcattaacaccctggccgaccaccaccacagaggaaccgacttcgggggcagtccgtggttacatgtcattatcgccttcccaacgagctacaaggtagttattaccctgtggatcgtgtacttgtgggtgtccctcttaaaaaccatcttttggtcaagaaatggtcacgatggatccacagatgtccagcagagagcttggcgctcaaataggcgcaggcaagaggggctccgctcaatatgcatgcataccaagaaaagagtgagcagcttccgaggtaacaagatcgggctgaaggacgtgataacactgcgtagacatgttgagacaaaagtacgggcaaaaattcgtaagcgcaaagtgaccactaaaatcaatcaccacgacaagattaacggaaagagaaaaacagccagaaaacagaagatgttccagagagcacaagagttgagaagacgcgccgaggactatcacaaatgcaagattcctccctctgcacgcaaagcattgtgtaactgggtgcgcatggcagctgccgaacaccgacacagtagcggcttgccgtactggccttaccttaccgccgagaccttgaaaaatcgcatgggacatcagccccctcctcctacgcaacagcatagcatcacggataattcactgtctctgaagactccccccgagtgcttgctgacccccctgcctccctcagccgacgataacttgaaaacacccccggaatgtgtgttaactccgcttcccccatccgcagacgacaacctgaaaaccccccctgaatgtgtcctgactccacttcccccctcagcagatgataaccttaagactccgcctgagtgtctgctgactcctctccctccatccgctgatgataatcttaagacaccccctgaatgtttactgacgcccctccccccgtccgctctcccaagcgcgcctccatctgctgacgataacctcaagacaagggccgaatgtctgctgcacccacttcctccatccgcagatgacaatcttaaaacgccgtccgagagacagctgacgccgctacctccaagtgccccaccaagcgctgacgataacatcaagacccccgcagaacgactgcggggacccctgcctccgtccgctgatgataacctcaaaacacctagcgagaggcaacttacccctctgcctcccagcgcccctccgtctgctgatgacaacataaagaccccagccgaaaggctccggggacccttaccgccatccgccgacgataacctcaaaactccaagcgagcgccagcttacccctcttccccctagcgctccccccagcgcagacgacaatatcaaaaccccggccgaaagactccgcggacctctgcccccgagcgctgacgataacttaaagaccccttccgagagacagctgactgctttacccccttctgccgacgataatattaaaacccccgccgagaggctcaggggcccacttcccccatccgctgatgacaatctgaagactccgtctgagaggcagctgactcctctgcctccctctgctccgccctctgccgatgataatatcaaaactcccgcagagcggctgcggggcccactgcccccttctgctgatgataatttgaagaccccgtcagaacggcaattgacaccgctgccgccctctgcaccccccagcgcggatgataacatcaagacgccagccgagaggctgagaggacccctgccccctagcgccgatgacaacttgaaaacacccccgctggccacccaggaagccgaggctgaaaaaccaagaaagcccaaacggcaaagagccgctgaaatggagccccccccagagcccaagaggcggcgagtaggcgatgtggaaccctctaggaagccgaaacgcagacgggctgcagacgtggaacctagctctcctgagccaaaaagacgtagagtcggtgacgttgagccctcacgaaaacctaaaagacgacgcgcagccgacgtggagcctagttctccagaaccaaagcgacgccgggtcggggatgtcgaacctagcagaaaaccaaaaaggcggagggctgctgacgtcgagcccagcctgccagagcccaagagacggcgattgtcctag

SEQ ID NO: 45287 - DNA, 3402 bp, Artificial Sequence
  Description of Artificial Sequence: Synthetic coding sequence
atggtgaagctgagcatcgtgctgaccccccagttcctgagccacgatcaggggcagctgacaaaagagctgcagcaacacgttaagagcgtgacctgtccctgcgagtatctgaggaaggttataaacacattagccgatcaccaccaccggggtactgacttcggcgggagtccatggttgcatgtgattatcgctttccctacctcatacaaagtcgtcattactctttggatcgtttacctctgggtgtctctgctgaaaacaatcttctggagccggaatggacacgacggttccaccgatgttcaacagcgggcctggcgctctaatcgacgacgacaggagggattgagatctatctgcatgcatacaaaaaaaagggtaagtagtttcagagggaacaagatcggcctcaaagacgtcattactctgcggcgccatgtcgagacaaaggttcgagctaaaattagaaagcgtaaggtaactaccaaaatcaaccaccacgacaagatcaatggaaaacggaagacagcccgcaagcaaaaaatgttccaacgggctcaggaactgcgccggagagctgaggattatcacaaatgtaaaatccctcctagtgccaggaaggcactttgtaattgggttcgcatggccgcggccgagcatagacactcttccggtttaccatactggccttacctcacagccgagaccctgaagaatagaatggggcaccagccaccgccccccacacagcagcactccatcactgataacagcctgagcctaaagacccctcccgagtgcctgcttactcccctgcccccttctgctgacgataatctgaaaacaccaccagaatgtgtgctgactcctcttcccccctccgccgatgacaatttaaagacaccaccagaatgcgtgctgacgcctctgccaccttccgcggatgataacctgaaaacccctcccgaatgtctgttgacccccctgccgcctagcgccgacgataacctcaaaacccctccagagtgtcttctgactccgctgccaccctccgctctgccaagcgcacccccctctgccgatgacaatctgaaaacccgggcagaatgtctcctgcatcccctcccccccagtgctgacgataatcttaagacaccgtcagagaggcagctgacaccactccccccgagtgcaccgcctagcgccgacgacaatattaagacaccggcggaacgcctaagaggaccactccctccgtctgcggacgataacctcaagacccccagtgaacgccaactgacacccctgcctccttcggccccgcccagcgccgacgacaacattaaaaccccagctgagcgtcttcgcggcccgctgcctcccagcgccgatgataacctgaaaactccatccgaaaggcagttgacccctctgcctccttctgccccccctagtgctgacgataacatcaaaacacccgccgagcggctgcgtggcccattaccgccttctgccgatgataatctcaaaaccccctcagaacgccagttgactgctctcccacccagtgctgatgataacataaaaactccagctgagagattaaggggccccctccccccctctgctgacgacaatctgaagacacccagtgaacgccagctaactccattgccaccctctgcccccccaagtgccgatgacaatattaaaactcctgcatttcacccccagcgcatgatctctcgacacttaccctccgtgtcctcactaccattccacccccagctgcatccccaacagatgattatcagtagatacttgctgtctgtgtgtggttttagattccaccaccagcctatgatcatctccagacatctgcctagcgtgtccagtttaccattccatccacagctacacccccagcaaatgatcatctctcgacatctcccttcagtatgcggcggccgtttccacccagaaagaatgatcatctctaggcacctgccatcagtgtctagcctgccgtttcaccctcagctgcacccacagcagatgataataagcaggcatcttccaagcgtttgcggcggtaggtttcatccgcagcagatgatcatctcacggcacctccccagtgtctcatcactgccgtttcacccacaactgcatccacagcaaatgatcattagtagacacctccccagcgtttgcggcgggcgattccatccccagcggatgataatctctcgccacctaccctcagttagctccctgccttttcatccacagctgcatccacagcagatgatcatttcccggcacctgccctctgtgtgcggcggtaggttccacccccagcaaatgatcattagtaggcatctgcccagcgtgagttctctgccctttcaccctcagctgcatccacagcagatgattattagcagacacctgccctccgtgtgtgggggtaggtttcaccctcagcgcatgataatctccagacatctgccttcagtttcctctctacctttccaccctcaactccatccacaacagatgatcattagtaggcacttaccatctgtgtgcggggagcgcttgcgggggcccctccctcctagcgccgacgataatctgaaaaccccttcagaacgtcagcttacgcctttgcctccctccgcccctccatctgccgacgacaatatcaaaacccctgctgaaaggctgagaggccccctcccaccttcagctgatgacaatttgaagactccaagcgagaggcaactgacccccctcccgccaagtgcacccccaagcgccgatgacaacatcaaaactccagcggagcgtctgcgtggtcccctgcctccttccgctgacgataatctcaagactcccagtgaaagacagctgacacccctgcctccaagcgcacccccttccgccgatgataacattaagacaccagccgaacgtctgaggggacctctcccacctagcgctgacgacaacctgaaaacgccccccctggccacccaggaagccgaggccgagaagcctcggaaaccgaaaaggcagcgggccgccgagatggagccccctccagagcctaaaagaaggagagttggggatgtggagccgagccgcaagcctaaaagaagacgggcagccgacgttgagcctagttccccagagccaaagaggcgaagagttggcgacgtggaaccaagccggaagcccaagagacgccgcgcggcggacgttgagccaagctcacctgagcctaagcggcgacgcgtaggagacgttgagccatctcgtaaaccaaagaggaggcgcgccgcagatgtcgagccctcacttcctgagcctaagaggaggcggctgagttag

SEQ ID NO: 45288 - DNA, 2037 bp, Artificial Sequence
  Description of Artificial Sequence: Synthetic coding sequence
atggtgaagctgagcatcgtgctgaccccccagttcctgagccacgatcagggtcagctgaccaaggagctgcagcagcatgtaaagtccgttacgtgcccctgtgaatacttaaggaaagtgataaatacgcttgctgaccaccatcaccggggcactgacttcggtggcagtccatggctacacgtgataatagccttcccgacctcctataaagttgtgattactctgtggattgtgtacctctgggtctctctacttaaaaccatcttctggagtcggaacggacatgatggaagcactgacgttcagcagcgcgcatggcgttcgaatcgcaggcggcaggaaggtctgaggtctatctgtatgcacacgaagaagagggtgagttctttcagaggaaacaagatcggactgaaagatgtcattacgttaagaagacatgtcgagaccaaggtgcgtgccaaaattcgtaagagaaaagtgacaacgaaaataaaccaccacgataaaatcaatgggaagaggaagaccgcccgaaaacagaaaatgtttcagagggcccaagagctccgacggagggcagaggactaccataaatgcaaaatccccccctccgccagaaaggcattatgcaattgggtccgaatggctgcggcagaacaccggcactcttcaggtttaccttactggccttatctgactgcagagacactgaagaatcgtatgggtcatcagccgcctccccctacacagcagcactcaataacagacaactcgctaagcctcaaaacacctccggagtgcctgttgacccctctgcctccatctgctgacgataatctgaagactccacccgagtgtgtcttgacccccttgccccccagtgccgacgataatctgaagacacctcctgagtgcgtgttaacgcccctcccacctagcgcggatgataacttaaaaacaccacctgaatgtctacttacacctctaccgccctcagcggacgacaatttgaaaactccaccagagtgtctcctgacacccttgcccccatccgcactgccatccgcccctcccagcgcagatgataatctgaagacaagggctgagtgtcttctgcatcctcttcctccgtctgccgatgacaaccttaaaacgccaagtgagcggcaactgactccactgcctccatccgcgcctccctctgccgacgacaatataaagacccccgcggagagactgagggggccactacctcctagcgctgacgacaacttgaagaccccatccgagagacagctgacccccctgcccccctcagctccgccgtccgccgacgacaacattaagaccccagcagaacggcttcggggtccgcttccaccaagtgctgacgacaaccttaagacaccaagtgagaggcaacttaccccacttcccccatctgcccccccatctgcagatgacaacattaaaacacctgctgagcgcctgagaggtcctctccccccgtcagcagacgacaacctgaaaaccccatccgagcggcaactgacaccactgcccccatccgccccccctagcgcagatgacaacattaaaactccggctgagcggctgagaggtccattaccaccctctgccgatgataatttgaagaccccgcctcttgcaacccaagaggccgaagccgaaaagccccgcaaaccgaagcgacagcgggccgctgaaatggagccaccgcccgagcctaaacgccggagagtgggagacgtcgagccctccaggaagcccaagaggcgcagagccgccgacgtcgagccttcctctccagagccaaagcgtagacgcgtcggggacgtggagccttcaagaaaacctaagcgacgcagggctgccgatgttgaaccaagctcacctgagcccaagcgtcgccgcgtaggcgacgtcgagccctcccgcaagcccaagagacgaagagctgctgatgtcgaaccgtcactgcccgaacctaagcgccgtagactgtcctag

SEQ ID NO: 45289 - DNA, 2547 bp, Artificial Sequence
  Description of Artificial Sequence: Synthetic coding sequence
atggtgaagctgagcatcgtgctgaccccccagttcctgagccacgaccagggtcagctgacgaaagagctgcagcaacacgtgaagagtgttacatgtccctgcgagtacttaagaaaggtgattaacacactcgccgatcaccatcaccggggaacagacttcggtggcagcccatggcttcacgtaatcatagcatttcccactagttataaggtggttatcacactgtggattgtgtacctctgggtgtctctccttaaaacaatcttttggtctagaaacggacacgacgggtcaaccgacgttcagcaaagggcgtggcggtccaatcggagaaggcaggaggggttgaggtccatctgtatgcatactaagaaaagggtgagttcgttcagaggcaataaaattggccttaaagatgtgatcaccctgcggcgccatgtcgagactaaagtgcgcgccaaaatcagaaagcgcaaagtgaccaccaaaattaaccatcacgataaaattaatggcaagcggaagaccgcaagaaagcagaaaatgtttcagcgggcacaggaacttaggaggagggctgaagattaccataagtgtaagatccctccctccgcacgtaaggccctctgtaactgggttcggatggcggctgctgaacatcggcattcatctgggctcccctattggccctacctgactgcagaaacactgaaaaatagaatgggccatcagcctccacccccaacccagcagcactccatcaccgacaattccctgtccttgaagacccctcccgagtgtctgctgacccccttacctccaagtgctgacgataatctaaaaacccccccagaatgcgtgctgacacctttaccgccttccgctgacgataatctaaaaacacctccagagtgccttttaacccctcttcctccttccgctctgccttcagcccctcctagcgcggatgacaacctgaaaactcgggccgaatgcctcttgcaccccctgcccccttccgctgatgacaacctgaagactccctccgaacggcagctcacacccctcccgccatccgccccaccgagcgctgacgacaacataaaaaccccagctttccaccctcaacggatgatcatcagtaggcacctccccagcgtatcctcactgcccttccacccacaactccacccacagcagatgataatctccaggcacttacccagtgtgtgcggtggcaggttccatccagaaaggatgattatatcgagacacttgccatctgttagcagtctgccgttccatcctcagctccatccacagcaaatgattatcagcaggcaccttccttctgtgtgcgggggtcggttccatccgcaacagatgataatcagccgacatttgccatccgtgtcttccctcccatttcaccctcaactgcatccgcagcagatgatcatctctcggcatctgccctccgtctgtggggggcgattccaccctcaacggatgatcatctctaggcaccttccttcagtgtctagcctgcccttccacccgcagctacacccccagcagatgattatctccagacatctacccagcgtgtgtggggggaggttccatccacagcaaatgataatctcccgccaccttcccagtgtaagttctctcccatttcacccccagctgcacccccagcagatgattatctcccgacacctgcccagcgtgtgcggcggcaggtttcacccgcaaagaatgattatctccaggcacttgccgtccgtgtcttccttaccatttcatccacaattgcacccccagcagatgatcattagccgccacctgccatcggtctgcggagaaaggttacgaggtccactaccgccctccgcagacgacaatctgaaaaccccgagtgaacgacagctaacaccgcttcccccttccgccccaccaagtgccgacgataatatcaaaactcccgctgaacgattacgcgggcccttaccgccatctgccgacgataacctgaaaacgccatcggaaagacagctgaccccgctgccgccttccgcccctccttccgctgatgataacatcaaaacaccggctgagcgactgcgagggcccctcccaccgagcgctgatgacaatctaaagaccccacctttggccacacaggaggctgaagctgaaaaaccaaggaagccgaaacggcaaagggcagcagagatggagcccccgcccgaaccgaagcgacggagggttggagatgtagaaccttcccgcaagcctaagcgtcgtagggctgctgatgtagagcctagctctccagaacctaagcgcaggagagtgggagacgtagaacctagcaggaaaccaaagcgccgtcgtgcagcagatgtggaaccaagtagcccagaaccaaaaaggagaagagttggagatgtcgagccctctcgtaagcccaagaggagacgggctgccgacgtggagccatccctcccagaaccaaagcgccggcgcctgtcttag

SEQ ID NO: 45290 - DNA, 3033 bp, Artificial Sequence
  Description of Artificial Sequence: Synthetic coding sequence
atgcacaccaagaagcgggtgagcagcttccggggcaacaagatcggactaaaagacgttatcaccctgcgtagacatgttgagactaaggtgagggcaaaaatcaggaagagaaaggttaccactaagataaaccaccacgacaagatcaacggcaaacggaaaacagcaaggaaacagaaaatgtttcaaagggctcaggaactacggcgccgtgccgaggattatcataagtgtaagattccaccctctgccaggaaggcgctgtgtaattgggttcggatggcagcagccgaacataggcatagctccggattgccatactggccatacttgacagccgagacactgaagaatcgcatgggccaccagccgcctcctcctacccagcagcattccattaccgataactctcttagcctgaagaccccaccagagtgtttactcactccactccctcccagtgccgacgataatttaaaaacgcctccagaatgtgtgttgactccactgcctccttccgcggacgataacctcaagactcccccggagtgcgtgctgaccccgcttcctcctagtgcggatgacaatctgaagaccccccccgaatgcctgctgacgccgctaccaccttctgctgatgacaatctaaaaacaccccccgagtgtctcctgacccccctgccaccctcagctctgcccagtgctccaccaagtgctgacgataacctgaaaacgagggctgaatgtctgctgcatcctctgccgccttccgcggacgacaatttgaaaactcccagcgagcgccagctcacccccctcccaccctcagcccctccctcagcggacgacaatataaaaacccccgcagagagattaagaggaccattacccccttctgcggatgataatctcaagaccccatctgagcgtcaattaacccctctgccaccttctgctcctccgagcgccgatgacaacattaaaacaccagccgagaggctccggggccctctaccacctagcgctgatgacaacctgaaaaccccttctgaacgccagctcacccctctgcccccatccgctcctccctctgccgatgacaacatcaagacaccggctgagcggctgagaggacctcttcctccatcagctgatgataacctgaaaacgccgtccgaacgccagctgactgccttgcccccatctgctgatgataatatcaagactcccgccgaacgtcttcgcggaccgctccctccttccgctgatgacaatctcaagacgccttcagagagacagcttacgcctctgcccccgtcagccccaccttctgcagacgacaatattaaaacacctgcatttcaccctcagagaatgatttccaggcatctcccctctgtctcgagcctgcccttccacccacagctgcatccccagcaaatgattatctcgcgctaccttctgtctgtatgcggttttcgcttccaccaccagcccatgataatcagccgccaccttcctagcgtgtcctctttgccttttcatccccagctccatccgcagcagatgattattagcagacacctgccctctgtttgtgggggacgatttcaccccgaacgcatgattattagtaggcacctgccaagcgtgtccagtctcccatttcatcctcaactgcatcctcagcaaatgatcatttcaaggcatctgcctagcgtgtgtggcggtaggtttcacccacagcagatgataataagtcgccacctaccaagtgtctcttccctaccatttcaccctcagttacatccgcagcagatgattataagtcggcatctaccctccgtatgtggtggcagatttcaccctcagagaatgattatttcacggcacctgcccagtgtgagttctctcccgttccatccccagctgcaccctcagcagatgattatatcccggcaccttccatctgtctgcggcgggcgcttccacccgcagcagatgattatctctcgtcacctgccaagcgtgtcatctttaccattccatccccaactacaccctcagcagatgattatctcacgccacctgcccagtgtgtgtggtccactgcccccctcggctgacgataatctcaaaacaccctccgagaggcagttaactccattcccaccctctgccccaccaagcgcagacgacaacattaagacccctgcagaacgcttgcgtgaacgattgcgggggcccctgccacctagcgcagatgacaatctgaaaacccccagcgaacgccagctcaccccccttcccccatctgctcctccaagcgcagatgacaacatcaaaacccccgcggaacgtcttaggggtcctctccctcctagtgccgatgataatttaaaaacgccttctgaacgacaacttacacccttgccgccctctgcccccccaagtgcagacgacaacattaaaacccctgcagagcggttgcgcgggcctctgcctccttctgccgacgacaacctcaaaaccccatccgagaggcaattgacgcctctccccccatccgcccctccgagcgctgacgacaatattaagacacctgccgaaagactgcgggggcccctgcccccttccgcagacgacaacctgaagacacccccattggctacccaggaggcagaagccgagaagccacgaaaacccaagcgtcagagagccgcggaaatggaaccaccccccgaaccgaaacggcgcagagtgggagacgttgaaccaagccggaagccaaagcgccggagggctgcggacgtcgagccaagttctcccgagccaaaacgtcgacgcgtcggagatgtcgaaccctctagaaaacctaagagacggagggcagctgatgtagagcccagttcccccgagcccaagagacgtcgtgtgggtgacgtggaaccatcccggaaacctaagagacgacgggcggcggatgtggaaccaagcctgcccgagcctaagcgaagaagactgagttag

SEQ ID NO: 45291 - DNA, 3402 bp, Artificial Sequence
  Description of Artificial Sequence: Synthetic coding sequence
atggtgaagctgagcatcgtgctgaccccccagttcctgagccacgatcaggggcaactaacaaaagagctccagcagcacgttaaaagtgtgacatgtccttgcgaatatctgagaaaagtgattaacacactggccgatcatcaccacagaggcactgattttgggggttccccttggctgcatgtaattatcgcctttcctacttcttataaggtggttattaccctctggattgtgtatctttgggtatcactgctcaagacgattttctggagtcgaaacggccatgatgggagcaccgatgttcagcagcgagcatggcggtctaatcggcgacggcaggaaggactgaggtcaatatgcatgcacactaagaaacgggtatcttctttccgcggaaacaagataggcctgaaggacgtgatcaccctgcgacgtcacgtggaaactaaggtccgggcaaaaattcgcaagcgtaaggtgacaacaaaaattaaccatcacgacaagataaatggcaaaaggaagacagcccgtaagcagaaaatgtttcagcgagcccaggagttgcgcaggcgagccgaagactatcataagtgtaagatccctccatctgcccgaaaggcgctttgcaattgggttcgcatggctgccgctgaacacagacattccagtggcttaccgtactggccttacttaaccgccgagaccctcaagaacaggatgggacaccagcccccccctccaacacaacagcatagcatcaccgacaactcgttgagtctgaagactccaccagagtgcctgctgactccccttccccccagcgcagatgacaacctgaagactccacctgaatgtgtcctgacacctctaccacctagtgctgacgataatctgaaaactcctccggagtgcgtgctaacgccccttccaccttcagccgatgataacttgaaaacccctcctgagtgccttttgacccccctaccaccttccgcagacgacaacctgaagacaccccccgagtgcctgctgactcccttgccacccagtgcccttccgtcagctccgccatcagctgacgataacctgaagacaagagctgagtgcctgctccatccacttcccccttctgcagacgacaacctgaaaaccccaagtgaaaggcagctcacgccactccccccttctgcgccaccttctgctgacgacaacattaagacacccgccgagcgactgcgaggtcctctccccccttctgcagatgataatttgaagaccccctcggagaggcaacttaccccactaccccctagtgcaccccccagcgccgatgacaatatcaaaactcctgctgaaagattaagaggccctctgcctccgagtgctgatgacaacctgaaaactccttccgagcggcaacttacgccgcttcctcctagtgctcccccgagcgcagatgacaatattaagacccctgcagagcgcttacgggggccattgcctccttccgcagacgacaatctgaagaccccctcagagaggcagttaacagctctgcctccgtcggctgacgataacattaaaactcctgcggagagactaagggggccattgcccccatcagcagatgataacctcaagactcccagcgagagacagttgaccccattgcctccctccgccccccccagcgctgatgataacataaaaacacctgcattccatccccagaggatgatctcgcgccatttgccgagcgtgtccagtctgccctttcacccgcagctccatcctcagcaaatgataatctcaaggtatcttctctctgtgtgtggcttccggttccatcatcagcccatgataatatccaggcacctgccctccgtgtcatctctacccttccacccacaactgcatccacagcaaatgatcatcagccgccatcttccctctgtgtgtggtggtaggtttcatcctgagaggatgatcatctcacgacacctgcctagtgtgagctcattgccgttccatcctcagctacaccctcagcagatgataatcagccgccatttgcccagcgtctgtggcggacggtttcatccccagcagatgatcatttcccgtcatctgccgtctgtgtcttccttgccattccacccacagttacatcctcagcaaatgattatcagtagacacctgccttccgtttgtgggggaagattccatccccagcggatgattatctcccggcatctccctagcgtcagttccctgccctttcaccctcagctgcacccgcagcaaatgatcatcagcagacacttaccatccgtgtgtggagggcgatttcacccacagcagatgattatttcccgacacctgcctagcgtgtcttcactgcccttccacccccagctccacccccagcaaatgataatttcccggcaccttccttcagtgtgcggtgggaggttccacccacagcggatgattatttctcgccatttgcctagcgtgagctccttgccctttcacccccagctgcatccacaacagatgataatctcccggcaccttccatctgtttgcggcgagcgtttaagaggccctctcccccctagtgctgacgataacctgaagaccccgagtgagcgccagttaactccattgcccccttctgctcctccctccgccgacgacaacatcaaaacccctgctgagaggctcagagggcccttacctcccagcgctgacgacaacttgaaaaccccttccgaaagacagctgactcccttaccaccctccgccccccccagtgccgatgacaatatcaaaacccctgctgagcgcttgcgcggccctctcccgcctagtgctgacgacaatctgaaaaccccgagcgaaagacaacttactcctctcccccctagtgcaccgccatcggctgatgataatataaagacgcccgccgaacggcttcgtggaccgttgcctccaagcgctgacgacaatctgaaaactccaccccttgccactcaggaggctgaggcggagaaaccacgaaagccaaagaggcagagggccgcagagatggaaccgcccccggaaccaaagaggcggagggtcggggacgtggaaccgtcgagaaaaccgaaacgacgaagggcagccgatgtcgaaccaagttccccagagccaaagagaaggcgggtgggggatgttgagccctcccgcaagcccaaacggcgtagggcggctgacgtggagcccagtagcccagagccaaagcggcggcgagtgggagacgttgagccctcgaggaaacctaaacggaggagggcagccgacgtcgagccgagcctgccagagccaaagcgtcgaaggttgtcgtag

SEQ ID NO: 45292 - DNA, 708 bp, Artificial Sequence
  Description of Artificial Sequence: Synthetic coding sequence
atgcccaagggccgggccggcagcctgcccaccaccagcatcggctggaggttccagctctggtttctaggactcacctgtcccgagcggcacctggctaggcggctgaagaacaatagcttctatccttttgtgcaacaggaacccaatgtctttgtattagagtactatctagatactctgtggaagggaatgctgctgtttatcataagcgtggtgttagtgtccttttcaagcctcagggaggtccaaaaacaggagacctgggtgttcttggtctatggtgtaggagtgggcctttggcttgtgatttcgagcctcccccgccggagactcgtgctgaatcacacccgaggagtgtaccatttcagcatccagggccggaccgtatgccaaggcccattgcacctagtgtatgtgagactcgcactctcctcagatgctcatggcagatgtttctttcacctcgtgctcggtggtcatcgccttgagcctcttgtgttggtgcagttgagtgagcactatgaacagatggaataccttggtaggtatattgcccgcaagctgaatatcaactattttgactacttagcaacgtcatatagacatgtggtgagacattggcctccccctggggcaggcacagtcatgggaaagtccccaatggggcacaagccatctagtagccagagctcactggaagtttag

SEQ ID NO: 45293 - DNA, 708 bp, Artificial Sequence
  Description of Artificial Sequence: Synthetic coding sequence
atgcccaagggccgggccggcagcctgcccaccaccagcatcggctggaggtttcagctctggtttctgggactgacatgtcctgagagacacctggctaggaggctgaagaataacagcttctatccctttgttcagcaggagcctaatgtgttcgtcctggaatactacctggacaccctctggaagggcatgctgctgttcattatctctgtcgtcctggtttccttctcaagtctgcgggaggtgcagaaacaggagacttgggtcttcctcgtatatggcgtcggcgtcgggttatggttggtaattagctccctaccaagaaggcgtctcgtcctgaaccacacaaggggggtctatcacttctctattcagggtaggaccgtgtgtcagggacccttacacctggtctatgtccgtttggccctatcaagcgacgctcatggccggtgcttctttcaccttgtcttgggcgggcataggctcgaaccactggtgctagttcagctgagcgagcactatgagcaaatggagtacctgggcaggtacatcgccagaaaactgaatattaactacttcgactatctggcaacgtcataccgccacgtggtccggcactggcccccacctggcgctggcacagtcatgggtaaatcgcccatggggcacaagcctagcagttctcagtcttcactggaggtgtag

SEQ ID NO: 45294 - DNA, 180 bp, Artificial Sequence
  Description of Artificial Sequence: Synthetic coding sequence
atgaccagcgtgagcacccagctgagcctggtgctgatgagcctgctcctcgtcctgcccgtggtggaggcagtggaggcaggtgacgcgatcgctctgctcctgggcgttgtgttaagcattacaggcatttgcgcctgcctgggcgtgtatgctcggaagaggaatggtcagatgtag

SEQ ID NO: 45295 - DNA, 180 bp, Artificial Sequence
  Description of Artificial Sequence: Synthetic coding sequence
atgaccagcgtgagcacccagctgagcctggtgctgatgagcctgttattggtactgccagtggttgaggctgttgaagcaggagacgccattgccctcttactcggggtcgtgttgtccatcactggcatctgcgcatgcctgggcgtttacgcccggaaacgcaacgggcagatgtag

SEQ ID NO: 45296 - DNA, 180 bp, Artificial Sequence
  Description of Artificial Sequence: Synthetic coding sequence
atgaccagcgtgagcacccagctgagcctggtgctgatgagcctgctcctggtgctgcctgtggtggaggctgtcgaagctggtgatgcaatcgccctgctcctgggcgtggtcctaagcattacaggcatttgcgcttgcctgggggtgtatgcccgcaagagaaatggccaaatgtag

SEQ ID NO: 45297 - DNA, 399 bp, Artificial Sequence
  Description of Artificial Sequence: Synthetic coding sequence
atgaccggcgagctggaggtgaagaacatggacatgaagcccggctctacactgaagatcaccgggtccattgcagacgggacagatgggtttgtgataaatctgggccagggcacagataaactcaatctgcactttaacccgagattttccgagtccacgatcgtgtgcaattccttggacggcagtaactggggacaggagcagcgggaagaccatctctgtttctcaccgggctcagaggttaagtttactgtaacatttgaatccgacaagttcaaggtgaagttgcccgatggacatgagctcaccttcccaaacagactcggccattctcacctgagctatctgtccgtgcggggggggtttaacatgtcttccttcaaactgaaggagtag

SEQ ID NO: 45298 - DNA, 240 bp, Artificial Sequence
  Description of Artificial Sequence: Synthetic coding sequence
atgttcgagtgcatcaccgagaacttcagcatcgaccccgcccggaccctcatggtaggcgaccgccttgagacggacatcttgtttgggcatcggtgcggcatgactacagttttgactctcactggtgtgtcccgattagaggaagcgcaagcttacttggctgctggacagcatgacttagtcccacattactacgtcgagagcatcgcggacttaacagaaggcctcgaagattag

SEQ ID NO: 45299 - DNA, 1296 bp, Artificial Sequence
  Description of Artificial Sequence: Synthetic coding sequence
atgcaggccctgaacatcacccccgagcagttcagccggctgctgcgggaccataatttaactagggaacaattcatagccctgtaccgcttaagaccactagtgtatacacccgaactgcccgggcgcgccaagctggcgttagtgttgactggagtgttgattttcgccctggcattattcggaaacgcactcgtcttctacgtcgttacacgtagcaaagccatgaggaccgtgaccaatatctttatctgtagccttgccctaagcgatttgctgattacttttttttgcatccccgtgacaatgctccagaatatctctgataattggcttggcggtgctttcatctgtaagatggtgccgttcgtgcaatcaacggccgtggtgacggagattctgaccatgacctgcattgccgtcgaaaggcaccagggcctggtgcatccttttaagatgaaatggcaatataccaaccggcgggctttcaccatgctgggcgtggtatggttggtggccgtgatcgtaggctcaccaatgtggcatgtgcagcaactggagattaagtatgacttcttgtatgagaaggagcatatttgctgcttggaggaatggacatccccagtgcatcagaaaatttataccacattcatccttgtcatcctgttcctgcttccccttatggtgatgctcatcttgtactctaagatcgggtacgaactttggataaagaagagggtgggtgatggttctgtattgcgcactatccacggtaaggaaatgtcaaaaatcgctcggaagaaaaagagggccgttattatgatggtgacggtggtggcgctctttgccgtttgctgggcccccttccatgtagtacacatgatgatcgaatattctaatttcgagaaggagtatgacgacgtcaccataaagatgatattcgccatcgtccagattatcggattttcaaacagcatatgtaaccccattgtgtacgccttcatgaacgagaacttcaagaaaaatgtgttaagcgctgtctgctattgcatcgtgaataagacattttcccccgcacaacgccacggcaattccggtatcacaatgatgcggaaaaaggctaagttctcacttcgcgagaacccggtggaggagacaaagggcgaagcattctcagacggtaacatagaggtgaagttgtgtgagcagaccgaagaaaaaaaaaagctgaagaggcacctggctctgtttcgcagtgagctggctgagaattccccactggattctggccactag

SEQ ID NO: 45300 - DNA, 825 bp, Artificial Sequence
  Description of Artificial Sequence: Synthetic coding sequence
atggccgccagctggcggctgggctgcgacccccggctgctgcggtaccttgtcgggttcccagggagacgctcggttggcctcgtgaagggcgccctaggatggtccgtcagtaggggggccaactggcggtggttccatagcacccagtggttgcgcggggacccaattaagatcttgatgccatccctaagcccaaccatggaggaaggcaatatcgtcaagtggttgaagaaggaaggcgaagcggtgtccgccggcgacgccctatgcgagattgaaactgacaaggcggtggtgactctggatgcttccgatgacggtatcctggctaagatagtgcagatgcctgacgttaatgtatcttgggatggtgagggccccaagcagctgcctttcatagatattagtgtggcagtggctactgacaaaggtctgttaacacctattatcaaggacgcggctgctaagggaatccaggagattgctgacagcgtgaaggcgctgagcaagaaggcacgggacgggaagctgctgcccgaggagtaccaaggtgggtcctttagcatcagcaatttaggcatgttcggaattgatgagtttaccgcagttattaacccaccccaggcttgtatcttggcagtcggaaggtttagacctgtcttgaagctgacggaagacgaagaagggaatgctaaacttcagcagcgccagctgattacagttacgatgtcctccgattccagagtggtcgatgacgagctggccacacgcttcctaaagtcgttcaaggccaacttagaaaatcctattcgactggcatag

SEQ ID NO: 45301 - DNA, 1857 bp, Artificial Sequence
  Description of Artificial Sequence: Synthetic coding sequence
atgcacaagaccgccagccagcggctgttccccggccccagctaccagaatattaagtctataatggaggacagtactatcctgtccgactggacaaactctaacaagcagaagatgaaatatgacttctcttgtgagctgtacaggatgagcacctactcaacattccccgcaggcgtgcctgtgtcggaaaggtctctcgccagagccggcttttactataccggtgtaaacgataaagtgaagtgtttctgctgcgggctgatgttggataactggaagctcggcgactctcccattcagaagcacaagcagctgtacccctcctgctcatttatccaaaaccttgtgtctgcgtcactgggctcgacctcgaaaaataccagtcccatgcgtaactcgttcgcccactcactatctcctactttggagcatagctcccttttttccggtagttactcctcactgagccccaatccgctcaattctcgggctgtggaggacatcagcagctcccgcaccaacccgtactcttacgcaatgagcacagaggaggcaagatttctgacgtatcatatgtggcctttgactttcttaagccctagcgagctggcacgggcaggcttttactatattggtccaggggacagggttgcgtgctttgcttgtggagggaagctgtctaactgggagccaaaggacgacgcgatgagtgagcatcggcgccacttccctaactgcccctttctcgagaatagtttagaaactctgaggtttagtataagcaatctctcaatgcagactcacgctgccagaatgaggacatttatgtattggccctccagtgtaccagtacagccggagcagcttgcatccgccggattttattatgtgggtcggaatgacgacgtgaagtgcttctgttgcgacggcggactgcgatgctgggagtccggggacgatccctgggtcgagcacgccaaatggttcccccgatgtgagttcctgattcggatgaagggccaggagttcgtggacgagatccagggccggtacccccatctgctcgaacagcttctttcgacttccgacacgaccggggaggaaaatgccgatccccccatcattcactttggccccggagaatcctccagcgaagatgccgtcatgatgaacacacccgtcgttaagagcgcgttggagatgggtttcaatcgtgacctggtgaaacaaactgtgcagagtaagatcttaacaaccggagaaaactataaaactgtcaatgacatcgtgagtgccctactgaatgctgaggacgaaaagcgcgaagaagaaaaggaaaagcaggcagaggagatggcctctgatgacctgtcgctgattcggaaaaatcgcatggctctgttccagcaactgacctgcgtgctgccgatactggataaccttctcaaggctaatgtgataaacaaacaggagcacgacatcatcaaacagaagacccagattccactgcaggcccgagaacttattgacacgatcctcgtgaagggcaatgccgctgccaacatttttaagaactgtctgaaagagatcgacagcaccctctacaaaaacttatttgtggataagaacatgaaatatattccaactgaggacgtgtctggtctgtcactggaagagcagctcagacggctgcaggaggagaggacctgtaaagtctgcatggataaggaggtttcagtcgtctttatcccctgtggccacctggtggtgtgccaggaatgcgctccatctctgagaaagtgcccaatctgcagaggaataattaaagggaccgtgagaacttttctgtcttag

SEQ ID NO: 45302 - DNA, 1461 bp, Artificial Sequence
  Description of Artificial Sequence: Synthetic coding sequence
atgcagagcggcggcgccgagggcagccccggcgccggccggaccgggcgcggaccagggagcgggaaggcgccacccgcggagatttccagcggagctcctgactttcccggaggcgatccaatcaaaatcttgatgccatctctgtcgcctaccatggaagaagggaacattgtgaaatggttgaagaaggagggagaggctgtatcagccggcgatgcactttgcgagattgagactgacaaggccgttgttaccctggatgcaagtgacgacggcattttagcaaaaatagtcgtggaagaaggttccaaaaatatccgtctgggctcgcttataggcctcattgtggaagagggcgaggactggaagcacgtggagatccccaaagacgtggggccaccaccccccgtgtccaagcccagcgaaccaagaccctcccctgaaccccagatcagcatcccggttaagaaagagcacataccaggaaccctcaggtttagactcagtccggcggccagaaacattttagaaaaacattctcttgacgcgagtcagggcaccgctacagggccaagaggaatttttacaaaggaagacgcccttaaattggtgcagctcaagcagacaggtaaaatcactgagagccgtccgactcccgcacctacagcaacacccacggcaccatccccactgcaggcaactgcaggaccaagctatccgcggccagtgatccctcccgtgagcacgcccggccaaccaaatgctgttggtacatttactgagattccggcttccaatatccgccgagtcattgcaaaaagattaactgaaagcaagagcacggtaccacatgcctatgctacggccgactgcgacctcggagccgttttaaaagtgcggcaggatctagtcaaggatgatatcaaggtctcagtcaatgacttcattatcaaagccgccgctgtaactctgaagcagatgccagatgtgaacgtgtcctgggacggagagggccccaaacagcttccctttattgatatctccgttgcagtagcaactgacaaagggctgctcacacctatcataaaagatgctgccgccaagggaattcaggagattgctgactcagtgaaggcgcttagtaagaaggcccgtgacggaaagctccttccggaagagtatcagggggggagtttctctattagcaacctggggatgttcggtattgacgaattcaccgctgtgataaacccccctcaggcgtgcatattggcagtaggtagatttaggccagtactcaaactcaccgaagatgaagaaggaaacgctaagctgcagcaacgtcagcttattacagtcacgatgtctagcgatagtcgggttgtagacgacgagctggccacacgtttcctcaaatcgtttaaagctaacctggagaatcctattagattggcatag

SEQ ID NO: 45303 - DNA, 1221 bp, Artificial Sequence
  Description of Artificial Sequence: Synthetic coding sequence
atgcggctgttccggtggctgctgaagcagcccgtgcccaagcagatcgagagatattccaggttctccccaagcccactatctatcaaacagttcctcgatttcggcagggataacgcgtgtgaaaagacctcctacatgttcctgagaaaggagctcccagtacgcctggccaatactatgagagaggtgaacctgctgcctgataatttgctgaatcgaccctctgtgggactggtgcagagctggtacatgcagtcctttctggagctcctggagtatgaaaacaagtcccctgaggacccacaggtactggataattttctccaggtgttgatcaaggttaggaaccgccataatgacgtggtgcccaccatggcccagggagtgatcgaatacaaagagaagttcggctttgatccttttatttccactaacatccagtacttcctggatcgtttttacaccaaccgaatcagcttccgtatgctgataaaccagcacactcttctgtttggcggggacacgaaccctgtgcaccccaagcacatcggcagcatcgatccaacatgcaacgtggcagacgtggtgaaggatgcctatgagaccgctaagatgctatgtgagcagtattatttagttgctccggaactggaggtggaggagttcaacgctaaggcccctgataagcccattcaggtcgtgtatgttcctagtcacctgtttcatatgctgttcgagctgttcaagaattcaatgagagctacggtggagctgtacgaagatcggaaggaggggtaccctgcagtaaagaccctggtaacactgggtaaggaggacctttctattaagatctctgacctgggaggcggagtgccgctcaggaaaattgatcgactgtttaactacatgtactccactgcacctcgtcctagcttagagccgactcgcgccgcgcctctagccgggttcggttacgggctgccaatttccaggttatatgccaggtacttccagggcgatctcaagttgtactctatggagggagtggggacagatgccgtcatctatctgaaggcattaagctccgagagttttgaaaggctgcccgtattcaacaagtcagcttggagacactataaaacaacgcctgaagccgacgattggagcaatccctctagcgaacccagggatgcatccaagtataaagcaaagcagtag

SEQ ID NO: 45304 - DNA, 1248 bp, Artificial Sequence
  Description of Artificial Sequence: Synthetic coding sequence
atgcggctgttccggtggctgctgaagcagcccgtgcccaagcagatcgagcgatatagccggttcagcccaagcccgctgagtattaaacagttccttgacttcggccgtgacaatgcatgtgaaaagactagttatatgttcctgcgtaaagaattgccagttagactggctaacacgatgcgagaagtgaatctcctgccggacaacctgttgaatcgtccttccgtgggattggttcaatcatggtacatgcagtctttcttggaactgcttgaatacgaaaataagtcacctgaagacccccaggtgctggataacttcctccaggtcttgattaaggtgaggaaccgacacaacgatgtggtacctaccatggctcagggggtgattgaatacaaggaaaaatttggattcgacccgtttatatcgactaatattcagtacttcttagaccggttttacaccaatcgtatctcatttcggatgttgatcaaccagcatactctgctgttcggaggggacaccaaccctgttcatccgaaacacatcggtagtattgatcctacgtgcaacgtggccgatgttgtcaaggacgcatatgaaaccgcaaaaatgctgtgtgaacagtattacctggtggctccagaactggaggtggaggaatttaacgctaaagctcctgacaagcctatccaggtggtttacgtcccctcacatttgttccatatgttgttcgaattgttcaaaaacagcatgcgggccacggtcgagctctacgaggaccgtaaagagggttaccccgcagttaagacattagtgacattgggcaaagaagacctgtccatcaagattagcgatctgggaggcggcgtccccctcaggaagatcgaccggctgtttaactacatgtactccacagccccaaggccatcacttgagccaactcgcgcagcgccactggcgggtttcggctacgggctgcctatcagtcgcctctacgcacgctactttcagggcgaccttaaactatatagcatggaaggcgtaggaaccgatgccgtgatctaccttaaggccctgtcttccgagtccttcgagcgcctgccagtgtttaataagtctgcttggaggcactataaaactacccctgaggcggacgactggtcaaacccgtctagtgagccgcgagacgctagcaagtacaaagctaagcaggacaaaattaagacaaaccggacattctag

SEQ ID NO: 45305 - DNA, 1590 bp, Artificial Sequence
  Description of Artificial Sequence: Synthetic coding sequence
atgagcagcaccgtgagctactggatcctgaacagcacccggaactcaattgccaccctccagggaggccgcaggctgtattctaggtacgtcagcaaccgaaataagcttaaatggcgtctcttctcccgggtcccacctacgttaaacagttcaccatgtggtggtttcaccctgtgtaaggcttaccgccatacaagcacggaggaggacgacttccacctgcagttgtcccccgagcaaatcaacgaggtgctgcgggccggcgagaccacgcacaagatacttgacctggagagtcgggtcccaaactctgtccttcgttttgagtccaaccagctggcagctaattctccagtggaggatcgcagaggcgtcgcgtcctgtctgcagaccaatggccttatgtttggcatttttgatggacacggtggtcacgcttgtgcccaggcagtgtctgagcgtctgttttactatgtggcggtgtccctgatgtcacatcagacactggagcacatggaaggcgctatggaatctatgaaaccacttctcccaatacttcattggctaaagcatcctggcgatagtatctacaaagacgttacttcagttcacctggatcaccttagagtgtattggcaggagctgctagatctccacatggagatgggactcagcattgaggaggctctcatgtactctttccagagactcgattccgacattagcctcgagatccaagcaccactggaggacgaggtcacccgcaatctgtcgctccaggttgctttttccggcgccacagcctgcatggcccacgtggatgggattcacctgcatgttgcaaacgcaggcgactgcagagccatcctgggtgtccaggaggacaatgggatgtggtcttgtctgcctctgacacgggaccataacgcttggaatcaggccgagctgagcaggctaaagagggaacatcccgaatctgaggatcgaaccattattatggaggacagactgctaggagtgctgattccatgcagggcctttggcgatgttcaactgaagtggtccaaggaactccagagatccatactcgagcggggattcaataccgaggcacttaatatttaccagtttacacctcctcactactacacccccccgtacctcaccgctgagccagaagtgacatatcatcggctgagaccccaggacaagtttcttgtgctggcatcagatggcttatgggatatgctcagtaatgaggacgtagtgcgcctggtggtgggccacttggctgaagcggactggcataagacagacctggcccagcggcccgccaacctggggctcatgcaatccttgttactccagcgcaaagcttccggactgcatgaggcagatcagaatgcggccactcgactcattcgccatgcaatcggtaacaatgagtatggggagatggaggctgaacgcctcgcagcgatgctgacacttcctgaggacttggccagaatgtatcgtgatgacatcactgtcaccgtggtttatttcaattcggaatccatcggggcatattacaaaggcggttag

SEQ ID NO: 45306 - DNA, 978 bp, Artificial Sequence
  Description of Artificial Sequence: Synthetic coding sequence
atggtgggcgagatggagaccaaggagaagcccaagcccacccccgattacctgatgcagctcatgaacgataagaaactaatgagctcgctccccaatttttgcgggattttcaatcaccttgaaaggcttttagacgaggagatttccagggtgcgcaaggatatgtacaacgacaccctgaatgggtccaccgaaaaaagatcagccgaactgcctgacgcggtaggccctattgtccaactacaggagaaactgtacgtccccgtgaaggagtacccagacttcaattttgtcggcaggatactgggacccagaggactaacggcaaagcagttagaagccgaaactgggtgcaaaatcatggtgcgaggaaaaggtagcatgcgagataaaaagaaggaagagcagaatcgcgggaagccaaactgggagcatttaaacgaggacctccatgtcctgatcactgtcgaagacgcacagaaccgggccgagattaagctcaagagggctgtcgaggaagtgaaaaaactgctggtacctgccgcagagggcgaggatagcttgaagaaaatgcaactgatggagttagcaatcctgaacggcacataccgagacgcaaatattaagtccccagctttagctttttcattggctgcgactgcacaggccgccccccgcatcataacgggccctgcccctgttctcccgcctgccgctctgcgaacacctacgcctgctggccccaccatcatgcccctgattaggcagatccagaccgccgtgatgccaaacggcaccccacaccctactgcggcaatcgttccacctggcccagaggccggtctgatttacactccatatgaatatccatacacacttgcccccgccacatctatcctcgaatatcctatcgaaccctcgggcgtcctggagtggattgaaatgcctgtgatgcctgacatctcagcgcattag

SEQ ID NO: 45307 - DNA, 1002 bp, Artificial Sequence
  Description of Artificial Sequence: Synthetic coding sequence
atggtgggcgagatggagaccaaggagaagcccaagcccacccccgattacttgatgcagctgatgaatgacaagaagctgatgtcttctctcccgaacttttgtggaatcttcaaccaccttgagagacttttggacgaggagatcagcagggtgcgtaaggacatgtataacgacactctcaatggcagcaccgaaaaaagatccgccgagctgccagacgccgtggggcccatagtacagttacaagaaaaattatatgtgccagtcaaagagtatcccgacttcaactttgtgggtcggattctcgggccacgaggactaaccgctaaacagctggaggcggagacaggatgcaagataatggtgcggggcaagggctccatgcgggataagaagaaggaggagcagaaccggggaaagcccaattgggaacacctcaatgaggacctgcacgtgcttatcactgtggaagacgctcagaatagagccgaaattaagctgaagagggccgtcgaggaggtgaagaaactcttagtgcctgccgcagaaggcgaggattctttgaaaaagatgcaattaatggaactggccatactcaacgggacctaccgagacgccaatataaagtcacctactgctcaggccgcccccaggatcatcacggggcctgcgcctgtcctgccgcctgctgccctccgaacgcccacccctgcagggcccactattatgcctctgatccgccagatccagactgccgtgatgcctaatggcacccctcatcccaccgccgccatcgtcccccctggccctgaggccgggctgatatacaccccatacgagtacccctataccctggctcctgctacgtccatcctggaatatccaattgaaccatctggcgttcttggcgccgttgctactaaagtacgtcggcatgatatgagagtccacccttatcagagaatcgtaacggcagatcgggcagctaccggaaattag

SEQ ID NO: 45308 - DNA, 1026 bp, Artificial Sequence
  Description of Artificial Sequence: Synthetic coding sequence
atggtgggcgagatggagaccaaggagaagcccaagcccacccccgattatctgatgcagctgatgaacgacaaaaaattgatgtcttctctgccaaatttctgtggcattttcaatcatttggagaggctgctcgatgaagaaatttccagggtgcgcaaggacatgtataacgataccctcaacggctccacggagaagcgctccgccgaattgcccgacgctgtcggcccaatcgtccaactgcaagaaaagttgtacgttcctgtgaaggagtatcctgattttaacttcgtggggaggatcctcggccctcgcggccttaccgccaagcagcttgaggcagagaccgggtgcaaaatcatggtgcgcgggaagggatccatgagggacaaaaaaaaagaggagcagaaccgcggcaaaccaaattgggagcacctcaacgaagatctgcatgtgctgataacagtggaggatgcccagaacagagctgagattaaactgaaaagggctgtggaggaggtgaaaaaacttctcgtgccagcggccgaaggggaagacagcctgaagaaaatgcaactgatggagctggcgattctgaacggaacctaccgagatgctaatattaagagccctgccctggcttttagcctcgccgccactgcccaggctgctccgcggatcatcacagggcccgctccagttctgccccccgccgcactccgcaccccaacccctgccggacccactattatgccactgatccgacagatccagaccgctgtgatgcctaatggcacgccacatcctactgctgccattgtcccaccagggcccgaggctggattgatttacactccatatgaatacccctacacattggctccggctacctccattctcgagtacccaatagagcccagcggcgtattgggcgccgtggccacgaaagtccggcgccacgatatgagggtgcatccctatcagagaatagtgactgccgaccgcgctgcgactggcaattag

SEQ ID NO: 45309 - DNA, 960 bp, Artificial Sequence
  Description of Artificial Sequence: Synthetic coding sequence
atggtgggcgagatggagaccaaggagaagcccaagcccacccccgattatctgatgcagctgatgaatgacaagaaactgatgagcagtttgcccaacttctgtggtatctttaatcaccttgaacgcctgctggacgaagagatctctcgggtgagaaaggacatgtataatgatacactcaatggctccacagagaagcgcagcgccgagctccctgatgccgtgggcccaattgttcagttgcaagaaaaactctatgtgcccgtgaaggagtatcctgacttcaactttgtggggcgaatccttggacctcgcggcctgactgcaaagcagctcgaggcggagactggatgcaagataatggtgagggggaaaggctcaatgcgagataaaaagaaggaagagcagaatagggggaagccaaattgggagcacctgaacgaagacctgcacgtgttgattacagtagaggatgcccagaatagagcagagatcaagctgaaaagggcagtcgaagaggtcaagaagttgttagtgccagctgctgagggggaggacagcctcaagaagatgcagctgatggagttagccatcctgaatggcacttaccgtgacgctaacatcaaaagccctgctctggcatttagcctagcagccaccgctcaggctgccccgagaataataaccggtcccgccccggtgctcccccccgctgccctccggaccccgacaccggcaggacctacgattatgccccttatcaggcaaattcagacggccgtcatgcctaacggaaccccccatccaaccgctgccatcgttccccctgggccagaagctggcctaatctatactccctatgagtatccctacacactggcccctgcaacatcgatactggagtacccaatcgagccctctggggtgctcggcaagtttttctctccatggggctag

SEQ ID NO: 45310 - DNA, 960 bp, Artificial Sequence
  Description of Artificial Sequence: Synthetic coding sequence
atggtgggcgagatggagaccaaggagaagcccaagcccacccccgattacttgatgcaactcatgaacgataagaagctgatgtctagcttacccaacttctgtggtatatttaaccacctcgagaggcttctggacgaggagatctctcgggttaggaaggacatgtacaacgacaccctgaacgggtcgacagaaaaaagatcagctgagctcccagatgccgtgggcccaatcgtgcagctgcaggaaaagctatacgtaccagttaaggagtacccagacttcaacttcgtgggccgcatcttgggccctcggggtctgaccgccaagcagctggaagccgaaaccggatgcaaaattatggtgagaggaaagggctccatgcgcgataagaagaaggaggagcagaatcggggtaagccgaattgggagcacttaaatgaggatctgcacgtgttgatcacagtggaagacgctcagaaccgggccgagatcaagcttaagagggccgtggaggaggtgaagaagctgctggtgcccgccgccgagggggaggacagtctgaagaaaatgcagctgatggagcttgcaattctgaatggtacttacagggacgctaacattaagtcccccgctctggccttcagtcttgccgcaaccgctcaggcagcacctcgtatcattacgggaccagcccctgtcctgccgccagccgccctgagaacacccaccccagccgggcctactattatgcccttgatccgccagattcagaccgcagtgatgcccaatggcacaccgcacccaaccgctgctatcgtgcctcctggccccgaagctgggctgatctatacgccttacgagtacccatacacactggcaccagcaacatcaattcttgaatatcccatagaacctagtggagtgctagggatggccttcccgactaaggggtag

SEQ ID NO: 45311 - DNA, 1137 bp, Artificial Sequence
  Description of Artificial Sequence: Synthetic coding sequence
atggtggactacagcgtgtgggaccacatcgaggtgagcgacgacgaggatgaaacgcacccaaatatcgacactgccagcttattcaggtggcgacaccaggcacgggttgaacggatggaacagtttcagaaggaaaaagaggagctggatagaggctgtcgtgagtgcaagcggaaagtggccgaatgccagcgtaagctgaaggaactcgaggtggccgagggcggcaaggctgaacttgaacgcttacaggccgaggcccagcagttacgtaaggaagagcgaagttgggaacagaagcttgaggagatgcggaagaaggagaaatccatgccctggaatgtggatacactttcaaaggacgggttcagcaagtccatggtcaacacaaagcccgagaaaacggaggaggactctgaagaagtgcgagaacagaagcataaaactttcgtcgaaaaatatgaaaagcagattaagcactttggcatgctccggagatgggatgatagtcagaaatacttaagcgataacgtccatctggtgtgcgaggagacggccaattatttggtgatctggtgtattgatcttgaggtggaggagaagtgtgctctgatggaacaggtggcccaccagaccatcgtcatgcagtttattttagaactggctaaaagtctgaaagtggacccgcgtgcctgttttagacagttttttacaaaaattaaaacagccgacagacaatacatggagggatttaatgatgagctcgaggcattcaaggaacgggtgaggggacgggcaaaactcagaattgagaaggccatgaaagagtacgaagaggaggaacgtaaaaagaggctggggcccggggggctggatcctgtggaggtgtacgagtccctgcccgaggagctgcagaagtgcttcgacgtgaaagacgtgcaaatgttgcaggacgccatttccaaaatggaccctacagacgctaagtaccatatgcagcggtgtattgactctggactgtgggtacctaactcaaaagcgagcgaggcaaaggaaggcgaggaagccggcccaggtgaccctctcttagaagctgtccccaaaaccggcgacgagaaggacgtttcagtgtag

SEQ ID NO: 45312 - DNA, 1962 bp, Artificial Sequence
  Description of Artificial Sequence: Synthetic coding sequence
atggccctggtgcggggcgccgagcccgccgccggccccagccggtggcttcccacacatgtgcaagtcaccgtcttgagggcccgagggctcagaggcaaatcatccggagccggatctaccagcgacgcttataccgtcatccaggtcggcagagagaaatattcgacaagcgtggttgagaagacacacgggtgccccgagtggagagaagaatgctccttcgaattgccacctggagcccttgacggtcttcttagagctcaagaagccgacgcagggccagccccttgggcagctagcagcgcagctgcgtgcgagctcgtcctgactacaatgcatcgttcactaatcggcgtagataaatttctgggccaagccaccgtggctctcgatgaggtttttggagctggaagggcacagcatacccaatggtataaactgcatagtaaacctggcaaaaaagagaaagaacgcggtgagatcgaagttacaatccagtttacacgcaacaatctctcagcttctatgttcgatttgagtatgaaggacaagcctaggtcacctttctctaagatccgtgataaaatgaaagggaagaagaagtatgatctcgagagtgccagcgctatattgccttccagcgcgatagaggatcccgaccttggtagcctagggaagatgggaaaggcaaaagggtttttcctaaggaataaattgcgaaagagtagcctgacccagtcaaacacgtctctaggttctgacagtactttgagctcggccagcggctccctcgcatatcagggcccaggggccgagctgttaactagaagccctagtcgatcaagctggctgtccactgaggggggccgggatagcgcccaatcgccaaaactcttcactcacaagcggacatacagcgacgaagcaaaccagatgagagttgccccgccgagagcactgcttgatctccaaggccatttagatgcggcctcaaggagcagcttgtgcgttaacgggtcacatatatacaacgaagagccacagggccctgtgcggcacagatcatctatttcgggctccctgccttcgtccgggtccttacaggcagtctcttccaggttttccgaagaaggtcctcgttccaccgacgatacgtggcccagggggtctcgaagtaacagctcctccgaggccgttttaggacaagaggaattatcggcgcaggccaaggtcctggcccctggcgccagtcaccctggcgaagaagaaggtgctaggctgccagagggaaagcccgttcaggtcgcgacacctatagtggcatcttccgaggcagtggcagagaaagagggggcgcgcaaagaggagcgcaagcctcggatgggtctattccaccatcaccaccaaggtctctctcgatccgagctaggtaggcgcagcagtcttggagagaagggtggtccaattttgggggcctcaccacaccattcaagcagcggggaagagaaagcaaaatcttcttggttcggcctgcgcgaggctaaagatcccactcagaaaccctccccccaccctgtgaagcctctgtccgcagcacccgtcgaaggatccccggacaggaaacagagcagaagttcactgtctatagccctgtctagtggacttgagaagctgaaaactgtgactagtggatccatacaaccggtgacccaggctcctcaagccgggcagatggtcgatacaaaacgtctgaaggattcagccgttctggaccagagcgctaaatattaccacctcacacatgacgagctgattagtctcctgcttcagcgagagagggagctttcacagcgggatgaacacgttcaagaactggagtcctatattgatcggttactggtgagaattatggagacttctccaaccctgttacagataccacccggtcctcccaagtag

SEQ ID NO: 45313 - DNA, 657 bp, Artificial Sequence
  Description of Artificial Sequence: Synthetic coding sequence
atgggcacccgggacgacgagtacgactacctgttcaaggtggtgctgatcggcgactctggcgtgggaaagtcgaatctgctatccagattcactagaaatgagttcaatctggagagtaagtctaccatcggcgtagagtttgcaacaaggtccattcaggtggacggcaagacaatcaaggcccagatctgggacaccgccggccaggagagatatcgggcaatcacctcagcctactatcggggagcagtgggtgctttgctcgtttatgatattgcaaagcaccttacgtacgagaacgtggagagatggttgaaggagctgagagaccatgcagactccaacatcgtgataatgttggtgggcaataagtcagacctccgccacctcagagcagtgcctactgacgaagctcgagcattcgccgaaaaaaataatcttagttttatcgagacgtcagcactcgacagcacgaacgtagaagaggcttttaagaatattctgactgaaatttatagaatagtttcacaaaagcagattgccgaccgcgccgctcacgacgaatctccgggcaataatgtggtggacatctctgtacctcctaccaccgacggtcaaaaaccgaacaagttgcagtgttgtcaaaatctctag

SEQ ID NO: 45314 - DNA, 627 bp, Artificial Sequence
  Description of Artificial Sequence: Synthetic coding sequence
atggccaagcagtacgacgtgctgttccggctgctgctgatcggcgacagtggtgtggggaagacatgccttctgtgtcgctttaccgataatgagttccactccagccacattagcactatcggggtagatttcaaaatgaaaaccatcgaagtggacggcatcaaagttcgcattcagatttgggatactgccgggcaggagcggtaccagaccattaccaaacagtactatcgacgtgcgcagggcatattcttagtctacgacatcagcagcgagcgcagttaccagcacatcatgaagtgggtgtcggacgtggatgaagtgggcgatgcgacttctctgcccgggtgcggagagggggcttcgccaggaaaagcaagacgaggccccgatgggaaagccaatgcctcaagaaaattgtgtttgccccagccatggatgaaaacaagtggcacgcaccagaaagccagccgccgttcactcctcgggatccgtcttatgcggtccaggaatgggcggtgggaggaaagcaaggggtcatcgtggaggcgcagcatggcatggacatctatgaagcaggtgccagcccctaccagtactcttaagagtcatagcagggtttag

SEQ ID NO: 45315 - DNA, 639 bp, Artificial Sequence
  Description of Artificial Sequence: Synthetic coding sequence
atggccaagcagtacgacgtgctgttccggctgctgctgatcggcgactcgggagtcggcaagacctgcctcttgtgtaggtttacagataacgagttccactcatctcatatcagcactattggagttgacttcaaaatgaagactatcgaagtagacgggatcaaggtgcgcatacaaatctgggatacagcaggccaagagagataccaaacaatcacaaaacagtattatcgacgggcacaaggcatttttcttgtgtatgacatctcctccgaacgaagctaccagcatatcatgaaatgggtcagtgatgttgacgagtacgcgcctgagggagtgcagaagatcctcattgggaacaaggccgatgaagagcagaaaaggcaggtgggacgtgagcagggacaacagctcgccaaggagtatgggatggacttctatgaaaccagtgcttgtaccaacctgaacatcaaggaaagtttcactcgcctgacggagctggtcctacaggctcatcgcaaagaattggaagggcttcgcatgcgagcttcaaatgaactcgcactcgctgaactcgaggaagaggaggggaagcctgaggggccagctaactcttcaaaaacatgttggtgctag

SEQ ID NO: 45316 - DNA, 795 bp, Artificial Sequence
  Description of Artificial Sequence: Synthetic coding sequence
atgcacttcagcagcagcgcccgggccgccgacgagaacttcgactatctgtttaaaattattcttatcggtgattccaacgtcggcaaaacgtgcgtggtacagcactttaaatctggcgtgtacactgagactcagcagaatactataggtgtggacttcactgtgcgatctctggatatagatgggaaaaaagttaagaattcttctgctagcatcattacatttgccagtattcagattcacggacagacacagaaaatgtctccacaaatctggacaaaaagctcccattacctgtgggagccactgatctggactttactgcctgtgctcctgcagatgcaagtttgggataccgctgggcaggaacgatttaggaccataacacaaagctactataggtcagcgcacgcggccattatcgcctacgatctcacccgccgaagtaccttcgagtccattcctcactggattcatgagattgaaaaatacggggcagctaacgtagttattatgctcatcggcaacaagtgtgatctgtgggagaagcgccacgtgctctttgaggacgcctgcactctcgccgagaaatatgggcttttggccgtcttggagacatctgccaaagagagcaagaacatcgaggaggtgtttgtgctgatggctaaggagctgatcgcgcgcaattccctgcatttatatggagagagtgccctgaacggcctcccactggatagctctcccgtgctcatggcccaaggaccttccgaaaagacccattgtacttgttag

SEQ ID NO: 45317 - DNA, 654 bp, Artificial Sequence
  Description of Artificial Sequence: Synthetic coding sequence
atgcacttcagcagcagcgcccgggccgccgacgagaacttcgactacctatttaagatcatactgataggcgattctaacgtagggaagacctgtgtggttcaacatttcaaatccggcgtgtatacagagacgcagcaaaacacgatcggggtagattttacagttcggtctctggatatcgatggcaagaaagttaaaatgcaggtgtgggacacagctggacaagagcggtttagaacgatcactcagagctactaccgatccgctcacgcggctattatagcttacgacttaacgagaagatccacgttcgaaagcatcccacattggatacatgaaatcgagaagtacggggccgcaaacgtggtcatcatgttaattgggaacaagtgcgatttgtgggagaagcgccatgtgttgtttgaggacgcttgcaccctggctgaaaaatatggattgctggctgtcctcgagacttctgctaaagagtcgaaaaacatcgaggaggtcttcgttctcatggcaaaggaactcatcgcacggaacagcttacacctctatggtgagagcgctctgaacggcttgccgctcgatagttctccagtgctaatggctcaaggaccttccgagaaaacccactgcacatgttag

SEQ ID NO: 45318 - DNA, 450 bp, Artificial Sequence
  Description of Artificial Sequence: Synthetic coding sequence
atgcacttcagcagcagcgcccgggccgccgacgagaacttcgactacctgttcaagatcatcttgatcggagactccaatgtggggaagacctgcgtcgttcagcatttcaaaagcggcgtctacaccgagacacagcaaaacacaatcggcgtcgacttcacagtaaggtctttggatatcgacggaaaaaaggtgaaaatgcaggtgtgggatactgccgggcaggagaggttccgtacaatcactcagagttactacagaagcgctcacgctgcgattatagcgtacgacttaactcggcgatccacctttgaatcaattccccactggattcacgaaattgagaaatacggggctgccaatgtagtgataatgttgatcggaaataaatgtgatctctgggagaagagacacgtgctcttcgaagatgcatgcaccctggcatag

SEQ ID NO: 45319 - DNA, 654 bp, Artificial Sequence
  Description of Artificial Sequence: Synthetic coding sequence
atgcacttcagcagcagcgcccgggccgccgacgagaacttcgactacctctttaaaataattttaatcggggattctaatgtgggcaagacctgtgtggtccagcattttaaatctggagtgtacacagagacccagcagaataccatcggcgtggacttcacagtgaggtcactcgatattgacggcaaaaaggtgaagatgcaagtgtgggacaccgccggtcaagagcggtttcgtactataacacaaagttattaccgtagcgcccatgcagcgatcatcgcctatgaccttacaaggaggtccacctttgagagcatcccacattggatacatgaaatcgagaagtatggcgctgccaacgtcgtcatcatgttgattgggaataaatgtgacttgtgggaaaagaggcacgttctgtttgaggatgcatgcactctggccgaaaagtacggcctgctcgcagttctcgagaccagcgcgaaggaatcaaagaacatagaagaagttttcgtgttgatggccaaggagctcattgcccgcaactccctgcacctgtatggagaatccgccctaaacggcctcccactggactcctcaccggtgctaatggcacaaggacccagtgagaagacccattgcacttgttag

SEQ ID NO: 45320 - DNA, 705 bp, Artificial Sequence
  Description of Artificial Sequence: Synthetic coding sequence
atgcggaagcccgacagcaagatcgtgctgctgggcgacatgaacgtggggaagacatcgctgctgcagcgatatatggagcgccgcttcccagacaccgtgtcaacggttgggggtgccttttacctgaagcagtggcggtcatataacatctccatctgggatactgcgggtagagagcagtttcacgggcttggaagtatgtactgtagaggagcagctgcaatcatcctgacatacgacgtaaatcataggcagagcctggtggagttggaagatagattcctcggactaacagacactgcttcaaaggattgtctctttgccatagtgggtaataaggtggacttgactgaggagggtgcccttgctggccaggaaaaggaagagtgctcacccaatatggatgcgggcgatcgagtcagcccgagggcacctaagcaggtgcagctggaagacgctgtggcgctctacaaaaagatcctgaagtacaaaatgctagatgaacaagacgtgcccgctgcagagcagatgtgtttcgagaccagtgctaagaccgggtacaatgtggacttactctttgagacgctcttcgacctggttgtccccatgatcctccagcaacgggccgagaggcctagtcatacagttgatattagctcacacaaaccacccaaaaggacgagaagtgggtgttgtgcctag

SEQ ID NO: 45321 - DNA, 657 bp, Artificial Sequence
  Description of Artificial Sequence: Synthetic coding sequence
atgaccgacggcgactacgactacctgatcaagctgctggccctgggagattccggcgtgggtaagactactttcctgtaccgctacactgataataagtttaacccaaagtttatcaccacggtgggaattgacttccgcgagaagagagtggtctataatgcccagggcccaaacggaagctccggaaaggcttttaaggttcatctgcagctgtgggacaccgccgggcaggagcgctttcgcagtttaacaactgccttctttagggacgccatggggttccttcttatgttcgacctgacctcacaacagtcatttcttaacgttcgcaattggatgagccagctacaggctaacgcatattgtgaaaatcctgatattgtgctgataggcaacaaagcagatctcccagaccagagggaggtcaacgagaggcaagcgcgcgaactggcagataagtacggtattccatactttgaaaccagcgcagctaccgggcagaatgttgagaaggccgtcgagaccttgcttgacctgattatgaagagaatggagcagtgtgtagagaagactcagattccagatactgttaatggggggaattccggtaacctcgacggcgagaaacccccagaaaaaaaatgtatctgctag

SEQ ID NO: 45322 - DNA, 654 bp, Artificial Sequence
  Description of Artificial Sequence: Synthetic coding sequence
atggagaccatctggatctaccagttccggctgatcgtgatcggcgactcaactgtgggtaagtcgtgcctgctgcaccggtttactcaaggcaggtttccgggcctgaggtcccccgcctgcgaccccacagttggggtcgattttttctctaggttgctggagatcgagcccggcaagcgcataaagttgcagctgtgggacacagccggccaggagagatttagaagcatcacccgttcttattatcgaaattcagttgggggcttcctcgtttttgacattactaatagacgttcctttgagcacgtcaaggattggcttgaggaagctaaaatgtatgtgcaacctttcaggatagtgttcctgttagtagggcacaagtgtgatctcgccagtcagcgtcaggtgacaagagaggaagctgaaaaactgagcgccgactgcgggatgaagtatatcgaaacgagtgcaaaggatgccactaatgtggaggagagcttcacaatccttacgcgtgacatttacgaactaatcaaaaaaggagagatctgtatccaggatggctgggagggggtcaaatctggcttcgtgcccaatacagtccactcctcagaggaggcggtaaagccccgtaaggagtgtttttgctag

SEQ ID NO: 45323 - DNA, 1737 bp, Artificial Sequence
  Description of Artificial Sequence: Synthetic coding sequence
atgcggcagcaggacgcccccaagcccacccccgccgcctgccggtgttccggattagccaggcgtgtgctgacgattgcatttgcactgctgatcctgggtcttatgacatgggcatacgctgcaggcgtccctctcgcttccgaccgctacggactgcttgcatttgggctgtacggggcattcctgagcgctcatctcgttgctcagagtctgttcgcttatttagagcacaggagagtggccgcagccgcgagaggaccgctggacgccgccaccgctcggagtgtcgcactgacgatctctgcgtaccaagaggaccccgcctacctgagacagtgtctggcctcggcacgagctcttttatatccacgcgctcggctgagagtcctcatggtggtggatgggaatagagccgaggacctgtatatggttgatatgtttagggaggtgttcgccgatgaagaccccgctacctatgtgtgggatggcaactatcaccagccatgggaaccagccgcggctggtgcggtgggagcaggagcatatcgggaggtggaggcggaggaccccggtcgcctggccgtggaggcactcgtgcggactcgccgctgcgtttgcgttgcacagcgctggggtgggaagcgcgaggtgatgtacacggcttttaaggctctaggcgactcggtggattacgtgcaggtctgcgactccgatactaggctggaccccatggcccttttggaactggtgcgggtcctggatgaggatccacgggtgggcgcagttggaggcgacgtaagaattttgaatccactcgactcatgggtgagcttcctgagctcactgcggtactgggttgcatttaatgtagagcgggcctgtcaatcgtacttccactgtgtatcctgtatatctgggcctctgggcttgtatcgtaacaatctgcttcagcaattcctggaggcctggtataaccagaagtttttgggtacccactgtacattcggcgacgataggcatcttaccaaccggatgctttctatgggatacgctacgaagtacacttcaaggtctagatgctactctgaaacaccctccagcttcttgcgctggctgagccagcagacccgatggtctaagtcctactttagggaatggctgtataatgccctgtggtggcatcggcatcacgcatggatgacatatgaagccgttgtctccgggcttttccctttctttgtagcagcgaccgtgcttcgcctgttttacgccggccgaccatgggcccttctttgggtattgttgtgtgtccagggggtcgcccttgctaaggcggcctttgcagcctggctccgcgggtgcctgcggatggtgttgcttagtttgtatgcgcccctctatatgtgcggcttgcttcctgcaaagtttctggcacttgtaactatgaaccagtctgggtggggaacatcaggaaggcgaaaattggcggccaactatgtaccactcctacccctggcactgtgggcgctgctccttttgggcggcctcgtccgcagcgttgctcacgaagctagagctgattggtctgggccgtcacgagccgccgaggcctaccacctggcagcaggcgcaggggcctacgtcggctactgggtggctatgttgaccctgtattgggttggggttcgtcggctttgtagacgccgcaccgggggctaccgggtgcaagtgtag

SEQ ID NO: 45324 - DNA, 834 bp, Artificial Sequence
  Description of Artificial Sequence: Synthetic coding sequence
atgagcgcccccggcagccccgaccaggcctacgacttcctgctgaagtttctcctcgtaggcgatagggacgtgggaaaaagcgagatacttgaatccttgcaggacggagcggcagagtcgccgtatagtcatttgggcggcattgattataagactaccacaatcctactggacggccagcgggtgaagttgaagctgtgggatacctctggacagggccggttttgcaccatctttcggtcctactcccgcggagcacaaggcgtgatactggtttacgacatcgccaaccgctggtcattcgaaggtatggataggtggatcaagaagatcgaagagcacgcacctggtgtccccaaaattctggtcggaaatcggctgcacctggcattcaaacgtcaggtgccccgagagcaggcgcaggcgtacgccgagcggctgggagttacattctttgaagtaagccccctttgcaactttaatatcatagagagcttcacagaattggctaggattgtactgctgcgccaccgaatgaactggttaggtcggccttctaaggttctgagtcttcaggacctatgttgccggacgatagtctcttgcacccctgtccatctcgtggataagctccctcttccttctactctgcggtcacaccttaaatccttcagtatggcgaaaggcctgaacgcacggatgatgagaggactgtcctattcactgacgacaagctccacgcacaagtcctctctttgcaaagtggagattgtctgtcctcctcagtctccccctaaaaactgtacgcggaacagttgcaagatttcctag

SEQ ID NO: 45325 - DNA, 834 bp, Artificial Sequence
  Description of Artificial Sequence: Synthetic coding sequence
atgagcgcccccggcagccccgaccaggcctacgacttcctgctgaaattccttttggtgggcgacagagacgtaggcaagagcgaaatcctggagagccttcaggatggagcagctgaatcaccgtattcccatttgggaggcatagattataagactaccacaatactgcttgatgggcagagagttaagctgaagctgtgggacaccagcgggcaaggtcgcttttgcaccatcttcagatcctactctaggggagctcaaggcgtcatcttggtctacgacattgccaatagatggagcttcgaaggaatggataggtggataaagaaaatcgaggaacatgctcccggggtgcccaagatcttggtcggaaatagactgcacttagccttcaaacgtcaggtgccacgcgaacaggcgcaagcatacgcggagagattgggagtgactttcttcgaggtgagcccattgtgcaactttaatatcatagaaagtttcactgaactggcacggatcgtgctgttgcggcacaggatgaactggctgggacggccttccaaagtactctcactgcaagatctttgttgcagaactatagtgagttgcactccggtgcatctggttgataagctgcctttaccatcgactctgcggtctcatctcaaatccttttcgatggctaaaggattgaatgcgaggatgatgcgcggcctctcatactcccttaccacctcatctacacacaagtctagtctctgtaaggtcgagatcgtctgtcctccacagtcaccaccaaagaactgcacacggaactcctgtaaaattagctag

SEQ ID NO: 45326 - DNA, 837 bp, Artificial Sequence
  Description of Artificial Sequence: Synthetic coding sequence
atgagcgccctgggcagccccgtgcgggcctacgacttcctgctgaagttcctcttggtcggcgattccgatgtgggcaagggggagatcctggcttccctgcaggacggagcagccgagagtccttatggccatcctgctgggatcgattataagaccactaccatcctactggatggtcgccgggtgaagctgcagctgtgggataccagtgggcagggacgcttctgcaccatctttagaagttattcacggggcgcccagggagtgatcctggtatatgacattgcgaaccggtggtcatttgacggaatcgatagatggattaaagaaatagatgaacacgctcccggcgtgccgaaaattcttgtgggaaacaggctccacctggcattcaagcggcaggttccaacggaacaggcccaggcctacgcagaaaggctgggtgtgacattctttgaggtgtcacccttgtgcaattttaatattacagaatcatttacagagctggcacgaattgtgctgctgaggcacggcatggatcgactttggcggccctcaaaggtactgtccctacaggacttgtgttgcagagctgttgtgagttgcacacctgtccatcttgtggacaagctgcccctcccaatagcactcagaagccacctcaagtccttctcaatggcaaatggactgaacgctagaatgatgcacggcggttcttactccctcaccacatcctccacacacaagcgctcaagtcttagaaaagtaaagctggtgcgccctccccaaagcccacctaaaaactgcacaaggaattcatgcaagatcagttag

SEQ ID NO: 45327 - DNA, 837 bp, Artificial Sequence
  Description of Artificial Sequence: Synthetic coding sequence
atgagcgccctgggcagccccgtgcgggcctacgacttcctgctgaagtttctcctggttggggatagcgacgttggcaaaggcgagattttggcaagtcttcaggacggcgccgccgagagcccctacggtcatcccgccggtatcgattataagaccacaacaatactccttgatggcaggcgtgtcaaacttcagttgtgggatacatcagggcagggtcgtttctgtactatttttcggagctacagccgaggagcgcagggggtgattttggtgtacgatattgccaaccggtggtcttttgatggcattgatagatggattaaggagatagatgagcatgctcccggcgtcccaaagattctagtaggaaatcgtctgcatcttgccttcaagagacaggtacctacagagcaggctcaagcctacgccgagaggctcggtgtcacgttttttgaagtgagtccactgtgtaattttaatattacagaatcatttaccgagctcgccagaatcgtgttgctgcgccacgggatggacagactgtggaggcctagcaaggtgctctcactccaagacctgtgctgtagggccgtcgtatcttgcaccccagtgcacctggtggacaaactcccacttccgatcgccttgcgttcccacctgaaatccttcagcatggcaaacgggttgaatgctcgcatgatgcacggtggcagctacagcttaacgacctcaagtactcataaaagaagctctctccgcaaggtgaaattagtgcgcccgccacagtctcctcctaaaaactgcacacgcaattcctgcaagatcagctag

SEQ ID NO: 45328 - DNA, 1140 bp, Artificial Sequence
  Description of Artificial Sequence: Synthetic coding sequence
gagcagggcctgggcgcccgggccgcccccctgggcgccggcccccctccactgagatccgcaccacaggccggtcacggctggggaaggcgggccgtgaccatgtccgctctgggttcccctgtgcgggcttacgattttttgctcaagtttctactggtgggggacagcgatgttggaaaaggcgagatccttgcttctctccaggatggcgcagcagagagtccatacgggcatcccgccgggatcgattacaagaccactacgatcctattggacggccggagggtgaagctgcagctgtgggacacctcagggcaggggaggttctgtaccatttttcggtcatactctagaggggcccagggcgttatcctggtgtatgatatcgctaacagatggagtttcgatggtatcgaccgttggatcaaggagatcgatgaacacgcccctggggttccaaagatactggtaggaaataggctgcacctggcctttaagcgacaggtccccaccgaacaagcccaggcttatgcagagcgattgggggttaccttctttgaggtttcgcccctttgcaattttaacattacagaatcattcacagagttagcgcggattgtcctattacgccacggtatggatcgactgtggcgtccatccaaggtgctgtccctccaggatctctgttgtagagcagttgtgtcatgtacgccagtacacttggtggacaaacttccattgccaatcgccttgagatcccaccttaaatccttctccatggcgaacggcttgaatgctcggatgatgcatggaggatcctactcattaacaacgtcatcgactcacaagagaagctcactgcgaaaggtgaagttagtgcgaccgccgcagccaccacagaagctgcaccagaagcaactgcagaacttcttacgaaaagccctgaaggaaacccgtagaaacctctctaggagaagcagcgccctgccccccgccgcaggaggctgtatcagtgatcccgggtcttcgcgtcgtatgttattggcaaacgtctgcgacgcattccgcgtaatggaaacgcattacccggtgggactccgcataagcacatggatgtgcatgaagctgctcttctag

SEQ ID NO: 45329 - DNA, 846 bp, Artificial Sequence
  Description of Artificial Sequence: Synthetic coding sequence
atgggcagccagggcagccccgtgaagagctacgactacctgctgaagtttttactggtgggggatagcgatgtaggtaagggcgaaatactcgagtccctgcaggatggggccgccgaatctccatatgcgtatagtaacggtattgactacaagactaccacaatcctactggatggccgcagagtaaagctggaactctgggacacaagcggacaggggcgcttttgcacgatttttaggtcctacagccgcggcgcccagggaattctcctggtttatgatattacaaatcgttggagctttgacggtatcgacaggtggattaaggagatcgacgagcacgccccaggggtcccgaggatcctcgtgggcaacagattgcatctcgcattcaaaagacaggttcccaccgagcaggcaagagcatacgccgaaaaaaactgcatgacattctttgaagtctctccactctgcaattttaacgtgatcgaaagttttaccgagctctccaggattgtcctgatgcggcacggtatggagaaaatttggcgccctaacagggtattctctctgcaggatctgtgttgcagggcaattgttagttgcaccccagttcatttgatagacaagctgcccttgccagtgaccatcaagtcacatttaaagtcatttagcatggccaatggaatgaatgcggtgatgatgcatgggcggtcctacagcttggcgtccggcgccggcgggggggggtccaagggcaactccctcaaacggtcaaaaagcattcgacctccacagtcacccccacagaattgtagtaggagcaattgcaagatttcgtag

SEQ ID NO: 45330 - DNA, 846 bp, Artificial Sequence
  Description of Artificial Sequence: Synthetic coding sequence
atgggcagccagggcagccccgtgaagagctacgactacctgctgaagttccttctagtgggggatagcgacgtcggtaaaggcgagattctagagtctttacaggacggggctgccgaaagcccctatgcttattccaacggaatcgactataaaacgaccaccatcttattggacggtaggcgagtgaaactagaactctgggatacttctggacaagggcgcttttgtacaatatttcggagttattctaggggagcccaaggaattctgctggtgtatgatattacaaatcgctggagtttcgatggcatcgataggtggataaaagaaatcgacgagcatgctcctggcgtgccaagaattctggtggggaatcgcctccacctggcttttaagcgacaggttcccactgagcaagctcgagcttacgccgaaaaaaactgcatgaccttcttcgaggtctctccactgtgcaacttcaacgtgatcgaaagctttactgagttaagccggatcgtgctgatgcggcacggtatggagaagatttggcgccccaaccgcgtgttcagcctccaggatctgtgttgccgagccatcgtaagttgcactcctgtgcacctaatcgacaagctcccgctgcccgttactattaagagccatctgaaatccttttccatggctaatggtatgaacgcagtgatgatgcacgggcgatcctactccctggcttcaggtgcaggcggaggaggatccaaaggcaacagcctcaagcgatctaagtcaatccggcctccccagtctccaccccaaaattgctctagatctaattgcaagattagctag

SEQ ID NO: 45331 - DNA, 846 bp, Artificial Sequence
  Description of Artificial Sequence: Synthetic coding sequence
atgggcagccagggcagccccgtgaagagctacgactacctgctgaagttcctcctagtcggagattccgacgttggcaagggagagatcctggaaagcttacaggatggcgccgccgagtccccatacgcatattcaaatggtattgactataagactactacaatcttgctagacggacgccgcgtaaagctggaattatgggacacttctggccagggtcggttttgtactatctttcgatcttactcccgcggtgcacagggaattctgctggtgtacgacataaccaatcggtggtctttcgacggcattgatcggtggatcaaggagatcgacgagcacgctcctggtgtccccaggattctggtgggtaaccgccttcacctggcgtttaagcgtcaggtgcctacggaacaggcgagggcctatgcagagaaaaactgtatgacttttttcgaagtcagccccctgtgtaattttaatgtcattgagtcatttactgagctctccagaatcgtgttgatgagacatgggatggaaaaaatttggagaccaaaccgggtgttctctcttcaagacctgtgctgtcgtgcaattgtgtcttgcacccccgtgcacttgatagataagctgccactccccgtgaccatcaagtcccacttgaaatctttttctatggctaacggaatgaatgcagtcatgatgcatggcaggtcctattctcttgcctcaggagcaggcgggggggggagtaaaggcaactccctgaaaagaagcaaaagtatcaggcctccgcagtcacccccccagaattgttcacgctcaaactgtaaaattagttag

SEQ ID NO: 45332 - DNA, 846 bp, Artificial Sequence
  Description of Artificial Sequence: Synthetic coding sequence
atgggcagccagggcagccccgtgaagagctacgactacctgctgaaatttctcctcgtgggcgatagcgatgtgggcaagggagagatcctggagtcattgcaggatggcgccgctgagtctccctatgcctattctaatggaattgactacaagacaaccacaatcctgctcgacggtcggcgcgtgaagctggagctctgggatacgtctggtcaggggcgattctgtacaatcttccggagctacagccgcggcgcccagggaatcctgttggtctacgatattacgaataggtggtcttttgacgggattgacagatggatcaaggaaatcgacgagcacgcccccggggtgcctcgcatcctggtgggaaaccgtttacatctcgcatttaaacggcaagttccgaccgaacaggcacgcgcatatgccgagaaaaattgtatgaccttttttgaggtatcccctctatgcaattttaacgtgattgagtcattcacagagctgtctcgaatcgtcttaatgcgccacggaatggagaagatttggcgcccaaacagagtgtttagcttgcaggatctatgctgccgggccattgtttcttgtactcccgtccacttgatcgacaagctgcctctgccagtcactattaagtctcacctcaaaagtttctccatggctaatggaatgaacgccgtcatgatgcacgggaggtcgtattccctggcctctggggccggaggaggcgggagcaagggcaactccctgaaacggtctaaaagcattaggcctccacaaagccccccccaaaattgctcgcggagcaactgcaaaatctcttag

SEQ ID NO: 45333 - DNA, 468 bp, Artificial Sequence
  Description of Artificial Sequence: Synthetic coding sequence
atggccggccccggccccggccccggcgaccccgacgagcagtacgacttcctgttcaagctggtcctcgtaggtgatgcctctgtgggtaaaacatgcgtcgtacagagatttaagactggcgcattttctgagcggcaggggagtaccattggggttgacttcaccatgaagacactagagatccaagggaagcgagtcaaattgcagatctgggacactgccggccaggaaagattcaggacaatcactcagtcctactacagatcagcaaacggagctatcctggcttacgacattaccaaacgctcctctttcctctcagttccacattggattgaagatgtgagaaaatacgcaggcagtaatatcgtacagctccttatcgagatgcagagttgctacgtagcccaggctgacctcgaattgcttgcttcctcaaatccacccgcgtccaccagcaagtag

SEQ ID NO: 45334 - DNA, 639 bp, Artificial Sequence
  Description of Artificial Sequence: Synthetic coding sequence
atggccggccccggccccggccccggcgaccccgacgagcagtacgactttctgttcaagctggtgctggtgggagacgcctcggtcggaaagacttgcgtggtgcagcggtttaaaactggagccttttcagagcggcagggctctactattggtgtagactttactatgaaaacgttggagatacaaggaaagcgggtgaaacttcagatttgggatactgctggccaggagagattccgaactattacccagagctactaccgctcagcaaacggcgcaatccttgcctacgatattacaaagcgttcatcttttctgtcagtgccccactggatcgaggacgtgagaaagtatgcaggttccaacatcgttcaactgcttattggaaataagtctgatttaagcgagctgagagaagtcagcctggcggaggcacagtccctcgctgagcattacgacatcttatgcgcaattgagaccagtgctaaggatagtagtaacgttgaggaagctttcctacgggtggctaccgagctgattatgaggcacggtggacccctgtttagcgagaagtctcctgaccacatccaactgaattcgaaggacatcggcgagggatgggggtgcggttgctag

SEQ ID NO: 45335 - DNA, 639 bp, Artificial Sequence
  Description of Artificial Sequence: Synthetic coding sequence
atggccggccccggccccggccccggcgaccccgacgagcagtacgacttcctgttcaagctggtactggttggggacgcctccgtaggcaagacctgtgtggtacagcgattcaaaactggcgcctttagcgagcgtcagggcagcacgattggagtggatttcacgatgaagactctggagatccagggcaagagggtgaagctacagatatgggacacagctgggcaggagaggttccggactatcacacagtcatactacaggtccgctaacggggcgatcttagcgtacgacatcacgaagcggagttctttcctgagcgttccccactggattgaggatgtgaggaagtacgcaggatcaaacatcgtgcagctgctgatcgggaataaatccgacctatctgagctgagagaggtctctttagccgaagcccagtccctggccgaacactacgatatactttgcgcaatagagacaagtgccaaagatagctccaatgtagaggaagccttcctgagagttgccaccgagctgatcatgcgccatggaggaccgctttttagcgagaagagccccgatcacattcagctgaactctaaggatattggagagggttggggatgtggatgttag

SEQ ID NO: 45336 - DNA, 639 bp, Artificial Sequence
  Description of Artificial Sequence: Synthetic coding sequence
atggccggccccggccccggccccggcgaccccgacgagcagtacgacttcctttttaaactggtgctagtgggagatgctagtgttggaaagacttgcgtggtccagcggttcaagactggagctttttctgaaagacagggtagcaccattggcgtggacttcaccatgaagacactagagattcagggaaagcgggtgaagttacagatctgggacacagcaggacaggaacgatttagaacaatcacccaatcttactaccggagtgccaacggtgcaattctggcatacgacattactaagaggagtagtttcctgagcgttccacattggatcgaggacgtgcggaaatacgccggcagtaacatagtccagctcctgatagggaataaatctgatttatctgagctcagagaagtcagcctggccgaggcccaatcactggccgaacactatgacattctctgtgccattgaaacgagcgccaaggatagctccaatgtggaggaggcttttctcagagtagccactgagcttattatgcggcatgggggaccacttttcagtgaaaaaagtcccgatcacattcagttaaactccaaagatattggcgaaggctggggctgtggctgctag

SEQ ID NO: 45337 - DNA, 639 bp, Artificial Sequence
  Description of Artificial Sequence: Synthetic coding sequence
atggccggccccggccccggccccggcgaccccgacgagcagtacgattttctttttaagctcgtgttagtgggggatgcctcagttggtaagacttgtgttgtccaacgctttaagaccggcgctttctcagagcgccagggttccacgattggggtggacttcacaatgaaaaccctcgagattcagggaaaacgcgttaagctgcagatctgggatacagccggacaagagcgctttcggacaattacgcagtcatactaccgctcagctaacggcgccatcttagcatacgatataaccaagcgctcctcatttcttagcgtcccacactggatcgaggatgtcagaaaatacgctgggtcaaatatagtccagctgttgatcggaaacaagagcgatctcagtgaactccgtgaagtaagcctggccgaggctcagtctctcgccgagcattacgacatcctgtgcgcaatcgagacgagcgctaaggattccagcaatgtcgaagaagctttcctgcgcgtggcaaccgagctgatcatgcggcatggaggtcccctcttcagcgagaaatcccccgaccatattcagctcaattctaaggatatcggtgaagggtgggggtgcggctgttag

SEQ ID NO: 45338 - DNA, 639 bp, Artificial Sequence
  Description of Artificial Sequence: Synthetic coding sequence
atggccggccccggccccggccccggcgaccccgacgagcagtacgactttttgttcaagctcgtgctggtcggggacgctagtgttggaaagacatgtgtggtgcagagatttaaaacaggggcattctccgagagacaggggtccactattggagtggacttcaccatgaaaacacttgagattcagggcaaaagagtgaaacttcaaatctgggacacagctggccaggaaagatttaggacgatcactcagtcctattatcgttcggcgaatggcgcaatcctagcctacgacatcacaaagcgaagtagcttcctgtccgtgcctcactggattgaggatgtccgcaaatatgcggggtcaaacatcgtacagttgctcatcgggaataagagtgatctgtccgagctgcgggaagtgtcattggctgaagcccagagcctggccgagcactatgacatcttgtgtgcgatagagacgtctgccaaagacagctctaatgtggaagaggccttcctgcgcgtggctacagagctgatcatgaggcacggaggccccctcttcagcgagaaaagtcctgatcacatccagttgaattctaaagacataggggaaggctggggctgcggatgttag

SEQ ID NO: 45339 - DNA, 261 bp, Artificial Sequence
  Description of Artificial Sequence: Synthetic coding sequence
atggccggccccggccccggccccggcgaccccgacgagcagtacgatttcctgtttaagctggtgctggtaggagacgccagcgtgggtaagacatgtgtggtccaacgcttcaaaactggcgcattctctgagagacaaggcagcacgatcggcgtcgacttcaccatgaaaactctcgagattcagggaaagagggtgaaactgcaaatctgggacaccgccgggcaggagagatttaggaccattactcagagctag

SEQ ID NO: 45340 - DNA, 624 bp, Artificial Sequence
  Description of Artificial Sequence: Synthetic coding sequence
atggccaagacctacgactacctgttcaagctgctgctgatcggcgattcgggtgtgggcaaaacatgtctgctgttcagattctcagaggatgcttttaatacaactttcatcagcactataggcattgacttcaagatccgaaccattgagttggatggtaaaaaaatcaaactgcagatctgggatactgctggccaagagaggttccgtaccattaccacggcgtattacagaggagccatggggattatgctcgtgtacgacatcacaaacgagaagtcctttgataatatcaaaaattggatacgcaacatcgaggaacatgccagctctgatgtggaacggatgatactggggaataagtgtgacatgaatgataaaaggcaggtgtcaaaggaacgcggagagaaactggcgatagactatggtatcaagttccttgagacaagcgcaaagtccagtgctaatgtggaggaggccttcttcaccctggctagagatatcatgacgaagctcaacagaaaaatgaatgattcaaattccgctggagcgggtgggccagttaagatcacggagaaccgttccaaaaaaacaagcttctttcggtgttccttgctctag

SEQ ID NO: 45341 - DNA, 573 bp, Artificial Sequence
  Description of Artificial Sequence: Synthetic coding sequence
atggccaagacctacgactacctgttcaagctgctgctgatcggcgactccggcgtggggaagacctgtctcttgttcagattcagtgaggacgcattcaatacaacattcatctcaactatagggatcgatttcaaaatacggactatagaactggatgggaagaagatcaagctgcagatctgggacacagcgggccaggagaggtttcggaccatcaccaccgcttattatcggggcgcgatgggcattatgctagtctacgacataactaatgaaaaatcttttgacaatatcaaaaattggattagaaacatcgaggagcatgcttcatccgacgtcgaacggatgatactaggtaataagtgcgacatgaacgataaacgacaggttagcaaagagcggggtgaaaaactggccattgactatggaatcaagttcctggaaacgtctgcgaaaagttctgctaatgtcgaagaaaacgattcgaactccgcgggtgctggggggcctgtaaagatcactgaaaacagatctaagaagacgagctttttcaggtgcagcttactctag

SEQ ID NO: 45342 - DNA, 966 bp, Artificial Sequence
  Description of Artificial Sequence: Synthetic coding sequence
atgaagcagctgcccgtgctggagcccggcgacaagccccggaaggcaacttggtataccttaaccgtccctggcgacagcccctgcgcccgggttggtcacagttgttcatacctgccccctgttggtaacgctaagagggggaaagtcttcattgttggaggcgcaaatcccaaccgctccttcagcgacgtgcacacaatggacttggagacccgaacatggacaacgcctgaggtcacaagtccccctcccagtccccgtacgtttcatacatcatctgctgctatagggaaccagctatacgtgttcggtggaggtgagcggggagcacagcccgtccaggacacaaagctgcacgtgttcgacgccaacacacttacttggagccagccggagacactgggcaatccaccatcgcccaggcacggccacgtaatggtggcagctggtacaaagctgttcatccacggagggctcgccggcgatagattttacgacgacctgcattgtatcgacatctccgacatgaagtggcaaaaactaaatccaacaggcgccgcaccagccgggtgcgctgcacatagtgccgtggctatggggaagcacgtatacatctttgggggtatgaccccagctggggcactcgacaccatgtatcaatatcacactgaagagcaacactggaccctacttaagtttgatacactgttaccgccaggcagactggaccacagcatgtgtattatcccctggcccgtgacgtgtgcttccgaaaaagaggacagcaattctcttacgttgaaccacgaagccgagaaggaggacagtgccgataaagtgatgtcacatagcggagattcacacgaggaaagtcaaacagcgactttgctgtgcctggtgtttggtggaatgaataccgaaggcgagatctacgatgattgcatcgttaccgtcgtggactag

SEQ ID NO: 45343 - DNA, 1119 bp, Artificial Sequence
  Description of Artificial Sequence: Synthetic coding sequence
atgaagcagctgcccgtgctggagcccggcgacaagccccggaaggccacctggtatacccttactgtacctggtgattccccatgtgctcgggtgggccactcatgttcctacctgcctcctgtcgggaacgcgaaacgcggcaaagtgtttattgtgggcggggccaatcctaatcgttcgttttcggacgttcatactatggatctcggcaagcatcagtgggacctggacacctgtaagggcctccttccccggtatgaacacgcatcgttcattccatcctgtacacccgataggatttgggtcttcggcggcgccaatcaatcaggaaaccgtaactgtctccaggtgttgaatccagagacgcggacatggacaacgccggaggtaacctcaccacccccaagcccacgcacttttcacacttcctctgcagccattggcaaccagctgtacgtgttcggtggtggggagagaggcgcgcagcctgtccaggatactaagttgcatgtgttcgacgctaatacactgacttggtctcagccagagacactggggaatccacccagcccccgtcacggccatgttatggttgccgcgggaactaagctcttcattcacgggggcctggcaggggacagattttatgacgacttgcactgtatcgacatctctgatatgaaatggcagaagttgaaccccaccggggccgcaccggccgggtgcgctgcgcacagtgccgtcgcaatgggcaaacacgtgtatattttcgggggtatgacacccgccggcgctctggataccatgtaccaataccacactgaagagcagcactggacccttctgaagttcgatactcttctgcctcccggccgcctggaccattcgatgtgcattattccgtggcccgtcacctgtgcctccgagaaggaggactcgaacagcttgaccttgaaccacgaagctgagaaagaagacagcgcggataaggtcatgtcccactccggggacagccatgaggaaagccaaacagctaccctgctgtgcctggtgtttggcggaatgaatacagagggagagatttatgacgattgtatcgtgacagtagtggactag

SEQ ID NO: 45344 - DNA, 465 bp, Artificial Sequence
  Description of Artificial Sequence: Synthetic coding sequence
atgaagcagctgcccgtgctggagcccggcgacaagccccggaaggccacttggtacacattgaccgttccgggtgactccccttgcgcccgggtggggcactcttgttcttacctccctcccgttgggaatgcaaaacggggtaaggtattcatagtgggaggcgccaaccctaatcgaagcttcagcgatgtccacacaatggacttagggaagcaccagtgggacttggacacctgtaaaggcctcctcccgcgatatgaacacgcatctttcatcccttcctgtacccccgacagaatctgggtgttcggcggagcgaaccagtccggtaatcgcaactgcctgcaagtactgaatccggcgtttaaatcttggggtttctggaccgtactcgctaaccctaaataccatctacatagcagtctgatgtttaaacccggccgcgggccaagacagaagtag

SEQ ID NO: 45345 - DNA, 465 bp, Artificial Sequence
  Description of Artificial Sequence: Synthetic coding sequence
atgaagcagctgcccgtgctggagcccggcgacaagccccggaaggcaacatggtacacgcttacggttccaggagattcgccatgtgctagggtcggtcatagctgcagttatttaccgcccgtcggcaatgccaagcggggcaaggtgttcatcgttggcggggcgaacccaaatcgctctttctcagatgttcatactatggacctcgggaagcatcaatgggatctggatacctgcaaaggcctgttaccccgctacgagcacgctagtttcatcccaagttgcacccccgaccgcatctgggtgttcggaggtgccaatcagagtggcaacagaaattgcctgcaagtactaaatcccgcctttaagagctggggattctggactgtgctcgccaaccctaaataccacctgcacagttcactgatgttcaagccaggtcggggccctcgccaaaaatag

SEQ ID NO: 45346 - DNA, 1119 bp, Artificial Sequence
  Description of Artificial Sequence: Synthetic coding sequence
atgaagcagctgcccgtgctggagcccggcgacaagccccggaaggccacatggtacaccttgaccgtgcctggggactcgccctgtgcccgagtcgggcattcttgttcctatttacctccagtcggaaatgctaaacggggaaaggtgtttatagtgggtggagccaaccctaatagatctttttctgacgtccatacgatggacctgggcaaacaccagtgggatcttgacacctgcaaggggctgctcccccgctacgaacatgcctctttcattccctcctgcaccccagacagaatctgggtgtttggcggtgccaaccaatcagggaatcgcaactgcctacaggttttaaatccagagaccaggacatggaccacccctgaggtgacttctcctcccccctccccgagaacgtttcatacctcgagtgcagcgatcgggaaccaattatatgtgttcgggggcggtgagagaggtgcccagcctgtccaagatacaaagctgcacgtgttcgatgccaataccctcacctggtcacagcctgagaccctgggcaaccccccaagtccacgacatggccatgtgatggtggccgctgggactaagttgttcatccacggaggcctcgccggcgacagattttatgatgacctacattgtatcgacatttctgatatgaagtggcagaaactgaaccctaccggcgcagccccagccgggtgtgccgcccacagcgccgtggctatgggaaagcatgtgtacattttcggtggcatgacgccagctggagctttggatacaatgtaccagtaccacaccgaggagcaacactggaccctgctgaagttcgacactctcctgccccctggcaggttggaccactccatgtgcatcatcccttggcccgtgacctgtgcctctgaaaaggaggattccaactcactgacacttaaccacgaagcggaaaaagaggactcggctgataaggtcatgtcacactcaggcgactcccatgaggaaagccagaccgccactctactttgtttagttttcggcggaatgaatacagaaggggaaatctatgatgactgtatcgtgacagtggtggactag

SEQ ID NO: 45347 - DNA, 735 bp, Artificial Sequence
  Description of Artificial Sequence: Synthetic coding sequence
ggccggggcagccccgacaccggcagcatcaccgtgagcggccgggagagcgagagctttcggggagtcgggccgagccgggtgcaacgcactggcaagggtctgccctggctgaggcctggacatttcgataggataagtctgttcttccctgatcccgtgtcttatccgctggagctcccacgcggagacgaaatttgttgggcgggatcaggaggatgctgcggcagaagcagacccagggaagcttctctcactgagctgtggactcttggaacagccgtctccggtctcggacgtcgttacactctgactgtgcctggggactcaccttgtgcaagggtgggccactcttgtagttatctgcctccagtcggtaatgcaaagagaggaaaggtgttcatcgtcggaggcgcgaacccgaatcggtcgttctcggatgtgcacaccatggacctggggaaacatcagtgggacctggacacttgtaaaggcctcctcccccgctacgagcatgctagcttcattccatcctgtactcctgataggatttgggtatttgggggcgctaatcagagtgggaaccgcaattgccttcaggtgctcaatcctgagacacgcacctggaccacacccgaagtgacttcaccccccccaagtcctcggacctttcacacctcctccgccgccatcggcaatcagttgtacgtttttggtggaggagaaaggggctag

SEQ ID NO: 45348 - DNA, 606 bp, Artificial Sequence
  Description of Artificial Sequence: Synthetic coding sequence
atggccggcaagagcagcctgttcaaggtgatcctgctgggcgacgggggtgtggggaagtcctccctcatgaaccgctacgtcacaaacaagttcgacacccaactattccataccataggagtggagtttctcaataaggacctggaagtggacggccacttcgttaccatgcagatttgggatacggccggccaggagaggtttcggagtctgcgcactcccttctacaggggatccgactgttgtctgctgaccttctccgtggacgattcccagagcttccagaacctgtcaaactggaagaaggagttcatctattacgctgacgttaaagaaccggagtcgttccccttcgtgattctaggaaacaagattgacatcagtgaacgccaggttagtacagaagaagctcaggcatggtgtcgagataatggcgactatccatactttgagacctctgcaaaggatgctacgaacgtggccgctgccttcgaagaggccgtgaggagggtgttggccacagaggacaggtcagatcacctgatccagaccgacactgtgaatctccacaggaagcctaaaccatctagctcatgctgctag

SEQ ID NO: 45349 - DNA, 1506 bp, Artificial Sequence
  Description of Artificial Sequence: Synthetic coding sequence
atgggctgcggcctgcggaagctggaggaccccgacgacagcagcccaggtaagatcttcagcaccttaaaacgcccccaggttgagaccaagactgagttcgcttacgaatacgttctgctggactttaccctgcaggcatcttctaatccagaggtgataaaaattaacagtatcctcgatatcgtgaccaaggtggaaaactactatttgaaaggttatattgtgggggcaatacaccctgtaatccaacccgtagggcagcgcaagcacctcccagctagttatctgtaccgcgtggttctgttacggctcaagctttccccaaaaaactcagcggctccttcaggccagaggcgacctcgactggttatcgaggagtgtcctctcacctctgaggcccagacaaacgatgctgcgaaagaactgattgaaaagatcaacgtggccgccaaaagaggtatgaaattcgtgggattcatctctcagcattattctccatctaagttttgcaacggaacaaatcatgatggggatatcgaaagcatgcttcacgtgagacacgggtccgacgagaattgtcggagctggaatgaaggcaccctcagcggacagtctagcgaatcgggaattgaggaggagctgcatcacgaaagcggacagtaccaaatggagcagaatggctccccaacttcctctaagtcacgcaaaggcgaggcgagtgataacaagctgtacactgtctttaatgccttcgatgacgatagcacctcctgggcgtaccaagagggaatactttcaatgaaagtgactcgaaaaggcagcgtgatctccacgctcgacgcagattggcttgaactcactaccttttattacaaacaagggctgtcgctaatcgattcttttgtcttctgggaaacttcaaaaggggagcacctacccaagtctttggagggtttcttcatctacgaagaagaaggatctggagtacctggcagcagtcgcaaggggaatgacgccatcgtggtggaacagtggactgtaatcgaaggatgcgagataaaaaccgattacggcccattgcttcacacactggctgagttcgggtggttgttgacttccgtgctccccaccccagtgctccggcatgattcggaaggcaatttggctacaaaacagatcgtgttccttcagcggccagtgatgtggaattctgcagcacaaacgcccgataagaaagctagtcgccacatcaagggagaagacaaaaacaaggccacatcccgtagcattgggttagacactacctcaagccagcctgcagagtctcggcacctaccagaggaatgtcggctttctccttccagagaatgctggacaaaagagggacggttggctcaacataattcattctctggtttcagctcttcagataacgtcctgcgcgagctcgatgacggccagttcgaccaggaagatggtgtgacacaggtgacttgcatgtag

SEQ ID NO: 45350 - DNA, 1737 bp, Artificial Sequence
  Description of Artificial Sequence: Synthetic coding sequence
atgggctgcggcctgaacaagctggagaagcgggacgagaagcggcccggaaacatttacagtaccctcaaaaggccccaggtggaaactaaaatcgatgtcagttacgagtataggttcttggaattcactactctatccgctgctgagcttcctggatccagtgccgtgcggctagcctctctccgtgatctgccggcccaattactggaactataccagcagggattcagtctggccgctttgcacccatttgtacaacctactcatgaacgggagaaaacccctcttgagcacatctttagagctatccttatcaagaagacggataggagccagaaaacggacctccataatgaagggtatatcctcgaattggattgctgcagtagtctggatcacccaacggaccagaaacttatacccgaatttatcaagaaaatacaggaggcagcaagccagggtctgaagttcgtaggtgtgatcccacagtaccacagctccgttaattctgcgggtagctcagctccagtcagcaccgcaaatagcactgaggatgctcgcgatgcaaagaacgctcgcggcgatcatgccagcctcgagaacgagaagcctgggactggcgacgtgtgcagtgctccagccggtcggaatcaatcccccgagcctagctcagggccaagaggtgaagttccacttgctaagcagccatcatccccttctggcgaaggtgacggtggagagctcagccctcagggagtgtccaagacacttgatgggccggagtcgaacccactggaagtccacgaagagcccctgagcggcaagatggagattttcacattgtttaacaagcccaagagtcatcagaagtgccggcagtactatccagtgaccatccctctccatgtgtccaagaacggtcagacagtgtctgggctggacgccaattggctggaacatatgagtgatcactttcgtaagggaggtatgctcgttaatgccgtgttctacctcggcatcgtgaacgatagcctccacggactgactgacggagtctttatttttgaggcagtgtctacggaggacagtaagacaatccaggggtacgacgctatcgtggtggaacagtggacggtgctggaaggcgtggaggttcagacagattacgtccctctgcttaacagcctcgcggcatacggctggcaactaacctgtgttctccccactcctgtcgtgaagactactagcgaggggagcgtttccacaaagcagatcgtgtttctccagcgcccttgtctgccacagaagatcaaaaagaaggaatcaaaatttcaatggagatttagccgggaagagatgcataacaggcagatgcgcaaatccaaagggaaacttagcgccagagacaaacaacaagccgaagaaaatgaaaagaacctagaagatcagtctagtaaagctggcgacatgggaaactgtgtgtctggccagcaacaggagggaggggtttctgaagagatgaagggaccagtgcaggaagacaagggagagcagctatctcccggcggtctcctgtgtggggtcggggtggagggtgaggccgtccaaaacggcccggccagccatagtcgcgccctggtgggaatttgtaccggacactccaatccaggggaggatgctagggacggggatgcagaggaggtccgcgaactgggaacagtggaagagaactag

SEQ ID NO: 45351 - DNA, 345 bp, Artificial Sequence
  Description of Artificial Sequence: Synthetic coding sequence
atgggctgcggcctgaacaagctggagaagcgggacgagaagcggcctggaaacatttacagtacactgaaaagaccccaggtggaaaccaaaatagatgtctcttatgagtataggttcctggaattcaccaccctctcggccgcagagctaccagggagttcagccgtgcgactagcatcactgcgtgatcttcccgcccaacttctggaactttaccagcagggtttctccctcgcagctcttcacccttttgtacagccgactcacgaaagagagaaaaccccgctcgagcatatcttccgcgcaattctgatcaaaaaaaccgatcgatcacagaagtag

SEQ ID NO: 45352 - DNA, 450 bp, Artificial Sequence
  Description of Artificial Sequence: Synthetic coding sequence
atgggctgcggcctgaacaagctggagaagcgggacgagaagcggccaggcaatatttattcaaccttgaaaaggcctcaggtggagacaaaaatcgatgtgtcttacgaataccgttttctggaattcacgacactctccgccgcggaattacccggaagctctgccgtgcggctcgcctccctcagggacttgcctgcacaactcctggaactgtaccagcagggattttctctggctgctctgcatccatttgtgcagcctacacacgaacgggaaaagacaccccttgagcacatttttcgcgctatccttataaaaaagactgatcggtctcagaaaactgacctgcacaatgaaggatacatcctggagctggattgctgcagctccctcgaccaccctaccgatcagaagttgattccagaattcattaaaaagattcagtag

SEQ ID NO: 45353 - DNA, 450 bp, Artificial Sequence
  Description of Artificial Sequence: Synthetic coding sequence
atgggctgcggcctgaacaagctggagaagcgggacgagaagcggccagggaacatctattccacactgaagagacctcaggtggaaaccaagatcgatgtgagttatgagtatcggtttttggagttcaccacgcttagcgcagccgaattacccggctctagtgccgtgcgcctggccagtctgcgcgatttaccggcgcagctgttagagctgtatcagcaaggcttttctctagcggctctgcaccccttcgtccagcctacgcacgagcgcgagaaaaccccacttgaacacattttcagagcaatccttattaaaaagaccgaccgctcccagaagaccgatctgcataacgagggatatatactggagctggactgttgtagcagcctcgaccatcctactgatcagaaactgatcccggaatttataaaaaaaatccagtag

SEQ ID NO: 45354 - DNA, 828 bp, Artificial Sequence
  Description of Artificial Sequence: Synthetic coding sequence
atgggctgcggcctgaacaagctggagaagcgggacgagaagcggcctgggaacatttacagtactcttaagaggcctcaagttgaaactaagatcgacgtctcctacgagtaccgttttctcgagtttaccaccctctccgcagccgagcttccaggaagctctgccgtgagactcgccagcttacgcgacctgcccgcacagctactggaactctatcagcaaggtttcagtctcgcggctctgcatccgtttgtgcagcctactcacgaacgtgagaaaactccactcgagcacatatttagggccatcctgataaagaaaaccgaccgctcacagaaaactgatctacacaatgagggttacattttggagctcgactgctgttcctctctcgatcatccaaccgatcagaaactgatccccgaatttatcaagaagatccaggaggctgctagccagggactgaagttcgtgggtgtgatccctcaatatcatagttcagtgaacagcgctggaagcagcgctccagtctctaccgcgaactctactgaagatgctagggatgccaagaatgctcgcggtgatcacgcgagcctggagaatgagaaacctggcaccggggacgtttgttcggctcccgcgggacgcaatcaatctcccgagcctagtagcggaccaagaggcgaggtgcctctggctaaacaaccatcgtccccctctggggaaggggatggtggggagctctctccccaaggagtgagcaagactctggacggaccagaaagcaatccactcgaggtgcacgaagaacccctgtccgggtag

SEQ ID NO: 45355 - DNA, 1647 bp, Artificial Sequence
  Description of Artificial Sequence: Synthetic coding sequence
atggacctgatgaacggccaggccagcagcgtgaacatcgccgccaccgcttccgaggggcagatcaccctgatggatgtacccgtattcaaagctatccaacctgatgaactctcatcttgcggttggaacaaaaaggaaaagtattcttcggctcccaatgccgtggctttcaccaggcggttcaatcacgtttctttctgggtcgtccgcgagatcctccacgctcagacattgaagattcgcgccgaagtactgagtcactacattaaaaccgccaagaaattgtatgaactgaataatctccacgctctgatggcagttgtttccggcctgcagtctgctcctatctttcgcctgacaaagacatgggcgctcctttctaggaaggacaagactacttttgagaaacttgagtatgtcatgtccaaggaggacaattataaaaggctgcgagactatatcagttccctgaagatgaccccatgtattccctacctagggatctacctgagcgacctcacatatatcgattctgcgtacccctcgactggcagcattctcgaaaatgagcaacggtccaacctgatgaataatatactgaggattatcagtgatctacagcagtcctgtgagtacgacatcccaatgctgccccacgtgcagaagtatcttaactctgtccagtatatcgaggagctccaaaaattcgtagaggacgacaattacaagctctctcttaaaatagaaccgggtacatccaccccacgtagtgccgcttcacgggaggacctcgtgggccccgaagtcggcgcaagtcctcagtcgggccggaagagcgtggcagcggagggggcgttactgccacagacccctccatcacctcggaatttgataccgcatggacataggaagtgccattccctcgggtataattttatccataaaatgaataccgctgagttcaaaagtgcgactttccccaacgccggccctaggcatcttctggatgattccgtgatggagcctcatgcacccagtagggggcaagccgaatcgtccactctgtcatccgggatttcaatcggctcttctgatggaagcgagctgtctgaggagactagctggcctgcattcgaaaggaatcggctttaccacagcctcgggcctgtcacccgtgtggccaggaacgggtatcggagccacatgaaggccagctcatcagcggagtcagaagacctggcggtccatctttacccaggcgcagtgacaattcagggggtccttcggcgaaagactctgctgaaggagggaaaaaagccaaccgtggcttcctggaccaaatactgggcagccctgtgtggaacacagctcttctactacgcagctaagtcgctaaaagcgacagagcggaaacacttcaaatccacctcaaataagaatgtgtctgttataggctggatggtcatgatggccgacgatcctgaacaccctgatctcttcttgttgacagactcagagaaaggcaactcttataagtttcaggccggaaaccgaatgaatgccatgttgtggtttaagcacctgtccgctgcttgtcagagtaacaagcagcaggtgcctacgaacttgatgacctttgaatag

SEQ ID NO: 45356 - DNA, 1674 bp, Artificial Sequence
  Description of Artificial Sequence: Synthetic coding sequence
atggacctgatgaacggccaggccagcagcgtgaacatcgccgccacagccagcgaaaaatcatcctcaagtgaaagcctatccgacaagggctctgagctgaaaaagagctttgacgccgtcgtctttgacgtccttaaggtgacgcccgaggagtacgctggccagatcacgctcatggacgtccccgtcttcaaagcaattcaaccggacgaactgagctcttgcggctggaataagaaagaaaaatactccagcgctcctaatgctgtggccttcaccaggcgctttaaccatgtaagcttttgggtggttagagagatcctacatgcgcaaacccttaagataagagccgaagttttgtcccactacatcaaaacagccaagaagctgtacgagctaaataatctgcacgcactaatggctgtggtatccgggctacagagtgctcccatcttcaggcttaccaaaacttgggctttgctaagcaggaaggacaaaactaccttcgagaagttggaatacgttatgagtaaggaagacaactacaaaagattgcgggattatataagctctctgaagatgaccccctgcattccttaccttgggatctacctttcggatttaacctatatagattccgcctatcccagtaccggtagcatcttagagaatgagcagagatccaatctgatgaataatattttgcggataatatctgacctgcaacagtcttgcgagtatgacatcccaatgctgccccatgtgcaaaaatacctcaattcagtccagtatattgaagagctgcagaagttcgtcgaggatgacaactacaagttatctctgaaaattgagcccggaacttcaactccacggtctgcagcttccagagaagacctcgtgggtccagaggtcggagcctctcctcagtctggaagaaaatctgtggctgcggagggggccctactgccccagacgccaccgagccctcgcaatctgattcctcacggtcacagaaagtgccattctttgggctataacttcatacacaagatgaataccgccgagtttaagtccgccactttccccaacgccggcccaaggcacttgcttgacgattcggttatggaaccccacgcaccctccagaggccaggcagagtccagcacattgtcgtctggtatcagtattggatcgtccgacggatctgaactgtccgaagaaacctcctggccagcatttgagtcctcggccgaaagtgaggacctcgccgtgcatttgtatcccggcgccgtcacgatccagggggtgctgcggaggaagacactgctcaaagagggtaagaagccaactgtcgctagttggactaagtattgggccgccctttgtggcacacagcttttctattatgccgcgaagtcactcaaagcaactgagcgcaagcactttaagagcaccagcaataagaacgtgtcagtgattggttggatggtgatgatggcggacgacccagagcacccagatttatttctactgacagatagcgaaaagggcaattcttacaagttccaggcaggaaatagaatgaatgcgatgctgtggttcaaacatctgagcgccgcttgccagtccaacaagcaacaagtccccactaacttgatgaccttcgaatag

SEQ ID NO: 45357 - DNA, 1752 bp, Artificial Sequence
  Description of Artificial Sequence: Synthetic coding sequence
atggacctgatgaacggccaggccagcagcgtgaacatcgccgccacggcctccgagaaatccagttctagtgagtcactgagcgacaaaggaagcgaacttaagaagagttttgatgccgtcgtatttgatgtgctgaaggttactcctgaggagtatgccggtcagattacactcatggatgtgcccgtgtttaaagctattcaaccggacgagttgagcagttgtggttggaacaaaaaagaaaaatatagttctgcgcctaatgccgtcgctttcactcgccgctttaatcatgtcagtttctgggtggtgcgggagattttgcatgcacagacgcttaagatcagggcagaagtgctgtcacactatattaagactgccaaaaagctgtacgagctcaacaatctgcatgctctgatggctgtcgtgagtggactccagagtgcgccaattttccgcctgaccaagacatgggcactcctgtcccgcaaggataagacaaccttcgagaaactggaatacgtgatgagcaaagaggataactacaaacggctcagagattacatttcctctttgaaaatgacgccctgcatcccatatttagggatttatttgtcagacctcacatatatcgactcagcctacccctctacaggcagtatccttgaaaatgagcagagaagcaatcttatgaataatatcctgagaatcatctctgacctccagcagtcttgcgaatacgacattcctatgctgccgcacgtgcagaaatacctgaactccgtgcagtatatcgaagagttacaaaaatttgttgaggatgacaactataaactctccttgaaaattgaacctggcacttccaccccaaggtcagccgcttccagagaggatctagtgggacccgaagtaggagcctcaccacaatctggaagaaaatccgttgcagctgagggggctcttctgccacagacacctccctccccaagaaatctgatccctcacgggcaccgcaagtgccactccctgggctacaacttcattcataaaatgaataccgccgaattcaaaagcgcaactttccccaatgccggcccacggcatctgttagatgattcagtgatggagccacatgcgcccagtagaggccaggctgagtctagcactttaagcagcgggatttcaatcggcagtagcgatggctcagagctgagcgaggagacttcctggccagccttcgaacggaaccgattataccactctctgggtccagtaacacgagttgcgagaaacgggtacaggagtcacatgaaggcatcttcatccgcagagagtgaagatctggccgtgcatctttatcccggcgccgtgacaattcagggcgtactgcgcagaaaaactctcctgaaggaagggaagaagcccacagttgcgtcttggaccaagtactgggctgcactttgtgggacccaactgttctactatgcagctaagtccctgaaggccacagagaggaagcattttaagtctacatcaaacaagaacgtaagcgtcattgggtggatggtgatgatggcagatgaccccgagcaccctgatctgttcctcttgactgactccgagaaagggaattcttataaatttcaggccggcaatcgcatgaacgctatgttgtggtttaaacacctgtctgccgcctgccaatcaaataaacagcaggtgcccacaaatctgatgaccttcgagtag

SEQ ID NO: 45358 - DNA, 699 bp, Artificial Sequence
  Description of Artificial Sequence: Synthetic coding sequence
atgaacaccgccgagttcaagagcgccaccttccccaacgccggcccgcgacatttgctcgatgattcggtgatggaaccacatgcaccaagtcggggccaggcagaatcctcgactttgtcgtcagggatctctattggttcctctgacggctcggaactgtcggaggagacgagttggcctgcatttgagcggaaccggctgtatcatagcctgggtcccgtcacccgggtggctcgaaacggctatagatctcacatgaaagcctcttccagcgccgaatctgaggatttggccgtccacctctatcctggagcagtcacaattcagggagttctccgcagaaaaactctcttgaaggaagggaaaaagccgacggtagcctcctggaccaaatactgggcagctctatgcggcacacagctattctattatgccgcgaaatcactcaaggcaacagagcgaaagcatttcaaaagcacttccaataagaatgtgtcagtgattggatggatggtgatgatggcagatgaccccgagcaccccgatctctttctgctgactgatagcgagaaaggaaattcctataagttccaggctggaaatcggatgaacgccatgctctggttcaagcatcttagcgcagcttgccagagcaacaagcagcaggtgccaacaaacttaatgacatttgagtag

SEQ ID NO: 45359 - DNA, 2388 bp, Artificial Sequence
  Description of Artificial Sequence: Synthetic coding sequence
atggagggcctgaccctgagcgacgccgagcagaagtactacagcgacctgttctcctactgtgacattgaaagcaccaaaaaagttgtggtgaatggcagagtccttgaactttttagagctgctcaactgcctaatgatgtcgttctacagatcatggaactctgcggggccacaagattgggctatttcggccgatcacagttctatattgcactgaaactagttgctgttgcccagagcggctttcccctccgagtcgagtccataaacactgttaaagacctgcctttgccacgattcgtggccagcaagaatgagcaggagagccgccacgcagcctcttatagtagtgatagcgagaaccaaggcagctattctggagtgattccgcctccacccggccgtggccaggtgaaaaaaggtagtgtgtcccacgacaccgtgcaacctcgcacctcagcggacgctcaagagcccgcttcaccagtggtgtcacctcagcagtcacctcccacaagtccccacacctggcgtaaacatagtagacaccctagcggggggaacagtgagcgcccactggctgggccagggcccttttggtcacccttcggggaggcacagagcggcagctctgctggtgacgccgtgtggtcagggcactccccgcccccacctcaagagaattgggttagctttgccgatactcctccaacctcaacccttctgacaatgcacccggcgtcagtccaagatcaaacgacagtgcggacagtggcaagcgctactactgctatcgaaatcagaaggcagtcctcaagctacgatgacccatggaagatcacggacgagcagcggcaatattatgtgaaccagttcaagacaatccagcccgatctcaatgggtttataccagggtctgccgctaaggaattctttaccaaatccaaactgcccatcctggagctgagccatatttgggaattgagcgactttgataaggatggtgctctaaccctggacgaattctgcgctgcctttcaccttgtggtcgcgcgaaaaaacggatacgacctccctgagaagcttcccgaatcactgatgcccaaactcatagacctcgaagacagtgccgatgtgggcgaccagccaggcgaggtcggatacagcgggtccccagcagaggcccctccatctaaaagcccgtcaatgccctccctaaaccagacgtggcctgagcttaatcagtcctccgagcaatgggaaacgttctcggagcgaagctctagctcccaaacgctgactcagtttgacagcaatattgctcctgctgatccggatactgcgattgttcaccctgtaccaattcgaatgactccaagtaaaatacacatgcaagaaatggaactgaaacgaacaggtagcgaccacaccaatccaacctccccgctgttagtcaagccttcagacctgctggaagaaaacaagatcaattcatccgtaaaatttgcaagtggaaacacggtcgacggctattccagttccgattccttcacctctgatcctgagcaaatcggcagtaacgtgacaagacagaggagtcatagtggaacatctcctgacaatacagcacctccgccacctcctccaaggccgcagccaagccactcccggtcttcttcgctggatatgaacaggaccttcaccgtcaccaccggacaacagcaggccggcgtcgtggcccatccacccgctgtgcccccacgcccgcaaccttcacaggcacctggacctgcagtgcatcggccagtggatgctgacggcttaataacccatacatccacctccccccagcagatccctgagcagcctaacttcgccgacttcagccaattcgaggtgttcgccgcatctaacgttaatgacgagcaggacgatgaggcggagaaacaccccgaggtactgcccgccgaaaaagcctcagatccagcctcctctcttagggtggcaaagaccgattcaaaaactgaggagaagaccgccgcctctgcccctgcaaacgtgtccaaagggacaacccccctagcccctccccctaaaccagtcaggcggcgtctcaaatcagaagatgagttgaggcccgaggtggacgagcacacccagaaaacaggggtattagccgcggttctcgctagtcagcctagcattccgaggtctgtcggcaaggacaagaaggccattcaggctagcatcagaaggaacaaggagacaaacactgtccttgccaggctgaattccgaattacagcagcaactcaaggatgtgctcgaggagcggatatcattggaggtgcagctggaacaactgaggccgttcagtcacctgtag

SEQ ID NO: 45360 - DNA, 2310 bp, Artificial Sequence
  Description of Artificial Sequence: Synthetic coding sequence
atggagggcctgaccctgagcgacgccgagcagaagtactacagcgacttgtttagttactgtgatattgagtctacaaaaaaggtcgtggtgaacggtcgagttctggagctgtttcgggcagctcagctgcctaacgatgtggtgctgcagattatggagctttgcggggccactaggcttgggtactttggacgctcacaattctacatagctttgaagctggtcgctgtggcccagagtggattccctctaagggtggaatcaatcaataccgtgaaggacctgcccttaccccgcttcgtcgccagcaagaatgagcaagagagtcggcatgcagcatcttattcaagcgactccgaaaatcaagggagctattccggtgtcatcccccctcctccagggcgtggacaggttaagaaaggttcggtgtctcacgataccgtgcagccgcggacttccgccgacgcacaggaacctgccagccccgtagtgtcacctcagcagtctccccctacctccccacacacatggaggaagcatagtagacacccctctggaggcaattccgagcgccccttggctggccctggaccgttctggtccccatttggtgaagcgcagagcggatcgtccgcaggtgacgcggtgtggtctggacactccccccctcctcctcaagaaaattgggtgagttttgcagatacacctccaacatcaactcttctcaccatgcaccctgcctcggttcaggatcaaacaacagtaaggacagttgcatccgcaacaaccgcaattgaaatacgtaggcagtcttcctcctatgacgatccgtggaaaataacagacgagcagcggcaatattatgtgaaccagttcaagactattcagccggacctgaatggatttatccctgggagtgctgctaaggagttcttcaccaaatccaagcttcccatcctcgaactgtctcacatctgggagctctctgattttgacaaagacggggctctgactctggatgagttctgcgctgccttccacctcgtggttgcccgtaagaatgggtatgacctacccgaaaaactgcctgagagcttaatgccgaagctgattgatctagaggatagcgcggacgtcggagaccagcctggagaggtgggctactccggttcccctgctgaggcccccccatccaaaagcccgagcatgccttctttgaatcagacttggccagaactaaatcagtcctctgaggacaccgccatcgttcaccccgtcccgatacgtatgacaccatccaagatccacatgcaggagatggaacttaagcggactggctcagaccatactaatccaaccagccccctcctggttaagccgagcgacctgctggaggaaaacaaaattaattccagtgttaagttcgccagcggcaatacagtggctgatggttactccagttcagacagctttactagcgacccagaacagatcggctcaaatgtgacaagacagcggtcacacagcgggacatcacctgacaataccgctcccccacctccaccacctagaccgcaaccaagccattcacggtccagttcactggacatgaaccggacctttacagtaacaacggggcaacagcaggcaggagtggttgctcaccccccagctgtgccaccccgacctcagcctagccaggcccccgggcctgctgtgcacaggcccgtggatgcagacggcctgatcactcatacttcaaccagtccacagcagattcctgaacagcccaattttgcggacttcagccaatttgaggtcttcgccgcctcaaacgtcaatgatgaacaggacgatgaggccgaaaaacaccctgaagtcctgcccgcagagaaggcatccgatccggcctcaagcttgagggtggccaagacagactctaagaccgaagaaaaaactgcggcaagcgctcccgcaaacgtgagcaagggaaccacacccttggcccccccaccaaagcctgtcagacggagattgaaatccgaagacgagctgcgccctgaggtggacgagcacactcagaaaacaggagtcctggcagcagttctcgcatcccagccttcgattccaagaagcgtgggaaaggacaagaaggctattcaagcctccatacggcggaacaaagagactaataccgtgctagcccgccttaactctgagttacagcaacagctcaaggacgtgttggaggaaagaattagcctggaggtgcagctggaacagctcaggcctttcagtcacctgtag

SEQ ID NO: 45361 - DNA, 2235 bp, Artificial Sequence
  Description of Artificial Sequence: Synthetic coding sequence
atggagctgtgcggcgccacccggctgggctacttcggccggagccagttttacatagcattgaagctagttgccgtggcccagtcaggcttccccctcagggttgaatcaataaacactgttaaagatttaccacttcccagattcgtagctagcaagaatgagcaggaaagccggcatgccgcgtcctactcatccgatagcgaaaaccaaggatcttactcaggggtaatccccccgcccccgggccggggacaggtcaagaagggcagcgtgtctcatgacaccgtgcagccccgcacaagcgctgacgctcaagagcctgccagccccgttgtgagcccccagcaatcaccacctacaagcccacacacatggagaaagcattcacggcatcctagcgggggcaacagtgagaggcctctggcgggaccgggcccattttggtcaccctttggggaggcacaaagtgggtcctcagccggggacgccgtgtggtccggccactcccctccccctcctcaagagaattgggtgagtttcgcggacaccccccctacttcaaccctcctgacaatgcatccagcatcagtgcaggaccaaacaaccgtgcggactgtggcctccgcaactacggctatagagatcagaagacagtcttcttcctacgatgatccttggaaaattacagacgaacagaggcagtattatgtcaaccagtttaaaacgatccagcctgatctgaacggctttatccccggtagtgcggcgaaagagtttttcaccaagagtaagctgcccatcctggaactgtcacatatctgggagctatctgattttgacaaagatggtgccctgacgcttgacgagttctgtgccgcctttcatctcgtggtggccagaaagaatggctacgatctgccagagaaactgccggagtcgctcatgcccaaactcattgacttggaggattctgctgatgtgggcgatcaaccgggcgaagttggatactctggatcaccagcagaagccccacccagcaaaagtccttcaatgcccagcctgaaccagacctggcctgaactgaatcagagctccgaacagtgggaaacctttagcgaaagaagctcctcttcacaaacattgactcagttcgattctaacatagccccagctgaccctgataccgctatcgtgcatccagtccccatcaggatgacgccatctaagatccacatgcaagaaatggaactgaaacgcaccgggtccgatcacactaatccgaccagcccacttctcgtgaagccatcagacctcctggaagaaaataagatcaacagtagcgtgaagtttgccagtggcaacacagtagccgacgggtacagcagtagcgacagtttcactagcgacccagagcagattgggagcaatgtgacccgccagagaagccatagtggcacgtcaccagataacacagctccacctccacccccacctaggccgcaaccaagccattcccgctcttcatctctcgacatgaatcgcacattcaccgtgacgactgggcagcagcaggcgggtgtggtcgcccatccaccggccgtgcctccaagaccccagccttcccaggcaccaggccccgccgtgcacaggccggtcgatgccgacgggctgatcacccacacatccacaagcccacagcagattcccgaacagcctaacttcgccgactttagccagtttgaggtgttcgccgcctccaatgtgaacgacgaacaggatgacgaggcagagaaacaccccgaggtgcttcccgccgagaaggcatctgatccagcttcaagtctaagagtggcgaagacagacagtaagaccgaagagaaaaccgcagcatcagctccagccaatgtgagcaaggggactacccccctcgctcccccacctaagccggtgcggaggcgcctcaagtccgaggacgagcttcgtccagaggtggacgaacacacacaaaagaccggtgtcctggccgctgttttagcatcccaaccctccatccccaggtctgtcgggaaggacaaaaaagccatccaggcgtcaatccgaaggaataaggaaacgaacacagtcctagcgcgtttaaactcagagttgcagcaacagctgaaagacgtcttggaggagagaatttctctagaggtgcagctggaacagctgaggcctttttctcacctgtag

SEQ ID NO: 45362 - DNA, 2118 bp, Artificial Sequence
  Description of Artificial Sequence: Synthetic coding sequence
atggagggcctgaccctgagcgacgccgagcagaagtactacagcgacctgttcagctattgtgatattgaatccactaagaaagtggtagtcaacggtcgagtgctggagctcttcagagccgcccagctcccaaacgacgttgtactccagattatggagctgtgtggcgcaactagactgggatactttggcagatcccagttctatatcgcactcaagcttgtcgcggtagcgcagtccgggtttcctctcagagtggagtctatcaacactgtcaaagacctgcctctacctagatttgtggcctccaaaaacgagcaggagagccggcacgcagcatcttactcatcggactcagagaatcaagggagctactctggtgtgatcccccctccccctggacgaggtcaggtgaaaaagggaagtgtgtcacacgatacagtccagccacgtacatcagccgacgcccaagaaccagcttccccagtggtatccccgcagcagagtccacccacgtccccccacacatggagaaagcacagcagacatcccagtggagggaactctgaacgccccttggcgggtccaggtcctttctggtctcccttcggggaagcccagagtgggagttcggccggagatgccgtctggtcagggcacagtccaccacccccccaggagaattgggtatcttttgccgataccccacccactagcacgctgctcaccatgcatcccgcttcagtacaggatcaaaccacagtccgaacagtggctagcgcgactaccgcaatcgaaattagaaggcagtcctccagttatgatgacccatggaaaattacagacgagcagagacagtattacgtcaaccaattcaaaaccattcagcccgatttaaatggctttattcccggatccgctgcgaaagaattttttaccaagagtaagctgccaattctcgaactatcacatatctgggagctcagcgactttgataaggatggtgctctgactctcgacgagttctgcgccgcttttcacctggtggtcgcccggaagaatgggtatgatctccctgagaaattacctgaatcactgatgccgaagctcatcgatctggaagatagcgccgacgtgggcgatcaacctggcgaagtggggtattccgggtcacctgccgaggctcccccctccaaaagcccaagcatgccgagcctcaatcagacctggcccgagttgaaccaaagttctgaggataccgcaattgtgcaccccgttcccattaggatgacccctagtaagatacatatgcaggaaatggagctgaagcggactggctcagaccacacaaatccaacctcccccctgctcgtcaagccctccgatctgttagaggaaaacaaaattaatagtagcgtgaaattcgcctctggtaacacagtggggcagcagcaggcgggggtcgttgctcatccacctgccgtgcccccgagaccgcagccgagccaagctccaggccccgcagtgcaccgcccggtggacgcagacggcttgattacccatacaagcacctcaccccagcagatacctgaacagcccaacttcgcagacttttctcagttcgaggtgtttgccgcctccaatgttaacgacgagcaggacgatgaagctgagaaacatcctgaagttctaccggcggagaaagcatccgaccccgcctcgtcactgagggtggctaaaactgacagcaaaacagaggagaagacagccgccagcgcccccgcaaacgtatccaagggcacaacccctctggctccaccacccaagccagtgaggcggaggctgaaatccgaggacgaacttagacctgaggtcgacgagcacactcaaaagacaggggtgctggctgccgtcctggcttctcagccgtccataccccggtcggtggggaaagataaaaaagctatccaagccagtatcaggcggaacaaagagaccaatactgtcctcgcccgactaaactccgagctacaacagcaattgaaagacgtcttggaggaaaggatatctcttgaggtgcaactggaacagttacggcccttcagccacctgtag

SEQ ID NO: 45363 - DNA, 2391 bp, Artificial Sequence
  Description of Artificial Sequence: Synthetic coding sequence
atggagggcctgaccctgagcgacgccgagcagaagtactacagcgacctcttctcctactgcgacatcgagagcactaagaaggtggtggtgaatgggagggtcctggaactgtttagagccgcacagctccccaatgatgtggtgctgcaaattatggagttatgtggtgccactcgtctcggatacttcgggagatcgcagttttacatagcgctcaagctcgtggctgtcgcacaatcaggctttccccttcgcgtagaatcaataaatacggtgaaggacctgcccttgccacgatttgtggcgagtaaaaacgagcaggaaagccgacatgcagccagctactctagtgattccgaaaaccagggcagctattctggcgtcatccctccaccacccggccgcgggcaagttaagaagggtagcgtcagccatgacaccgtgcagccacgaaccagtgcagatgctcaggagccagcctctcctgtagtgtctccccagcagagtccacccacctctccgcacacctggcggaaacactcaaggcatccttcgggtgggaacagcgagagacctctcgcaggacctgggccgttctggtcccctttcggggaggcccaatctggctcaagtgcaggtgacgccgtgtggtccggtcacagtccacctcccccacaggagaattgggtatcctttgctgacaccccacccacctctacccttctcacaatgcaccccgcatcagttcaggaccagacgacggtgaggacagtggcctcagcgacgacagcaatcgaaattaggagacagtcgagcagttacgatgacccatggaagattactgatgaacagcggcagtattacgtcaatcagttcaaaacaatccagcccgatttaaatgggtttatcccaggcagtgctgcgaaggagttttttactaaatccaaactcccaatcctcgagctgagtcacatctgggaacttagcgactttgacaaggatggggcattgactcttgatgagttctgtgccgccttccatcttgtcgttgctcggaaaaacggttatgatctgcctgagaagcttcccgagtcattgatgccaaaattgatagacctggaagactctgccgatgtcggcgaccagcctggcgaggttggctatagcggtagccctgccgaagctccaccatccaaatcacccagcatgccgtcactgaaccagacgtggccagaactgaaccaatcctcagaacaatgggagactttcagcgaacgctctagcagctctcagacactcactcagtttgacagcaacattgcacccgccgatccagacactgctattgtccatcccgttcctattcggatgacgccatcaaagatccatatgcaggagatggaattaaaacggacaggctcagaccacaccaatcccacttcccctctgctcgtcaaaccaagcgatctgctcgaggagaataaaattaactcttcggtgaagttcgcctctggcaacacagtcgctgacggatattctagcagcgactcgtttacctctgaccctgagcagatcggaagcaacgttacacgacagaggtctcactcagggacaagccctgataatacagctccaccaccgccacctccgagacctcaacccagccattctagatcgtcatcacttgacatgaatcgtacttttaccgtgaccactggtcaacagcaggccggtgtagtggcacatccaccggcagtgcctccaagaccccagccctcccaagcacccggtcctgcagtccaccggcccgtagacgccgacggcctgataactcacacctccacctccccacagcagattccagaacagcccaactttgctgacttctcccagtttgaggtctttgccgcatccaatgtcaacgatgagcaggacgatgaggcagaaaagcatccagaggtgctgcctgccgagaaagcctccgatcctgccagtagcctgcgcgtggctaagacggactcaaagacagaagaaaagactgccgctagcgcccccgccaatgtgtccaaaggaactactcccctggcgccaccgccaaagcccgtccgaagacgccttaagtccgaggatgaactcaggcctgaagtggatgaacatacgcagaaaacgggtgttctggccgcggttctggcttcacagccgagcataccccgaagtgtgggaaaggataaaaaggcgattcaagcatccatccggagaaataaggaaaccaataccgtgttagcaagactcaatagtgagttgcaacaacagctgaaagacgtactggaagagcgaatttccttggaggtccagttggaacagcttcggcccttctcgcacttgtag

SEQ ID NO: 45364 - DNA, 441 bp, Artificial Sequence
  Description of Artificial Sequence: Synthetic coding sequence
gagctgaaccagagcagcgagtgggagaccttcagcgagcggagctcctcaagtcagaccctgacgcagttcgacagcaatattgcacctgccgaccccgatacagcaatcgtacaccctgtgcctatcagaatgactccttctaagattcacatgcaagaaatggaactgaaacgtacagggagcgatcataccaatccaacatcacctctgttggtaaagccatctgacctgctggaagagaataagatcaacagctctgtgaagttcgctagcggcaacacagtgggtcagcagcaggctggagtagtagcccacccaccagctgttcctcccaggcctcaaccctcacaggccccaggacctgctgtgcaccgccccgttgatgctgatggcctgatcacccatacttccacttcgcctcaacaaatacctgagtag

SEQ ID NO: 45365 - DNA, 1398 bp, Artificial Sequence
  Description of Artificial Sequence: Synthetic coding sequence
atgaccaccatcccccggaagggcagcagccacctgcccggcagcctacacacgtgcaagctgaaattacaggaggatcgaagacagcaggaaaaatctgtgatagcacagccgatattcgtcttcgagaaaggagagcagactttcaaacgtcctgctgaagatacactttacgaggcggcagagcccgagtgtaacgggtttcccactaaacgcgtaaggagcagtagctttacgtttcatattactgacagccagtcccagggcgtgcggaagaacaacgtgtttatgacttctgccctggtccaatcgagcgtcgatataaagagcgccgagcagggacctgtgaaacacagtaaacatgttattcgaccagctattcttcagctcccccaggccaggagttgtgccaaggtgcgcaaaacctttggccacaaggccctggaatcctgcaagactaaagaaaaaacaaacaacaagatctctgagggcaacagctacctgcttagcgaaaacttgtctcgcgcacgcataagcgtgcaactctcaacaaaccaggacttccttggggccacttccgtaggatgtcagcctaatgaggacaagtgctcctttaagtcttgctcatctaatttcgtctttggcgaaaatatggtggagcgagtccttggtactcagaagttgacccagccacagttggaaaatgattcttacgctaaggagaaaccgtttaagtctattcctaaatttcccgtgaattttctgtcttccaggaccgacagcatcaaaaacacgtcgttaatcgaaagtgctgccgctttctccagccaaccgtcccgcaaatgtctgctggagaagattgacgtaatcactggcgaggaaactgagcataacgttctgaagataaactgcaaactctttattttcaacaaaaccacacaaagctggattgagagaggcaggggaacactgcggctgaatgacacagcaagtacagattgtgggacactgcagagtcgattaatcatgcggaaccagggaagcctgcgactgatcctgaactccaaactgtgggcgcaaatgaaaatccagcgcgcaaaccataaaaatgtacgaattactgccacagatctggaagattacagtattaagatctttctgattcaggcatcagcccaggacacagcttatctctatgctgccatccaccaccgtttggtggccctccaatcattcaacaagcagcgggacgtgaaccaggccgagtccttgagtgaaacagcccagcaactcaattgcgaaagctgcgacgaaaacgaggacgacttcatccaagtcacaaagaacggcagcgatccgtcctcctggactcatcgtcagagcgttgcttgttcctag

SEQ ID NO: 45366 - DNA, 327 bp, Artificial Sequence
  Description of Artificial Sequence: Synthetic coding sequence
atgaccaccatcccccggaagggcagcagccacctgcccggcagcttgcatacatgtaaattgaaactgcaggaggatcgaaggcaacaggagaaatctgttatcgcccagcccatctttgttttcgagaagggagaacaaacgttcaagcggcctgcggaggacacgctctatgaagctgcggaacctgagtgtaatggattccccaccaagcgcgtcaggagcagctccttcacattccacatcaccgattcgcagagccagggtgtgcggaagaacaacgtgttcatgacttccgcgctcgtccagtcttctgtcgatatttag

SEQ ID NO: 45367 - DNA, 1473 bp, Artificial Sequence
  Description of Artificial Sequence: Synthetic coding sequence
atgaccaccatcccccggaagggcagcagccacctgcccggcagcctgcacacctgtaagttgaagcttcaggaggacaggcggcagcaggagaaatctgtgatcgcccaacccattttcgtgtttgagaaaggcgagcagacgttcaagcggcccgccgaagacacgctgtacgaagccgccgagcctgaatgcaacgggtttccaacaaagcgcgtgcgaagctcatctttcacatttcacattaccgacagtcagtcccagggcgtgtccacattgagccaaaagcaaatgcgctgctccagtgttaccaatcttccaacattccctcattcgggccctgtgaggaagaacaacgtgtttatgaccagtgccctcgttcagtcctctgtggatatcaaaagtgctgaacaggggcccgtgaagcacagtaaacacgtcatccgccccgccatcctgcaactaccccaggcaaggtcgtgcgctaaggtgcggaagactttcggacataaagcattagagagctgcaagactaaggagaagacaaataacaaaattagcgagggtaatagttatctcttgtcggaaaatttgtctagagctagaattagtgtacaactgtctacaaatcaggacttcttgggggctaccagtgtagggtgccagcccaatgaggacaagtgctctttcaaatcctgttccagtaacttcgttttcggcgagaatatggtggaaagagtgctagggacccagaaactcacgcagccccagctcgagaacgatagttacgccaaggaaaaaccctttaaatcaatcccaaagttccctgtgaactttctcagctcacgaactgactctataaaaaacacttctttgatagagtcagctgctgctttcagttcccagcctagtaggaaatgtctccttgagaaaattgatgtgatcaccggagaagaaaccgagcacaatgtgttgaagattaactgcaagcttttcatttttaataaaacaacccagagctggatcgagaggggacgcggaacactacgcctcaatgatacagcgtccactgactgtggtacgctccagtccagactgataatgagaaatcagggttcactgcgtctaattctgaattctaaactgtgggcacaaatgaagatccagagagcaaaccacaaaaatgttcggataactgccactgatctggaagactacagcatcaaaattttccttattcaagcttctgcacaggacacagcctacctgtatgcagcgatacaccacagattggtggcactgcagagcttcaacaagcaacgggatgtgaatcaagctgaaagcctgagcgagacagcccagcagctcaattgtgaaagctgtgatgagaacgaggacgactttatccaagttacaaagaacgggtccgatccatcatcctggactcaccgacagagtgtcgcctgtagctag

SEQ ID NO: 45368 - DNA, 4500 bp, Artificial Sequence
  Description of Artificial Sequence: Synthetic coding sequence
atgaagcccctggccatccccgccaaccacggcgtgatgggccagcaggagaagcactcactgcccgcagactttacaaaactgcatttaaccgactccctacaccctcaggtaacccacgtgtcctccagccactctggctgctcaataacgtccgactctggtagcagctccctaagcgatatctatcaagcaaccgagagcgaagctggcgacatggatctgagcgggctccccgagactgctgtggattccgaggacgatgatgatgaggaagatatagagagagcctccgacccgttaatgtcccgggatatagtgcgagactgtctggaaaaggaccccatcgatcgaaccgacgatgacattgagcaactcttagagttcatgcatcagctccccgcttttgctaacatgaccatgagcgtgcggagagagctgtgcgccgtcatggtttttgccgttgtggagcgggctggcaccatcgtattgaatgatggcgaagagctcgacagttggagtgtgattctgaacgggagcgtggaggtgacctaccccgacggaaaggccgaaattctgtgtatgggaaatagctttggcgtaagtcccacgatggataaagagtatatgaaaggggtaatgaggaccaaggtggatgactgccaattcgtgtgtattgcccagcaggactactgccgtattcttaaccaggttgaaaagaatatgcagaaggtcgaggaggagggggaaatagtcatggttaaagaacatcgtgagctagacaggaccggcacacgaaagggccacatcgtcattaagggtaccagcgaaagattgacaatgcatctggtagaggagcactccgtggtcgatccaacattcatagaggattttcttctgacttatcgcactttcctgtcaagtcctatggaggtgggtaagaaactgcttgagtggtttaacgatccctccctccgtgacaaggtgactagggttgttctgctgtgggtaaataaccacttcaacgattttgaaggcgacccagccatgacaaggttcctggaggaatttgaaaataacctcgaaagagagaagatgggtggacatttgcgcctgttaaatattgcatgtgctgcgaaggccaagaggagactgatgaccctgacgaagcccagcagagaggcgccgctcccctttattctgctgggagggagcgaaaaagggttcggcattttcgtcgactccgtggactctggtagcaaggctaccgaagcggggctcaagagaggtgaccaaattttagaggtaaacggtcagaacttcgagaacattcagctttctaaggcaatggaaattctgcgaaataatactcacctgtctattacagtgaagacaaatctgttcgtgttcaaggagctccttaccagactgagtgaagaaaaacggaacggggcccctcacttgcctaagatcggtgacatcaagaaagcatccaggtatagtatacctgacctcgcggtcgacgtggaacaggttatcgggcttgaaaaggtgaataaaaagagcaaggccaataccgttggaggacgtaataaactcaagaaaattctggacaagacaaggatctcgattcttccgcaaaaaccgtataacgacattggcatcggacaatcccaggacgactctatcgtcggcttgcgtcagaccaagcacattccaacggccttaccagtctcaggcacattgtcatcttctaatcccgacttactacagagtcatcatagaattctggactttagcgccacacccgatttgcctgatcaggtcctgcgcgtgtttaaagcagatcagcagagcaggtatataatgatttcaaaagacacgaccgctaaagaggttgtcattcaggcaatcagagaatttgcggtgacagcaaccccagatcagtatagtttgtgtgaggtctcagtaacacccgagggtgtgatcaagcagcgtaggctgcctgatcagctgtcaaagcttgccgacaggattcaactatccggacgctattatcttaagaacaacatggaaacagagaccctgtgcagcgatgaagatgcccaggagctcctgcgagagtctcaaatctccctgcttcagctcagcactgtggaggttgctacacagctgtctatgcggaatttcgagctgttcaggaacatagaaccaacagaatacatagacgacctctttaagctcaggagcaaaacgtcgtgtgctaacttaaagagattcgaagaagtaattaatcaggagactttctgggtggcctccgagatccttcgtgaaacgaaccagctgaagaggatgaaaataattaaacactttattaagatcgccttgcactgtcgcgagtgcaagaatttcaatagcatgttcgcaatcatttccggcttaaacctggctccagttgctagactgcggacaacatgggagaaacttcctaacaaatacgagaaactgttccaagacttgcaagatctatttgaccctagccgaaatatggcaaaataccggaacgtcttaaattcccagaatctccagccaccaatcataccactctttccggttattaagaaggacctgactttcctgcacgaggggaacgactccaaggtggatggactggtgaacttcgaaaaactccgcatgattgcaaaggaaattaggcacgtgggtagaatggccagtgtcaacatggaccccgccctaatgttccgtacaagaaagaagaagtggaggagtctcggctcactttcccagggtagtactaacgccaccgtcctggatgtggcgcaaactggagggcacaaaaaaagggtcagaagaagctctttcctaaatgccaaaaagctgtatgaagacgctcagatggccagaaaggttaaacagtacctctcgaacctggaactcgaaatggacgaagagtcgctccagacactgtccctccagtgcgaacctgcgacaaacacactcccaaagaaccccggcgacaagaaacctgtgaaatctgaaaccagccctgtcgcgcccagagctgggtcccaacaaaaggcacaatccctgccacagcctcagcagcagcctcccccagcccataagatcaaccagggacttcaggtccccgctgtgtccctttatcccagccgcaagaaagttccagttaaggacttaccgccatttgggatcaacagtccacaagccctgaagaaaattctgtcactcagcgaagaaggctctctcgagaggcataaaaagcaggctgaggatacgattagcaacgcgtcctctcagctgagttctccacccacaagtcctcagtcttctccacgaaagggatacactctcgcaccaagtggcactgtcgacaattttagcgacagcggtcactctgaaatcagctcccgcagctcgatcgtttccaactccagctttgatagcgtgcccgtgtccttacacgatgagaggagacaaagacatagtgtgagcatcgtggagactaatctcgggatgggccgcatggaaaggagaaccatgatcgagcccgatcaatactcccttggttcctacgcccctatgagcgaaggcaggggcttgtacgcgactgccacagtgatctcttcccccagtacggaggagcttagccaggatcaaggtgatagagcctccctcgatgcggccgatagcggacgcggtagctggactagttgttcaagtggcagtcacgacaatatccagacaatccagcaccaaagatcttgggagaccctgcctttcggacacacccatttcgattactccggtgacccagcaggtttgtgggctagtagctcccatatggatcagatcatgttctcagatcacagcacaaagtacaatcgacagaatcaaagccgggaatctcttgaacaagctcagagtcgcgcaagctgggcctctagcaccgggtactggggggaagattccgagggcgataccggcaccatcaagaggagaggaggtaaggacgtcagcatcgaggccgagagctcaagcctgacgtccgtgacaactgaagaaaccaagccagtgcccatgccagcccatattgccgttgcgagcagcacaacaaagggcctgatcgcacggaaagagggcaggtacagagaaccacctcctacgcctcccggatatattggcatacccatcaccgatttccccgaggggcattcccacccagctcgcaagccacctgactataatgtggctctgcagcggtctagaatggtggcacggagtagtgacaccgccggaccatcatctgttcagcagccccatgggcatcccacctctagcagacctgtaaacaagccacagtggcacaaacccaacgaatccgatcctcgccttgccccttatcaatcccaagggttttccacggaagaagatgaagacgaacaggtctctgccgtctag

SEQ ID NO: 45369 - DNA, 2646 bp, Artificial Sequence
  Description of Artificial Sequence: Synthetic coding sequence
atggtgctgcggcggatgcaccggccccggagctgcagctaccagcttctcctagaacatcagagaccttcttgcattcagggacttcggtggacgccactcaccaattctgaggagagcctggatttcagcgagtccctggagcaggctagcacggagcgagtgctgcgtgccgggagacagctgcatagacacctgcttgctacctgccccaacctgatcagggatagaaaataccatctccgcctgtatagacagtgttgctctggcagagagcttgtagacggtatcctggcacttggcttgggcgtgcattcacgctcccaggtggtcggcatctgtcaagtccttcttgatgaaggagctctgtgccatgtgaagcatgattgggccttccaggatagagatgcccagttctatcgatttcccggccccgaacccgagcccgtgcggacacacgagatggaagaggagcttgccgaagccgtagcactgctttcccagcggggtcccgatgcactgcttaccgtggctctgagaaaaccacccgggcagcggacagacgaagagttggaccttatcttcgaagaactactgcacatcaaagctgttgcccacctatcgaattccgtgaagcgcgaacttgcagccgtgctcctgtttgaacctcacagtaaagccgggaccgtgctgttttctcagggggataaagggacctcttggtacatcatttggaagggatccgtgaacgtcgttacccacgggaaaggcttagtcactacattgcacgagggggacgattttgggcaactggctttagtaaacgatgcccctcgcgccgccacaatcattctgcgtgaggacaactgtcatttccttcgggtcgacaagcaagattttaacaggattatcaaagacgtggaggccaagacaatgagactagaggagcatggtaaagtggtgctagtccttgagagagccagtcagggtgcgggtccatcaaggcctcccacacccgggcgcaatcgatacacagttatgagtggcactcctgagaagattttggagctcctcctggaagcgatgggaccagactcaagtgcacacgatccgaccgagaccttcttaagtgacttcctgcttactcatcgcgtgttcatgccttccgcccagctctgtgctgcactccttcatcatttccatgtcgaacctgcggggggatcggagcaggaacgatccacgtacgtgtgcaacaagcggcaacagatcctcaggctcgtaagccagtgggtcgctttgtacggtagcatgctccacaccgatccggtagccactagcttcctgcagaagttatccgaccttgtggggagggacacaagactttccaacttgcttcgggagcagtggcctgagaggcgaagatgccatcgccttgagaatggctgtgggaacgcgtcccctcaaatgaaagccagaaacctgcccgtgtggctgcctaatcaggatgaaccactgccgggtagctcctgtgccattcaggtcggagacaaagtgccctacgacatctgccggcctgatcatagtgtgctgacactccagttgcccgtaaccgcctcagtgcgcgaagtgatggctgcattagcccaggaagatggatggacaaaaggacaggtgctggttaaggtgaactccgctggagatgccattggattacagcccgatgcaagaggcgtggccacttctctggggctgaatgaaaggctatttgttgtgaaccctcaggaggtgcacgagctgatcccccacccggaccagcttggtccgactgtgggctcagccgaaggtctcgacttggttagcgctaaggatctcgccgggcaactgaccgaccacgattggtctctgttcaactcgattcatcaggtcgagctgatacactacgtgttggggcctcaacatttgcgggacgtgaccaccgcgaatctcgagaggtttatgagacgctttaacgagcttcaatactgggtcgcaaccgagctgtgtctgtgtcccgtacctgggccacgtgctcagttgctccgaaaattcattaaactggccgctcatctcaaggagcagaaaaacctgaactctttcttcgctgtgatgtttggattaagtaactccgcaataagtcgcctcgcacacacatgggagcgattgcctcacaaagtgcgtaagctttacagcgcccttgaaagactgttagacccctcctggaatcaccgagtctatagactcgccctcgcaaaattatcaccccctgtaattcccttcatgcctctcttgttgaaagacatgactttcatccatgaagggaatcacaccctcgtggaaaatttgataaatttcgaaaagatgagaatgatggctcgggccgctagaatgctccatcactgcagatcccacaatcccgtgccactctcccccctgaggagccgggtctcccacctgcacgaggacagccaagtcgcccgaataagcacctgttcagagcagagcctttctacccggtctccggcgagcacctgggcctacgtgcaacagttgaaggtgattgacaaccaacgggagctgagccggctttcaagagagcttgagccttag

SEQ ID NO: 45370 - DNA, 2646 bp, Artificial Sequence
  Description of Artificial Sequence: Synthetic coding sequence
atggtgctgcggcggatgcaccggccccggagctgcagctaccagctgctgctcgagcatcaaagaccttcgtgcatacagggactgcgatggacccctcttactaattcagaggaatctctggattttagtgaatccctcgaacaggccagcacagagcgtgttctccgggcgggccggcagctccaccgccaccttctcgccacgtgccctaacctcatccgcgacagaaaataccacctccgcctgtaccgacaatgttgctcgggacgcgagctagtagacgggatcctggctctgggcctgggtgtccattcccgatctcaggtcgtcggtatttgtcaggtgctgcttgacgagggggccttatgtcatgtgaagcacgactgggcctttcaggatcgtgacgcccagttttatagatttcccggtcccgaacccgagccagtgcgtacccacgagatggaagaagagcttgcggaagcagtggctctgctctctcagagaggaccggatgctcttcttaccgtggccctgaggaaacccccaggacaaaggacagacgaagaattggacctgattttcgaagaactgttgcatatcaaggcggttgctcatctctccaacagcgttaaaagagagctcgcggccgtgctcctgtttgaaccccattctaaagcgggcactgttctcttttcacagggggacaaggggacaagctggtatattatctggaagggctcagttaacgtagtcactcacggaaaggggttggtcaccacactgcatgagggggatgatttcggccagctcgcactggtgaacgatgctcctcgggctgctacaattattctgcgtgaggacaattgtcactttctgcgggtggataagcaggacttcaaccggatcataaaggatgtggaggccaaaactatgagactggaagagcacggtaaggtcgtgctcgttctcgaaagagcgtcccagggtgccggcccatcgcggcctcccacccctgggcggaatcggtacaccgtgatgtcaggcactccagaaaaaattctagagctgttgctggaagccatgggacctgactctagtgcgcacgatcctactgagacatttctgtcggattttcttctcactcatcgggtcttcatgccttcagcgcagctctgcgccgccctgctgcaccatttccatgtggaaccagcaggtggatcagaacaggaacggtcaacgtacgtctgcaacaagagacaacagattctgaggctcgtgagccagtgggttgccttatacggtagcatgctgcacacagatccagtcgcaacaagcttcctccagaagctgtccgacctggtcggaagagacaccaggctatctaacctgttacgtgaacagtggcccgaaagaagacggtgtcataggctagaaaacggatgtgggaacgcttccccccaaatgaaagcacgcaacctccctgtgtggctgcccaatcaagatgagccactgcccggatcttcttgcgcaattcaggtcggtgacaaagtaccttacgatatctgtaggccagatcattcagtcctgaccctgcagttgccggtgacagcaagtgttcgcgaggtgatggccgcactggctcaggaggacggatggactaaaggccaagtcttggttaaagtcaacagcgcaggggatgcgattgggttacaacccgacgcgcgaggcgttgccacctccctgggcctcaatgaaaggttgttcgtggtgaatccacaggaagtgcacgagctgattccccatccagaccaactggggcccacggtgggcagtgcagaaggactggatcttgtttcagcaaaagacctggccggacaactaaccgaccatgactggtctctctttaactccatccatcaagtcgagcttattcattatgttctcggtcctcagcatctgcgggacgtgacaaccgcgaacctggagcgctttatgcgccgattcaacgagttgcagtactgggtcgccaccgagctctgtctctgtcctgtgcctggccctagggcgcagctcctgaggaagttcattaaactcgccgcccacttgaaagagcagaaaaatctcaacagttttttcgcagtcatgtttggtctgtccaactccgcaatctcgaggctcgcgcatacttgggagagactgccccacaaagtcagaaaattgtactcggccttagagaggctcctagatccctcctggaaccaccgggtatatagactagcactggccaagctttcacctccagtgatccctttcatgccactgctgctcaaagatatgactttcatccacgaggggaaccatacactcgtcgagaatctaataaactttgaaaaaatgcggatgatggctcgggcggctagaatgctgcatcactgtagatctcataatcccgtacccctcagcccactgcgatccagggtgagtcatttgcatgaagattcccaggtggcacgcatttctacttgttccgagcaatctctcagcactagaagtcccgcttctacctgggcttacgtccagcagctcaaggtgatcgacaatcaacgagagttgtcaaggctttctcgcgaattagagccttag

SEQ ID NO: 45371 - DNA, 2772 bp, Artificial Sequence
  Description of Artificial Sequence: Synthetic coding sequence
atgaaggtgggctggcccggcgagagctgctggcaggtgggcctggccgttgaggactcccccgcactaggcgcgccacgcgttggcgccttgcctgatgtcgtgcccgaaggcaccctgctgaacatggtgctccgtagaatgcaccggccccggagctgcagctaccagttgttgcttgaacatcaaagaccatcttgcattcagggccttcgatggacacccctgactaacagcgaggagagcctcgacttctccgagagtttagagcaggcatcaacagagagagtcctccgcgccggccgtcaactccacaggcatctgctggcaacctgtccaaaccttatcagagacagaaaatatcacctgcgcttgtaccgacagtgttgctctggaagggagcttgtcgacggcattctggctctgggcttaggcgtgcactccaggagccaagtggtaggcatctgtcaggtactcctggatgagggggctctttgccacgtcaaacacgattgggctttccaggaccgggatgcccaattctaccgattccccggaccagaacctgaacccgttagaacacacgagatggaggaagagctcgccgaggccgttgcactgctatcccagagaggacctgacgccctgctgactgttgccctgagaaagccccctggacaaaggaccgatgaagagctggacttaattttcgaagaactgcttcacattaaagctgtggcccacttaagcaattcagtgaagcgggagttggccgcagtgttactgttcgagccccactcgaaggcgggtaccgtcctatttagccagggggacaaaggcacaagctggtatattatctggaagggctccgtcaacgtggtgactcacgggaaaggtctggtcaccactctgcacgaaggagacgattttggtcaactggcactcgtcaacgacgcacctcgggccgcgactatcattctgagggaggacaattgtcattttctgcgggtggataagcaggatttcaacagaattatcaaagatgtcgaagccaagacaatgcggttggaagaacatggcaaggtcgtgctcgtcttggaacgcgcatctcagggtgctggcccgagcagacctcccacccccggacggaatagatatacggtgatgagcgggacacctgagaagatcctggaattgctgctcgaagccatgggacctgattctagcgcgcacgaccctacagaaacattcctgtctgattttctgctgactcacagggtatttatgccgagtgcacaactgtgcgccgctctgcttcaccacttccacgttgagccagccggtggttcagaacaggaacgctcgacttacgtctgtaacaagcgacagcagatcctgagacttgtgtcacagtgggtggccttatacgggagcatgctgcatacggatcccgtggccacatccttcctccagaaactgtccgatctggtgggccgcgacaccaggctgagtaaccttctcagggaacagtggcctgaaaggagacgctgccaccgtctggagaatggctgcgggaacgcctctccacagatgaaggcccggaatctgcctgtttggttaccaaaccaggatgagccgttgcctggaagcagctgtgctatccaggtgggtgataaggtgccatatgatatttgtcggcccgatcacagcgttctcactctccagctgccagttaccgcatctgtaagggaagtcatggccgcccttgcacaggaagacggttggactaagggacaagttctggttaaggtgaactccgctggagatgccattgggttacagcccgatgcgagaggggtggcgacatctctgggcctgaatgagcgcttgttcgtggtgaacccccaagaggtgcacgagttgatccctcatcctgatcagctaggtccaacagtggggagcgctgaaggcctggacttggtgtcggccaaggaccttgctggtcagctaaccgatcacgactggtctcttttcaacagtatccaccaggtggagctgatccactacgtgctgggacctcaacatttgagggacgttaccactgctaatctggagaggttcatgcgccgctttaacgaactgcagtactgggtcgctacggagctctgcctgtgcccagtgccaggaccccgggctcagctgttgagaaagtttatcaagctcgctgctcacctgaaggagcagaagaacctgaacagtttcttcgccgtaatgtttggactgagtaatagcgccatcagtcgactggcccacacctgggagcgtctaccgcataaggtacgcaagctgtattcagccttggaacgcttacttgatcctagctggaaccaccgggtctacaggttggcattggcgaagctttcaccccccgttatcccctttatgcccttgctattgaaggatatgacgtttattcatgaagggaatcacacactagtagaaaacctgattaatttcgaaaagatgagaatgatggcccgggccgcacgaatgctgcaccactgtcggagtcataacccagtgccgctctctcccctgcggagtagagtgagtcatcttcatgaggacagccaagtggcgagaatcagcacctgttctgaacagtccctcagcacaaggtctcctgccagtacatgggcgtatgtccaacagttgaaggtgatcgacaatcaaagagaactgagtaggctatcgcgagaattagagccgtag

SEQ ID NO: 45372 - DNA, 1797 bp, Artificial Sequence
  Description of Artificial Sequence: Synthetic coding sequence
atgaaggtgggctggcccggcgagagctgctggcaggtgggcctggccgtggaagactcaccagctttgggagctcctcgggttggtgctcttcccgacgttgtcccagagggaacgctgctgaacatggtcctgaggaggatgcataggcctcggagttgttcctaccagttactcctcgagcaccagcgtcccagttgcattcaggggctgcgctggacccccctcactaattccgaggagtctctagacttttctgaaagcttagagcaggccagtactgaacgagtgctcagagcaggcaggcaactgcacagacacctgcttgccacctgtcctaatttgatccgggaccgcaagtaccacctgagactatatcggcagtgttgcagcggcagggagctcgtcgacggcatcctggccctcggactcggcgtccattctcggtctcaggtcgtgggcatttgccaggttctgctagatgagggggcactgtgtcatgttaagcatgactgggcttttcaggatcgagatgcacagttttaccggtttccaggccctgaacctgaaccagtgcggacacacgaaatggaagaggagctggccgaagccgtagccctgcttagccaacggggtcccgacgccctgcttactgttgcccttaggaagcccccaggccaaagaacagatgaggaactggatctgattttcgaagaactgctgcacattaaggcagtggcccatctctctaattctgtcaagcgagaactggccgcggtcctacttttcgagcctcatagcaaggcgggtacagttttgttctcacagggggataaggggacatcttggtatatcatttggaaaggttctgttaacgtggtgacccacggcaaaggtctcgtgacaactctgcacgaaggggacgatttcgggcaactggctctggtcaatgatgccccaagggcagccacaattatactgagggaggataactgccactttctgcgcgtcgataaacaggactttaatagaatcataaaagatgtagaggctaaaactatgcgccttgaagaacatggaaaggtggtcctggtgctcgagagggccagtcaaggcgccggtccatctcgcccccctactcctggaagaaacaggtataccgtgatgagtggtacccccgaaaaaatcttggagctgctgctagaggcaatggggcccgactcttcagcccacgaccccactgaaactttcctttcggactttctcctgacgcatcgagttttcatgccttccgcccagttgtgcgccgccctgttacaccattttcacgtcgagcctgctggtggatctgagcaggagcgatccacatacgtgtgcaataaacgccagcagattctcagactcgtgtcacagtgggtggccctttatggttcgatgctccataccgatcccgttgcgacttcgttccttcaaaagctgagcgacctggttggccgagacacaaggctgagcaaccttttgagggagcagtggccagagcggagacggtgtcacaggttggagaacgggtgtggaaatgcctccccccagatgaaagtgagcgcatggccacagtttctgtcttccgcgccacccggcctacaggcacctccttccccccctgaccccgagggcctgtgcgggcgcggcaaactgagtagccatcgccatacgctgggatctttgatcggggtccatggggcccttgccgcctgcggtgctctggggcaagccgtccctggtggcgcagaggcctag

SEQ ID NO: 45373 - DNA, 2607 bp, Artificial Sequence
  Description of Artificial Sequence: Synthetic coding sequence
atggcccagcgggaggagatcaagcggcccctgtgggagaccgtggggtggcccggggagtcatgttggcaggtcggactcgccgtcgaagacagccccgccctgggcgcccctagggttggagctctgcctgatgtggttcccgaagggactcttctgaatatggttctgcgcagaatgcatcggcccagaagttgttcttaccagctactcctggagcaccaacgcccttcttgcattcagggtctgaggtggacgccactgacaaattccgaggagtcattggactttagtgagtcactggagcaggctagcactgagagggtgcttcgcgcgggccgccagctccacagacatctacttgccacgtgtcccaacttaatcagagatcgtaagtatcatttgcggttgtataggcagtgctgtagtgggcgcgaactcgtcgacggaatccttgcactgggtctcggcgttcacagtcgctcccaggtggtgggaatttgtcaggttttactggatgaaggggccctgtgccatgtaaaacatgattgggcttttcaggatagagatgctcagttttatcggtttcccggacccgagccagagccagtacgaacgcatgagatggaagaagagctcgcagaggccgtggcacttctgagccagaggggtccagacgctctgctgacagtcgcactgagaaagccacctgggcaaaggactgatgaagaacttgatctcattttcgaggagcttctgcacattaaggctgtggcccatctgtcaaattctgtgaaaagggagttggccgccgttcttctcttcgagccccactctaaagccggaacggtgcttttttctcagggggataaaggcacatcctggtacatcatatggaaagggtcggtgaacgtggtgacgcatggtaagggactagtaaccaccctccacgagggagacgattttggacagcttgccctagtgaacgacgctccgcgcgccgccaccatcattttgcgcgaagacaattgccatttcctgagggtcgacaagcaggactttaacagaatcatcaaagatgtcgaagcaaaaacgatgaggctggaggagcacggaaaagtggtgttagttttagagagggcttcacagggagccggtcctagtcggccgcctactccgggcagaaaccggtataccgtcatgtctgggacaccagagaagatcctcgagctgctgctggaagcgatggggccagacagcagtgcgcacgacccaaccgaaacctttctgtccgacttcctactaacccatcgggtttttatgccatctgcgcagctctgtgcggctctcctccatcattttcacgttgagccagccggcggcagtgaacaggaacgcagcacctacgtgtgcaacaaaagacagcaaatcctcaggctggtgtcacaatgggtcgcactctacggttcaatgcttcacaccgacccggttgctacctcatttcttcaaaagctaagtgacctcgtcggaagagatactaggctcagcaacctgctcagagagcagtggcccgaaagaagaaggtgccaccgcctcgaaaacgggtgcggtaatgcttcaccccagatgaaagcccggaatctaccggtttggcttcctaaccaggacgagccacttccagggtcctcgtgtgcaatccaggtgggggacaaagacgccatcggattacagcctgacgctcggggcgtggccacaagcctgggcttgaacgagaggctgtttgtggttaacccacaagaggttcacgaacttataccgcatcccgaccagctcggtcccaccgtgggcagcgccgaaggcctggacctggtttcagctaaggacctcgctggacagctaactgaccacgattggtccctgttcaactcaatacaccaagtggaactcattcactatgtgctggggccccagcacctgcgcgatgtgactactgccaacctggaacgattcatgcgtaggtttaacgaactgcagtactgggtggctactgaactgtgtctctgcccagttcccgggcctagagcccagctgctgcgcaagttcattaaacttgccgcacacaactctgcgattagccggctggcccacacctgggagcgcctgccacacaaggtgcggaaactttatagtgctcttgagcgcctgttggatccatcttggaaccaccgcgtgtaccggctcgccctggcaaagctctcgcctcccgtgatccctttcatgcccctgctattaaaggacatgacgttcatccatgaagggaatcatactctggtcgagaacttaattaacttcgaaaagatgagaatgatggctagggctgcccgaatgctccatcactgtcggtcccacaaccctgtgcctttgagccctttgcgtagccgcgtgtcacatttgcatgaggactcccaggttgcccgaatatcaacatgtagtgaacagtctctgtccactaggagccctgcatccacctgggcttacgtccagcagctgaaagtgatcgacaatcagagggagctatcccgcctttctcgggagcttgaaccttag

SEQ ID NO: 45374 - DNA, 2646 bp, Artificial Sequence
  Description of Artificial Sequence: Synthetic coding sequence
atggtgctgcggcggatgcaccggccccggagctgcagctaccagcttctgcttgagcatcaacggccatcttgtatccagggtctcagatggacacccctcacgaattctgaggaaagcttagacttcagcgaatccctcgagcaggcctctaccgaaagagtcctgagagccgggcgtcaactacacaggcaccttctggcaacctgtcccaacctaattcgggaccggaagtaccacttacgcctgtataggcagtgctgtagcgggcgagagctggttgacggcatccttgcccttggtctgggagtgcactccagatcccaggtggtagggatatgtcaagtgctactcgacgagggtgctctgtgtcatgtgaagcacgactgggccttccaagacagggacgcccagttctaccgcttccccggtcctgagcccgaacccgtgcgcactcatgagatggaggaggaactggcagaggccgttgccttgctgagtcagcgaggaccggacgccctgctcaccgtcgccttgagaaagccaccaggccagcggacggacgaggagcttgatctcattttcgaggaactgctgcatattaaagccgtggcccatctgagcaactcggtaaaacgtgagctggcagctgtgctgctgttcgaaccacactctaaggccggcaccgtacttttctcacagggcgacaaaggaacatcctggtacattatttggaagggaagtgtcaatgtagtcacccacggcaaaggcctcgtaaccactttacatgagggtgatgactttgggcagctcgccctggtgaatgatgcacctcgcgccgccactataatactccgggaagacaactgccatttcctacgggtggataagcaagacttcaataggataattaaagatgttgaggcaaagacaatgcgtctggaggagcacggtaaggtagtgcttgtcctggaaagggcttcccagggcgctggcccttcccgcccgccaactccgggtcgtaaccgctatactgtgatgtctgggaccccagagaaaatcctcgaactcctattagaggccatgggacccgactcttccgcgcatgacccgaccgagacttttctgtctgatttccttctgactcacagagtgttcatgccttcagcccagctctgcgccgcactgctccaccacttccacgtcgagcccgcggggggcagcgaacaggagcgaagtacatacgtctgtaacaaaaggcagcagatcctaagactcgtttcgcagtgggtagcattatacggctctatgctgcacaccgaccctgtcgctacctctttcttacagaaactcagcgatcttgtcggacgagacactaggctgtccaatttactgcgggagcagtggcctgaaagacggcgatgccatagattggagaacggctgtggcaatgcctcacctcagatgaaagctcgcaacctcccagtctggcttcctaatcaggacgaaccgttacccggatcaagctgcgccatccaggtaggcgataaagtcccctacgacatctgcagacccgaccattctgttcttacattgcagcttcctgtgacagctagtgtgcgggaagtaatggcagctctcgcacaggaggatggctggactaagggtcaggtcctggttaaagtcaattcagcaggtgacgctatcggcctgcaaccagacgcccgtggtgtggctacatcactgggactgaacgaacggttgtttgtcgtgaaccctcaggaggtgcatgagctcatcccacatccagatcagttgggacctaccgtgggatctgcagaaggactggatctcgtcagcgccaaggatctggctggtcagctgactgaccacgactggtctctgttcaattccattcaccaagtggaactgattcactatgtgctcgggcctcaacacctgcgtgacgttactaccgctaaccttgagagattcatgcgaaggttcaacgagcttcagtactgggtcgctacagagctttgcctatgccccgtgcccggacctcgcgcccagttactcagaaaattcattaagttagctgcccatttgaaggaacaaaaaaacctgaattcctttttcgccgtcatgttcggcctcagcaactcggcgatctcgagattggcacacacgtgggagaggctcccccataaggtacgaaaattgtacagcgcgctggagcggctgttggatccaagctggaaccatagggtgtaccggctggcattggccaagctcagtccccccgtgataccatttatgccactgcttctcaaggatatgactttcatccatgaagggaaccacacattggtagagaatttgatcaactttgaaaaaatgagaatgatggctcgggcagcgaggatgctacaccactgcaggagccacaaccccgttccgttaagccctctacggtccagggtgtctcatctccatgaagattctcaggtggcccgcattagtacctgcagtgaacaaagcctgagcactcgcagtccagccagtacatgggcttacgtgcagcaactcaaagtaatagacaaccaacgggagctgtcacgcctgagtagagagctggagccatag

SEQ ID NO: 45375 - DNA, 2772 bp, Artificial Sequence
  Description of Artificial Sequence: Synthetic coding sequence
atgaaggtgggctggcccggcgagagctgctggcaggtgggcctggcggtggaagattcaccagcccttggcgcccctcgggtcggtgccttgcccgacgtggtcccagagggtactctgctcaatatggtgctgcggcgcatgcaccgacccaggagctgttcctatcaacttttgctagagcaccaaagaccatcatgtatccaagggttacggtggaccccactgaccaactccgaagagtcgctcgactttagcgagagcctagaacaggcctctacggaacgcgtgcttagggcggggcggcagctgcaccggcacctactggccacctgccccaacttaatcagggaccggaaatatcatcttcgcttgtaccggcagtgctgctctggacgggagctggtcgatgggatcctggccctaggactaggagtgcactcccgatcgcaggtggtgggcatttgccaggtgctccttgatgagggagctctatgtcacgtcaagcacgactgggcctttcaggaccgggatgcgcagttctataggtttccaggacctgagcccgagcctgttcgcacccacgaaatggaagaagagttagcggaggcagttgcactcctttcacagcgcggacctgacgcattgctgactgtggcacttagaaaaccaccgggccagcggaccgatgaggagcttgacctcatattcgaggagcttctgcatattaaggcggtcgctcatctcagtaacagcgtgaaaagggaactcgctgctgttctactgtttgaaccccatagcaaggctgggactgtcctcttctctcagggcgataaaggcacctcatggtacataatctggaaagggtctgtgaatgtagttacgcacggtaaggggctcgtgactacacttcatgagggcgacgacttcggccaactggcacttgttaacgacgcgccgagagccgcaacaattattcttcgagaggataattgtcacttcttacgtgttgacaaacaggatttcaataggattatcaaggacgtggaagctaaaaccatgcgcctggaagagcacgggaaggtcgtgctggtgcttgagcgagccagtcagggagctggcccaagcaggccccctacccctgggaggaatcgctataccgtgatgtcaggcacccccgagaagattctagaattgttgctcgaagccatgggacccgacagctctgcgcacgaccctacagagaccttcctaagtgacttcttactgacgcatcgagtgttcatgcctagcgcccagttatgcgccgctctcctgcaccacttccatgttgagcccgccgggggatccgagcaagaacgctctacttacgtgtgcaataagagacaacaaatcctccgactggtgagccagtgggtcgcactttatgggagtatgctgcacaccgatcctgtcgctactagttttcttcaaaaactcagcgatttggtgggacgcgatacacgcctgagcaatctgctgcgggagcagtggcctgaaaggcgtagatgccataggctagaaaacgggtgcggtaatgcaagcccacaaatgaaggcaagaaatttacccgtgtggctcccaaatcaagacgaaccccttcccgggtcctcttgcgcaatccaggtgggagataaagtgccatacgacatttgtcgtcctgaccacagtgttcttacacttcaactacctgtgaccgcttcagtgagagaagttatggccgctttggctcaggaagacggttggaccaaaggccaggtcctagttaaggtgaattcggctggggacgccatcggcctgcagccagatgccaggggagtggccacctctctgggtctgaatgagagacttttcgtggttaatccgcaagaggtgcacgaactgatccctcacccagaccagttgggccccacggtaggcagtgccgaaggcctggaccttgtctcagcaaaggatcttgccggtcagctgaccgaccatgactggtcactgtttaactcaatccaccaggttgaactaattcactacgtgctgggcccgcagcatcttagagacgtcacaaccgccaacctggagcgctttatgcggcgcttcaatgagctacagtattgggtggccaccgagttgtgcctttgtccagtgccaggcccccgcgctcaactgctcagaaaattcatcaagctggccgcacatctgaaagagcagaaaaacttaaacagtttctttgcagtcatgttcggcctgtcaaactctgccatatcccggcttgcacatacctgggaacgtctcccccataaggttagaaagctgtattccgcactcgaacggttgttggacccatcatggaaccaccgtgtatacagactggccttagcaaagcttagtccgcccgttatccctttcatgcccctcctgctgaaggatatgacgtttatacatgaagggaaccataccctggtggagaatctgattaatttcgagaagatgagaatgatggctagagcagcacgtatgttgcaccattgccggtcccacaatcctgtgccgctgagtccactgaggagccgggtgtctcaccttcacgaagacagccaggtggctcgaattagtacttgttcggagcagtcactgtcaaccagaagcccggcctccacgtgggcctacgtacaacagctgaaggtcatcgacaatcaacgagaattgtctcgactttcaagggaacttgagccctag

SEQ ID NO: 45376 - DNA, 672 bp, Artificial Sequence
  Description of Artificial Sequence: Synthetic coding sequence
atggtgctgcggcggatgcaccggccccggagctgcagctaccagctgttgctggaacaccagcgcccgagctgtatccaggggttgaggtggacacccctgaccaattcggaggagtctctggattttagcgagtctctcgaacaagcctctactgaacgagtgctgagagcagggcgtcaattgcaccggcacctgcttgctacatgtcctaatctgatcagggacagaaagtaccaccttcgtttgtatcgccagtgttgtagtggtagagagcttgtggacggaattttggcattaggcctcggtgtgcatagcagatcccaggttgtcggcatatgtcaggtgttgctggatgaaggtgccctgtgtcacgttaaacatgactgggccttccaggacagagatgcccaattttaccggtttcccggtccagaacccgaacctgtcaggactcatgaaatggaagaggagttggccgaggctgtggccttgctcagccagcgaggccccgacgctctactcaccgtggcgttgcgcaagccacccggacaaagaaccgatgaggagctcgatctgatctttgaggagctgctgcacatcaaagcagtggctcatcttagcaatagtgtgaaacgcgaactcgccgcagttctgttgttcgagccctag

SEQ ID NO: 45377 - DNA, 426 bp, Artificial Sequence
  Description of Artificial Sequence: Synthetic coding sequence
atggtgctgcggcggatgcaccggccccggagctgcagctaccagctccttctggagcatcagcgccccagctgcatacaaggattgcgctggactcctctgaccaacagcgaggagagtttggactttagtgaatctttggaacaagcttcgaccgagagggtgctgagggcaggccgtcagctccatcgtcacctgctggccacctgtcctaatctgatacgtgaccggaagtaccatttaaggctgtaccggcaatgttgctctggcagagagcttgtggatggcattctggctttaggcctgggagtgcattctcgttcacaggtagtgggaatttgtcaggtgctgctggatgagggggcattgtgccacgtcaagcacgattgggcctttcaggatcgcgacgcacaattttaccgatag

SEQ ID NO: 45378 - DNA, 1713 bp, Artificial Sequence
  Description of Artificial Sequence: Synthetic coding sequence
atgcggctggaggagcacggcaaggtggtgctggtgctggagcgggcctctcagggcgcggggccaagccgccccccaactccagggagaaatcggtacaccgtcatgagcggaacccctgaaaagattcttgagctactgctcgaggcaatgggccccgactcttcagcgcatgaccccactgagacattcctatcagattttctcctcacccatagagtgtttatgccctcagctcagctctgtgcagcactgctgcatcatttccacgtagagccagcaggaggttccgaacaagagagaagtacctacgtctgcaataagaggcagcaaatacttaggttggtgtcccagtgggtagccttatatggctcgatgctacacaccgatccagtggccacttcctttctgcagaagctctcggatttggtcggtagagacacccgcctgtcaaacctgttgcgtgaacagtggcctgaaaggcggaggtgccatagactagaaaatgggtgcggtaacgccagcccccagatgaaggctcgaaaccttcctgtgtggctgcctaatcaggatgagcctcttcctgggagctcgtgtgctatccaggtaggagacaaggtcccttacgacatctgtcgtccagaccactcagtgttgacccttcaacttccagtcactgcctctgtgcgagaagtgatggcagccttggcgcaggaagacgggtggacaaagggacaggtgctcgtcaaggtaaactccgcaggcgacgccattgggttacagcccgacgctcgcggcgtcgctacttctcttggactgaacgagcggttatttgtggtgaatcctcaggaagtgcatgagctaattccacaccctgaccagctgggcccaacagtggggagtgcggaggggctagatctggtctcagcaaaggacctggctggccagctgaccgatcatgactggtcccttttcaattccattcatcaggttgaactcattcactacgtgttaggtccacagcacctccgcgacgtgaccaccgccaacctggagcgctttatgagaagattcaatgagcttcagtattgggtggcgaccgaactgtgcctgtgccctgtccccggtccccgggcacagctgctgcgcaagtttataaagctggcagcccaccttaaggagcaaaagaaccttaatagcttttttgccgtgatgtttggtctgtctaattctgccatctcccggctcgcccacacatgggaacgcctcccccacaaggtgaggaaactttattccgccctcgagaggctccttgacccgtcttggaaccaccgcgtataccgcctggctctggccaaactgtccccccctgtaatccctttcatgccactgttgctcaaggatatgactttcatccacgaaggcaaccacaccctggttgagaatctcatcaacttcgaaaagatgaggatgatggcaagagcagcaagaatgcttcaccactgtcgcagccacaatcccgttccgctgtctccactacgatccagggtgtctcacctgcatgaagacagccaggtggctcggatttccacctgctcggagcagtccttgagtacccggagccccgcatctacctgggcctatgtccaacagctgaaagttatagataatcagcgagagttatcaaggctgtcccgagaactcgaaccatag

SEQ ID NO: 45379 - DNA, 2646 bp, Artificial Sequence
  Description of Artificial Sequence: Synthetic coding sequence
atggtgctgcggcggatgcaccggccccggagctgcagctaccagctgctgctggaacaccagcggccgagctgcattcaaggcctgcgctggactcccctgactaatagtgaagaaagcttggacttttcagagagtctggagcaggcctccactgaaagggtgcttagggccggtcggcaactgcaccggcatctcttagccacatgcccaaacctgatcagagatcggaagtatcatcttaggctgtatagacagtgttgctctggcagggaactggttgacgggatcttggctctgggtctcggcgtgcacagcagaagtcaggttgtaggaatatgccaagtgctcctcgatgaaggggccctatgtcatgttaagcatgactgggcgtttcaggacagagacgcacaattctatcgttttcccggacccgaaccagagccggtgagaacccacgaaatggaggaggagctggctgaagcggtggccctgctgtcacagcgggggcccgatgcccttttgactgtggctctccgcaagcccccaggccagaggacagatgaagaactggaccttattttcgaagagttactccatattaaagcagtggctcacctgtccaatagcgtcaagcgggagctggctgcggtgttactgttcgaacctcactctaaggctggaaccgtgctgttttctcaaggagacaagggcacctcatggtacatcatttggaaggggagcgtcaacgtcgtcacccacggcaagggactcgtgacaaccttgcatgaaggcgacgacttcgggcagctggctctggtcaatgacgcgcctcgggcggccacgattattctgcgcgaagacaactgccactttctgagggtggacaagcaggactttaataggataatcaaagatgtggaggccaagaccatgcgcctagaggagcacggtaaagtggtgctggtgctcgagcgggccagtcagggcgccggtccatcaaggccccctaccccaggaagaaatcgatataccgtgatgtccggaacaccagaaaaaattctggagttactgctggaggccatgggacctgattcttccgctcatgatccgacagaaacattcctgtccgattttttactcacgcatagagtatttatgccgtctgctcagctctgcgctgccttattacaccactttcacgtggagcctgccggcggcagtgagcaagaacgtagtacgtacgtctgcaataaaagacagcagatcctgcgcctggttagtcagtgggttgccctgtacggaagtatgctgcatacagatcctgttgccacgagcttcctgcagaagctgagcgacctggtcgggcgagatacacggttgtccaatctgctccgtgagcagtggccagaacgtcgcagatgtcaccgactggagaacggctgcggcaatgcctcacctcagatgaaggcacgcaacttaccggtgtggcttcccaaccaggatgagccactccctggatccagctgcgccatccaggtgggcgacaaggtgccctatgacatttgccgcccagaccacagcgtcctcaccttgcagctccccgtgacggcatcagtgcgagaggtaatggccgcacttgcacaggaggatggatggacaaaaggccaggtcctggtgaaggtgaattcggcaggggatgctatcggtctgcagcccgatgcgcgcggcgtggcaacgagtctcggtctaaatgagcggctctttgtggtgaacccgcaggaggtccacgagctaattccccacccagaccaactcgggccaacggtagggagtgccgagggactagacctcgtatcagctaaagacctggccggtcagctgactgatcatgattggtccctgttcaattcgatacaccaggtcgagctcatccattacgtgctcggccctcagcacctgagagacgtaactacagccaatctggagcggtttatgagacgctttaacgaattgcagtactgggtcgctacagagctttgtctctgcccggtcccaggccctcgggctcagctccttaggaagttcattaaactagctgcacatctgaaggaacagaaaaacctgaacagctttttcgccgttatgttcggcctctctaactctgcgatctcaagactcgctcatacctgggagagactgccacacaaggttcgcaagctgtactccgcactagaaaggctgctggatccctcttggaaccaccgcgtgtatcggctggctcttgctaaattaagtccgcctgtcatcccatttatgcctctgctgttaaaagacatgaccttcatccatgaagggaaccataccttagtagaaaacctcattaattttgagaaaatgaggatgatggcccgagccgcccgcatgctgcaccactgtcggtcgcataacccggtccctttgtcccctctgaggtcacgagtgagtcacttgcacgaagatagccaagttgcaaggatatcaacctgctctgagcaatcactgtccactaggagccccgcaagtacctgggcctatgtgcagcagcttaaggtaatcgataaccagagggaactaagccgtctttcccgagagctagagccatag

SEQ ID NO: 45380 - DNA, 3033 bp, Artificial Sequence
  Description of Artificial Sequence: Synthetic coding sequence
atggtggccgcccacgccgcccacagcagcagcagcgccgagtggatagcctgccttgataaacggcctctcgagcggagttccgaggacgtggacatcatattcactcggctgaaggaggttaaagcatttgagaagttccatcccaaccttttgcatcagatatgcctttgcggctactatgagaacctcgagaagggaatcacgttgtttaggcaaggcgacatcggcactaactggtatgccgtactcgccggctctctggacgtgaaagtttcggagacctcttctcaccaggatgcagtaaccatatgtactttgggaattgggaccgcatttggtgaaagcatcctagacaatacgccacgccacgccacaatcgtcaccagggagagctccgagttgctgaggatcgaacagaaggacttcaaggcgttgtgggagaagtatcggcaatatatggccgggctgctggcacccccttacggagttatggagacgggctctaataacgataacatttttaaggaaatgacccccttaattgaaccacacgtgccactgcgcccagccaacaccataacaaaggtgccctctgaaaaaattctgcgcgccggaaaaattctgcggaacgcgattttgtcccgagcaccccacatgataagggatcggaaatatcatctcaagacctataggcagtgctgcgtcggtactgagcttgtggattggatgatgcaacagaccccttgtgtgcactcacggactcaggccgttggcatgtggcaggtcctgcttgaggacggtgttctgaatcatgtcgaccaggaacatcatttccaggataagtacctgttctaccgcttcctcgacgatgagcatgaggatgcccccctgcctacagaggaggagaagaaagagtgcgatgaggaactgcaagacactatgctccttttgtctcaaatggggccggacgcccatatgaggatgatcttgagaaaaccccccggtcagagaactgttgatgatttggaaatcatttatgaggaactgctgcatatcaaggcgctcagtcatctttccacaaccgtgaaaagggaacttgccggggtactgatcttcgaatctcatgccaaaggcggcaccgtgctctttaatcagggggaggaaggcacatcgtggtatattatcctgaaaggatccgtgaacgtggttatctatggaaaaggtgtggtctgcacgctgcacgagggggacgatttcggcaagctggctctcgttaacgacgcaccaagagcggcttcaattgtcttacgagaagacaattgtcacttccttcgtgtggataaagaagattttaatagaattctgcgggacgttgaggctaataccgttcgactgaaggagcacgatcaggacgtgttagtgctggagaaagtcccagccgggaacagggcttcgaatcagggcaacagccagccccagcagaaatacactgttatgagcggtactccagagaagatcctcgagcactttctggagaccatacgattggaagcgaccctaaacgaggccaccgacagtgtgctgaatgatttcataatgatgcactgtgtgttcatgcccaacacgcaactgtgccccgctctggtggcacactaccacgcccagccttcccaaggtacagagcaggagaagatggactatgccctcaacaacaaacgccgggtgattagactcgtactgcaatgggctgcaatgtatggagacctcctccaggaggatgacgtgagcatggcttttcttgaggaattttacgtgagcgtgagcgatgatgccaggatgatcgccgctctcaaggagcagctgccagaattagaaaagattgtaaaacagatcagcgaggatgcaaaggcgccccagaagaaacataaggtactcctccaacagtttaataccggtgacgaacgtgcccagaaaaggcagccgatccgaggttcggacgaggttctgttcaaggtatattgcatggatcacacttacaccaccattcgggtgcccgtcgccacctctgtgaaggaagtgatctccgccgtggccgacaagctggggtctggtgagggattgattattgtaaagatgagctccgggggagagaaagtggttttgaaacccaatgacgtttctgtgttcactacgctgactataaacggcagactctttgcgtgccctagggagcagtttgactcacttactcccctaccagagcaagagggccccactgttggcaccgtaggtacgttcgaactgatgtcgagcaaagatctcgcctaccagatgacaatctacgactgggaacttttcaactgtgttcatgagctagaactgatctatcacaccttcggaagacataatttcaagaagactactgctaatctggatcttttcctgaggcggttcaatgagatccagttttgggttgtgactgagatttgcttgtgttcccaactgtcaaagcgtgtgcagttgttgaagaagtttatcaaaattgccgcccattgtaaagagtataagaacctaaacagcttttttgcaatcgtgatgggactgagcaacgttgccgtgtcccgcctcgcccttacgtgggagaaactgcctagcaaattcaaaaagttttatgcagagttcgagtcgctaatggacccgtcgcgaaatcatagggcctatagactcacggtcgccaaactcgagccccccttgattccatttatgccactgctaattaaggatatgacgttcactcatgagggtaacaagacattcatcgataatttggtgaacttcgagaaaatgcgcatgatcgccaataccgcgagaacagtcaggtattaccggagccagccattcaatccagatgcagcccaagcgaacaaaaatcatcaggacgtgagaagctatgtacggcagttgaacgtgatagacaatcagagaaccctttcacaaatgtctcatagactggagcccaggaggccatag

SEQ ID NO: 45381 - DNA, 3036 bp, Artificial Sequence
  Description of Artificial Sequence: Synthetic coding sequence
atggtggccgcccacgccgcccacagcagcagcagcgccgagtggatcgcttgtctcgataaacgaccactcgagcgatctagtgaggatgtagacatcattttcacacgccttaaggaggtgaaagcctttgaaaaattccaccctaatctcctgcaccaaatttgtctgtgtggatactacgaaaatcttgagaagggaattacccttttccgacaaggggatattggaactaattggtacgccgtgctggcaggcagcttagacgtgaaggtgtcagaaacgtccagtcatcaggacgccgtcaccatctgtactttaggcatcgggacggccttcggggagtccatcttggacaatactccacggcacgccacaattgtgacaagagaatcttctgaacttctgagaattgagcagaaggactttaaagccctgtgggagaagtatagacagtacatggcaggactgttggctcctccgtacggcgtgatggagacgggctccaacaacgatcggattcccgacaaggaaaacactccattgatagagccacatgttccacttcgcccggcaaatactatcaccaaagtccctagtgagaaaatcctgcgtgcaggcaaaatcttgagaaacgcaatcctatctagagcgcctcacatgatccgcgacaggaagtaccatctaaagacttataggcagtgctgcgtagggacagagctggtcgattggatgatgcagcagacaccctgcgtgcacagtagaactcaagccgtgggaatgtggcaggtgctgctggaagacggagtgctgaaccatgtggatcaggaacaccacttccaggataaatacctgttctatcggttcttggatgatgagcatgaggacgcacccctcccaaccgaggaagagaagaaggagtgtgatgaggagctacaggacacaatgcttttactgtcccaaatggggccagatgcccatatgagaatgatcttacggaaaccacctggacagcgtaccgtggacgatttagagataatttatgaagaactcctacatataaaggcattaagtcatctcagtaccacagtgaagagggagctagccggagtgctcatcttcgagagtcacgccaagggcgggaccgttctttttaatcaaggtgaagaagggacaagctggtacatcatactgaaaggttccgttaacgtagtgatatatggaaagggggttgtttgtacgttacacgagggtgatgacttcgggaagctggctttggtcaatgatgcaccgcgagcagctagtatcgtgctgcgagaagataattgccattttttaagggtagacaaggaggatttcaatcgcattcttagggacgtcgaagcaaatactgtgaggctcaaggagcatgaccaggatgtcttggtactcgagaaagtgccggccggcaacagggcctcaaatcagggcaattcacaacctcaacagaaatatactgtgatgtcagggacacctgagaaaattctggagcacttcctggaaaccattaggttggaggcaactcttaatgaggccacagacagcgttcttaatgattttatcatgatgcactgtgtgtttatgccaaatacccaactgtgtccagccctggtggctcattaccacgcccagcctagtcagggcaccgagcaagagaagatggattacgcactcaataacaagagaagggtgatcagactcgtgctgcagtgggcggcaatgtatggcgatcttttgcaggaggacgatgtgagtatggccttcctcgaagagttctatgtctccgtcagcgatgacgcaaggatgatcgccgcgttgaaagagcagctacctgaactggagaaaattgtgaaacaaatcagtgaagacgcaaaggcaccccaaaagaaacacaaggtgctcctgcagcaatttaacacaggcgacgagagagcacagaagagacaacccattcgagggtccgatgaagttctgttcaaggtgtattgcatggatcacacatatacaacgatccgggtgcctgttgcaacatctgtgaaagaagtcattagtgccgtcgcagacaaattaggatctggggaaggtttgataatcgttaagatgagcagcggtggggagaaggtggtactgaagcctaatgacgtatccgttttcaccacactgacaataaatggaaggctcttcgcgtgccctcgggagcagtttgatagtcttactcctctccctgaacaggagggacccaccgttggcaccgtgggaacttttgagctcatgtcttccaaggatctcgcttaccagatgacaatctacgactgggagttgtttaattgtgttcatgagctcgagctgatctatcatacttttggacgccataacttcaaaaaaactaccgcaaacctggacctgtttcttcgcaggtttaacgaaatacaattttgggttgttactgagatttgtctgtgttctcagttgtccaagcgcgtccaactcctcaaaaagttcatcaaaatcgctgcgcattgtaaggagtataagaatctgaattcattttttgctatagtaatgggccttagcaacgtcgctgtctcccggctcgccctgacttgggagaaactaccttcaaaattcaagaaattttatgctgagtttgagtcgcttatggacccatccagaaaccacagagcttacaggttgaccgtggcaaagctggaaccgcctcttatcccatttatgcccctgttaattaaggacatgacattcacgcatgagggtaacaaaacctttatcgacaacctggtcaacttcgaaaagatgcggatgattgccaacacagcccgaacggtccgctattaccgcagtcagccctttaatccagatgccgcccaggccaacaagaaccaccaggacgtccggtcatatgtgcggcaattgaacgttattgataaccagcgtactctgagtcaaatgagccacagacttgagcccaggaggccatag

SEQ ID NO: 45382 - DNA, 2604 bp, Artificial Sequence
  Description of Artificial Sequence: Synthetic coding sequence
atgctgtacaagaagtaccggcagtacatggccggcctgctggccccaccctacggggtgatggagacagggtcaaataacgaccgtatacccgataaggaaaacacccccctgatcgaaccccacgtgccactgcgccccgccaatactatcaccaaggttcctagtgaaaaaatactgagggcggggaagatccttcggaacgcaattttatcccgcgccccccacatgatccgggacaggaaatatcaccttaaaacctataggcagtgttgtgtggggacagagttagtggattggatgatgcagcagaccccctgtgtgcattctcggacacaagctgttgggatgtggcaggtgttgttagaagatggcgtactgaatcatgtggatcaggagcaccactttcaggacaagtatttgttctacaggttcctggatgatgaacacgaggatgccccactgccaacggaggaggaaaagaaggagtgtgacgaagaactccaagacaccatgctcctgctctcacagatgggcccggatgctcacatgagaatgattcttcggaaaccgcccgggcagagaacagtggatgatctggagattatctatgaagagcttctacacatcaaggctctaagtcacttgtccacaaccgtgaaacgcgagttggccggcgtcctgatctttgaatcacatgccaagggagggactgtactcttcaaccagggagaagaggggacaagctggtatatcatattaaaaggcagtgtcaacgtagtaatctatgggaaaggtgtggtgtgcaccctgcatgaaggcgatgactttggaaagttggctcttgtgaatgacgcaccccgggcggcaagcattgtgctacgagaggacaattgccacttcttaagagtagacaaggaggactttaacaggatcctgagggatgtggaggctaacaccgtgcgactgaaggagcatgatcaggacgtcctggtcctggaaaaagtgcctgccggcaatagggcctcgaatcagggcaactctcaacctcaacagaagtacacagtaatgtctggaacgccagagaagatcctggaacatttcctagagactattagactggaggccactctgaatgaagctaccgacagtgtcttgaacgatttcataatgatgcactgtgtgtttatgcccaatacacagctatgtccagccctcgtggctcactaccacgctcagccgagccagggcacagaacaggaaaagatggactacgcccttaacaacaaacgacgagtgattaggctggtactacaatgggctgccatgtacggggacctgctgcaagaagacgatgtgagtatggcatttcttgaggagttttatgtctcagtgtctgatgacgcccgcatgatcgccgctctcaaagaacaacttcccgagctggagaagatcgtaaagcagatttccgaagatgccaaagcgccacagaagaaacacaaggtactgttacagcagttcaacactggcgacgagagagctcagaaaaggcagcctatacggggttctgatgaggttcttttcaaggtctactgtatggatcatacctacaccacaatacgagtgcctgtggcaacttctgttaaggaggtgatctctgccgtggctgataaactagggagcggtgaaggactgatcatcgtgaaaatgagctccggcggcgaaaaggtcgtactgaagccaaacgatgtctccgttttcactaccctgacaatcaacggcaggctcttcgcatgcccccgagagcagttcgactcgctgacccctttacccgagcaagaaggcccaacggttggcacagtgggcacttttgagctgatgtctagtaaagatctggcttaccagatgaccatctatgactgggagctcttcaactgcgtgcacgagctagaacttatataccataccttcggacgccataactttaaaaaaactaccgccaacctagatctctttctgcggagattcaatgagatccagttctgggtcgtgacagaaatctgtctatgttcccaactttcaaagagggtccagctcctgaagaaattcattaagattgctgcccactgtaaggagtacaagaacctgaattccttcttcgctattgtgatgggactttcaaatgtagcagtgtctcggttggccctcacctgggagaaacttccaagcaaatttaaaaagttctatgctgaattcgagtctctgatggatccatcccggaatcatcgtgcctataggctaactgttgctaagttggagccccccctgatcccatttatgccgttactcattaaggatatgacattcactcacgaaggaaacaaaacttttatagataacttggtaaattttgagaaaatgaggatgatcgctaacactgccagaacagtccggtactaccgatcacagccatttaatccagacgccgctcaggccaataaaaatcatcaggacgtgcgctcttacgtgcgtcaactgaacgtgatagataatcagcgaacgctgtctcagatgtctcacagactggagccacgcaggccgtag

SEQ ID NO: 45383 - DNA, 2832 bp, Artificial Sequence
  Description of Artificial Sequence: Synthetic coding sequence
atggtggccgcccacgccgcccacagcagcagcagcgccgagtggatcgcttgcctggacaagcgacctcttgagcgctcctcagaggacgtcgacattatatttacccggctgaaggaagtgaaggctttcgagaaatttcaccccaacctgctacatcagatttgtctgtgcggctactatgaaaacttggaaaaagggattacattatttcgccagggcgacattggaaccaactggtacgctgtgctggccgggtctctggatgtcaaagtttccgagaccagctcccatcaagacgctgtaaccatctgcactttgggtatcggcacagccttcggcgagagcattttggataatactcccagacacgcaaccattgtgactagggaaagtagtgagctgctgcgaattgagcagaaagacttcaaggctttatgggaaaagtacaggcagtatatggcagggctgctggcccctccctacggagtgatggaaacaggatcaaataatgatcgaatcccagacaaggagaacacgccactgatcgagccacacgtgcctctccggccagccaatacgattacaaaagtcccgagtgagaaaattttgcgggccggaaaaatcctacgaaatgccattctttcccgagccccccacatgataagagacaggaagtaccacttgaaaacatatcgccaatgctgcgtcgggacggagctggtcgattggatgatgcagcagacaccgtgcgtgcatagccgcacccaggcagtgggaatgtggcaggtgctgctcgaggacggcgtattaaatcacgtagaccaggaacatcacttccaggataaatatctattctaccggtttctggatgatgagcacgaggacgctcctctgccaaccgaagaggagaagaaagagtgcgacgaggagctgcaggataccatgttgttgctgtcccagatggggccagatgctcacatgagaatgatattaaggaagcccccgggccagcggacggttgacgatctggagattatctacgaagagctcctgcacattaaagctctgagccatctgtcaacaactgtgaagcgggagctggccggggtgctgatatttgagagccacgctaaggggggcactgtgctctttaatcagggcgaggaagggacttcctggtatataattctaaagggatctgtaaatgtcgtcatatatggcaaaggcgtcgtctgcaccctccatgaaggcgacgacttcggcaaactcgcactggtaaatgacgcgcctcgggcagcgtccattgtccttagagaggataattgtcactttctgcgggtggacaaagaggactttaaccggatcctgagagatgtcgaagcaaacaccgtgcggctgaaagaacacgatcaggatgttcttgtcctcgaaaaagtgcccgcaggcaatcgggcttctaaccaaggcaattcacagccgcagcagaagtacacagtcatgtccggtactccagagaaaattcttgaacactttttagagacaatccgccttgaggcgaccctaaatgaggccacagactctgtgctgaacgacttcattatgatgcattgtgtgttcatgcctaacacccagctttgtcctgctttagtggcccattaccatgcacagccaagccagggcaccgaacaagaaaaaatggactatgcgctgaacaataaaaggagggtgatacgcctggtactccaatgggccgccatgtacggcgatttactgcaggaggatgacgtctccatggctttcttagaagaattctacgtttctgtctctgacgacgcccgcatgatcgctgcccttaaagagcaactgcccgagttagaaaagatagtgaagcagatatctgaagacgcaaaagctccccagaagaagcataaggtgctcctccagcaatttaatacgggagacgagagggcccaaaagcgccagcccattagaggcagcgatgaagtcctcttcaaggtctactgcatggatcatacatacactacaatcagagtgcccgtggctacttctgtgaaagaggtcatttcagcggtcgccgataaacttgggtccggcgaaggactcatcatagttaaaatgagcagcggcggagagaaagtcgtgcttaagccaaacgacgtctcagtgttcacaacactcactattaacggcaggctgtttgcttgccctagggagcaattcgactcccttacccctctacccgagcaagaaggccctaccgtgggaaccgtgggcactttcgaactgatgagctctaaggatcttgcgtaccaaatgacgatatacgattgggaactgttcaactgcgtacacgagctggaactgatttatcacactttcggcagacacaattttaagaaaactacggctaatctcgacctctttctgagacggttcaacgaaatacagttttgggttgtaacggaaatctgtctgtgcagtcagttgagcaagagggtgcaactgctgaagaagttcatcaagatcgcagctcactgcaaggagtacaaaaatcttaattccttctttgctatcgttatgggcctgagcaatgtggcggtcagccgcctggctcttacctgggagcgcatgatagctaataccgcgaggaccgtcagatactaccgcagccaaccttttaatccagacgcagcccaggctaacaagaatcatcaagatgtgcgaagctacgttcggcagctgaacgtgattgataaccagaggacactgtcccagatgagtcaccgcctcgagccacgtcggccttag

SEQ ID NO: 45384 - DNA, 2376 bp, Artificial Sequence
  Description of Artificial Sequence: Synthetic coding sequence
atgatccgggaccggaagtaccacctgaagacctaccggcagtgctgcgtggggaccgaactggtcgattggatgatgcagcaaaccccatgtgtgcactctagaactcaggccgtgggaatgtggcaggtccttttggaagacggcgtgctgaatcatgtcgaccaggagcaccactttcaggataaatacctgttttatcgcttcctggacgacgaacacgaggacgcaccactgcccaccgaggaagaaaagaaggagtgtgacgaagagcttcaggacacaatgcttctgctctctcaaatgggacctgacgcacacatgagaatgattttgaggaagccccctggacagagaactgttgatgacctcgagatcatctacgaggaactgttacacatcaaggcattgtcacacctgagtacgactgtcaaacgtgaactggccggggttttgattttcgaaagccacgcaaaggggggtacggtcctctttaaccagggggaggaggggacctcatggtatatcatcctgaaagggagcgtgaatgtggtcatctacggcaaaggggtcgtctgcaccctgcacgagggcgacgactttgggaagctcgccctggtcaacgacgcccccagggctgcatccatcgtcttgagagaggacaactgtcactttctgcgtgtagataaagaagattttaaccggatcctgagagatgttgaagccaatactgttcgtctgaaggaacacgaccaagacgtcctggtgctcgagaaggtaccggctggcaatcgggcctccaatcagggcaacagccagccacaacagaagtataccgtcatgagcgggactcctgaaaagattttggagcatttcttggagactatacgtctggaggcgaccctcaatgaggccacagatagtgtcctaaatgactttattatgatgcattgcgtctttatgccaaacacccagttatgcccagctctggtcgcccattatcacgcacagccttctcagggcacggagcaggaaaaaatggactacgctctaaataacaaacgacgcgtgatccgcctggtgcttcagtgggctgccatgtatggagatctcctccaagaggatgatgtctctatggccttcctggaagagttttatgtgtctgtgagtgatgacgcgaggatgatagccgctcttaaggaacagttgcccgagctggagaaaatcgtcaaacagatttctgaggacgccaaggcgccacagaaaaagcacaaggtgctattgcagcagtttaacacgggggatgaacgcgctcagaagcggcagcccattagaggcagcgatgaggtgttgttcaaagtgtattgcatggatcatacctatactactatccgggtgcctgttgctacaagcgtgaaagaggtcatctccgctgtggccgacaagctgggcagcggtgaaggactaattattgtgaagatgtcatccggcggcgagaaggtggtgttaaaaccaaacgacgtgtcagtcttcacaacattgactattaacggtcggctcttcgcttgccctcgggaacagttcgattcacttacacccctgcccgaacaggagggaccaaccgtcggaacagttggcaccttcgagctgatgtcaagtaaagacctggcgtatcagatgacgatatacgattgggaactattcaattgtgttcatgagctcgagctgatctatcacaccttcggacggcataactttaagaagaccacagccaatcttgatttatttctgcggagatttaatgagatccagttctgggtggtaaccgagatctgtctttgtagccagctaagcaaaagggtacagcttctgaaaaagtttattaagatcgccgcacattgcaaggagtataagaacctaaacagttttttcgccattgtgatggggctctcaaacgtggccgtatccagactcgccctgacctgggaaaagctcccttctaaattcaaaaagttctatgccgagttcgaatccctaatggatcccagtaggaaccatagggcctatcggctgacagtggctaaactggagccaccccttatcccattcatgcctctcctgatcaaggatatgacctttacacacgaaggcaacaagactttcatagacaacctggtgaactttgaaaagatgcgcatgatcgccaacacggcgcggacagtgcggtactaccgctcgcagccattcaatccagacgcagctcaggctaataaaaaccaccaggacgttcggagttatgtccgccagctgaatgtgattgacaaccagcgcacattgtctcaaatgtcacacaggctcgaaccaaggcgtccttag

SEQ ID NO: 45385 - DNA, 2523 bp, Artificial Sequence
  Description of Artificial Sequence: Synthetic coding sequence
atggccggcctgctggcccccccctacggcgtgatggagaccggctcaaacaatgacagaataccggacaaggaaaacgtcccatcagagaaaatattgagggccggaaagatcctgcgcaacgccatcctgtccagagcaccacatatgatcagagataggaagtaccacctgaagacgtacaggcagtgctgtgtcggcaccgaattagtggactggatgatgcagcagactccctgcgtccacagcaggacacaagctgtggggatgtggcaagttctgttggaagatggggtcctgaaccacgtagatcaagagcatcatttccaggataaatatctcttttatcgctttctggatgatgaacacgaagacgcgcccctgccaaccgaggaagagaagaaagagtgtgacgaagagctgcaagacacaatgctcctgctgagccagatgggcccagatgcccacatgaggatgatcctccggaagcctcccggccaaaggactgtggacgacttggaaatcatctacgaagaacttttacacattaaggccctgagtcatctgtccaccacagtcaagcgggaactggcaggggtgctcatctttgaaagccatgccaaaggcggcaccgtgttgttcaaccagggtgaggaagggacttcatggtatattattctgaaggggtcagtaaatgtggtaatatatggcaaaggcgtcgtctgcacgctgcacgagggtgacgattttggaaagttggccctagtcaacgatgcaccaagagccgcctctatcgtactccgtgaagacaattgtcatttcttgcgcgtggacaaagaggactttaaccggatcctgagagatgtagaagctaacacagtcagactgaaggagcacgaccaggatgtgctggttttggagaaggtgccagcaggcaatagagcttcaaaccagggcaatagtcagccccaacagaagtacaccgtgatgagtggtacaccagagaaaatccttgagcactttctagagacaattcgactggaagccacactgaatgaagctacggacagcgtgttgaacgatttcatcatgatgcactgtgtatttatgccaaatactcagttatgtccagcattagtggcacactatcacgctcagcctagccagggaaccgagcaggaaaagatggactacgcgttgaataataagcgcagagtaatccgcctcgtgctgcaatgggcagccatgtatggtgacctcctgcaagaagatgacgtgtctatggccttcctggaggaattttatgtgtcagtttctgatgacgcccgaatgatcgccgcattaaaagagcaactcccagagctggaaaagatagttaaacaaatttctgaagatgccaaagccccacagaagaagcataaagtgctcctgcagcagttcaatactggagatgaacgggctcagaaacgccagcccatcagaggaagcgatgaagttctgttcaaggtctactgtatggatcacacttatacaacaatccgcgtgcctgtggcaacctcagttaaagaggtaataagtgctgtggctgacaaactcgggtccggtgagggtttaattattgtgaaaatgagctctgggggcgagaaagtggtgctaaagcctaacgacgtgtctgtctttacaactttaacgattaacggccggctgttcgcatgcccccgcgagcaattcgactcactgactccgttgccagagcaggaaggccccaccgtaggaacagttggtacatttgagctcatgtcttcgaaggatctcgcttaccagatgactatttacgattgggagttgtttaattgtgttcatgaactggaacttatctaccatacctttgggcgccataatttcaaaaagactactgccaacctggatctttttttacggcgctttaacgaaattcagttctgggtcgtaacagagatctgtctgtgctctcagctgtcgaagcgcgtgcagcttttgaagaagtttattaaaatcgccgcgcattgtaaggagtataagaatttgaactcttttttcgctatagtcatgggactatcaaacgtcgccgtgagccgacttgcgctgacatgggaaaagctcccctctaaattcaaaaaattctacgcagaattcgagagcctgatggatcctagccggaatcaccgggcctacagactcaccgttgccaaactcgaacctcccctgataccttttatgccactgctgatcaaggacatgaccttcactcacgaggggaataaaacttttattgataaccttgtcaactttgagaaaatgaggatgattgctaataccgcccgcacagtcagatactatcggagtcagccttttaacccagatgctgcacaagctaataagaaccaccaggacgttcgctcctacgttcgacagcttaacgtcattgataatcagcgtacactttcccagatgtctcacaggctggagccaagaaggccatag

SEQ ID NO: 45386 - DNA, 2577 bp, Artificial Sequence
  Description of Artificial Sequence: Synthetic coding sequence
atggccggcctgctggcccccccctacggcgtgatggagaccggcagtaataacgatcgtattcctgataaggagaatactcctctcatcgagccacatgtccccctcagacccgcgaacacgattactaaagttcccagcgaaaagatattgagagcaggcaaaattcttagaaatgccatcttaagcagggcccctcacatgatccgtgatagaaagtaccatctgaaaacgtatcggcagtgctgtgttggaaccgagctcgtcgattggatgatgcagcaaactccctgtgtgcatagccggacacaggcagtgggaatgtggcaggttctcctggaagacggtgtactgaatcacgtggaccaggaacaccacttccaggacaaatatctgttctatcgattcctggatgatgagcacgaggatgcccccctccctaccgaggaagaaaaaaaggaatgcgacgaagaactgcaggacaccatgctgttgctgagccagatgggcccagacgctcacatgaggatgatcctccgcaagcccccagggcaacggaccgtcgacgaccttgaaatcatctacgaagagcttcttcacatcaaagccctgagccacttgtctacaactgtgaaaagagagctggcgggtgtcctaatttttgaatcgcacgccaagggtggcactgttctgttcaaccagggggaagaggggacatcttggtacattatccttaaagggtctgtcaacgtcgtaatctacggtaagggcgtcgtctgcacactgcacgaaggcgacgactttggaaaacttgccctcgtgaacgacgccccgagagccgcctccattgtgcttcgggaagacaattgccatttcctgagagttgacaaagaagattttaacagaattctccgggatgttgaagctaacacagtccggctgaaggagcacgatcaagacgtgctggtgttagagaaggtcccggctggtaaccgggcatcaaatcaaggcaattcccagcctcagcagaaatacacggtaatgtccgggacgcctgagaaaatcctggagcacttcctcgagacaattagactggaagcaactctcaatgaggctactgacagcgtcctgaatgacttcataatgatgcactgtgttttcatgcccaatacgcagttgtgcccagcactggtagcccactatcacgcacaaccctctcagggaaccgagcaggaaaagatggactacgccctcaacaacaaaagacgcgtgattcggcttgtactgcagtgggctgcgatgtatggggatctgcttcaggaggacgacgtgagtatggcttttctggaagagttttacgtcagtgtctccgacgacgcgcgtatgatagccgccctgaaggaacagcttcccgagctagaaaaaatagttaagcagatctccgaggatgcaaaggcccctcaaaaaaagcacaaggtcttactccagcagtttaacaccggcgacgagagagctcagaaacggcaaccaatcaggggcagcgacgaggttctgtttaaggtgtattgcatggaccacacttacacaaccattcgggtgcctgtggcaacgtcagtaaaggaagtcatctccgccgttgctgataagctgggcagtggggaaggcttgataattgtcaaaatgtcgtccggcggggagaaagtggtgttgaaacccaatgacgtgtctgtgtttacaaccctgactatcaacggcaggctcttcgcttgtcctcgggagcagtttgactctctaaccccactcccggagcaggaaggacccaccgtgggtacagtcggaaccttcgagctgatgagttctaaagacctggcctatcagatgaccatctacgattgggagctgtttaattgtgtacacgaactggagctcatatatcacacttttggcaggcacaactttaagaagaccaccgccaatctggacttgttcctcaggcgctttaatgagatccagttctgggtcgtcactgaaatctgcctgtgttctcagttgtccaagagggtccagcttcttaagaagtttataaagatcgccgcacactgtaaagagtacaaaaacctgaattcattcttcgctatcgtgatgggcctgtccaacgttgcagtgagtaggctagctcttacgtgggaaaagctgcctagcaagttcaaaaaattttatgcggagtttgaatccctcatggacccttctcggaaccaccgcgcgtatcgcctgacagtagcgaagcttgagcctccactgattcctttcatgcccctgctcatcaaggatatgacatttacccatgaaggaaataagaccttcatcgacaaccttgtgaactttgaaaagatgagaatgattgctaacaccgccagaaccgttaggtattatcggtctcaaccttttaacccagacgctgcacaggccaataaaaaccaccaggatgtgaggagttatgtcagacagctcaacgtgatcgataatcagcgcacactctctcaaatgtcacacagattagaaccaagacgaccttag

SEQ ID NO: 45387 - DNA, 1200 bp, Artificial Sequence
  Description of Artificial Sequence: Synthetic coding sequence
atgttcgtgttcgtgctgacccccctgatcgagccccacgtgcccttgaggcccgctaacaccatcaccaaggtgccgagcgagaagattctccgggcaggcaaaattctgcgcaacgccatcctgtcccgcgctccacacatgatcagagacaggaagtaccacctcaagacctatagacagtgttgcgtggggaccgagttggtggactggatgatgcagcaaacaccctgcgtgcactctcggacccaagccgtcgggatgtggcaggtcctgctggaagatggagtgctcaatcatgtggaccaggagcaccactttcaggacaaatatttattctataggtttctggatgacgaacatgaggatgcgccccttcccacagaggaggaaaagaaggaatgtgacgaagagctccaggacactatgctactgctgagccagatgggtcctgacgcacacatgcgcatgatcctccgtaaacctccagggcagcgaacagttgatgaccttgaaataatatatgaagagctacttcacatcaaggccctgtcacatttgtctactacggtcaagcgggagctcgctggcgtactcatcttcgagagccacgccaagggcgggaccgtgctgtttaatcaaggagaggaaggcacgtcttggtatatcatcctgaaggggagcgtgaacgtggtcatctacgggaaaggggttgtgtgtaccttacatgaaggggatgatttcggtaaactggccctcgtgaacgatgcaccacgggctgcgagcattgttctgagagaagataattgtcatttcctccgcgtggacaaggaagacttcaaccgaatcctcagggatgtggaggccaacacagtgaggctgaaagaacacgaccaggatgtgctcgtgctcgagaaagttcctgccggaaaccgagcctccaatcagggtaactcacagccacagcaaaaatacacagtaatgtcagggacaccagaaaagatccttgagcattttttggagactatacgcttggaggcgactctgaatgaggccaccgactctgtcctaaatgacttcatcatgatgcattgtgtgtttatgcccaacactcagctttgtcctgctttagtagcccactaccatgcccagccaagcaggtaccgcaccggagaaaacggcctgtgcccacagcagtag

SEQ ID NO: 45388 - DNA, 2577 bp, Artificial Sequence
  Description of Artificial Sequence: Synthetic coding sequence
atggccggcctgctggcccccccctacggcgtgatggagaccggcagtaacaatgataggattcccgacaaggagaacaccccccttattgaaccacacgtgccactgcggcctgcaaacacgataaccaaggtgccttccgagaaaattcttcgagcaggaaagatcctgcgcaacgctatcctgagccgcgccccacacatgatcagagacagaaaataccacctcaagacatatcgtcagtgctgtgtcggcactgaactggtcgattggatgatgcagcagactccctgtgtccactcccggacccaggctgtgggtatgtggcaggttctcctggaggatggagtcctgaaccacgtggatcaggaacaccattttcaagataagtacctgttttacagatttcttgacgacgagcatgaagatgctccacttcccactgaagaagaaaagaaagaatgtgatgaagagctccaggatactatgctgctgttatctcaaatgggaccagatgcccacatgagaatgatactccggaagccacctgggcagcgtaccgtcgacgatctagaaatcatttacgaggaactgctccacattaaagcactttctcatctcagcacaacagttaagagggagctggctggcgtgctaattttcgaatcccacgccaaggggggaacagtactctttaaccagggcgaggagggcacgtcctggtacatcattcttaagggctccgtgaatgtcgtcatatacggcaaaggcgtggtatgcacactgcatgaaggtgatgatttcgggaaactagcgctggtgaacgacgctccccgagcagcctccatcgtgttacgtgaagacaattgtcatttcctccgtgtggataaggaggacttcaacaggatactacgggacgtggaagccaataccgtgcgcctgaaggagcatgaccaggacgttttagtgctcgaaaaagttcctgctgggaatcgagcctccaatcaaggcaactcacaaccacagcagaagtatacggtaatgagcgggacacctgagaagatactggagcacttcttggagacgatacggttggaggctacacttaatgaggctacagacagcgtattgaacgattttataatgatgcactgcgtttttatgccaaacacccaactctgccccgctctggtggctcactatcatgcccagccaagccaagggacagagcaagagaagatggactacgccttaaacaataagcggcgagtcatcaggctggtgctccagtgggcagccatgtacggggacctacttcaggaggacgatgtcagcatggcattccttgaggagttctacgtgagtgtgtccgacgacgcccgcatgatcgccgcgctgaaagaacaattgcctgagttggagaaaatagtgaagcagattagcgaggacgctaaggccccgcaaaagaagcacaaagttctgctccagcagttcaacaccggggatgaacgggctcagaaacgccagcctatccgggggagcgatgaagtgctctttaaggtgtactgtatggatcacacctataccaccatccgagtgcctgtggccacatctgtgaaagaggttataagcgccgtggcagacaaactgggcagcggggagggtttgattatcgtaaagatgagttcggggggtgaaaaagtggtacttaaacccaacgacgtgtcagtgtttaccacattgacaatcaacgggaggctgtttgcatgtccccgagagcagttcgatagcctgacaccgctacccgaacaagaggggcccactgtgggtactgttggcacctttgagcttatgtcctcaaaagacctggcgtatcagatgactatctacgattgggagctctttaactgcgtccatgagctggagctaatttaccataccttcggcagacacaatttcaagaaaaccaccgccaacctggacttgttcttaaggaggttcaatgagatccagttctgggtagtgacagagatctgcctctgcagccagctttctaagcgcgttcagttgctgaaaaaatttatcaagatcgccgcccattgcaaagaatacaagaacctgaatagtttttttgctatcgtgatgggtctcagcaatgtggccgtcagtaggttggcactgacttgggagaaactgccaagcaagtttaaaaaattttacgctgaattcgagtccctaatggacccctcacgcaatcaccgggcataccgcctgactgtggcgaaactcgagcccccactaattccgttcatgcccttactgattaaggacatgacatttacccatgaagggaacaagacgtttattgacaacctggttaatttcgaaaaaatgcgcatgatagccaataccgcccgcacagtccggtattaccggagccagcccttcaatcccgacgcagcccaggccaataaaaaccatcaggacgtgcggtcctatgtcaggcagctaaatgtgatcgacaatcagcgaaccctctcacagatgtcacacagactggagccccggcggccatag

SEQ ID NO: 45389 - DNA, 552 bp, Artificial Sequence
  Description of Artificial Sequence: Synthetic coding sequence
atgcgggagtacaaggtggtggtgctgggcagcggcggcgtgggcaaaagtgcacttacggtgcagttcgtgacgggttctttcatagaaaaatatgatcccaccatcgaggatttctatcggaaagaaattgaagtcgacagctcccctagcgtgctggagatcttagacaccgccgggactgaacagtttgcttcgatgcgcgacctgtacattaagaacgggcagggatttattctggtatattcactcgtcaatcaacaatcctttcaggacattaaacctatgagagatcaaatcattagggttaagcgatacgagagagtgcctatgatattggtgggaaacaaggtggatttagaaggagagagagaggtgtcctacggcgaaggaaaggcactggctgaagagtggtcctgtcctttcatggaaacttccgccaagaataaggcatctgtagacgagctcttcgctgagatagtgcgtcagatgaactatgccgcccaacctaatggtgatgagggctgctgctcagcatgtgtgattctgtag

SEQ ID NO: 45390 - DNA, 552 bp, Artificial Sequence
  Description of Artificial Sequence: Synthetic coding sequence
atgcgggagtacaaggtggtggtgctgggcagcggcggcgtgggcaagagtgccctcaccgtacagtttgtgactgggactttcatcgaaaagtatgatcccactattgaagatttctaccgcaaagaaattgaggttgattcctcaccctccgtgctcgaaatcttggacacagcaggtacggagcagttcgcctctatgcgggacctgtacattaagaacggacagggttttattctcgtgtactctctggtcaaccagcagtccttccaggatattaaaccaatgagggaccagatcgtgcgggtcaagaggtatgagaaagtgccgcttattctggtgggaaataaggtcgacttggagcccgaaagggaagtgatgtcttccgagggcagagccttagcccaggaatggggatgcccttttatggaaacttcagccaagagcaagtccatggtggacgaactgtttgcagagattgtcagacagatgaactactcctctctgcccgagaaacaggatcagtgctgcacgacgtgcgtcgtccaatag

SEQ ID NO: 45391 - DNA, 552 bp, Artificial Sequence
  Description of Artificial Sequence: Synthetic coding sequence
atgcgggagtacaaggtggtggtgctgggcagcggcggcgtgggcaagagcgcactgaccgtccaattcgtgactggcaccttcatcgaaaaatacgaccccacaatcgaggatttttatagaaaagagattgaggtagattcttcaccaagtgtactcgaaatcttggacactgcagggacagagcagtttgcgtccatgcgagatctgtatatcaaaaacggtcagggtttcatcctggtgtactccctggtcaaccagcaatcgttccaggatatcaagcccatgcgggatcagattgtaagagtcaaacggtacgagaaggttcccctaatcctggtcggcaataaggtcgacctggaacctgagcgggaggtaatgagcagtgaaggccgagccttggcacaggagtggggatgcccctttatggaaacatccgctaaaagcaagagcatggtggacgagctgtttgccgaaatcgtaagacagatgaattattctagtctacccgaaaagcaagaccagtgttgtacaacatgcgtggtgcagtag

SEQ ID NO: 45392 - DNA, 1023 bp, Artificial Sequence
  Description of Artificial Sequence: Synthetic coding sequence
atgcacaccgacctggacaccgacatggacatggacaccgagaccaccgccctctgcccatctgggtcgagacgcgccagtccaccaggaacccctactccggaggcagacgctactcttctgaaaaagagcgagaagctcctggccgaactagaccgcagcggccttccctcggctccaggcgctcccaggcgcagggggagtatgcccgttccatataagcaccagctccggagggctcaggccgtagacgaactcgactggcctcctcaggcatcctcaagcgggtcctcagattccttaggcagtggggaagccgccccagctcaaaaagatgggatctttaaagttatgttagtcggtgagagtggagtcggtaaaagcacactggctggtaccttcggtgggctacaaggtgatagtgcccatgaaccggaaaaccccgaagatacctacgagcgtcgaatcatggtggacaaggaagaggtgactctggttgtttacgatatctgggaacagggagacgctggcgggtggctccgagaccactgcctccagaccggtgatgcttttcttatagtctttagcgtcacagataggcggtcattctcaaaggttcctgagactttactccgtctccgtgccgggcggccgcatcacgatcttcccgtgattctggtaggtaataagtcggacctagctcgctctcgtgaggtcagcctggaggagggtcgccacctggcagggaccttgagttgtaaacatatcgagacatccgccgcacttcatcacaatacacgagaactctttgaaggcgccgtccgccagatccgcctgaggcgcggccgcaaccatgctggcggccagaggcctgatcccggcagcccagaaggcccagcaccgccagccagaagggaatctttgacaaagaaagctaaacggttcctagctaacctcgtccccagaaatgcgaaattctttaagcaaaggtctagatcctgtcatgacctgtccgttttgtag

SEQ ID NO: 45393 - DNA, 666 bp, Artificial Sequence
  Description of Artificial Sequence: Synthetic coding sequence
atgcacaccgacctggacaccgacatggacatggacaccgagaccacagctctgtgtccttccggaagcagacgcgcctcccctccagggacgccaaccccagaggcagatgcaacactgctcaaaaagagcgagaagctgctagccgagttagacaggtctggcctgcctagtgctccaggcgcaccacggcggcgtgggagtatgcccgtgccttacaagcaccaactgaggcgggctcaggctgttgacgaactggactggccgccacaagcctccagttcaggctcatcggacagtttaggaagcggcgaggcagcccctgcccaaaaggatgggatctttaaagtcatgttggtgggagaaagtggcgtaggcaaatcaacactcgccggtacttttggtggactgcagggagactccgcccacgaacccgaaaacccaggcgggtgccgacgcgtggcagctggcccgctcccctctgacagaggacgtttatcccaccgccttctgagccatcggcccactgaattcctgcagtctagccgggacccaacctccgctccaggctgggaagccgcaccccgtccaacccgctacccgcgatggaagcaggagagactgggccccctgccggggggaataaccgggggttgcgtgtcctag

SEQ ID NO: 45394 - DNA, 897 bp, Artificial Sequence
  Description of Artificial Sequence: Synthetic coding sequence
atgaccctgaacaccgagcaggaggccaagacccccctgcaccggcgagcctccacccccttgcccctctcacccagagggcatcagcctggcaggctgtctacggttccctccacccagtcccagcaccctcgactcggccagtccgcctctctaaatcctcccacccaaaagccttcaccagcgcccgatgactggtcgagcgaatcttcagactcagagggctcatgggaggccctgtatcgggtggtactccttggagatcctggcgtaggaaaaaccagtctggcctcgctcttcgccggaaagcaggaacgcgatcttcacgagcagctgggggaggacgtctacgagaggaccctgacggtagacggggaggatacaaccctggtggttgttgatacatgggaagctgagaagctggataaatcctggagccaggagagctgtctgcagggcggcagtgcgtatgtaatcgtctacagcattgcagatcgaggcagtttcgagtctgcttcagaactgcgcatccaactgagaagaacacaccaggctgaccacgtgcctatcattctggtcggcaacaaagcggacctcgccagatgccgggaggtgagcgttgaggaggggcgcgcctgcgccgttgttttcgattgcaaattcattgagacatcagcgacactgcagcacaatgttgcagaactctttgagggtgttgtccgccaactgcgactccgaaggagagactctgcggccaaggagccaccagccccccgccggccggcttcactggcgcagagagcccgccgcttcttagctaggctgacagcacgcagtgccaggcgacgtgcactgaaagcaagatccaaatcttgtcacaatctggcagtcctgtag

SEQ ID NO: 45395 - DNA, 2352 bp, Artificial Sequence
  Description of Artificial Sequence: Synthetic coding sequence
atggagagccccggcgagagcggcgccggcagccccggcgccccctctccaagtagcttcacgactggccacctggcccgagaaaagcctgctcaggaccccctctatgacgttcccaatgcctcaggcggccaggccggcggccctcagaggcctggacgggtcgtcagcctgcgtgaacgattattgctcacaaggcctgtgtggctgcagctgcaggccaatgccgcggcagcccttcatatgcttagaacagagcctccgggaacttttctcgttcggaagtcaaacaccaggcagtgccaggctctatgtatgcgcctgccggaggctagtggcccgagcttcgtgtctagtcattatattctggaaagtcctggcggggtttctttggagggatccgagttaatgtttcctgacctggttcaactcatctgcgcctactgccacaccagggacatactgctcttgccactgcagctgcctagggctatccaccacgccgcaacccataaagaattggaagcaatctctcacttggggattgaattctggtcatcttctctcaatatcaaggctcaaagggggcctgccgggggaccagtgctccctcagttgaaagcccggagccctcaggaacttgatcagggaacaggtgctgcactctgcttctttaatccactgttccctggtgatctgggcccaacaaaaagagagaagttcaaacgcagttttaaagtacgggtatccacagagacttccagtcctttgtccccccctgccgtgccaccacctcctgtgcctgtcctgccaggcgctgttccatctcagaccgagagactgcccccctgccagctgctgcggagagagtccagtgtaggatacagggtccccgccggaagtggcccctccttaccacctatgccgagcctgcaggaggtggattgcgggtcaccatcatcatccgaggaggagggcgtgcctgggagtagagggagcccagctacctcgccacaccttggccgccggcgccccctactcaggtccatgtctgcagcattttgtagcctcctcgcccccgaaaggcaagttgggcgggccgcagccgcattaatgcaggacagacatactgctgccggacaactggttcaggacttgctcacccaagtgcgagctggacccgagccccaggagcttcaaggaatacgccaggccctgagtagagctcgggctatgttgtcagcagaactggggccagaaaaactcctgtctcctaaacgccttgaacacgtgctggagaaatcgcttcactgctcagtgcttaagcctctgcgacccatcctcgcggcccgtctccgccgacgccttgctgcagatggatctctgggtaggttggcggaaggcttaaggcttgcgcgcgcccaaggaccaggcgctttcggttctcacctgtctcttccaagcccagtcgagctagagcaggtccgacagaagttgcttcaactcctgcgcacgtattccccatctgctcaagtcaaacgcctgttgcaggcttgcaagctgctgtacatggccctgcggacccaggaaggtgaaggagctggcgctgacgaattcttgccacttctgtcactggtcttggcccattgcgatctccctgaactgctcctggaagcagagtatatgtctgaacttttggagccctctctgctgactggagaaggaggctactatctcacgagcctgagtgcctccctggctcttctcagcggattagggcaagcacacacacttcctctgtcacccgtgcaggagctcaggcggagcctgtctctttgggagcagagacgtctgcccgccacacactgttttcagcacctgctgcgcgttgcttaccaagatccatccagcggttgcacaagtaagacgctggctgtgccacccgaggcaagtatagctacactcaatcagctttgcgccacaaaattccgggttacacaaccgaatacctttggcctgttcttgtacaaggaacagggctaccacaggctcccaccaggcgctttggctcaccggttacctaccaccgggtacctggtgtatcggcgcgccgagtggccagagacccaaggtgcagttaccgaggaagaaggctcaggccagagtgaagctagaagcagaggagaagagcaaggctgtcagggcgatggcgacgccggagttaaagcgagccccagggacatacgagagcagtctgagaccaccgccgaaggaggtcagggtcaagctcaggaaggtccggcccaacccggcgagccggaagccgagggttcaagggcagctgaagagtag

SEQ ID NO: 45396 - DNA, 1818 bp, Artificial Sequence
  Description of Artificial Sequence: Synthetic coding sequence
atgcggctgcccgaggccagcggccccagcttcgtgagcagccactacattctggagagccctggtggagtctcgctcgagggctctgagctcatgtttcccgacctggtacagctcatctgcgcctactgccacacccgagacattctgctgcttccccttcagcttcctagagctatccatcatgccgcgacccacaaagaactcgaggccatatcgcacctcggtatcgaattctggtctagttcactcaatatcaaggcccagagaggcccagctggcgggccagtgcttccccagctgaaagcgcgcagcccccaggagctggaccagggaaccggagcagccttatgttttttcaaccctctctttcctggcgacctcggccccactaaaagggagaagtttaaaagatcgttcaaagtgcgggtaagcactgagacttcctcaccactgagtccccctgccgtccctccgccacccgtcccggttctgccgggtgcggtgccgtcacagaccgaaaggctccctccctgtcaactgctgcgccgggagagctctgtggggtatcgagtacccgcaggatccggacccagtttaccgcccatgccatctctgcaggaggtggattgtggaagcccatctagctcagaagaagaaggcgtcccggggtcccgaggatcccccgccacaagtccccatcttggccgccgacgcccactattgagatcaatgagtgccgccttctgttccctgctggctcccgaaaggcaggtgggccgggcagccgcagcacttatgcaggatcgacacactgcggctgggcaactggtgcaggacctgctgacccaggttcgagcaggccctgaaccacaggagctccagggtatccgccaagctctgtcccgggcccgtgctatgctatctgccgagctcggacctgagaaactcctgtcgcccaaacgtctggaacacgttctggagaaatccctccattgttctgttctgaagccactccggccgatcctggctgctaggttgcgcaggcgactcgccgccgatggatcactggggcggctcgctgagggcctcagactggcccgcgcccagggacctggcgcctttggctcccatctatccctgccctcccctgtggaacttgagcaggtgcgtcagaagcttctccagctgctccggacctattcacccagcgcgcaggtgaagaggcttctgcaggcgtgtaagctcctttatatggcgttgaggacccaagagggagagggggcaggagctgatgaattcctccccctcttaagcctcgtgctggcacattgcgatctccctgagctacttttggaggcagagtacatgagcgaacttctcgaaccctctctgctgacgggagagggcggctactacctgacatcactctccgcaagtctggcgttgctgtccggcctgggacaggcacatactctgccgctgagtcccgtccaggagctgagacgcagtttgagcctgtgggagcagcgcagactgccagcaactcactgcttccaacacttgttaagggtggcctaccaagacccgagctccggatgtacaagtaagacgctggccgtgccccccgaagcaagcatcgcaacgcttaaccagctttgcgcgacgaagtttcgggtgacacagccaaataccttcggcttattcctgcagggaaatcagaggcaacgcgaagctgggcagcagcgaagttcgctcaagtggcctgagggatcttttggcgctggcgacccagagcccgcagagaaatctttctag

SEQ ID NO: 45397 - DNA, 1935 bp, Artificial Sequence
  Description of Artificial Sequence: Synthetic coding sequence
atggagcagctgagcgacgaggagatcgaccacggcgccgaggaggattctgacaaggaagaccaagacttagacaaaatgtttggcgcctggctaggcgagctggacaagcttactcagtctctggacagcgacaaaccaatggaacccgttaaaaggtcacccctgaggcaagagactaatatggctaatttcagctacaggttctcaatttacaacctcaacgaagctctcaaccagggtgaaaccgtggatctggatgcactgatggcagatctgtgttccatagagcaggagttgtcttccataggcagtggtaattccaagaggcagatcaccgaaacaaaggctactcagaagttgcccgtttcgaggcacaccctgaagcacgggaccttgaaggggctatcctcatcctccaaccggattgcgaaacctagtcatgcctcatatagcttggacgatgtgaccgctcagctcgaacaggccagtttgagtatggacgaagccgcacagcagtccgtcctcgaagacacaaagcccctggtgactaaccaacacagaaggacggccagcgcaggcaccgtgtctgacgccgaagtgcactccatctccaatagttctcatagctctattacctcagccgcctcaagcatggatagcctcgacattgacaaagtgactagaccgcaagagctcgatttgacccatcagggtcagccaataaccgaacatgcaatttccctccgctgctcgagcaagcaagcaaaaaggcacatagatttcacagaggaacaagcagagctcacaccacatagctaccttgatagggaaacttccctgttgttgcggaatatcgcaggtaaaccttcgcacttgctgacgaaagaggagcaagccgcaaagttgaaagcagagaaaatccgggtcgcactcgagaaaatcaaagaggctcaggtcaagaagctggtcatccgggtccatatgagtgatgattcctctaagactatgatggttgacgaaagacagaccgtgcgtcaagttctagacaacctgatggataaatcacactgcggctattctttggactggtctctggtggagacagtaagtgagttacaaatggaacggattttcgaggaccatgaaaacttggtcgagaatctcctgaattggacgcgagacagtcagaataagctgatcttcatggagcgcatcgagaagtatgctctgtttaagaacccccaaaactacttactggggaagaaggagaccgccgaaatggccgatcggaataaggaggttttgcttgaagaatgtttctgcgggtcctctgtcacggtcccagaaatagagggagtcttgtggctgaaggacgacgggaaaaagtcttggaagaaacggtattttctcctccgagcttcgggcatctattatgtcccaaaaggcaaagccaaagtctcacgggacttagtatgtttcctccagctggaccacgtgaatgtctattatggtcaggactatcgcaataagtacaaagcacctacggattactgtctggtgctcaagcatccacagatacagaagaagtctcagtacattaagtatctgtgctgtgacgatgtgcgtacactgcatcagtgggtaaatggcatcaggatcgccaaatacggcaaacaactgtacatgaattatcaggaggccttaaaacgaaccgagtcggcgtatgactggacatcgctttcgtcttcatccatcaagtcggggtcttccagctcttccatcccagagtcgcagagcaaccatagtaatcagtcagacagcggcgtgtccgatacccagccagcgggtcatgtaaggagccagagtatcgtgagcagcgtcttctccgaggcctggaagaggggtactcaactggaagaatctagtaagtag

SEQ ID NO: 45398 - DNA, 3753 bp, Artificial Sequence
  Description of Artificial Sequence: Synthetic coding sequence
atggagcagctgagcgacgaggagatcgaccacggcgccgaggaggactctgataaggaggatcaggatctcgacaagatgttcggcgcatggctgggcgagcttgataagctgactcaatctctcgatagcgataaaccgatggaacccgtgaaacgttcccctctccgccaagaaaccaacatggctaacttctcatatcgattcagcatctacaatctgaatgaagctctgaaccaaggcgagactgtggacttggacgccctgatggctgacctgtgttccattgagcaagaactgtcctctatcggctctggaaacagcaaacgacagattacagagactaaggccactcaaaagctacccgtttcacgtcacactcttaaacacggtaccctgaagggcctctcgagctcttccaaccggatagccaagccatctcacgccagctattccctggatgacgtgactgctcagctcgagcaggcctctttgtccatggacgaggcagcccagcagagcgttttggaagacacaaagcctttagttacgaaccagcacagacgcacagcatcagctggcactgtgtctgatgccgaagtccattccatcagcaactcatcacactcaagtatcaccagtgctgcgagttcaatggattcacttgatatcgacaaggtcacaagacctcaggagcttgacctgactcaccagggtcagccaattacggaggaggagcaggcggcaaagttaaaagctgagaagattcgcgtggctctcgagaagattaaggaagcacaagtcaagaagctggtcatccgggtgcatatgtcggatgacagttccaagaccatgatggtcgacgagcgccaaacggtgcgacaggtcttggacaaccttatggacaagtcccactgcggatactcgctcgattggtcactcgtggagaccgtttcagaactgcaaatggagagaatctttgaggatcacgagaacctcgttgaaaatctcctcaactggactcgtgacagccaaaataagctcattttcatggaaagaatagagaaatatgcattgttcaagaatccacagaactacctactggggaagaaagagaccgcagagatggcagacagaaacaaggaagttctgcttgaggaatgtttttgcgggtccagtgttacagtgcctgagattgagggggttctctggctaaaggacgacggcaagaagagctggaaaaaaagatattttctgctcagggcaagcggcatttactacgttcccaaaggcaaagccaaggtgtcccgagacctggtttgtttcctgcagctcgaccacgtgaacgtttattatggccaggactatcgtaataaatataaggctccaaccgattactgcctcgtgctgaagcatccacagatccagaaaaagtctcagtatatcaagtacctttgctgcgacgatgttcgtacgcttcaccagtgggtcaatggtatcagaatcgcgaaatacggtaaacagttatacatgaactaccaagaagctctgaaaaggaccgagtccgcttacgattggacaagcctgagctcaagctcgatcaaaagtggctcatcatcgagcagcatacctgagtcccagtcgaaccactctaaccaatccgatagcggagttagcgacacacagcccgctgggcacgtgaggtctcagtccattgttagctcggtgttttctgaggcctggaaacgaggaacccagctagaagagagtagcaaggccagaatggaatcgatgaaccgcccttatacgtcactcgtcccgcccctgtcccctcagcccaagatcgtgactccatacaccgcgtcacagccatcacctcctctgcctcccccccctccccctccaccacctccaccacctcctcctcctcctccacctcccccactgccctctcagtctgcgccaagcgccggctcagctgcacctatgtttgtaaagtacagtaccattaccaggctgcagaatgctagccagcattcaggcgcattgttcaagccccctactccacctgtcatgcagagtcagtcggtgaagccccagattttggtacccccaaacggggtggtccctcccccgccccctccaccccccccaccgactcccggctctgcaatggcacagctcaaacctgcaccttgtgcccccagcttgccgcagtttagcgccccccctcctccactgaagatacaccaggtgcaacacattacccaggtggctccgccaactccaccaccacccccgcctattccagccccactccctcctcaggctccccctaagcctctcgttaccatacccgctccaacgagtacaaagacggttgcacccgtagttactcaggcagcacccccaactcccaccccaccggttccgccagcaaagaaacaacccgcctttccggccagttacatccctccctctcccccaactccacctgtgcctgtccctcctcccacactgccaaagcagcaaagtttctgcgcgaagcctcccccatccccgctcagccccgtgccgtccgtggttaaacagattgcgagtcagtttccaccaccacctacccctccggctatggagtctcaacctctaaagccagtgccagctaatgtggccccccaaagtcccccagccgtaaaggctaaacccaaatggcaaccatcatcgatccccgtgcccagcccagattttccacctcctccgccagagagctcacttgtgtttcctcctcctcctccttctcctgttcccgctcccccaccgccaccaccccctaccgcaagcccaaccccagataagtccggctcaccaggcaaaaagactagtaaaaccagcagcccaggaggtaaaaaaccgcctcccactccacagagaaacagctctatcaagtcatccagcggggccgagcaccccgaacctaaaaggccgtctgtggactcactggtgagcaaattcactccccccgctgaaagtggaagccctagcaaggagactctcccaccccccgccgccccaccaaagccaggcaagctgaacctgagcggcgttaatctcccgggagttctgcagcagggatgcgtctctgccaaggcacccgtgctctctggtagagggaaggattcagttgtggaatttcctagtccccccagtgattctgacttccctccacccccaccagagaccgaactgcctctgccccccatcgaaattcccgcggtcttttctggcaatacatcccctaaggtagcagtggtcaatcctcaaccacagcagtggtccaagatgagcgtgaaaaaagcaccacctcctactaggccaaaacgcaatgactcaactcggttgacacaagcggaaatcagtgagcagcccacaatggcaactgtggtgcctcaggtgccaacttctccgaagtcaagtctgtcggtgcagcctgggttccttgctgatcttaaccggactctccagcggaagtctatcactcgacacggttcattgtcttcacgaatgtctagagcggaacccaccgcgaccatggacgacatggctttgcctcccccaccacccgagttgctgtctgaccaacagaaagccggctacggaggctctcatattagtggctatgcaaccctgagacgcgggccgccaccagccccgcctaaaagagaccagaacacaaagttgtcgcgggactggtag

SEQ ID NO: 45399 - DNA, 1854 bp, Artificial Sequence
  Description of Artificial Sequence: Synthetic coding sequence
atggagcagctgagcgacgaggagatcgaccacggcgccgaggaggatagtgacaaagaggatcaggatcttgacaagatgtttggggcctggctgggagagttggacaagctgactcaaagtttggatagcgataagccgatggagcccgtgaaacggtcgccactcagacaggagacaaatatggccaatttttcttaccgcttctccatctataatctgaacgaagcccttaaccagggcgagactgtggatctggatgccttaatggcggatctctgctccatcgagcaagagctgtcatcaattggttcaggaaactccaagcgccagatcaccgagaccaaggcaacgcaaaagctgcctgtctcccggcataccctcaagcacggcacgctgaaaggcctctctagcagctccaataggatcgcaaagccttcccacgcgagctacagcctagacgatgtcaccgcccagctagaacaggccagtctttccatggacgaagccgcccaacagtcggttttggaggacaccaaaccgctcgttactaaccagcataggcgaaccgccagcgcaggcactgtcagtgatgccgaggtccactccatcagcaattcctctcacagctctataacatctgccgcttcatcaatggatagtctagacattgataaagtgactcgtccacaagagttggatctcacacaccagggccagcccatcactgaacattcctatttggaccgagagacctctctgctgttaagaaacatagctggcaagccttcccatctgctgactaaagaggagcaagcagctaaactaaaagctgagaaaatcagggtggccctggagaaaattaaagaggcccaggtgaaaaagctggtcattagagtccacatgagcgacgacagttccaagacaatgatggtggatgaacgccaaacagtgcgtcaggttttggacaatctgatggacaagagtcattgtgggtactccctggattggtctttagtggagactgtctccgagctccagatggagagaattttcgaggaccatgagaacctcgtcgagaatctcctgaactggacgcgggatagccagaataaactcatcttcatggaaaggattgaaaaatacgctttgttcaagaacccacagaattatctgcttggtaaaaaggagactgctgagatggcagataggaataaagaggtgctgctggaggaatgcttctgtggaagttccgtcaccgtgccagagatcgaaggggtcctatggctgaaggacgacggtaaaaaaagttggaagaaacgttattttctgttgagagctagcggaatttattatgtcccgaagggtaaggctaaggttagccgagacttggtgtgcttcctgcaactggaccatgtgaacgtttactacgggcaggattaccgtaacaagtataaagcccccacagactactgcctcgttctgaaacacccccagatccagaagaagagtcagtacatcaaatacctctgttgcgacgacgtccgcacactccaccagtgggttaacggcatcagaattgccaagtacggtaaacagctgtatatgaactaccaggaagccctgaagcgaaccgagtcggcgtatgactggacgtctctgtcttcatccagtatcaaaagtgggtcctccagcagctccattcctgaatcgcagagtaaccatagtaatcagagcgactcaggggtttccgatacgcagcctgcggggcatgtccgctcccaaagtatcgtgtcaagcgtcttcagtgaagcatggaagagaggcacccaactggaagagagttcaaagtag

SEQ ID NO: 45400 - DNA, 1860 bp, Artificial Sequence
  Description of Artificial Sequence: Synthetic coding sequence
atggagcagctgagcgacgaggagatcgaccacggcgccgaggaggactccgacaaggaagatcaagatcttgacaagatgttcggggcgtggctcggcgaacttgacaaactgacacagtctctggacagcgacaagcctatggaacccgtgaaaagatcccctctgcgccaggagaccaatatggctaatttctcctatagattcagtatctacaatctgaacgaagcactcaaccagggcgagactgttgatctcgacgccttgatggccgacctgtgcagtatcgagcaagaactgagttcgatcggcagtggaaactctaagaggcaaattaccgagaccaaggcgacacagaagcttccggttagccgtcataccctcaaacacggaaccttgaagggcctatcttctagttctaacaggattgctaaaccgagccatgcttcttatagtctagatgacgtgaccgcccaactggaacaggcttctctgagtatggatgaggcagcccagcagagtgtgctggaagatacaaagccgctcgtgactaaccaacacaggcgaaccgcctcagccggtactgtgagtgacgctgaggtgcactcaatttccaatagcagccatagctccataacttccgctgcttcatctatggactcgctcgacattgataaggtgacccgccctcaggagttagatttaactcaccagggccagcctataacggagcacgcgatctcactgcgctgtagttccaaacaggccaaacgccacattgacttcacagaagaacaggccgagctaacccccgaggaacaggccgcaaagctcaaggccgaaaaaatcagggtggcattggaaaaaatcaaagaggcgcaggtgaagaaacttgtaattagagttcacatgtccgacgacagctccaaaacaatgatggtggacgaaaggcaaactgtacggcaggttctcgacaacctcatggacaaatcacattgcggctacagcctcgactggagcttggtcgagaccgtttcagagctgcaaatggagcggatatttgaggatcacgagaacctggttgaaaacctgctgaattggacgagagattcacagaataagttaatttttatggaaaggatcgagaagtatgctttattcaagaacccgcagaattatctgttagggaagaaagagactgccgagatggctgacaggaataaggaagttctgctcgaggaatgcttttgcggatcgtcggtaacagtgccagaaattgagggcgttctttggctgaaagatgacggtaagaaaagttggaagaagagatattttctgttacgtgccagcggcatttactacgtgcctaaagggaaggcaaaagtctctagagacctggtgtgctttctacagttagatcatgtgaatgtctattatggccaggattaccgaaacaaatacaaagccccgacagattactgtttagtcttgaaacacccgcagatccaaaagaagtcccaatacattaagtacctgtgttgcgatgacgtgcgcacactccaccagtgggtgaacgggattcggattgccaaatatgggaagcaactgtatatgaattatcaggaggccttgaaacgaacagagtcagcttacgactggacatctctctcttcgtccagcatcaagtctggatcttcctcctctagcattcctgagagccagagcaaccatagcaatcaatccgacagcggcgtgtctgacactcagcctgccgggcatgtgaggtctcagagcatcgtctcctctgtgttcagcgaagcatggaaacgcgggactcagctcgaggaaagttctaagtag

SEQ ID NO: 45401 - DNA, 3909 bp, Artificial Sequence
  Description of Artificial Sequence: Synthetic coding sequence
atggagcagctgagcgacgaggagatcgaccacggcgccgaggaggacagtgataaagaagatcaggacctggataagatgttcggagcctggttgggagaactggacaagctcacacaaagtctggattccgataaaccaatggagccagttaaacggtcccccttacgtcaggagaccaatatggccaattttagctatcgcttttcaatatacaacttgaacgaagccctaaatcagggggagaccgtcgacctcgacgcactcatggctgacttatgcagcattgagcaggagctgtccagcatcggttccggcaactcgaaacgacagattaccgaaaccaaagcaactcagaagttgcctgttagcaggcacactttgaagcatggcaccctgaaaggcctgtcttcctcaagcaaccgcatcgccaagcctagtcatgccagttactccctggatgacgtcacagcccaactggagcaggccagcctgtcgatggacgaggctgctcagcaatccgtgctcgaggataccaagcctctcgtgacgaaccagcacaggcggacggcctccgccggcacagtcagcgatgcggaggtgcacagtatcagtaactcttcacattcttccattacatcagcagctagctcgatggatagccttgacattgataaggtcacccggccccaggagctggatctaactcatcaggggcaacccattactgaacatgctataagcctgcggtgtagctctaagcaggccaagaggcatatcgacttcactgaggaacaggctgagctgacaccacactcctaccttgaccgcgaaacatccctgctccttagaaacatagccggtaagccaagccacctgctcaccaaagaagagcaggcagccaagctgaaggctgagaaaattcgagttgcattggagaagattaaagaagcacaagtgaaaaagctggtcatccgtgtgcacatgagcgatgattcttctaaaaccatgatggtggacgaacgtcagactgtcaggcaggttttggataatctgatggacaagtctcactgcggctactcactggattggagcctggtagaaaccgttagcgagctccagatggagcggatcttcgaggaccatgaaaatctagtcgagaacttattaaactggacaagggactcccagaataagctcatcttcatggaacgaatagagaaatatgcgctgttcaagaatccgcagaattatttacttgggaagaaggagactgccgagatggccgatcgcaataaggaggtcttactggaggagtgtttctgtggaagtagtgtgaccgttccagagatcgagggagtgctttggctcaaggacgacggcaaaaaatcctggaagaagcggtactttctgctccgggctagcgggatttattacgtgcccaaaggcaaggcaaaagtgtctcgcgacctcgtatgcttcctacagctggaccacgttaatgtttactacgggcaggactatcggaataagtacaaagcaccaacggactattgtcttgttctgaagcatccccagattcagaagaagagccagtacattaaatacctctgctgtgacgacgtccggacactgcatcaatgggtcaatggaattaggatcgccaagtacggaaaacagctctatatgaactaccaagaagcccttaagcggactgaaagtgcgtacgactggacgagcctctcctcctcttctatcaaatctgggtcctcaagctcatcaattcccgagtcccaatctaatcacagcaaccagagtgatagcggggtttctgacacgcaaccagcgggacatgttcggtcgcagagcatcgtgtcatcagttttttctgaggcatggaagcgaggtacccaactagaggaatcctctaaagcaaggatggagtccatgaataggccgtacacgagcttggtgccgccgctatcccctcagcccaagatagttacaccctacactgcctcacagccaagccctcctctgcctccccctcctccgccccctccccccccacctccgcctccccctccccccccacctcccctgccttctcagtcagcacccagcgctggatccgccgcccccatgttcgtcaaatactccacgatcactcggctccagaacgcttctcagcacagtggagccctgtttaagccaccaaccccacctgtgatgcagagtcaatcggtgaaaccccagattctggtcccccccaacggagtggtgcctccccctcctcccccgcctcccccacctacccccggcagtgctatggcacagttaaaaccagccccgtgcgctccttcactgccccagttttctgcaccgccaccaccgttaaagatccatcaggtgcaacacatcacacaagtggcaccaccaacaccccctccgcctcctcctataccggcccccttgccaccacaggcacctcccaaaccgctcgtcacgatacccgcacccacgtccacgaaaacagtcgcacctgtggtaactcaggcagcacctccaacccccacaccacccgtgcctccggcgaaaaagcagccagccttccctgcctcgtacatcccacccagcccccccacgccaccggtgcctgtaccccctcccacccttcctaagcagcagtccttctgtgcaaagcctcctccatcccccctttccccggtgccgagtgtagttaagcaaatagccagtcaatttccacctcctccaacaccccccgctatggaatctcagccattgaagcccgttcccgcgaatgtcgccccccagtcaccacccgctgtgaaagcgaagccgaagtggcagcccagctccatcccggtcccgtctccagatttccctccaccaccaccagaaagcagtctggtgttccccccccccccgcccagtcccgttcccgcgccaccaccgcctcccccccctacagcctcgccgacccctgataaaagtggttctcctggtaaaaagaccagtaagactagttcgcccggcggaaaaaagccacctcccactcctcagcgaaacagtagcatcaaaagctcaagcggcgcggaacatcccgaaccaaaaagaccttccgtggacagtcttgtttctaaatttacacccccagctgagagcggcagcccctcaaaagaaaccctgcccccccctgccgcaccgcccaagccagggaaactaaatctgtctggcgttaatctgcctggagtgctgcaacagggctgcgtgtcagccaaagcccccgtgttgtcgggcagaggcaaggactcagtcgtcgaatttccttcaccccctagcgattccgactttccaccacccccccccgagactgagctgccactgccgccaatagaaattcctgcagtgttcagcggtaacacaagcccaaaggttgccgttgtgaaccctcagccccagcaatggtcgaagatgagcgtgaagaaggctccgccaccaacccgaccgaagagaaacgactcaactagattaacccaggctgagatctcggagcaacctactatggccaccgtggtaccgcaggttcccacctcaccaaagtcttcactctccgtgcagccaggcttcctggcagacctcaacagaacacttcagcgaaagtcaataaccaggcacggtagcttgtcaagtcggatgtcccgtgctgaaccgaccgccacaatggatgacatggcactgcctcctccccctccggagctgctttcggaccagcagaaggcaggctatggtggtagccacatcagcgggtacgcaactctccgaaggggtccacctcccgcgcccccgaaacgggaccaaaacactaagctcagcagagattggtag

SEQ ID NO: 45402 - DNA, 1875 bp, Artificial Sequence
  Description of Artificial Sequence: Synthetic coding sequence
atggagcagctgagcgacgaggagatcgaccacggcgccgaggaggattcagataaggaggatcaggacctcgacaagatgttcggagcgtggctaggcgagctcgacaagctgacgcagagcctggattctgacaagcccatggagcctgtaaagagaagtcctctaagacaggagacaaatatggcaaacttctcttataggttcagcatctataatcttaatgaggctctaaatcagggggaaacagtggacctggacgccttgatggctgacttatgttccattgaacaagagttgtcgtctatcggcagtggaaattctaaaagacagatcaccgagactaaggcgacccagaagctgcccgtgagtcgccacacgctaaagcatggcactctaaagggtctgtcctcctcttccaacagaattgctaaaccatcccatgcgtcatattccctggatgacgttacggcacagctggagcaggcctccctgagcatggatgaggccgcacagcaaagtgtcctcgaagacaccaaaccactggtcactaatcagcacaggcggacggctagtgcagggactgtgtccgatgctgaggtgcactcaataagcaatagctctcactcttcaataaccagcgccgctagcagcatggatagtttagatattgacaaggtgacaaggccacaggagttagatttaacccaccaggggcagcccataaccgaacacgccatttcacttcgatgttcctctaagcaggcgaaacgccatatagattttacggaagagcaggctgaactaacaccggaggagcaagccgccaaattaaaagctgaaaaaatcagggtggccctggagaaaataaaagaagcacaggttaagaagctggttattagggtacacatgtctgatgattctagcaaaactatgatggtagatgagcggcaaactgttcgacaggtgctggacaacctgatggacaagtcccattgcggatatagcctcgactggtccctcgtagagacggtcagcgagctccagatggagagaatttttgaggaccacgagaatctggtggaaaacctgcttaattggaccagagactcccaaaataagttgatattcatggagcgcatcgaaaaatacgccttattcaagaatccgcagaattacctgctaggaaaaaaagagactgcagaaatggccgaccgcaataaggaagttctgctcgaggaatgcttttgtggcagttccgtgaccgttcctgagattgagggggttctatggctcaaagatgacggcaaaaaatcttggaaaaaacggtactttctcctccgtgcttcaggcatctactatgtgcccaagggaaaggcgaaggtctcaagggatcttgtctgttttcttcagctggaccacgtgaacgtatactatggacaggactataggaacaaatataaagcacccacagattactgcttggtcctaaaacatccgcagatacagaagaagagtcagtacataaagtatctgtgttgcgatgatgtcagaacacttcatcagtgggtgaatgggattaggattgcaaagtacggaaaacagctgtacatgaactatcaggaagccctgaaacgaacagagtcagcttatgattggacttccttatcgagcagcagcatcaagtcaggatcctcaagcagctcaatccccgagtcacagtcaaatcattcaaaccagtctgactccggggtgtccgacacacagcctgcggggcatgtgcgcagtcaaagcattgtgagcagcgttttttccgaggcttggaagcgaggaacgcagctcgaggagtcttctaaagtgactgcttcattctag

SEQ ID NO: 45403 - DNA, 1794 bp, Artificial Sequence
  Description of Artificial Sequence: Synthetic coding sequence
atggagcagctgagcgacgaggagatcgaccacggcgccgaggaggatagcgataaagaggaccaagatctggacaaaatgttcggcgcttggctgggcgagctcgataagctgacacaaagtttagatagcgacaaacctatggaacccgtgaaaaggtctccattacgccaagaaaccaatatggccaacttcagctacaggttctcgatctataacctgaacgaggccttgaaccagggggaaactgtggatctggacgcactgatggccgatctctgcagtattgagcaggaactcagcagtatcggatcagggaattctaagcgacaaattacagaaacgaaggcaacacagaagctgcccgtttcgcggcacacgcttaagcatgggactttgaagggcctctcatctagctccaataggatcgccaaacctagccacgccagctacagtctggatgatgttaccgcacagttagaacaagccagtctctcgatggacgaggctgcacagcagtccgtcctggaagataccaagccgttagtcactaaccagcaccgcagaaccgcatcagcgggtactgtgtccgatgcggaggttcattctatatcaaactcgtcccattcctcaattactagcgcagcctcaagtatggacagcctcgacatagacaaggtgactagaccgcaagaactggacctaacccaccagggccagcctataaccgaagaggaacaagccgctaagctaaaggcagaaaaaatccgcgtcgcattggaaaagatcaaggaggcgcaggtgaaaaagcttgtcatccgggtgcacatgtccgacgactcatcgaaaactatgatggtggacgagcggcagaccgttaggcaggtgctggataacctcatggataagtcccattgcggttactctctagactggagtcttgtagagactgttagcgagctgcagatggagagaatttttgaggaccacgaaaacctggtggaaaatctgctgaactggactagggactctcaaaacaagctgatcttcatggaacgcatagaaaaatatgctctgttcaaaaacccacagaactacctgctgggcaaaaaggaaacagcagaaatggccgacaggaacaaagaggtgcttctcgaggagtgtttttgtggttcaagcgtcactgttccagaaatcgagggggttctctggctcaaggacgatggaaaaaaatcttggaaaaaacgctactttcttcttcgggcatctggcatttactacgtaccaaaaggtaaagccaaggtttccagagacttggtctgttttcttcaattggatcatgtgaatgtatattatggccaggactaccgaaacaagtacaaagctcctactgactattgtctggtcttaaagcacccacagattcagaagaaaagtcagtatataaaatatctgtgttgcgatgacgttcggactttgcaccagtgggtgaatggcatccgcattgcgaagtatggtaagcagctctacatgaactaccaagaggcgctaaagcggaccgagtccgcatatgactggactagtctgagtagtagctccattaagtcaggttcttcctcaagctcaataccggagtcacagtccaaccactcaaatcaatccgattcaggtgtgtccgacacccagcccgcaggccatgtgcgctcacagagcatcgtgagtagtgtgttttccgaggcctggaagagaggcacacagctggaggagtccagcaaggtaactgcatccttttag

SEQ ID NO: 45404 - DNA, 1779 bp, Artificial Sequence
  Description of Artificial Sequence: Synthetic coding sequence
atggagcagctgagcgacgaggagatcgaccacggcgccgaggaggattctgacaaggaagatcaggatctggacaaaatgttcggcgcctggctaggcgaactggacaaactgactcaatccctggatagcgacaagccaatggaacccgtgaagcggtctcccctccgacaggaaacaaacatggccaacttctcttaccggttctcaatctacaacctaaacgaagccttgaaccagggcgagactgttgatctggacgctctgatggctgatctctgttccattgagcaggagctctcttccatcgggagtggcaatagtaagcgtcaaataacggagacgaaagcaactcagaagctgcctgtatcccgacacaccttaaagcacggaacgctcaagggtctgagtagcagctcgaatcggatcgccaaacccagccacgcttcttactcactggacgatgtgacggcccagctggagcaagcctcgctgtctatggacgaggccgctcagcagtctgtcctggaagacactaagcctttggtgaccaaccagcacaggagaactgccagcgccggtactgtgtctgacgcggaagtgcattcgatttcgaacagcagccactcgtccattacttccgccgcttccagtatggattccctggacatcgacaaagtaactcgcccgcaagagctcgatctcactcaccaaggacagccaataacggaggaagaacaggccgctaaacttaaggccgagaaaattcgggtggccctggagaagataaaggaggctcaggtcaaaaagcttgtcataagggtgcacatgtcagacgactccagcaagacaatgatggtcgacgagcggcagaccgtgagacaggtgctagataatctgatggacaagtctcactgcgggtatagcctagattggtccctcgttgagacggtgtctgagctgcaaatggagagaatctttgaggatcacgaaaatctagtggagaatctgctgaactggactagggactcccagaacaaactgatatttatggaacggatcgagaagtatgcactcttcaagaatccccagaactacctgctcggaaagaaggaaaccgcagagatggcagaccggaacaaagaagtgttgcttgaggagtgtttctgtggcagctccgtcacagtgcccgagatagaaggcgtactctggctcaaggacgatggcaagaagagctggaaaaaaaggtacttcctactgagggccagcggaatctattatgtccctaagggaaaggctaaagtgtccagggatcttgtgtgttttctgcagttggaccatgtgaatgtttattacggccaggattacagaaataaatacaaagctccaaccgactactgcctggtactgaagcacccccaaattcagaagaagagtcagtatatcaaatatctgtgctgcgacgacgttagaactctccatcagtgggtgaacggcatccggatcgcgaaatacgggaagcagctgtatatgaactatcaggaggctctgaaacggacggagagcgcctacgattggacgtccctgtcatcttcttcaataaaatctggctcaagctcttcatccatcccggaaagccagagcaatcatagcaaccagtccgacagcggagtctctgacacccagccagcaggccacgttcggtcccagtccattgttagctctgtcttcagcgaggcatggaagcggggtacacaactggaagaatcatcgaagtag

SEQ ID NO: 45405 - DNA, 270 bp, Artificial Sequence
  Description of Artificial Sequence: Synthetic coding sequence
atggagcagctgagcgacgaggagatcgaccacggcgccgaggaggattctgataaggaagatcaagatctagacaagatgttcggcgcttggctgggggaactggacaagttgacacagagcttggactcagataagcccatggaaccagtaaaacggagtcctctgagacaggaaaccaacatggcaaactttagctatagatttagcatttacaatctaaatgcacttaatcagggcgagacagtagatctggatgccctgatgtag

SEQ ID NO: 45406 - DNA, 1860 bp, Artificial Sequence
  Description of Artificial Sequence: Synthetic coding sequence
atggagcagctgagcgacgaggagatcgaccacggcgccgaggaggattccgacaaagaggaccaggatctcgacaagatgtttggcgcctggcttggcgaattggacaaactgacacagagcctcgactcggacaaacccatggaacctgtcaagaggtcgccactgcgccaggagacgaatatggcgaatttttcctaccgattctctatttacaacctgaatgaggcgctaaaccagggcgaaacagtggacctagacgccttgatggctgatctctgctctatcgagcaggaactgtcctctataggatccggtaatagtaagagacagattactgaaactaaggccacgcaaaaactgcctgtcagcagacacacactcaaacacgggacactgaagggcctgtcctcttcctcaaacagaattgctaagcctagccacgcatcatacagcctggacgacgtcacagcccagctggagcaggcatctctctccatggatgaagccgcccagcaatccgtcctggaagatacaaagcctttggtgactaatcagcacagaaggacagcatccgccggtaccgtttctgacgcagaggtgcatagcattagtaactcttctcactcatccattacgtctgctgcctcgtccatggactctctggacattgataaagtgacccgtccccaggaactggacctgacccaccaggggcagcctatcacagaacatgccattagccttcgctgttctagcaaacaggcaaagcggcacatagactttaccgaagagcaggcagagctgacacccgaggagcaagctgcaaaactcaaagccgagaagatccgcgtcgcgcttgaaaagatcaaggaggctcaggtgaagaagttagtgataagagtgcacatgtccgatgactcttcaaaaaccatgatggtggatgagaggcaaaccgttcgccaggtgttagataacttgatggataagtcccactgcgggtactccttggattggtctttagtggagacagtcagcgagctgcagatggagcgcatctttgaagatcacgaaaacttggtcgagaaccttcttaactggacaagggattcccagaacaagcttatcttcatggagagaatcgaaaagtatgcgctcttcaaaaatccccagaattatctgttaggcaagaaggaaacagccgaaatggcagataggaacaaagaggtgttgctcgaggagtgcttttgcgggtcatccgttacggttcccgagatcgaaggtgtgctatggctgaaggatgacgggaagaagtcctggaagaaaaggtattttctgttacgcgcctctggtatctactacgtgccaaagggaaaggcgaaggtgtctcgtgatctcgtgtgctttctccagttggaccatgtgaacgtatattatggacaggactatcgaaataagtacaaagcgccgacggactattgcctggtgctgaagcatccacagatccagaagaagtcccagtatataaagtacctttgttgcgatgacgttcgcacactacaccagtgggtgaatggcatacgcattgccaaatacggcaaacagttgtacatgaactaccaggaggctctcaaacggaccgagagcgcttacgactggacatcactgtcctcctcaagtattaaatcaggctctagctcctcctccattcccgagagtcaatccaatcattcaaaccagagcgactcgggcgtctcagacacgcagccagctggtcacgttcgttcccagtccatcgtatccagtgttttctccgaagcctggaaaagaggaacacagcttgaggaaagctctaaatag

SEQ ID NO: 45407 - DNA, 519 bp, Artificial Sequence
  Description of Artificial Sequence: Synthetic coding sequence
atggagcagctgagcgacgaggagatcgaccacggcgccgaggaggactctgataaggaagatcaagacctcgacaaaatgtttggtgcttggcttggtgagctagataaattaactcagtccttggactccgacaaacccatggaacccgtcaagcgctccccattgcgacaagaaactaacatggcaaacttctcctacagatttagcatttataacctcaatgaggcacttaatcagggagaaactgtcgatctggacgccttaatggccgatctgtgttccattgaacaggagctgtcaagtattggaagtgggaacagcaagcggcaaataactgagaccaaagcaacccagaaactgccggtgtcacgccatacgttaaaacacggtacactaaagggattgagcagctctagcaataggattgccaagccttcacacgccagttactctttagacgatgtgaccgcccagttggaacaagccagtcttagtatggatgaagcggctcagtag

SEQ ID NO: 45408 - DNA, 1869 bp, Artificial Sequence
  Description of Artificial Sequence: Synthetic coding sequence
atggagcagctgagcgacgaggagatcgaccacggcgccgaggaggattccgacaaggaggatcaagacctcgacaaaatgttcggagcctggctcggcgagctcgacaaactgacacagagcctggacagtgacaaaccaatggagcctgtcaaaaggtctcccttaagacaagaaacaaatatggcaaacttctcatatagattcagtatctataatttgaatgaggccttaaaccagggtgagacggtcgacctcgacgccctgatggcagacctgtgcagtattgaacaggagctgtccagcatcggttcaggcaacagcaaacgtcagattaccgagacaaaggctactcagaaactgccggtgtctcggcatactctgaagcacggcacactgaagggactatcttcctcttcaaacaggatagctaagcccagccacgcctcatatagtctagacgacgtcactgctcagcttgagcaggcatcactctctatggacgaggctgcacagcaatcagtgcttgaggatacaaaaccactggtaacaaatcaacatagacggacagccagcgccgggacggtcagcgatgcagaagtgcactcaatctcaaatagcagtcatagttctataactagcgccgcctcaagcatggatagtctggatatagataaggtcactcggccacaggaattggatctgacccaccagggccaaccaataaccgaacattcctatctcgacagggaaacaagtctgctgctgcggaacatcgccgggaaacccagccacttattgactaaagaagaacaggcagccaagctgaaagctgagaagatccgcgtggcccttgagaaaatcaaggaagctcaagtaaaaaagctggttatccgagtgcatatgtcggacgattcttccaagacaatgatggtggatgaacgccagacggttcgtcaggtgttagacaaccttatggacaaatcccactgtgggtacagcttggattggagcctggttgaaactgtgagcgagctgcaaatggaacgcattttcgaggaccatgagaatctagtggagaacctgctgaattggactcgagattctcaaaacaagctgatatttatggagcgcatagagaagtacgccctcttcaagaacccccagaattaccttctggggaagaaagagacagcagaaatggccgataggaataaagaagtcctcctggaggagtgtttctgcggaagttcagtgaccgtgcctgagatcgagggagtgttgtggctgaaggatgatggaaaaaaatcttggaagaagcgctactttctcctgcgcgcttccggaatatactatgtacctaagggtaaggcgaaggtctctcgcgatctggtgtgcttcctccagttggaccacgtgaatgtgtattacggacaggactacagaaataagtacaaggctcccactgattactgcctagtcctgaaacatccgcagatccagaagaaatcacagtatatcaaatatttgtgctgcgacgatgtgaggacactgcaccagtgggtcaatggaattcgcattgcaaaatatggcaagcaactctacatgaactaccaggaagctctaaagaggacagaatcggcgtacgactggacatccctttcctcaagttcaattaagtccggttcctctagtagcagtatcccggagagccagtctaaccatagtaatcagagtgattcaggtgtcagcgacactcagcccgccggtcatgttaggagccagagtatcgtttcaagcgttttttcagaagcttggaagagagggactcagctggaagagtcatccaaagttaccgcaagcttctag

SEQ ID NO: 45409 - DNA, 1854 bp, Artificial Sequence
  Description of Artificial Sequence: Synthetic coding sequence
atggagcagctgagcgacgaggagatcgaccacggcgccgaggaggattctgacaaggaagatcaagacttagataaaatgttcggcgcctggcttggggaactggacaaactgactcagtcactggattcagacaagccaatggaacctgttaaacgatccccactacggcaagaaactaatatggccaatttctcctatagattcagtatctataatctgaatgaagctctgaatcaaggtgaaacggtcgatctagatgcccttatggcagatctctgctctatcgagcaagaactttcctctatcgggtctggcaattcaaagcggcaaatcacagaaactaaggctacccagaagctgcctgtgtcaaggcatactcttaaacatgggaccctgaaggggctgagttcaagcagcaaccgtatagccaaacctagccacgccagttacagcctcgatgatgtgaccgcccagcttgagcaggcctccctttccatggatgaagctgcccaacagtctgtgttagaggacacaaaacccctagttaccaatcagcaccggagaacagccagtgccggcactgtctcagatgcggaggtgcactccatcagcaactcctctcacagctcaatcacttcagctgcatcttctatggactcacttgacatcgacaaagtcactcgccctcaggagctcgatctcacacatcaaggccagcccataaccgagcactcatatttggacagagagacctccctgctgcttagaaacatcgcagggaagcccagccacctgctcacaaaagaggaacaggctgccaagttgaaagctgagaaaattcgggtggctctcgagaaaattaaagaggctcaggtgaagaagctagtgatcagggtgcatatgtccgacgattcatcgaagacgatgatggtcgacgaaagacagacagtgaggcaggtgttggacaacctgatggataagtctcactgcggctacagccttgactggtcacttgtggagactgtgagtgaacttcagatggagagaatttttgaagaccatgaaaacctggtcgagaacttgctaaactggactagagattcccagaacaaacttatttttatggagcgaatcgaaaaatatgcactcttcaagaatccacagaactatctcctcgggaaaaaggagaccgccgagatggctgacaggaataaagaggtccttttggaggaatgcttctgtggcagcagcgtaactgtcccagagattgagggagtgctgtggctaaaagacgatgggaaaaagtcctggaagaagcgatattttcttttgagagcctcagggatctactatgttccgaaaggtaaggcaaaagtctctcgagacctggtttgtttcctccagctggatcatgtcaacgtctactatggccaggactacagaaacaaatacaaggccccgactgattattgcctcgtcctgaaacaccctcaaatccaaaaaaaaagccaatatattaaatatctgtgctgtgacgatgtgaggacactccatcagtgggttaacgggattcgcattgcaaaatatggtaaacagctgtacatgaattaccaggaggctctgaagcggaccgagagtgcgtatgattggaccagtttgagcagtagctcaatcaagagcggcagcagctcctcgagcattccagagtctcaatccaatcacagcaaccaatctgattccggcgtgtcagatacccagccggcaggacacgtgcgtagccagtccatcgtgtctagcgtgtttagcgaggcgtggaaacgaggaacacagcttgaggaatcatcaaagtag

SEQ ID NO: 45410 - DNA, 1950 bp, Artificial Sequence
  Description of Artificial Sequence: Synthetic coding sequence
atggagcagctgagcgacgaggagatcgaccacggcgccgaggaggacagcgataaagaagatcaggatctggataaaatgttcggcgcttggctcggcgaacttgataagctgacacaatcccttgactctgataagccaatggagcctgtgaaacggagtcccttacgccaagaaactaatatggctaattttagttaccggttctctatttataaccttaacgaggcgctcaaccagggcgaaacagtggacctggacgcgctcatggccgatctgtgttccattgagcaggagctctcttctatcggcagtggtaacagcaagcggcagatcactgaaactaaggccacacagaagctaccagtgtcacgtcacactttaaaacatggaacactcaaggggcttagcagctcttctaacagaatcgccaaacccagtcacgcaagttacagtttagacgacgtcaccgcacaacttgagcaggcttctctctctatggatgaagctgcccagcagtccgtgctggaggatacaaaacctctggtcaccaaccagcatagacgcaccgctagcgctggcaccgtcagcgacgccgaggttcatagcatctccaacagcagtcacagcagcatcacctctgccgctagctctatggactcattggacatcgataaagtgacaagaccacaagaattagatctaacccatcagggacagccaattacagaacacgccattagcctccggtgttcatccaagcaggccaagcggcatatcgatttcaccgaggagcaggctgaattgacacctcacagctacctggacagggaaacttccctactcctgcggaacattgccggtaagccctcccacctgctgaccaaagaggaacaagctgccaagctaaaggctgaaaagatcagggtggcactggaaaagatcaaggaagctcaagtgaagaaacttgtgatacgggtccatatgagcgacgactcctctaaaaccatgatggtcgacgagcgccagaccgtccggcaggtactggacaacctgatggataaatctcactgcggttacagcctagactggtccctggttgagaccgtgtcagaactgcagatggaacggatctttgaagaccacgaaaacctggttgaaaatctattgaactggacgcgcgattcacagaataaattgatattcatggagagaattgagaaatacgcattgttcaagaacccacagaactaccttttaggtaagaaagaaaccgcggaaatggcggacagaaacaaagaggtgttacttgaggaatgcttttgcggtagcagcgtcactgtgcctgaaattgagggcgttttgtggttaaaagatgacgggaagaaaagttggaagaagaggtatttcctgctgagagcatcagggatttattacgtgccaaaaggcaaggctaaagtgtccagagacctggtctgtttcctacagttagaccatgtaaacgtgtattatggacaagactaccgcaataagtacaaggcacctaccgactactgcctggttctgaagcatcctcaaatacagaaaaaatcccagtacattaagtacctctgttgtgatgacgtgcgaacacttcatcagtgggttaacggcattaggatcgctaagtacgggaagcaactttatatgaattatcaggaggccctgaagcggacagaatcagcatatgactggacatctctgtcaagttctagtatcaagagtggttcttcgtcgtcaagcatacctgagtcccaatcgaatcattctaaccaatctgatagtggagtctcagatacccaacctgcaggccacgtgcgtagtcaatcaatagtctctagcgttttttcagaggcctggaagagaggcacccagcttgaggagtcatccaaggtcacagccagtttttag

SEQ ID NO: 45411 - DNA, 2073 bp, Artificial Sequence
  Description of Artificial Sequence: Synthetic coding sequence
atgggcagcagcggcctgggcaaggccgccaccctggacgagctgctctgtacttgcattgagatgtttgatgacaatggtgagttggacaactcctacctgcctcgcattgtgcttcttatgcacaggtggtaccttagttcaaccgaattggcagagaagctgctgtgcatgtatcgaaatgcaactggtgaatcttgtaacgaatttagattaaagatctgttacttcatgcgctattggattctgaaatttcccgccgagttcaatttagacctagggctcatcaggatgactgaggaatttcgggaggttgccagtcagctgggttacgagaaacacgtaagtctgatcgacatttcttccattccctcttacgattggatgaggcgggttacccagcgcaagaaggtcagcaagaaaggcaaagcttgcttgctgttcgaccacctcgagccaatcgaactagcagaacatctgacgtttctggagcataaaagcttccggagaattagttttacagactatcagagctatgtcatccacggctgcctggagaacaaccctaccctggagaggtccattgctcttttcaatggtatttctaagtgggtgcagctgatggtcctgtctaagcctactcctcagcagcgggccgaagtcatcactaagttcatcaatgttgccaagaagttactccagttgaaaaactttaacaccctcatggccgttgtcgggggtctctcccactctagtatttcccgattgaaagaaacgcattctcacctgtcctctgaggttacaaagaactggaatgagatgacagagctggtgtcctctaacggaaactattgtaattatcggaaagccttcgccgactgtgatgggtttaaaattccgatcttgggggtgcatctgaaggatttgattgctgttcatgtgattttcccagattggacagaagaaaataaagttaatatagtgaagatgcatcaactcagtgtcaccctgtccgagctcgtctcactgcaaaacgcctcccaccacctggaacctaatatggatctcattaacttactgactttatcactggatctgtatcacacagaagacgacatctacaagctgtcactcgtgctggaacctaggaactccaaatcgcaacccacgtccccaacgacccctaacaagcctgtggttccgttggagtgggccctgggtgtgatgcccaaaccagaccccacagttatcaataagcacatccgcaagttagtggagtctgtgtttaggaattatgaccacgaccatgatggctatatctctcaggaggactttgagagtatcgccgcaaactttccattcctagattcattctgtgtgctggataaggaccaggatggcctgatttccaaggatgagatgatggcatatttcctcagagccaagagtcagctgcactgcaagatggggcctgggttcatccataatttccaagagatgacatatctgaagcctactttctgcgagcactgtgcgggcttcctgtggggcatcatcaagcagggctataagtgtaaggattgtggcgccaattgccacaagcagtgcaaagatctgttagttctggcctgccggcggttcgcaagagctccctccctgtcaagcggtcacggatcacttcctggctcccctagcctgccacccgcacaggacgaagtgttcgagttccctggggtgactgccggccatagggatctggactccagagccattacactcgtgaccggctcctcccgaaaaataagcgtgcgactgcagcgggctacaacaagccaggccacccagaccgagccggtgtggtcagaggcgggatggggcgactctggatcccataccttcccgaagatgaagtccaaattccacgataaggcagcgaaggataaaggctttgctaaatgggagaacgagaagccaagggtacatgctggtgtcgacgtggttgatcgaggcaccgagtttgagcttgaccaggacgagggcgaggagacccggcaggacggcgaggacggatag

SEQ ID NO: 45412 - DNA, 2073 bp, Artificial Sequence
  Description of Artificial Sequence: Synthetic coding sequence
atgggcagcagcggcctgggcaaggccgccaccctggacgagctgctgtgtacctgcatagaaatgttcgacgacaacggtgaacttgataattcatacctgccgagaattgtgctcctcatgcacagatggtacctgtcttccaccgagttggcggagaagttgttgtgcatgtaccggaatgcaacaggggagagctgtaacgagttccgactgaagatctgctatttcatgcgctactggatcctgaagttccctgcagagtttaacctcgatctcggattgatccgaatgaccgaggagttcagagaagttgcatctcagctcggatatgagaagcacgttagtctgatcgatatcagctctatcccttcctacgattggatgcgccgagttactcaaaggaagaaagttagtaagaaggggaaggcttgtctgctgtttgaccacctggaacccatcgaactggcagagcacctcacattcctggagcacaagtcctttcggagaatctctttcacggactaccaaagttatgtaatccatggatgcctggagaacaacccgacgttggaaagatcaattgctttgttcaacggaatttctaagtgggtccagctgatggtgctgagcaaacctacacctcaacagcgagccgaggtgattacgaagtttattaatgtcgccaagaagttgctgcaactcaaaaattttaataccttaatggctgttgtcggggggcttagccactcttcaatttcaagacttaaagaaacccattcccatctctcatccgaggtcacgaagaattggaacgagatgaccgaactcgtctccagtaacggcaactattgcaattatagaaaggcctttgccgattgtgatgggtttaaaataccaatattaggggtgcacctcaaggacctgattgcagttcatgttatattccccgactggaccgaggaaaacaaggtcaacatcgtcaaaatgcaccagctatccgtgactctttccgagctggtcagcctgcagaacgcctcccaccatctggaacccaacatggatttgattaaccttctgacactgtcacttgacttataccacaccgaagatgatatttataagctcagcttagtactggagccccgtaattcgaagtctcagcccacaagccccacgacccctaataaaccagtcgttcccttagaatgggctctcggagtcatgcctaaacccgaccccaccgtgataaacaagcacatacgcaaactggtggagtccgtgtttaggaattacgatcacgaccacgacggatacatctctcaggaggatttcgagtctatagccgcgaattttcccttcctggattcattttgtgtactcgataaagaccaggatggattgattagcaaagacgaaatgatggcctacttcttgcgagctaagtcgcagctccattgtaaaatgggccccgggtttattcataatttccaggaaatgacctacttaaaaccgacattttgtgagcattgcgctgggttcctttggggaatcataaaacagggatacaaatgtaaagattgtggcgcaaattgccacaagcagtgcaaagatttattggttttagcatgccgaaggttcgctagggctccgtcactgagttccggccacggttccctgcccgggtcccctagtctgcctcccgctcaggacgaagttttcgagttccccggggtcaccgccgggcatcgggatctcgactcccgtgcaattacactcgtgaccggatccagtcgcaaaatctctgtgcgtttacaacgggcaactacgagtcaggcaacccagacagagccagtctggagtgaagccggctggggcgatagtggctcacataccttccccaaaatgaagagtaaattccacgacaaagctgcaaaggacaaaggttttgctaaatgggagaacgagaaacctcgggtgcacgctggggttgacgtcgtcgatcgcggaactgaatttgaactagaccaggatgagggtgaggaaactcgccaggacggggaggatgggtag

SEQ ID NO: 45413 - DNA, 2070 bp, Artificial Sequence
  Description of Artificial Sequence: Synthetic coding sequence
atgggcagcagcggcctgggcaaggccgccaccctggacgagctgctgtgcacttgtattgagatgtttgatgacaacggcgagcttgacaatagctacctgcctagaattgttctcttaatgcacaggtggtacctgtcgagcactgaactggccgagaagctgctctgcatgtaccgcaatgcaactggcgaaagctgcaatgaatttaggctgaagatctgctactttatgagatactggatacttaaattccccgctgagtttaatctggatctgggcctaatacgcatgacagaggaattccgcgaggtcgcgtctcagcttggttatgaaaaacatgtgtctctgattgatatctcttccattcccagctatgactggatgcgccgcgtgactcagcgtaaaaaggtgagcaagaaggggaaggcatgcctgctcttcgaccacctggagccaattgagctggcggaacatctgacctttcttgaacataagtctttccgacgcatttcatttacagattatcagtcctatgtaatccatgggtgcctagagaacaacccaacactggagcgaagtatagctttatttaacggcatttctaagtgggtgcaattaatggtgctatctaagcccacgccacagcaaagagcagaggtgattacaaaattcatcaacgtggcaaagaaactgctgcaactgaaaaatttcaacacgctgatggcagtcgtcggcgggttaagtcattctagcattagccggcttaaggagactcactcacacctttcctcggaggttacgaagaattggaacgagatgactgaattggtgtcttccaacggcaactactgtaattatcgcaaagcttttgccgattgcgatggatttaagatacctatcctgggcgtccatctcaaagacctgatcgctgtgcatgtgatctttcccgattggactgaggaaaacaaagtaaacatcgtgaagatgcaccagctcagcgtgaccttgtccgaactggttagcctacagaacgcctctcatcatctggaacctaacatggatctgatcaatctccttactctgtctctcgacctgtatcacacagaggacgatatatataagctttccctagtgctagagccacgaaatagcaagtcaccaactagccctactactcccaacaaacctgtggtgcccctggaatgggccttgggcgtgatgcccaagcccgatccaacagtgattaacaagcacattaggaaacttgttgaaagtgtattccgaaactatgaccacgatcacgatgggtacattagtcaagaggatttcgaatccattgccgctaatttcccctttctggatagcttttgtgtgctggacaaagatcaggatggcttgatctccaaggatgaaatgatggcttatttcctcagagccaagagtcagctccattgcaaaatgggccccggctttatccacaattttcaggaaatgacctaccttaagcctaccttttgcgagcattgtgccggattcctatggggaatcatcaagcaaggctataagtgtaaagattgcggcgctaattgccacaagcaatgtaaagatttgcttgtgttggcgtgtcgccgtttcgcccgagctcctagcctgtcgtccgggcacggctctctcccagggagcccttcattgcctccagcacaggacgaggtttttgaattcccgggcgtgacggctggacatagagacctggatagtcgggcgatcaccctagtgactggatcttcccggaaaataagtgtccggctccagagggctacgacgagccaggcaacccagaccgaaccagtgtggtctgaggcgggttggggcgatagtgggagccacaccttccccaagatgaagagtaagtttcacgataaggctgcgaaagataagggctttgctaagtgggagaacgaaaagccacgcgttcatgcgggcgtggatgtggtggaccggggcactgaattcgagctggaccaggatgaaggggaagagacccgccaagacggtgaagatgggtag

SEQ ID NO: 45414 - DNA, 342 bp, Artificial Sequence
  Description of Artificial Sequence: Synthetic coding sequence
atgggcagcagcggcctgggcaaggccgccaccctggacgagctgctgtgcacatgtatagagatgtttgacgataatggagagttggacaactcctacctcccaagaatcgtcttgctgatgcacaggtggtacctgtcttccaccgagctcgcagagaagctgctgtgtatgtatcgaaatgccactggggagtcatgcaatgagttcaggttaaagatatgttattttatgcggtattggattctgaaatttccggcagagttcaatttagatctaggactgatccgcatgacggaggagttcagagaggtcgctagccagctcggatacgagaagtag

SEQ ID NO: 45415 - DNA, 105 bp, Artificial Sequence
  Description of Artificial Sequence: Synthetic coding sequence
atgggcagcagcggcctgggcaaggccgccaccctggacgagctgctctgcacttgtatagaaatgttcgatgacaatggcgaactggataactcctatttgtag

SEQ ID NO: 45416 - DNA, 519 bp, Artificial Sequence
  Description of Artificial Sequence: Synthetic coding sequence
atgggcagcagcggcctgggcaaggccgccaccctggacgagctgctatgcacgtgtatagagatgtttgacgataatggggaacttgataacagctatctgccaagaattgtgctcctcatgcaccgctggtacctctctagtaccgaacttgctgagaagctcctgtgcatgtaccgaaatgcaaccggtgagtcttgtaacgagttccgtctgaaaatctgttatttcatgcggtattggatcctgaagttcccagccgagtttaacctggatttgggactgataagaatgacagaagagttccgggaagtcgccagtcagttgggctacgagaaacatgtaagcctgatcgatatctctagcattcccagctatgattggatgaggcgagttacacagagaaaaaaggtgtcaaaaaaggggaaggcctgtttattgttcgatcatttggagcctattgaactggcagaacatttaacattcctggaacacaaatccttcagacgaatcagctag

SEQ ID NO: 45417 - DNA, 234 bp, Artificial Sequence
  Description of Artificial Sequence: Synthetic coding sequence
atgggcagcagcggcctgggcaaggccgccaccctggacgagctgttgtgtacatgcatagagatgtttgacgataacggtgaacttgataactcatacctgccgcgcattgttctgcttatgcatcgttggtacctgagttctaccgaactggcagaaaagcttctctgtatgtaccgcaacgccactggcgaatcctgcaacgaatttagattaaagatctgctacttctag

SEQ ID NO: 45418 - DNA, 339 bp, Artificial Sequence
  Description of Artificial Sequence: Synthetic coding sequence
atgggcagcagcggcctgggcaaggccgccaccctggacgagctgctgtgtacatgtatcgaaatgttcgatgacaatggggagctggacaactcatacctgcctcgcattgttctactcatgcatcgctggtatctgagttcaactgaactggccgagaagctcctctgcatgtaccgtaatgcaaccggcgagagttgcaatgagtttaggcttaagatttgctatttcatgaggtattggatcctcaagttccccgcagagtttaatctggatctaggcctcatcaggatgacggaggaatttagagaagtcgcttcccagttggggtacgagtag

SEQ ID NO: 45419 - DNA, 552 bp, Artificial Sequence
  Description of Artificial Sequence: Synthetic coding sequence
atgcccctggtgcggtaccggaaggtggtgatcctgggctaccggtgcgttggcaaaacgtctctggctcaccagttcgtggaaggtgaatttagcgaaggttatgaccctactgtcgaaaatacttactccaagattgtgacgcttggaaaggatgaatttcaccttcacctggtcgacacagccggacaggacgagtactccatccttccttactcctttataataggcgtgcacgggtatgtgctcgtttactctgtgacatcattacactccttccaggttattgagagtctgtatcagaagcttcacgaaggtcacggaaagacacgggtccctgttgtgctagtgggtaataaggctgatctgtcccctgaacgcgaggttcaggccgtcgagggtaagaaactggccgagtcctggggagctacttttatggagtcaagtgcgagggagaaccagctgacgcagggcatatttactaaagtgattcaggagatcgcgcgtgtggagaacagctatggccaggagaggaggtgccatcttatgtag

SEQ ID NO: 45420 - DNA, 633 bp, Artificial Sequence
  Description of Artificial Sequence: Synthetic coding sequence
atgaccgccgcccaggccgccggcgaggaggccccccccggcgtgcggagtgtgaaggtggtcctagtaggagatgggggctgtggcaaaactagtctgctgatggtgttcgccgacggggcatttcctgagagctacactccaactgtcttcgaacggtacatggtaaatctgcaggtgaaaggcaagccggtccacctgcatatatgggatacagcaggacaggacgactacgatcgccttcgcccactcttctatccagacgcaagcgtgctcttgctctgctttgatgtcacttcacccaactcctttgacaatatattcaaccgatggtaccccgaagttaatcacttttgtaaaaaggtcccaatcattgtggtgggctgtaaaaccgatctgtgcaaggataagtcattagtcaataagctgcgtaggaatggccttgaacctgttacttatcatcgtgggcaggaaatggcccgcagcgtgggcgctgtggcttatctggaatgtagtgcccggcttcacgacaatgtgcacgcagtttttcaggaggccgcagaagtggctctgagcagtcggggacggaatttctggaggcgaatcacccagggcttttgcgtggtgacctag

SEQ ID NO: 45421 - DNA, 636 bp, Artificial Sequence
  Description of Artificial Sequence: Synthetic coding sequence
atggacgcccccggcgccctggcccagaccgccgcccccggccccggtaggaaagagttaaagattgtgatagtcggggatggcgggtgcggaaagacttcactactgatggtatatagtcagggctcctttccagagcactatgccccaagcgtgtttgagaagtatactgcctcagtcactgtgggatcaaaagaagtcaccctcaacctatatgacaccgccggtcaagaggattacgatcgacttcgccccctgagctaccagaacacccatctcgtgctcatttgctacgatgtcatgaatccaacatcgtatgataatgtccttattaaatggttccctgaagtcacacacttctgtcggggcatcccaatggttctgattggctgcaagacagacttgaggaaggacaaagaacagctccgcaagctgagggccgctcaacttgaacctatcacctacatgcaaggcctttccgcctgtgaacaaattcgtgccgccctttacttggagtgcagcgccaagttcagagagaatgtggaggacgtgtttagggaggcagctaaggtggccctctctgccctcaagaaggcccagaggcagaaaaaaaggaggttgtgcctcctcctctag

SEQ ID NO: 45422 - DNA, 342 bp, Artificial Sequence
  Description of Artificial Sequence: Synthetic coding sequence
atggacgcccccggcgccctggcccagaccgccgcccccggccccggcaggaaggaactgaaaattgtcatcgtaggtgatggaggctgtggaaagactagtttgctcatggtctacagccagggctcgtttccagaacactacgccccatccgtcttcgaaaaatacacagcatctgtcaccgtgggcagcaaagaggtgacacttaacctgtacgatacggccgggcaggaagactatgaccggcttcgccctctgtcttatcagaacacacatttggtattaatttgttacgacgtgatgaacccaacatcatacgataatgtgctcatcaaagtgtag

SEQ ID NO: 45423 - DNA, 576 bp, Artificial Sequence
  Description of Artificial Sequence: Synthetic coding sequence
atgcagagcatcaagtgcgtggtggtgggcgacggcgccgtgggcaagacgtgcttgctgatttgttatactaccaacgctttccctaaagaatacatacctactgtgttcgataactattctgcccagagcgcggttgacggtcggacagtcaatctgaatctgtgggacaccgctggccaggaagaatacgaccgcctgcgcaccctaagctatcctcagaccaatgtctttgtgatctgcttctcaatcgcctctcccccgtcctatgagaacgtcaggcacaagtggcatccagaagtgtgccatcactgcccagatgtgccaatccttctagtgggcacaaagaaggatctgagggctcagcctgacaccctgcgcagactgaaagagcagggacaggcaccaattacgcctcaacaggggcaagccttggccaaacaaatccacgcagttcgatatttggaatgttcagccttgcagcaggatggggtcaaagaggtgttcgcggaggccgttagggcagttctgaaccctacccccatcaagcgaggtaggtcttgtatactgctgtag

SEQ ID NO: 45424 - DNA, 576 bp, Artificial Sequence
  Description of Artificial Sequence: Synthetic coding sequence
atgcagagcatcaagtgcgtggtggtgggcgacggcgccgtgggcaaaacttgcctgctgatctgttataccacaaatgcctttcctaaagaatatatcccaaccgtgtttgataattattcggctcaaagcgccgtggatgggcggaccgttaatctgaatctctgggatactgccggacaggaagaatatgataggttgcgaacattgtcctacccccagaccaacgtcttcgtgatatgcttctctattgcgtccccccctagttatgagaatgtgcgacataaatggcatcctgaagtttgccaccactgccccgatgtgccgatactcttggtgggaacaaagaaggacctgagggcacagccagacactttgcggcgcctcaaagagcaaggccaggcgccgatcactcctcagcaaggacaggcccttgccaaacagattcatgccgtgcgatatctggaatgtagtgctctgcaacaggacggtgtaaaagaggtgttcgccgaggccgtgcgcgcagtcttaaaccctacaccgattaagcgtggccggtcatgtattctcctttag

SEQ ID NO: 45425 - DNA, 576 bp, Artificial Sequence
  Description of Artificial Sequence: Synthetic coding sequence
atgcagagcatcaagtgcgtggtggtgggcgacggcgccgtgggcaagacttgcctgctgatctgctatacaaccaacgcattcccaaaagagtacattcccactgtgtttgataactactcagcccagtcagccgtagacgggcgcactgtaaacttgaacctctgggataccgctgggcaggaagaatatgatcggcttagaacactctcctatccacaaaccaatgtgtttgtcatctgcttctcaatcgcctcccccccctcctacgagaatgtccgtcacaagtggcatcctgaggtgtgtcaccactgccctgatgtcccgatattattagtcggcacgaagaaggacctgagggctcagcccgacaccctacgtagattaaaggagcagggtcaggcccccatcacgccgcagcagggccaggcactggccaagcagattcacgccgtacgctatttggaatgttcggcactccaacaagatggcgtaaaggaggtctttgcagaagcggtgagagcggtcctcaaccccactcccataaagcgggggcggagttgcatccttctgtag

SEQ ID NO: 45426 - DNA, 576 bp, Artificial Sequence
  Description of Artificial Sequence: Synthetic coding sequence
atgcagagcatcaagtgcgtggtggtgggcgacggcgccgtgggcaagacttgcctgctgatctgctacaccaccaatgcatttcccaaagaatatattcccacagtgttcgacaactattccgctcagtcagctgtcgacgggcgcacagtgaatcttaatctgtgggacactgcagggcaggaggagtatgatagactgagaaccctctcgtacccgcagactaatgtgtttgtcatctgtttcagcatagcttcacctccaagttatgaaaatgtgcgccacaagtggcatccagaagtctgccaccactgtccagatgtgccaatactcctggtcggtaccaagaaggacctgagggcacagccagatacgttgaggaggctgaaagagcagggtcaggcccctatcacaccccaacaggggcaggctttagctaagcagatacacgcagtgcgctacctggagtgtagtgctcttcagcaggacggtgtcaaagaggtgtttgctgaggccgtgcgcgctgtgcttaatccgactcccatcaagagggggcgcagctgtatcctcctgtag

SEQ ID NO: 45427 - DNA, 576 bp, Artificial Sequence
  Description of Artificial Sequence: Synthetic coding sequence
atgctgagcagcatcaagtgcgtgctggtgggcgacagcgccgtgggaaaaacctctctgttggtacgcttcacaagtgagaccttccccgaagcatacaagccaacggtttatgagaacactggggtggacgtcttcatggatgggatacagatttctctgggcctctgggacaccgctggcaacgacgcattccggagcatccggccgctgagttatcagcaggccgacgtggtacttatgtgttacagcgtcgcaaaccacaacagctttctgaatctgaagaacaaatggattggagagataagatccaacctgccatgtacacctgtcctggtcgtcgctacacaaactgatcagcgggaaatgggcccacacagggccagttgtgtgaatgctatggagggaaaaaaacttgcccaggacgtgcgcgctaaaggctacctagaatgcagcgcactctctaaccgaggagtgcagcaggtgtttgaatgcgcggttcggactgcagtaaaccaggcccgccggcggaatcgtaggcgattgtttagcattaacgaatgtaaaattttctag

SEQ ID NO: 45428 - DNA, 312 bp, Artificial Sequence
  Description of Artificial Sequence: Synthetic coding sequence
atgctgagcagcatcaagtgcgtgctggtgggcgacagcgccgtggggaaaacttcgctgctggtgcggttcactagcgagaccttccccgaggcttacaagcccactgtctatgagaacacaggggtcgacgtcttcatggatggcatacaaatcagcttaggcctgtgggacaccgcaggcaatgatgcgttcaggtctataaggcctttatcgtatcagcaggctgacgtcgtgttgatgtgctacagtgtcgccaaccacaattcatttttgaatctgaagaataaatggatcggggaaattaggtag

SEQ ID NO: 45429 - DNA, 576 bp, Artificial Sequence
  Description of Artificial Sequence: Synthetic coding sequence
atgctgagcagcatcaagtgcgtgctggtgggcgacagcgccgtgggtaagacttcactgctggtgcgatttacaagcgaaacctttcctgaggcctataaacctacagtttacgagaatactggggtggacgtctttatggacggaattcagatctcactgggtttgtgggacaccgcaggaaatgatgcttttcgcagtattcgaccgctgagttaccagcaggccgacgtcgtgctcatgtgctactcggtggccaatcacaacagctttcttaacctgaaaaacaagtggataggcgagattcggagtaatctgccctgtactcccgtgttagtcgttgctacacagaccgatcaaagagagatgggcccgcaccgcgcctcgtgcgtcaacgcaatggaaggcaaaaagctcgcgcaggatgttagagctaaggggtacctggagtgttctgccctgtccaaccgcggcgtgcagcaggtgtttgagtgtgctgtgcgcacggccgtgaatcaggcaagacggcgcaatcggcggcggttgttttccatcaacgagtgcaagattttctag

SEQ ID NO: 45430 - DNA, 330 bp, Artificial Sequence
  Description of Artificial Sequence: Synthetic coding sequence
atgctgagcagcatcaagtgcgtgctggtgggcgacagcgccgtgggtaagaccagccttctcgtgaggttcacaagcgagacattccccgaggcatacaagcctactgtgtacgagaacacaggtgtggatgtcttcatggatggaatccagatttccctggggctctgggacacggcagggaacgatgctttccggtctattagaccactttcctaccagcaagctgatgtcgtcctcatgtgctactcagtcgcaaatcacaattctttcctgaacctaaagaataaatggattggagagattcgctctaacctgccttgcacatag

SEQ ID NO: 45431 - DNA, 51 bp, Artificial Sequence
  Description of Artificial Sequence: Synthetic coding sequence
atgctgagcagcatcaagtgcgtgctggtgggcgacagcgccgtggggtag

SEQ ID NO: 45432 - DNA, 21 bp, Artificial Sequence
  Description of Artificial Sequence: Synthetic coding sequence
atgctgagcagcatcaagtag

SEQ ID NO: 45433 - DNA, 645 bp, Artificial Sequence
  Description of Artificial Sequence: Synthetic coding sequence
atgaactgcaaggagggcaccgacagcagctgcggctgccggggcaatgatgaaaagaaaatgctgaaatgtgttgtggtaggtgacggcgccgtgggtaagacctgcctcctgatgtcgtacgcaaatgatgccttccctgaagaatacgttcccactgtattcgaccattacgccgtcacagttaccgtgggtgggaagcaacacctactggggctctatgacaccgcaggccaggaggactacaaccagctaagaccactatcctaccccaatactgatgtgttcttgatttgtttcagcgtcgtgaatcccgctagctatcacaacgttcaggaagagtgggtgcccgagttaaaggactgcatgcctcacgtcccatacgttctcatcggcacgcagatcgatctccgggacgacccaaagacactcgcccgtttgctgtatatgaaggagaagccactcacctacgaacacggggttaaactcgccaaggcgataggcgcacagtgctatctggagtgtagcgctctgacccagaagggtcttaaggccgtgtttgatgaggcaattctcaccatctttcatcctaaaaagaagaagaaacggtgctccgagggacattcttgttgttccatcatatag

SEQ ID NO: 45434 - DNA, 618 bp, Artificial Sequence
  Description of Artificial Sequence: Synthetic coding sequence
atggcccacggccccggcgccctgatgctgaagtgcgtggtggtgggggacggagccgtgggtaagacgtgtcttctgatgtcatacgccaacgatgccttccctgaggagtatgtgccaaccgtgtttgatcattacgctgtttcagtgactgtgggaggcaagcagtatcttttaggcctgtacgacacggccggccaagaagactacgatcgcctacggcccctcagctatcccatgactgacgtattcttaatctgcttcagcgttgtgaatcccgcctccttccagaatgtaaaagaggaatgggtgccggaactaaaggagtacgccccaaacgtgccctttctgcttatcggcactcagatcgaccttagagatgatccaaagacacttgcccgtttgaatgacatgaaagaaaaacctatctgcgtggaacaagggcagaaactggcgaaggagatcggagcctgttgctacgttgagtgctcagctctgacccaaaagggactgaagacggtgttcgatgaggctattatcgctatcctgacacccaaaaagcatacagtgaagaaacgcatcggatcacgctgcattaactgttgtctgatcacctag

SEQ ID NO: 45435 - DNA, 915 bp, Artificial Sequence
  Description of Artificial Sequence: Synthetic coding sequence
atggccgtgaccaaggagctgctgcagatggacctgtacgccctgcttggaattgaagagaaggctgcagacaaagaggtgaagaaagcttaccgccaaaaggcattatcgtgtcatcctgataagaatcccgacaatcccagggctgccgaactcttccaccagctgtcccaggcgctcgaagtcctcactgacgccgcagcccgtgccgcttacgataaagtgaggaaagcaaagaagcaggccgcggaacgcacccaaaagctggacgagaagaggaagaaagttaagctggacctcgaggctagggaacgacaggcccaggcacaggaaagcgaggaggaagaagagtccagaagtactagaaccctcgaacaggagattgaaagactcagggaagagggatcccgacagttggaagagcaacagcgattaattcgggaacagataaggcaagaaagggatcagagacttagaggaaaggccgagaataccgagggccagggaacgcctaaactcaaattgaagtggaagtgtaagaaagaggatgagagcaagggaggttacagcaaggacgtccttcttcggttgctacagaagtatggggaggtgcttaacttagttttgtcttcaaaaaagccaggtacagctgtcgtcgaattcgcaaccgtcaaggccgctgaattagctgtacagaatgaagttgggctggtagataatcccctgaaaatcagctggcttgaaggacaaccacaggatgctgtaggccgtagtcatagcggccttagtaagggctcagtgttatccgagcgagattatgagtccctggtgatgatgcggatgagacaggctgccgaacggcagcagctgatagctcgtatgcagcaggaggatcaggagggcccacccacctag

SEQ ID NO: 45436 - DNA, 258 bp, Artificial Sequence
  Description of Artificial Sequence: Synthetic coding sequence
atggccgtggaggaggagctgaagaaggaccacgccgagatgcaggctgtcattgacgccaagcaaaaaatcatcgatgctcaggtaattaatggggacgagatcatccagactggaaaaacagatcgggtacctggcttttctcagcatcagacagacgaaagggcagaccccagtgagggtgccgtccaacatgcaggaccacaatggcacctgccgcatcagccccatcaggcatttcaccatggcgaatggtag

SEQ ID NO: 45437 - DNA, 3843 bp, Artificial Sequence
  Description of Artificial Sequence: Synthetic coding sequence
atggagctgagccccagcagcggcggcgccgccgaggccctgagctggcccgaaatgtttccggccctcgagtctgatagccctctgcctcctgaagatctcgacgcagttgtccctgtttctggcgcagttgccggaggaatgctcgacagaatcctgttggaaagcgtctgccaacagcagtcctgggttcgtgtgtatgatgtcaaagggcctcccactcaccggctgagttgcggccagtccccatatactgaaacaaccacgtgggaacggaagtactgtatcctaactgactctcagctcgtgttactaaataaggagaaggagatccccgttgagggcggacaagagcagcagaccgactctaccaagggcagatgtctccgtcgcacagttagcgtcccctccgagggacagtttcccgagtacccgccggaaggtgcaacgaagctggaggtgcctgccgaacgatcccctagaagaaggtccatcagtgggacttccactagcgagaaacccaattctatggacacagcaaacaccagccccttcaaggtgcctggctttttctcaaaacgactcaaaggcagcattaagcgcacgaagagccagagcaaactggatcgaaatacatcttttagactgcctagcctcaggtccactgatgataggagtagagggctgcccaaactgaaggaaagccggtcgcatgaaagtcttctctcaccttgcagtactgtggagtgtctggatctgggcaggggcgagcccgtctcagttaaacctctacactcatccattctcggccaagacttttgcttcgaggttacatatcttagcggatcaaagtgcttctcctgtaacagcgctagcgaacgggacaagtggatggaaaatctgcgtcggacggtacagcccaacaaagacaactgtaggagagctgagaacgttctgaggctgtggatcatagaggctaaggatctcgcccctaaaaagaaatacttctgtgagctttgcctcgacgacacactcttcgcacgaacgacctctaagacaaaggccgacaatattttctggggcgaacacttcgagttcttttcacttcccccgcttcatagtattacagtccatatctacaaagatgtggagaaaaagaagaaaaaagataaaaacaactatgtaggactcgtaaacatccccacagcttctgtgacagggcgccagttcgtggaaaagtggtatcctgtttccacccctacccctaataaggggaagacggggggaccatccattcgtatcaagtccagattccagactatcactatccttccaatggagcagtacaaagagtttgcggagttcgtgacgtctaactacacgatgctgtgctcggtcttagagcccgttattagcgtgcggaataaggaggaactagcttgtgccctcgtgcatattctgcagtcaactggtcgggcaaaggacttcctgactgaccttgtgatgagtgaggttgatagatgtggcgaacatgatgttcttatattccgggagaacacaattgctaccaagtccattgaagagtacttgaaacttgttggccaacagtatctccacgacgccctgggagagtttattaaggccctttacgagtcagacgaaaattgcgaagtggacccctcgaaatgctcgagctccgagctcattgaccaccagagtaatctgaagatgtgctgtgagctcgcgttttgcaaaatcattaactcctattgtgttttccctagagagctgaaggaagtgtttgcttcctggaaacagcaatgtttgaacaggggcaagcaggatataagtgagcgcctgatcagtgcatccctctttctgagattcctctgcccagccattatgtcacccagcctctttaatctaatgcaggaatatccagacgaccggacttctcgcactcttacgctgattgccaaagtgatacagaatctagcgaacttcgccaagttcggaaataaagaagaatacatggcattcatgaacgactttctggaacacgaatggggtgggatgaaaagatttcttctggagatctctaaccctgataccatttccaacacccctggcttcgacgggtatatcgacttggggcgcgagctcagcgtgctgcatagcctgctttgggaagttgtctcacagctggacaaggctactgtggctaaactcggccccctacctcgcgtgttggccgacattaccaaaagccttacaaacccaaccccaattcagcagcagctcaggcgttttaccgaacataattcgtcccctaacgtctccggttccctgagcagcggtctgcagaagatctttgaggaccccactgacagcgatctgcataagttgaagtcgccgagccaagacaatactgattcctactttagggggaaaactctgttgctggtacagcaggcatccagccaaagtatgacctacagcgagaaggatgaacgcgaaagttcgttacctaacgggcggagcgtgtctttgatggacctgcaggacactcatgccgcacaagtggaacacgcatcagttatgctcgatgtgccgatacgacttaccgggtctcagctttcaatcactcaggttgcaagtattaagcagttgcgcgaaacccagagcactccacagtccgctccacaagtgcgacggcccctgcatccggcgttaaatcagcccggtggtttgcaacccctctccttccagaaccccgtctatcacttgaacaatcctatcccagcgatgcccaaggcctcgattgatagctcactggagaacctatccacagctagcagccgtagccagagcaatagtgaagatttcaaattgtcagggcccagcaatagctccatggaggacttcaccaagcggtctactcagtcagaagacttcagcaggcgtcatacagtgccagatcggcacatccccctggccctgcctcgccaaaatagtactggtcaagctcagatcaggaaagtggaccagggtggtctgggagctagggccaaggccccgccctcactgccacactccgcgtctttaagatccactggctctatgtcagtggtatccgcagctttagttgccgagcccgtacagaatggttcacgttcaagacaacagtccagctcctctcgtgagtcacccgtgcccaaagtgcgcgcaattcagagacagcagactcagcaggtacagagccctgtggattccgctacaatgtcacccgtggagaggactgccgcttgggttcttaacaacggacagtatgaagaggacgttgaagaaacagaacagaatctcgacgaagctaagcacgcggagaagtacgaacaggagattaccaagttgaaggaacggctgcgggtcagctcccgaagactcgaggaatatgaacgtcgactccttgtccaggaacagcagatgcagaagctgctactggagtataaagcccgacttgaggactctgaagagcgcctgcggagacaacaagaagaaaaggattctcagatgaaaagcattatatcccgcttgatggctgtcgaggaagaacttaagaaagatcatgcagagatgcaggccgtgattgacgccaaacagaaaattattgacgctcaggaaaaaagaatagtctctctagattccgcaaacacccgcctgatgtccgcattaacccaggtgaaggaacgctactcgatgcaggtgcgtaatggaatttctccaacaaatccgacaaaactgagtattacagagaacggagaatttaaaaatagctcttgttag

SEQ ID NO: 45438 - DNA, 2082 bp, Artificial Sequence
  Description of Artificial Sequence: Synthetic coding sequence
tgagaggtgttcgccagctggaagcagcagtgcctgaaccggggcaagcaggatatatcggaacgcctcatcagcgcatccctgtttttgcgctttctgtgcccggcaatcatgtctccgtccttgtttaatctcatgcaggagtatcctgatgatagaacgagtcgaaccctgacactgatcgcgaaggtaattcagaaccttgcaaattttgctaagttcggtaacaaagaagagtacatggcctttatgaacgactttcttgaacatgaatggggtgggatgaaaaggtttttactcgaaatatctaaccccgacacgatatccaacacccccgggttcgacggctatattgacctcgggagagaactatccgttcttcactcgctactctgggaggtcgtaagccagctggacaaaggggagaatagcttcctgcaggctactgtggctaaactgggccccttacctagagttctggccgatattaccaaatctctcacgaacccaacccccatccaacagcagctgagaagattcactgagcataactcttctcctaatgtctccggctcattatcttcgggattacagaaaatctttgaggatcccacagacagcgatttacacaaactaaagagtccctcccaggacaacaccgacagctactttcgtgggaaaaccctattgcttgtgcagcaagcaagctcccagagtatgacatactcagagaaggatgagcgggaatcgtctttgccgaacggaagatcagtctctctaatggacttacaggatacacacgccgcgcaggtggaacacgcgtctgtcatgctggacgtgcctatcaggctgacaggaagccagctctccatcactcaggtggcatctataaaacagctccgagaaacccaatctacaccacagtcggccccccaagtgcgccgccccctccaccccgctctaaaccagcctggcggtcttcagccactctctttccagaaccccgtgtaccatctgaacaaccccatccctgcgatgccaaaagcttctatcgactccagcctggagaacctgagcacggcttccagcagaagccagtccaatagtgaagattttaaactgtcagggccctcaaacagttctatggaggacttcactaaacggtcgacacagtcagaggactttagtcgccgacataccgtgccagaccgccatattcccctagcgctgcccaggcagaacagcactgggcaggctcagataaggaaggtggaccagggagggctgggcgcgcgtgcaaaagcccctccctccctgccccacagtgcttcactgaggagcaccggctccatgtccgtggtatccgccgccttagtggctgaaccggtacagaatggctctaggtccagacagcagagcagcagcagtagagagtcaccagttccaaaggttcgtgcaatacagcgacagcaaacacagcaggtgcagagtccagtagattctgcgaccatgagcccagtggagcgtacagcagcttgggtgctgaacaatggacaatatgaggaggacgtcgaagagactgaacagaacttggatgaagccaagcacgctgagaaatacgagcaagaaataaccaagctgaaagaacgattacgggtatcctcaaggaggctcgaagaatacgagcgcaggctgctcgtgcaggagcagcagatgcaaaagttgctactggagtacaaagctcgcctggaagacagcgaagagcgccttcgccggcagcaagaggaaaaggatagccagatgaagtctatcatatcacgacttatggcagtggaagaagaactgaagaaggatcatgccgaaatgcaggccgtcatcgatgccaaacagaagattattgacgcacaggtgatcaatggtgatgaaatcatccaaacaggcaaaacagatcgggtgcccggcttcagccaacaccaaactgacgagcgcgctgacccttctgaaggtgctgtccagcacgctggaccccagtggcatctgccccatcagccacaccaggctttccaccacggcgagtggtag

SEQ ID NO: 45439 - DNA, 3810 bp, Artificial Sequence
  Description of Artificial Sequence: Synthetic coding sequence
atgttccccgccctggagagcgacagccccctgccccccgaggacctagatgctgtggtgcctgttagcggcgctgttgcaggaggtatgctagataggatcttgttagagtcagtttgccagcagcagtcttgggtgagggtgtatgatgtaaaggggcccccaactcaccgcctgtcatgcggacagagtccatacactgagacaaccacttgggagaggaaatattgcatcttgacagatagccagcttgtcctgctgaataaagagaaggagatccctgtagagggcggacaggagcaacagacagactccaccaaaggacgctgcctgagacgcactgtcagcgttcctagtgagggacaatttcctgagtaccctccagagggggcaaccaagctagaggtgccagcagaacggtcccctaggaggagaagtatcagtggcaccagtacgtcagagaagcctaactctatggacaccgccaacacatctccgtttaaagtcccgggattcttcagtaagaggctgaagggatctatcaagcgaactaaaagccagtccaaactcgatcgcaataccagtttccgcctgccgtccctccggtccaccgacgacagatctaggggcctccctaagctgaaggaaagcagatcgcacgaatctctgttgtcaccatgctccactgtggagtgcctcgatttaggcaggggagagccggttagtgtgaaaccactgcactcgtctatcttaggccaggatttctgtttcgaggtgacctatctgtctgggtctaaatgcttttcttgtaactcagcctctgagcgggataagtggatggagaatctgcggagaactgtccagcctaataaggacaattgcaggcgggccgagaatgtgttgcgtctatggattatcgaggccaaagacctggcacccaaaaaaaaatacttttgcgagctgtgcctggatgataccctgttcgcccgaaccacctcaaaaacgaaagctgacaacattttttggggtgagcattttgaattcttctccttgccacctcttcattccattacagttcatatctacaaggatgtggaaaagaaaaagaaaaaggataaaaataactacgtggggctggtgaacatccccacggccagcgttacgggtaggcagtttgtggagaagtggtatcctgtgtcaaccccaacccccaacaaaggaaagactggtggtcctagtatacggatcaagtccaggttccaaactattaccattctgccgatggaacagtataaggagttcgccgaatttgtcacaagtaactacaccatgctgtgtagcgtccttgaaccagtgatctctgtccgcaataaggaggagctggcgtgcgctctggtgcacatcctacaatcaacaggtagagctaaggattttctgacagacctggtcatgtccgaagtcgatcggtgcggagagcatgacgtgctgatctttcgggagaacaccattgctacaaagtctatagaggagtacttaaaacttgtggggcagcagtatctccacgacgcgctcggagaattcattaaggccctgtacgagtccgatgagaattgcgaggtggacccctctaagtgtagctcctcggaactgatagatcaccagagcaacctgaaaatgtgctgcgaactggctttctgcaagatcattaactcatattgcgtttttccgagggagcttaaagaagtattcgcctcgtggaagcagcagtgtcttaacaggggaaaacaagacatttccgaacggctaatcagcgcctctctgtttctgcgcttcctgtgcccagccatcatgtccccttctctctttaaccttatgcaggaatacccagatgacaggacctcccggacgctgacacttatcgccaaggtgattcagaatctagcaaacttcgcgaaattcggcaacaaagaagagtatatggcattcatgaatgatttcttggagcacgagtggggcggaatgaagaggtttctgctggaaattagtaatcccgacactatctccaataccccaggatttgatgggtatatcgatttaggtcgagaattgtcagtccttcacagtctgctatgggaagttgtctcgcaattggataagggagagaatagcttcttgcaggccacggtagcaaaactcgggcctttaccgcgagtcctcgccgacataaccaaatccctgaccaatcccacacccattcagcagcagctccgaaggtttacagaacacaactcttctccaaacgtgagcggatcactgtcaagcggcctgcaaaagattttcgaggatccaactgacagtgatttgcataaattgaagagtccctctcaggataacacagactcctatttcaggggtaaaactcttctgctggtgcaacaggcatctagtcagtcaatgacttactccgagaaagacgaacgcgagtcttccttacccaacggaaggtcagtgtctctgatggacttgcaggacacacacgcagcccaggtagagcatgcaagtgtcatgctggacgttcctatcagattgacaggttctcagctctcgatcacacaggtcgcatctatcaagcagctcagagaaactcagtctacaccccagagtgcccctcaggtcaggcggcctttacacccggcgctgaaccagcccggaggtctgcagccactgtcctttcagaacccagtgtaccatctcaacaatccaatacccgcaatgccaaaggcaagtatagacagttctctggagaatctttcaaccgcttcaagtcggagtcagagcaatagcgaagatttcaagctcagcggcccctcgaactccagcatggaggacttcaccaagcgctcaacgcagagcgaagatttctcacgacggcacactgtcccagacaggcatattccactcgcgttaccccgtcagaatagcaccggccaggcacagattcggaaagtcgatcaaggagggctgggcgcgcgcgccaaagctcctccgtccctccctcacagcgcaagtcttagaagcaccggcagcatgtcggtcgtcagtgctgctctggtggctgaaccagtccagaatggatccagaagtcggcagcagtccagctccagccgggagagccccgtaccaaaggtcagagccatccaacggcagcagactcaacaagtgcagtctcccgtcgactcagccactatgagtccggttgagagaactgcagcgtgggtcctgaacaacgggcagtacgaagaagacgttgaagaaacagagcagaatctcgatgaagctaaacatgctgagaagtacgagcaggagatcacaaagctgaaggaaaggcttagggtgtcctcaaggcgcctagaagaatatgagcgcaggttgctggtgcaagagcagcaaatgcaaaagctgctcctagagtataaggcacgactcgaggacagtgaagagagactgcggcggcaacaagaggagaaggacagccaaatgaaaagtattattagcaggcttatggcggtggaagaggaactgaagaaggatcatgccgagatgcaggctgttattgacgcaaaacagaagataattgacgctcaggagaaaagaatagtctcgctagattccgcgaatacccggctgatgtccgccctgacccaggtgaaggagcggtacagtatgcaggtccgcaatggcatttcccccaccaatcccacaaagctgtcgatcacagagaatggggagtttaagaattcttcgtgctag

SEQ ID NO: 45440 - DNA, 3420 bp, Artificial Sequence
  Description of Artificial Sequence: Synthetic coding sequence
atgcagacccccgaggtgcccgccgagcggagcccccggcggcggtctattagtggtacaagtacgtctgaaaaacctaattctatggacacggcaaatactagtccattcaaggttcccggcttttttagtaagcgactaaagggctccatcaagagaacgaagagtcagtctaagctggatcgcaacacatctttccgcctgccatcgttacggtcaaccgatgataggagccggggacttcctaaacttaaagaatctcgcagccacgaatcactcctgtcgccgtgttccacagtagagtgcctggatctaggacggggggagcctgtgagcgtcaagcctctgcattctagtatcctagggcaggacttttgtttcgaggtaacctacctatcaggctccaaatgtttcagttgcaactccgctagcgagcgcgacaaatggatggagaacctacggcggactgttcagcctaataaggataattgtcgaagagccgagaacgtgctgagattgtggataattgaagcaaaagacctcgctcccaagaagaaatatttctgtgagttgtgcctggatgacacactttttgcccgcacgacaagtaaaactaaggccgacaacatcttctggggggagcacttcgagttctttagtttgcctcctctgcactcgataacggtgcacatctacaaggatgtggaaaaaaagaaaaaaaaggataagaataactacgtcgggctggtgaacattcccacagcttcagtcacggggaggcaattcgtagagaaatggtatccggtgtctacacccacgcccaacaagggcaagaccggcggaccatccattcggattaagtctcgcttccagactattacaatcctgcctatggaacaatacaaggaattcgcggaattcgtgacatcaaattacaccatgctgtgttctgtgctcgaacctgtcatatctgtaaggaacaaagaggaacttgcctgcgcgctcgtgcacatcttacagtccaccggcagggccaaggatttccttaccgatctggtgatgtccgaggttgacaggtgtggggaacacgatgtgctgatttttagggaaaataccatcgctaccaaaagcatcgaagaatacctaaaactcgtcgggcagcagtacttgcatgacgcccttggtgagttcatcaaggccctgtatgagtctgacgagaactgtgaggtcgacccatcaaagtgcagctcctcagaactgattgatcaccaaagcaacctgaaaatgtgctgtgaactagcattttgcaagattattaattcctattgcgtgtttccaagggagctgaaagaggtgttcgctagttggaagcaacaatgtctgaatcgtggaaaacaggacatctctgagaggctgattagcgcatctctatttctgagattcctatgtcctgcaattatgagcccgagtctgttcaacctcatgcaggaatatccagacgatcggactagtcggactttgacgctcatcgctaaagtgatccagaacctggcaaactttgcaaagttcggcaacaaggaggaatacatggctttcatgaatgacttcctcgagcatgaatggggagggatgaagaggttcctcctggaaatcagtaacccagatacaatcagcaacactccggggttcgacggatatatagaccttggaagagaattgagtgttttgcatagtttgctttgggaagtggtgtctcagctggacaagggcgaaaattcctttcttcaggcgacagtggcaaaattgggacctttaccaagggtcttggcagatatcacaaaatcattaacaaaccctacaccaattcagcagcaactgcgtagatttaccgagcataactcatctccaaacgtgtccggatccctgtcctctggattacagaaaatcttcgaggatcctacggattcagatttgcacaagttaaagtccccaagccaagacaatacagattcctatttccggggaaagacactgctgctggtgcaacaagccagtagccagtctatgacctacagcgagaaggacgaaagggaatcttccctacccaacggtcggtccgtctcactcatggacctccaagatactcatgctgcccaggtcgagcatgcctccgtcatgctcgacgtacccattcgtctgacaggatcacagctgagcatcacccaggttgctagtattaagcaactgagagaaacacaatccactccacagtctgctcctcaggttcggcgcccactgcatcctgcgttgaatcagcccgggggtctccagcctctatcctttcagaaccccgtgtaccacctcaacaatccgatcccagccatgcccaaagcatccatagactcctcgctggagaatttatccacagcgtctagtagatcccagagcaattctgaagattttaagctgagcggccctagcaatagtagcatggaagatttcaccaagagatcaacacagtctgaagactttagtcggaggcacacagttcccgataggcacatcccactggccctgcccagacaaaactcaactgggcaggctcagattcgtaaagtagatcagggtggactaggcgcacgggcaaaggcgcctccatctctgccccatagtgcctccctgagatctaccggcagtatgtcagtcgtatccgccgctctcgtagcggaaccagtgcagaacggctcccgtagcaggcaacagagtagctctagccgagagtcccccgtccccaaggtgcgagcaatccaacgacagcagactcagcaggtgcagagccccgtcgactctgcaacaatgtcaccagtggagaggacagcagcatgggttctgaacaacggccagtacgaagaagatgtggaggagacagagcagaacttagatgaggcgaagcacgcagaaaagtacgaacaggaaattaccaaactcaaggaacgccttcgggtgtcatccaggagacttgaggaatatgagcgtcgcttgctggtgcaggaacagcagatgcagaagctgcttttggagtacaaggctcgcttggaagactctgaagagaggttgcgccgccaacaggaggagaaggacagccagatgaaatccattatttcaagattgatggccgtggaagaagaactgaagaaggaccacgccgagatgcaggccgtcatcgatgctaagcagaaaatcatagatgcgcaggaaaaacgtatcgtgagtctcgactctgccaatacaaggctgatgtctgcactcactcaagtgaaagagcggtacagtatgcaagtgcgaaacggaatctccccaaccaatccaaccaagctatctattactgaaaatggagagtttaagaacagctcatgctag

SEQ ID NO: 45441 - DNA, 3036 bp, Artificial Sequence
  Description of Artificial Sequence: Synthetic coding sequence
atggacccccccagccccagccggaccagccagacccagcccaccgccaccagtccccttacctcttaccggtggcatactggaggaggaggcgagaaagcggccggtgggtttcggtggggacgatttgctgggtggggaagggccttatctcaccaagagcccatggtgtcgactcagccagccccccgctctatttttagacgggtgctttcagccccccctaaggaaagccggaccagccgactgcgattgtccaaagccctgtggggccgtcataagaacccacctccagagccggacccggagcctgagcaggaggctccggagcttgaacccgaacccgaactggagcctcctacgccgcagatacccgaagcccccactcccaacgtgccagtgtgggatatcggagggttcacgctactggacggcaagctggtcctcctcggtggcgaggaagagggccctaggcgtcctcgggtgggctccgcctcgtccgaaggctctatccatgtggcaatggggaacttcagggatcccgaccgaatgcccgggaaaactgagcccgagacagctggcccaaatcaggtccataacgtccgcggactcttaaagcggcttaaggagaagaagaaggcccgccttgagccccgtgatggccctcccagtgcactgggatcccgtgagtccctggctaccctgtcagagctggacctgggagccgagagagacgtacggatctggcctttacaccctagcctcctaggggagccccactgcttccaggtgacttggacaggggggtccaggtgcttcagttgccggagtgccgcagagagagatcgatggatcgaagacttgcgcaggcagttccagcctacacaagacaacgtggagcgggaggagacttggttgtctgtatgggtgcacgaagcaaaagggctcccccgggctgcggccggggctcctggggtgcgcgcagagctttggctagacggggccctgcttgccaggaccgcacctcgcgccggccctggacagttattctgggcagagcggtttcatttcgaggccttgcccccagcccgccgcctctcgctgaggcttcgcggcttgggccctggctccgccgttttgggtcgggttgccctggccctggaggagctggacgcccctagggcccctgccgcgggactggagcggtggttccctcttcttggagcccctgcaggggcagccttgagggctaggattagggctcgccggctgagagtccttccgtcggagagatacaaggaattagccgagttcctgaccttccactacgctcgcctctgcggcgctctcgagcctgctttacctgcgcaagcgaaggaggagctggcagccgccatggtaagggtcctgagggcaacaggaagggcccaagcattagtgacggacctaggaacggcagagctcgcccgctgtggaggccgggaagccttgctgttccgcgagaatacacttgcgacaaaagccatcgacgaatacatgaagctggtcgcccaagactatctgcaggagacacttggccaagttgtgcgccggctatgtgccagcaccgaggattgcgaagtggatccttcaaagtgcccggcatcggaactgccagagcaccaggcaagactccgaaactcttgtgaggaagtcttcgaaacgatcatccattcctacgattggttcccagctgagctgggaatcgtgttcagcagttggcgtgaagcctgcaaggagcgcggaagcgaagttctgggaccaagactggtctgcgctagtttgtttctccggctactctgccccgcgatactggccccctcactcttcggcctcgcccccgaccacccagctcccggtcctgccaggaccctcacccttatagcaaaagtgattcagaacctagcaaacagggctccttttggggaaaaagaggcttatatgggcttcatgaactccttcctggaagaacatggacctgccatgcagtgcttcctggatcaggtcgccatggtggatgtggatgcagcacccagtggctaccaaggcagtggtgatctggctctgcagcttgccgtcctccatgcacagctgtgcacaatttttgcggagctggaccagaccacacgggacaccctggaacccctccctacaattctgagggcaatcgaggagggacaacctgtgttagtctcagtgcctatgcgcctgcctctgcctccagcacaagtgcactctagcttgtccgcaggagagaaacccggatttttggctccaagagatcttccaaagcatacacctcttatttccaagtcccagagtctgcggagcgtccgccgatccgaaagttgggcccgaccccgcccagatgaagagcgcccactcagaagacccaggcctgtgcagaggacgcaatccgtgccagtccgccggccagcgcgcagaaggcagagcgccggcccatggccacgaccaaaaggatccctttctatgggcccagcaccccgagctcggccatggacacgtgattctgcctccttgccaagaaaaccctccgtgccatggcagcgccagatggaccagccccaggataggaatcaggctctggggacccaccggccggtcaacaaacttgcagagctacagtgcgaggtggcagccttgcgggaggaacagaaggtgctgagtcgcctggttgagagtctctctacacaaatcagagcacttactgagcaacaagagcagctccgtgggcagctgcaagacctggactcccggttgcgggcaggcagttctgaatttgattccgaacataacctgaccagcaatgaggggcatagtctcaaaaatctggagcatagactcaatgaaatggagcgaacccaagcacagctgagagatgcagtgcagtctttgcagctgtctccacgaacccggggtagttggagccagccgcagccactgaaagccccgtgcctaaacggagacacaacctag

SEQ ID NO: 45442 - DNA, 711 bp, Artificial Sequence
  Description of Artificial Sequence: Synthetic coding sequence
atggagcggtggctgttcctgggcgccaccgaggagggccccaagagaacaatggactccggcactcgacccgtgggcagttgctgttcttccccagccggactttctcgagagtacaaactggtgatgctgggggcagggggggttggaaaatctgccatgacaatgcagttcatctcacatcgtttccctgaagaccacgatccaacaatcgaggacgcttataagattagaattaggattgatgatgaacccgctaatttggacatcctggacactgctgggcaagccgagttcaccgccatgcgggaccagtacatgcgggctggcgaaggcttcatcatatgttattcgatcaccgatcgaaggagtttccacgaggtgcgcgaatttaagcagctcatttaccgggttcgccgcaccgatgataccccagttgtccttgtcggcaacaagtccgacctgaagcaactgcgacaggttaccaaagaggagggattggccctggctcgggagttctcctgtcccttcttcgagacctccgcagcctacagatactatatagatgacgtttttcacgccctggtgagggagatccggcgcaaggagaaggaggcagtgttggcaatggagaagaagtctaagccaaaaaactcagtgtggaagcgcttgaagtctccgttcaggaaaaaaaaagactccgtcacatag

SEQ ID NO: 45443 - DNA, 660 bp, Artificial Sequence
  Description of Artificial Sequence: Synthetic coding sequence
atggacagcggcacccggcccgtgggcagctgctgcagcagccccgccggactgtctcgggaatacaaattggttatgttaggggctggaggtgtgggcaaaagcgccatgactatgcaattcatttcgcaccgatttccggaagaccatgatcctaccattgaagatgcatataaaatccgcattcggatagacgacgaaccggccaacctggacatcctggacacagccggtcaggccgagttcactgccatgcgtgatcagtacatgcgcgctggggagggattcattatctgttatagcattactgatcgccgcagcttccacgaagtgcgagagttcaagcagctcatttatagggtacggagaactgatgacacacccgtcgttctggtcggaaacaagtccgatctgaagcaactccggcaggtaaccaaggaagagggtctcgcattggccagagagttcagctgtcctttcttcgaaacctcagccgcctatcgttattacattgatgacgtctttcacgctctggtgcgtgagatcaggcgtaaggagaaggaagcggtgctggctatggagaaaaagtccaagcccaagaattctgtttggaaacgcttgaaatcaccatttaggaagaagaaggatagcgtcacctag

SEQ ID NO: 45444 - DNA, 552 bp, Artificial Sequence
  Description of Artificial Sequence: Synthetic coding sequence
atgaccatgcagttcatcagccaccggttccccgaggaccacgacccgacgatcgaagacgcctacaagattaggatacgcattgatgacgagcccgctaacttggacattctggacacagctggacaggccgagtttaccgcaatgcgcgatcagtacatgcgggcaggtgagggttttatcatctgctactcaatcaccgatcgcaggtcttttcacgaggtgcgggagtttaagcagcttatataccgagtgcggcggaccgatgacactccagtcgtgctagtgggaaacaagagcgatctgaagcaacttaggcaggtgacgaaggaagaaggtttagccctggcccgcgaatttagctgcccattctttgagacgagtgctgcctatagatactatatcgatgatgtgttccatgccctggtaagggagatcaggaggaaagaaaaagaagccgtgctcgctatggagaaaaagagcaagcccaagaactctgtttggaagaggctaaagtctccctttaggaaaaagaaagattctgtgacgtag

SEQ ID NO: 45445 - DNA, 462 bp, Artificial Sequence
  Description of Artificial Sequence: Synthetic coding sequence
atggaggtggagaacgaggccagctgcagccccggcagcgccagcggaggatcacgggagtataaggtggtcatgttaggagctggcggcgttggtaagagcgctatgaccatgcagttcataagccaccaattccccgattatcatgatcccactatcgaagacgcctacaagacacaggtacgcattgataacgagcctgcatatttagacattctggatacagccgggcaggccgagtttacagctatgcgcgaacagtatatgaggggcggggaaggattcattatctgctatagtgtcactgaccggcaatcttttcaagaggcagctaaattcaaagaattaatttttcaagtgaggcacacctacgagatcccattagtccttgtcggaaacaaaatcgacctcgaacagtttcgccagcctactcttaaagaattcggccgagaggagttttag

SEQ ID NO: 45446 - DNA, 654 bp, Artificial Sequence
  Description of Artificial Sequence: Synthetic coding sequence
atggaggtggagaacgaggccagctgcagccccggcagcgccagcggcggtagcagggagtataaggttgtcatgctgggggcaggcggcgtgggcaaatcggcaatgaccatgcagtttatatcccatcagttccccgactatcatgacccaaccatcgaggatgcatacaagacccaagtacggatcgataacgaaccagcctacctggacatactggataccgccggacaggcagaattcactgccatgagagagcagtatatgcggggaggagaaggctttatcatttgctattctgtaaccgataggcagagctttcaggaagccgctaagttcaaggagctaatcttccaggtccggcacacgtacgaaatcccattggttttggtgggcaacaagatagacttagagcagttccggcaggtttctacagaagagggtttaagcctagcacaggagtacaattgcgggttcttcgaaacgtccgctgctcttcgattctgcatcgatgatgcatttcatggccttgtacgcgagataaggaagaaggagtccatgccctctctgatggagaaaaaactcaaacgaaaggatagcttgtggaagaagctgaaaggctctctcaagaagaaacgagagaatatgacttag

SEQ ID NO: 45447 - DNA, 240 bp, Artificial Sequence
  Description of Artificial Sequence: Synthetic coding sequence
atgcccgtggccgtgggcccctacggccagagccagcccagctgcttcgacagagtgaagatgggcttcgtgatgggttgtgccgtaggaatggcggccggagctctgttcggcacattctcatgcctccggatcggcatgagaggcagggagctcatgggcggaatcggtaagactatgatgcaatccggaggcacttttggcacctttatggctattggaatgggcataagatgttag

SEQ ID NO: 45448 - DNA, 240 bp, Artificial Sequence
  Description of Artificial Sequence: Synthetic coding sequence
atgcccgtggccgtgggcccctacggccagagccagcccagctgcttcgatcgggtcaaaatgggcttcgtgatgggatgtgctgtgggcatggccgcaggagcactgtttggaacctttagctgcctccgcattggaatgaggggccgtgaactcatgggcgggattggcaaaacaatgatgcaatcggggggcacgttcggtacttttatggctataggtatgggaatcaggtgttag

SEQ ID NO: 45449 - DNA, 240 bp, Artificial Sequence
  Description of Artificial Sequence: Synthetic coding sequence
atgcccgtggccgtgggcccctacggccagagccagcccagctgcttcgatcgggtaaagatggggttcgtgatgggatgcgcagtgggcatggccgctggcgcattatttgggaccttctcatgtctgcgcattggcatgagggggcgagaactcatgggtgggatcggaaagactatgatgcagtccggtgggacatttgggacatttatggccattggtatgggaatccggtgttag

SEQ ID NO: 45450 - DNA, 240 bp, Artificial Sequence
  Description of Artificial Sequence: Synthetic coding sequence
atgcccgtggccgtgggcccctacggccagagccagcccagctgcttcgacagagtaaagatgggattcgttatggggtgcgcggttggaatggccgccggggccttgtttgggacttttagttgtcttcgaattggcatgaggggccgcgaattgatgggtgggatagggaagacgatgatgcagtctggagggacattcgggactttcatggcgatcggtatgggaattagatgttag

SEQ ID NO: 45451 - DNA, 792 bp, Artificial Sequence
  Description of Artificial Sequence: Synthetic coding sequence
atgcggatcttccggccctggcggctgcggtgccccgccctgcacctgccgagcctatctgtgttttccctgcgctggaagctgccttctcttaccacggatgagacgatgtgcaaatctgtgacaaccgatgaatggaaaaaggtattctatgagaagatggaagaagcaaaacctgctgacagctgggatctgatcatcgacccgaacctgaaacacaacgtgctgagccccggctggaaacaatatcttgagctgcatgcctccggtcgctttcactgctcctggtgttggcatacgtggcagagcccttacgtggtgatcctgttccacatgtttttggacagagcccagcgcgctggcagtgtcaggatgagagttttcaagcagctatgctacgaatgcggaacagcacggttggacgagtcaagtatgcttgaggaaaacatcgaggggctagtggacaatctgatcacctctttgagggagcagtgctacggcgagcggggggggcagtataggatccatgtagcttccagacaagacaaccggcggcatagaggggaattctgcgaggcttgtcaggagggtatagtgcattggaagccctccgaaaagctccttgaagaagaagcaaccacctatactttcagcagggcaccaagccccaccaagtcacaggatcaaacaggatccgggtggaatttttgctcaatcccctggtgtctgttttgggcaaccgtactccttctgatcatctatttacagttttcgttccgcagctctgtgtag

SEQ ID NO: 45452 - DNA, 678 bp, Artificial Sequence
  Description of Artificial Sequence: Synthetic coding sequence
atgtgcaccagcctgaccacctgcgagtggaagaaggtgttctacgagaagatggaagtcgccaagcccgctgacagttgggaactgatcatcgaccccaacctgaaaccaagtgagctcgcacccggctggaagcagtatttagaacagcatgcctctggccgtttccattgcagctggtgttggcacacatggcagagtgcacacgtggtgatcctgttccacatgttcctggacagggctcagcgcgccggcagcgtccgaatgagggtattcaagcagctgtgttatgagtgtggaaccgcacgtctggacgagagcagcatgctggaggagaatatcgaaggtcttgtggataacctgatcaccagcttgcgagagcagtgctacgaggaggacggcgggcaatatcgtattcacgtagcatcacggccggactccgggcctcaccgtgccgagttctgtgaggcctgtcaggaaggcattgttcactggaaaccaagcgagaagctgctcgaagaagaggttaccacctatacatcggaggccagtaagccacgggcccaagcggggtccggttacaattttctgagcctcagatggtgtctgttttgggcctccctgtgtctcctggttgtgtatttgcagttttccttcctcagtcctgcatttttctag

SEQ ID NO: 45453 - DNA, 2016 bp, Artificial Sequence
  Description of Artificial Sequence: Synthetic coding sequence
atgcagcccgacatgagcctgaacgtgatcaagatgaagagcagcgatttcctggagtcagcggagcttgactctggcggtttcggcaaagtgagtctgtgctttcacaggacccagggcctcatgataatgaagacagtctacaaggggcccaattgcattgaacataatgaggcgctcttggaggaggctaagatgatgaacagactgcgacactccagagtggtcaaactactgggtgtgattatcgaagagggtaagtacagtctggtgatggagtacatggaaaagggaaacctgatgcatgtgttgaaagccgagatgagcacgcccctctccgtgaaagggcggatcatcctggagattatcgagggcatgtgctacttgcacggaaagggagtgattcacaaggacttaaagccggagaatatcttggtagataacgacttccacatcaagattgccgatctcggactggcctcattcaagatgtggagcaagcttaataacgaggagcacaacgagctccgggaggtagatggcaccgctaagaaaaatggaggaacattatactatatggcacctgaacacttaaacgacgtgaacgctaagccgaccgaaaagtctgatgtttacagcttcgcagtcgtcttgtgggctattttcgcaaacaaagaaccttacgagaacgccatctgtgaacaacagcttatcatgtgcatcaagtccggaaatcgcccggacgttgacgatattaccgaatattgcccccgggaaataatatccctaatgaaactgtgctgggaagccaatcctgaggccagacccaccttccccggcatagaggaaaaatttagacctttttacctgagtcagctcgaggagagcgtggaggaagatgtaaaatctctgaagaaggagtactcgaatgagaacgctgtcgtaaaaagaatgcagtccttgcagctggattgcgtggcagtaccgagcagccgatctaattctgcaacagagcagccgggctccctacactcaagtcaggggcttggcatgggaccggttgaagaatcatggtttgcgccatctctcgaacatccccaggaagagaacgaacctagcctccaatccaagctgcaagacgaggccaactatcacttatatggctctagaatggacaggcagacgaagcagcaaccgcgccagaacgtggcctacaatcgggaggaagagcgacggagacgcgtttcacacgatccgttcgcccaacagagaccctatgaaaatttccagaatactgagggcaagggcaccgcctatagctccgccgcgagtcatgggaatgcagttcaccagccctctggcctgacatcgcagccgcaggtcttgtatcagaataacgggctttattcctctcacggattcggcacccgccctctagatccaggaacagcaggccccagagtgtggtaccgacctattccaagccacatgccctcacttcacaacatcccagtgccggaaacgaattacctcggcaatactcctactatgcctttttcaagtctacccccgactgatgaaagcattaagtataccatctacaactctacgggtatccagatcggtgcatataattacatggaaatagggggtactagtagcagcttattagactcaacaaacacaaacttcaaggaggaacctgctgcgaagtaccaagccatcttcgataacactacgagcctcacagacaaacacctcgatcccatcagggaaaacctggggaagcattggaaaaactgtgcacgcaagcttggattcacccaaagccagatcgacgaaatcgaccacgactacgagcgtgatggcttgaaggagaaggtttaccagatgttgcagaagtgggtcatgagggagggtattaaaggcgccaccgtggggaagctcgcccaagcccttcaccagtgctcaagaattgatctgctcagctcactaatttatgtgtcacaaaattag

SEQ ID NO: 45454 - DNA, 2016 bp, Artificial Sequence
  Description of Artificial Sequence: Synthetic coding sequence
atgcagcccgacatgagcctgaacgtgatcaagatgaagagcagcgactttcttgaatctgccgaacttgacagcggcggctttggaaaggtgtctctttgtttccacaggacacaagggttaatgatcatgaagaccgtgtacaagggccctaactgtatagagcataatgaggcactgctcgaggaagctaagatgatgaacagactaagacacagcagggttgtaaagcttctgggcgtgattatcgaggaaggtaaatattccctagtgatggagtacatggagaaaggcaacttaatgcatgttctgaaggctgagatgtccacgcccctgagtgttaagggcagaatcatactcgagattatcgaggggatgtgttatctgcatgggaaaggggtgatccacaaagacctcaaaccagaaaatatcctggtggataatgacttccacatcaaaatcgcagaccttggtctggcatcttttaaaatgtggagcaaattaaataatgaagaacacaacgaactaagggaagttgacggtacagctaagaagaatggcgggaccctgtactacatggccccggaacatcttaatgatgtgaatgccaagccaaccgagaaaagcgacgtttacagcttcgccgtcgttctttgggccatcttcgccaataaggaaccttatgaaaacgccatctgtgagcagcagttgataatgtgcatcaagtcaggaaatcgaccagatgtagatgatatcacggaatactgcccccgcgaaatcatttctctgatgaagctgtgctgggaagctaaccctgaggccaggccaacctttcctggtatcgaggagaaattccggcccttctacctgtctcagttagaggagtctgtggaggaggacgtaaagagtcttaaaaaagagtactctaacgagaacgctgtcgtgaaacgcatgcagtctcttcaactggactgtgtggccgtgccatcttccaggtccaattcggcaacagaacagcccggatccctgcactcaagccagggtttggggatgggccccgttgaggagtcctggtttgccccatcactggagcacccccaggaagagaatgagccttcccttcaatcaaagttacaggatgaagctaattaccacctgtacggttcccgcatggatcggcagactaaacagcagcctcgccagaatgtggcctataaccgcgaggaggagcgtagacggcgggtttctcacgacccatttgcgcagcaaaggccttacgagaattttcagaacacggagggaaagggaaccgcttacagcagtgcagcgagtcatggtaatgcagtccatcagcctagcgggctcacgtcccagccccaggtactttatcagaataacggattgtactctagccacggtttcggtacaaggccgctcgacccaggaaccgccggccccagagtctggtataggcctattcccagccatatgccatcattacacaatatcccagttcctgaaaccaattatttagggaatacacccacaatgcccttctcctccctcccacctaccgacgagtccattaagtataccatctataattccaccggaattcagataggtgcctataactacatggagattgggggcaccagctcctctttacttgatagtacgaatactaacttcaaggaggaacccgcagccaagtaccaggctatttttgataataccacttccttgaccgacaaacatctcgacccgattagggagaacctcggaaagcattggaagaactgcgcgcgcaagcttgggttcacacaaagtcaaatagatgaaatcgaccatgactacgagcgcgatggattgaaagagaaagtctaccagatgttacagaagtgggtcatgcgggagggaattaagggtgctacagtgggaaaactagcgcaggcgctgcaccaatgctcgcgtattgacctcctctcttcattgatttacgtgtcccaaaactag

SEQ ID NO: 45455 - DNA, 822 bp, Artificial Sequence
  Description of Artificial Sequence: Synthetic coding sequence
atgagccccgcctgccgggtgaacagcaagaccaagcccaccaccatcttcatggccgcagcctggaccggtcgtcgcaactcttccccagatcgcatgtggcttactaccgaaaggaggaagggtgacgctggaagcccaatgaccttactccatcgacccagcggcctgacgagccagccgcaggtgctctatcagaacaacggtctctactctagccacggttttggcactcggccactggatcccggtaccgcaggcccccgtgtttggtatcgcccaattccatcgcacatgccatcattgcataatattccagtgccagagaccaattatctcggcaacacacccacaatgcctttctcttcactgccaccaaccgacgaatcaattaagtatacgatctataattccaccggaatccagatcggtgcatataattacatggagatcgggggcactagctcttccctcttggattcaacaaatactaacttcaaagaggagcctgcagccaagtaccaggcaattttcgataataccactagcctcacagacaaacacctggaccctatcagagaaaaccttggtaagcattggaagaactgtgccaggaaactcggatttacccagtcccagatcgacgagatcgaccacgactatgaaagggatgggctgaaagagaaggtatatcagatgttacaaaagtgggttatgagagaagggattaagggggccaccgtaggtaaactcgcgcaggctttgcaccagtgtagccgcatagatctgctcagctctttgatttacgtaagccagaactag

SEQ ID NO: 45456 - DNA, 1878 bp, Artificial Sequence
  Description of Artificial Sequence: Synthetic coding sequence
atgcagcccgacatgagcctgaacgtgatcaagatgaagagcagcgactttctggagagtgctgagctcgactccggtgggtttggcaaagtcagcctgtgttttcatcgcactcaaggacttatgattatgaagaccgtgtataaaggaccaaattgtattgaacataatgaagcgctgcttgaggaggcaaagatgatgaataggctccgacactcaagggttgtcaagttacttggggtgatcattgaagaaggaaaatactcattagtgatggagtatatggaaaagggtaacctcatgcatgtgctgaaggcagaaattgcagacctaggattagcctccttcaagatgtggagcaagttgaataatgaggagcacaatgagctccgggaagttgatggcaccgcgaaaaagaatggcggcaccctgtactacatggcacccgagcatttaaatgacgtaaatgctaagcccacagaaaagtcggacgtgtatagctttgctgttgtactgtgggcaattttcgcaaacaaagaaccttacgaaaatgccatctgtgagcagcaacttattatgtgcataaaatccggaaacaggcccgacgtcgatgatatcaccgagtactgtccacgcgagatcatctcactaatgaagctgtgttgggaagctaatcccgaagcccgtccaaccttccctgggatcgaggagaaattccgcccattctacttatctcagctggaggagagtgtggaagaggacgtgaagagcctcaaaaaagaatacagcaacgagaacgcagttgtgaaaaggatgcagagcttacagttagattgtgtagctgtaccttcaagtcggtctaattctgcaactgagcagcccggaagcttgcattccagtcagggactggggatgggaccagtggaggagagctggtttgcccctagtttagagcaccctcaggaggagaatgagccatcccttcagagtaagctgcaagatgaagccaattaccacttgtatggctcgaggatggaccggcagaccaaacaacagcctcgtcaaaacgtcgcctacaaccgagaagaggaacggcggaggagggtgagtcatgatcccttcgcccaacagcggccctacgagaatttccagaacaccgaaggaaagggcacagcttatagcagcgccgcctcacatggaaatgccgttcaccagcctagtggcctgaccagccagccccaggtgttgtaccagaataatggactatactcttctcatggcttcggtactcggcccctggacccagggaccgcggggccccgcgtgtggtaccggcctataccctcacacatgccatctttgcacaacatcccggtgccagagacaaactatctaggcaacacccccacaatgcctttttccagcctcccaccgacagacgagtcaatcaagtacaccatatataatagcacaggcattcagattggcgcttacaactacatggaaatagggggcaccagctcctctctacttgactctaccaatacgaacttcaaggaagaacccgctgccaagtaccaagcaatctttgataataccacctctctgactgacaaacacctggatcccatccgagaaaacctgggcaagcactggaaaaattgcgcgagaaaacttggcttcactcagtcgcagatagatgagatcgaccacgactatgagagagacggcctgaaggagaaggtttatcagatgctgcagaagtgggtgatgagggaaggaatcaagggcgccaccgtgggtaaactcgctcaagccctacatcaatgcagtagaattgatctcctgtcttcactgatttacgtgtcgcaaaactag

SEQ ID NO: 45457 - DNA, 522 bp, Artificial Sequence
  Description of Artificial Sequence: Synthetic coding sequence
atgcagagcgagctgtgcttcgccgacatccacgacagcgacggctcatccagcagcagtcaccaatcgcttaaatctaccgccaagtgggccgccagtctcgagaatctgttggaagatcccgagggagtcaaacggtttcgggaattcctgaagaaggagtttagtgaggaaaatgtgctgttttggcttgcttgcgaagactttaaaaagatgcaggataagacccaaatgcaggaaaaagcaaaagagatctacatgacgttcttaagtagtaaggcttccagccaggttaacgtggaaggccaatcccgtctgaatgagaaaattctggaggaaccacacccattgatgtttcagaaactgcaagaccaaatcttcaacctgatgaagtatgacagctactcccgattcttaaaatcagatctatttttgaagcacaagaggactgaggaagaggaggaagatctgcccgacgcgcaaactgcagccaagcgcgcgtccaggatctacaatacctag

SEQ ID NO: 45458 - DNA, 546 bp, Artificial Sequence
  Description of Artificial Sequence: Synthetic coding sequence
atgttcaaccgggccgtgagccggctgagccggaagcggccccccagcgatattcacgacagtgacgggtctagctccagttctcaccagtccttaaagagcaccgcaaaatgggcagcttctcttgagaatctgctggaggaccccgagggcgtaaaaagatttcgggaattcctaaagaaagaattcagcgaggagaacgtgctgttctggctagcctgcgaggattttaaaaaaatgcaagacaagacacagatgcaggaaaaggctaaggagatttacatgacttttctgtctagtaaggcaagctctcaagtcaacgtcgagggccagtcccgcttaaacgaaaagatcctcgaagagccccatccactcatgttccaaaaactgcaggatcagatcttcaacttaatgaagtatgactcttattcccgcttcctcaaatctgatctctttctgaagcacaaacgcacagaagaagaggaagaagatctaccagacgctcagaccgccgcaaagagagccagccggatctacaatacctag

SEQ ID NO: 45459 - DNA, 504 bp, Artificial Sequence
  Description of Artificial Sequence: Synthetic coding sequence
atggagcacatccacgacagcgacggcagcagcagcagcagccaccagagcctgaagagcactgctaagtgggcggcgagtttggaaaatctcctggaggaccccgaaggtgtcaagcggtttcgcgaattcttgaaaaaggagtttagcgaggaaaacgtattattttggctcgcttgcgaggacttcaaaaagatgcaggacaaaacccagatgcaggaaaaagccaaggagatctatatgacttttctgagttctaaagcgtctagccaggtgaatgttgagggccagtccaggttgaatgagaagattctcgaggaaccgcatcccctcatgtttcagaaactgcaggatcaaatcttcaacctgatgaaatacgacagttactctaggtttctgaaatccgatcttttcctgaaacataagcggaccgaggaggaggaagaagacctgcctgacgcacagactgctgcaaagcgggcctcccgcatctacaatacatag

SEQ ID NO: 45460 - DNA, 1341 bp, Artificial Sequence
  Description of Artificial Sequence: Synthetic coding sequence
atggagcgggtggtggtgagcatgcaggaccccgaccagggcgtgaaaatgaggtcccaaagactgttggtgactgtgattccgcatgccgttacaggatctgatgtggtccagtggcttgcgcagaagttctgtgtttccgaggaggaggccctacacttaggtgcggtgctcgtccagcacgggtacatctatcccctgcgggacccccgcagcctgatgctgcgccccgatgaaactccgtaccgctttcagactccctacttttggacatccacactcaggcccgccgcagagcttgattacgctatctacttggccaagaaaaacatccggaaacgcgggaccctggttgactatgagaaggactgctacgacaggttgcataagaagataaaccatgcttgggacctggtcctcatgcaggcccgggaacagctgcgtgccgccaaacagcgaagtaagggggatagattggtaatcgcctgccaggaacaaacttattggctcgtgaacaggccacccccaggtgcccccgacgtgttggaacaaggaccaggcagaggctcctgtgcggcgagtcgtgttctcatgactaaatcagcagactttcataaacgcgagattgagtacttccgaaaggcccttggtagaacacgagtgaaaagctccgtctgcttagaggcttaccttagtttttgcggccagaggggcccgcatgaccccctggttagcggctgccttccctctaacccgtggattagcgacaacgacgcttactgggtgatgaacgctccgactgtggctgccccgacaaaactgcgggtggaaaggtggggcttttccttcagggaattattagaagatccagtgggccgtgcgcactttatggactttctcggcaaagaattttctggggaaaatctgagtttctgggaggcctgcgaggaactgcggtatggagctcaggctcaagtgccaacacttgtcgatgccgtctatgagcaatttttggctcccggagccgctcactgggtcaacatcgacagccgcaccatggagcagacccttgagggcctcagacaaccccacaggtatgttttggatgatgcgcagctccatatttacatgcttatgaagaaagattcttatccgcgatttctgaagtccgacatgtataaggccctattagccgaggccggcattcctctagagatgaaaaggcgggtgttcccttttacctggcgcccaagacattctagtccctctcccgctctcctgcctacccccgtggaaccaacagctgcctgcggcccaggcggaggcgacggagtggcctag

SEQ ID NO: 45461 - DNA, 786 bp, Artificial Sequence
  Description of Artificial Sequence: Synthetic coding sequence
atggccgccggccccgcccccccccccggccggccccgggcccagatgccacatctcagaaaaatggaacgtgtggtcgtctcaatgcaggaccctgatcagggcgtcaaaatgaggagccaaagactactcgtgaccgtgattccgcacgccgtgacaggctcagacgtcgtgcaatggctcgctcagaagttctgcgtatccgaagaggaagccctgcatctaggagctgtcctcgtacaacacggatacatttacccactgcgcgacccccggagtctcatgcttcgacctgacgagactccataccgatttcagaccccatacttttggacctctacacttaggcctgcagctgaactcgattatgcaatctacctggccaaaaagaacattagaaagagaggtactcttgtggattatgagaaggactgctatgatcgtctacataagaagatcaaccatgcctgggaccttgtgttaatgcaagctcgcgaacaacttcgcgccgcaaagcaacgctccaagggtgaccgcttagtgatcgcgtgtcaggagcaaacatattggctggtgaataggccacccccaggcgctcctgatgttcttgaacagggtccgggaaggggttcgtgcgccgcaagtcgcgtgctgatggtcgaagcttccaggacacgtggtaccaggccagagggcgcatccgagccccggagtagcaaaactctgtgctcaaaccaatctcatccggacccaacaagtggaaaaatgcatcttgagccgcactag

SEQ ID NO: 45462 - DNA, 1404 bp, Artificial Sequence
  Description of Artificial Sequence: Synthetic coding sequence
atggccgccggccccgcccccccccccggccggccccgggcccagatgccccatctgcggaagatggagcgagtcgtcgtgagcatgcaagacccggaccagggagtgaagatgcggtcccagcggcttctggtcaccgtgataccccatgccgtgacgggcagtgatgtggtccagtggctggcacagaagttctgcgtgagtgaagaagaagcgctacatctgggggcagttctagttcagcacgggtacatataccctctccgcgatcctcgatccctgatgttacgccccgatgaaacaccctaccgctttcagaccccttatttctggactagcacgctgcgccctgccgcggagttggactacgctatatacctcgctaaaaaaaatatccgcaaaagggggacactcgtcgactacgagaaggactgctacgatcggctccacaagaagatcaaccatgcctgggatctcgttctgatgcaagcccgagagcaacttcgcgcagcgaagcagcggagcaaaggcgatagactggtgattgcatgccaagagcaaacctactggctggtaaatcgccctccgccaggggcacctgacgtcctggaacaaggccccggaagagggtcatgtgccgcctctcgagtgctaatgacgaagagtgccgatttccacaaaagggagattgagtactttaggaaggctttaggccgcacgagagttaagtcttccgtgtgtctggaggcctacctctccttctgcgggcaacgaggaccccacgacccgctcgtgtctggatgtctgccatctaacccatggatctccgataacgacgcttactgggtgatgaacgccccgactgttgcagctcccaccaaactgcgcgttgagagatggggctttagctttcgtgagctgctagaggacccggtgggtcgagctcactttatggacttcttgggcaaagaattctccggagaaaacttgtccttctgggaagcatgtgaggagctgaggtacggggctcaggcgcaggtgccaactctggtggatgccgtttacgagcagtttctcgcccctggggcggctcattgggtcaatattgatagtcgtacaatggagcaaaccttggaagggctccgccagccacatagatacgtgctggatgatgcacaactccacatttatatgctgatgaagaaggactcttatccaagattcctgaaatcagacatgtataaggctttgcttgccgaggcagggattccacttgagatgaagcgccgagttttccctttcacatggaggcccagacatagcagccccagccccgcactgttgccgacacccgttgagcctacggcggcctgcggccctggcgggggagacggggttgcttag

SEQ ID NO: 45463 - DNA, 405 bp, Artificial Sequence
  Description of Artificial Sequence: Synthetic coding sequence
atggccaccagcacccggtgcgccacccccgtggccagctgcagcggacaaacaaggcgccccaccggatctcggagtggatctggagtgcaagtcggggccggtggcactcctactccaacacaccctgcataccaactgggcgagacaggcggagccccttcactgctaggcctggaatgggattccgcaatgtccccatgggccggggggcccagtccacctccgcagaaaagctggaccgcaagtacggatgtggtcagacggactcggctgcgagacggagcgtcggttttcctcggaactaccgccgggcctcataaagggtcctatgtgcaacgcatcctgcctagctcctggggcagcctcggccctggacccgagggcggggcggtgaaggcttag

SEQ ID NO: 45464 - DNA, 480 bp, Artificial Sequence
  Description of Artificial Sequence: Synthetic coding sequence
atgagccggcggaactgctggatctgcaagatgtgccgggacgagagcaaacgccccccctctaatctcactcttgaggaggtgttacagtgggcccagagttttgagaatctgatggcaaccaaatacgggcccgtggtctacgccgcttacctgaaaatggagcactcagatgaaaacatccagttttggatggcatgtgaaacttataagaaaattgcctctagatggtctcggatctctagggcgaagaagttgtataaaatctacattcaaccccagtcacctagggagattaatatcgacagctctactcgtgagacaatcatcaggaatatccaagagccgaccgagacatgtttcgaggaggctcagaagatcgtttatatgcatatggagagggactcttatccccgtttcctgaagtccgagatgtaccagaaactcttaaagacgatgcagagcaacaattcattttag

SEQ ID NO: 45465 - DNA, 480 bp, Artificial Sequence
  Description of Artificial Sequence: Synthetic coding sequence
atgagccggcggaactgctggatctgcaagatgtgccgggacgagtcaaagcgccctccctccaacctgaccctcgaggaggtgttgcaatgggcccagtcatttgagaatctaatggccaccaagtacgggcccgtggtgtacgcagcatatctgaaaatggagcactcggacgagaacattcagttttggatggcatgcgagacctataagaagatcgcctccagatggtctaggatcagtagagccaagaagttatataaaatctatattcagccccagtccccccgggaaattaacattgatagctcgacacgcgagacaatcattaggaatatccaggagccaacggagacttgttttgaggaggcccaaaagatcgtctatatgcatatggagcgagatagttacccacgctttctgaaaagcgagatgtaccagaaactactaaagaccatgcagagcaataattctttctag

SEQ ID NO: 45466 - DNA, 1788 bp, Artificial Sequence
  Description of Artificial Sequence: Synthetic coding sequence
atgaccatgaccctgcacaccaaggccagcggcatggccctgctgcaccaaatccaggggaatgagctggaacccttgaaccggccccagctgaaaattcccctggagcggccgctgggggaagtctatttggattcttctaagccagctgtctacaactatcccgaaggggctgcatatgagttcaatgctgccgcggcagccaacgcccaggtctatgggcagacaggactcccgtatggcccgggaagcgaggctgccgctttcgggtccaatggcctggggggattccccccgctgaattccgtgtcccctagtccgctaatgcttctgcacccacctcctcagctctctcccttccttcagccccacggccagcaggtaccttattacctggagaatgaaccctctggctatactgtgcgtgaggccggaccgcccgccttttaccgtcccaactccgacaaccgacggcagggtgggagggagaggttagccagtaccaacgacaagggctccatggcaatggagtccgccaaagaaacaaggtattgtgcggtgtgtaatgattacgcctctggataccactatggagtttggagctgtgagggatgtaaagcattctttaaaaggtcgattcaaggccacaatgactatatgtgtcccgctacgaatcagtgtactatcgacaagaataggcgcaagtcctgccaggcgtgcagactgcggaaatgctatgaagtgggcatgatgaagggcgggatccgtaaggacagaagaggtggtaggatgctgaagcacaaacgccagcgagacgacggcgagggcaggggagaggttgggagcgcaggcgacatgcgagctgctaacctgtggccatccccgttaatgataaaaagatctaaaaaaaattcacttgcattgagcctcaccgctgaccagatggtcagcgcactgctagacgcggaaccacccatcctttatagcgagtacgatcctacccgcccgttcagtgaagccagcatgatggggctgctgacgaacctggcggatcgagagctggtgcacatgattaattgggccaagcgggtgccgggcttcgtggacttgacactccatgaccaggtacatctcctcgagtgcgcgtggctcgaaatccttatgattggcctcgtctggaggagcatggagcatccagggaaactactgtttgcgcctaatctccttctggacaggaatcaagggaagtgtgtagagggcatggtggagatcttcgacatgctgttggccacatcctcacgtttccgcatgatgaatctccagggcgaagagttcgtgtgcctgaagtctattatcctcctcaattccggcgtgtataccttcctaagcagcacgctgaagagtctggaagagaaggaccatattcatcgagttctcgataagataacagacactttaatacatctaatggccaaagccggccttaccttgcaacagcagcaccaacgcctagctcagctcctgttgattctgtcacatatccgacatatgagtaacaagggaatggagcacctgtactccatgaagtgcaagaatgtggtgcctttgtatgatttgctgctggaaatgctggatgcccatcgcctgcatgctcctacttcaaggggtggtgccagcgtggaagagacggatcaaagccacctggcaacagcaggcagtacctctagccatagcctccagaaatattacattacaggggaggccgaggggttccctgcaactgtctag

SEQ ID NO: 45467 - DNA, 633 bp, Artificial Sequence
  Description of Artificial Sequence: Synthetic coding sequence
atgcggaagcggcagcagagccagaacgagggcacccccgccgtgtcacaggctcccggcaatcagagacctaataatacttgttgcttctgttggtgttgttgctgtagttgctcctgcctcaccgtgcggaacgaggagcggggtgagaatgcgggcagaccgacacacactacaaagatggaatcaatccaggttctcgaagaatgccagaaccctaccgccgaagaggtgctttcctggtcccaaaacttcgataaaatgatgaaggcgcctgcaggacgaaatttgttcagggagtttctgagaaccgagtactctgaagaaaaccttctgttctggctggcttgcgaagacctgaagaaagagcagaataagaaagtgatcgaggagaaggcacgcatgatatatgaggactacatctcaatcttgtctccaaaagaggtttctttagattcacgagtgcgggaagtgatcaacaggaacctgcttgatcctaatcctcacatgtatgaggacgcgcagctgcagatttatacactaatgcaccgggacagcttccctaggttcctcaacagtcagatctacaagtcctttgtggaatctaccgcgggttcctcttccgagtcctag

SEQ ID NO: 45468 - DNA, 708 bp, Artificial Sequence
  Description of Artificial Sequence: Synthetic coding sequence
atggagaccaccctgctgttcttcagccagatcaacatgtgcgagtctaaggagaaaacgttttttaagttgatccatggcagtggaaaggaagaaacgtcaaaggaggccaagatacgcgccaaggagaaacggaaccgtctgtccctgttggtccagaaaccagaattccacgaggataccagatctagtaggtcagggcatctggcaaaggagactagagtgtctcccgaggaagctgtaaagtggggcgagagcttcgataaactcctcagccacagggatggacttgaagccttcactcgttttctcaagactgaattttcagaggagaacatcgagttctggattgcctgtgaggactttaagaagtctaagggtcctcagcaaatccacctgaaagcgaaggccatctacgaaaagtttatccaaacagacgcacccaaggaggtcaatttagattttcacactaaggaggtgataacaaactctatcacccagccaacactccacagttttgatgccgcccaatctcgagtgtaccagttgatggaacaagattcctacacacggtttttgaagtctgatatatacctagatcttatggagggacgcccgcagagacctaccaatctccgacgtcgctcccgcagtttcacatgcaatgagttccaggatgtgcagtccgacgttgccatatggctttag

SEQ ID NO: 45469 - DNA, 654 bp, Artificial Sequence
  Description of Artificial Sequence: Synthetic coding sequence
atgcccaccccccacgaggccgagaagcagatcaccggccccgaggaagctgacagacccccatccatgtcctcacacgataccgcaagccccgcagcaccttctaggaatccatgttgcctgtgttggtgttgctgttgctcttgttcctggaatcaagagagacggagagcttggcaggcttctcgggaatctaaacttcaacctctcccttcatgcgaggtgtgcgccacgccatccccagaggaggtccagtcatgggcgcagtccttcgataagctgatgcattctcctgccgggaggagtgtattcagagcctttttaagaacagagtactcggaggaaaacatgctgttctggctggcatgtgaggagttaaaggcagaggccaatcagcacgtggtggacgagaaagcaaggttgatttatgaagactacgtctctatcttatcccccaaagaagtgagtctcgactctcgcgtccgcgagggaattaataaaaaaatgcaggagccttctgcgcacactttcgacgacgcccagctgcagatttatacactaatgcacagggattcttaccctcgctttctttcctcgcccacttacagagcgttgttgcttcaggggccatctcaatcttcctccgaggcctag

SEQ ID NO: 45470 - DNA, 654 bp, Artificial Sequence
  Description of Artificial Sequence: Synthetic coding sequence
atgcccaccccccacgaggccgagaagcagatcaccggccccgaggaggctgacaggcccccatccatgtcgtcacacgacactgcctcccccgcagcccccagcaggaacccctgctgcctgtgctggtgttgctgctgcagttgtagctggaatcaagaaaggagaagagcttggcaagcaagcagggagtctaaacttcagccgctgcccagttgtgaggtttgcgctacacccagcccagaagaggtacagagctgggctcagagcttcgataaactgatgcattctcccgccggcagatccgtatttcgcgccttcctacggaccgagtattcggaggaaaacatgctcttctggctggcctgcgaagagcttaaagcggaggctaatcagcacgtggtcgacgagaaagctagactgatctatgaggattatgtctctatcctctccccgaaggaagttagcttggactctcgtgtccgtgaggggataaacaaaaaaatgcaggagccgtcagcccacacatttgatgatgcccagctgcaaatctataccctgatgcaccgggattcctacccgaggttcctgtcaagccccacttacagagccttgctgctgcaggggccctcacagtcttcttctgaggcctag

SEQ ID NO: 45471 - DNA, 726 bp, Artificial Sequence
  Description of Artificial Sequence: Synthetic coding sequence
atgcggaccgccgacggcggcgagcccgccggcgccagcagccccgcggggcgagtggacggcggactgcagatgggctctgagcgaatggagatgcggaagcggcagatgcccgctgctcaggatacccctggcgccgcccccggccagccgggagctggctcaagagggagcaacgcatgctgtttctgttggtgctgctgctgtagctgcagctgccttacagttcgtaaccaagaggaccaacggcctactattgcttctcacgagctgagagctgacctgcccacctgggaagaatcaccggcccccacgctcgaggaagttaatgcttgggcgcagagcttcgataaactgatggtgactcccgcagggcgaaatgcgttccgtgagttcttgcgcaccgagttttccgaagagaatatgctattctggatggcctgcgaggaactcaaaaaagaagctaataagaatattatcgaagaaaaagctagaattatctacgaagattacatctctatattgtcccccaaggaagtgagcctcgactccagggtcagagaggtaataaatcggaatatggttgagccctcccaacacatcttcgacgatgcccagctacagatatacactctgatgcacagggacagttatcctcgcttcatgaactcagccgtgtacaaggatcttctgcagtctctttctgagaagagcatcgaagcttag

SEQ ID NO: 45472 - DNA, 1167 bp, Artificial Sequence
  Description of Artificial Sequence: Synthetic coding sequence
atgccccagctgagccaggacaaccaggagtgcctgcagaagcacttctctagacccagtatctggacgcagtttctgccactgtttagggcacagcgatacaatacagacattcatcagattacggagaatgaaggcgaccttcgggctgtcccagacatcaaaagtttcccccctgcgcaactgcccgattcaccagctgcccctaaattattcggacttctgtctagccccctgtctagcctggctaggttcttttcccacctcctgcggcgtcccccccctgaggcgccccgacggcgcttggacttcagtcccctgttgcccgccctgccagcagcaagattgtccaggggccacgaggaactccctggccgcctctcactattactgggggctgccctggctttgcccgggcggcctagtggaggacggccactgaggcctcctcatcccgtggccaagccacgggaagaggacgctacagccggccagagcagtccaatgccgcagatgggaagtgagcggatggagatgcggaagagacagatgccggccgcccaggatactcctggagccgctccaggacagccaggcgccgggtcaagagggtcgaatgcgtgctgcttttgctggtgctgctgctgcagttgtagctgcctgaccgtgcgcaatcaggaggatcagagaccaacaatcgcctctcatgaactgcgtgctgacctgccgacatgggaagagtctcccgcacctacactggaggaggtgaatgcctgggcccagtcgtttgataagctgatggtaactccggccggccgtaacgcctttagggaatttctgcggacggagtttagtgaagagaatatgctgttctggatggcgtgcgaagagcttaaaaaggaagccaacaaaaatatcatcgaagagaaggcgaggatcatctacgaggattacatttctatattatctccaaaagaagtttccttggactcaagagtccgggaagtgatcaacaggaatatggtagagccttctcagcacatttttgacgatgcccagcttcagatttatacactcatgcaccgcgactcatatcctcggtttatgaatagtgccgtttataaagatctgctccagtctctctccgagaaatctatagaagcgtag

SEQ ID NO: 45473 - DNA, 3795 bp, Artificial Sequence
  Description of Artificial Sequence: Synthetic coding sequence
atgcccgagaagcggctgaccgccgagccccccaccatcaccgaggaggaatttgaggatagtctggctacagacgactttctcgtcgactatttcaatgaattcctgagtttgcctactttttccgaggcaattaggttcaacgccgactacggggtttttgaggtcgctaacgacgctccccagttcttggaaaaacagctgaagaagatcctgcagaaccaacagcctcgcaacccaatctatgacgtcgtgcgaaagggcaagaatgaggtcaaacctgtccaaatgaacgccccagacgaggacgagacgattaacgtgaactacaacattatgtgcctgtcacgcgaagaaggaatcaaatggatcaaaaaagaacgtctaccagcgtttctggagtctgattgctacttcgagtaccgtctcgcaaagcttgtttcccaggtgcgatggagtaagagcgggatgaacttcacagtagggtccaattttagtccttggattgtgaagaagcctccttctttgcccccaccagcgactgaggaggacaacctggtgattatgaagaagttttacgtgtccctgggagaagcctcatatacgcagaccaaagactggtttgcactcgctaaacagagccagcagaccgtatccaccttctccctgccgtgctgtgtcccctataacaaactgaaatcgcctgcaatatcttccgtgtctgaaaacttcatattcgacgacggggtgcatccacggaccaaaaaggatccctctaaaaccaataagttaatatcagagtttgaagaagaagagggcgaagaagaagaagtctctgtttcactccaggataccccctctcaggcactgttgcgagtgtacctggaaaagaagcaagacgtggacgagagcctgaccatgcactttagcacatgtgaggaattcctgagcagctacatctatttcattctccggggggcaattcagcagatcgtcggcaagccggtaggtgagacacccgactatatcaatttcaacaacataaccaaggtgtccttcgatgactgcttcgagtctattcacgggaaaaactttctgagcgagctcgtccaaaccacaaaggaacgctccgaggaaattgaacagacctctttgtctagcaaaaacgaatctgctgggcctgaaagtcgggccgattggtgtattagtcatagaacttatgacatcggtaacagaaaggaatttgagaggtttaaaaagttcattaaaggaaccttaggcgagcggtactggtggctctggatggatatagaacgcttgaaggtcttaaaagacccagggcggcaccagagacacctggagaagatgaaaaaatgttatctggtgtccaacggggactattacctctcggccgagattctctcaaagttcaagctcctggacggtagtcaatggaacgaagaacatcttcgcaatatccagagcgaggtcctaaagcctctactactttattgggctccacgcttctgcgtcactcactcggcgagcactaagtatgcgtcagccgaactgaagttctggcatctccgtcaagctaagccgcgcaaggacattgacccgtttccgcagatggccacccttctgcctctcagaccaaaaagctgtataccacagatacccgagatccagaaggaggagtttagcctgtcccagcctcccaaatccccgaacaaaagcccagaagttaagaccgcgactcagaaaccatggaagcgcgagctgctgtacccagggtctagcaaagacgacgtcatcgagaaagggtccaaatacatgtccgagtcaagtaaagtcatccacctcacctcatttaccgacatatccgagtgcctgaagcctcagctggaccggcggtatgcctatactgaggagcctcgtgtgaaaacagtctcagacgtcggcgcgctcggaggcagcgacatggagaacttactgcaatccctctacgtggagaacagggctgggttctttttcacaaagttttgcgagcactccgggaacaaactgtggaaaaactccgtgtacttttggtttgacctgcaggcctatcaccaactgttttatcaagagacgctccagcctttcaaagtatgtaagcaggcccagtaccttttcgccacgtatgtcgccccaagtgccactctggatattggcctgcaacaagaaaaaaaaaaagagatctatatgaagatacagcctccgtttgaggatctgtttgatacggccgaggaatatattcttctgctgcttttggaaccctggacgaaaatggtgaagtccgaccagatcgcctataaaaaggtggagttggtggaagaaactagacagcttgactccacgtatttccgcaaactgcaggcgctgcataaagagaccttcagcaaaaaagcggaggataccacatgtgaaattggaaccgggattctctccttgagcaatgtctcgaagcgtaccgagtactgggacaacgttccagctgaatataaacacttcaaattctcggacctgctaaacaacaagctggaattcgagcatttccgccaatttctggagacacattctagctctatggaccttatgtgttggaccgatatcgaacagtttcgacggataacatatcgagaccggaatcagagaaaggccaaaagcatctacattaagaacaagtacctaaacaagaaatacttcttcggacccaacagtcccgccagtctctaccagcaaaatcaggtcatgcacttgtccggcggttggggtaaaatcctgcatgagcaactggacgctccagtgctggtcgaaatacagaagcacgtccaaaataggctggaaaatgtttggctacctttattcttagcttcagagcagttcgccgccaggcagaagatcaaagtgcagatgaaagatatcgcggaagagttgctgctgcaaaaggccgagaagaagatcggcgtttggaagccagttgaaagtaagtggatctccagcagctgtaaaatcatcgctttccgtaaagcgcttctgaaccccgttacttcgcggcagtttcagagatttgttgccctgaagggcgatctgctcgaaaatggtctattattctggcaggaggtgcaaaaatacaaagacctctgccattcacattgtgatgaaagtgtgatacagaaaaaaattaccacaataataaattgcttcataaatagctctatcccccctgcacttcagatagatattccagttgaacaggctcaaaagatcatcgaacaccgaaaggagcttggcccctacgtgtttcgcgaagcccagatgactattttcggcgtgctcttcaagttctggccacagttctgcgagtttcgtaaaaaccttaccgacgagaacattatgagcgtgctggaaagacgccaggagtacaataaacagaagaaaaagctggccgtgctggaggatgagaagagtgggaaagacgggattaagcagtatgccaatacaagcgttcccgcaatcaaaacggctctgttgagtgatagtttccttgggctacaaccttacgggcggcaacctacctggtgttattctaagtatattgaggcactcgaacaggagagaatattgttaaagatccaggaggagttggaaaagaagctcttcgccggcttgcagcccttgaccaatttcaaggcgtccagcagcactatgagccttaaaaaaaatatgagcgcccattcttcccagaagtag

SEQ ID NO: 45474 - DNA, 3756 bp, Artificial Sequence
  Description of Artificial Sequence: Synthetic coding sequence
atgcccgagaagcggctgaccgccgagccccccaccatcaccgaggaggaatttgaggacagcctggcaaccgatgatttcctggtcgattacttcaatgagtttttgagcctgcctacgttttctgaggccattcggttcaacgctgattacggcgtttttgaggttgccaacgacgcaccacaattcctggagaaacaattaaagaaaatccttcaaaaccagcagccacgcaatcccatatacgacgtggtgcggaagggtaagaatgaggttaaaccagtccagatgaacgcccccgatgaggatgagacaatcaatgtgaactacaatattatgtgtcttagcagggaggagggtatcaagtggattaaaaaggagcgcctccccgctttcttggagagcgactgctattttgaatatcggctcgctaagctggtgtcccaagtgagatggtctaaatccggaatgaatttcaccgtcggctccaacttttcaccatggattgttaaaaaacccccatctttgccccctccagccacggaagaggataaccttgcctcttacacacagaccaaagactggttcgcacttgccaagcagtcacagcagacagtgagcacattctcactcccatgctgcgttccctataacaagctgaagtccccagccatctctagcgtttccgaaaatttcattttcgatgatggcgtgcatcctcggacaaaaaaggaccccagcaagaccaacaaactgatctcagagttcgaggaggaagagggggaagaggaagaggtgtctgtctccctgcaagatacccctagtcaggcactcctaagagtttacttggaaaagaagcaggacgttgacgaatcacttaccatgcacttctctacatgcgaggagttccttagcagctacatctactttattcttcgtggggcaattcagcagattgtgggcaaaccagtgggcgagacacctgactatattaactttaataacatcaccaaagtgtcttttgacgattgcttcgaatcaatccacgggaagaattttcttagcgagctcgtgcaaaccacaaaggaaaggagtgaggagatagaacagacctcactttcatctaagaatgagtctgccgggccagagagtagggctgactggtgcatctcgcatcgtacatatgacatcggaaataggaaggaatttgaacgcttcaagaagtttattaaaggcaccctgggggagcgttactggtggctgtggatggatatcgagcgactaaaagtgcttaaggatccagggcgacaccaacgacatctagaaaagatgaagaagtgttacctcgtgtctaacggggattactacctcagcgcagaaatcctctccaagtttaaactgctggatgggagccaatggaatgaggaacacctgcgaaacatccagtctgaagtgctcaaacccctcctattgtattgggctccaagattctgtgtaacacattcagcgagcaccaaatacgcatcggccgagctgaagttctggcatctgcgccaggccaaacctcgtaaggatattgacccttttccacaaatggccactctgctgccgctcaggccaaagagttgcattccacagataccagaaattcagaaagaggagtttagtctatcccagcccccaaaatcacctaacaaatcccccgaagtgaagactgccactcagaagccttggaagcgggagctgctatatccgggctcaagcaaggatgacgtgattgagaagggcagcaaatacatgagcgagagcagcaaggtgattcacctaacttcttttacagacattagcgaatgcctgaagcctcagctggatcgaaggtacgcttatactgaggaacctcgggtcaaaaccgtgtccgacgtgggcgccctcggcggtagcgacatggaaaatttgctccaatccctctacgttgagaatcgcgccggatttttcttcacaaagttttgcgagcacagcggcaataagctgtggaagaactcagtgtacttctggttcgacctccaggcttatcatcagctgttctatcaggaaactctacaaccattcaaagtatgtaagcaggctcaatacctgttcgcgacctatgttgcaccatcagccactcttgatattggcctgcagcaggaaaagaaaaaggagatctacatgaagatccagccacctttcgaagatctgttcgataccgccgaagagtacattctccttttgctgctggagccatggaccaaaatggtgaagtcagaccaaattgcatataagaaggtggagctcgtggaagaaacgaggcaactggactccacctatttccggaagctgcaggccctccataaggagacattttctaaaaaggcagaagacaccacctgcgaaatcggaaccgggatcctcagcctttcgaatgtttcaaagaggaccgaatattgggacaacgtgccagcggagtacaaacacttcaagttcagcgatttactgaacaataagctggaattcgagcactttaggcagttcctggagacgcactcttcgcgttggatcctgtgtgctggacagacactcagttcaagcggtgagacgtacagagacagaaaccagaggaaggcaaagagtatctacatcaaaaataagtacctcaataaaaagtatttttttggtcccaacagccccgcgagtctctaccagcaaaaccaggtcatgcatctctccggggggtggggaaagattctccacgaacaattagatgcacccgtcttggtggaaatccaaaagcacgtgcaaaaccgtctcgagaacgtatggttacccctctttctggcatccgagcaatttgccgctagacagaaaatcaaagtacagatgaaagacattgccgaagaactgctattacagaaagcggagaaaaaaattggggtgtggaaacccgtagaaagtaagtggataagtagtagctgtaaaataattgccttccggaaggcactgcttaatcctgtgacttctcgccaattccagcggtttgtcgcattaaagggggatctgctggagaacgggctcctgttttggcaggaggtgcaaaagtacaaggacctctgtcactcacactgtgatgaaagcgtcattcagaagaaaataacaaccattatcaactgttttatcaacagctccataccacccgcactgcagatcgacattcctgttgagcaggctcagaagattattgaacatagaaaggagcttggaccgtatgtctttagggaggcccaaatgacgatctttggcgtgctttttaagttctggccgcagttctgtgaatttaggaagaatctgacggacgagaatatcatgagcgtgttggagagacgccaggaatataataagcaaaagaagaaactcgctgtgctggaggatgagaaaagtggaaaggatgggataaagcagtatgcgaacacctccgttcccgccattaagactgccctactgagtgacagtttcctgggccttcaaccttatggcagacagcctacatggtgttactcaaagtatattgaggccctggaacaggagcgaatcctgctgaagattcaggaagagctggagaaaaagctcttcgccgggctgcaacctttgacaaatttcaaagcgagttcttccaccatgagtcttaaaaagaatatgtcagcccactctagtcaaaagtag

SEQ ID NO: 45475 - DNA, 597 bp, Artificial Sequence
  Description of Artificial Sequence: Synthetic coding sequence
atgtggaacaccctgacccggagcctgagcgaccaccccgtgggcaaggacccccaggccatgcggactgggcaacgtcagaacaaagggatgcgcactaggcttgggtgtctgagtcataaatcagatagttgctctgactttacagccatcctcccagataagcccaatagggcactgaagagactgtccacagaggaggcgacacgctgggctgattcatttgacgtcctcctgtcacataaatacggggtggcagcgtttagggccttcctgaagactgagtttagcgaagaaaatctcgaattttggttagcgtgtgaggagtttaagaaaacacgctctaccgcaaagctcgtgtcaaaagctcacagaatattcgaggagttcgtggacgtccaagcccctcgagaggttaatatcgacttccagactagggaggccactagaaagaacctgcaggagccctcactgacctgcttcgatcaggctcagggcaaggttcacagtctcatggagaaggattcctatcctcgttttctgcgcagcaaaatgtacctcgatctgctatctcagtcccagcgacgattaagctag

SEQ ID NO: 45476 - DNA, 543 bp, Artificial Sequence
  Description of Artificial Sequence: Synthetic coding sequence
atggccgccctgctgatgccccggcggaacaagggcatgcggaccagactgggctgcctgagccacaaatctgactcctgctcagatttcaccgcaatactaccagataaaccaaatcgcgcactaaaacggctctcaacagaagaagccacaagatgggctgattcgttcgacgtgcttctgtcccataaatacggagtcgcagctttccgggccttcttgaagaccgagtttagtgaggaaaacctggaattttggctggcgtgcgaagagttcaagaagaccagaagtactgctaagctagtgtcaaaagctcatagaatctttgaggagtttgtggacgtgcaggccccccgcgaagtgaatatagactttcagacaagggaggctacacgaaagaatctacaggaaccatccttaacatgctttgatcaggcccaagggaaggtgcacagcttaatggaaaaagactcttacccgagattcctgcggagtaagatgtatctggaccttctgtcgcaatctcagagacgcctttcgtag

SEQ ID NO: 45477 - DNA, 543 bp, Artificial Sequence
  Description of Artificial Sequence: Synthetic coding sequence
atggccgccctgctgatgccccggcggaacaagggcatgcggaccaggttgggatgcctaagccacaagagcgattcctgcagcgacttcacagctatcctcccagacaagcctaacagagcccttaagcgtctgtcgactgaagaggctacgcggtgggctgattcgtttgacgtactactctcccataagtacggagtagccgcctttagagcgttcttgaagacggagttcagcgaagagaacctcgaattctggctagcgtgtgaggagtttaaaaaaacaaggagcacggctaagctagtaagcaaggctcatcgcatttttgaagagtttgtggacgttcaggcaccacgagaggttaacatcgatttccagacccgggaggcaacccggaaaaacctacaggaaccttctctcacatgctttgaccaggcgcagggtaaagttcactcattgatggaaaaggattcataccctcgtttcctgagaagcaaaatgtacctagatctgctaagccagagccagcgccgcctgtcttag

SEQ ID NO: 45478 - DNA, 543 bp, Artificial Sequence
  Description of Artificial Sequence: Synthetic coding sequence
atggccgccctgctgatgccccggcggaacaagggcatgcggacccgactggggtgtctgtcccacaaatcagactcctgctcagacttcactgctatcttgcctgataagcctaaccgggccctgaagagactgtcgacagaagaggccacaaggtgggccgactcctttgacgtgctgctgtcacacaaatacggcgtggccgcattccgcgccttccttaaaactgagttcagcgaggagaacttggagttttggcttgcctgtgaggagttcaaaaaaacacgttccactgccaagctggtttccaaagcccacagaatatttgaagagtttgtggacgtgcaggctcctcgggaagttaacatcgactttcagacccgcgaagccacaagaaagaacctgcaggaaccttctctgacctgtttcgatcaggcccaagggaaagttcattcactgatggaaaaagactcatatcccaggtttctgcgatcgaagatgtacctggacttgctgtcccagagccagagacggctgagctag

SEQ ID NO: 45479 - DNA, 174 bp, Artificial Sequence
  Description of Artificial Sequence: Synthetic coding sequence
atggccgccctgctgatgccccggcggaacaagggcatgcggaccagattaggatgtctgtcccataagtctgattcttgttcagacttcacagctattctgccagacaagccaaaccgggcccttaagagactgtccactgaagaagccactagatgggccgactccttttag

SEQ ID NO: 45480 - DNA, 2274 bp, Artificial Sequence
  Description of Artificial Sequence: Synthetic coding sequence
atgaccagcggcagcgtgttcttctacatcctgatcttcggcaagtacttctcacatgggggagggcaagatgttaagtgttccttagggtacttcccttgtggcaacattacgaagtgcctgccgcagcttttgcactgcaacggagtcgacgactgtggaaatcaagccgatgaggacaactgcggggacaataacggttggtcactgcagttcgacaagtacttcgcatcgtactataagatgaccagtcagtacccgttcgaggctgagactccagaatgtttagtgggatccgtgcccgtacaatgcctctgtcaggggctggagctggactgtgacgagaccaatctcagggctgttcccagcgtatcctcaaacgtgacggcaatgagtctgcaatggaatctgatccggaagctcccaccagactgttttaaaaactatcatgatctacaaaaactatatttacagaataacaaaattaccagtatttctatatatgcatttcggggactgaattccctcaccaagctgtatttgagccataacagaattaccttcttgaagcccggagtatttgaagacctgcacagactggagtggcttatcattgaggataatcacctctccagaatctcacctccaactttctacgggctcaattcactgatcctgctggttctcatgaacaacgtactgaccagactgcccgataagcccttatgtcagcacatgccccgactacactggctggacttagaagggaatcatatccataacctccgcaacctgacgttcatatcctgctctaacctcaccgtgctggtgatgagaaaaaataagatcaaccacctgaatgaaaatacgttcgctcctttgcagaaactggacgagctggatctcggctccaacaaaattgaaaacctcccaccattgatctttaaggatttaaaggagttgtcccagctgaatctcagctacaacccgatacagaaaatccaggcgaaccagttcgattatctggtcaagcttaagagcctgagccttgagggcatagaaatttccaatatccagcagcggatgtttaggcccctaatgaacctcagccacatctatttcaagaaatttcagtactgtggatatgccccacacgtccgctcttgtaagcctaacactgacggcatttccagtctagagaatctgctcgcttcaattattcagcgggtgtttgtgtgggtggtgagtgccgtgacctgcttcggaaatatcttcgttatctgtatgagaccgtacatccggtcagagaacaaactgtatgccatgtctataatcagcctgtgctgcgccgactgcctaatgggaatctacctctttgtgattggggggtttgatttaaaattcagaggagaatacaataagcacgcccagctgtggatggagtccacccactgtcaacttgtggggtccttggcgatcctaagcaccgaagtgtctgtgctcctgctgaccttcctcacattggagaaatatatatgcattgtgtatccattcaggtgcgtgagaccgggaaagtgccgcaccatcacagtgctcattttaatttggattacaggttttatcgtggcctttatccccttgagcaacaaggagtttttcaaaaactactatgggactaacggcgtgtgcttccccctgcatagcgaggatacggaaagtatcggggcacagatttattctgtggccatctttctaggcataaacctcgccgccttcataatcatcgtgttcagctacggttccatgttttattctgtacatcagtcagctatcaccgccacggaaatcaggaaccaagttaaaaaagaaatgatattggcaaaaagatttttctttatcgtgtttacggacgctctctgttggattccgatcttcgtggtcaagttcctgagtttgctgcaagtggagataccgggcaccattacatcatgggtagtgattttcatcctgccaatcaatagcgcattgaacccaattctctatacactcacgactagaccctttaaagagatgatacatcgattttggtacaattatcgtcagcgaaaatccatggactctaaaggccagaagacctacgccccttcttttatttgggttgagatgtggcccctgcaggaaatgcctcccgaactgatgaaaccagacctgttcacgtatccatgcgaaatgtccctgatctcacagagcacccggcttaacagctacagctag

SEQ ID NO: 45481 - DNA, 570 bp, Artificial Sequence
  Description of Artificial Sequence: Synthetic coding sequence
atgaccagcggcagcgtgttcttctacatcctgatcttcggcaagtacttcagtcatgggggggggcaggacgtgaaatgctcactgggttatttcccttgcggcaacatcacaaagtgtctccctcagcttctgcattgtaacggcgtggacgactgtgggaaccaagccgacgaagacaactgtggtgataataatggctggtccttgcagttcgataaatactttgctagttattacaaaatgacctcccagtacccatttgaggccgaaacccccgagtgcctggtgggatccgttcccgtgcagtgcctctgtcaggggttggaactggattgtgatgagactaacctgcgtgcagtgcctagcgtgagcagcaacgttactgcaatgtctctccagtggaatcttattagaaagctgccccctgactgtttcaagaactaccatgacctgcagaaactgtacctgcaaaacaacaaaattaccagcatcagcatatatgcctttagagggttgaattctctaaccaaactgtctagggccgtgaaggacggatcagagaaatag

SEQ ID NO: 45482 - DNA, 1884 bp, Artificial Sequence
  Description of Artificial Sequence: Synthetic coding sequence
cggaccatggtgacctgcacccagaacatgaaggccgccctgaagtcacttctgtaccattccagaaacctcgggtacctgcagaacaacaagataacatcaatctcgatttatgcatttcgcgggctgaattccctaactaaactctacctgtcacacaaccggattacatttctgaagcccggcgtgtttgaggatcttcacagattagagtggctgattattgaggataatcatttgtctaggattagtccacctaccttctatggtcttaattctctgattttgctcgtcctcatgaacaacgtccttacgcgtttacctgacaaacccctctgtcagcatatgcctaggcttcactggctagatctggaaggcaaccacattcacaatttacggaacctcactttcatctcatgtagtaatctcaccgtgctagtgatgagaaaaaacaagataaatcatcttaacgaaaatacctttgcccctctccagaagctcgatgagctagatctaggttccaataagattgagaacctgcctcctctgatctttaaggacctgaaagaactttcacagctgaatctctcttacaatcctatccagaagatccaagctaatcaattcgactacttagtaaaactcaaaagcctctccctcgagggcatcgaaatatcaaacatacagcaacgcatgttccgcccattgatgaacctctcccacatctactttaaaaaattccagtactgcggatacgcgccgcacgttcgatcatgcaaacccaacacagatggaatctcatcgctcgaaaatttgctcgctagcatcatccagcgcgtattcgtgtgggtggtttccgctgtaacctgctttggtaatatttttgtgatctgcatgaggccctacattcgctcagagaacaagctatatgctatgtcaatcatttctctgtgctgcgcagattgtctcatgggaatttaccttttcgtgattggaggctttgatctgaagttccgaggtgaatacaataaacacgcgcagttgtggatggagtcaacacactgtcagctggtgggctcacttgccatattgagcacagaagtgtccgtactcctgcttacgttcctgaccctagaaaaatacatctgtatagtttaccctttccgctgcgttcgtcccggcaaatgccggaccatcaccgtccttatcctgatttggataacggggtttattgtagctttcataccgttaagcaataaagaattctttaagaactattatgggaccaacggggtatgttttccgcttcacagtgaagacacggaatccattggggcacaaatttattctgtagcaatctttctgggcattaacctggccgcttttataatcattgtgttctcgtatggctctatgttctattctgttcatcaatctgccattaccgccacagagattagaaaccaggtgaagaaggaaatgatactcgcaaaacgctttttcttcatagtgtttaccgacgccctgtgctggatccccatcttcgttgtgaaatttctttcactgctgcaagtcgaaatccccggcacaatcacatcatgggtagtaatcttcattctcccaatcaattccgctctaaatccgatcctgtacactttgacaactcgcccatttaaggagatgattcaccggttctggtacaactatagacagcgcaagtccatggatagtaaaggccagaaaacttatgccccctcttttatctgggtcgaaatgtggcctttgcaggaaatgccccccgagctcatgaaaccggacctatttacctatccttgcgagatgagcctcatcagtcagagcactaggcttaactcatacagttag

SEQ ID NO: 45483 - DNA, 1959 bp, Artificial Sequence
  Description of Artificial Sequence: Synthetic coding sequence
atgaccagccagtaccccttcgaggccgagacccccgagtgcctggtgggatctgtaccagttcagtgtctgtgccagggcctggagctcgactgcgacgagaccaacctgcgggctgtgcctagtgtgagctccaacgtgactgctatgagcctccaatggaatctgatacgcaagctgcccccagattgttttaagaactaccatgatttacagaaactgtacctgcagaataacaaaatcaccagcatttccatctatgcttttagaggactgaactcactgaccaagctgtacctgagccataataggatcacattccttaagccaggcgtgttcgaggacctgcatcggctggagtggctgatcatcgaagacaaccacttatcccgtataagtcctcccaccttctatggcttgaactctctcattttgctggtcctgatgaacaatgttcttacgagattgcctgataagcccctatgtcaacatatgcccaggctccactggctggttatgcgaaagaacaagataaaccacttaaatgaaaataccttcgcgcccctccagaagcttgatgagttggatctgggaagtaataagatcgaaaatctgccgcccctcatctttaaggacttaaaagaactctctcagctgaacctgagctacaacccaatccagaagatccaggctaatcagtttgactacttagtaaagctgaaatcactctcactggagggtatcgagattagcaacattcagcagcgcatgttcaggccactaatgaacttgagccacatatacttcaagaagttccagtattgtggatatgcaccacacgttaggtcttgcaagcccaataccgatgggatctcttccttggagaacctgctagcttcaatcattcagcgggtgttcgtctgggtggtatccgcggtgacttgtttcggcaatatttttgtgatctgcatgagaccttacatacgttctgagaataaattgtacgccatgtctattatttcattatgctgcgcagattgcctgatgggaatctacctgtttgtgatcggaggatttgacctgaaattccgcggagaatacaataagcacgctcagttgtggatggaaagcacccattgccagttggttggatcattggctatcctgtcgaccgaagtgtccgttctgctcttgacctttttgacattagaaaagtacatctgtattgtttacccatttcgctgcgtgaggcccggtaaatgtagaactattacagtcttgatactaatctggatcacaggatttattgtggcgtttatccccctcagcaacaaggaattttttaaaaattattacgggacaaatggcgtgtgcttcccgttgcatagcgaagacactgagtctatcggcgcgcaaatttactcggtggcaatatttctgggaattaatctggccgccttcatcataattgttttctcctatggatctatgttctacagcgtgcaccagagcgcaatcacagccactgaaattcgcaaccaagtcaaaaaggaaatgattctggctaagcgcttcttcttcatcgtgtttaccgacgccctgtgctggatccctattttcgtcgttaagttcttgagcctactccaagttgagatcccaggcacaatcacctcttgggtggtgatctttatattacctattaattctgctttaaatcctattctgtacactctgacaacccggcccttcaaggagatgattcaccgattctggtataattaccgtcagagaaaatccatggattcgaaaggacaaaagacctacgccccttcctttatctgggtggaaatgtggccattacaggagatgccccccgagctgatgaaaccagacttgtttacctatccttgcgagatgtccctcatttcacagagtacgcgcctgaacagctattcctag

SEQ ID NO: 45484 - DNA, 474 bp, Artificial Sequence
  Description of Artificial Sequence: Synthetic coding sequence
atgaccagcggcagcgtgttcttctacatcctgatcttcggcaagtactttagccacgggggcgggcaggacgtgaagtgttcacttggctactttccttgcgggaacatcacaaagtgcctgccacagctgcttcactgcaatggagtagacgattgcggtaaccaggcggatgaggacaactgcggagataataatggatggagcctgcaatttgacaaatacttcgctagctactacaaaatgacaagccagtatccattcgaggccgaaactcctgaatgcctggtgggcagcgtgcctgtgcagtgcttgtgccaagggctggagctggactgtgatgagactaatttgagagccgtcccctccgtttcttctaatgtcactgcaatgtctctgcaatggaatctgataaggaagctcccgcccgattgctttaagaattatcacgatctgcagaagcttacactgtag

SEQ ID NO: 45485 - DNA, 2265 bp, Artificial Sequence
  Description of Artificial Sequence: Synthetic coding sequence
atgatcgtgttcctggtgttcaagcacctgttcagcctgcggctgatcactatgtttttcttgctgcattttattgtgctgattaacgtgaaagacttcgccctcacccaggggagtatgatcactccaagctgccagaaggggtacttcccgtgcggcaacctgactaagtgcctgccccgtgcttttcactgcgatggtaaagatgattgtggtaacggagctgatgaggaaaattgcggtgacactagcggctgggctacgatctttggtacagtgcatgggaacgctaattctgtagccctcacgcaggaatgttttctgaagcagtacccacagtgctgtgattgtaaggagacggaactggagtgcgtcaacggtgatctgaaatcagtacccatgatatccaacaatgttacgttgctgagtctgaagaagaacaagatccacagcctgcctgacaaagtgtttatcaagtacaccaagttgaagaagatcttcttgcagcacaattgcatacgccatatcagcagaaaagcattcttcgggctgtgcaaccttcagatcctgtatctgaatcataactgtattacaacccttaggccgggaatctttaaggacttgcatcagctgacctggctgattctggatgacaatccaataacccggatctcacaacgcctcttcacaggcctgaactccctgtttttcctcagtatggtgaacaattatctggaagccttgcccaagcagatgtgcgctcaaatgcctcagctgaactgggtagatcttgagggcaacagaatcaaatatctcacaaatagcacttttctgagctgtgacagcctgaccgtcctatttttaccaagaaatcagattggatttgtccccgagaagacctttagcagcctgaaaaaccttggggagctggaccttagcagcaacaccatcacggaattgagcccgcatttattcaaggatttgaaactccttcagaaattgaatctgtctagcaatcctctcatgtacctacataagaaccagtttgaatcactcaagcaactccagagcctggaccttgagaggatagagatccccaatattaatacaaggatgttccagcccatgaagaatttgtcacacatctactttaagaactttcggtattgctcttatgcaccccatgtaaggatttgcatgccgctgaccgacggcatcagttcatttgaggatctgctggctaataatatacttcgaatcttcgtgtgggtcattgcctttattacatgctttggcaatctgtttgtcatcggaatgcgcagctttatcaaagcggagaacactactcatgccatgtcaataaagattctgtgctgtgcagattgccttatgggtgtgtacttgtttttcgtaggcattttcgatatcaaatacagggggcagtaccagaaatatgcactcttgtggatggaaagcgtacagtgcaggcttatgggatttttggctatgctcagtactgaggttagcgttcttttactgacatatttaacacttgagaaatttctcgtgattgtgttccctttctcaaatatccgccctgggaagcgccagacatcggtgatcttgatctgtatctggatggcagggttcctgatcgccgtgatccccttttggaacaaggactacttcggaaacttctacggtaagaacggagtttgttttcctttgtattatgatcagacagaagatatcggaagcaaggggtactctctggggattttccttggggtgaacctgctcgctttcctaataattgtgtttagttatatcactatgttttgttcaattcaaaaaacagccttgcaaactaccgaggttcgcaactgctttgggcgtgaggtggcagtggccaacaggttctttttcatagttttttccgacgccatttgctggattcctgtatttgtggtgaaaatcctgtctttattcagagtggaaattccagatacaatgacctcctggatagtcatttttttccttccagttaactctgcactcaatcccatactctacacccttaccacaaattttttcaaagataaacttaagcagctcctgcacaaacaccaaaggaagtcgatttttaaaatcaagaaaaagtctctctcaaccagtatagtgtggattgaggacagttcttcacttaaactcggcgtcttgaataaaattacattgggcgactcaattatgaagccagtgtcttag

SEQ ID NO: 45486 - DNA, 2193 bp, Artificial Sequence
  Description of Artificial Sequence: Synthetic coding sequence
atgatcgtgttcctggtgttcaagcacctgttcagcctgcggctgatcaccatgttttttctcttacacttcattgttctcataaacgtgaaagactttgctcttacccagggatccatgatcactcctagttgccaaaaggggtacttcccgtgcggtaatctgactaagtgtctgccaagggcatttcactgtgatggcaaagacgactgtggaaacggtgctgatgaggagaattgcggcgacactagtggttgggcgacgatttttgggactgtgcacggcaatgccaattcagtagccctcacccaggaatgtttcctcaagcaatacccccaatgctgcgactgtaaagagactgaattggagtgcgtcaatggagatcttaagtccgttccaatgatttccaacaacgtgaccttgctcagcctcaagaaaaataaaattcactctcttccagacaaggtatttataaagtatacaaaactgaaaaaaatctttctccaacataactgtattcgccacatatcacggaaagccttttttggcttatgcaatctccagatactctacctgaaccacaactgcataactactctgcgacccggaatttttaaggatctgcaccagctcacctggctgatacttgacgataatcccattacacgcatttcccaacggctttttaccggtcttaacagcctgttttttctgtctatggtgaataactacctcgaggcattgccgaagcagatgtgtgcccaaatgccacagctcaactgggtggatcttgaaggcaaccgaattaagtatctcacgaattcaacttttttatcttgcgactctcttacggtgctcgatctgtcatcaaacaccatcaccgagctttcgccgcacctgtttaaggacttgaagctgttacagaagctcaacctctcaagtaaccccctgatgtacttgcacaagaaccaattcgaatcacttaagcagctgcagagcctggacctggagcgaattgaaataccaaatatcaacacacggatgttccagccaatgaagaaccttagccacatttactttaaaaattttcggtattgcagttatgccccccatgtgcgcatttgcatgcctttaactgatggtatttcaagcttcgaagacctactggcaaacaatatacttaggattttcgtgtgggtgatagctttcattacttgctttggtaatctgtttgtgattggcatgcgatccttcatcaaggcagagaacacaacacacgctatgtctattaaaatcctctgttgtgccgattgcctgatgggagtttaccttttctttgtgggaatatttgatatcaaataccggggacagtaccagaagtatgcactgttgtggatggagtcggttcaatgccgactcatgggctttctcgctatgctttcaacggaagtgtccgtcctgctgttgacctacctgaccttggagaaattcttagtcattgtgttccctttctccaatattaggccggggaagaggcagacctctgttatcctgatctgtatatggatggccggatttctaattgctgttattcctttctggaacaaggactacttcgggaacttctacggtaagaatggcgtctgctttcctctctactatgatcagactgaagatatcggctccaaaggatacagcctgggcattttcctgggggtcaaccttctggcttttctcatcatagtgttctcatacataaccatgttctgttctatccaaaagaccgccctgcagaccaccgaggtgcgtaactgttttgggagagaagtcgccgtggccaacaggttcttctttattgtgttttctgacgcaatctgctggattcctgtgtttgtcgtgaaaatactgtccctatttagggtggaaattcctgataccatgacctcctggattgtgatttttttcttacctgtcaactccgcactcaacccaattctgtatacactgacaacaaatttttttaaagataagcttaagcagctccttcacaaacatcaaaggaagtccatttttaaaatcaagaaaaaatcattgtccaccagtatcgtatggatagaggactcgagtagcctcaaactgggcgtcctaaacaagataactctgggggattcgatcatgaagcccgtgtcttag

SEQ ID NO: 45487 - DNA, 1410 bp, Artificial Sequence
  Description of Artificial Sequence: Synthetic coding sequence
atgcagatggccgacgccgccaccatcgccaccatgaacaaggccgccggtggagacaaattagccgagttattctccctggtgcctgatctactggaggctgccaacacgtcaggtaatgctagtctccaattaccggatctctggtgggagctaggcctggagctgcccgacggagcaccgcccgggcatccccccggctccggcggggccgagagcgcagatacagaggcgcgggtgaggatcctcatttccgtcgtatactgggtcgtatgcgccctgggactcgcgggcaacctgcttgtcctctacttgatgaagagcatgcagggctggcgcaagtcaagcataaatctattcgtgacgaacctggctctgaccgactttcagtttgttcttaccctgcccttctgggcagtagaaaacgccctcgacttcaagtggccattcggcaaggcaatgtgcaaaatcgtctccatggtgaccagcatgaatatgtacgccagtgttttctttctcacggccatgtcggttacacggtaccacagcgttgcctccgcactgaaatcccaccggactagaggccatggccgcggtgactgctgcggtagatccttgggcgatagctgctgcttctccgctaaagccttgtgcgtgtggatttgggccctggccgctctcgccagcctcccttccgccatctttagcacgacggtgaaagtcatgggagaggagctctgtctggttcgattcccagacaaattgttgggccgggacagacagttctggttgggcctgtaccattcccagaaagtgcttttgggattcgtactcccactggggatcatcattttatgctacctgctactggtgcgctttatcgctgatcgcagggcagccggcacaaagggaggtgccgctgtcgccggtgggcgcccaacaggtgctagcgcccgaaggttgtctaaagttactaagtctgtgacaatcgtagtgctgtccttcttcctctgttggctgcccaaccaggccctgaccacttggtcgatcctcatcaagtttaacgcggtcccttttagtcaggaatactttctctgtcaagtctacgccttccccgtcagtgtgtgtctagcacactctaactcctgtctcaatcccgtgctgtactgcctcgttcgccgggaatttcggaaggccctcaagagtttgttatggagaattgcttccccttcgatcaccagtatgcgaccctttacagctacaacaaaacccgagcacgaagatcagggactccaagcgcccgctcctccccatgcggccgccgagcccgacttgttatattaccccccaggggtcgtggtgtactcagggggacgatatgatctcctgcctagtagttctgcatactag

SEQ ID NO: 45488 - DNA, 1125 bp, Artificial Sequence
  Description of Artificial Sequence: Synthetic coding sequence
atgcccaccctgaacaccagcgccagcccccccaccttcttctgggccaacgccagtggcggctctgtgcttagtgctgatgatgctcccatgcctgttaagtttcttgccctgagactcatggtagctctagcgtacggcctggtcggtgctataggattgctcgggaatttggccgtgctgtgggtgctgtccaattgcgcaagaagggcccctggccccccctctgacactttcgtgtttaacctggccttggctgatcttggtctcgccctgacattacctttttgggctgccgaatctgctcttgactttcattggccgtttggaggcgcattatgtaaaatggtgctaactgcgaccgtgcttaatgtatacgcctccatttttctcatcactgccctgtctgtggctcgttactgggtcgtggccatggccgcaggaccgggcacacatctgtccctcttctgggcccgtattgccaccctcgccgtgtgggccgctgctgctcttgtgactgtgccaactgctgtctttggagtcgagggcgaagtatgtggcgtacgcctgtgtctgctaagatttccctcccgctattggctcggcgcgtatcagcttcaacgcgtcgtgttggccttcatggtgcccttgggcgttattaccacctcctatctcctgctgcttgcgtttctacaacggcgtcagcgacggagacaagactcccgcgttgtggcgcggagtgtgagaatcctcgtcgcttcattttttttatgctggttccccaaccatgtcgtcaccctgtggggcgtgctggtcaaattcgacctcgtgccatggaactccactttttacacgatacaaacttacgtcttcccggtcacaacgtgcctggcgcattctaactcttgcctgaacccagtgctgtactgtctcttgagaagagaaccacgacaagccctagccggcacctttcgcgatcttcgtttgcgattatggccccaaggtggtggttgggtgcaacaagtggctctgaaacaagtcggccgacgctgggttgcttcaaatcctagagaaagtagaccgagcactctgctcacaaaccttgatcgagggacccccggatag

SEQ ID NO: 45489 - DNA, 816 bp, Artificial Sequence
  Description of Artificial Sequence: Synthetic coding sequence
atggccccccgggccctgcccggcagcgccgtgctggccgccgccgtgttcgtgggtggagccgtctctagccctctggtggcccccgacaacggaagcagtcggacattgcactcaagaactgaaactactccctccccttctaatgacaccggtaatggacatccggagtatatcgcttacgcgttagtccccgtattctttatcatgggacttttcggcgttctgatctgccatttactcaaaaaaaagggttaccgctgcactactgaggccgagcaggacattgaggaggaaaaagttgaaaaaattgagctcaacgatagcgttaacgaaaactccgacaccgttggacagatcgttcattacatcatgaagaatgaggctaacgctgacgtgcttaaagcaatggtggctgacaatagcctgtacgatccagaatcacccgtcactccatccacccccggttctcctcctgtctcaccaggccctctctcccccggaggcaccccaggaaagcacgtttgtgggcatcacttgcacaccgtgggcggcgttgtcgagagggacgtgtgtcacaggtgccggcataaacggtggcacttcataaagcctaccaataagagcagggagtcccgaccccggagacagggtgaggtcacggttctttcagtgggcaggtttagagtcaccaaggtcgagcacaaatccaatcagaaagagcgtaggtctttgatgagtgtgagtggtgccgagactgtgaatggtgaagtgcctgcaacccccgtgaagagggagcgaagtggcactgaatag

SEQ ID NO: 45490 - DNA, 816 bp, Artificial Sequence
  Description of Artificial Sequence: Synthetic coding sequence
atggccccccgggccctgcccggcagcgccgtgctggccgccgccgtcttcgtgggcggcgccgtgtccagcccgctggtggctccagacaatggatcatccagaacactacactcacggacagaaactactcccagtccctcgaacgacacaggtaacggtcatccggaatacatcgcatatgcccttgtcccggttttctttattatgggtctgttcggcgtgctgatatgccacttgctgaagaagaaggggtacaggtgtaccaccgaagctgaacaagacatcgaagaggaaaaagtcgagaaaatcgaactcaacgactcggttaacgaaaattctgataccgtggggcagatagtgcactacatcatgaaaaatgaagcgaatgctgacgtgttgaaagccatggtggccgataacagtctgtacgaccccgaatcacccgtgacaccgtccacacccggctcaccacccgtgtctccgggcccgctctcacccggagggacaccaggaaagcacgtgtgcgggcaccatttgcacactgttggcggtgtggtggagcgggacgtgtgtcaccgatgtagacataagcggtggcactttattaagcccacaaacaagtccagggaaagccgtccccgccggcagggcgaagttacagtgctgtccgtgggacggttcagagtcaccaaagtggagcacaaaagcaatcaaaaagagaggagatctttgatgtccgtctccggcgccgagactgtgaatggcgaggtccccgccacccccgtgaagcgtgagaggtcgggcacagagtag

SEQ ID NO: 45491 - DNA, 363 bp, Artificial Sequence
  Description of Artificial Sequence: Synthetic coding sequence
atgaacgccaccttcctgaaccacagcggcctggaggaggtggacggcgtgggcggcggagctggagccgcactcggtaataggacccatggactgggcacctggctgggctgttgtcccggaggcgctccacttgctgccagcgacggagtgcctgctggcctagctcctgacgagaggagcctgtgggtttccagagtggctcagattgctgtattatgcgttctgagtctgacagtcgtgttcggtgtgttcttcctcggctgcaacctgctcatcaagagtgaatccatgatcaattttttggtgcaagagcgacggccctccaaagatgtgggggcagctattttgggcttgtactag

SEQ ID NO: 45492 - DNA, 717 bp, Artificial Sequence
  Description of Artificial Sequence: Synthetic coding sequence
atgggcgtggagaacagcgccaaggagggcgaccccggcaccatcttctttttccgagagggagccgctgttttttggaatgtgaaggataaaacgatgaaacacgtaatgaaagtgctagaaaagcacgagatccaaccgtatgaaatcgccctcgtccattgggaaaacgaggagctcaactatatcaagatagaggggcagtcgaaattgcacagaggggaaatcaagctgaacagtgaactggacttagatgatgccattctggagaagttcgcatttagcaacgctttgtgtttatctgtgaagttggccatctgggaggctagtttggataagttcattgaaagcattcagagtattccagaagccttgaaggccggcaagaaagtgaaactgtcccacgaggaggttatgcagaagattggggaactttttgcgctgcgccaccgcattaacctctcctccgacttcctgataacacctgatttttattgggaccgggaaaaccttgaggggttgtatgataagacatgtcagttcctctctattggtagaagagtgaaggtgatgaatgagaaactgcaacattgtatggaattaactgatctgatgagaaatcatctgaacgaaaagagagcgctaagactggagtggatgattgtgatccttattaccatagaagttatgttcgaacttggaagagtgttcttctag

SEQ ID NO: 45493 - DNA, 423 bp, Artificial Sequence
  Description of Artificial Sequence: Synthetic coding sequence
atgcccttctgcaagaccggcaacctgggcagcatcctggacaagttcatcgagtctatacagtccatcccggaagccctgaaggccggaaagaaagtgaaactctctcacgaagaggtaatgcaaaagattggggaactgttcgccttacgccacagaataaacctctcatcagattttcttatcacccccgacttctattgggaccgggagaatttggagggactctatgacaaaacttgtcagtttcttagtatcggccgcagggtgaaagttatgaacgaaaagcttcaacattgtatggaactgacagaccttatgcgaaatcacctcaatgaaaaacgagccctgcgcctcgagtggatgattgtaatccttataactatagaagtgatgttcgagcttggcagggtctttttctag

SEQ ID NO: 45494 - DNA, 1350 bp, Artificial Sequence
  Description of Artificial Sequence: Synthetic coding sequence
atgcccgccaccctgctgcgggccgtggcccggagccaccacatcctgagcaaagcccaccagtgccgccggattggccatcttatgcttaagccacttaaggaattcgagaatactacatgcagcacattgaccattagacaatccctggatctcttcctgcctgacaagacggccagtgggctgaacaaaagtcaaatccttgagatgaatcagaaaaaaagcgatacgtccatgctgtcacccctgaacgccgctaggtgccaggatgaaaaagcccacctgcccaccatgaagagctttggcacacatagaagggtgacccataagccgaatctgttgggatcaaagtggtttattaagattctcaaaaggcatttcagctctgtgagcacagagacgtttgtgccgaaacaggatttccctcaggtgaaacggcctttgaaagcctcaagaactaggcaaccctcccgcaccaatctgcccgttttgagcgttaacgaggacctcatgcactgcaccgcatttgctaccgccgacgaatatcacctgggaaatctgtcccaggatttagccagtcacggctatgtcgaagtgacctccctgccacgagacgcagccaatatccttgtcatgggggttgaaaattccgccaaagaaggagaccccggtactatattcttcttccgggagggtgctgcggtgttctggaacgtgaaagacaaaactatgaaacacgtgatgaaggtgttggagaagcatgaaattcagccatacgaaatagcactggtgcactgggaaaacgaagagctgaactatatcaagatcgagggccagtcaaagttgcataggggcgaaataaaactcaattccgagttggacctggatgacgctattctagaaaagtttgcattctccaatgctctgtgcttgtccgttaaactggcaatttgggaggccagtcttgacaagttcattgagtctattcagtccatcccagaggcactgaaagctggtaagaaagtaaagctctcacatgaggaggttatgcaaaagatcggcgagctctttgccttaagacatcggattaacctgtccagcgactttctgataaccccagatttctactgggaccgtgaaaatctcgaaggtttgtatgacaaaacttgccaattccttagcattggaagacgggtgaaggtaatgaacgaaaagttgcaacattgcatggaacttactgacctaatgagaaatcacttaaacgagaagagggccctccgactcgaatggatgattgtcatcctgatcacaatcgaggtgatgtttgaattaggacgcgttttcttctag

SEQ ID NO: 45495 - DNA, 636 bp, Artificial Sequence
  Description of Artificial Sequence: Synthetic coding sequence
atgcactgcaccgccttcgccaccgccgacgagtaccacctgggcaacttatcacaggacttggcctcacacggctacgttgaggttaccagcctcccccgggatgcagccaacattttagttatgggagttgagaactcagctaaagagggggatcccggcacaatatttttcttcagagagggggctgccgtgttctggaacgtaaaagataaaaccatgaaacatgtcatgaaagttctggagaagcacgagattcagccctatgagattgcactggtgcactgggaaaacgaggaacttaattatatcaagatagagggccagtctaaactgcaccgaggcgagattaaattgaactccgaactggacctggacgatgccattctagaaaagtttgctttttcgaacgcattgtgcttaagcgttaagctggctatctgggaggcatctctcgacaagtttattgagtctatccaatcaatacccgaggccctaaaggccggaaaaaaggtgaaacttagccacgaggaggtcatgcagaaaataggagaattgtttgcactgagacatcggattaatctgtcctcggacttcctcattactcctgatttttactgggaccgagagaactag

SEQ ID NO: 45496 - DNA, 591 bp, Artificial Sequence
  Description of Artificial Sequence: Synthetic coding sequence
atgagcgagggcgacagcgtgggcgagagcgtgcacggcaagcccagcgttgtttatcgattttttacgcggctggggcagatctatcaatcatggctagataagtctacaccttacacggctgtgcggtgggtggtgaccctaggactgagctttgtttacatgattagagtgtacctactgcaggggtggtacatagtgacttacgctcttggcatataccacttaaacctattcatcgccttcctctcccccaaggtggatccttccctgatggaagatagtgatgacgggccgtccctacctacaaagcagaacgaagagtttcggcccttcattcggcgcctgccagaattcaagttctggcatgccgctaccaaaggtatccttgtggcaatggtctgcacattctttgatgcttttaacgtacccgtcttctggccaatacttgtgatgtatttcattatgctgttctgtatcactatgaagagacagattaagcacatgatcaaataccgctacatcccattcacccacgggaaaaggcgctacagaggcaaggaagacgccgggaaggctttcgccagctag

SEQ ID NO: 45497 - DNA, 564 bp, Artificial Sequence
  Description of Artificial Sequence: Synthetic coding sequence
atgagcgagggcgacagcgtgggcgagagcgtgcacggcaagccctcagtcgtctaccgctttttcaccagactcgggcaaatttaccagagctggctcgataagtcaacgccttatacagcagttcggtgggttgtgactctggggctgtcatttgtgtatatgattcgagtatacttattacaaggttggtacattgttacatacgcgcttgggatctatcatctgaacctgttcatcgcgttcctgtcgcctaaagtggacccttctctgatggaggactcagatgacggtccgtctctgcctacgaagcagaatgaagagtttagaccgttcataaggaggctgcctgagttcaagttctgggacgctagcgtctgcggggacggccggtgctcctgcaaggccggagggggaaggcaagtgcctggggctggctgccgatgcggcgccaatttgctttccccacttgaaggtatgcgcctgccgcgggctagtctgtggctgtggtctgtgttgtcctctacattgagcacaagtaggtgctctggacgcttctggtag

SEQ ID NO: 45498 - DNA, 354 bp, Artificial Sequence
  Description of Artificial Sequence: Synthetic coding sequence
atgagcgagggcgacagcgtgggcgagagcgtgcacggcaagccctcagtggtctatcggtttttcacccggctcggtcagatataccaatcatggctggataagagcactccatatacagccgtgcgctgggtggttactctgggcctgagctttgtctatatgatccgagtttatcttctgcagatgaccgtgctgagatatccacccaaccgcacacgaaattccgccccctccttcgagggatctcagagtttgaactttggtatgcgcctcccacgcgctagcctgtggctgtggagcgtactgtcgtcaactctgagtacttccagatgttcggggcgtttctggtag

SEQ ID NO: 45499 - DNA, 354 bp, Artificial Sequence
  Description of Artificial Sequence: Synthetic coding sequence
atgagcgagggcgacagcgtgggcgagagcgtgcacggcaagccctctgtggtataccgattcttcaccaggctcggccaaatctaccagtcttggctcgataagtctacaccctatacagcagtacgctgggtggttactctcggcctaagctttgtatacatgatcagggtctaccttctgcagatgactgtcctgaggtatccccccaacaggactcgcaacagcgcccccagttttgaggggagtcaaagcctgaactttggaatgcgcctgccacgcgcaagcctgtggctatggtccgtcctctccagtacactcagtacttcacgctgtagtgggaggttctggtag

SEQ ID NO: 45500 - DNA, 645 bp, Artificial Sequence
  Description of Artificial Sequence: Synthetic coding sequence
atgagcgagggcgacagcgtgggcgagagcgtgcacggcaagcccagtgtggtgtaccgatttttcacacggctgggacaaatctaccagagttggctagacaagagtaccccatacacagcagtaaggtgggtggtgaccctcggcttgtcgttcgtgtatatgatacgggtgtaccttcttcagggttggtacattgttacctatgctcttggaatatatcacctgaatttgtttattgctttcctctccccgaaagtggacccaagtctgatggaggattctgatgatgggccctctctgcctacaaaacaaaacgaagaattccggcccttcatacgcaggcttccagaatttaaattctggcacgccgccactaaaggaattctggttgctatggtgtgtactttctttgacgcgtttaacgtgccggttttttggcctatcctggtgatgtatttcataatgttgttctgtattaccatgaaaaggcagatcaagcacatgatcaaataccgttatatcccattcacccacgggaagcgtcgttacaggggaaaggaagatgccggaaaaccctcaccggctaggtccggcacagaggccgcatctagagtggccaggaccgtactctctcactgctag

SEQ ID NO: 45501 - DNA, 477 bp, Artificial Sequence
  Description of Artificial Sequence: Synthetic coding sequence
atgagcgagggcgacagcgtgggcgagagcgtgcacggcaagccctctgtggtataccgtttttttactaggctgggacagatctatcaaagttggctggacaaatccacaccttacacagccgtgcgatgggtggtaacactcggtttatcctttgtgtacatgatccgggtctaccttctgcagggttggtatatcgtgacatacgccttggggatctaccacctaaatttattcatcgccttcctgtcacccaaggtggacccgagtttaatggaggactccgacgacggccctagtctacctaccaagcagaacgaagagttccggccctttatacggaggctcccagagttcaagttttggcatgcggccaccaagggtatcttggttgcaatggtctgtacgttcttcgacgccttcaatgtgcctgtgttttggccaatcctggtgatgtacttcatcatgctcttttag

SEQ ID NO: 45502 - DNA, 1110 bp, Artificial Sequence
  Description of Artificial Sequence: Synthetic coding sequence
atggcctacagcaccgtgcagcgggtggccctggccagcggcctggtattagctctttccttactactgccgaaggccttcctgtctagagggaaacgccaagagcccccccctacgccagaggggaaactcggaaggtttccgcctatgatgcatcaccaccaggctcctagcgatggccagacccccggtgctagattccagaggtcccatcttgccgaagccttcgccaaagccaagggctccggaggaggagcaggtggtggcgggtccggaaggggattgatgggtcagatcatccccatctacggcttcgggattttcctgtatattttgtacatcctttttaaactgtccaagggtaaaaccactgcggaagacgggaaatgctatactgctatgcctggcaacacacatagaaagatcacatccttcgagttagcccagctccaggagaagttaaaggagacggaagccgctatggaaaaattgataaatcgggttggccctaatggtgaatcccgggcccagactgtgactagtgatcaggaaaagcggcttcttcatcagctgcgggaaattaccagggtcatgaaagagggcaagtttattgataggttttcccccgaaaaggaggctgaggaagccccttacatggaggactgggaagggtatcctgaggagacctatccaatctacgacctaagtgactgcataaaacgccgccaggagaccatcctggtcgactatcctgatcccaaagaactgtccgccgaagagattgctgagcgcatgggcatgatagaggaggaggagtccgatcacttgggctgggagagtttaccaactgaccccagggcccaggaagataactctgtaacatcttgcgaccccaagccagagacttgttcttgttgtttccacgaagatgaagaccccgctgtgttagcagaaaacgcaggattctccgcagactcctacccagagcaagaggagaccaccaaagaagaatggtctcaggactttaaagacgagggtctgggcattagcaccgataaggcctacaccgggagtatgctaaggaaacgcaacccacaaggattggaatag

SEQ ID NO: 45503 - DNA, 564 bp, Artificial Sequence
  Description of Artificial Sequence: Synthetic coding sequence
atggcctacagcaccgtgcagcgggtggccctggccagcggcctggtcttagcgctgagcctcctgcttccaaaagcatttctgtctcgaggcaaacggcaggaacctcctccgacccctgaagggtatccggaggaaacatatcccatttacgacctttctgactgcataaagagaagacaggagacgatccttgtagattatcccgaccccaaggagctgtctgctgaagagatagctgagcggatgggtatgattgaagaggaggaaagtgaccacctgggttgggagtcactgcccaccgaccctcgcgcccaggaagataactcagtgacatcctgcgaccccaagccagagacatgctcatgctgttttcatgaggatgaagaccccgcggtgttggcagaaaatgccggattttcagccgattcataccctgagcaggaagagaccaccaaagaggagtggagtcaggactttaaggatgaaggcctgggcataagtaccgacaaggcttataccggttctatgttgaggaaacgaaacccgcagggtttggaatag

SEQ ID NO: 45504 - DNA, 1107 bp, Artificial Sequence
  Description of Artificial Sequence: Synthetic coding sequence
atggcctacagcaccgtgcagcgggtggccctggccagcggcctggtgctggcactcagcttgttgctgcctaaggcattcttgtcgcggggcaaacgtcaggaacccccgcccaccccagaggggaagttagggagattcccccctatgatgcatcatcatcaggctccctcagatggtcagacacccggtgctcgttttcagcgctcacatttagccgaagctttcgctaaggccaaaggcagcggcggtggcgcggggggcggcgggagcgggcgggggctcatgggccagatcatccccatctacggattcgggatctttttgtatatcctctacatactgttcaagctgtctaaaggaaagactacagcagaggatggcaaatgctataccgccatgcctggcaatacccatcgtaagattacatcttttgaactcgcccagctgcaggagaagcttaaggagaccgaggcagcaatggaaaaactgatcaatagagtggggccaaacggagaacgcgctcagaccgtcaccagtgatcaggagaagcgcctgctgcaccagctgagggagattactagagttatgaaggaggggaagtttattgatagattcagtccagaaaaggaggcggaagaagcaccttacatggaggattgggagggatatccagaagagacctatcctatttatgacctgtcagattgtataaaaagacgccaggaaaccatcctggtcgattacccagaccctaaggagctcagcgcagaggagatcgccgagcgtatgggaatgatcgaagaggaggagtcggaccatctgggctgggagtccctgcccaccgatcccagagctcaggaggataatagcgtgacaagttgtgatcccaagccagaaacatgttcttgctgctttcacgaggacgaggatcccgctgtgctcgccgagaacgctggattttctgcagattcgtatcctgagcaggaagagacaactaaggaggagtggtcccaggatttcaaagatgaagggctcggaattagtactgataaagcttacactggtagtatgctgaggaaaaggaatccccaaggattggagtag

SEQ ID NO: 45505 - DNA, 624 bp, Artificial Sequence
  Description of Artificial Sequence: Synthetic coding sequence
atgtgccggctgaagcggcaggagttcgtgatcagccgggcccagacagtgacatctgaccaagagaagcgactcttacaccagcttagggaaataactcgcgttatgaaagaaggcaaattcattgatcggttttctcctgagaaggaggcagaggaagctccatacatggaggattgggaggggtatcctgaagagacctatccaatttatgatctgtcagactgcataaagcgcagacaggagacaatcctcgtggactacccagatcccaaggagctctcagccgaggaaatagctgagcggatgggcatgattgaagaagaggagtctgaccacctgggatgggaatccctcccaacagacccacgagcccaagaggataacagcgtgacctcctgcgaccctaagcctgagacgtgtagctgttgtttccatgaagacgaggatcctgcagtgcttgcagaaaatgcaggcttttcagccgattcatacccggaacaggaagaaaccacgaaagaggagtggtcacaggactttaaggatgaaggcctggggatctccacagacaaagcgtatactggatccatgctgagaaagagaaacccccagggcttggagtag

SEQ ID NO: 45506 - DNA, 387 bp, Artificial Sequence
  Description of Artificial Sequence: Synthetic coding sequence
atggcctacagcaccgtgcagcgggtggccctggccagcggcctggtcctcgccctttcgctcttattacccaaggcatttctctcaaggggcaagcgacaggaacccccgccaactcccgaggggaaactgggcagattccctcccatgatgcatcaccatcaagccccaagcgatggacagactcctggagcacgattccagcgcagccacctggcagaggcttttgctaaggccaaaggttccgggggaggtgccggaggtgggggttctggaagggggttgatgggacagatcatacctatatacggtttcggcatcttcctgtatattttgtatatcctatttaaggttagtcgcattatcctgatcattctccatcagtag

SEQ ID NO: 45507 - DNA, 963 bp, Artificial Sequence
  Description of Artificial Sequence: Synthetic coding sequence
atgatgcaccaccaccaggcccccagcgacggccagacccccggcgcacggtttcagcgctcccatttggcagaagcttttgcaaaggccaaaggctccgggggcggagctgggggtggaggttctggaaggggattaatgggtcagataattccaatctacggtttcggcattttcctgtatatactttacattctgttcaaactgtccaaaggcaaaaccactgccgaggacgggaaatgttatacggcgatgccaggcaatacgcatcggaaaatcaccagctttgaactggcacagttacaggagaagctgaaggagacagaggcagccatggagaagctgatcaaccgcgttggccctaatggcgagagtagagctcagaccgtaacaagtgatcaggagaaacgattacttcaccagttacgggagattacccgagttatgaaagaaggcaagtttattgatcgctttagcccagaaaaggaagccgaggaggcaccctacatggaagattgggagggctatccagaggagacgtaccccatatacgacctatcagattgtatcaagaggcgtcaggagaccattctggtggattacccagaccctaaggagctttcagcggaggagatcgccgagcggatgggcatgattgaagaggaagagtcagatcacctgggatgggagtccctgccaactgacccccgggcccaggaggataatagcgtcacatcctgtgatccaaagccagagacatgtagctgctgttttcacgaggatgaggaccctgccgtccttgcagagaatgccggattctctgccgactcttaccccgaacaagaggaaaccaccaaagaagagtggagtcaagacttcaaggatgagggcctcggaatctcaactgacaaggcttacaccggctcgatgctgagaaagcgaaaccctcaagggcttgaatag

SEQ ID NO: 45508 - DNA, 990 bp, Artificial Sequence
  Description of Artificial Sequence: Synthetic coding sequence
atggcctacagcaccgtgcagcgggtggccctggccagcggcctggtgctggcattgtctttactgctgcccaaggctttcttgtcaaggggcaaaaggcaggagccgccccctaccccagaaggtaagcttggccgctttccaccaatgatgcatcatcaccaggcccctagtgacggacagacaccaggagctagattccagcgcagccatctcgccgaggcctttgccaaggcaaaagggtccggaggcggtgcagggggcgggggcagtgggcgaggcttaatgggacagatcatcccaatatatggctttggaattttcctctatattctgtatattctgttcaagctgagtaaagggaaaacaaccgcagaagacggtaagtgctatactgccatgcccggcaatactcataggaaaattacaagcttcgagctggcccagctacaagagaaactgaaggagacggaagccgcaatggaaaaattaatcaaccgcgtgggccctaacggcgagagtacacaaaccgatcattctgatgtgtatgtacactgccttggcgtctttactactaaatggcttgattgcctcattttcctctctcgggcccagaccgtgacttctgaccaggagaagcggctgctccaccagctacgcgagataactcgcgttatgaaagaaggtaagtttattgatagatttagccctgaaaaggaagcggaggaggcaccttatatggaagactgggaaggatatcccgaggagacttaccccatttacgacctctccgactgcatcaaacggagacaggaaaccatattggttgattatcccgaccctaaagaattgtccgcagaggagattgcagagcgcatgggaatgattgaagaggaggagagcgaccacctggggtgggaaagcctgcccacagaccctcgggctcaagaggacaactctgttacttcgtgcgacccgaagcccgtttag

SEQ ID NO: 45509 - DNA, 867 bp, Artificial Sequence
  Description of Artificial Sequence: Synthetic coding sequence
atggcctacagcaccgtgcagcgggtggccctggccagcggcctggttctggcactgtcattgctgttacccaaagccttcctgtctaggggcaaacgccaagagcccccccccacaccggagggaaagctcgggcgcttccccccaatgatgcatcatcaccaggccccctctgatggccagacccccggcgcgcggtttcagaggagtcacctcgccgaggccttcgctaaagctaaggggagtggaggtggcgccggcgggggcggcagcggccgcggcctgatgggtcaaattataccaatctacgggtttgggatctttttgtacattctgtacatcctgtttaagctctcaaaggggaaaactacggctgaggacgggaagtgttacactgccatgcctggaaatactcacaggaaaatctcctatccagaagagacgtacccgatttacgatttgtctgactgtataaagaggaggcaagaaaccatactagtggactatccagaccccaaggagctgtcagcagaagaaatcgctgaacgtatgggtatgatagaagaggaggaaagcgatcatcttggttgggaatccctgcctacagaccctcgcgcccaggaggacaatagcgtgacgtcgtgcgatcccaaacctgaaacctgctcctgttgttttcatgaggatgaagaccctgccgtcctcgccgagaatgcagggttcagtgctgattcctatccagagcaggaagaaaccacgaaggaggagtggtcacaagacttcaaggatgagggactgggtattagcacagacaaggcatacacaggcagcatgctgaggaagcgcaatccgcagggactggaatag

SEQ ID NO: 45510 - DNA, 1614 bp, Artificial Sequence
  Description of Artificial Sequence: Synthetic coding sequence
atggagccccgggccgtggccgaggccgtggagaccggcgaggaggatgttattatggaggctctgcgttcatataatcaggaacactctcagagttttacgttcgatgacgctcagcaggaggacaggaagaggctggcggagctgctggtgagcgtgttggagcaaggcctgccaccatctcaccgggtcatatggctacagagcgttcggatactgagtagggatcgcaactgcctcgacccatttacttcccggcagtcccttcaggcgcttgcgtgctacgccgatatttctgtgtccgaaggatcagtccccgaaagcgctgacatggatgtggtcttggaatcactcaagtgtctctgcaacctggtgctctcatccccggtggctcagatgcttgccgccgaggcccgcttagtggtgaagctgacagagcgtgtgggtctatatcgggaaaggagtttccctcacgacgtgcaattcttcgacctgcggctgttgttcttacttaccgcattgcgaacagacgtgagacagcagctttttcaggagctgaaaggagttaggctgcttacggatactctggagctgaccctgggggtgacacccgagggcaatccccctcctacgctcctccctagccaagaaaccgagagggctatggagatcctgaaggtgttgttcaacatcacattggacagtatcaagggtgaggttgatgaggaagacgcggctctgtaccggcacctgggcaccttgctccgacactgtgtgatgattgccacagctggggaccggacagaggagttccatggacatgccgtaaatctgcttggcaacctgccccttaagtgtttggatgttcttctcacccttgagccccacggcgattcaaccgagttcatgggagtaaatatggacgtaatcagagcactccttattttccttgagaagcgcctccacaagacccatcgcctgaaagagtctgtggcccctgtgctcagcgtgctgacagagtgtgcgcgcatgcacagaccggctcgtaaattcctgaaagcccagggctggccacctcctcaggtcctgccaccgctcagggacgttagaactcgtccggaagttggagagatgctgcgaaacaaactggtgcgcttgatgacgcacctggacactgacgtgaaacgagtggccgcggagtttctctttgtgctgtgcagcgagtcggtgcctcggttcatcaagtacacaggctatggaaacgctgccggcttgctggctgctagagggttgatggcaggagggagaccagagggacagtacagtgaggacgaggatactgatacagatgagtacaaagaggctaaggccagcataaatccagtaaccggccgcgtggaagaaaaacccccgaaccctatggaggggatgaccgaggagcagaaggagcatgaggccatgaaacttgttaccatgttcgataagctgtcacgtaaccgcgttattcaacccatgggtatgtcccctcggggtcaccttacttccctccaggacgccatgtgcgagacaatggagcagcagcttagctctgaccctgactctgaccctgattag

SEQ ID NO: 45511 - DNA, 1596 bp, Artificial Sequence
  Description of Artificial Sequence: Synthetic coding sequence
atggagccccgggccgtggccgaggccgtggagaccggcgaggaggacgtgattatggaagcactgcgatcatacaatcaggagcatagccagagtttcactttcgatgacgcacagcaggaggataggaagcggctggccgagcttctggtgtctgttttggagcagggtctgccacctagtcaccgcgtcatttggttgcagagtgtgcggatactgagtagggaccgcaactgtctggatcccttcaccagcaggcaaagccttcaggccttggcttgttacgccgacatatctgtcagcgagggttccgtccctgaaagcgctgacatggatgtagttctggagagtctgaagtgcctttgtaatttggttttatcttcccctgtggcccagatgctcgcggccgaggcacgcctcgtcgtgaaacttacagagagggtaggcctttaccgggagcgcagctttccacacgatgtgcagttttttgatctccgcctgttgttcttattaaccgctcttcggaccgacgtgaggcagcagctgtttcaggaattgaagggggtcagacttctgacagacacccttgaactcaccctcggtgtcacaccagaaggcaacccaccacccaccctcttgccctcccaggaaacagagcgggcaatggagattctgaaggtgttgtttaacatcaccttagatagcattaagggcgaagtggacgaagaggatgccgctctataccgacatctgggaaccttgttgcgacattgcgtgatgatcgctactgccggagaccgaaccgaagagttccacggacatgccgtgaatctgctggggaatctcccgttgaagtgtctagatgtccttctgacacttgagccacatggtgactccaccgagttcatgggcgtgaatatggatgtgatccgcgccctgcttatctttcttgaaaaaagattgcacaagacccaccgattgaaggagagcgtcgctccagtgctgtccgtactgaccgagtgtgccaggatgcaccggcccgctaggaaatttctgaaggcacaggtattacctcccctgcgagacgtgcggactaggcctgaagtcggcgaaatgctgcgcaataagttggtcaggctgatgacccacctcgacaccgacgtcaaacgcgtggcagccgagttcctgttcgtcttgtgttctgagagcgttcccaggttcatcaaatatacaggctacgggaatgcagctgggctcctggcggcccgcggccttatggccgggggtcggccagaaggccagtattcagaggacgaagataccgacaccgatgaatataaggaagcgaaggcttccatcaaccccgttactggccgagttgaggagaaaccgccaaacccaatggagggcatgaccgaggaacaaaaggaacacgaggccatgaagctggtgacgatgttcgacaagctgagcaggaatcgggtaatccaacctatggggatgagccctagagggcacctgacctctttgcaagacgccatgtgcgaaacaatggaacagcagctttcctcagaccctgacagtgatccagactag

SEQ ID NO: 45512 - DNA, 1491 bp, Artificial Sequence
  Description of Artificial Sequence: Synthetic coding sequence
atgctggccagcaagctgtgcgagggcatcttcaaggtgctgatcaaggacatccctactacgtgccaggtgtcatgccttgaggtgcttaggatcctgagtagggacaaaaaagtcctcgttccagtgacaacaaaagagaatatgcaaatcctcctgcggctcgctaaactaaatgaactcgacgatagtttggagaaggtaagcgaattccctgtcatcgttgagtctttaaaatgtctctgcaacatcgttttcaatagccagatggcccagcagttgtctcttgagttaaacctagctgcaaagctctgcaacctcctgcgaaaatgtaaagataggaaatttataaacgatatcaagtgctttgaccttcgcttactgttcctgctttcgctgttacacacagatataaggtctcaacttagatatgagctgcaaggtctccccttactgactcagatactggaatctgcatttagcatcaagtggacggacgaatatgagtctgctatagatcacaatggaccacctttgagcccacaagaaacggactgcgcgatcgaagctctcaaggcactttttaacgtcacagtggattcttggaaggtccataaggaatctgatagccatcagtttagagtgatggctgccgtgctgagacactgcttgctgattgtgggccctacagaagacaaaaccgaagagcttcactcaaatgccgtgaatctgctttctaacgtaccagtgagctgcttagacgtgctaatatgtcctttgacccatgaggaaacggctcaggaagcaaccacccttgacgagctgccttcaaacaagactgcggagaaagaaacagtgctcaaaaacaatacaatggtatacaacggtatgaatatggaagcaatccacgtgcttttgaacttcatggagaagagaatcgataaagggagctcctaccgcgaaggtctgacaccggtcctcagcttattgaccgagtgctctagagcacaccgtaatatacggaagtttctcaaggaccaggtcctccctcctctcagagacgttaccaacaggcccgaggttggaagcactgttagaaacaaactcgtccggcttatgacgcacgttgacctgggagtcaaacaaatcgccgccgagttcctcttcgtgttgtgtaaggagagagtggactccttgctgaaatataccggttacgggaacgctgctggactgttggctgcccgagggttgctcgctggaggcaggggggacaattggtactctgaggatgaagacactgacactgaggagtacaagaacgcgaaacctaacatcaatctgattaccggacatctcgaagagcctatgcccaacccaatcgacgagatgacagaggagcagaaggagtatgaggccatgaagttggtcaacatgctggataaactgtcccgcagggcagacgtgaaggacttacaccaggatgggggctag

SEQ ID NO: 45513 - DNA, 1683 bp, Artificial Sequence
  Description of Artificial Sequence: Synthetic coding sequence
atggacgaggagcgggccctgtacatcgtgcgggccggcgaggccggagcaatagaaagggtgctgcgcgactattctgacaagcatcgcgccaccttcaaatttgagagtaccgatgaagataaaaggaagaagctgtgtgaaggaatctttaaggtattgataaaagatattccaactacatgtcaggtaagctgtctcgaggtgctgcggatcctcagtcgcgacaaaaaggttctggtgccggtcacaacgaaggaaaacatgcagatacttttgcgtctcgccaaactgaatgaactagacgacagccttgaaaaagtgagtgaatttcccgtgatcgtggagtcactcaaatgtctttgtaacattgttttcaatagtcagatggcccagcagctgagcctggaactcaatcttgctgctaagttgtgtaacttactgagaaagtgtaaggaccggaagttcattaatgatataaaatgtttcgatctgcgcctgctttttctgttaagtcttctgcacactgacataaggagccagctgagatacgagctacagggcctgcctcttcttacgcagatccttgaaagcgccttcagcattaagtggactgatgaatacgaatcggcgattgatcataacgggccccccctgagtccgcaggagacggattgcgcgatcgaagctttaaaggcgctattcaacgtcactgtagattcatggaaagttcataaagaatctgattcccatcaatttcgcgtgatggccgcggtgcttcgccactgcctactaattgtgggaccaaccgaagataagaccgaagagctgcactctaacgccgtgaacctcctgtctaatgtcccagtgagttgtcttgacgttctcatctgcccgttaactcatgaggaaacggcacaagaggcaacgacacttgacgaactcccttcgaataagacggctgagaaagagactgtgctgaagaacaacaccatggtttacaatggtatgaatatggaagccatccatgtgctgctcaacttcatggagaagcgcattgacaagggttcatcgtatcgggagggtttaactcccgtgctatcgcttcttaccgagtgttcccgggcccatcggaatatacggaagttcttaaaggaccaagtactccctcccctgcgcgacgtgactaatcgccctgaggtggggtccactgtccgcaataagttggtgcggctgatgactcacgttgatctgggcgtgaaacagatcgctgccgagtttcttttcgtgctctgtaaagagagagttgatagcctgctgaagtacaccggctacggaaacgccgccgggctccttgccgccagaggtttactcgccggcggacggggagacaactggtattctgaggacgaagatactgacaccgaggagtacaaaaatgctaaacctaacataaatcttattaccgggcatctggaggagccaatgcccaatccaatagacgaaatgaccgaagagcagaaagagtacgaggctatgaagttggtgaacatgctggataagctgagtagagaggagctgctgaaacccatgggactcaaacccgacggcactattacgccattggaggaagctctgaatcagtattccgttatcgaggagactagcagtgatacagactag

SEQ ID NO: 45514 - DNA, 1563 bp, Artificial Sequence
  Description of Artificial Sequence: Synthetic coding sequence
atggacgaggagcgggccctgtacatcgtgcgggccggcgaggccggagctatcgaaagggtcctcagggattacagtgataagcacagggcaacgtttaaatttgaaagtactgatgaagataagcgtaaaaagctgtgcgaggggatttttaaggtgctgatcaaagacatccctaccacctgccaagtttcttgccttgaggttctgcgtatcttgtcccgcgataaaaaggttctggttcctgtgaccaccaaggagaatatgcagatcttgctccgactggccaaactcaatgagctggatgattctttggagaaggttagtgagttccccgtcatagttgaatcattaaagtgcctgtgtaacatcgtcttcaattctcagatggctcagcaactatctcttgagctgaacctggcggccaagctgtgcaacctgctaagaaagtgcaaagataggaagtttattaatgacattaaatgttttgacctgaggctgcttttccttttatccctgctacataccgacattcgctcacagctgcgatatgagctccagggcctcccacttctcacacagattcttgagagcgcatttagcatcaaatggactgacgaatacgagtccgctattgatcacaatgggccacccctctctcctcaagagactgattgcgcaattgaagccctcaaagccctcttcaacgtgactgtggacagttggaaagttcataaggaaagcgatagccaccagtttagggtcatggctgccgtgttgcgacactgtctactcatagtcggacccacagaggataagaccgaagagctgcattccaatgcagtgaacctgctaagtaatgtccccgtgtcctgcctggacgttttgatctgcccactaacccatgaagaaaccgcgcaggaggctactacactggacgagctaccttctaataagaccgctgaaaaggagactgtactgaagaacaacactatggtgtataacggaatgaatatggaagcaattcatgtgctgctgaattttatggagaaaaggattgacaaagggagcagctatagagaggggttaacgccagtgcttagcctgcttaccgagtgctctagagctcaccgaaacatccggaagtttctgaaggatcaggtcttgccccctcttcgggacgttactaaccgccctgaggttgggagcactgtgcgtaacaaactcgtcaggctgatgacccacgtggacctaggcgtgaaacaaattgccgcagagtttctattcgtattgtgcaaagagagggtggattcacttctaaaatatactggctacggtaatgccgctggactgctggctgctcgcggacttctcgctggtggacgcggggacaactggtatagtgaggacgaggatactgatacggaagagtacaagaacgccaaaccgaaggaagagctgcttaaacctatgggactgaagcccgacggaacgatcactccactcgaagaggccctgaaccagtactcggtgattgaagagacatccagcgacactgactag

SEQ ID NO: 45515 - DNA, 987 bp, Artificial Sequence
  Description of Artificial Sequence: Synthetic coding sequence
atgatgtggcggcccagcgtgctgctgctgctgctgctgctgcggcatggcgcccaagggaagccctcacctgatgccggaccccacggccaggggcgagttcatcaggcagcacccctgtcagatgctccccatgacgatgcacatggcaattttcagtatgaccacgaggccttcctggggagggaggtggccaaggagtttgaccagctgacgccggaggaaagccaggcaaggctgggacgaatcgtcgaccggatggaccgggctggtgacggggatggctgggtctctctggccgagctgcgagcgtggatcgcccatacccagcaaagacatatccgagactctgtgtccgccgcctgggatacatatgacaccgatcgagatggccgagttggttgggaagaactgcgcaacgcgacatacggccattacgctccaggcgaggagtttcatgatgtcgaagacgctgagacctataagaagatgctggcgagagatgagagaaggtttcgcgtcgccgatcaggacggggacagtatggcaacacgtgaggagctaacagcttttctgcatcctgaggagttcccacacatgagagatatcgtgatagccgaaaccctagaagacctggatcggaataaggacggatatgtccaggttgaggagtacatcgcagacctgtatagcgcagagccaggtgaggaggagccagcgtgggtacagaccgaacggcagcaattccgggatttccgggatcttaataaggatggacatttggacgggagtgaagtagggcattgggtgctgcctcctgctcaagatcagccacttgtcgaagccaatcacctgttgcatgagagcgacaccgacaaagacggcagattgtctaaagccgaaattcttggaaactggaatatgtttgtgggaagccaggccaccaactacggagaagacctcactcgtcaccacgacgagctgtag

SEQ ID NO: 45516 - DNA, 1326 bp, Artificial Sequence
  Description of Artificial Sequence: Synthetic coding sequence
atgctgcggaagggctgctgcgtggagctgctgctgctgctggtggctgcagaattaccactgggtgggggctgtccgagggattgcgtgtgctatccagcccccatgaccgtatcctgccaggcccataactttgccgccatccctgaaggcatacccgtggatagcgagcgtgtcttcctccagaacaatagaatcggactcttacagcccggccacttttctcctgctatggtgacactgtggatctactctaacaacatcacctatatacatccatcgacgttcgaaggattcgtgcaccttgaggagctcgaccttggcgacaatcggcagctccggaccctggcccccgagacgttccaaggacttgttaagctgcatgccctgtacttatacaagtgtgggctgagcgctcttcccgccggcgtgtttggaggcttacactccttgcagtacttgtatctccaggacaaccatattgaatatctccaggacgacattttcgttgatctggtaaaccttagccatcttttcctacatgggaataagctttggtccctgggaccagggacgttcagaggcttagtgaatctggaccgactgcttctgcacgagaaccagttacagtgggtgcatcacaaagcatttcatgacttacggcggctgacgacccttttcttgtttaataacagcctgtctgagctgcagggcgagtgcctggcgcccctgggagccctggagttcctaagattgaatggtaacccatgggactgcgggtgtcgggcccgcagcctttgggagtggctgcaaagattccgaggctcatcctctgccgtcccttgtgtctcaccgggactacgacacggccaggatctgaagctgctccgggcagaggacttcaggaattgcactggccccgcatctcctcaccagattaagagccatacattgactactaccgatcgagctgcaagaaaagagcatcacagtccacatgggccgacgcgatccaagggacatcctcacgggcctaggccgggtcataggaagccaggcaaaaactgtacgaaccccagaaatcgcaatcaaatatcaaaggcgggagccggaaagcaggcgcctgaactccctgactacgcacccgattaccagcataagttctctttcgatataatgcccacagcccggcctaaacgcaagggaaaatgcgcacgtagaacccctataagagcgccaagcggcgtacagcaagcatcctccgcctcaagcctgggggcatcattgctggcctggactcttggcctggccgtgaccttgaggtag

SEQ ID NO: 45517 - DNA, 1263 bp, Artificial Sequence
  Description of Artificial Sequence: Synthetic coding sequence
atgctgcccggcctgcggcggctgctgcaggcccccgccagcgcctgtctactgcttatgctactggcgctgcctctcgcagcgccatcctgcccaatgctctgtacttgttattcttcaccccctacagtcagctgtcaggcaaacaatttttcctcggtccccttaagccttccccctagcacacaacgccttttcttgcaaaataacctgattaggacgctcagaccaggtacattcggcagcaatttactaacactatggctgttctccaataacctgagcacaatctaccctggcaccttccgacacttacaggccttggaggagctggatctgggagataatagacacctacgctctcttgagcccgataccttccaaggccttgagcgcctgcaatcactccacctgtataggtgccagctctcctcgctgcctgggaatatctttcgtggcttggtcagcctgcaatacctatacctccaggagaattcgctgctgcacttgcaggacgaccttttcgcggacctcgctaacctgtcacatttatttctgcacggtaatcggctaaggctgctgacagagcatgtattccggggcttgggaagcctcgaccgcctgctattacatggcaaccgcctgcagggagtgcaccgggctgcttttcgaggtctgtctaggctcaccatcctttacttgttcaacaactctctggcctctctgccaggagaagccctagctgatctgccctcactggaattcctccgacttaatgccaacccatgggcttgtgactgccgtgcaagacctctgtgggcatggtttcagagagccagggtttcgagcagcgatgtgacatgtgcaactcccccagagaggcagggccgggaccttcgcgctttgagggaggcagatttccaggcctgtccacctgcagctccgacccgccccggatcgagggctcgaggtaattcaagttccaatcacttgtacggagtagcagaggccggagccccacccgctgacccaagcaccctgtatcgcgatctacctgcagaggatagcaggggaagacagggcggcgatgcgccgacggaagatgattattggggcgggtatggcggcgaagatcagcgtggagaacagatgtgcccgggggctgcctgccaggcccctcccgactcccggggccccgccctcagcgccggcctcccgtcacccctgctgtgtttattgctgctagttccccaccacctatag

SEQ ID NO: 45518 - DNA, 1014 bp, Artificial Sequence
  Description of Artificial Sequence: Synthetic coding sequence
atgctgcggaacaacctgggcaacagcagcgacagcaagaacgaggatggctccgttttttctcaaaccgaacacaacattgtcgcaacatatctaatcatggcgggtatgatttccatcataagtaatatcattgtgctagggattttcatcaagtacaaggaactgcgcacccctacgaacgcgattatcattaatctcgctgtgacagacatcggcgtttcctctataggctacccgatgtctgctgcctccgatctgtacgggtcttggaagttcggttacgcaggttgccaggtgtacgctggactgaatatatttttcggcatggctagcatcggactccttactgtagtggctgtggataggtacttgaccatctgtcttcccgatgttgggcggcgcatgacaaccaatacctatataggactgatcctgggggcgtggattaacggcctcttttgggcgctaatgcctattattggttgggcttcttacgcaccagatcctactggtgcgacgtgtactatcaactggcggaaaaatgacaggtcctttgtgagttacacaatgactgttatcgcgataaacttcatagtgccgcttaccgttatgttttattgctactaccacgtaactttaagcataaaacaccacaccacttctgattgtaccgaaagcttgaatagggactggtccgaccagatagacgtgacaaagatgtccgtaataatgatttgtatgttcctcgttgcctggagcccttactccattgtttgcctctgggcatccttcggagacccaaagaaaattcctccgcctatggccattatagctcctctctttgccaagagcagtactttttacaatccttgcatatacgttgtggccaacaagaaatttaggcgcgcaatgttggccatgtttaaatgtcagacacatcagaccatgcccgtaacgagcatcttgcctatggatgtatcccagaatccactagctagtgggcgtatttag

SEQ ID NO: 45519 - DNA, 792 bp, Artificial Sequence
  Description of Artificial Sequence: Synthetic coding sequence
atgcggcggatcagcctgaccagcagccccgtgcggctgctgctgtttctcttattattgctcattgcattagagatcatggtgggagggcattccttgtgctttaactttactataaaaagtcttagccgccccggtcagccctggtgtgaagcacaagtgtttttgaacaagaatctatttctgcaatacaactcagacaataatatggtgaagcccctgggcttactcggtaagaaagtatacgccactagcacatggggggaacttacgcagactctgggggaagtggggagagaccttagaatgttactgtgcgacatcaagccgcagataaaaacttccgacccgtccacactccaagttgagatgttttgtcaacgcgaggctgagcgatgtaccggagctagctggcagttcgcaaccaatggagagaaatccctgttattcgacgctatgaacatgacatggaccgtgatcaaccacgaggcctcaaagattaaagagacgtggaagaaggatagagggctagaaaagtactttagaaagctgtctaagggagactgtgatcactggttgagagaatttctgggccactgggaggccatgcccgaaccaacagtgagcccagtgaacgcaagtgatatccactggtcttccagcagcttgcctgatcgctggatcatcctgggcgctttcatactgctggtgctcatgggcattgtcttgatttgcgtgtggtggcagaacggcgaatggcaagctggcttgtggcccctgagaacttcttag

SEQ ID NO: 45520 - DNA, 684 bp, Artificial Sequence
  Description of Artificial Sequence: Synthetic coding sequence
atgcggcggatcagcctgaccagcagccccgtgcggctgctgctgttcctgctcctgctgttgattgctctggaaatcatgtacaactctgacaacaacatggtgaaacctcttggactgcttggaaagaaggtctacgcaacgtctacgtggggggaactcacgcagaccctcggcgaagtcggaagggatcttcgcatgttgctgtgcgatataaaacctcaaatcaagacttcggacccttcaaccctgcaggtggagatgttctgtcaacgagaggccgaaaggtgcactggggcctcctggcagtttgcaacaaacggggagaaatctctgctgttcgatgcaatgaatatgacatggacggtgatcaaccatgaagcctccaagatcaaagagacatggaagaaagataggggcctcgagaagtattttagaaaactgtctaagggagattgcgaccactggcttcgtgagttcttggggcactgggaagcaatgcctgaacccacggtgagtcctgtgaacgcgagtgatatacactggtcttctagtagcctacccgaccgatggatcatccttggcgcctttattctgttggttttgatgggtattgtgctgatatgcgtgtggtggcagaatggggagtggcaagctggcttatggcctctccgcacctcatag

SEQ ID NO: 45521 - DNA, 354 bp, Artificial Sequence
  Description of Artificial Sequence: Synthetic coding sequence
atgcggcggatcagcctgaccagcagccccgtgcggctgctgctgttcctgcttctgctgctgattgctctggagattatggtaggaggtcattcactgtgcttcaatttcacgattaagtcattgagccgccctggccagccgtggtgcgaggcccaggttttccttaacaaaaatcttttcctccagtacaactcagacaacaacatggttaaaccactcggcctgctcggcaagaaaatactgcccctgtgcaagtcacgctgcttcgtaaatgtaaaacagaacggtgcactggtgcaccccggctcctcccccccaatggagcgaaacccttcttccctgacccaatag

SEQ ID NO: 45522 - DNA, 630 bp, Artificial Sequence
  Description of Artificial Sequence: Synthetic coding sequence
atgcggcggatcagcctgaccagcagccccgtgcggctgctgctgttccttctgctactgctcatcgctctagaaatcatggtgggcggacacagcctctgtttcaacttcacgattaagtccctaagccgccccgggcagccttggtgcgaagcccaggtattcctgaataagaatcttttcttgcagtataattcagacaacaacatggtcaagcctctgggcttgctgggtaagaaggtgtatgctacaagcacatggggggagctgacacagactttgggcgaagtagggagggacctgcgcatgctcctatgcgacatcaaaccccaaataaagacgtccgatccaagcaccctgcaggtcgagatgttttgtcagcgcgaggccgagaggtgtaccggtgcaagttggcagtttgctacgaacggtgaaaagtccttgctattcgacgccatgaacatgacatggactgtcataaaccatgaggccagcaaaattaaggagacttggaaaaaggaccgcggcctggagaagtatttcaggaaattgagcaaaggagactgcgaccattggttgcgagaattcttggggcactgggaggccatgccagaaccaacgggtaattag

SEQ ID NO: 45523 - DNA, 243 bp, Artificial Sequence
  Description of Artificial Sequence: Synthetic coding sequence
atgcggcggatcagcctgaccagcagccccgtgcggctgctgctgttcttgctgctgctgctgatcgctctggaaatcatggtgggggggcacagcctatgcttcaatttcactattaagtccctgtcccgccctgggcaaccatggtgcgaggcccaagtctttcttaataaaaatctgttcctccaatataattctgataataacatggtgaaacccctcggcctcctcggtaaaaagtag

SEQ ID NO: 45524 - DNA, 639 bp, Artificial Sequence
  Description of Artificial Sequence: Synthetic coding sequence
atgcggcggatcagcctgaccagcagccccgtgcggctgctgctgttcctgttgctgcttttgatagccctggagattatggtcggcgggcatagtctctgcttcaattttacaattaaatccctctcacgccccgggcagccctggtgcgaggcccaagtttttctcaataagaatctgttccttcagtacaactcggataataacatggtgaagcctttaggtctgcttggcaagaaggtgtacgccacaagcacatggggggagctcacccagactctcggcgaggtgggaagagaccttcggatgttgctatgtgatatcaaaccgcaaattaaaacctcggatccttcaactctgcaggtggagatgttctgtcagagagaagctgaaaggtgcactggtgccagctggcagtttgcaactaacggggaaaagtcattgcttttcgacgcaatgaatatgacatggaccgtgatcaatcacgaggcaagtaagattaaagaaacttggaaaaaagatcgtgggcttgagaaatactttaggaagctttctaagggagactgtgaccactggctgagagagttcctgggacattgggaagctatgcccgaaccaacgggtcgcaggtctacctag

SEQ ID NO: 45525 - DNA, 1005 bp, Artificial Sequence
  Description of Artificial Sequence: Synthetic coding sequence
atggccgccgccgccagccccgccttcctgctgcggctgcccctgctgctgctcctctcgtcttggtgccgcaccggcctcgcagatccacactcgctttgttatgacatcacggttattcccaaatttaggcctggtccccggtggtgcgcagtacaaggacaggttgatgaaaaaactttcctgcattatgactgcgggagcaagaccgtgacgcccgtgtcccctctgggcaagaagctgaacgtgacaaccgcgtggaaggcacagaaccctgttcttagagaggtggtggatatcttgaccgagcaactgctggatatccagcttgaaaattatatccccaaagagccgctgacactacaagcccggatgagttgcgaacagaaagccgagggacacgggtccggatcctggcagctgtcgtttgacggtcagattttcctgctgttcgactccgagaaccggatgtggactacagttcacccaggcgcccgtaaaatgaaagagaaatgggaaaatgataaggacatgactatgtcttttcattacattagtatgggcgactgtacaggatggctggaggactttttgatgggtatggactctaccctggaaccatccgctggagcccccccaactatgtcatcaggtacagctcaacctagggctacagccacaaccctcattctttgctgcctgcttattatgtgcctgctaatctgtagcaggcactccttaactcagtcccatggccatcatccccagtcacttcagccgccaccacaccctcctctgctgcatcccacatggctgctgcgccgggtactctggtcagatagctatcagatcgccaaacggccactctctggaggacacgtaacgcgagtgactctgccaatcattggtgatgattcacactcattgccctgtcccttggccttatatacaatcaacaatggggccgcaaggtattctgagcccttgcaagtttccataagctag

SEQ ID NO: 45526 - DNA, 663 bp, Artificial Sequence
  Description of Artificial Sequence: Synthetic coding sequence
atgagccggtacctgctgcccctgagcgccctgggcaccgtggccggggctgccgtactgctaaaggactatgtgaccggcggcgcctgcccttcaaaagctacaatccctggtaagacggtcattgtgaccggtgccaacacagggattggtaagcaaaccgcacttgagctggcccgtcgcggcgggaacatcatcctggcctgcagggatatggagaaatgcgaagcggccgccaaggacataagaggggaaacactgaaccaccacgtaaacgcacgccatttagacttggcctcactgaaaagtattagagagtttgctgctaagattatcgaggaggaagagcgtgttgacattctcataaataacgccggagtcatgcgctgcccccattggaccaccgaggacggctttgagatgcagttcggagttaaccacctgggacattttctcctcaccaacctgcttctggacaagctgaaggcctcagccccttcacgtatcatcaacctgtcttcccttgcccatgtggccggccatatcgacttcgatgatttgaattggcagaccagaaagtataacacaaaggccgcctactgtcagagcaagctggccatcgttttgtttacaaaagaattgtctagacgccttcaagggtag

SEQ ID NO: 45527 - DNA, 783 bp, Artificial Sequence
  Description of Artificial Sequence: Synthetic coding sequence
atggagaagtgcgaggccgccgccaaggacatccggggcgagaccctgaatcaccacgtgaacgcaaggcatctggatctggccagcctgaagtcaatccgagaattcgccgctaagataattgaggaagaagaacgcgttgatattctgataaacaatgccggagtgatgcggtgtccgcactggacaacagaagatggctttgaaatgcaattcggcgtcaaccacctgggccactttctgctgaccaatcttttattggataagctaaaagcctctgccccaagcaggattattaatctctctagccttgcgcacgtcgctggtcatatcgacttcgacgatctgaactggcaaacaaggaagtacaatacaaaagccgcttactgccaatccaagctcgccatagttctgttcaccaaggagctctcacggagactgcaaggaagtggtgtgacagtcaatgccctccaccccggtgtggcgcgaaccgagctcggcaggcataccgggatacatggttccacgttttcctccacaaccttggggcctatattctggctacttgtgaagtccccagaactggctgcgcagccgtccacttacctggccgttgcggaagagctcgcagacgtgtctggaaagtatttcgacggcctcaagcagaaagcgccagctccagaggctgaagacgaggaggtcgcaaggcgactatgggccgaaagcgctagactcgtgggactggaggcaccctcagtgagggagcagcctttaccaaggtag

SEQ ID NO: 45528 - DNA, 996 bp, Artificial Sequence
  Description of Artificial Sequence: Synthetic coding sequence
atgagccggtacctgctgcccctgagcgccctgggcaccgtggccggcgctgccgtgctccttaaagattatgtgaccgggggcgcctgcccctccaaagccactatacctggtaagaccgtaatcgtgaccggggctaacacggggatcgggaaacaaaccgctctggagcttgccaggcgcgggggaaacattatcctggcgtgcagagacatggagaagtgtgaagccgctgccaaggacatcagaggcgaaactttaaatcaccacgtgaatgcgcgccatttagacctcgcctcactcaagagtattcgggagttcgcagctaaaatcatcgaagaggaagagagagtagacatattaatcaacaatgctggggtcatgcgctgtccgcactggacaacagaggatggatttgagatgcaatttggcgtgaaccatctgggccattttctcctaacaaatctgcttctagataagctcaaggcgagcgcccccagcaggatcattaatctgtcctcactggcccacgtcgctggacacatcgattttgatgatttgaattggcagacaagaaaatacaacactaaggctgcttactgccaatcaaagctggccatcgtgttgttcaccaaggagctgtcaagacgcttgcaggggtctggggttacggtcaacgccttgcatcctggtgtggcaagaaccgagctaggcagacacaccggaatccacggttcgaccttctcctcaactaccctggggccaattttttggcttctggttaaaagccccgaactagccgcacaacctagcacctacctggctgtagcagaggagttagctgatgtcagcgggaagtactttgacgggctaaaacagaaggctccagcccccgaagcagaggatgaggaagttgctaggcggctctgggctgagagcgcccggctggtcggactagaagcccccagtgtcagggaacagcccctgcctagatag

SEQ ID NO: 45529 - DNA, 1011 bp, Artificial Sequence
  Description of Artificial Sequence: Synthetic coding sequence
atggccgtggccaccgccgccgccgtgctggccgccctgggcggcgccctgtggctagccgccaggcgattcgtgggcccaagagtgcagcgacttcggaggggcggtgaccccggactaatgcacgggaagacagtgctcatcactggcgctaattcgggcctgggaagagctactgctgccgagctgttgcgactgggggctcgtgtcattatggggtgcagggacagggccagggcggaagaagcggcaggacagttgcgccgcgagctgaggcaggccgccgaatgtggtcccgaacccggtgtctcgggtgtgggtgaacttatcgtgagagagctcgatctggcttcattaaggagcgtacgggcattttgtcaggaaatgctgcaggaagagcctcgacttgatgttctgatcaataacgcaggtatctttcagtgcccctatatgaagaccgaggatggctttgagatgcagttcggggtcaatcatctggggcatttcctgcttaccaatctattattgggtctgctgaaatctagtgcacccagccgaattgtggtggtgtcaagcaaactgtataagtacggcgacattaactttgacgaccttaattccgaacagagctataataaatccttttgttattcccggagcaaacttgctaatatcttgtttaccagagagctggcaagaagactagagggcacaaatgtgaccgtcaatgtgttgcaccctgggatcgtccgcacaaaccttggcagacacatccatatccccctactggtgaagccactgttcaacttagtctcgtgggctttctttaagaccccagtggagggagctcaaacgtctatctaccttgcaagtagtccagaggtggagggggtcagtggccggtattttggagattgtaaagaggaagaactgctgccaaaggccatggacgagagtgttgcgagaaaactatgggatatatccgaggtaatggttgggctgctgaaatag

SEQ ID NO: 45530 - DNA, 954 bp, Artificial Sequence
  Description of Artificial Sequence: Synthetic coding sequence
atgtggctgtacctggccgtgttcgtgggcctgtactacctgctgcactggtaccgcgaacggcaggtgttatctcacctgcgcgacaagtatgtgttcattaccgggtgcgattctggctttggcaagctactggccaggcagcttgacgccagagggctgcgcgttctggcagcctgtttgactgagaagggtgcggaacagttgcgagggcaaactagcgataggttggagaccgttaccctcgatgtaacaaagacagagtcagtcgctgccgccgctcaatgggtgaaagagtgcgtacgagataaaggtctgtggggactagtgaacaatgctggcattagtctgccgactgctcccaatgaactgcttaccaaacaggattttgtgaccatcttggacgttaatttactgggggtgattgacgtgaccctgtccctgctcccattggtgaggcgcgcgagaggacgggtggtcaatgtgagctcagtaatgggccgggtgtcccttttcggaggggggtattgcatctccaaatatggcgttgaagccttctctgattcactgcgtagggaactctcatactttggcgtgaaggtggccatgattgaacccgggtatttcaagaccgctgtcactagcaaggaacgattcctgaaaagctttcttgagatttgggatcgtagcagtcctgaagtcaaagaggcctatggagagaaatttgtggcagattataaaaaatctgcggaacagatggagcagaagtgcactcaagacttgagcctcgtgacaaactgcatggaacacgcccttatagcatgccatcctcggactaggtattcagccggatgggatgccaagctgttatacctaccgatgtcctacatgcctacatttcttgtagatgcaatcatgtactgggtttctccctcccccgccaaggcactgtag

SEQ ID NO: 45531 - DNA, 1446 bp, Artificial Sequence
  Description of Artificial Sequence: Synthetic coding sequence
atgtggctgcccctggtgctgctgctggccgtgctgctgctggccgtcctgtgtaaggtgtatcttggactgtttagcggcagcagcccgaatcccttttccgaagatgtgaagagaccccccgccccgttagttacggacaaggaggcgcgcaaaaaagtcttgaaacaggcctttagtgcgaatcaggtgccagagaagcttgatgtggtcgtgattggatcaggatttgggggtttagcagccgccgctatattggcaaaagcaggtaagcgggtcctcgtgttagagcagcataccaaggccgggggctgctgtcacacttttgggaagaatggcctggagttcgacactggaattcactacattgggcggatggaggaaggttcaattggcagatttatacttgaccaaatcacagagggccagcttgactgggcccccctgtcaagtccattcgacataatggtcttggaaggtcctaatggccggaaagagtacccaatgtatagtggagaaaaggcctatatccaaggacttaaagaaaagttcccgcaggaagaggctataattgacaagtatatcaagctcgtaaaggtcgtgtcaagtggcgctccacatgccattttgctgaagtttctgccactgcctgtcgtgcagctgcttgatcggtgtggattgctcacccgatttagtccctttctccaagcgagcacacagtccctggccgaggtactgcagcagctcggcgctagctcagaactccaagctgtgctgtcatatatcttccctacatatggtgtaactcccaatcatagtgcctttagtatgcatgccctgttggtgaatcactacatgaaggggggattttaccccaggggtggatcatctgaaatcgcttttcacactattcccgtgatccagagagctggcggggccgtgttaacgaaagccactgttcagtcggttcttctggattcagccggtaaggcctgcggtgtaagcgtgaagaaaggacatgaattggtgaacatctactgcccaatagtggtgtctaacgccggactgtttaacacctacgaacatctcctccccgggaacgcccgatgcctccctggtgttaagcagcagttaggcaccgtgaggcccggccttggaatgaccagcgtcttcatatgcctgagagggacaaaagaggacctgcacctaccaagtacgaattattacgtgtactatgacacagacatggaccaagcaatggaacgttacgtgagtatgcctagggaagaagctgccgagcatatccccttgttattcttcgcttttccctccgcgaaggacccaacctgggaggacagatttccaggcggtgagtgcgactgcaggatcccaactcatcagcccgtgctgagtggctgcagtccgcgatgtttactgcgcggatag

SEQ ID NO: 45532 - DNA, 1833 bp, Artificial Sequence
  Description of Artificial Sequence: Synthetic coding sequence
atgtggctgcccctggtgctgctgctggccgtgctgctgctggccgttctttgtaaggtgtatcttggcttatttagcgggagctcacccaacccattcagcgaggacgtgaagagacctccagcccctttggtgaccgacaaggaagcaagaaagaaagtgctgaaacaagccttctctgcaaatcaggtgcctgaaaagttagatgtggtcgtgataggctccggattcgggggacttgcagcagccgccattctggccaaggccggaaagagggtgcttgtcctggaacaacatacaaaggccgggggatgttgtcacacgtttgggaaaaatggcctggaattcgatacaggtatacactacattggccggatggaggaggggagtatcggtcgctttatcctcgaccagattacggagggccagctggactgggcacccttgtcaagtccatttgacatcatggttctggaaggaccgaacggcaggaaagaataccctatgtattctggtgaaaaggcctatattcagggactcaaggagaagtttccacaggaagaagccatcattgacaaatacataaaactcgttaaggtggtgtcgtctggggcaccccacgccattttgttgaaatttctgcccctcccagtggtgcagcttctggaccgttgtggattgctaacccgattcagcccttttctgcaagctagtacccagtcactggctgaggtgttgcaacagctcggagcctcttccgagctgcaggccgtgctgtcttacatatttccaacctatggagtaacacccaatcacagcgccttttcgatgcatgccctgcttgtgaaccattatatgaagggtggcttttacccaagggggggctcttctgaaatcgccttccacaccattcctgtgatccaaagagccgggggagcggtgctaaccaaggcgactgtccaatctgtactgctggacagcgcgggcaaggcatgtggcgtgagtgtgaaaaaggggcatgaactagtgaacatctattgccctattgtagtgagcaacgctggcctcttcaacacttacgaacacctgctgccaggaaacgccagatgccttcctggggtgaaacagcagttggggacggttcgacctggcctgggaatgacctccgtcttcatttgtttacggggcactaaggaggatctgcacttgcccagcactaattattatgtgtactatgacactgacatggatcaggccatggagcgatacgtttccatgcctcgggaggaggcagcagaacacatacccctgctgtttttcgcgtttccatcagctaaagatccaacctgggaggatcggttccccggccgttccactatgatcatgctcattcctacggcctacgagtggttcgaggagtggcaagctgagttgaaaggtaagcgcggatccgactatgagactttcaagaacagcttcgtcgaagcatccatgtcagtggtgttgaaactgtttcctcagctggagggcaaggtggagagtgtgacagccgggagccctttgaccaaccagttttatttggccgctccacggggtgcttgttatggcgccgatcatgacctgggtcgccttcacccttgcgttatggcctctctcagggcacagtcccccattcctaacctatatctaactgggcaagatatattcacatgcgggttggtgggggccctgcagggcgccttgctgtgtagctctgcgatactcaagcggaatctgtactcggatcttaagaacctcgactctcgaattagagcgcaaaagaaaaagaattag

SEQ ID NO: 45533 - DNA, 1650 bp, Artificial Sequence
  Description of Artificial Sequence: Synthetic coding sequence
atgtggctgcccctggtgctgctgctggccgtgctgctgctggccgtgctatgcaaggtgtatttgggcttgttcagcggcagctcaccaaaccctttctccgaggatgtgaaaagacccccagcaccactggtgacagataaggaggcacggaaaaaagtgctgaagcagggtatccactatatcgggagaatggaagaagggagtataggccgcttcatcctcgaccagatcacggagggacagcttgattgggcacccctcagcagtcctttcgacattatggttttagagggtcccaatggaagaaaggagtaccccatgtactctggtgagaaggcttacatccagggtctcaaggagaaattcccacaggaagaggccatcatcgacaaatatattaagttagttaaagtagtctcaagcggcgcacctcatgccatccttctaaagtttttgccattgcccgtggttcaacttctggacagatgtggactgctaacccgtttttcaccgttccttcaggcctctactcagtcactggcagaggtactacaacagcttggcgctagttcagagctccaagcagtcctaagttacattttcccaacgtacggcgtcacaccgaaccactccgcatttagtatgcacgcactgcttgtgaatcattacatgaaggggggattttatccacggggagggagttccgaaatagccttccacaccatcccagtcattcagcgagcaggaggggcagtgttgacaaaggctacagtgcagagcgttctgctggattcagcaggcaaggcctgtggcgtgtccgtcaaaaaaggacacgagctcgtgaacatctattgccctatcgtggttagcaacgcagggctgttcaacacttatgaacacttgctgcctggcaacgctaggtgtctgcctggtgtgaagcaacagctgggcaccgtgaggcccggtctggggatgacgtccgtctttatttgcctcagggggaccaaagaagacctgcatttgcctagtactaactactatgtctattacgacactgacatggatcaagccatggaaagatacgtaagcatgccacgagaagaggccgcagagcatattcccctccttttcttcgcattcccctctgctaaagatcccacttgggaggaccggttccctggccgcagcaccatgataatgcttatccccacggcctacgagtggttcgaggagtggcaagccgaactgaaaggcaagaggggctctgactatgagactttcaagaactcattcgtagaggcgtccatgtccgttgtgctgaagctgtttccacagctggaaggcaaggtcgaaagcgttactgctggatctcctctgactaaccaattctatttggcagcgccacgcggagcttgctacggagcagatcatgatctcgggaggctgcacccctgcgtgatggctagcctgcgagctcagagcccaattccaaatttgtacctgacgggacaggatatttttacctgcgggctcgtgggcgccctgcagggggcattgctctgttcttccgccatcctgaagagaaatttgtacagcgacctgaaaaacctagactcgcggattagggctcagaaaaaaaaaaactag

SEQ ID NO: 45534 - DNA, 699 bp, Artificial Sequence
  Description of Artificial Sequence: Synthetic coding sequence
atgaaggagcggcgggccccccagcccgtggtggcccggtgcaagttggtcctggtgggggatgtccagtgcggcaaaaccgccatgctacaagtgctcgctaaggattgttatcctgaaacctatgttcccacggtgttcgagaactataccgcgtgcctggagacagaggagcagcgcgtcgaactgtccctatgggatacctctggtagcccttattacgacaatgtccgtcctctgtgctatagcgactccgatgccgtactgctgtgcttcgatatttctcggccagaaactgtagactcagctttgaagaaatggcgcaccgagatcttggattattgtcctagtacacgagtgctgctgataggctgtaagaccgacctacgcacagatttgagcaccctgatggaattgtcacaccaaaaacaggctcctatctcgtacgagcagggctgcgccatcgccaagcagctcggagcggaaatttatctggagggctcagcttttactagtgagaaaagtatccactcaatattcagaacagccagtatgctctgtttgaacaagcctagcccgctgccccaaaagtcacctgttcggtccttgtcaaaacgactcctgcatttgccaagccggtccgaactcatatcctcgacctttaagaaggaaaaggccaagtcttgctctattatgtag

SEQ ID NO: 45535 - DNA, 381 bp, Artificial Sequence
  Description of Artificial Sequence: Synthetic coding sequence
tggcggaccgagatcctggactactgccccagcacccgggtgctgcttataggctgtaagactgacctccggactgacctttccaccctcatggaactaagtcatcagaagcaagctccaatctcttatgaacaaggctgtgcgatcgccaaacagctgggcgcagaaatctatctggaaggaagcgcttttacatccgagaaatctatccatagcatattccggaccgcgtccatgctctgtctcaataagccttccccgttaccccagaaaagcccagttcggagcctttccaaacgcctgttgcacctaccctcacggtctgagcttatttcgagtacgttcaaaaaggagaaggccaaaagctgctctataatgtag

SEQ ID NO: 45536 - DNA, 924 bp, Artificial Sequence
  Description of Artificial Sequence: Synthetic coding sequence
atgaccaaggccggcagcaagggcggcaacctgcgggacaagctggacggcaacgaactggacctgtccctgtctgaccttaatgaggtccccgtgaaggaactagccgccctcccaaaagcgacaatcttggacctatcatgtaacaaactcacgactttgcccagtgatttctgtggccttacacatctggtaaagctagacctgtcaaagaacaagctgcagcagcttccagcagatttcggaagacttgttaacctgcaacatctcgaccttttgaacaacaagctggtcactctgccggtgagctttgcacagctaaagaacttgaaatggctggacctgaaggacaacccattagatccagtgctcgcaaaggtcgctggtgactgtctagacgaaaagcaatgtaaacagtgcgcaaacaaagtgcttcagcatatgaaagccgtgcaggcagatcaagaacgcgagcgtcaaaggaggctagaggttgagcgtgaggctgagaaaaaaagagaggccaaacagagggctaaagaggcccaagagcgggagctgcgaaaacgggagaaagctgaggagaaggaaagacggagaaaggaatacgacgccctcaaggccgccaagcgagaacaggagaagaagcccaaaaaagaggccaaccaagctcccaaatccaagtcagggtcgagaccacgaaagccgcctcctcgcaagcatacgcggtcctgggctgtgctgaaactgcttctccttctgctgctgttcggcgtggccggtggactggttgcctgtcgagtgactgagcttcagcagcaaccactgtgtacgtcggtgaacacaatctatgataacgccgtgcaggggttaagaagacacgaaatcttgcagtgggtcctgcagaccgactcccagcagtag

SEQ ID NO: 45537 - DNA, 687 bp, Artificial Sequence
  Description of Artificial Sequence: Synthetic coding sequence
atggagggccagagcggccggtgcaagatcgtggtggtgggcgacgctgagtgtggcaaaactgctctgctccaggttttcgctaaggacgcatatcctggctcttacgttcccaccgtctttgaaaattatactgcatctttcgaaattgacaagcgcagaatcgaactcaacatgtgggacaccagcggaagcagctactacgacaatgttaggcctctggcttatcctgactctgatgccgtgctgatctgctttgacatcagccggccagagactctggattctgtgttgaaaaagtggcagggcgagacccaggagttttgtcccaatgctaaagtggtcctggttgggtgcaagcttgacatgcgcacagatttggcaaccttacgcgaactgagcaagcagcgactgattccagtaacacatgagcaggtgggcactgtgctggccaaacaggtgggggccgtctcatatgtcgaatgctctagcagatcatcggagcgaagcgtgagggacgtttttcacgtcgctacagtggccagcttaggacgaggacaccgacagctgcgtcgtaccgattcacggcgaggaatgcagaggtcagcccaattatctggacgccctgacagaggtaacgagggagagattcataaggatagggctaagtcgtgcaaccttatgtag

SEQ ID NO: 45538 - DNA, 684 bp, Artificial Sequence
  Description of Artificial Sequence: Synthetic coding sequence
atggagggccagagcggccggtgcaagatcgtggtggtgggcgacgccgagtgcgggaagaccgcactgcttcaagtgttcgccaaagacgcttatcctggcagctacgttcccacagtgtttgaaaattatactgcctcttttgaaattgataagcgacgcatcgagctgaatatgtgggataccagcggatcttcctactatgacaatgtgcgccccctcgcttatcctgactcagatgccgtactgatatgctttgacatttctcggcctgagaccctggactcagtactgaaaaagtggcagggcgaaacccaagagttttgtcctaatgccaaggtcgtgctggttggatgtaagctcgacatgaggacagacctggccactctcagagaactcagcaaacagaggttgatacccgtcacccatgaacaggggacggtacttgccaagcaggtgggggccgtatcctacgtcgaatgttcatctaggagttccgaacgcagtgttcgggatgtgtttcatgtcgctacagtggcttccctgggccgggggcaccgacaactgcggcgcactgattcacggcgcggaatgcagcgctccgcccaactttctgggaggcctgatcggggtaacgaaggcgagatccacaaagaccgcgctaaaagctgcaacctaatgtag

SEQ ID NO: 45539 - DNA, 6264 bp, Artificial Sequence
  Description of Artificial Sequence: Synthetic coding sequence
atggagaccgagagcgagagcagcaccctgggcgacgacagcgtgttctggttggagtccgaggtgattatacaggtgactgattgcgaggaagaggaaagggaagagaaattccggaagatgaagagcagtgtgcacagcgaggaagacgacttcgtgcccgagctccatagaaacgtacacccccgagaaagacctgactgggaggagaccttaagcgctatggcccgtggcgcagacgtgcctgaaatacccggcgatctgacgctgaagacctgtggctcaacagccagcatgaaggtgaagcatgtgaagaagctgccatttaccaagggccacttcccaaaaatggctgagtgcgcccattttcattacgaaaatgtggagtttggatcaattcagctttccctttcagaagaacagaatgaggtgatgaagaacggatgcgaaagtaaggagttagtctatttagtgcagatcgcctgccagggaaagtcatggattgtgaaacgttcatacgaggatttccgggtgctagataagcatctgcacctgtgtatctatgaccgccggttctctcagttatcagagctgcctcggtctgacaccctgaaagactcccccgaatcagttactcagatgctcatggcctacttatcccgcctgagcgcaattgccggcaataagatcaattgcggtcctgcactcacctggatggagatcgataataaaggtaatcacctacttgtacatgaggaatcatccattaacacacctgcagtcggcgccgcacatgtaatcaagaggtacacagctagagctccagacgagctaacactcgaagtgggcgacatcgtgtctgtcattgacatgccgcctaaagtcttgtccacgtggtggcgcggaaaacacggattccaggtgggattgttccctgggcattgcgtggaactgataaatcagaaagtccctcagtctgtaaccaactctgtccctaaaccagtatcaaagaagcacggcaagcttattacatttctgcgaactttcatgaaatcaagacctaccaaacagaagctgaagcagagggggattctgaaggaacgggtctttggatgcgacctcggcgagcaccttcttaatagcgggttcgaagtgccgcaggtgcttcaatcgtgcaccgccttcattgaacgctatgggatcgtggatggtatctatcggttgagcggagtcgccagtaatattcaacggttgaggcatgagtttgactccgaacacgtaccagacctgacgaaggagccttatgtccaggacatacactccgtcggcagcttatgtaagttgtactttcgggagctccccaatcccctgctgacataccagctctacgaaaagttttctgacgctgtttcagccgccacggacgaagaaaggctcatcaaaattcacgacgttattcagcagctgccgccgcctcattatcggactctggagtttcttatgagacacctctccttgctggcagactactgtagtattaccaatatgcacgccaaaaatcttgcaatcgtgtgggcccctaatttgctgcggagcaaacaaattgagagtgcttgcttctccggcaccgcggcctttatggaagtccggatacagagcgtggttgtagaatttattctgaaccatgtcgatgttctttttagcggccggatctccatggccatgcaagaaggtgctgccagcctatctcgccctaagtcccttttggtgtcctcaccctccacgaagcttctcacactcgaggaggcccaagccaggacacaggcacaggtcaattcacccattgtgacggagaacaagtacattgaggtgggagaaggaccagccgcactgcagggcaagttccacactattattgagtttccattagaaagaaagaggcctcaaaacaaaatgaagaaatctcctgtaggcagttggcggagtttctttaacctgggaaagagtagcagtgtctctaaacggaaattacagaggaatgaatccgaaccttcagagatgaaagcaatggccttgaaaggtgggagggccgaagggacgctgaggagtgccaaaagcgaagaatcactcactagcctccacgccgtcgacggcgacagtaagctgttcagacctagaagacctagatctagtagcgatgctctgtcagctagcttcaacggggaaatgctcggaaaccggtgcaacagttatgataatctccctcatgataatgaatctgaggaggaagggggactcctgcatattccagctctgatgtcaccacactctgcagaggacgttgacctgagtcctcctgacattggagtcgcctcattagatttcgaccctatgtccttccaatgcagcccccctaaagcagaatctgaatgtctcgaatcaggtgcctccttcttagactctccaggttattccaaagacaaaccttctgccaataagaaagatgcagaaacaggatccagccagtgtcagactccagggagcactgctagtagtgagcctgtgtccccactccaggagaaactctcaccttttttcacactggacctgtcgcctaccgaggacaaaagctcaaaacctagcagctttactgaaaaggtagtgtacgcattctcaccaaaaattgggagaaaactgtccaaatcccctagcatgtccatctccgaacctataagcgtgaccttgccacctagagtcagcgaggtgattggaaccgtaagcaatactaccgctcagaatgcgagctccagcacgtgggacaaatgcgtggaggaaagagacgccaccaatcgcagcccaacccagattgtaaaaatgaagactaacgaaaccgtggctcaggaggcctacgaatctgaggtccagccattggatcaggtggcagccgaggaagtggagctccccgggaaagaggatcagagcgtaagctcctcacagagcaaggccgtggcttccgggcagactcagaccggagccgtgacgcacgacccaccccaggactctgtgccagtgtcgagcgtgagtctgattccaccaccccctccacccaaaaacgttgcgaggatgcttgctctcgctttggcagaaagcgcccagcaggccagtactcagtctctcaagagaccaggtacatcacaggcaggatacaccaattatggcgatatcgccgtcgcaaccacagaggacaacttatccagctcttattctgcagtcgccctagataaggcttacttccagacagaccggccggccgagcagtttcatttacagaacaacgctcctggaaactgtgaccatccactcccagagacgaccgcgacaggagaccctacacattcgaatacgacagaatctggtgagcagcaccatcaagtagacttgacaggtaaccagccccaccaagcctatctttctggcgacccagagaaggccaggataacctccgtgcccctcgatagtgagaagtcagatgaccacgtctctttccctgaagatcaatcaggcaagaacagtatgccgaccgtgagttttctcgaccaagatcaaagtcctccccggttctacagcggcgaccagcctcctagctatttaggtgcttcagtggacaagctgcaccatccactggagtttgccgataagagcccgactccccccaatctcccgagcgataagatctaccccccatccggatcacccgaggagaacactagtactgccaccatgacttatatgacaactaccccagccaccgcccagatgtccacaaaggaggctagctgggacgtcgcggagcagccaacaacagccgacttcgccgctgctacgctccaaaggacgcaccgcactaataggccactaccgccccctcccagccagaggagtgcagagcagccaccggtcgtgggacaggtgcaggccgcgactaacatcggcctgaataactcccataaggttcagggggtggtgcctgtccccgagaggccaccagagccccgcgccatggacgaccctgcctccgctttcatctccgactcaggtgccgctgcggcgcagtgccccatggcaactgctgttcagccagggctccccgaaaaagtgcgcgatggtgctcgcgttccactgcttcatctgagagcagagagtgtaccagctcacccttgtggctttcccgccccactcccgcccaccagaatgatggagagtaaaatgattgcagcaatccactcttcatcagccgatgctacctcttccagcaactatcacagtttcgttaccgcctctagcacgtccgttgacgatgccctgcctctgcccctacctgttccccagccgaagcatgcctcacaaaagaccgtctatagttcattcgctcggcctgacgttactaccgaacctttcggccccgataactgcttacattttaatatgacacctaactgccaatacaggccgcagagtgtgccaccgcaccataataaactggagcagcatcaggtatacggcgcccgaagtgaaccacctgccagcatgggcctgcggtacaatacctacgtggcaccaggaagaaacgccagtggccaccacagcaaaccttgttctagagtagagtacgtttcttccctttcttcctctgttcggaacacgtgctatcctgaagacatccccccttaccctactatacgccgcgtccagagtctgcacgcgcctccctcaagcatgattagatcagtccccatcagccgtacagaggtgcccccggacgatgaacctgcttactgtccacgcccgctttaccagtataaaccatatcaatcatcacaggccaggtctgactaccacgtgacccaacttcagccctattttgaaaacggtcgcgttcactatcgctactccccttatagctccagtagcagctcttactactctcccgacggcgctctctgcgatgtggatgcctacggaacagtgcagctgagacctctgcataggttgcccaaccgggattttgccttttataatccgcggctgcaggggaagtcgttgtactcctatgctgggcttgctccccggcctcgggctaatgtgaccggctacttctctccaaatgatcataacgttgtttcgatgcctcctgcagccgatgttaagcacacctatacctcttgggacctggaagacatggagaagtacagaatgcaatctatcaggagggaatcaagggctcgccagaaagtcaagggacccgtgatgtctcagtacgataatatgacccccgcagtgcaggacgatttgggcggtatctatgtgatccacctcaggtccaaatcagacccggggaaaaccggcttgctgagcgtggccgaaggtaaagagagcaggcacgccgcaaaggctattagtccagaaggcgaggatagattctaccgtagacaccccgaagccgaaatggacagagcacaccatcacgggggtcacggatcaacccagccagagaaacctagcttgccacaaaagcaatccagcttacggtctcgaaagctccccgacatgggctgctccctgcccgagcaccgggctcaccaggaagcctctcaccggcagttctgtgagagcaagaacggaccaccttatccccagggtgccggtcagctggactatggaagtaaagggatccctgacacatctgagccagtgagctaccataactcaggagtgaagtatgccgcttccggccaggagtccctgcgcttgaatcacaaagaagtgcgcctctctaaagagatggaacgaccctgggtgagacaacctagcgccccagaaaagcacagcagagattgctataaagaggaagaacacctaacccagtcgatcgttccgcctccgaagcctgaaagaagtcactctcttaagctgcaccacactcagaacgttgaacgggacccttccgtgttgtaccagtaccagccacacgggaagcggcagtccagcgtcacggtggtctcccagtatgataatctggaggactaccacagcctgccccagcatcaacgcggtgtgtttggcggtggtggtatgggtacatacgtcccacctggattcccacatccgcagtctagaacatacgcgacagcccttggtcagggcgcgtttctccctgccgagctctctcttcagcacccagagactcagattcacgccgagtag

SEQ ID NO: 45540 - DNA, 969 bp, Artificial Sequence
  Description of Artificial Sequence: Synthetic coding sequence
atgccccccaaggtgctgagcacctggtggcggggcaagcacggctttcaagtgggtctgtttccgggtcactgtgtggaattgataaatcaaaaagtcccacaatctgtcaccaacagtgtgcccaagcccgtcagtaagaagcatggcaagctgatcactttcctgaggaccttcatgaagtctaggccaaccaaacaaaaacttaaacagcgcggcattctgaaggagcgggtgttcgggtgcgacctcggagaacatctcctgaattctggattcgaggttcctcaggttctccagtcctgcacagcttttattgaaaggtatggaattgtcgacggcatctacaggctgtctggggtggcctccaacattcagcgccttagacacgagtttgattccgaacacgtaccggatctgacaaaggagccttacgtccaggatatccattctgtcggctccctttgtaagctgtattttcgagaattgccaaatccactcttgacctaccagctgtacgaaaaattctccgacgcggtgagcgcagcaaccgacgaggaacgcctcatcaaaatccacgatgtgattcagcagctgcctccccctcattaccgaaccctggaattcctgatgagacatctatccctcctagccgactattgtagcattaccaatatgcatgccaaaaacctggcaatcgtttgggcaccaaacctcctgaggtccaagcaaattgagagtgcatgcttctccgggaccgcggcatttatggaagtacggatccaatcagtagtggtcgagttcattctcaatcacgtggacgtgttgctgcctcacttcagcgcacggacggagttgatcgtccccttcccactgagacttcctagaaaacaattcacaccaccactgcttgggcctatgagcccacttaatcccctggtgcaaatcacagtgtgcatctctatatag

SEQ ID NO: 45541 - DNA, 2865 bp, Artificial Sequence
  Description of Artificial Sequence: Synthetic coding sequence
gactacgaggagaccagcaagaaggaggcccggggcgccgacgtgcctgagatccccggcgacctcaccctgaagacgtgtggttctacagcctcaatgaaagttaaacacgtaaagaaactccctttcacgaaaggacacttccccaagatggctgagtgtgcgcactttcattacgaaaatgtggagttcggcagcatccaactgtctctgtctgaggagcagaatgaagtcatgaaaaacggttgcgagagcaaggaactggtttatctagtgcagatcgcctgtcagggcaagagctggatagttaagcggagctacgaggatttccgggtgctggataagcacctgcacctgtgcatatacgatcggcggttctcacagctgagtgaattgccccgctctgacactttgaaggatagtcctgagagcgtgacccagatgttgatggcctatctgagtcgcctatcagcaatagctgggaataagattaactgtgggcctgcactgacatggatggagatcgacaataagggtaaccacttgctcgtgcacgaggagagttccatcaataccccagctgtgggggctgcccacgtgataaagaggtacaccgccagggcacccgatgagctaacactcgaggtaggtgacattgtttccgttattgatatgccgcctaaagttctttcaacatggtggagagggaaacatgggttccaagtgggactcttccctggccattgtgttgagctgattaaccagaaagtcccccagtccgtgacgaatagcgtgcccaaacctgtgagcaaaaaacacggtaagctgatcacctttttacggaccttcatgaagtccagacccacaaagcagaaattgaagcaacgggggatcctcaaggaaagagtgttcggctgcgacctcggcgagcacctattgaattccgggttcgaggtgcctcaagtgcttcagtcttgtactgcctttatcgagcgttacggaattgttgatggaatttacaggctgtccggcgttgcatccaatatccaacgccttcgacatgaattcgatagcgagcacgtccctgatctgactaaggaaccatacgttcaagatattcactccgtgggctccttgtgtaaattatatttccgcgagctgcctaaccccctgttaacataccagctgtatgaaaagttctcagatgccgtcagtgccgcaacagatgaggagagactgatcaaaatccacgacgtcattcagcaattgcctccacctcattatcggacactcgagtttctgatgcggcatctgtctctccttgctgactattgctcgatcactaatatgcacgcaaaaaatttggcgatcgtatgggccccaaatcttttgcgctcaaagcagatcgaatctgcctgttttagcgggacagctgcctttatggaagtgcgaatccagtctgttgttgttgagttcatcctgaatcacgtcgacgttttgttctctggcaggatctcaatggccatgcaggagggtgccgcgtccttgagtcgccctaaaagcctgttggtatcctcaccttctacaaaactactcaccttggaagaagctcaagcccggacacaggctcaggtgaatagccccatcgtgacggagaacaaatatattgaagtaggagaagggcctgctgccctacaggggaagtttcatactatcattgaatttcctctagaacgcaagcgccctcagaacaaaatgaaaaaatccccagtcggatcatggagatctttttttaacttgggtaaatcatcctccgtgagtaagcggaaactgcagagaaacgaatccgaaccatctgagatgaaggccatggctctcaagggcggcagggcagagggtaccctgaggtccgcgaagtcagaggagagtctgacttcactccacgcagtggacggagatagcaagttgttccgtcccagaaggcctcgcagcagctccgatgctctgtctgcttcgtttaacggtgaaatgctaggcaacagatgcaacagctacgacaacctgccccatgataatgagtccgaagaggagggtggcttgctccatattcccgcattaatgagcccgcacagtgcagaggacgtagaccttagtccacccgacatcggtgttgcttcattagacttcgatccgatgagctttcagtgctcaccaccaaaggctgagtccgagtgtttggagtccggcgcctccttcctggactcacccggttattctaaggataagccaagcgccaacaagaaggacgccgagacagggtcgagccagtgccagactcctggttctaccgcctccagcgaaccagtgagccccctacaagagaagttgagcccctttttcactctcgacctctcaccgaccgaggacaaaagttccaagccaagtagtttcaccgagaaagtcgtctatgctttttccccaaaaattggacggaagctgtccaagtccccgtcaatgtccataagtgaaccaatcagtgttaccctgccgcccagagtgagtgaagtgattggtaccgtttcgaacacaacagcacagaacgctagcagttccacatgggacaaatgcgttgaagagcgagacgccactaatcgctccccaacacagatagtcaagatgaaaactaacgagaccgtggcccaggaagcctacgagtctgaggttcagcccttggaccaggtcgcagccgaggaagtcgagctccccggcaaggaagatcagtccgtgtcctcttcccagtcaaaggccgtggcctccggacagacacagaccggcacagtgtgttttcctcccttctttctctag

SEQ ID NO: 45542 - DNA, 5217 bp, Artificial Sequence
  Description of Artificial Sequence: Synthetic coding sequence
atgaagagccggcccaccaagcagaagctgaagcagcggggcatcctcaaagagagagtcttcggctgtgaccttggcgagcaccttctgaattcaggattcgaggtcccccaggtcctgcaaagttgcacagcgttcatcgaacgctacggtatcgtggacggcatttatcgccttagcggtgtcgcctccaacatccaacgcctgcgtcacgagttcgactcagagcacgtgccggacctgactaaggagccttatgttcaggatatccactccgttggtagtctttgtaagctgtacttcagagagctcccaaatcccctgctgacttaccagctgtacgagaagttctccgacgccgttagcgccgctaccgatgaagagcgactcattaaaatccacgacgttatacagcagctgccccctccacattatcgaacgttagagttcctgatgcggcatttaagcctcctcgccgattattgtagtattacaaatatgcatgctaagaatcttgctatagtgtgggccccgaatctgttgagatcaaagcagatcgagtccgcttgcttttccggtacagcagcttttatggaggtgaggatccagtcggtggtggtggagtttatcctcaatcacgtggatgttctgttcagcgggcgtatctccatggcaatgcaggagggtgctgcctcactttctcggccgaagtctcttctggtttcttcaccgagtacaaaattgctcacattggaagaggcccaggcaaggacccaggcccaggtgaattcccctattgttacagagaacaaatatatcgaagtgggcgagggcccagccgccctgcagggcaaattccacacaatcatcgaatttcccctggaacgcaagcggcctcagaacaaaatgaagaaatcccctgtaggcagttggcgcagcttttttaacctcgggaagagcagttctgtgtcaaagagaaaattgcagcgcaacgagagcgaaccttcggagatgaaggccatggctctgaaaggcgggagagccgagggcacccttcgatccgcaaaaagtgaagaatccctgacctccctgcacgccgtggacggtgactcgaagctctttagaccccggagaccccgctcttcctcagatgccctttctgcctcctttaacggtgaaatgctgggaaaccgttgtaattcctacgacaacctccctcatgacaatgagtctgaagaggagggcggcctcctacacatcccagctctgatgtcaccgcatagtgccgaagatgtcgatctcagcccacccgatattggagtggcatcactcgattttgacccaatgagtttccagtgcagtccaccaaaagctgagagcgaatgtctggaatctggggcctcatttctggactcccctggttatagcaaggacaagccttccgcaaacaaaaaggacgcagaaaccggatctagccaatgtcagacaccgggttccacagcctcctctgaacccgtttctcccctccaggaaaaactgagtccatttttcaccctggacctgagcccaacagaggacaagagctctaagccctcctctttcacggagaaagtggtttatgctttctccccaaaaataggtagaaaattaagcaaatctccttccatgagcatctcggagcccatctccgtgaccttacctccacgtgtcagcgaagtaattggaaccgtttcaaacactactgcgcagaacgcgagctcgtccacttgggacaagtgtgtcgaggagcgggacgcaaccaataggtctccgacccaaatcgttaaaatgaaaactaatgagactgtggcccaggaagcctacgagagcgaagtacagcctctggaccaagttgccgctgaggaggtggagctccccggcaaagaagaccagagtgtgtctagtagtcagtcaaaggccgtcgcctcaggccagactcaaacaggagccgtgacccacgacccacctcaggattctgtcccggtcagcagtgtgtctctcatcccaccccctccaccacctaagaatgtcgcccgaatgctagccctcgcactggcggagagcgcgcagcaagcatcaacccagtccctgaagagaccgggtacgtcacaggcaggctacactaactacggggatattgcagttgccactaccgaagacaatttgtcgagtagctatagcgccgtggctttagacaaggcatactttcagacagatcgccctgctgagcagtttcatctccaaaataacgcccctggcaattgcgaccacccccttcccgagactactgccactggagatcccacacattcaaataccacagaatccggcgaacaacatcaccaagtggacttgactggtaatcagccccaccaggcatatttatccggagatccagagaaggcgcgcatcacttccgtcccgctcgattcagagaagagtgacgatcatgtttcctttccagaagaccagagcggtaagaatagtatgcctacagtcagcttcctggaccaggatcagtcccccccaaggttctacagtggcgatcagccaccctcctatctcggcgcctccgttgataagctacaccacccattggaatttgccgataagagccctacaccccccaacctgcccagtgataaaatctaccctccatccggtagccctgaggagaacaccagcacagccactatgacatacatgacaactacaccagccaccgcacagatgagtactaaagaagcgtcatgggatgtggccgaacagccaacaacggcagacttcgccgcggcgacactgcaacggacccaccgcaccaaccggcccctgccgcctccaccctctcagagatccgccgagcagcccccagttgtcggacaggtgcaggcagccaccaacatcggactgaataacagccataaagtccagggagtagtcccagttcccgaacgcccccccgaaccgcgagcgatggatgaccctgcctcagcttttatcagcgatagtggggcagcagctgcccagtgcccaatggccaccgccgtacagccaggcctgcccgaaaaagtgcgcgacggcgctcgcgtcccccttctacacctgagggcggagagcgttccggcacacccttgtggattcccagcaccgcttcccccaactcgtatgatggagtccaaaatgatagctgcaatccactcttctagtgcagatgcaacaagtagttccaactatcacagtttcgtcactgccagttctacaagcgttgatgatgccctgccgctgcctctgcccgtcccccagccaaagcacgcctcacagaaaaccgtgtacagctccttcgcgaggccagacgtaaccaccgagcctttcggtccagataattgtctgcatttcaatatgacccccaattgccaataccgccctcagtccgttcccccgcaccataataaacttgagcagcaccaggtctacggagctcggagtgagccacccgctagcatgggactgcggtacaacacctacgtggcaccagggaggaacgcgtccggtcatcatagcaagccatgctctagagtcgagtacgtttcctctctcagtagttccgtgaggaatacttgctaccctgaggatatccccccctaccctaccatcagaagagttcagagcttgcacgctcctccttctagtatgatcaggagtgtgccgatttctagaacggaggtgcctccagacgacgagcccgcttactgtccgcgtcctctctaccagtacaaaccttatcagagctcccaggcccgctccgactaccacgtgactcagctacagccatacttcgagaatggacgagtccactacagatactctccatatagttccagttctagttcgtactactcccccgatggtgcgctgtgtgatgtcgatgcatatggaaccgttcagttaaggcccctgcaccggctgcctaatcgggattttgcgttctataatccacggttgcagggaaagtccttgtactcatacgcggggttagctccgcgacctagagcgaatgtgaccgggtatttcagccccaatgatcataatgtggtaagtatgcctccggccgcagatgtcaagcatacatatacatcctgggacctcgaggacatggaaaagtacagaatgcagagcattcgaagggagagtcgggctcgccagaaggtgaaggggcccgtcatgtcccagtacgataatatgaccccagccgtgcaggatgatcttgggggaatttatgttatccacctgcgcagtaaaagcgaccccggaaagaccggtctcctttctgtggccgaaggaaaggaatcacggcacgccgctaaagccatctcgcccgagggtgaagatagattttatagaagacatcctgaggcagagatggaccgcgcacaccaccatggcggacacggtagcacccagcctgaaaagcccagtttgccacagaagcagtcctccctcagaagccgcaaacttcctgacatggggtgttccctgcccgagcacagggcccatcaggaagcctcccatcgccagttttgtgagtccaaaaacgggccaccatatcctcagggagccggacagctggattatggcagtaaaggaattccagacacttctgagcccgtctcctaccacaattccggggtgaagtacgccgcttccggccaggaaagtctgagactgaatcataaggaagttcgattgtcgaaagagatggagaggccatgggtgcgacaacccagcgcgcccgaaaaacattcgcgcgactgttataaggaggaggagcatttgacccagagcatcgttcctccacccaagccagaaagatctcactctctcaaactgcatcatacccagaatgttgaacgagacccgtctgtgctctaccaatatcagcctcacggcaaacgtcagagcagtgttactgtggtctcccagtacgataacctggaagactaccacagtctgcctcagcaccagaggggagtgtttggaggaggagggatgggcacttacgtaccacctggatttccccacccgcagtcacgcacatacgctacagctctgggacagggagctttcctgcctgcagagctctctctgcagcacccggagacacagattcacgcagaatag

SEQ ID NO: 45543 - DNA, 2841 bp, Artificial Sequence
  Description of Artificial Sequence: Synthetic coding sequence
atggccgcccacggcaagctgcggcgggagcggggcctgcaggccgagtacgaaacgcaagtgaaggagatgaggtggcaactgagcgagcagttacggtgcctggaactacagggcgagctcaggagagagctcctccaagaactcgccgagtttatgcggcggagagccgaggtcgaactggaatatagccgggggctcgaaaagcttgccgagaggttctcatcccgcggtgggaggctgggatcaagccgggagcaccagagctttcggaaggaaccttctctgctgagccctctccactgctgggccgtcctgctccaacatacccggcagcagagtcgggaaagcgctgcattaagcgaggtcctggccggccccctggcccagcgcttatcacacatcgctgaagatgttggacggcttgtaaagaaaagccgcgatcttgagcagcagctccaggatgagctgcttgaggtggtttcagaactgcagacagccaagaaaacataccaggcctaccacatggaaagtgtgaacgctgaagccaaattgcgcgaggccgagcgccaggaagagaaacgtgcgggtcgctccgtgccgaccactaccgccggggctaccgaggccgggcccctaagaaagagttcactgaagaaagggggccggttggtcgaaaaacgacaggccaagttcatggaacataagctgaagtgtactaaggctcgtaatgagtatctgttgtccctcgcctcagtgaatgcagcagtgagtaattactatcttcatgatgtcttggacctgatggactgctgtgacaccggtttccatctggctctaggccaggtcttgaggtcgtatacggcagcagagagtaggacacaggcatctcaggtgcaggggctgggaagtctggaggaggccgttgaggctctggacccacctggcgacaaagccaaagtccttgaggtgcatgctacggtgttctgcccccctctgcgattcgattatcaccctcatgacggggacgaggtcgctgagatttgcgtcgagatggagctgcgggatgagatcctgccgcgggctcagaatattcaatctagacttgatcgtcagacaattgagacggaggaggttaataagactttgaaggcaacgctgcaggcactcttggaggtggtagcctccgatgacggggacgtgctggatagcttccagactagcccaagcacagaatcgctaaagtcgacttcttctgaccccgggtcacgccaagccggccgacggaggggacagcagcaggagaccgagaccttctacttgaccaagctgcaggaatacctatctggcaggagcatcctggcaaaactgcaggctaagcacgagaagctgcaggaggccctgcagcgaggagataaagaggagcaggaagtctcgtggacacagtatacacaaagaaagttccagaagtctagacaacctaggccatcctcccagtataaccaaaggctcttcgggggggacatggaaaagtttatccagtcatctggacagcccgtgcccctggtggttgaatcctgtattcgcttcatcaatctgaacgggttacagcacgagggcatctttcgagtttcgggtgcgcaattgagggtgtcggaaatccgggatgcattcgagcgaggcgaagaccccctggtcgaaggctgcactgcacacgacctggattctgttgcaggggtcctgaaattgtatttccgtagtctggaaccacctttgtttcccccagacctgtttggagagctcctggctagctctgagttagaagcaacggccgaaagggtcgagcacgtctctcgtctgttatggcgcctgccggctcctgtgctagtagttcttcggtacctctttacgtttctgaaccatcttgctcaatactccgacgagaacatgatggatccgtacaatctcgccgtgtgctttggacccacgctgctcccagtgcccgcaggccaggatccagtggccttgcaaggtcgcgtgaaccagctggtgcagacgctcatcgtgcagcctgaccgggtcttccctcctctgacatccctgccgggtccggtgtacgagaagtgcatggccccgccatcagcctcatgtctgggcgatgctcagctagaatctctgggagccgataatgaacctgagttagaggcagaaatgcccgcgcaagaggacgacttggaaggagtggtagaagccgtggcttgctttgcatacacgggtagaacagcacaggagctctccttcaggcgaggagatgtgctgcgcctgcatgaaagagcctcctccgactggtggaggggggaacacaatggaatgagaggactcatcccacataagtatattacgcttcccgcagggactgaaaaacaggtggtgggagccggccttcagacagccggggagtccgggtcctcaccagaaggcctactggctagcgagcttgtacatcgtcccgaaccatgcacctccccagaggctatggggcccagcgggcacagacggcgctgtctggttcccgcaagcccagagcagcatgtggaagtggacaaagccgtagcccagaatatggatagtgtgttcaaggagctgctgggcaagacttctgtgagacagggattgggacccgcatccacaacctcaccttcgcccggtcccaggtcaccaaaggcccccccctccagtcggttgggaagaaacaaggggttctctcgggggcctggggcacctgcctctccttccgccagtcaccctcagggacttgacaccacgccaaagccacattag

SEQ ID NO: 45544 - DNA, 2778 bp, Artificial Sequence
  Description of Artificial Sequence: Synthetic coding sequence
atggccgcccacggcaagctgcggcgggagcggggcctgcaggccgagtatgagacacaggtgaaagagatgcgttggcagttgtcagagcagctgcgctgcttggaattgcaaggcgagcttaggagggaactgctacaagaactcgccgagttcatgaggcgccgcgccgaggtggaactcgaatatagtcgtgggttggagaaactggccgaacggttctcctcacgtggcggaaggctgggatccagcagagaacaccagtcgttccggaaggagcctagtctgctgtcaccacttcactgttgggccgttttgctccaacatactagacagcagtccagagaatctgctgctttgtctgaggtattagccggtcctctagcacaaaggctgtcccacatcgcggaggatgtgggtagactcgttaaaaaggcgaagaaaacttatcaggcctatcacatggagagtgtaaacgccgaggccaaactacgagaggccgaaaggcaagaggaaaagcgagctgggaggtcagtacctacaacaacagctggggcgactgaagccggcccacttagaaagtcttccctaaagaagggtgggcgcttggtcgagaagcgccaggcaaagtttatggagcacaagctgaaatgcaccaaggccagaaatgaatatctgttgtctctggccagtgtgaatgcagctgtgtccaactactacttgcacgatgtgttggaccttatggactgttgcgacacggggttccacctcgccctgggccaggtactgcgctcgtatacagccgctgaatcccgcacacaggcctcacaggtgcaggggctaggcagcttggaagaggccgtggaagcattagacccacccggcgataaggccaaggtccttgaagttcacgcaactgtgttttgcccacctctgcgattcgactaccatcctcatgatggtgacgaggtagccgagatttgcgtcgagatggagctgagagatgagattcttccacgggcacagaacattcagtcccgcttggaccgccagacaattgaaacagaggaagtcaataagacactcaaggctaccttacaggccctgttggaggtcgtagcttctgacgacggcgatgtccttgattctttccaaacctctccgagtactgaatctcttaagtcaacttcctctgacccgggatctaggcaagccggcaggcgtagggggcagcagcaagaaaccgagacattctatcttaccaaacttcaagagtacctttctggccgatcaattttagctaaactgcaggctaagcacgaaaaacttcaggaggccctccaacggggtgataaagaagagcaagaagtttcctggactcagtatacccaacgcaaatttcaaaagtcaaggcagccccggcctagctcccagtataaccagagacttttcggcggagatatggagaagtttatccaaagcagtggccagcccgtgcccttagtcgtggagagctgtatcaggttcattaatctgaacgggctgcaacatgagggaattttccgcgtgtccggtgctcagctgcgagtgtcagaaatacgggacgcctttgaacgaggagaagatccacttgtagaaggctgcaccgcgcatgatctcgatagcgtcgctggcgtcctaaagctgtactttaggagcctggaaccgccgctgttccctcctgaccttttcggcgagctcctggcctcttcagagctcgaggctacagcggaaagagtggaacatgtgtcaaggttgctgtggagactgccagctccagtgcttgtagtcctccgctacctgttcacttttttgaaccatctagctcagtactcagacgaaaatatgatggatccttacaacctcgccgtttgcttcggtcccaccttgctcccagttccagccgggcaggatccagtggcactccagggacgcgtgaaccagcttgttcaaaccctaatcgttcaacccgatcgggtgtttccacctctgacttctcttccaggcccagtgtacgaaaagtgtatggcccctccttctgcctcatgcctgggcgacgcccagttagaatccctaggagcagacaatgagcccgagctggaagccgagatgcccgcgcaggaagatgaccttgagggtgtggtcgaggccgtggcatgtttcgcctatacaggaagaaccgcgcaggagctgagttttcgccgcggtgatgtgctgcgtttgcatgaacgggcttcgtcagattggtggcggggagagcacaacgggatgcgggggctgatcccccacaagtatattactctcccagcgggtaccgaaaaacaggttgttggtgcaggccttcagacagcaggggaatctggatcctcacctgagggcctgctggccagtgagctagtccaccgacccgaaccttgcacttctccggaagcaatgggcccatcaggccatcgccggcgttgccttgtgcccgccagcccagagcaacacgttgaggtcgacaaggctgttgcacagaatatggactcggtgttcaaggagttgctgggtaagacctcggtgagacaggggctgggcccagctagtacaacaagtcccagccctggtcctcgcagccccaaagccccccccagttcgagattagggaggaataagggattctcccggggacccggagcccccgcttcacccagcgcatctcaccctcagggacttgacaccacccccaagccacactag

SEQ ID NO: 45545 - DNA, 2961 bp, Artificial Sequence
  Description of Artificial Sequence: Synthetic coding sequence
atggccgcccacggcaagctgcggcgggagcggggcctgcaggccgaatatgaaacccaagttaaggagatgcggtggcagctgtccgaacagctcagatgtctggagcttcagggcgagttgagaagagagctgctgcaagagctggccgagttcatgcgtaggcgggcagaggtcgagctcgaatactctagggggctggagaaacttgcggagcggtttagttcccgggggggcagactgggctcctctagagaacatcagtctttcagaaaagaacctagtctactgtcccctctgcattgctgggccgtgctacttcagcatactcgacagcagtctcgggagtcagccgcactcagcgaggttctggctggtcctcttgcacaacgtctttcccatatcgctgaagatgtgggaagacttgtgaaaaaaagtcgtgatctggaacagcagttgcaagatgaattactggaggttgtgagcgaactacaaacagccaagaagacctatcaggcctaccatatggaaagcgtgaacgctgaggcaaaactccgggaggccgagcgccaggaggaaaagcgggcaggccgcagtgtgccaactaccactgccggtgccacagaagctggacctctacgtaaatccagcctaaagaaaggtggacgccttgtggagaagctttggcccccacaaaggcctgtggcggcctcctcctgcgctcccgtttgctggctgcaggccggcttcctcgtacaccccccttggtggggggctatgtgtgcccccagcactcatcaacggcaggctaagttcatggaacacaagctcaaatgtactaaagcgcgcaatgaatacctgctctcattggccagcgtaaatgcagctgtcagcaattattatctacatgatgtcctggatcttatggattgttgcgacaccggctttcacctcgcactaggtcaagtactccgctcgtataccgctgctgagtcgaggacccaggcatcccaggttcagggactgggcagtctggaggaagcagttgaggctctagatcccccaggtgacaaagctaaggtcctggaggtgcatgccacagtgttttgtccacctctcaggtttgattatcatccgcacgatggcgacgaagtggccgagatctgtgtggaaatggaactgcgcgatgagatattgccccgggcccagaatattcaaagccgactcgacaggcagacaatagagacggaggaagtcaataagactctgaaagctaccctgcaggctttgctcgaagtggtcgcgagtgacgatggtgacgtgctcgactcttttcaaacgtctccctcaacggagtccctgaagtccaccagttcagaccccggctctcggcaggccgggaggaggcgtggtcagcagcaggagactgagaccttttatttgactaagctgcaggagtatttatctggaaggtcgattttagccaagttgcaagctaagcacgaaaagctgcaggaggccttgcaacgtggggacaaggaggagcaggaagttagctggactcagtatacacagcgcaaattccagaaatcaagacaacctagaccatcatctcaatacaatcagcgtctgtttggcggagatatggaaaagttcatccagtccagtggccagccagtgccactggtcgtagagtcttgtattaggttcattaacctcaacgggctgcaacacgagggtattttccgggtgtccggggcacaactgagagtgtccgagatcagagacgcctttgaaagaggtgaggatcccctggttgaaggatgcacagcacacgatctggactctgttgctggcgtcctgaagctgtatttccgcagtctggaaccgcccctgttccctccagacctgttcggagagctgttagcatcctccgagcttgaggccaccgccgaacgcgtggaacatgtgtctcgactactgtggcgtctgccagctcctgtgctggtcgtattgcgctatttgtttaccttcctcaatcatcttgcgcagtatagcgacgagaatatgatggatccatataatttagccgtttgctttggacccacacttctccccgtgcctgccggacaggaccccgtcgcccttcaaggaagagtgaaccagctcgtgcagaccctaatcgtgcagcccgatcgcgtgttccctccgcttacctctctaccaggccctgtgtacgaaaagtgtatggcccccccctccgcttcatgcctgggagacgcgcaattggagagcctaggcgccgacaatgagccggaactagaggctgagatgcctgcgcaggaggatgatttagagggagtggtagaagccgtggcttgtttcgcctacaccgggcggacagcacaggagctgagcttccgtcgcggggatgtcctgaggttacacgaaagagcaagcagtgattggtggcgaggcgagcataatggcatgagaggacttatcccgcacaagtatataacactgccagccggaactgaaaaacaggtagtcggtgcgggcctccagactgcaggtgaaagcggatccagcccggaaggcttgctggcgtccgagctcgtccatcgaccagagccctgcacctcccccgaagccatggggccctccgggcataggagacgttgtctggttcctgccagccctgagcaacacgttgaggtggacaaagctgtggcacagaacatggattcagtgtttaaggagctcctgggcaaaacttccgtccggcaggggctgggtcccgcgtccaccacctccccatcaccaggaccacggtcgccaaaggcacctccaagttcccgcctgggccgtaataagggcttttctaggggaccaggcgcgcccgcgagtcccagcgcttcccacccacagggcctggatacaacgcctaagccacattag

SEQ ID NO: 45546 - DNA, 2307 bp, Artificial Sequence
  Description of Artificial Sequence: Synthetic coding sequence
atggccgcccacggcaagctgcggcgggagcggggcctgcaggccgagtacgagactcaggtgaaggaaatgcgctggcagttgagcgagcaacttagatgtctggaactgcaaggcgagcttcgtcgagaactgctgcaagagttagcggagttcatgagacggcgtgccgaagtggagctcgagtacagcaggggactggaaaagctggctgagcggttcagcagccgtgggggcaggttaggcagcagtcgggagcatcagagcttcaggaaggagccaagcctcctgtcccctctgcattgttgggcagttctgctccagcatacccgacagcagagtcgggaatccgcagctttgagcgaggtgctagcaggccctttggcacagagactgagccacatcgccgaggatgtcggccgcctggtgaaaaaatctcgggaccttgagcagcaacttcaggacgaactcttggaagtagtctctgaactgcagactgtggcagaaatctgtgtggagatggagctgagagacgagatactcccacgggcccaaaatatacaatcacgcctggatagacagactatagagaccgaagaggtgaataaaacccttaaagcgacgttgcaggcgctactggaggtcgttgcatcagatgatggggatgtgctggactctttccagacgagcccttcaaccgaatccctgaagtccacgtcctctgatccgggatcgcgccaggccggtagaagacggggacagcagcaggaaacggagacattctatctcaccaagctgcaggagtacctgtcagggcggtctattttggcaaaattgcaggcgaaacacgaaaagctgcaggaggcactgcagcgaggggataaagaggagcaagaggtcagctggacacaatatacgcagcggaaattccagaaatctcggcagccccgccctagtagtcagtataaccagaggctgttcgggggggacatggaaaagttcatccaaagctcggggcaacccgtgccccttgtcgttgagagctgcattaggtttatcaatcttaatgggctccagcatgaaggaatctttcgggtgtctggcgcacagctacgggtgtctgagatcagggatgctttcgaacgcggcgaggatccgctggtggaagggtgcacagcccacgacctggacagcgtagcaggagtgcttaagctctactttagatctctggaaccacctctgttccctccggatctgttcggagagttgctggcctcgtccgagctggaggcaaccgcggaacgtgtggaacacgtgtctagactgctctggcgccttccggctcctgtgctggtggtccttcggtatctctttacctttctgaatcacttagctcagtacagcgatgagaacatgatggacccttataacctcgcggtgtgtttcggtcccaccttgttgccggtaccagcaggtcaggatcccgtggccctccagggcagggttaaccagctggtccagaccctaattgtgcagcccgatagggtatttccacccctgacgtcactgccaggccccgtgtacgagaagtgcatggcccctccttctgcctcttgcttaggtgacgctcagctggagagtcttggggctgacaatgagccagaactcgaggcagagatgccggcacaggaggatgacctggagggggtggtggaagccgtagcctgttttgcttacactggtcgcaccgcacaggaactttccttccggaggggcgacgtgctcaggctgcatgaacgcgcttccagcgactggtggaggggcgagcacaacggaatgcgtggcctgattccccacaagtacatcacactcccagccggcacagagaagcaggtggtaggagccggtttgcagaccgcaggcgagagcggatcaagtcctgaaggccttctcgcgtccgagctcgtgcaccgtccagaaccctgcacctcccccgaagcaatggggccatctggccacaggcggaggtgtctggtgcctgcctcacccgagcaacatgtggaggtggacaaagccgtggctcagaacatggactccgtctttaaagagctcctcggaaaaacatctgtcagacagggcctaggaccagctagtacgacctcacccagcccagggcctagaagccccaaagccccaccctctagccggttaggacggaacaaaggcttctctagggggcctggcgctcccgcctcaccttccgccagccatcctcagggattggacactacgcctaaaccacactag

SEQ ID NO: 45547 - DNA, 2772 bp, Artificial Sequence
  Description of Artificial Sequence: Synthetic coding sequence
atgcggtggcagctgagcgagcagctgcggtgcctggagctgcagggggaactgcggagagagctgttacaggagctagctgaatttatgcgcagacgtgccgaggtggagctggaatatagccggggcctggaaaagcttgcagagcggtttagctctcggggcggtaggctcggcagttccagagaacatcagagctttcgcaaggagcccagtcttctgtcccccctgcattgttgggccgtgctcctgcagcacacacggcaacagtctagagaatcagccgcactcagcgaggtactcgcgggaccactagctcagagattaagccatatcgctgaagatgtgggacggctggtcaagaaaagcagagatctcgagcagcaactgcaggacgaactgttggaagtggtttcagagctccaaactgctaagaaaacctaccaagcttaccacatggagagcgttaatgctgaggccaagcttagagaagccgagcgacaagaggagaagcgagccgggcggtctgtgcccaccacaactgccggggcgacagaagctggacctttgcgaaaatccagcctgaagaaaggcggcaggttagtggagaaacgccaggctaaattcatggaacacaaactcaaatgcaccaaggcccgtaatgagtacctgctcagcttggcttccgtgaacgctgcggtttcgaactattacctgcacgacgtcctggacctcatggattgctgtgacacaggcttccacctggctctcggccaggtccttcgcagttacacagctgccgagagtagaactcaggcctcccaggtgcaaggactgggaagtttggaggaagcagtcgaggccctcgacccccctggtgataaggcaaaggtacttgaggtccatgccacagttttttgccctccactgaggttcgattaccatccccatgatggagacgaggtggctgaaatctgcgtcgaaatggagctgcgtgacgagatactcccccgcgcccagaacattcagtctaggctagaccggcagactatagagactgaagaagttaataaaaccctgaaggcaaccttgcaggccctactcgaagtggtggcttccgacgatggagatgtgctcgacagtttccagacaagcccttccaccgagagccttaaatccacttcctccgatcctggctctcggcaagccggccgcaggcggggacagcagcaagagacagaaaccttctacctgaccaagctgcaggaatatctctcaggtaggagtattctggctaaactccaggccaagcacgagaagctgcaagaggctctgcagcgcggcgataaggaagagcaggaagtgtcatggacacagtatactcagcggaagtttcagaaaagtcgtcaacctcgcccctcttcccagtacaatcagcgcctgttcggtggagatatggaaaaatttattcagtctagtggtcaacccgtcccactggtggtcgagagctgtatcaggttcatcaacctgaacggactccagcatgaaggaattttccgcgtgagcggcgctcagctcagagtctccgaaatcagagatgccttcgaacgtggggaggacccgctcgttgaagggtgcaccgcccatgacctggattccgtggccggcgtccttaaactctacttccggagcctcgagccgcctttatttccaccagatctgttcggggaactgctagctagcagtgaattggaagcgacagcggagcgggtggaacacgtctcccggttgctgtggaggctcccagctcctgtcctcgttgtactgcgatacctgttcacctttctgaatcacttagcccagtatagtgacgagaacatgatggatccatacaatctcgcagtttgtttcgggccaaccctccttcccgtgcccgcaggacaggatccagtagctctgcaaggaagagtgaatcagctggttcagacacttatagtgcagcccgatagggtgtttcctcccctgacgagccttccagggcctgtgtatgagaagtgcatggcccccccctcagccagctgcctcggggacgcccagcttgagagtttgggagcagataatgagcctgagctcgaggcggagatgcctgcacaggaagacgacctcgaaggtgtcgtggaagccgtcgcctgctttgcttataccgggcggaccgcacaagagttgtccttccggaggggcgacgtacttaggctccacgagagagcttcctctgattggtggagaggcgagcataacggtatgcgcggtcttataccgcataaatacatcacgttgccagccggtacggaaaaacaagttgtgggggctgggctgcagacagccggggaatcgggctcctctcctgaaggcctcctagcttccgagcttgttcacagaccagagccctgtaccagccccgaggccatgggaccctccggccataggagacgctgtctcgtgccggcttctccggagcagcacgtcgaggttgacaaggcggttgctcagaacatggacagtgtcttcaaggaactgctgggcaaaacaagtgtgcgtcaggggttggggcctgcatctaccacctccccttccccaggccctcggagtcccaaagcaccccccagtagcagacttgggagaaacaaaggcttctcaagggggccgggcgcaccagcatcacccagcgctagtcatccacagggtctggacaccacacccaagccacattag

SEQ ID NO: 45548 - DNA, 2817 bp, Artificial Sequence
  Description of Artificial Sequence: Synthetic coding sequence
atgttccggcggcggacctgcggcaccgaggccagcctgcggtggtcccattctagccgatctgaaattcgccttggtcggagtgagtccctgaagggacgggaagagatgaagcgctcacggaaagccgaaaacgtcccccggtcgcggtccgacgtggacatggacgctgccgccgaggccaccagactgcaccagtctgcttctagctcaacatcttccctctcaacccggtcgctcgaaaatccaactcccccatttacccccaaaatgggtcgtcgctccattgagagtccatccctaggcttctgtacagacacattactgccacatcttctagaagacgacctgggccagctgtccgatttggagcctgagcccgacgcccagaactggcaacacactgtcggaaaagatgttgtggcaggtctcactcagcgggaaatcgatagacaggaggtgataaacgaacttttcgtgaccgaagcttcccacctgaggacactgagggtgctagaccttatattctatcaacgcatgaaaaaggagaacttgatgcctagggaagagctcgccagactgttccctaatctgccagagcttattgaaatacacaactcatggtgtgaggccatgaagaaactgcgcgaggagggtcccatcattaaggagattagtgacttgatgctggcacgatttgacgggcctgcccgcgaagaattacagcaggtcgctgctcagttctgctcttaccagagcattgcgctggagctgataaagacaaagcaaaggaaggaaagtcgattccaactctttatgcaggaggcagaaagtcacccccaatgccgtaggctgcaactgcgcgatctcatcatttcggaaatgcagaggctcacaaaatacccgctcctgctggagtccattataaaacatacggagggcggaacctcagaacatgaaaagctttgtcgggccagagatcagtgccgcgagatactcaagtacgtgaatgaggctgtgaagcagacagagaatcgccataggttggagggctaccagaaacgcctcgacgctacagctttggagagggctagtaatcccctggcagccgaattcaagtctctggacctcaccacaaggaagatgatacacgagggacctctgacctggagaatcagtaaggataagacattagatttacatgtgctcctgttagaagacttgctggtcttactccagaaacaggacgagaagctgcttctaaaatgccactccaagacggccgtggggtctagcgactccaagcaaacttttagtccagtgctgaagctgaacgcggttttgataaggagtgtagcaactgataagagagcctttttcatcatctgcacaagcaaactggggccacctcaaatctatgagctggtggctcttacctcttctgacaagaatacatggatggagcttcttgaagaagccgtgcggaacgcaactaggcatcctggagctgcccccatgcctgtccatccgccacccccaggaccaagagaaccagcgcagcagggcccaacgcctagccgtgtggaactggatgatagtgatgtgttccacggggaacccgaaccagaagaactccccggcggtaccggttcccagcagcgtgtccaagggaagcatcaggtgcttctagaggacccagaacaggaaggatcagccgaagaagaggaactgggagtccttccatgtccatcgacatctctggacggggagaatcgcggaattaggactaggaatcccatacatctggcttttcctggccctttgtttatggaggggctggctgattccgccctggaggatgtcgaaaatctccggcacttgatcttatggtccctgctcccaggccacacaatggagacccaagccgcgcaggaaccagaggacgaccttactcccacaccgtccgtcatttccgttacttcccacccatgggacccagggtcccctggccaggcgccccccgggggtgagggagacaatacacagcttgcaggtcttgagggcgagagacccgagcaagaggacatgggcctgtgttctctggagcacctgccaccacggacccgtaattccggcatctgggaatccccagagctggacagaaacctggccgaggacgcttcaagtaccgaagccgcgggagggtataaggtggtgagaaaagccgaagtggctggtagcaaggtggtccctgcacttcccgaatcgggacaaagcgagcccgggccaccagaggtggaaggcggtaccaaggccactgggaattgcttctatgtttcaatgccatctggcccccccgactcatccaccgatcactcagaagcgccgatgtcccctccgcagcctgactcccttccagcaggccagacagagccgcaacctcagctgcagggaggaaatgacgatccccggcgcccatctaggtctccgcctagcttggccctacgggatgtaggcatgatattccacactatcgagcagctgacgttgaaactgaatcgcctgaaagacatggagctggctcacagagagctgctcaaatccctggggggagaatcttcaggtggcaccacacccgtgggcagtttccatacggaggcagcccggtggactgatggaagcctgtccccccccgcgaaggagcctcttgcttccgattctaggaatagccatgaactgggaccctgccccgaggatggcagcgacgccccactggaggactccacagcagacgctgctgcctcacccggtccctag

SEQ ID NO: 45549 - DNA, 4569 bp, Artificial Sequence
  Description of Artificial Sequence: Synthetic coding sequence
atgagcgtgcggctgccccagagcatcgaccggctgagcagcctgagcagcttaggcgattccgctcccgagcgcaaatcgcctagtcatcaccgccagccatccgatgcttccgaaaccaccgggctggtgcaacggtgtgtgattatccagaaggaccagcacgggttcgggttcactgtaagtggggaccggatcgtgttagtacagtctgttaggcccggtggcgcagctatgaaggccggggtcaaggaaggcgacagaataattaaggtgaatgggaccatggtgactaacagcagccatcttgaagtggtgaaactgataaagtctggagcctatgtggccctgaccttattaggtagctctccaagcagcatgggtatatccggactgcagcaggatccttcacctgccggagcgcccagaatcacctccgtgatcccatctccacctccacctccgccattgcctccaccccagcgcattactggtccaaagcccttgcaggaccccgaggttcagaaacacgccacgcagattttacggaacatgctaaggcaagaagagaaggagctccaggatatcctcccactgtacggggatacgagccagcgtccttcagaagggagactttctctagattcgcaggaaggcgactccggtttggatagcggaactgagagattcccgtccctgtccgagtcgcttatgaatcgcaactcggtgctctctgatcctggcctggactcccctcgcaccagccctgtcatcatggccagggttgcccaacatcaccgaagacagggttcagacgccgccgtccctagcaccggggatcaaggggtggaccagtcccctaagcccctgatcatcgggccggaggaagactacgaccccggctacttcaataatgagagcgatatcatctttcaggacctggagaagttaaagtctcggccagctcatcttggggtcttcttgaggtatatcttcagccaggcagatcctagccccctgctgttttatctctgtgcagaggtgtatcagcaggcaagcccaaaagacagcaggtccctggggaaggacatctggaacatcttcctcgagaaaaatgccccactcagggtcaagatcccggagatgctacaggctgaaatcgatagccggctgaggaactcggaagatgctcgcggagttctgtgtgaggcacaggaggcagcgatgcctgagattcaagaacagatccacgactataggaccaagagaactctgggtctcgggagtctttatggcgagaacgatttattagatttggatggagaccctctgagggaacgccaggtggctgaaaagcaactggcagcccttggagacatcctttctaagtacgaggaggatcgctcagcccctatggattttgctttgaatacttatatgagtcacgctggaatcaggctgagagaggcacggccgtcaaacaccgcagagaaggcgcagagcgctccagacaaggataagtggttgccttttttcccgaaaactaagaaatcatctaattcgaaaaaggaaaaagacgccctggaagataagaagcgaaatccaatcctaaagtatattggcaagcctaagtcgtcatcacagagcacttttcatattcctctgtctcccgtcgaagtgaagcccggtaacgtgaggaacattatacagcattttgaaaataatcagcagtatgatgctcccgagccagggactcagagattgtcaaccggctcttttccagaggacctcctggagtctgactcatctagatccgaaattcgcctgggtagatccgagagcctgaaaggtagagaggaaatgaagcggagccgcaaagctgagaatgtcccccggtcacggagtgatgtagatatggacgcagcagcagaggcgacccgtttgcaccaaagcgcatcaagcagcacctctagcctctctactcggtccttggagaaccctacccctcccttcaccccgaagatggggcggcgctctattgagtctccatccctgggtttttgtacagatactctcctaccacacctcttggaggatgacctcggtcagttaagcgacctagaaccagaacccgacgctcagaattggcaacacaccgtggggaaagacgtggttgctggcctgactcagcgcgaaatcgatcgacaggaggttattaatgaactctttgtcactgaggcctcacatcttcggactctgcgtgtgcttgatcttattttttatcaaaggatgaaaaaggagaacctaatgccgcgtgaggagctagcaagactcttccccaacttgcctgaattgatcgagatccataattcgtggtgtgaggccatgaaaaagctacgggaagagggacctatcataaaggagatctctgatttgatgctcgcacgcttcgacgggcccgctagagaagaactgcaacaggttgcggctcagttttgttcttaccagtccatcgcactcgagctgatcaaaacaaagcaaagaaaggaatctagatttcaacttttcatgcaggaggccgaatctcacccccagtgtcgtcggctgcaattacgcgacctcataatcagcgaaatgcaaagattgaccaagtatcctctcctccttgagtctatcatcaagcacaccgagggggggacttccgaacatgagaagctttgcagagccagggaccagtgcagagaaatacttaagtatgtgaatgaggccgtgaagcagaccgagaatcgtcatcgacttgagggttaccagaagcgattggacgccactgccttggaacgcgcgtcaaatcctctggctgcagagtttaagtctctggatttgaccaccagaaagatgatccacgagggcccactgacttggagaatctccaaggacaagaccctggaccttcatgtgctgctcctggaagacctgttagtgttattgcaaaaacaggatgaaaagctgctcctcaagtgtcatagcaaaacggctgtgggatcatccgattccaagcagactttctcccccgtgctgaagctgaacgcggtgctcataagatcagtcgcaacagacaaacgggctttctttatcatttgcaccagtaaactcggacccccgcagatatacgaattggtggccttgacaagtagcgacaagaacacttggatggaactcctggaggaggcagtgcgcaacgcgacgaggcatccgggggcagcaccaatgcctgtgcaccctccgcccccgggcccccgtgagccagcgcagcaaggtcctaccccctctcgggtcgagcttgatgactcagacgtctttcatggcgagcccgagcccgaggaactccccggaggcaccggaagtcagcagagagtccagggcaagcaccaggtcctcctggaggatcccgagcaagaaggctctgctgaggaggaggaactcggcgtgctgccatgcccaagcaccagcctggacggcgagaatcggggcatccgaacccggaacccaatccatctggcttttcctggcccactcttcatggaaggactggccgatagcgcactggaggacgtagaaaatctccggcatctcatcctgtggtcccttcttccagggcatacaatggaaacacaggccgcccaagagccagaggacgaccttacacctactccaagcgtcatcagtgtgacctcccacccctgggatcccggcagccctgggcaggctcccccaggcggcgagggtgataacactcagctggccggtttagagggagagaggccagagcaggaagacatgggcctctgctccctggagcatctccctcctagaacccggaacagcggaatttgggagtccccagaactggaccggaaccttgctgaggacgcttccagcactgaagccgccggcggctataaagtcgtgcgcaaggccgaagtagcaggttctaaagtcgtgcccgcacttcccgagagtggacagtcggagcctggtccccccgaggtcgagggtgggaccaaggcaacgggcaactgtttctacgtcagcatgccatccgggcctccggattcttcaactgatcatagcgaagctccaatgtcccctcctcaaccagattccctgcccgccggccaaacagagccccagccccagctgcagggcggcaatgacgacccacgccgccctagcagaagccctccttctcttgccctgagggacgtggggatgatctttcacactatcgagcagctcactctgaagctcaacagactgaaggacatggagctagcccatcgagagctcctgaaatccttagggggggagagttccggcggcaccacaccggttggaagctttcataccgaggccgcaagatggacagacgggagcctgagccctccggctaaggaaccactggcgtcggacagtcgtaatagccacgaattgggcccatgcccggaagacggctctgatgcccctctggaagactcaacagcagatgccgccgccagtcccggcccctag

SEQ ID NO: 45550 - DNA, 4689 bp, Artificial Sequence
  Description of Artificial Sequence: Synthetic coding sequence
atgagcgtgcggctgccccagagcatcgaccggctgagcagcctgtcctccctcggcgattccgctccagaacgtaagtctcctagtcaccaccggcagccctccgacgccagcgagacaactggcttggtccagaggtgcgttatcatccagaaggatcaacatggctttggatttaccgtgtccggggacagaatcgtgctcgtgcagtccgtgcgacctggcggagcagctatgaaagcgggagtgaaggaaggcgacagaattattaaagtgaacggaacaatggtaacaaattccagccatttagaagtggttaagcttattaaaagcggcgcgtacgtggcactgaccctgctgggttccagcccaagctctatggggatctccggccttcagcaagaccccagccctgctggagcaccacgcataactagcgttatcccatcccctcctcctccccctcccctacctcccccacagcgaatcactggaccaaaaccgctgcaagacccggaggtgcagaagcatgcaactcagatacttcgaaacatgttgagacaggaggaaaaagaattacagaggatatgtgaggtttacagccggaatccagcgagtctacttgaggagcagatagaaggcgccagaaggcgggtgactcagcttcagctgaagattcagcaggagactggagggagtgtagacatactacctctgtatggcgacacctcccagcgcccttctgagggcaggctgagcctcgactcacaagaaggtgatagcggactggatagtggaaccgagcgctttcctagcctctccgagagccttatgaatagaaactcagtgctgagcgaccctggattggattctccccgcacgtctcctgtgattatggccagggtggctcaacaccaccggaggcaagggtcagacgccgcagttcctagcaccggagatcagggagtagaccaatctcccaaacccctgattataggcccggaggaggattacgaccccggttattttaataatgagagcgatatcatctttcaagacttagagaaattgaagtccaggcctgcacacttgggtgtgttcctgaggtatatcttcagtcaggccgatccttcccccctgcttttttacctttgcgcagaagtgtaccagcaggcgtccccaaaggactctagatccctgggcaaggatatctggaatatatttctggagaagaacgctccgctccgggtgaagataccagagatgctccaggctgaaatcgactctaggcttcggaattctgaagacgctagaggggtactctgcgaggcccaggaagctgccatgccggagatccaggagcagattcatgattaccggaccaagcgcacgctgggactgggcagcctttacggcgagaatgacctcttggaccttgacggagatccactaagagagaggcaggtagccgaaaaacagctagcagccctaggcgacatcttgtctaaatatgaggaagataggagcgccccaatggacttcgccctgaacacttacatgagtcacgctggcatacggttacgcgaggctcggccttcaaacactgctgaaaaagcccagtctgcaccggacaaggacaaatggctgccttttttccccaaaaccaagaaatcttcgaactccaagaaagagaaagatgcactggaagataagaaacggaaccctatcctgaagtatattggcaaacctaagtcctcatctcagtctactttccacatcccactttcacccgtcgaggtgaagcctggtaacgtgagaaatatcattcagcattttgagaataatcagcagtacgacgccccggagcccggaacgcaaaggctctccaccggcagttttcccgaggatctgctggaaagcgactcaagtaggtccgaaatcagactggggcggtcagaaagtctgaagggccgcgaagagatgaaaaggtccagaaaagctgaaaacgttcctagatcccgcagcgatgttgacatggatgccgcggccgaggctactaggctgcaccagagtgcaagctcctctactagttcactgtcaacccggagccttgagaatcctacccccccttttaccccaaaaatggggaggaggagcatcgagagccccagcttgggattctgcaccgatacacttctccctcatctgctcgaagacgacctgggacagctcagtgacctcgagccagaacctgatgcccagaactggcaacacaccgttggcaaggacgtcgtcgccggacttacccagagggaaatagacaggcaggaggtcattaacgagctgttcgtcaccgaagcaagccacctcagaacactgagagtcctggatctcatcttttatcagcggatgaagaaggagaatctcatgcctagagaagagttggcccgcctcttccccaacttacccgagctgattgaaatacacaactcctggtgtgaggctatgaaaaaactgagggaagaagggcccattataaaagagattagcgacctcatgctggctagatttgacggtccagctagagaagagctccagcaggtcgctgcccaattttgcagttaccagagcatcgccctggagttgatcaagacaaagcagcgcaaggaaagccggttccagctgttcatgcaggaagccgagagccatccccagtgccgccgcctgcagctacgtgacctgattatttcggaaatgcagcgacttactaaatatccgctgcttctggagtctattatcaagcatactgagggcggcacgagcgagcacgagaaattgtgtcgcgccagagatcaatgcagggaaattcttaaatatgtaaacgaagcagtgaagcagaccgagaatcgacacagactggaagggtatcaaaagaggctggatgcaaccgccctcgagcgggcatcaaatccactagcagccgaatttaagagccttgacctcaccacacgcaagatgatccacgagggccctttgacctggcgtatctccaaggataaaacccttgatctgcacgttctgctgttagaggacctgttggtgcttcttcagaagcaggatgaaaaacttctgctcaaatgccactccaagacagccgttggatcatctgactcaaaacagaccttctcccccgtattgaagctgaatgctgttctgataaggtctgtcgcaactgataaaagagcttttttcattatctgcaccagcaaattgggacctcctcagatatacgaactagtcgctttaacctcctccgataagaatacatggatggagctcctggaggaagctgtgaggaatgccacgcgtcacccaggcgccgctcccatgccagttcaccctcccccacctggtccaagggagccagctcagcaaggcccaaccccaagcagggtagaactggatgactctgatgtttttcacggggaacctgagccagaggaacttccaggagggacgggctcacagcagagggtgcagggcaagcatcaggtccttctcgaggatcctgagcaggagggctctgccgaggaggaagaactcggcgtgctgccctgtccaagcacatccttggatggcgaaaatagaggcatccgaactaggaaccccattcaccttgcttttccgggccccctgtttatggaaggtctcgcagacagcgcccttgaagacgtggaaaacctgagacatctgattctgtggagtttgctgcctggccacaccatggagacacaagccgcccaagagccggaggacgacctcaccccaacgccaagcgtcatctccgtcacttcccacccttgggaccctggttccccaggccaagcaccaccagggggggaaggtgacaatactcaactcgccggactggagggagagaggccagaacaggaggacatgggcctttgcagcctggaacacttaccccctcgcacccgcaattcagggatttgggaaagtccagagttggaccgaaacctcgcagaagacgcctcatccacggaagccgctggaggttataaggtcgtgcggaaagccgaggtggccggctctaaggtcgtccccgcccttcccgagtcaggacagtccgagccaggtccgccggaagttgaaggggggacaaaagccactggcaattgcttctacgtgagcatgcctagcgggccccccgacagctccactgaccacagtgaagctcctatgtcgcctccccagcctgattcgctgcctgccggtcaaaccgagcctcagccccagctgcagggtggtaacgacgaccctagacgcccttctagatcccccccttccctggctttgcgggacgtgggcatgattttccacactattgagcaactgacactcaaactgaaccgattgaaagacatggagctggcccatagagagctgctgaagagcctcggcggagagtcgagcggcggcaccactcccgtgggtagttttcatactgaggccgcccgctggacagatggttctctgagtcccccggcaaaggagcccctggcatcagactcccgcaattctcacgagctggggccatgcccggaagacgggtctgatgcgcctctggaggactccaccgccgacgctgctgcctctcccggtccttag

SEQ ID NO: 45551 - DNA, 1743 bp, Artificial Sequence
  Description of Artificial Sequence: Synthetic coding sequence
atgcggggcggccacaagggcggccggtgcgcctgcccccgggtgatccggaaagtccttgccaagtgcggatgttgttttgcgagaggaggtcgggagtcctactccatagcaggctctgaagggagcatttcagcatctgccgcctcgggcctcgccgcgcccagcggtccttcctctggactctctagtggtccatgttctcctggccctccaggtcccgtaagtggtctgaggaggtggctggatcactccaagcattgtctgagtgtggagactgaagctgacagcggacaggcaggcccttacgagaactggatgctggagccggcacttgctaccggtgaggagttacctgaactgacgctgctgacaactctcctcgagggacctggggataagacccagccaccagaggaggagaccctcagtcaagctcccgagagcgaagaggaacagaaaaagaaggcattggaacgcagtatgtatgtgctgtccgaactcgttgagacggagaaaatgtatgtcgatgacttgggccagatcgtggagggctacatggctactatggctgctcagggagtcccagaaagcctgagaggcagggatagaattgtgttcggaaacatccaacaaatctatgagtggcacagagactatttcctgcaggaactccagagatgtttgaaagacccagactggcttgctcaactctttattaagcacgagagaagactccatatgtatgtggtgtattgtcagaataagcccaagagcgagcatgttgtgtctgagtttggtgacagctacttcgaggagctccgacagcagttggggcatcgcctccagctgaatgacctcctgatcaagccggttcagagaattatgaagtaccagttgctgctgaaagacttcctcaagtactataatagggctggcatggacacggcagacctggaacaggctgttgaagtaatgtgtttcgtacccaaacggtgcaatgacatgatgacactggggaggttgcgcggctttgaagggaagttgaccgcgcagggcaagctgctgggccaggatacgttctgggtgaccgaaccggaggcaggaggtctgctgagcagtcgtggtagggaacgccgcgtcttcctgttcgagcagatcataatttttagtgaagccctgggaggtggagtgagagggggtacgcaaccaggatatgtgtacaaaaatagcatcaaagtctcatgcctcgggctagaagggaatctccagggtgacccgtgcagatttgcactcacttcgcgcggacccgaggggggaatccagaggtacgtgctgcaagctgccgacccggcgatttcgcaagcctggatcaaacacgtggcccagatcctggagtctcagagagatttcctgaacgctctccaaagtcccattgaatatcagcgcagggagtcacagacaaactcccttggacgcccccgcggaccaggcgtggggagtcctggaaggatccagctgggcgaccaggctcagggatcgacccatacccccattaacggtagtcttccctctttattgttatctccaaagggcgaggtggctagggcgttgcttccgctcgataagcaggcccttggtgacattccccaggcacctcacgattctccaccagtaagtccaactccaaagacccctccttgccaggcccgcctggccaagctggatgaggatgagctgtag

SEQ ID NO: 45552 - DNA, 921 bp, Artificial Sequence
  Description of Artificial Sequence: Synthetic coding sequence
atgcggagcagccccggcctgtgcagccccccccccgaggaggagacactgtcccaagcacccgaatccgaggaggaacaaaaaaaaaaggccctggagcgatccatgtacgtgctgtcagagttagtggagacagaaaagatgtacgttgacgacctcggccagattgtggagggttacatggccactatggccgcacaaggtgtcccagagagcctgagaggacgggatcggatcgtgttcggtaatatccagcagatctatgaatggcaccgggattactttctgcaagagctacagagatgcctgaaggaccctgattggttagcccaacttttcataaagcacgaacgacgtctacatatgtatgttgtctattgccagaacaaacccaagagcgagcatgtggtctcagaatttggggacagctacttcgaagagctcagacaacaactgggccatagattgcagcttaacgacctcctgattaaacctgtacaacggattatgaaatatcagctcctgctgaaagacttcttgaaatactacaacagagctggcatggataccgccgatctggagggtaaactaaccgcacagggcaaactcctggggcaggataccttctgggtcacggagcccgaagctggggggctgttgtcctcacggggccgagaaaggcgcgtttttctgttcgaacagataattatcttttctgaggcgcttggggggggggtgcgcggtggaactcagcctgggtacgtttataaaaactctatgagacaagtgttctgccagatgcaagagttgccccagctatggcatatctcaagagttgactttgtgcgcaacgcgataaccccacgacttccacctctgattttgttggcaagcccagcctctgccctgaatcagacgtag

SEQ ID NO: 45553 - DNA, 1860 bp, Artificial Sequence
  Description of Artificial Sequence: Synthetic coding sequence
atgaagccccccgaccggcccgcccccggccggaccgaccggatccttggagtaatgggtgggatgctgagagcttgcgcgctccccgggcaagagggaccccctagacgcagccccctgggccttgtaggtactgagcctgaatccgagaggacggaaggcgaccaccgccgggatagggagcatgaggtattagccggagctctgcagccggagtcctattcaattgcaggaagcgagggaagcatatccgcctcggctgcatctggactggccgcaccctcaggaccttcctccgggctgagttctgggccctgctcacccgggcccccaggaccagttagtggccttcggcggtggcttgaccattcaaagcactgtctgtctgtggaaaccgaggcggactcaggccaagcaggaccatacgaaaattggatgttagagcccgcactggctaccggcgaagaactgcctgaactgacgctgcttaccacactcttagaaggtcccggggataagacacagcccccagaagaagagaccctgagccaagcaccagaatcagaggaggaacagaaaaaaaaggccttagaacgctctatgtacgttctctctgaactcgttgagacagaaaaaatgtacgtggacgacctgggccagatcgtggaagggtacatggctaccatggcagctcagggcgtgcccgaaagtctgagaggcagagatcgaatagtatttggtaatatccagcaaatctacgaatggcatcgagattatttcctgcaagagctccagcgctgccttaaagaccccgactggctggcacagctttttatcaaacatgagcgacggctccacatgtatgttgtttactgccaaaacaaaccaaagtccgaacacgtggtgagtgaattcggcgactcatactttgaggagttaaggcaacagctgggtcaccgactgcagcttaacgatttgctaatcaaacccgtccagcgcattatgaaatatcagctcctcctgaaggacttcctgaaatactacaatcgcgccgggatggatactgccgatctggagcaagccgtggaggtgatgtgcttcgttcctaaaagatgcaatgacatgatgacacttggccgtctgaggggctttgaaggaaaactgactgctcagggcaagctgctaggtcaggacaccttctgggtgacggaaccagaggcagggggccttctttcttctcgaggccgagagaggagggtgttcctgttcgaacaaattattatcttttccgaagcactcggcggaggcgttagaggaggcacacagcccggttatgtttataagaactccataaaggtgtcctgtctgggtcttgagggcaaccttcagggcgacccctgccggtttgccttgacttcacggggtcctgaaggggggatccaacgctatgtgctccaggctgcagacccagccatctctcaggcctggataaagcatgtggcccagatcttggagagtcagcgagatttcctgaacgccctgcagtctcccattgagtaccagcgcagggagagtcagacaaattccttagggaggcctaggggtccaggcgtgggtagtccaggccgaatccaactgggcgatcaggcgcagggatcgacccacactcctatcaatggttccctgccatcccttctgctaagccccaaaggagaggtggccagggctctcctcccgctcgacaagcaggcattgggggacataccgcaagctccccacgattcccctccagtgtcacctactccaaagacgcccccttgccaggccagactggccaagctggacgaagacgagttgtag

SEQ ID NO: 45554 - DNA, 5064 bp, Artificial Sequence
  Description of Artificial Sequence: Synthetic coding sequence
atggagctgagctgcagcgaggcccccctgtacggccagatgatgatctacgcgaaattcgacaagaacgtatatcttcctgaggacgccgagttctattttacctatgatggttcacatcagcgccacgtgatgatagcggagagaattgaagacaatgttctgcagagttctgtgccaggacacgggctgcaggagacagtgactgtttccgtctgcttgtgctcagaaggatacagtcctgtgaccatggggagtggctccgtaacttacgtggacaatatggcttgcagactcgcaagactgctcgtgacacaggctaaccgcctaactgcatgctcacatcagactttgctcaccccctttgccctgactgccggagctttacctgctctcgatgaggagttagtcttagcacttacacacctggagctgcctctggagtggacagtgcttggatcttcctcgttagaggtgtcaagccaccgcgaaagtcttttacacctcgctatgagatggggactagccaagctgtcccagttcttcctttgcctgccaggtggggtgcaagctctcgccctgcccaatgaggagggcgcgacacctttggacttggccctgcgtgaaggacacagcaagctagtggaagatgttacaaattttcaggggaggtggtctccaagtttcagccgtgttcagttatcggaggaggccagtttgcattatatccatagctcagaaactctaactctgaccctcaaccacaccgctgaacacctgctggaagcggatattaagctgtttcggaagtatttttgggatagagctttcctcgtgaaagcatttgagcctgaggctcggcccgaggagcgaaccgctatgccaagctctggggctgaaactgaagaggagattaaaaatagcgtgagcagccgctccgcagccgaaaaggaggatatcaaacgggtgaaatcccttgtggtccagcataatgaacacgaggatcagcactcactggatctcgacaggtcctttgacatcttgaagaagtcaaaacctccttcgactctgttggcggcggggcggctgagtgatatgctgaacggcggggatgaagtttacgctaactgcatggttatcgaccaggtcggcgacctggacatctcttacataaacatagaagggatcaccgccaccacaagcccagaatccaggggctgtacactgtggcctcaaagctcaaagcacaccttacctacggagacctctccttcagtgtacccattgtcagagaatgtagaaggaacagcacataccgaggctcaacagtcatttatgtcgccgtccagctcctgcgcgagtaatctcaatttatcctttgggtggcacgggtttgaaaaggaacaatctcacctgaagaagagatcctcctctctagatgctctcgacgcagacagtgaaggcgaaggccactcagagcccagccacatttgctatactccaggctcacagtcatcatctagaaccgggattccttcaggcgacgagctggattctttcgaaacaaacaccgagcccgattttaacatctcccgcgcagagtccctgccgttatcatcaaaccttcaaagtaaggaaagccttctctctggggtgaggtctcgctcttattcttgctcaagtccgaagatttcgctcggtaaaacaaggctagtgcgggaactgaccgtgtgcagcagtagtgaggagcaaagagcctactctctgtctgaaccaccccgtgaaaacagaatccaggaagaggaatgggacaaatacattatcccagccaagtcagagagtgaaaagtacaaggtgtcgcgaacttttagcttcctcatgaatcgaatgacctctcctcgcaacaaaagcaagacaaaatcaaaggatgctaaggataaggaaaagctcaacaggcatcagttcgcccccgggacattttctggcgtcctgcagtgcctcgtatgcgacaagactcttctaggaaaggagagtctccagtgctcaaattgcaatgcaaatgtgcataaggggtgcaaagatgccgcacctgcttgcaccaaaaaatttcaggagaagtacaacaagaataaaccccagacaatccttggcaatagcagctttcgcgacataccgcaaccagggcttagcctccacccttcatcatctgtgcccgttgggctccccactgggaggagggagacagtgggacaagtccacccgctgtcgagatcagtacccggcactaccctggaatctttccgtaggagtgcaacctctttggagagcgaaagtgaccacaactcatgtaggtctaggtctcactctgacgagctgttgcaatctatgggttcctccccctccacagagagcttcatcatggaagatgttgtggactcctcactgtggtctgatttgtcctctgatgcccaggaatttgaggcagagtcctggtctctcgtcgtggaccctagtttctgcaacaggcaggagaaggatgtgatcaaacggcaagacgtcatttttgagctgatgcagactgagatgcaccatatccagacgcttttcatcatgtcggagatattccggaagggtatgaaagaggaactgcagttagatcatagcaccgttgataaaatctttccctgcctggacgagctccttgagatccaccggcatttcttttattctatgaaggagaggaggcaggagtcgtgtgcaggttcagaccgcaacttcgtgattgacaggatcggcgacattttagtccagcagttttcagaggagaatgcttccaaaatgaaaaagatatatggcgaattctgctgccaccataaagaggccgtcaatctgtttaaggagctgcagcagaataagaaattccaaaactttattaaactccggaatagcaatttgcttgcaagaaggaggggcatcccggaatgtatcttgctggtgacccagaggataacaaaataccccgttctggtggaacggatcctgcagtacaccaaggaaagaactgaagagcataaagacctgagaaaggcgctgtgcctaattaaagacatgatcgccacagtggatcttaaggttaatgagtatgagaagaatcaaaaatggttggagattctcaacaagatagaaaataagacttataccaagttaaagaatggccatgtgtttcgcaagcaggcactcatgagtgaagagcgaacacttctttatgacggtcttgtgtattggaagactgctactggccgatttaaggacattttagccctcttgctgaccgacgtactgctgtttctgcaggaaaaagaccagaaatacatcttcgcggctgtggaccagaaaccctccgtaatctctctgcagaagcttattgccagggaggtggcgaatgaggagcgtggcatgttccttataagcgcctcctccgccggacctgagatgtatgagatccacacaaatagtaaggaggaacggaataattggatgagacggattcagcaggccgtagagtcctgtcccgaggagaaaggaggccgcacatctgagtccgatgaggataagcgcaaagccgaggcgagggtcgccaaaatccagcagtgccaggagatactcactaatcaggatcagcagatttgtgcatacctcgaggaaaagttgcatatctatgccgagctaggcgagttgagcggcttcgaggacgtgcatcttgaaccccacttgctgatcaagcctgaccccggtgagcctccgcaggcggcaagcctgctggcggctgctctcaaggaagctctggttactggtggtagagagggcagagggtgcagtgacgtcgacccgggcattcaaggggtggtaacagatctggctgttagcgacgcaggcgaaaaggtggaatgtaggaatttccctgggtctagtcagagcgaaattattcaggcgatccagaatctcactcggttgctttattccctccaggcagccctcactatacaggactctcacatcgagattcaccggttagtgctgcagcagcaggagggcctgagccttggccattcaattctacgcggtggtccattacaagatcagaagagccgcgatgcggatcgacagcacgaagaattggctaacgtccatcaactgcaacaccagctccagcaagaacagcgtcgctggctcagacgctgtgaacagcagcagcgcgcacaggccacccgcgaatcttggcttcaggaaagagagagagaatgccagagccaagaagaactgctgttgcgctcccggggcgaacttgacctgcagctgcaagagtaccagcattccctggaaagattacgagagggccagcggctcgtggaacgggagcaggcgcgcatgcgggcccaacagagcctcctggggcactggaagcatgggagacagcgctccctccctgctgttctcttaccaggaggcccggaagtgatggagctgaaccgttccgagtcgttatgccacgagaattcttttttcattaatgaagcccttgtgcagatgagctttaataccttcaataaacttaacccctcggtgatccaccaggatgccacctacccgacaacacagtcgcatagcgatctcgtacggaccagcgaacaccaggttgaccttaaagtggatccatcacagccttcaaacgtgtcccataagctgtggacagctgctggctcaggtcatcaaattctgcccttccacgagtcctccaaggactcttgtaagaatgggtcatccatgactaagtgctcgtgcactttgacttcaccaccgggcctgtggacaggaactacttcaactctcaaagacttggatacaagccataccgaaagtccaactccacatgactccaatagtcaccggccccagttgcaggcctttattaccgaggcaaagttgaacctccctacaagaaccatgacaaggcaggatggagagactggagatggtgctaaggaaaatatcgtatacctctag

SEQ ID NO: 45555 - DNA, 4956 bp, Artificial Sequence
  Description of Artificial Sequence: Synthetic coding sequence
atggagctgagctgcagcgaggcccccctgtacggccagatgatgatttatgcaaaatttgacaagaatgtatacttgcccgaagacgccgagttctactttacatacgacggcagccaccagagacatgttatgatagcagaacgcatcgaggataatgtgttgcagtctagcgtgcccgggcatggcctgcaagagactgtcacggtgtccgtgtgtctttgcagtgagggctattcaccagtcaccatgggtagcggctctgtgacatacgtggataacatggcatgcagactcgccaggctgcttgttacccaggccaatagactgaccgcctgtagccaccagactctcttaacacctttcgctctgaccgctggagctcttcctgccttagacgaggaactcgtgcttgcactgacacacttggagctacctctcgagtggactgttctcggctcaagcagtctggaagtgtcgtcccatcgcgagtctttgcttcaccttgccatgaggtggggactggcaaagctttcccagtttttcctttgtttgccagggggagtgcaggccctggccctgcccaacgaagaaggcgcaactcccctcgacctggccctgagggaagggcactctaagctggtagaggacgtgaccaactttcagggcagatggagtccgagtttctcccgggtgcaactgtctgaagaggcctccctacattacattcattcttccgaaaccctcacactcacactgaaccacactgctgagcacttactcgaggcggacattaagctgtttcgaaaatatttctgggatagggcgtttctggtgaaggccttcgaaccggaagccagaccggaagagcgaactgccatgccgtcatccggggccgaaaccgaggaagaaatcaagaactccgtctcttctagatctgccgccgaaaaagaagatatcaaacgagtgaagagcctggtggtacagcacaacgaacacgaggatcagcattccttggatttggataggtcttttgatatccttaagaagagcaagcccccttcaaccctgctggccgccgggcggctgtccgatatgttaaacgggggcgatgaagtatacgccaattgcatggtgatcgatcaagtgggagatcttgatatcagctacatcaatatcgagggtatcacagccactacctctcctgaatcacgggggtgcacattatggccacagtcctcaaagcataccctgccaaccgagacttcaccatccgtgtatcctttgtccgagaatgtcgagggaacagcgcacactgaagcgcaacagagctttatgagtccaagtagcagttgtgcttctaatctgaacctttccttcgggtggcacgggtttgagaaagagcagtcacatctgaaaaaacgcagttcatccctcgacgccctggatgccgacagcgaaggggaagggcactctgagcccagccacatttgctatacgcctggaagccaatcttcctcccggacaggaataccttccggagacgagcttgactctttcgagaccaatacagaaccagatttcaacattagtcgagcggagagcttgccactctcgtccaatctccagtccaaggagtctcttttgagtggtgtgagatcccgaagctacagttgctcctcacccaagatttcactgggaaagacacggctcgtgcgtgaactcacggtctgttcaagctccgaggagcagagagcatactctttgagtgaacctcctagagaaaatagaattcaggaggaggaatgggacaagtacattatcccagctaaaagcgaatctgagaagtacaaggtgtcccgaactttcagcttccttatgaatcgtatgacttcgccccgtaacaagtctaaaacaaaatctaaggatgctaaggataaggaaaagctcaatcggcaccaatttgccccaggtacatttagtggcgtattgcagtgtctggtatgcgacaagactcttcttgggaaagagtcgctgcaatgcagcaattgcaacgctaatgtgcacaaaggatgcaaggatgccgccccagcgtgcaccaagaagtttcaggaaaagtacaacaaaaacaaaccgcagacaattctgggcaactccagcttccgcgacatacctcagccaggtctgagtctacacccttcatcatccgtgcctgtgggactgccaacgggacgacgcgaaaccgtagggcaggtccatccgctctcaagatcggtgcctggaaccacactggaatccttccggaggagtgccacatctttggagtcggagtcagaccacaattcatgtaggagccggtcgcactctgacgagctccttcagagtatgggctcctcgccaagcacagagagtttcatcatggaggacgtagttgacagcagcctttggagtgacctctcatctgacgctcaggagttcgaggcagagagctggagcctcgtcgtggacccatcattctgcaaccggcaggaaaaagatgtaataaagagacaggatgtcattttcgaactgatgcagacagagatgcatcatattcaaacactcttcatcatgtctgagatcttcagaaagggcatgaaagaagagcttcaacttgaccacagtaccgtcgataaaattttcccctgcctggatgaactgttggagatccatagacacttcttctactccatgaaagagagacgccaggagtcttgcgccggatcggaccgtaatttcgtcattgatagaatcggcgatattttggtccagcagttttcagaggagaatgctagtaagatgaagaaaatatacggcgaattttgctgccatcacaaggaagcagttaatctgttcaaagagctgcaacagaacaagaaattccagaacttcattaagttacgcaacagcaacctcttggcacgacgcaggggcatcccagaatgcattttgcttgtgacacagcgcattacgaaatatccagttcttgtcgagagaatcctccagtacacgaaggaacgcactgaagagcataaggaccttcggaaggcgctgtgcctcatcaaagatatgatcgcaaccgtggatctgaaagtgaatgaatatgagaagaaccagaaatggctggaaatcctgaacaaaattgagaacaaaacttacactaagctcaaaaatggacatgttttccgcaagcaggctctcatgtctgaagaaaggaccctgctgtatgatggccttgtgtactggaaaaccgcaaccggaagatttaaggacattctggctttgctactgactgatgtgctactctttttacaggaaaaggaccagaaatacattttcgccgcagtggatcagaaaccatctgtgatttccctgcagaaactgattgccagagaagtggcaaacgaggagcgcggaatgttccttatctccgcttctagcgccggtcctgaaatgtacgagatccatacaaattctaaagaagagcgtaacaattggatgcgtcggattcagcaggccgtggaatcttgcccagaggagaaaggtggtcggaccagcgagtccgatgaggacaaaagaaaagctgaagccagagtggccaaaatacagcagtgccaggagatactgacgaaccaggatcagcagatttgcgcttacctcgaagaaaaactccacatttacgcagagcttggcgagctttctggcttcgaagatgtacatctggagccccatctgctgatcaaacccgacccgggagaaccgccacaggcggcctctttactcgcggccgccctgaaggaggccgaatcacttcaggtggctgtaaaggcctcccaaatgggggccgtctcgcagagttgcgaagatagctgtggagattcagtgctggctgatactttgtcttctcacgatgttcctgggagccccaccgcctccctggtgaccggtggacgcgaaggtagggggtgtagcgacgtggacccaggtatccagggcgtggtgaccgacttggcggtgtcagatgctggcgaaaaggtggagtgcaggaactttccaggatcttcacagtctgaaattatccaggctattcagaatctcactcggctgctctactcattacaagctgccctgacaatccaagacagccacattgagattcaccgcttggtcctgcaacaacaggaaggtttgagcctgggacattctatcctcaggggtgggcccctgcaggatcagaagtccagagacgctgaccggcagcacgaagagctggcaaatgtccaccagctgcagcaccaactccagcaggagcagaggaggtggctgcgacggtgtgagcagcagcaaagggctcaggcgacccgcgaatcgtggctgcaagagagagagcgggaatgtcaatctcaggaagagctgctgctccgaagcaggggggagttagatctgcaacttcaagaatatcagcacagtttggaacgtctccgggaggggcagcgattagtagagcgggagcaggccagaatgcgcgcgcaacagtccctcttgggacactggaagcatgggaggcaacgctcccttccggccgtgttgctcccagggggcccagaagtgatggagctgaatagatcagagtctctatgtcacgagaactccttttttataaatgaggccctagttcagatgtcattcaatacattcaataagctcaaccccagcgtgatccaccaggacgctacctaccctacaacacaaagccactccgatctcgtgcgcacaagcgagcatcaggtggacctgaaagtggatcccagtcagccttctaatgtatcgcacaaactgtggacagctgccggaagcggacatcagatactgccttttcatgagagctctaaggattcatgtaagaacgggaactag

SEQ ID NO: 45556 - DNA, 5118 bp, Artificial Sequence
  Description of Artificial Sequence: Synthetic coding sequence
atggagctgagctgcagcgaggcccccctgtacggccagatgatgatttatgctaagtttgacaagaacgtgtacctacccgaggacgccgagttctatttcacttatgatggcagtcaccagagacacgtaatgatcgcagagcggatcgaggacaacgtcttgcagtctagcgtcccggggcatgggctgcaggaaacagtgaccgtcagcgtgtgtctctgcagtgagggatatagtccagtaactatggggagcggctccgtgacttatgtagataatatggcatgtaggttagcaagactgctagtcacacaggccaacaggctgacagcctgtagtcatcagacacttcttacgccctttgccttaaccgctggcgcccttccagccttggatgaagaactggttcttgcactcacgcatctcgagctgccattggaatggacagtgttgggcagtagttcactggaggtgtcatcccatagagagtccttgttacacctcgccatgagatggggcctcgcgaagttgtcacagttttttctctgcctgcccggcggagtgcaggccctggcactgccaaacgaggagggcgccactcccctggacctcgccctccgagaaggccattccaaattagtggaagatgtcacaaattttcaggggcgatggagcccctccttcagcagggtccaactcagcgaggaggcatccttacactacatccattcttctgaaacactaacactcaccctgaaccacactgcggagcatttactcgaagctgatatcaagctttttagaaagtacttctgggaccgggcatttctggtgaaggccttcgaacccgaggcccgcccagaggaaagaactgcaatgccctccagcggcgctgaaactgaagaggaaattaagaacagtgtgtcatccaggtccgccgccgaaaaagaagacatcaaacgggtcaaatcactggttgttcagcacaacgaacatgaggaccagcattctttggacttggatcgcagcttcgacatactgaagaaatctaaaccccctagtacactgctggctgcgggacgcttgtccgacatgctcaatggaggcgacgaagtttacgccaactgcatggtcatcgaccaggtgggcgatttggacatatcatatatcaatatcgaaggtataactgctactacatcccccgagtcgagaggttgtacattgtggcctcaaagtagtaagcatactctgcccaccgagacaagcccctccgtctatccactgagcgaaaacgtggaaggaaccgcccacacggaagcccaacagagtttcatgagccctagtagctcatgcgcctccaacctgaatctgtctttcggatggcacggttttgaaaaagaacagagtcacctgaagaagagaagctcaagtctggatgcgcttgatgccgattctgagggtgagggccatagtgagccttcgcacatttgctacacacctggaagccagtcttctagtcggaccggcattccatcaggggacgagctcgactctttcgagactaacactgagccagactttaacatctcgagggcggaatctctgccactctcatccaacctccaatccaaagagagcctgctgtcaggagtgcggagtcggagttactcttgcagctcaccgaagatatcgctcggtaagacccggctcgtccgggaactgactgtgtgcagctcaagcgaagaacagagggcctacagcctgtctgagccaccaagagaaaacaggattcaagaggaggaatgggataaatacatcattccagccaagtcggagagtgaaaaatataaagtgtctcgtaccttcagcttcctcatgaatcgaatgacctccccaaggaataagagcaagacgaaatcaaaggacgccaaggacaaagagaaactcaatagacatcagtttgctcccggcacattttccggagtgctccaatgcttggtctgcgacaaaaccctgcttggtaaagagtcactacagtgtagcaattgtaacgctaacgtgcacaagggttgtaaagatgcagctcccgcctgtactaagaagtttcaggaaaaatacaacaaaaacaaaccccagaccatacttggaaactctagtttccgggatatcccacagcccgggctttctctgcatccatcctcctctgtgccagtcggtctgcctaccgggcggcgcgagacagttgggcaagtgcaccccttatcccgcagcgtccctggaacaaccctggaaagctttaggaggtcggcaacctccttagagtctgagtctgaccataatagctgcagaagcagaagtcatagtgacgagttgctgcagtcaatgggttcttctcctagtaccgagtcttttataatggaagatgtagtcgatagttctctatggtccgacctgtctagcgacgcgcaggaattcgaggccgaatcatggagcctcgtcgtcgacccatctttttgcaatcgccaagaaaaagatgtaattaagcgccaggatgtgatattcgagctaatgcagaccgaaatgcatcacatccagacgctattcattatgtccgaaatatttcgtaaaggcatgaaggaagagctacagctcgaccattcaactgtcgacaaaatatttccgtgcctggatgaattactggaaattcaccgccactttttttactccatgaaggaacgcagacaggagtcatgcgccggatcagaccggaatttcgtgatagatcgcatcggcgacatcctggttcaacagtttagtgaagagaacgcttctaaaatgaaaaaaatttatggcgagttttgttgtcatcataaagaagcagtgaacctttttaaagaactgcagcaaaacaagaaattccagaactttatcaagttacgaaactcgaacctgcttgccaggagaaggggcattcccgaatgcatattgctggtgacccagagaattacgaagtatcccgtgctggtcgagaggatcctgcagtacactaaagagaggaccgaagagcataaagacttgcgcaaagcactatgcctaattaaggatatgatagcgactgtggatctcaaggttaatgagtatgaaaaaaaccagaaatggctggagatcctgaataagattgagaacaagacctacacaaagttaaagaatggccacgtctttcgcaagcaggctctcatgtctgaggagagaactctgttgtatgatggcctggtgtattggaagacagccactggacgctttaaagatatcctggcgctgctgctgacggacgtactcctttttctgcaagaaaaagaccagaaatacatattcgccgctgtagatcagaagccttccgtaatctcgctgcagaagcttatcgcccgggaagtagccaatgaagaaagaggcatgttcttgattagcgctagctcagcagggcctgaaatgtatgagattcacacaaattcgaaggaggagcgcaataactggatgcggcgcatccaacaagccgtggagagttgccccgaggagaaaggcggaaggacatctgagtctgacgaagataaacgcaaggccgaagcccgggttgcaaagattcaacagtgccaggaaatattaaccaaccaggaccagcagatatgcgcatacctggaggaaaaattacacatatacgccgaactgggcgaactcagcggcttcgaagacgtgcacctggagccccacctattaatcaagcccgatcctggcgagccccctcaggccgccagcctgctcgccgctgccctcaaggaggccgagtccctccaggtcgccgtgaaggcttcacaaatgggcgctgtcagccaaagttgtgaggattcctgcggtgacagtgtcctcgccgacaccctctcatcccacgatgttcccggatctcccactgccagcctggtaaccgggggccgcgaaggacgagggtgcagtgatgttgaccctggcattcagggggttgttactgacctcgcggtgagtgacgcgggcgagaaagtagagtgtcggaacttcccaggcagcagtcagagcgaaatcattcaagcgatacagaacttaactaggctcctctattccctgcaggcagcgttaacaatacaggacagccatattgagatccatcgcctggtcctccaacagcaggagggactctccctcggacactccatcttgcgtggaggacccctgcaggaccagaagagtcgcgacgctgacagacaacacgaggaactggccaatgttcatcagttacaacatcaactacagcaagagcagcgacgttggttgaggaggtgtgagcaacagcagagagctcaggcaactcgggagagctggcttcaagaacgggagcgggaatgccaaagtcaggaagagttgctgctccggtccagaggtgaactggatctgcagctgcaagagtaccagcactccctggagagactgagggaggggcagcggctagtggaacgcgagcaggcccgcatgcgcgctcagcagtcattgctgggacactggaagcacggccgtcagcgctctctgcccgctgtcttactgccggggggacccgaggtcatggaactgaacagaagcgagtcactttgtcacgaaaattcttttttcatcaatgaggccttggttcagatgagcttcaacactttcaacaagctgaacccaagcgttattcatcaagacgccacttatccaacaacgcagagccactccgaccttgtgagaaccagcgagcaccaggttgacctgaaagttgacccatctcagccatctaacgtttcccacaaactgtggaccgccgctggaagcggacaccagatacttccgtttcacgagtcttcgaaggattcctgcaaaaatgacctggatacctcgcatacagaatcacctacccctcacgacagtaacagccaccggcctcagttacaggcattcatcactgaggccaaactgaacctgccaactagaacaatgaccagacaggatggcgaaacaggagatggggcaaaagagaatatcgtgtacttgtag

SEQ ID NO: 45557 - DNA, 252 bp, Artificial Sequence
  Description of Artificial Sequence: Synthetic coding sequence
atggagctgagctgcagcgaggcccccctgtacggccagatgatgatatacgccaagtttgacaagaacgtgtaccttccagaagatgctgagttctatttcacttatgatggctcacaccaacggcacgttatgattgctgaacgtattgaggacaacgtcctgcagtcatctgtgcctgggcatggcttgcaggagaccgtgacagtaagcgtctgtttatgcagcgagggttactcccccgtcacctag

SEQ ID NO: 45558 - DNA, 5118 bp, Artificial Sequence
  Description of Artificial Sequence: Synthetic coding sequence
atggagctgagctgcagcgaggcccccctgtacggccagatgatgatttacgctaagttcgataagaatgtatatctaccagaggatgccgaattctactttacttacgatggcagccaccagagacacgtcatgatcgccgagcggattgaagacaacgttctgcagtcttcagttcccgggcacggactgcaggaaacagtgaccgtctccgtgtgcctgtgctccgaagggtattctcccgtcaccatgggtagcggcagcgttacctacgtggacaatatggcatgccggctcgccagattattagtgacccaggccaacagattgaccgcctgctctcatcagacactgttgacgcccttcgccttaacagcaggtgccctccctgccctcgacgaagaactagttctcgctcttacccatctggaactaccattagaatggaccgtgctgggatctagttctctggaggtatcatcccatcgggagtcattgctccaccttgccatgcgatggggactagccaagcttagccagttcttcctttgcctgccaggtggcgtccaggctctcgcactcccgaatgaggagggcgctacacccctggacctcgcactcagagaaggtcacagcaaacttgtggaggacgttacgaatttccagggtcgttggagtccttcttttagcagggtgcagctgtctgaggaagcaagtttacactatattcactcttctgaaactctgacactgacactcaaccacacagcagagcaccttctggaggcagacattaagttattccggaaatatttttgggacagggcatttcttgtgaaggcttttgagcccgaagctcggcctgaagagaggaccgccatgccttcctccggtgctgaaaccgaggaggagattaaaaactcagtgagttcgcgcagcgctgccgagaaagaggacataaagcgagtcaagtccctcgtcgtgcagcacaacgaacatgaggaccagcacagcttggacctggacagatccttcgatatactcaaaaaatctaagccgccttccacactccttgccgccggaagactgagcgacatgttgaacgggggcgacgaggtgtacgctaactgtatggtgatcgaccaagttggtgatctcgatatctcgtacattaatatcgaaggcattacagcaaccactagcccagagagccgtggatgcactctgtggcctcagtcttctaagcacacattgccaacagagaccagccccagcgtgtacccgctgtccgaaaacgtagaggggactgcgcacactgaagcacagcagagcttcatgtcccccagttcatcttgtgccagcaaccttaatctgtccttcggatggcacggattcgagaaggaacagagtcatttgaagaagcgttcatcatctctggacgctcttgatgctgattctgaaggagaaggacactctgaaccatcacatatctgctatacccccggatcacagagctcctctagaacaggcattccttcaggcgacgagcttgattcattcgagacaaatacggaacccgatttcaatatcagtagggccgaatctctcccacttagtagcaacctgcagtctaaagaatccctcttatctggagtccggtctcgttcctacagttgcagctctcctaagatctcactgggaaagacccgcttagtacgggaattgaccgtatgctcgtccagtgaggagcagcgtgcttactcactgagcgagcctccccgtgagaaccgaatccaagaagaggagtgggataagtacattattcctgccaagtctgagagcgaaaaatataaagtgagtaggacattcagcttcctcatgaatcgtatgacttctcctcgaaacaagagcaaaacaaaaagcaaagatgccaaagacaaagagaaactgaataggcatcagttcgcacctgggacttttagtggagtgctccagtgtttggtgtgcgacaaaacactgttgggcaaagagtctcttcagtgtagtaattgtaacgccaacgtacataaggggtgcaaggacgcagcccctgcctgcacaaaaaaattccaggaaaaatataacaagaacaaaccacagacgattctcggcaacagttcatttcgcgacataccacagcccggattgtcactgcacccctctagctctgtgcccgtgggtctgccgacagggcggagggaaacagttggacaggtacacccacttagcaggtcagtcccgggcacaacactggagtcctttcgacgatcggcaacctccttggaaagtgagagtgatcataactcttgccgaagtagatcacattcagatgagctccttcagtccatggggtcctccccgtctactgagtcctttatcatggaagacgttgtggattccagtctctggtctgacctctcatctgatgctcaggaattcgaggctgaatcttggtcactggtcgtggacccatctttctgtaatcgccaggaaaaggatgtaataaagaggcaggacgtgatttttgaactgatgcagactgaaatgcatcacatccagacgctcttcataatgagtgagatttttcgcaagggaatgaaggaggaactacagctcgatcattcaaccgtggacaagatcttcccgtgtctggacgaactgctggagatccaccgacacttcttttactcaatgaaggagcgcagacaggagagctgcgccggcagtgatagaaacttcgtgatagataggatcggcgacatactcgtccaacagttcagtgaagagaacgcttctaagatgaagaaaatctacggcgagttctgttgccaccacaaagaggctgtcaatctgtttaaagagctgcagcaaaataagaaatttcaaaactttatcaagctgagaaacagtaatttgctagcccgcagaagggggatccccgagtgtattctgctggtgacgcagagaattactaaataccccgttctggttgaacgcattctccagtacacaaaggaacgcacagaagagcacaaagatctgagaaaggccctgtgcctcatcaaagacatgattgcgaccgtggatctcaaggtgaatgaatacgagaaaaaccagaaatggttggaaatactgaacaagatagagaataagacttacaccaaactgaagaatggacatgtgtttcgcaagcaggccctcatgtctgaagaaagaaccttgctgtatgacggcctcgtctattggaaaacggccacgggcaggttcaaggatatactggcgctactcttgacagacgtgctgctctttctacaggaaaaggatcaaaagtacatttttgcggcggtggatcagaaacctagtgtgattagcttgcagaaactgatcgcccgggaagtcgctaatgaggaacggggtatgttccttattagcgcttcttcagctggcccagaaatgtacgagattcacacaaatagtaaggaagagcgaaacaattggatgcgtaggattcagcaggcagtggaaagctgccccgaggagaaaggagggaggacctccgagagtgatgaggataaacgcaaagccgaggccagggtcgctaagatccaacaatgtcaggaaatcctcaccaatcaggaccaacagatttgtgcttacctggaggaaaagctgcacatttacgcagaactcggtgagctaagtggatttgaggatgtgcacttagaaccacacctactgatcaagccagacccgggggagccacctcaagcggcctccctcttggccgccgctttaaaggaagctgaatcattgcaggtagcggtgaaggcctcccagatgggcgccgtatctcagagttgcgaggacagttgcggcgacagtgtgctcgctgacacgctgtcgtctcatgacgtacctggatctcccaccgccagtcttgtcaccggcgggcgcgagggacgtggatgctccgacgtagacccaggaatccagggcgtcgttacagacctggcagtctctgatgccggagagaaagtggaatgccgtaacttcccgggcagctctcagtcagaaattatacaagctattcagaatttgacacgcctcctgtacagtttacaggcagccctgacgatccaggattcccatatcgagattcacaggcttgtgcttcaacaacaagagggattgagtctggggcattcgattctgcggggggggcctctgcaggaccaaaagagccgggatgccgatcggcagcacgaagaattggctaatgtccaccagctgcagcaccagctgcagcaggagcagcgtagatggctccgaaggtgtgagcagcaacagagggcccaggccacacgagagagttggctgcaggaaagagaaagggagtgtcagtcccaggaagaactgctgctgaggtcccggggggagctcgatttacagctgcaagaatatcaacattcacttgaacgcttgagggaaggacaaaggctggtggagcgggaacaggctaggatgagagcacagcagagcctcttgggccactggaaacatggccgtcaacgtagcttgccagccgtgctgctccctgggggcccagaggtgatggagctcaatcggtctgaatctctgtgtcatgagaactcattttttataaatgaagctcttgtccagatgagctttaacaccttcaataaattgaacccaagtgttatccaccaagacgctacctatccaacaacccagagccattcagatctggttcgaacaagcgaacatcaggtcgacctgaaggtggacccatctcaaccttctaatgtgagtcacaagttgtggactgcagcgggttccggccaccaaattctgccctttcacgagagctcaaaggattcatgtaaaaacgatctggatacctcccacaccgagagccccactcctcatgattctaactcacaccgcccccagctgcaggccttcattaccgaggctaaactgaacttgccaacccgcacaatgacacggcaggacggcgaaaccggtgatggggcgaaggagaatatcgtgtatctctag

SEQ ID NO: 45559 - DNA, 5196 bp, Artificial Sequence
  Description of Artificial Sequence: Synthetic coding sequence
atggagctgagctgcagcgaggcccccctgtacggccagatgatgatctacgccaagttcgacaagaacgtatatctgccagaagatgcagagttttattttacctacgacgggtcccatcagaggcacgtgatgatcgccgagagaatcgaggacaacgtgctccagtccagcgtccccggacatgggttgcaagaaactgttacggtctcagtgtgcttgtgtagtgagggctatagtccagttacaatgggttctgggtccgtgacttatgtggataacatggcctgtcgcttagcccgtctactcgtgacccaggccaacaggcttaccgcctgtagtcatcaaacattgctaactcctttcgccctcaccgcaggtgcgctccctgctctggacgaggaactagttcttgccctgactcatttggagctacctctcgaatggacagttttagggagctccagcctagaagttagctcccacagagagagtctgcttcaccttgctatgagatggggtctggctaagctatcccagttttttctctgcctcccgggaggtgttcaggcactcgctcttcccaacgaagagggtgccacccccctggacctagcgctgagagaggggcactccaaactcgttgaagatgtcacaaacttccagggcagatggtcaccctcctttagccgtgttcagcttagcgaggaagcttccttgcattacattcattcctctgaaacgttgacacttacacttaatcacaccgctgagcacctcctggaagctgacataaaactgttcagaaaatatttttgggaccgtgcattcctggtgaaagcgtttgaacccgaagctcggccagaagaacgcactgccatgccatcttccggggctgagaccgaggaggagatcaaaaacagtgtgagttctcgatcagcggccgagaaagaagacataaaaagggtgaaaagtttagtggtgcagcataacgagcatgaggatcagcacagtctagacctcgataggagcttcgacatcctcaaaaaatctaagccaccctccacgctcctggccgctggtcggctctccgacatgttaaacgggggggacgaggtttacgctaactgtatggttatcgatcaagtgggggatttggatatttcttatataaatattgaaggaattacggcgacgacctccccggaaagtagagggtgtactttgtggcctcagtctagcaaacacactctgcccacagagacctccccctccgtttatccactgtctgagaatgttgagggcacagctcacacggaagcccagcagagctttatgtctccatcgtcaagctgtgcttctaatttaaacctgtctttcggctggcatgggtttgaaaaagagcagagtcacttgaagaaaaggtcgagttctctggacgcgctggatgcggacagcgagggtgagggacatagcgagccgtcccatatctgctacactcctggtagtcagagttcctccagaactggcataccttccggcgatgagctggattcattcgagacgaacaccgagcccgattttaacattagcagagcagagagtctgccactctcctccaacttgcaatctaaagaaagtctcctctccggcgtccggtcacggtcttactcttgtagctctccaaagatttctctgggtaaaacaaggctggtgagagaacttaccgtgtgctctagttccgaggagcagcgcgcgtacagtctatctgagccaccgagagagaatcggatacaggaggaggagtgggacaagtatattatccccgccaagtcagagtctgagaaatacaaagtgtctagaacgtttagcttcctgatgaacagaatgaccagccctaggaacaagtctaaaacaaagagcaaggacgccaaagataaggaaaagctgaataggcaccagtttgctccaggcacttttagtggcgtccttcagtgccttgtctgcgataagacgttgctcggcaaggagtccctgcaatgtagcaactgcaacgcaaatgtgcacaaaggctgtaaagacgcagcaccagcctgcactaaaaagtttcaggaaaagtacaacaagaataagccgcagaccatccttgggaactccagtttccgagacatccctcagccgggcctctccttgcacccgtcctcctcagtgccggtggggctgccaactggtcgaagagagaccgttggccaggtccaccccttaagccgaagtgtcccagggaccacgctagagtcttttagaaggagcgccaccagcctagagagcgagagcgatcacaactcatgccggtcgcgcagtcattccgacgagctcctgcagagcatgggatcgagcccttccaccgagagcttcataatggaggatgttgtggattcttctctgtggtcagacctgtcctcagacgctcaggagtttgaagccgagtcttggagcttagtagtggacccgtcattctgtaaccgccaagagaaagatgtaataaaacgccaggatgtgattttcgaactaatgcagacggagatgcaccacatacagactctgtttattatgtcagagatttttcgtaagggcatgaaggaagaactgcaactagaccattcgacggtggacaaaatcttcccatgtctcgatgagctgttggagattcataggcatttcttttactctatgaaagagcgacggcaggaaagctgcgctggatcagaccgtaacttcgtgatcgaccggattggcgatatcctggtgcagcagttctctgaagaaaatgctagtaaaatgaagaagatttatggagaattctgctgccaccacaaagaggccgtgaaccttttcaaagagcttcagcagaataaaaagttccagaacttcatcaagctgagaaacagcaacctccttgcacggcggagaggtattccggagtgtatcttgctggtcacacagaggataaccaagtaccctgttttagtggaacggattttgcagtatacaaaggagcgcactgaggagcacaaagacctgaggaaagccttatgtctcattaaggatatgatcgcaacagtggacctgaaggtgaacgaatatgagaaaaatcaaaagtggctagagatactgaataagattgagaataagacatacaccaaactgaaaaacggccacgtatttaggaagcaggcactgatgtccgaagagcgaactctcctttacgacggtcttgtttattggaaaactgccacgggtagattcaaagatatcctggctctgctgctgacagacgtcttgctgttcttacaagaaaaagatcaaaagtacatttttgcagctgtggaccagaagcctagcgtgatttccttgcagaagcttatcgccagagaagtagccaacgaggagagaggcatgttcctgatcagtgcttcctctgccggccccgaaatgtacgagattcacaccaatagtaaggaagagcgtaataattggatgaggcgaatccaacaagcagtggaatcttgtcctgaggagaagggcggccgcacatcagagtcggatgaggacaaacgcaaggctgaggctagagtcgccaaaattcagcaatgccaggagatcctgaccaaccaggatcagcaaatttgtgcttatctggaagaaaagctccatatctacgctgaactcggggagctctccggttttgaggacgtacacttggagccccatctgctgattaaacctgacccgggtgagcccccccaggctgcctcattgcttgccgcagccctaaaggaggccgagtctctccaagtcgccgtcaaagccagtcagatgggcgccgtatcacagtcttgcgaggactcctgtggtgatagtgtgctagccgatacacttagtagccatgacgtgcctggcagcccgaccgcttcgctggttaccggcgggagagagggtcgggggtgctcagacgtggacccgggcatccagggtgtggttacagacctggctgtcagcgatgctggtgagaaagtcgagtgtaggaattttcccgggtcctcccagtcagagattatacaggctatccaaaatctaactagacttctctatagtctccaggctgccctgaccatccaggatagccacatcgagattcacaggctggtccttcagcagcaggaaggcctgagcctggggcacagtattctcaggggagggcctttgcaggaccaaaagtctagagatgcggatcgacagcacgaagaattagctaacgtccatcagttgcagcaccagcttcaacaagaacagaggcggtggttaagaagatgcgaacagcaacaacgggcccaggcaacaagggaaagctggctccaagagcgggaaagggagtgtcagagtcaagaagagttgctgctgcgctcaagaggagaactcgatttacagctccaggaataccagcacagtctcgagcgattgagagaaggccaaaggctggtagaacgggagcaggcccgcatgagggctcagcagagcctgctggggcactggaaacatgggcggcagcggtcactgcccgcagtgttgttaccaggtggccctgaggtcatggaacttaatagaagcgaatccctgtgccatgagaactctttttttatcaacgaagcactagtccagatgtccttcaatacgtttaataagttgaacccatccgtcatacaccaggatgcgacctaccctacaacacagtcacactctgacctggtgcggacctcagagcaccaggtggatcttaaggtcgacccgagccagccctctaacgtgtctcacaaactttggactgctgccggctccgggcaccagattttgccattccatgagtctagtaaggactcctgtaaaaatggaagtagcatgactaaatgctcatgtacgctcacctcaccccctggattgtggaccgggaccactagcaccctgaaggacttagatacttcccataccgaatcaccaacccctcacgactccaattcccatcgaccccagctgcaggccttcatcaccgaggctaagctcaacctgcctacacgcactatgacccgtcaagatggggagaccggggacggtgccaaagagaacatcgtgtacctctag

SEQ ID NO: 45560 - DNA, 948 bp, Artificial Sequence
  Description of Artificial Sequence: Synthetic coding sequence
atgcagcggcggagccggggcatcaacaccggcctgatcctgctgttgtcccagatcttccatgtgggaattaacaatattccaccagtgactctggctaccctcgccttgaatatatggtttttcctgaatcctcagaagcccctatatagctcttgtttgtctgttgaaaagtgctaccaacagaaggactggcagcgccttctcctcagtccacttcatcatgctgacgattggcacctatatttcaacatggcctcgatgctgtggaagggcataaacctggaaaggcgccttgggtctcggtggtttgcgtacgtgataacagccttctcagtgcttactggggtcgtatacctcctccttcagtttgcagtggctgaattcatggatgaacccgactttaagaggtcctgcgccgtgggcttcagcggcgtgctgttcgccctcaaggtcctgaacaatcactactgtcccggtgggtttgtcaatattctcggatttcctgtgcctaatcggttcgcatgctgggtcgagctggtggccatacacctcttctcgccaggcaccagcttcgccgggcacctggctggcattcttgtaggcctcatgtacacccagggcccccttaagaaaatcatggaagcctgcgccgggggctttagctcctcagtgggatacccaggccggcagtactactttaattcctcaggtagctcgggctatcaggactactatccgcacggccgccccgaccactacgaggaggcgccaagaaattatgatacctacaccgcgggcctctccgaggaggaacagttggaacgggctcttcaggccagcctgtgggatcggggaaacactaggaattccccccccccgtacgggttccatttgtctccggaagagatgcggaggcaaagactacaccgatttgatagccaatag

SEQ ID NO: 45561 - DNA, 948 bp, Artificial Sequence
  Description of Artificial Sequence: Synthetic coding sequence
atgcagcggcggagccggggcatcaacaccggcctgatcctgctgctctcacagatatttcacgttggaataaataatatcccacctgtgactttggcaaccctagctcttaacatctggttttttctgaatcctcaaaagccattatactcaagctgcctgtcagtggagaagtgttatcagcaaaaagactggcaacgactgcttctctcaccactccaccacgctgacgactggcacctgtactttaacatggcttccatgctgtggaagggcattaatctggagcgccgtttgggctcccgctggtttgcctatgtgatcactgcattctctgtgctcaccggagtggtctacctattactgcagtttgcagtggcagagtttatggacgagcccgacttcaagcgtagttgtgccgtgggattctcaggcgtgctcttcgccctgaaagtcctgaacaatcattactgccccgggggattcgtcaacatcttggggtttcctgtgccgaataggtttgcatgttgggtggagttagtggccatacatcttttctctcccggaacatctttcgctggacatctcgccggtattctcgtcgggctgatgtacacacagggaccactgaaaaagattatggaggcttgcgctggaggcttctccagttccgtaggctaccccggcaggcagtattatttcaacagtagcggatcatcaggctaccaggattactacccacacggacggcctgatcattacgaggaagcgccccgcaactatgatacttacaccgccggtctttctgaggaagaacagctcgagagggcactgcaggcttccttgtgggatcgaggcaatacaagaaatagccctcccccatatggttttcacctttctccagaggagatgcgcagacagcgtctccaccgatttgattctcaatag

SEQ ID NO: 45562 - DNA, 456 bp, Artificial Sequence
  Description of Artificial Sequence: Synthetic coding sequence
atgcagcggcggagccggggcatcaacaccggcctgatcctgctgctgtcccaaatctttcacgtcggcatcaacaacatcccccccgtgacactcgcgaccctggctctcaacatctggttctttctgaacccccagaagcccttgtactctagctgcttatccgtggaaaaatgctatcagcagaaggactggcaacggctgctcctgagtccactgcaccacgctgatgattggcatctgtatttcaatatggccagtatgctgtggaaaggaattaatttggagcgaagactgggatctaggtggtttgcttatgtgataacagctttttcggtattgacaggagtggtctatctcctgctgcaatttgcagttgctgagtttatggatgaacctgactttaagagatcgtgtgcggtcggattctcaggcgtgctgttcgccttgaagtag

SEQ ID NO: 45563 - DNA, 405 bp, Artificial Sequence
  Description of Artificial Sequence: Synthetic coding sequence
atgcagcggcggagccggggcatcaacaccggcctgatcctgctgctgtcccagatctttcacgtggggatcaacaatatcccacccgtcactcttgccactctggccctaaatatttggttttttctgaatcctcagaagcctctttactccagttgcttgagtgtcgagaaatgctaccaacagaaagattggcaacgactgctcctgtcacccctacaccacgctgacgactggcatctgtactttaatatggccagcatgctttggaagggaattaacttggagcgtcgactagggagcaggtggtttgcttatgttatcaccgctttttccgtactgacaggggtggtatatttactgctgcagtttgctgtggccgagtttatggatgaaccggattag

SEQ ID NO: 45564 - DNA, 165 bp, Artificial Sequence
  Description of Artificial Sequence: Synthetic coding sequence
atgcagcggcggagccggggcatcaacaccggcctgatcctgctgttgtctcagatcttccatgtaggtattaataacattcccccagtgacactggctacgcttgccctcaatatttggtttttcctgaatccacaaaagccactctactcatcatgcctgtag

SEQ ID NO: 45565 - DNA, 153 bp, Artificial Sequence
  Description of Artificial Sequence: Synthetic coding sequence
atgcagcggcggagccggggcatcaacaccggcctgatcctgctgctttcccagatatttcacgtcgggattaacaatataccccccgtgacattggccacccttgccctgaacatctggtttttcctgaacccacagaagccactatattag

SEQ ID NO: 45566 - DNA, 21 bp, Artificial Sequence
  Description of Artificial Sequence: Synthetic coding sequence
atgcagcggcggagccggtag

SEQ ID NO: 45567 - DNA, 375 bp, Artificial Sequence
  Description of Artificial Sequence: Synthetic coding sequence
atgcagcggcggagccggggcatcaacaccggcctgatcctgctgctgtcacagattttccacgtgggaattaacaacattcccccagtcactttggccactctggccctaaacatctggttcttcctgaaccctcagaaacctctttacagtagttgcctgtccgtggaaaaatgctatcagcagaaagactggcagcggcttctgctttctccccttcatcacgccgatgactggcacctgtacttcaacatggcgagcatgctttggaaaggaattaacctagagcgtaggctagggagtcgttggtttgcgtatgttatcaccgcattttccgttctcactggtgtggtctacctgcttttacagttctag

SEQ ID NO: 45568 - DNA, 1095 bp, Artificial Sequence
  Description of Artificial Sequence: Synthetic coding sequence
atggccgccagcggccccggctgccggagctggtgcctgtgccccgaggtccctagcgcgaccttttttaccgctctactatctctgctggtctccggtccccgactgttcctgctgcaacagcccctggccccgtctggattaaccctgaagtctgaggccctcagaaattggcaagtgtatcgcctcgttacatatatcttcgtatacgagaatccaataagtctgctgtgcggggctattatcatctggagattcgccggcaattttgaaagaacggttggaacagtgcggcattgtttcttcaccgtgatctttgctatattttccgctatcatctttttaagtttcgaggctgtgagctctctgagtaaactgggcgaggtggaggacgcacgaggcttcacaccggtggcctttgcaatgttaggtgtaaccacagttcggtcgcggatgcggcgcgcactggtgttcggtatggtcgtgcctagcgtcctggtgccatggcttctgctcggcgcgagctggctcatcccacagacttctttcttgtccaatgtatgtgggctctcaatcggcctggcttacggcctcacctactgttacagcatcgacctctcagagagggtggcactgaaactggatcaaacctttcccttctcgctcatgagaaggatcagcgtgtttaaatacgtatcaggctcatccgcagaacgcagagccgcccagagccggaagctcaatcctgtcccaggcagctaccccactcaatcctgccaccctcatctatcacctagccacccggtgtctcagacacagcacgcgtctggccagaagctggcaagttggccgagttgcactcctggccacatgccaacacttcctccgtatcagcccgcttctggcctgtgttacgtccagaaccactttgggcctaaccctacctcaagtagcgtgtatcccgcgagtgcagggacatccctggggatccagccccctaccccagtcaactcgcctggtaccgtttactctggcgctctgggcacaccaggtgctgctggcagtaaggaatctagccgggtgcctatgccttag

SEQ ID NO: 45569 - DNA, 672 bp, Artificial Sequence
  Description of Artificial Sequence: Synthetic coding sequence
atgctgggcgtgaccaccgtgcggagccggatgcggcgggccctggtgttcggcatggtggtgccctctgtactggtgccctggctcttactcggcgctagctggctgattccccagacatctttcctgtcaaatgtatgtggactttcaattggcctggcttacggcctcacatattgctattccatcgatctgtccgagcgggtcgcccttaagctcgatcagacctttccattctctttgatgcgtcggatcagcgtgttcaaatatgtgtctggttcgtccgctgagcgtagagctgcccagtccaggaagcttaacccggtcccaggatcatacccgactcagagttgtcaccctcacctgtctccgagtcaccctgtgagccaaacccaacacgcatccggccaaaagcttgcttcttggcctagctgtacacccggccatatgcccactctgcccccatatcagcctgcctccgggctttgctatgtacagaaccatttcggcccgaacccaacttcctccagtgtttaccctgcttcagccggtacatctctcggcatccaaccgccgacaccagtgaactcccccgggaccgtgtacagtggagccttaggtactccaggcgccgccggatccaaagagtcctctcgcgtcccaatgccctag

SEQ ID NO: 45570 - DNA, 1305 bp, Artificial Sequence
  Description of Artificial Sequence: Synthetic coding sequence
atgggccggggcctgtgggaggcctggccccccgccggcagcagcgcagtggccaagggtaactgccgagaggaggcagaaggcgccgaggaccgacagccagcgagccggagaggggccggaaccacagccgcgatggcagcaagtggacccggctgtaggtcatggtgtctgtgtcccgaggttccgtcggcgacttttttcaccgcactgctgagtctcctggtttcagggcccaggctctttttgcttcagcaaccactggcgccttcaggtttgacacttaaatccgaagctctgcggaactggcaggtctaccggttggtcacgtacatcttcgtatacgaaaatcccatctccttactgtgcggagctattattatctggcggttcgccgggaattttgagaggaccgtgggaaccgtcaggcattgcttctttacagtgattttcgcgatctttagtgccatcatttttctaagttttgaggccgtctcctcgttatctaagttgggggaggtggaagacgcaagaggattcacccctgtggccttcgcaatgttaggcgtcactacagtgcgcagtagaatgcgcagggcccttgttttcgggatggtggtgcccagcgttttggtgccctggctgctgctgggtgcatcctggctgattccccagaccagctttctctccaatgtttgcggtctcagtattggcctcgcctacccacacttactgcttttccaccgacctctgcgggccagcggcacggaagctaggagtgacctgccactgcagcctgacgaagaggatatcagggtgcaggtgcggttgagggtatttagccgcgaggaggggagtcccgaaccggaaacagaacctggagcctggctcctgccgcacacagaactccccccttctccagtgccgaaacctccatgcgtacctgacgccgccaggcaatggtccgaggcagggctgttggctagctgtacccctgggcacatgcccaccctacctccttaccagccagctagcggtttatgctatgttcagaaccatttcggccctaatcccacttcttccagcgtgtatccggccagcgcaggaacatctctgggtattcaacctcccacccccgtaaactctccagggacagtgtactccggggctctcgggcaccagggcctgcaagccccgagaagtcctcccggttccccgtgtccagaacgcatctctcgcgaagttatcagcttaggcctgctcaaagtcctaccgaagagcctgcttactaaagttacctattag

SEQ ID NO: 45571 - DNA, 672 bp, Artificial Sequence
  Description of Artificial Sequence: Synthetic coding sequence
atgctgggcgtgaccaccgtgcggagccggatgcggcgggccctggtgtttgggatggtggttccgtctgtcctagttccatggcttctgttgggggccagttggcttatcccgcagacatctttcctgtcaaatgtctgtgggctgagtatcggacttgcctatggcctgacatactgctactcaatcgacctttccgagcgagtcgctctgaaactcgatcagacattcccattttccctcatgagacgtataagcgtgttcaagtacgtctccggctccagcgcagaaaggcgagcagcccaaagccggaagctcaatcctgtgcccggatcctacccaacccagagttgccatccacatctttctccttcgcatccagtgagccagactcaacacgcaagcggacagaagttagcgagctggccaagctgcactccaggccacatgcccaccctcccgccctaccagcctgcgagtggtctctgctatgttcagaatcactttggccctaatcccacatccagctctgtgtatcccgcatctgcaggaaccagcctaggtatccagcctcccacccccgtcaactcacccgggaccgtgtattcaggcgctctgggcacccctggcgccgcaggatcaaaagagagctcacgggtgccaatgccctag

SEQ ID NO: 45572 - DNA, 1185 bp, Artificial Sequence
  Description of Artificial Sequence: Synthetic coding sequence
atggagctgagcgccgtgggcgagcgggtgttcgccgccgagagcattatcaaacgccgcatcaggaagggcagaatcgagtacctggtgaaatggaaggggtgggccattaaatattcgacctgggaaccggaggaaaatatcctggattctaggttaatagccgcttttgaacagaaggaaagagagcgggagctgtatgggccgaagaagcgcgggcctaaacctaagacctttttgctgaaaccatctgcttccgcctcctcccccaagctccattcaagcgctgctgtgcatcgactcaagaaagatatccggagatgtcatcgcatgtctcgccgacctctgcccaggcctgaccctcaggggggctctccaggtctgagacccccgattagcccctttagcgagaccgttagaattatcaatcggaaggtgaagccgagagagcctaagagaaatcgaattattttgaatctgaaggtaattgataaaggcgctggcggcgggggagccggacagggcgctggggctctcgctaggcccaaggtgcccagcaggaatagggtaatagggaaatcgaagaagttctcggaatcggtactcagaacacagattcgtcatatgaaattcggcgcattcgctttgtataaaccaccaccggctcctttggtggcccccagccctggtaaggctgaagcgtctgccccaggacccggcctgctcctggctgcccctgcggccccttacgacgctagatccagcggttcatcaggctgcccttcccccacgccccagagtagcgatcccgacgacacgcctcccaagctgctacctgagaccgtgtccccctcagctccttcgtggcgagagcctgaggtgctagatcttagcctacctcctgagtccgccgccacaagcaagcgagccccccctgaggttacagctgccgcaggtcctgctcctccaactgcacccgagccagcaggagcgtcttcggaacctgaagccggggactggagacctgagatgtccccatgttccaacgtggtggtcacagacgtgacttctaatctgttgaccgtgaccattaaagagttttgcaatccagaggattttgaaaaagtcgccgcgggagttgctggggccgcaggcggcgggggcagcatcggagcttcaaaatag

SEQ ID NO: 45573 - DNA, 411 bp, Artificial Sequence
  Description of Artificial Sequence: Synthetic coding sequence
atgcacgcccggggcccccacggccagctgagccccgccctgcccctggccagttccgtactcatgctcctaatgagtacgctgtggctggtcggcgccggtccaggcctagtcctggcccccgagctgctgttggacccttggcaagtgcacaggttgctaacccacgcattaggtcatactgccctacctggcctgttactgtctttgctgctccttcccacggtcggctggcagcaggaatgtcatctgggtaccctgaggttcctgcacgcatcagccctgcttgcgctggcctccggcctcttggcagtgctgctggcggggctggggctgagtagcgccgcaggatcatgcgggtacatgccggtacatctggctatgcttgcaggtgaagggcaccgaccttag

SEQ ID NO: 45574 - DNA, 588 bp, Artificial Sequence
  Description of Artificial Sequence: Synthetic coding sequence
atgcacgcccggggcccccacggccagctgagccccgccctgcccctggcctcctctgtcctgatgctcctcatgagcacattgtggttggtgggggccggccctggactggtcctggctcccgaactgctgctggacccatggcaggtgcatcgtctgctgacccacgctcttggtcatactgcactgccaggattactgctgtctctgctgctcttgccgaccgtggggtggcagcaggaatgtcatctgggcaccctcaggttcctacacgcatcggcactgctggctctggcctccggcctcctcgccgtgttattggccggactcggactgtcttcggctgccggctcctgcggatacatgcccgtgcacctcgctatgttggccggggaaggccatcgccctcgccgaccaaggggtgccctgcccccttggttatctccgtggctgctattggccctcactcccctgctgtccagcgaaccgccctttttgcagctcctgtgtggcctgctggccggcttagcatatgccgcaggcgcatttagatggctggagccgagtgagaggagactccaggtgtag

SEQ ID NO: 45575 - DNA, 912 bp, Artificial Sequence
  Description of Artificial Sequence: Synthetic coding sequence
atgaagggcaaggaggagaaggagggcggcgcccggctgggcgccggagggggaagtcccgaaaaaagcccaagtgcccaggagcttaaagaacagggaaaccgcctgttcgtcggtcgtaagtaccctgaagcagcagcctgttacggtagagcaattacgcgaaatcctctggtcgcggtgtactacactaacagagccttgtgctatctcaagatgcagcagcatgagcaggccctggcagactgtcggcgagccttagaactggatggccagtccgttaaggctcactttttccttggacagtgtcagttggaaatggagagctacgacgaagctattgcaaatctacagcgcgcatactcccttgccaaagagcagagactgaacttcggagatgacatcccttcagcactcaggatcgccaagaaaaagagatggaatagcatcgaggagagacggattcaccaggaaagcgagctccatagttatctgtcacgcctgattgccgccgaaagagagcgcgaactcgaggagtgccaaaggaatcacgagggggacgaagacgactcccacgtacgggctcagcaggcttgtatcgaggccaaacacgataagtacatggctgatatggacgagttgttctcccaggtagatgaaaagcgcaaaaaacgcgacatcccagattatctctgtgggaagatttctttcgaattgatgcgtgagccatgcattacccccagcgggatcacttacgaccggaaggacatcgaggagcacctacagcgcgtgggacacttcgacccagtgactcgctctccactgactcaggaacagcttattccaaatctagcgatgaaagaagttatcgatgcatttatctccgaaaatggatgggttgaggattattag

SEQ ID NO: 45576 - DNA, 1122 bp, Artificial Sequence
  Description of Artificial Sequence: Synthetic coding sequence
atggaccggagcagcctgctgcagctgatccaggagcagcagctggaccctgaaaatactggcttcataggagccgacacattcaccggacttgtgcacagccacgagctgcccctcgatccagctaaactggatatgctagtcgccctggcgcagagcaacgaacagggtcaggtgtgctaccaagagctggtagacctcatcagctctaagagaagctctagctttaagagagctatcgccaatggccagcgtgccctgccaagagacgggccactagatgagccagggctcggcgtttacaaaaggtttgtgagatatgttgcctatgagatcctgccctgtgaagtggataggaggtggtatttttataggcaccgttcctgccccccccccgtcttcatggcctcagtcaccctcgcccaaattattgtgttcctttgctatggggctcgattgaataaatgggttcttcagacctaccaccccgaatacatgaaatctcccttggtgtaccaccccgggcatcgcgccagagcctggaggtttctcacttacatgttcatgcatgtaggtttggagcagctgggattcaatgccctgctccaattgatgatcggcgttccgttagagatggtccatggcttattaaggatctctctgttgtatcttgccggcgtgctagccggctccctcactgtgtctatcaccgacatgcgggcgcccgtcgtaggcggctcaggaggcgtgtacgctctctgctccgctcaccttgctaacgtggttatgaattgggctgggatgaggtgcccctacaagctgctacggatggtccttgctcttgtatgcatgtctagcgaagtgggaagggccgtttggctccgttttagtcctccgctgcctgccagcggacctcaacccagttttatggcacacctggccggagccgtcgtgggagtcagcatgggattgaccattctgcgttcgtacgaggagcgactacgtgaccagtgtggttggtgggttgtcctgctggcgtatggtacattcctgcttttcgctgttttttggaacgtctttgcctatgatctactgggagcgcatataccccctcccccctag

SEQ ID NO: 45577 - DNA, 933 bp, Artificial Sequence
  Description of Artificial Sequence: Synthetic coding sequence
atggaccggagcagcctgctgcagctgatccaggagcagcagctggatccagagaatactgggtttattggggcagacacgtttacaggactggtgcactcgcatgagctgcctcttgatccagctaagcttgatatgctcgtggcccttgcacagagtaacgagcaagggcaggtctgctaccaggaactcgtcgaccttatttcctcaaagaggtcctcaagtttcaagagagccatcgccaatggacagcgggctctcccacgcgatggtcccctggacgaacccgggttgggggtgtacaagcggtttgttcgttatgtcgcttacgaaattctgccttgtgaagttgatcggcgttggtacttctatcgccatagatcttgcccacctccagtgttcatggcgagtgtaacactagctcagattatcgtctttctgtgttacggagcaagactgaacaagtgggtactgcaaacttatcaccctgagtatatgaagtccccgctagtttatcatcccggacatagagctcgggcatggcggttcctcacgtacatgtttatgcacgtggggctggaacagctgggctttaacgcgctgctccagctgatgataggcgttcctctggaaatggttcatggcctgctaagaataagcctcctttacctggccggagtgctggcaggctcgctaacagtgagcatcacagatatgcgggccccggtggtagggggtagcggcggagtctacgctctctgtagcgcccacttggctaacgtagtgatggtaacaggtctgcccggagggggtcggggcgaagggcctcaagtctctctcacaaccagcagattacatacccccatagaacttggctgggacgaaatgagtctccaggtggccgaagacggggcaggactgggcgtgcagtag

SEQ ID NO: 45578 - DNA, 912 bp, Artificial Sequence
  Description of Artificial Sequence: Synthetic coding sequence
atggccgccgtgcacgacctggagatggagagcatgaacctgaacatggggagggagatgaaggaggagctcgaagaggaggagaagatgcgtgaggatggcggagggaaggatagagcgaaaagtaagaaggtgcaccgaatcgtctccaaatggatgcttccagaaaaatcaaggggtacttacttggaacgagcaaattgcttcccgccccctgtttttataataagcatcagtctggcggaactggccgtttttatttactacgctgtgtggaagccgcagaaacagtggataactcttgacaccgggatactcgagtccccattcatatattcccctgagaagcgagaggaggcctggcgctttatcagctacatgctcgtacatgctggcgttcagcatatcttgggtaatctgtgtatgcagctggtcctgggcatccccttagagatggtgcacaaggggctgcgggtgggtctcgtgtatctagccggcgtgatcgcgggctccctcgcctcatcgatcttcgatccgctgaggtatttggtgggggcctcggggggagtgtacgccctgatggggggatattttatgaatgttctggtcaactttcaggaaatgattccagctttcggaatattccgactgctgattataatcttaattatcgtcctagatatgggattcgcactatacaggaggtttttcgtaccagaggatggcagtcccgtgtccttcgcagcgcacatcgccggcggattcgcgggcatgtctatcggttacactgtgttttcttgcttcgataaggcccttctgaaggatcctagattttggattgctatcgccgcatacctggcttgtgttttgttcgcggtgttcttcaacattttcctgtctcctgcaaactag

SEQ ID NO: 45579 - DNA, 1152 bp, Artificial Sequence
  Description of Artificial Sequence: Synthetic coding sequence
atgcagctgggcaagcggcacaagctgaccaccaagagcgtgtgccacggcaagggggttgtaatcagagtcctggccctgccaggccctagttgggtgcgtcggaggcgtgagggtaaggccttggaatcttctcgctgcgccagacaacctcgcgaagagaggcagccagaagacttggggcctccggcagtcccttgggactcttgcccgtcaggcgaagaaggcgggccaagaaccatggccgcagttcatgaccttgaaatggaaagcatgaacttgaacatggggagggagatgaaagaagaattagaagaggaggagaagatgcgggaagacggagggggtaaggatagagcgaagagcaagaaggtccacagaatcgtctccaaatggatgttgccggagaagtctagagggacctacctagagagggccaattgctttcccccccccgtattcattatatctatcagtctagctgagctcgctgtcttcatttactacgcagtttggaaaccccagaagcaatggattactctggacaccggaatcctggaatccccctttatttatagcccggagaaaagggaagaggcctggagatttatcagctatatgttggtgcacgccggagtgcaacacattcttggaaacctgtgtatgcagctggtgttgggcattccactcgagatggtacacaagggattgcgggtgggcctggtgtatctggctggtgttatagccgggtctctggcctctagcatcttcgaccctcttcgttacctcgtgggagcaagcggaggcgtgtacgcactgatgggtggatatttcatgaatgttctcgtgaatttccaagagatgattcctgcgtttggaatcttccgattacttatcattattctgatcattgtgttagatatgggattcgccctgtacagacgcttcttcgtgcccgaagatgggagtcccgtgtcctttgccgctcatattgccggcggctttgccggtatgagtattggatacaccgtcttctcttgctttgataaagctcttctaaaggatccacggttctggatcgcaattgctgcttatctggcatgtgtgcttttcgcagtctttttcaatattttcttgagtcctgccaattag

SEQ ID NO: 45580 - DNA, 912 bp, Artificial Sequence
  Description of Artificial Sequence: Synthetic coding sequence
atggccgccgtgcacgacctggagatggagagcatgaacctgaacatgggccgagagatgaaggaggagttggaggaggaggaaaaaatgcgcgaggacggggggggtaaagatagggccaagagcaagaaggtgcaccgcatcgtgtctaagtggatgcttccagaaaagtctagagggacctacttggagcgagcaaactgttttcctcccccagtgttcatcattagtatcagtttggccgaacttgcagtattcatttactatgccgtgtggaaaccacagaagcagtggattaccctggacaccggcattctggaatcaccctttatttacagtcctgagaagagagaggaggcctggagatttatttcttatatgttggtacatgcaggagtgcagcacatcctagggaacctgtgtatgcagctggtgttaggtattcctctggagatggtccataaggggctccgggtgggtctagtttatctggccggggtcatcgccggctccctggccagcagtattttcgacccactgaggtacctcgtgggcgcgagcgggggggtctacgccctgatgggaggctacttcatgaatgtcctggttaacttccaagaaatgatccctgccttcggaattttccgcttgctgattattatcctaatcattgttcttgacatggggtttgcactgtaccgtcggttctttgtccccgaggacggatcccccgtgtccttcgccgctcacatcgccggcgggttcgcaggcatgagtattgggtacactgttttttcttgtttcgataaagctctgctgaaggatccgcggttctggatcgcaattgcggcctatctcgcgtgcgtcctcttcgctgtcttcttcaatatcttcctgtcaccggccaattag

SEQ ID NO: 45581 - DNA, 1113 bp, Artificial Sequence
  Description of Artificial Sequence: Synthetic coding sequence
atgaccaccacctacatgctgagcaagaaccccctggaggtgttcgatatctgccgatttaatacttgtaactttggtaaagcccttgagtcgagtcggtgcgctagacagccccgggaggagcggcagcctgaggatttaggccctcccgctgtcccctgggactcgtgtccaagcggagaagagggcgggccccggaccatggcagcagttcacgatctggaaatggaatcaatgaacctaaacatggggcgcgaaatgaaggaagaacttgaagaggaagagaaaatgcgtgaggacggcggcggaaaggacagggccaagtccaaaaaggtacacagaatagtatctaaatggatgctccccgaaaagtctaggggtacatacctggagcgcgcaaattgttttcctccaccagtcttcattatctccatctcattggcagagctggcggtgtttatatattatgcagtgtggaagccacagaagcagtggattacactagatactgggattctggagtcaccttttatctatagtccagaaaaacgagaggaggcttggcggtttataagctacatgctggtccacgcgggggttcagcatatactcggaaacttgtgtatgcagttggtgctcgggatacctctggagatggtgcacaagggtttacgagtgggactcgtgtatcttgccggagtcattgctgggagcctcgcaagtagcatttttgatccactgcggtatctggtgggcgcctccgggggtgtgtacgcacttatgggggggtactttatgaatgtgctggtgaatttccaggagatgatccctgcctttggaatttttaggctgttgataattatcctgatcatcgtgctcgatatggggttcgccctgtatcgtcggttctttgtccccgaagatggcagcccagtgtccttcgccgcgcatatcgctgggggatttgcaggcatgtccatcggatacaccgttttctcttgttttgacaaagccttgcttaaagacccacgcttttggattgcaattgccgcctatcttgcttgcgtgctctttgctgtgttcttcaacatcttcctaagccctgcaaattag

SEQ ID NO: 45582 - DNA, 1215 bp, Artificial Sequence
  Description of Artificial Sequence: Synthetic coding sequence
atgggcgagcaccccagccccggccccgccgtggccgcctgcgccgaagctgagaggatcgaggagctagagccggaagcagaggaaagactgccagctgccccagaggatcactggaaggtgttgtttgatcaatttgatccaggaaacacaggctacatctccacgggtaagtttcgcagcctgctggaatcacactcgtctaaattagatcctcataagcgggaggtgctacttgcactggccgacagccacgccgatgggcagatcgggtaccaggacttcgtctcccttatgtccaacaaacgcagcaactcattcagacaagccatcctgcaaggcaatcgaagactcagctccaaggcccttctggaggagaagggcttatccctgtcacagcggctgattcgccatgtggcttatgagactctgccaagagaaattgacaggaaatggtactacgattcctacacatgttgtccccccccctggtttatgatcacagttacactgcttgaagtggccttcttcctgtacaatggggtgtctctgggccagtttgttcttcaggtgactcacccgcggtatctgaagaactcactagtgtaccaccctcagttgagagcccaggtttggcgctacttaacttacatatttatgcatgcaggtatcgaacatctgggcctcaatgtggtcctgcaattgcttgtgggagtgcctctggagatggtccatggggccacacgcattggtctggtatatgtggccggcgtggtggcgggctccctggcggtgtctgtggcagacatgacagcccccgtggtgggtagctccggtggcgtgtatgcgcttgtgtcagcgcacctagccaacattgtgatgaactggtctggcatgaaatgccagttcaagctactgagaatggcagtggcgctgatctgcatgagcatggaattcgggagagcagtctggcttcggttccatccctcagcctatccaccttgcccccatccgagctttgtagctcacctgggcggcgtggcagtgggcatcactctaggcgtagtggtgctgcggaattacgagcagaggctccaagaccagtctctgtggtggattttcgtcgccatgtacaccgttttcgtactgtttgcagtgttctggaacatctttgcttacacactgctggatctcaagctgcctccgcctccctag

SEQ ID NO: 45583 - DNA, 1287 bp, Artificial Sequence
  Description of Artificial Sequence: Synthetic coding sequence
atgggcgagcaccccagccccggccccgccgtggccgcctgcgccgaggctgagcggatagaggagctggaacccgaagctgaagagcggctacctgccgctcccgaggaccactggaaagttctgtttgaccaatttgaccctggaaatactggttacatcagtacaggcaagtttcgatcattgctggaaagccattcctctaagctcgatccacacaagagagaggtgctgctcgcgctcgccgactcccatgctgatggccagatcgggtatcaagatttcgtgtctctgatgtcaaacaagagatccaactcatttaggcaggcgatcctccaggggaaccgtaggctgtcttctaaggctttgttagaagagaagggattgtcgctgagccagcggctaatcaggcacgtagcatatgagacgctgccccgtgagatcgacaggaaatggtattacgactcttacacctgttgtccacccccgtggttcatgatcacagtgaccttgctcgaggttgccttctttctgtataatggcgtgtcgctgggacaattcgtactgcaggtgacccaccctcgatacttaaagaacagcctagtgtaccacccccagctcagagctcaagtctggagatacctaacatacattttcatgcatgccgggattgagcatcttgggttgaatgtcgtgctgcagttgctggtaggtgtgcctcttgagatggttcatggcgcaactcgcatcggcttagtgtacgtggccggagtagtggccgaactggtgcgccatgaggtccccgtgcaggctgccgcagatggatgtggtccgtatctctacgagcatggagtgtgggctggcagagtagcgcccctccctcccgtgggactgtccccagtgccgtccccgaagctgtgcggagctctgggatggagagggagagggcaccacccgggaagaggaggccccgaggaactgagagccgaggcacctgggccggttaccgttgtggatttctgtgggcacgtacaccggcttagagctgtgcggtgtttactggaacacctttgtctgcacccagctggcctcaaggccgcagcctctccccttcgcgccggagggccacgcagcggaaggggggggaagtcatccactcatcgcgagcgacttagaggctttttctcttcccccgcccagctcggtcgggcagataaagaccggcggttgtgggccaccgtgatgtttgtatttcgctttggccataccgtggaaacgttattctag

SEQ ID NO: 45584 - DNA, 921 bp, Artificial Sequence
  Description of Artificial Sequence: Synthetic coding sequence
atgagcaacaagcggagcaacagcttccggcaggccatcctgcagggaaatcgtcgcctgtcttcaaaggctttgctggaagagaaggggctttcgctctcacagcggctgatccggcatgtcgcttacgaaacactccccagagagatcgatcggaagtggtactacgattcctacacttgttgcccgcccccgtggttcatgatcactgtgaccttactagaagtggccttctttctgtacaatggcgtttcgttgggacagttcgtgcttcaagtgacccacccaagatatctgaagaattcgctagtgtaccatccacagttaagggcccaagtatggcgttatcttacttacatttttatgcatgcagggattgagcacttaggcctcaatgtggtattacaactcttagtcggtgtgccactggagatggttcatggcgccaccaggatcgggttggtgtatgtcgctggcgtggtggcaggtagtctagccgtgtctgtagccgatatgacggccccggtcgtgggctcatcaggcggcgtttacgcgctggtgtcagcccaccttgctaatatcgtaatgaactggagtgggatgaaatgtcagttcaaactcttaaggatggcggtcgctctcatttgcatgtcgatggaattcggtagagcagtgtggttaagatttcacccttcagcgtacccaccgtgtcctcacccttcattcgttgctcacctgggcggcgtcgccgtcggaatcacacttggggtggtcgtccttaggaactatgaacaacgtctgcaggaccagtcactatggtggatctttgtggccatgtacaccgttttcgtcctgttcgccgtcttctggaacatcttcgcatatacgctcctggacctgaagctcccgcctcccccttag

SEQ ID NO: 45585 - DNA, 1191 bp, Artificial Sequence
  Description of Artificial Sequence: Synthetic coding sequence
atgggcgagcaccccagccccggccccgccgtggccgcctgcgccgaagctgaaagaatagaggagctcgagccagaagctgaggagagactgccggcagcgccggaagactttgatcctggaaatacaggttatatatctacaggcaagttcagaagtctgctcgaaagtcacagcagcaagctggacccccataagagagaggtgctcctggccttggcagacagccatgccgacggacagattggataccaggacttcgtctctctgatgtccaataagaggtcaaattcgtttagacaggccattctgcagggcaaccgaagactcagttcgaaagccttactggaagaaaaaggcctctcacttagtcagaggctcattcgccatgtagcttatgagacactgccacgcgaaatcgatagaaagtggtactatgatagctacacttgttgcccccctccatggttcatgatcaccgtgactctgctggaggtagcgttttttctctacaatggcgtgagcctgggacagttcgttctgcaagtaacacaccctaggtaccttaaaaattcactggtgtaccacccccagctgcgcgcccaggtttggaggtatctgacatatatttttatgcatgcagggatcgaacaccttgggctgaatgtggttctgcagctacttgtgggagttcctctggagatggtccatggagccacaagaattggcctggtgtacgttgccggggtggtcgcaggctcacttgcagtgtccgtagctgatatgacggcacctgtcgtgggcagttctggtggggtgtacgcattggtgtctgcccacctggcaaacattgtaatgaactggtcagggatgaagtgccagttcaaacttctgcgcatggccgtggcgctgatttgcatgtctatggagtttggccgggctgtctggctaaggttccatccctccgcctatccaccttgtccgcacccctcctttgtggcccatctagggggagttgccgtaggcatcacactaggagtggtggtgctgcggaactatgaacagcggctgcaggaccagtccctgtggtggattttcgtcgccatgtacaccgtgtttgtgctgttcgccgtcttttggaatatcttcgcctatactctgttggaccttaagctgccgcctcctccttag

SEQ ID NO: 45586 - DNA, 927 bp, Artificial Sequence
  Description of Artificial Sequence: Synthetic coding sequence
atgtgcctgctgctgagcagcgccgtgttcggcgtgaagtacaaccttctggcgcacactactcttactctggaaagcgctgaggactcgtttaaaacacataatttgagcatcaacgggaatgaagagtcctcattctggctacccctctatggcaatatgtgctgtcgtttggtggctcagcccgcctgtatggccgaagatgctttcgcaggatttcttaaccagcagcagatggtcgaagggctgattagttggaggcgcctgtactgcgtgttgagagggggcaaactgtactgtttttattcacctgaggaaattgaggctaaggtggagcccgcgcttgtcgtaccaattaacaaaagcttagtgctgttcgaggacagcctggagggaatacagctggcaatctcccagagctttaaggaaactagaatccgcgccatggacaaggacgccaaaaagcggattcataacttctccgtgataaatcctgtgcctggccaggctatcacacagatctttgccgtggataacagagaagatctgcagaagtggatggaggcattttggcaacacttcttcgacctttcccagtggaagcattgttgcgaggagctaatgaaaattgaaataatgtcccccaggaagccaccactctttctgacaaaagaagctacaagtgtataccacgatatgagtattgacagtcccatgaagttagagagcctgacagacatcatacagaagaagatcgaagagacaaatgggcagttccttatcggccaacacgaagagtccttgcctccgccctgggcgaccctcttcgatggtaaccatcagatggttattcagaagaagaataactccaaccagctacacaatctgcagaaattgcctgctactagcaagtttttgtttacatag

SEQ ID NO: 45587 - DNA, 1830 bp, Artificial Sequence
  Description of Artificial Sequence: Synthetic coding sequence
atggagggccccagcctgcggggccccgccctgcggctggccggcttaccaactcaacaagattgtaatatccaggagaaaattgacttggagatacgaatgagagagggaatctggaaactcctcagtctgtcaacccaaaaagaccaggttctgcacgcggttaaaaatctgatggtctgcaacgcgcggctcatggcttatacttcagaacttcaaaagttagaggagcagatcgcaaatcaaactggtaggtgcgacgtgaaattcgaaagcaaagagcggacggcatgcaagggcaaaatcgcaatcagtgacattcgtataccactaatgtggaaagacagcgatcatttcagcaacaaggagcgctcccggaggtacgcaattttctgcctgttcaagatgggcgccaacgtcttcgataccgatgttgtcaatgttgacaagactattacagacatctgcttcgagaacgtgactattttcaacgaagcaggaccagacttccagattaaagtcgaggtttattcgtgctgcacagaggagagttcgattacaaatacccctaagaagctcgctaagaagctgaagaccagtatcagtaaagctacaggcaaaaagataagctccgtcctgcaggaagaagatgatgagatgtgcttactactatcaagcgccgtgtttggagtaaagtataatcttctggcacatactactctgactctagagtcagccgaagactcatttaagacccacaacctgtctattaatggcaatgaagagtcatctttttggctgcctttgtatggaaatatgtgctgccggctggtggctcagcccgcttgcatggcagaggacgccttcgccgggtttttgaatcagcagcagatggtggagggtctgattagttggcgccgactgtactgtgttttgaggggcggaaaactgtactgcttttactcaccagaggaaatagaagccaaggtggagcctgcacttgtggtgccaattaataaagagacacggatccgcgccatggataaagatgccaagaagagaattcacaatttctccgttataaacccggtgccggggcaggcaattacccaaatctttgcagtcgataaccgcgaggatctccagaaatggatggaggcattctggcagcacttcttcgatttgagtcagtggaagcattgttgcgaagaacttatgaagatcgagatcatgtccccccgaaagcccccacttttcctgacgaaagaggcgacatctgtgtatcacgacatgtctattgactcacccatgaaattggagagtctgacagacatcattcaaaaaaagatagaggagacaaacgggcagtttctcataggccagcacgaggaaagcctgccacccccctgggctaccctcttcgatggtaatcaccagatggttattcaaaagaaagtgctgtaccccgcttcagagccactccacgatgagaaaggtaagaaaaggcaagcaccgctgcctccctccgacaaactacctttctccctgaagagccagtcaaacacagatcagcttgtcaaggataactggggaaaaaccagtgtctcccagacaagctctcttgataccaagctctccacccttatgcaccatctgcagaaacccatggcagcccccagaaaactgctgccggctcgccgcaataggctgagtgacggagagcacaccgatacaaagaccaacttcgaagcaaaaccggtgccagcgcctcgacagaagtctataaaagatatcctggatcccaggagttggctgcaggctcaagtgtag

SEQ ID NO: 45588 - DNA, 492 bp, Artificial Sequence
  Description of Artificial Sequence: Synthetic coding sequence
atggagggccccagcctgcggggccccgccctgcggctggccggcctccctacccagcaggactgtaacattcaggaaaaaattgacctagaaatccggatgagggagggtatctggaagctactgtcattatcaactcagaaagaccaggtccttcatgcagtgaagaacttgatggtgtgcaatgctcgactgatggcttacacaagcgagctccagaagctcgaggagcaaattgccaaccagacaggaaggtgtgatgtaaagtttgagagcaaggaacggaccgcctgcaaagggaagattgctatctccgacatacgaattcccctgatgtggaaagatagcgatcacttttctaacaaagagaggtcgaggcggtacgccatcttctgtttgttcaagatgggcgccaacgtttttgatactgatgtcgttaacgttgacaaaacaattacggacatttgcttcgagaacgtcacgatcttatag

SEQ ID NO: 45589 - DNA, 1584 bp, Artificial Sequence
  Description of Artificial Sequence: Synthetic coding sequence
atggagggccccagcctgcggggccccgccctgcggctggccggcctgcctactcagcaggattgtaatatacaagagaaaattgacctagagatacgtatgcgggaaggcatttggaaattgctgtcccttagcactcagaaagaccaggtgttacacgcagttaagaacctgatggtttgtaatgctcgtctcatggcctacacctctgagctgcaaaaactggaggagcagattgctaatcagacaggacggtgcgatgtgaaattcgagtccaaagagcgaaccgcatgtaaggggaaaatcgcaatttccgacattagaatacctcttatgtggaaagattctgaccatttcagcaacaaggagcgctctcggcgctatgcaatattctgcctctttaagatgggggctaatgtgtttgacacagatgtagtgaacgtggacaagacgatcaccgacatctgcttcgagaatgtgactattttcaatgaggccggacccgacttccaaatcaaagtcgaagtttattcatgctgcaccgaggagagctccataacaaacacccccaagaagctcgctaagaagttaaagactagcattagcaaagctaccggtaagaagattagctccgttctgcaggaagaggacgacgaaatgtgtttactgctgtcctctgcagtgtttggcgtaaagtacaacctacttgcccacacgactctgacactggaatcagcagaggactccttcaagacacacaatttatctataaatggaaatgaagaaagctctttttggctccctttgtatggaaacatgtgttgccggttggtcgctcagccagcctgtatggctgaagacgccttcgcggggttcttgaaccagcagcagatggttgagggccttatatcgtggcgaagattatactgtgtgctacgaggcggcaagctgtattgcttttacagccctgaggagatcgaggccaaagtcgaaccagcactcgtcgtccctatcaataaatcactcgttctgttcgaggactctttggaaggcatacagttagcaatctcgcagagcttcaaggaaactcgaatcagggcaatggacaaagatgccaagaagcggatccataactttagcgtgattaaccctgtgccaggacaggccattacccagatcttcgctgtagataaccgagaagatttgcaaaaatggatggaggcattctggcagcactttttcgacctcagtcagtggaaacactgctgtgaagagctgatgaagatagagatcatgtccccaaggaagcctccattgtttctcaccaaggaggcaacttcagtataccacgatatgagcatcgattcacccatgaaattggaaagtcttactgatattatccagaaaaagattgaggagaccaatgggcagttcctgatcggtcagcacgaggaatccctgccacccccgtgggcaaccctgtttgatggaaatcatcagatggtgatacaaaagaagaacaactcaaatcagcttcacaatctgcagaaactccctgcaactagtaagtttctcttcacatag

SEQ ID NO: 45590 - DNA, 297 bp, Artificial Sequence
  Description of Artificial Sequence: Synthetic coding sequence
atggccagcctgctgtgctgcggccccaagctggccgcctgcggcatagtgctcagcgcctggggggtcatcatgctcattatgctggggattttttttaacgtccactcagctgttctgatcgaagacgtacccttcacggagaaagatttcgaaaatggaccgcaaaatatctacaacttgtacgagcaagtctcttacaactgttttattgccgctggcttgtacctgctgctgggaggcttttctttttgtcaggtacggctcaataagcgcaaggagtacatggtgcgatag

SEQ ID NO: 45591 - DNA, 414 bp, Artificial Sequence
  Description of Artificial Sequence: Synthetic coding sequence
atgggctggctgcggcccggcccccggcccctgtgcccccccgccagagcctcctgggcgttcagccatcggtttcccagtcctcttgccccccgaagatctcccaccccctttttcatggcttcattactatgctgcggacctaaactggccgcctgcggtattgtactgtcggcatggggagtcattatgctgataatgctgggtattttcttcaacgtccacagtgccgttctaatcgaagatgtgcccttcacagaaaaggatttcgagaacggccctcagaatatctataacctttatgaacaggtgagctacaattgtttcatcgccgccggactctatctgttactcggaggtttctctttctgccaagtgaggctgaataagcgaaaggaatacatggtccgctag

SEQ ID NO: 45592 - DNA, 471 bp, Artificial Sequence
  Description of Artificial Sequence: Synthetic coding sequence
atgcagatcttcgtgaagaccctgaccggcaagaccatcaccctggaggtcgagccctcggatacgatcgaaaacgttaaggctaagattcaggataaagaaggtataccccctgaccaacaaaggctgatcttcgccgggaaacaactggaagacgggagaactctatccgattacaacatacaaaaggagagtactttgcacctggttctccgtctgagaggcggggccaagaagcgcaagaagaagagctacaccactcctaagaaaaataagcacaagaggaagaaggtgaaactggcggtgctgaagtactataaggtggatgagaatgggaagatcagccgcctgcggcgtgaatgcccatctgacgaatgtggcgcaggtgtgtttatggcctctcattttgatcgtcactattgtgggaagtgttgcttgacttactgctttaataaaccagaggacaaatag

SEQ ID NO: 45593 - DNA, 471 bp, Artificial Sequence
  Description of Artificial Sequence: Synthetic coding sequence
atgcagatcttcgtgaagaccctgaccggcaagaccatcaccctggaagtggagccaagtgatacaattgagaacgtgaaggccaaaattcaggacaaggagggcattccccctgatcaacagagacttatcttcgccggaaaacagctggaggacggacggactctgtccgactacaatattcagaaagaaagcacgctacacttagtgttgagactcaggggtggtgcgaagaaaagaaaaaaaaaaagttatactactcccaaaaagaacaagcacaagagaaaaaaggtaaaactggctgtcctcaaatactacaaggtcgatgagaacggcaaaattagccgactgagaagagagtgtccctccgatgagtgtggggcaggggtgttcatggcgtcccacttcgacaggcactattgcgggaagtgttgcttgacctattgcttcaataagccagaggacaagtag

SEQ ID NO: 45594 - DNA, 471 bp, Artificial Sequence
  Description of Artificial Sequence: Synthetic coding sequence
atgcagatcttcgtgaagaccctgaccggcaagaccatcaccctggaagtggagccctccgatacgattgaaaacgtcaaggcgaagattcaagacaaggaaggtatcccccctgatcaacagaggctgatcttcgctggcaagcaactggaagacggacggactttgtcagattacaacatccaaaaggagagcaccctgcatctggttttgcgactgagggggggagcgaagaaacggaagaaaaaaagttacaccacaccaaagaagaacaaacacaagcggaagaaagttaagctcgccgttctcaagtactacaaagtggatgaaaacggtaagatctcccgcctgagacgcgaatgcccctctgacgagtgcggcgcaggtgtattcatggcgtcccacttcgaccgccattattgtggcaagtgctgccttacctattgttttaacaagcctgaggataagtag

SEQ ID NO: 45595 - DNA, 321 bp, Artificial Sequence
  Description of Artificial Sequence: Synthetic coding sequence
atgcagatcttcgtgaagaccctgaccggcaagaccatcaccctggaggtcgagcccagcgatactattgagaacgtaaaggcaaagattcaggacaaggaaggcattccaccggaccagcaacgcttgattttcgccggcaaacagctggaagacggccggaccctatcggactataatattcagaaggagtccactcttcaccttgtacttcggcttcggggcggcgccaagaagcggaagaaaaaatcatacacaacgcccaagaaaaataaacataagagaaaaaaagtgaaactagccgttctaaaatattattag

SEQ ID NO: 45596 - DNA, 1428 bp, Artificial Sequence
  Description of Artificial Sequence: Synthetic coding sequence
atgcccggcatcagcgcccggggcctgagccacgagggccggaagcaactggctgtaaacctgacacgcgtgctcgcgctgtacagaagtatcctggacgcttacatcatcgagttttttactgacaacctctgggatacactgccatgtagctggcaggaggcccttgacggactgaagcctcctcagctggccactatgctgcttgggatgcctggcgagggcgaagtggtacgctataggtcagtctggcctcttactcttctcgctctgaagtccacggcctgcgctttagccttcacccgcatgcccggtttccagacaccctcggagtttctcgagaatcctagccagagtagtcgactcacagctccatttcggaagcacgttcggccaaagaagcagcacgaaattagaagactcggcgaattggttaaaaagctctcagatttcacaggatgtacacaagtggtcgacgttggatcaggtcagggccatttatcacgattcatggctctgggtctagggctcatggtgaaaagtatcgaaggcgaccagcggctggtagaacgagcacagagactcgaccaagaactcttgcaggcactggagaaggaagaaaagagaaatccacaggtggtccagaccagtcccaggcattctcctcatcacgtggtgcgatgggtagaccccaccgccctgtgtgaggagctcctgctgccgctggagaacccatgtcagggaagggccagactgctgctcacagggttgcacgcttgtggcgatttatcagtagccctcctgcgtcatttcagctgctgcccagaagtagtggcgctggcttcggtgggatgttgttacatgaaactgagtgatccgggcggctaccctctgtctcaatgggtcgccggtctacctggctatgaactcccctatcggctgcgtgagggagcttgtcacgcccttgaagagtatgcagagcgccttcagaaagccggccccgggctccgtacccattgctatcgggcggcgttagagacagttataaggagagctcgccccgaattaaggcgcccaggcgtacagggcatcccccgagtgcacgaactgaagattgaggaatacgtgcagcggggcctacagcgggtcggcctggatcctcagctgcccctgaatctggcggccctacaggcccacgttgcgcaagaaaacagggtcgtcgccttcttcagtctcgcactcttactcgcccctctggtcgaaacactgatactcctcgatcgcctgctttatctgcaggaacaaggattccatgctgagctgctaccgatcttcagtccagagctcagcccccggaatctggtgctggtggctactaagatgccactcggacaggccctatcggtactcgaaaccgaggattcatag

SEQ ID NO: 45597 - DNA, 834 bp, Artificial Sequence
  Description of Artificial Sequence: Synthetic coding sequence
atgcccggcatcagcgcccggggcctgagccacgagggccggaagcagctcgccgtgaacctgacacgggttttggcactgtatcgatctattctcgatgcttacataatcgagttcttcactgacaatttgtgggatacattaccttgcagctggcaggaggcacttgatggactgaaacctccgcagctcgcaacaatgttgctgggcatgcctggggaaggcgaagtcgtgcgctatcgctccgtttggcctctgacccttctggccctgaagtcaaccgcctgcgcgctggcgtttacacgcatgcccggattccagacgcctagtgaatttcttgaaaatccctctcaatcgtccaggttgaccgcgccctttcgaaaacacgtgcgacccaagaaacagcatgagattaggagacttggtgaattggtaaagaaactgagcgatttcacagggtgtactcaggtggtggatgtcggctccgggcaggggcatctcagccgattcatggccctaggacttggcctgatggttaaatcaatcgagggcgaccagaggctcgtggaacgcgcacagaggctggaccaggagctccttcaggccctggagaaagaggaaaagcgcaacccacagatttgcgcagctggagctacagcctcgggcgccaggagccctgccgctaccgagtccggctgtccaagtgggccccgcgggcccggagagccctgtggagggctcctacaaccgggctcaacagcctgtcccaccggcggagacgcttactctacaggtccagccgccgtgccttccggaacaggtttcccttgctag

SEQ ID NO: 45598 - DNA, 3594 bp, Artificial Sequence
  Description of Artificial Sequence: Synthetic coding sequence
atgggccggagcggcaagctgcccagcggcgtgagcgccaagctgaagcggtggaagaaaggccacagttccgatagtaaccctgccatttgtaggcatcgacaggccgctcgcagcagattcttctcccggccgtcgggccgttctgaccttaccgttgatgcggtgaagctccacaacgaactacagtcagggagtctaaggctggggaaaagtgaagcacccgaaactccaatggaggaagaagcggagctcgtgctgactgagaaaagctccggcacattcctttcgggcctcagtgactgtacaaacgtaacgttttccaaggttcagcgcttttgggaatctaactctgcggcccataaagagatatgcgctgtgctggctgcggtcactgaggttattagatctcaagggggaaaggaaaccgagacagagtactttgccgccctcatcaggaaggcagcacagcacggcgtctgctcggtcctgaaggggtccgagttcatgttcgagaaggcacccgcccaccatcccgctgcaatttccacagcaaagttctgtatccaagagattgagaagagtggagggtccaaggaagccaccacgacgctgcacatgttaaccctcctaaaagatcttttaccttgcttccctgagggtctggtgaaaagttgttctgaaactctgctccgggtcatgaccctgtcacacgtcctcgtgacagcttgtgccatgcaggctttccattcgctgttccacgctaggcctggcctttcaacattgtccgcggagctgaatgcccagattatcacagcactgtacgactatgtaccttctgaaaatgatctacagcctctactggcctggttgaaggtgatggagaaagcccatattaatctcgttagactgcagtgggatctcggactggggcatttgccacgattttttgggacagccgttacctgtctgctgagcccgcatagccaggtgctaacagcggcaacccaatcactcaaggagatcctgaaagaatgtgtagcccctcatatggccgatattggatctgtcacctcaagcgctagcgggcccgctcagtcagtcgcaaagatgtttcgagccgtggaagaaggtctcacctataaattccatgcagcctggagttcggttctgcagctgctatgcgtttttttcgaagcctgcggaagacaggctcatccagtaatgcggaagtgcctccagtccttatgcgacctgagactgtccccacattttccccacaccgccgctctcgatcaagctgtgggcgccgctgtcacatccatgggacctgaggtggtgctacaggctgtcccactagagatcgatggtagcgaggaaacgctcgactttccccgcagctggttattaccagtcatccgtgatcacgtgcaagaaacccggctggggttctttacaacatatttcttgcccctggccaacacgctgaagagcaaggccatggatctggcgcaagctgggtcaacagtggaatctaaaatatacgataccttgcagtggcagatgtggacccttttgcccggattctgcaccagaccaaccgatgtcgccattagcttcaagggcctggcaagaactctgggaatggccatctctgaaaggccagacctccgggttacggtttgtcaggccttgagaactctgattacaaaaggatgccaggctgaggccgacagggccgaagtctcccgctttgccaagaactttttgcccatactgttcaatctctacgggcaacctgtagctgccggcgacacaccagctccacggagagccgtgctggaaactatcaggacttaccttactatcaccgacactcagttagtgaatagtctgttagaaaaggcctccgagaaggttctcgacccagcctccagtgacttcacacggctgagcgtcctggacctagtcgtggccctggccccatgcgccgacgaggctgccatttcaaagctctactccaccattcgcccttatctggagagcaaagcacacggagtgcagaagaaggcgtatagggttctggaggaggtatgcgcctcacctcagggtcccggggctcttttcgtgcaaagccacctggaggacctgaaaaaaactcttctggactcccttcgaagtacctcaagtcctgccaagcggcccaggctgaagtgccttctgcacatcgtccgcaagctctcggccgagcacaaggagttcatcaccgccttgattccagaagtcatcctatgcaccaaagaggtgtctgtgggagcgagaaagaacgcttttgctctgctagtagaaatggggcacgcatttctgaggtttggatcaaaccaggaggaggctttgcaatgctatctggtcttaatctatcccggtctggtaggcgcagtgaccatggtcagttgcagcatcctggcccttactcacctcctgttcgagttcaaaggcttaatgggaacttctacagtcgagcaactgttggagaacgtgtgccttctgctcgctagtcggactagggatgtcgtcaagtcggccctcgggttcatcaaggtggccgtcaccgttatggacgtggctcacctggctaagcacgtgcagctggtaatggaagcgatcggaaaactctctgacgacatgcggagacacttcagaatgaaactcaggaacctgttcactaaattcattcgcaaattcggttttgaactcgtgaaaagactgttaccggaagaataccatagagtgctggtcaatattagaaaagctgaagctcgagccaagcgacatagagccctcagtcaggctgccgtggaggaagaggaagaggaggaagaagaagaggaaccagcccaggggaaaggagatagcatcgaggagattctcgccgacagtgaggacgaggaagataacgaggaggaagagaggagccgaggcaaagagcagcgcaaactggcccgccagaggtcccgagcatggcttaaggaaggaggcggggatgaacctctgaacttcctggatccgaaggtggcccagcgagtgttggcaacacagccggggccgggccgtggccggaaaaaggatcatggatttaaggtgagtgctgacggcaggctgatcatcagagaggaagcagacgggaataagatggaagaagaagaaggtgctaaaggcgaggacgaagaaatggccgatccaatggaagatgtgatcattagaaataagaagcaccagaaacttaagcaccagaaggaagcagaggaagaggagctcgaaattccaccccaataccaagctgggggcagcggcatccaccgtcccgtggcaaagaaggctatgcccggcgcagaatataaagccaagaaagctaagggcgacgtcaaaaagaagggccgacctgacccttacgcgtacattcccctgaatcggagcaaactcaaccgccgcaaaaagatgaagttacagggtcagtttaaggggttggtgaaggccgcacgtagagggagccaggtgggccataaaaataggcgcaaagacaggagaccctag

SEQ ID NO: 45599 - DNA, 3894 bp, Artificial Sequence
  Description of Artificial Sequence: Synthetic coding sequence
atgggccggagcggcaagctgcccagcggcgtgagcgccaagctgaaaagatggaaaaagggtcacagcagcgactccaatcccgccatctgtaggcaccgccaagccgcacgaagtcgttttttctctaggcccagcggcaggagtgacctcacagttgatgctgtgaagcttcacaacgaactacagagtggctctcttcggctgggaaagagcgaggctcccgaaacacccatggaggaggaagccgagctagtccttaccgaaaagagttccggcacctttctctcaggtttaagcgactgcaccaatgtcacattttccaaggtgcagcgcttttgggagagcaactccgcagcccataaagagatctgcgctgtattggctgcggtgacagaggtcatccgcagtcagggtgggaaagagaccgaaaccgaatattttgcagctctcatgaccactatggaggcagtggaaagccccgagtccctcgcggcagtggcatatctgctcaacctcgttcttaaacgggtgccgtcacccgtgctaattaagaaattcagcgacactagcaaggccttcatggatatcatgtctgctcaggcttcttcagggagcaccagcgtactacgctgggtactgagctgcctcgctacgttactgagaaagcaagacctggaggcatggggctatccagtgacattgcaggtctaccacggcttactctcgtttactgtccatcccaagccgaagatccgtaaggccgcccagcatggagtatgttccgtattgaagggatccgagttcatgttcgagaaggcacctgcccaccaccccgcagctataagcacggccaaattttgtatccaagagatcgagaagagcggcggttcaaaagaggccacaacaacattacacatgctgactctgctcaaagaccttctgccctgtttccccgagggcctcgtcaagtcctgcagcgagactctgctgcgcgtgatgacattgagtcatgtgctggtgactgcatgtgccatgcaggcgtttcattcactttttcacgcacgacccggactgagcaccctgtctgctgaactcaacgctcaaataattacagccctctatgactacgtgccatcggagaatgaccttcagccactcctggcctggctgaaggtcatggagaaggctcatattaacctcgtgcgccttcagtgggacctgggcctgggtcacctccctagattctttggtaccgcagtgacatgcctccttagcccccacagtcaggtgttgaccgccgctacgcagtctcttaaagaaatcttaaaggagtgtgttgcaccccacatggccgacatcgggagcgttacctcttcagcaagcggcccggctcagtcagtggcgaagatgtttagggctgtcgaggaagggttgacttacaaatttcatgcggcctggtctagcgtcctccaactgttgtgcgttttctttgaagcctgcgggcgccaggctcatcctgttatgagaaagtgcctgcagtcgctgtgcgatctgagactgagccctcatttcccacacaccgctgcgctggaccaggctgtgggagctgcagtgacctccatgggtcctgaagtcgttttgcaagcagtccccctggagatagacgggtccgaggaaactctcgacttcccccggagctggctcctccctgttataagagatcatgtccaggagacacgcctgggtttttttacaacctacttcctgcctctcgctaacactctcaagtcaaaagctatggatttggcccaggcaggaagcaccgtggagagcaagatctatgatacactgcagtggcagatgtggaccctactcccaggattctgcacgaggcccactgacgtggccataagctttaagggcctcgctaggactctcggcatggccatttcagagcgccccgatttgagagtgaccgtgtgccaggcactgcgaaccctgatcaccaaggggtgccaggccgaggctgatagagcagaagtatcccgttttgcgaaaaactttctgccgattttgtttaacctctatggccagccagttgccgctggtgatacccctgccccgagacgtgctgtgttggaaacgatccggacgtatctgactatcacagacacacagctcgttaacagcctgctggaaaaagcctcagagaaggtgctggatcccgcgagtagtgactttacacggttatccgtattagatctggtggttgctctggctccatgcgctgacgaagctgccatcagcaaactgtactctacaatccgaccgtacctcgagtctaaggcacacggcgtccagaagaaagcgtaccgtgtactagaagaagtgtgtgcctcaccgcagggccctggggcactgttcgtacagagccacctcgaagacctcaagaaaaccctattagattcccttagaagcaccagctcccccgctaaaaggcccagactgaaatgcctgttgcatatcgttagaaagctgtctgctgaacataaggaattcataactgctctaattcccgaggttatcttgtgtacaaaagaagtgagtgtgggtgcaaggaagaacgcttttgcacttcttgtggagatgggccacgcattcttaagattcggttcaaaccaggaggaggctctgcagtgttacctcgtgctgatttatccaggattagttggagcagtcactatggtttcttgcagcattctggctctcacccacctgctgttcgaatttaagggactgatggggactagcactgtggagcagctgctggagaacgtgtgcctacttctggcatctcggacacgggacgtggtgaaatccgccctaggttttattaaggttgctgtcacggtgatggacgtagcacacctggcaaagcatgttcaactcgtcatggaggccattgggaaactctcagacgacatgagaagacactttcggatgaagctgcgcaacttgttcaccaaattcatccggaaattcggattcgagttggtgaagcgcctgctgccagaggagtaccatcgggtgctcgttaatatccgcaaggccgaagcaagagccaagcggcaccgcgccctctcacaggctgcggtggaggaggaagaagaagaagaggaggaagaggaaccagcgcaggggaagggagactccatcgaggaaattctggccgattctgaggatgaagaggataatgaagaggaggaaaggtctagaggaaaagagcagcggaagctcgccagacagcggtccagggcttggctgaaggaaggaggcggcgatgagcccctcaattttctggacccaaaggtggctcaacgtgtgctcgcaacacaacctggtccaggacgcggaagaaagaaggaccacggctttaaggtgagtgctgacggacgtctaatcatccgggaagaggccgatggaaacaagatggaagaggaagagggcgccaaaggcgaagacgaggagatggctgaccccatggaggacgtcatcataagaaataagaaacatcagaagctgaagcaccagaaagaggccgaagaagaagaattagagatcccaccacagtatcaggcaggtgggtctggcattcatcggcccgtcgctaaaaaagccatgcccggcgctgaatataaagctaagaaagcgaagggtgacgttaagaaaaagggacgcccggacccatacgcttatatccccctgaatcggagcaaactgaaccggcgtaaaaagatgaagctgcagggccagtttaagggcttggtgaaggcggctcgccgcggaagccaggttggacacaaaaatcggcgcaaggataggaggccgtag

SEQ ID NO: 45600 - DNA, 3711 bp, Artificial Sequence
  Description of Artificial Sequence: Synthetic coding sequence
atgggccggagcggcaagctgcccagcggcgtgagcgccaagctgaagcgttggaaaaaaggccacagctctgattccaatccagctatctgccggcatcgccaggccgctagaagtcgattctttagccgtcctagcggtaggagtgacctgactgtggatgccgttaaactccacaacgagttgcagagcggtagtcttcggctgggcaaatctgaagcccccgagacccctatggaggaggaagccgagttagtgctgacggagaagagctccggcactttcctctcaggcctttctgactgtacaaacgtgacgtttagcaaagtccagcgattctgggagagcaattcggccgcgcacaaagagatctgcgcggtgctggctgccgtgaccgaggtcatccggtcccagggcgggaaggagaccgaaactgaatacttcgcggccctagtgctgtcttgcctggctacactgcttcgcaagcaggacctagaagcttggggatatcctgtgacactccaagtctaccacggccttctaagttttaccgtccatcctaaacccaagatccggaaggctgcccagcacggggtgtgtagcgtgctgaagggatctgaattcatgttcgaaaaggcccccgcacaccaccctgctgctatatccaccgccaagttttgcatacaggaaatcgaaaagtcgggggggagcaaggaagccaccaccaccctgcatatgctaacgctcctaaaagacctgctgccatgcttccctgagggtttagttaagtcctgtagtgagaccctgttgagggtgatgaccttaagtcacgtgctcgtgaccgcctgtgcgatgcaggcattccattccctgtttcatgccaggccagggctgagtacactgtctgcagagctgaatgctcagataatcacagccctatatgactacgtgccatcagaaaatgatttgcagcctcttctggcttggcttaaagtcatggaaaaggcccacataaatttggtgcgcctccagtgggacctgggactgggacatttgccccggttcttcgggactgccgtgacttgcctgttatccccacattcgcaggttttgaccgcagcgacacagagtctgaaagaaattctgaaggaatgcgttgcgccccatatggccgatattggctctgtcacctccagcgcgtccggtcccgcccaatcagtggcaaagatgtttcgcgcggtggaagagggtctgacatacaagttccacgccgcctggagtagcgtgctgcagcttctctgtgtattttttgaggcatgcgggcgacaggcacatcccgtgatgcggaagtgtctgcagagcttgtgcgatctgaggttgtccccccattttccacacacggccgccctggatcaagctgtgggagctgccgtgacctccatggggccagaggttgtgttacaggccgtgcccctggagattgacgggagtgaagagaccctggactttccccgctcctggttactgcctgtcatccgggaccacgtacaggagacaagactaggattctttacaacatatttcctcccattggcaaataccctcaaaagcaaggccatggacctagcgcaagcagggtctaccgttgagagtaagatttacgatacactccaatggcaaatgtggaccctcttacccggcttttgtaccagaccaaccgacgtcgccatctcctttaagggactagccaggactcttgggatggccatctccgaacgcccggacctccgggttaccgtctgtcaggccctgaggacactaattacgaagggctgtcaggctgaggcagatcgggcggaagtgtctcgctttgccaagaatttcctccccatcctgttcaacctatacggtcagccagtcgccgccggcgatacacccgcacctcggagagctgtgctcgaaaccatccgcacatacctgactataacggatacacagctcgttaatagtctacttgagaaggccagcgagaaggtgctcgatcctgcctcctctgattttactcgactctcagtgttggatctggtggttgctctcgccccgtgtgccgacgaggctgctatatcgaaactttatagtaccattaggccgtatctcgaatccaaggcccacggggtgcagaaaaaggcttacagagtgttagaggaggtctgcgcaagtccccagggcccgggggccctgttcgtgcagtcacatctagaggatctaaaaaaaactctgctcgactcactgagaagcactagctcccctgccaagcggccccgcctgaagtgcctgcttcacatagtccgcaagctctctgccgagcacaaagaatttattaccgctttgattcctgaggtgatcctctgtacgaaggaggtgtcagtcggagctaggaagaacgcctttgctctgctcgtcgaaatgggacatgcttttttgcgcttcggaagcaatcaagaggaagccctgcagtgttacttggtcctaatttatcctggattggtgggtgcagtgacgatggttagttgtagtatattggccttaacccatttgctctttgaatttaaggggctgatgggcacatctacagtggagcagttattagagaatgtctgcctcctgctggcatcgagaacccgagatgtggtgaaaagcgcactggggttcattaaagtggcggtcacggtgatggacgttgcccatcttgccaaacacgtgcaactggtcatggaggcaataggtaaactgagcgacgacatgcggcgtcacttccgaatgaaattaagaaacctatttactaaattcattcgtaagttcggattcgaattagtgaaacgtctattgcctgaggagtaccacagagtcttagttaatatcaggaaagcggaggctcgtgctaagagacaccgggcccttagtcaagcagccgtcgaagaagaggaggaggaggaggaggaagaagaacccgcacagggcaagggggactccatcgaagaaatactggctgattccgaagacgaggaagataacgaagaggaggagcgatctcggggaaaggaacaacggaaattagcgagacagcggtccagagcatggcttaaagaaggggggggcgatgagcccctcaactttcttgaccctaaggtggctcagagggtcctggccacgcaaccggggccaggccgtggccgcaaaaaggatcacgggttcaaggttagtgccgacggaagactgatcatccgcgaagaagctgatggtaacaaaatggaagaagaggagggggccaaaggtgaagatgaagagatggccgatcccatggaggacgttattattcggaacaaaaaacatcagaaactgaagcaccagaaggaggccgaggaggaggagctggaaatcccaccacaataccaggccggcgggagtgggatacatagaccagtggccaagaaggccatgccgggcgctgagtacaaggccaagaaagccaaaggcgacgtaaagaaaaagggtcggcctgatccctacgcttatatacccttgaatcggtctaagctgaaccggcgtaagaagatgaagctccagggccagttcaagggactggttaaagccgcccgccgcggctcacaggttggacacaaaaataggaggaaggatagacggccctag

SEQ ID NO: 45601 - DNA, 3048 bp, Artificial Sequence
  Description of Artificial Sequence: Synthetic coding sequence
atggacatcatgagcgcccaggccagcagcggcagcaccagcgtgctcagatgggttttgagctgtctcgccactctacttagaaaacaggatctggaagcttggggatatcctgtgactttacaggtctaccacggactgctgtccttcactgtgcaccccaagccaaaattggtcaccgcgtgtgccatgcaggcctttcactccctttttcacgcaaggcctggccttagcactcttagcgccgagttaaatgcccagatcatcaccgcactgtacgattacgtgccgtccgaaaacgacttgcagccgctgctggcatggctgaaagtcatggaaaaagcccacatcaacctagtccgcctacagtgggatcttgggctgggacaccttccacgctttttcgggactgctgtgacttgtttgctcagtccacatagccaggtactcacagccgctacccaatcattaaaggagatcttgaaagagtgtgttgcaccccatatggctgacatcggaagcgtgactagttccgcctctgggcccgctcagagtgtggcaaaaatgtttcgcgctgtggaggagggactgacttataaattccacgcagcatggtccagcgtgctacagcttctctgcgtctttttcgaagcatgcggaaggcaggcccaccctgtgatgaggaagtgtctccagagtctgtgcgatctccgtttgtcaccgcacttcccccacacagctgcactggatcaagccgttggcgccgccgttacaagtatgggccccgaggtggtgttgcaagctgttccgctagagattgacgggagcgaggaaacactagactttccacggtcatggctgttacccgtcattagggaccatgtccaggaaacccggctgggcttttttacaacatactttctaccactggcaaacactttgaagagtaaggcaatggatctcgcacaggcagggtctactgtcgagtctaaaatatatgataccctccagtggcagatgtggactttgctgcccggcttctgcaccaggcctactgacgtggcaataagcttcaaaggactggcaaggaccctcggtatggccatctcagagcgcccggacttgagagtaactgtatgtcaagcactacggacactgattactaaaggctgtcaagcagaggctgatcgggccgaggtgtcaaggttcgcgaaaaacttcctgcctatcctctttaacctgtacggacagccagtagccgcgggtgacacccctgcccctagaagagctgttctcgaaaccattaggacctacctgacaatcaccgacacgcagctggtaaatagcctgctcgagaaagcaagtgaaaaagtcttggaccccgccagctccgacttcaccaggctcagtgtactcgatcttgttgtggcgttagctccttgcgctgacgaggcggccatctccaagctctattcaacgattcgcccatacctggagagcaaggctcatggtgttcaaaaaaaggcgtacagagtgctggaggaagtgtgtgcctccccccaaggccccggagctttattcgtgcagtcccacctggaagacttaaaaaagacattacttgattctctccggtccacatcctccccagcaaaacggcccaggctgaagtgtctacttcacatcgtgcggaaattgagcgccgagcataaggaattcataaccgctctcatccccgaagttatactctgcaccaaagaggtttcagttggcgccaggaaaaacgcattcgcactgttggtcgagatggggcacgcttttctgcgatttggctcaaaccaggaggaagctctgcagtgttacctagtgcttatatacccagggctggtgggcgccgtgaccatggtaagttgctcaattctcgcactcactcacttgctgtttgaatttaaggggctgatgggaacctccacagtggagcagctgctcgagaatgtctgccttctgcttgcctcacgaaccagagatgtggtcaaaagcgccctgggttttataaaggtggcggtgacagtgatggatgtggcccacttggccaagcatgtccagcttgttatggaagccatcggtaagctttccgacgacatgaggaggcacttcaggatgaaactgaggaacctgttcacaaaatttataaggaagttcggattcgaactcgttaaacggctccttccagaggaataccacagagtgctggtaaatattcggaaggccgaggcccgagccaaacgacacagagcactgagccaggcggccgtagaagaggaggaggaggaggaggaagaggaggaacccgcacaggggaagggggacagtatagaggaaatactagctgattcagaagatgaggaagacaacgaggaggaggagcgctctcggggaaaagagcagaggaagctggcgcgtcaaaggtccagagcttggcttaaagagggaggaggcgacgagcccttgaattttctcgaccccaaagtcgcccaaagagtgctcgccacgcagcctggcccgggcagaggtaggaaaaaagaccacggctttaaagttagcgccgatggccgactcataatacgggaggaggccgacggaaacaaaatggaggaagaagagggagctaaaggcgaggatgaggaaatggctgatcccatggaggatgtgatcatcaggaataagaagcaccaaaaattgaaacaccagaaggaggcagaggaagaagaattggagataccacctcagtatcaggctggcggaagcggtattcatcgcccagtggcaaagaaggccatgccaggagctgaatataaggctaaaaaagctaagggcgacgtaaagaaaaagggcaggcctgacccatatgcctatattcccctgaatcggtcaaagttgaatcggcgtaaaaaaatgaaactgcaggggcaattcaaggggctcgtcaaggcggctcgtagaggtagtcaggtgggtcacaagaaccggcgcaaagatcgcaggccttag

SEQ ID NO: 45602 - DNA, 849 bp, Artificial Sequence
  Description of Artificial Sequence: Synthetic coding sequence
atggccgccgccgcccccgacagccgggtgagcgaggaggagaacctgaaaaaaactcctaaaaaaaagatgaagatggtgactggggcggtggcgtccgtgcttgaagacgaagccaccgacacttcagacagcgagggctcctgcggatctgagaaagatcatttctattcagacgatgacgccatagaggctgactccgaaggggatgcggagccgtgcgacaaagagaacgagaacgacggcgagagttcagtcgggaccaacatgggctgggccgatgccatggccaaagtactcaataaaaagacccccgaatctaaacccaccattctggtcaaaaataagaagctcgaaaaagaaaaggagaaactcaagcaggaaaggttggagaaaatcaagcagagggataagagattggagtgggaaatgatgtgcagggtcaagcctgacgtcgttcaggacaaggaaacagagcgaaacctccagcgcattgccacccggggtgttgtacagttgttcaacgcggtccaaaagcaccaaaaaaatgtggacgaaaaggtaaaggaggccggctctagcatgaggaaacgggccaaattaatcagcacagtttctaaaaaagatttcatatcagtgctgagaggcatggatggaagcactaatgaaaccgcatcatccagaaaaaagccaaaggcaaaacagactgaggtgaagagtgaggagggaccaggctggaccattctcagggacgacttcatgatgggggcttctatgaaagattgggataaggagagtgatggccccgatgactccagacctgagtcggctagtgatagtgatacgtag

SEQ ID NO: 45603 - DNA, 729 bp, Artificial Sequence
  Description of Artificial Sequence: Synthetic coding sequence
atgtgggccgccgccggcggcctgtggcggagccgggccggcctgcgggccctgttccgctcacgggacgctgccttgttccccggatgtgagcgaggactacactgtagtgctgtttcttgtaagaactggcttaaaaaatttgcgtctaaaaccaagaaaaaagtgtggtatgagagtccatctctagggtcacatagcacctataaaccaagcaaactggaattcctgatgcgtagcacttccaagaagacacggaaagaagaccacgctaggttacgagctctgaatgggctgctgtataaggccctgaccgacctcttatgcacccccgaggtgagtcaggagctgtacgatctgaacgttgagctgagcaaagtgtctcttacgcccgatttctcagcatgccgagcctactggaagaccaccctttcagccgaacagaatgctcacatggaagcagtgctacagaggtccgccgcacacatgtcactcatatcatactggcaatctcagaccttagatcccggcatgaaagagactactctgtacaaaatgatcagtgggactctgatgcctcataatcccgctgccccccagtccaggccccaggcacctgtttgcgtaggatccatcatgaggagaagcacatcaagactgtggagtacaaagggaggtaagattaagggtagcggtgcgtggtgtgggcggggtcgctggttgtcctag

SEQ ID NO: 45604 - DNA, 1032 bp, Artificial Sequence
  Description of Artificial Sequence: Synthetic coding sequence
atgtgggccgccgccggcggcctgtggcggagccgggccggcctgagagcgctcttccgctctcgcgatgccgctctattcccgggctgtgagaggggtttgcactgttccgccgtgagctgcaaaaactggctgaaaaagtttgccagcaaaaccaaaaaaaaggtttggtacgagtcacccagcctgggctcgcactctacatacaagccttctaagctagaattcctcatgcgctcgacctccaagaagacacgcaaggaggaccacgccagattgcgggctctaaatggcctgttatacaaggccttaaccgatctgctgtgcactcctgaggtttcccaggagttatatgatctgaacgtagagttgagtaaagtgagtctgacacctgatttcagcgcctgccgtgcttactggaaaaccaccctctccgctgagcagaatgctcatatggaggccgtgctccaacggtccgccgcacatatgcggcatctcctgatgagccagcagaccttgagaaatgtcccacctatagtttttgtgcaagacaaaggcaatgctgccctcgccgagctggatcagctcctggccgtcgcagacttcggaccccgggatgaacgtgataattttgtgcagaacgattttcgagatcccgacgcgccacaaccctgtggcaccaccgagccgacgacctcttcatctctgtgcggcatcgatcacgaagcactgaataagcaaatcatggagtacaagcgaaggaaagacaaagggttaggcggtctcgtgtggcagggacaggtggctgaactcaccacacagatgaagaaaggacgaaaaagggccaaaccccgcttggagcaagactccagtcttaagagctatcttagtggcgaggaagtcgaggacgaccttgatctggtgggagcgcccgagtatgagtgttatgctcctgatactgaagaactcgaggctgagcgcggaggcggtcgaactgaagatggccactcgtgcggtgcctccagagagtag

SEQ ID NO: 45605 - DNA, 2058 bp, Artificial Sequence
  Description of Artificial Sequence: Synthetic coding sequence
atgtggctgaagctgttcttcctgctgctgtacttcctggtgctgtttgtccttgccagatttttcgaggctattgtgtggtatgaaaccgggattttcgcaactcaactggtggatccggttgcactgagcttcaaaaagttgaagactatactggagtgccgcggtctaggatactctggtcttcccgagaagaaggatgtccgcgaactggtggaaaagagtggcgacttaatggaaggcgagttgtatagtgcgctaaaagaagaggaggcgagcgaatctgttagttccacaaattttagcggcgagatgcacttctacgagctggtagaagataccaaggatggtatttggctggtacaggtcattgcgaacgatcgtagtcccctagtggggaaaatacattgggaaaaaatggtgaaaaaggtgtcaaggttcgggatccgcaccggtacctttaattgttcctctgaccctaggtattgtcgccggcggggatgggtgcgctcaacactcattatgtccgtgccgcagacctcaacatccaaggggaaggttatgctgaaggagtactcaggccgcaagattgaggtcgaacacattttcaagtggataactgctcacgctgcctctcgcatcaaaacaatatacaatgctgagcacctcaaagaggagtggaataaatccgaccagtactggctgaaaatctatctcttcgcaaacctggatcagcctcccgcctttttcagtgccctgagtataaaattcaccggccgggtggagtttatcttcgttaacgtggagaattgggacaacaagagctatatgaccgacattggtatctataacatgccatcttatatactgagaacaccagaaggtatttatcgctatggcaatcatacgggagagttcatatctctccaggccatggatagtttcctgagaagcctgcagcccgaggtgaatgatttgtttgtactctccctcgtgctcgttaaccttatggcgtggatggatctatttatcactcaaggtgctaccattaaacgtttcgtggtgctgataagcactctgggcacttacaatagcttattgatcatcagctggctgccagtcctcggttttttacagctcccatacctggacagtttttacgagtattcactgaaacttctccgctattccaacaccactactttggcctcttgggtccgggcggactggatgttctacagcagccatccggccctattcctgagtacatacctcggtcacggcctacttattgattacttcgagaagaaacgccgccgcaacaataataacgatgaggttaacgccaataaccttgaatggctatcatccctgtgggattggtatacatcctacctgttccatccgatcgctagcttccagaattttccagtcgagagcgattgggacgaagatccggacctgtttctggagaggcttgctttcccagatctgtggctgcacccactgattcccacagattacatcaaaaatctgcccatgtggcggttcaagtgcctgggcgtgcagagtgaagaagagatgtctgaagggtctcaagatactgaaaatgacagtgaatcagagaatactgacactctaagcagtgagaaggaggtgtttgaagataaacagagtgtgctgcacaacagccccgggaccgctagccattgcgacgctgaagcatgttcctgcgcaaataaatactgtcaaactagcccatgcgagcgcaagggccgtagctatggttcttacaacacaaatgaagacatggaacccgactggttgacttggccggcagatatgctgcattgtaccgaatgcgtcgtctgcctggaaaacttcgagaacgggtgcctccttatgggcctgccttgcggtcatgtttttcatcagaactgcatcgtcatgtggctggcagggggtagacattgttgccccgtgtgccgctggccctcgtacaagaagaagcagccctacgctcaacaccagccactgagcaacgacgtgccctcttag

SEQ ID NO: 45606 - DNA, 984 bp, Artificial Sequence
  Description of Artificial Sequence: Synthetic coding sequence
atggccgccgtggtggaggtggaggtgggcggcggcgccgccggcgaacgggagctcgacgaagttgacatgagtgacttaagcccagaagaacagtggcgtgtagagcatgcccgtatgcatgcgaaacacagaggtcacgaggccatgcacgccgaaatggtgctgattctgatcgcaaccctcgtcgtggcccagcttctgctcgttcagtggaagcagaggcacccaagaagttacaacatggtgacgcttttccagatgtgggtggttcccctatatttcactgtgaaactacattggtggcgcttcctagtgatctggatactgttttcagctgtaacagcctttgttaccttcagggctacacggaaaccccttgtccagactacccccagactggtttacaagtggtttctcctaatttacaagatcagctatgccaccggcatagtcggctacatggccgtcatgttcacccttttcggcctcaacctgctgttcaaaatcaagcctgaagatgctatggatttcgggatctcattactcttctacgggctgtactacggcgtcctggagcgcgacttcgccgagatgtgcgccgactacatggccagcacaatcggcttctactctgaatctgggatgcccaccaaacatctgtctgactccgtttgtgccgtttgtggtcagcaaattttcgtagacgtgtctgaagagggcattattgagaacacctatcgcctctcctgtaaccacgtgttccatgaattttgtattaggggctggtgtatcgtgggcaagaaacagacctgcccctactgcaaagagaaagttgatttgaaacggatgttctccaatccttgggagaggccgcacgtgatgtacggacagctcttggactggttgcgctatctagtcgcctggcagcccgtcattatcggcgtggtccagggcatcaactacattctggggctggagtag

SEQ ID NO: 45607 - DNA, 741 bp, Artificial Sequence
  Description of Artificial Sequence: Synthetic coding sequence
atggtgaccctgttccagatgtgggtggtgcccctgtacttcaccgtcaaactgcattggtggcgcttcctggttatctggattctgttttccgccgtgacagccttcgtcacatttagggccacccgcaaacccctggtgcagaccacccctcggttggtgtataagtggtttctgctgatctacaaaatatcttatgcaacaggcatcgtgggctacatggcagtgatgttcactcttttcgggctcaacctgttgtttaaaatcaagcccgaggacgctatggatttcggaatttcactgcttttctacggactctactacggcgtcctggagcgagattttgctgagatgtgcgccgactacatggcctccaccatcggattttactccgagagcgggatgcctacaaaacacctgtcggattctgtctgcgcagtgtgcggacagcaaatctttgtcgatgtctcggaagaaggaattatcgaaaatacatatcgcctgtcatgtaaccacgtgttccacgagttttgcattagagggtggtgcatcgtggggaaaaagcagacgtgtccctactgcaaagagaaagtcgacctcaaaaggatgtttagcaacccttgggaacgaccacacgtgatgtacggacagctgcttgattggttgaggtatctcgtggcctggcaacccgtaatcatcggagtggtccagggcataaattacatccttggcctggaatag

SEQ ID NO: 45608 - DNA, 468 bp, Artificial Sequence
  Description of Artificial Sequence: Synthetic coding sequence
atgcaccccttccagtggtgcaacggctgcttctgcggcctgggcctggtgtccaccaacaaatcctgttccatgccccccatctcatttcaggacttaccacttaacatctatatggtgatctttggaaccggcattttcgtctttatgctgtctcttattttttgctgttattttatttccaagctacgcaatcaggcgcagagtgagaggtatgggtataaggaggtcgtccttaagggagatgccaagaagcttcagctctatggccagacttgtgccgtgtgcctcgaggatttcaagggaaaggatgaactcggagtgcttccttgtcaacacgcctttcatcgcaaatgtctggttaagtggctggaagtgcgttgcgtctgtcccatgtgcaacaagcctattgcttctccctccgaagccacacagaatattgggatcttactggatgaactggtttag

SEQ ID NO: 45609 - DNA, 1146 bp, Artificial Sequence
  Description of Artificial Sequence: Synthetic coding sequence
atgctgctgagcatcggcatgctgatgctgagcgccacccaggtgtatacaatcttaactgtccaactatttgcttttctaaacttactgcctgtagaggcggacattttggcttataatttcgaaaacgcctcacaaactttcgatgatcttcccgctcgcttcggctaccggctgcctgcagaggggctcaaagggtttctgattaattccaaaccagagaacgcatgcgagcctatcgtgcctccacctgtcaaagacaactcgtccgggaccttcattgtgctgattagacggttagattgtaatttcgatattaaggtgctcaatgcacagagagcagggtacaaggccgccatcgtacacaatgtggactcagacgatctcatctctatgggatcaaatgacatcgaagttctgaagaaaatcgacatcccgtctgttttcattggggaatcatcagcgaactcactgaaggatgagttcacctatgaaaagggaggccacttgattcttgttccggaattcagtctgccgctagaatactacttgattccgttcttgatcatagtaggaatttgcctcatacttatcgtgatctttatgatcactaaatttgtgcaggatagacacagagctaggaggaaccggctcagaaaggaccagttgaagaagttgccggtgcataagttcaaaaaaggtgacgagtacgatgtgtgtgctatctgtttagacgagtacgaggacggtgacaaattacgcatcttgccctgtagccatgcttatcattgtaagtgcgttgacccttggctgactaaaaccaagaagacatgtcccgtctgcaaacagaaggttgttccaagtcagggggattccgactcagacactgacagtagccaggaagagaacgaggtcaccgagcacactcctctcctgcgccccctcgccagcgtcagcgcccagtcgttcggggcactcagtgagtcaagatcccatcagaatatgacggaaagttctgattatgaggaggacgataatgaagataccgactcatctgacgccgaaaacgaaattaacgagcacgatgtcgtcgtccagctgcagcctaatggcgaacgcgactataatatcgccaataccgtgtag

SEQ ID NO: 45610 - DNA, 1146 bp, Artificial Sequence
  Description of Artificial Sequence: Synthetic coding sequence
atgctgctgagcatcggcatgctgatgctgagcgccacccaggtgtatactatcctcaccgtccaactgttcgccttccttaacctccttcctgttgaagcggatattcttgcatataacttcgaaaatgcttcccaaacattcgacgaccttccggctagatttgggtatcgcctgcccgccgaaggtttgaaggggtttctgatcaactcgaaaccggaaaacgcttgcgaaccgattgtgcccccaccagtgaaggacaactcatccgggacgttcatcgtgctgatccggcgcctcgactgtaattttgacataaaggtgctgaatgcacagagggccggatacaaagccgccatcgtccacaatgtagacagtgacgacctgatcagcatgggttctaatgatatcgaagtcctgaagaagatcgacattccgagcgtgttcattggagagtcctctgctaactctcttaaggacgaattcacttacgagaagggaggacatctaattctggtgcccgaattcagccttcccttagagtactacctcatcccgtttctgatcatcgttggaatctgtctgatcttgattgtgatcttcatgattaccaagtttgtgcaagatcgacatagggccaggcggaaccggttaagaaaggatcaactgaagaagctgccagtccataagtttaagaaaggcgacgagtatgacgtctgcgccatctgcctggatgaatacgaggacggtgacaagctgcggattctgccttgctctcacgcctaccactgcaagtgtgtggatccctggcttacaaaaaccaaaaagacgtgccctgtttgcaagcagaaggtggtcccctcgcagggcgacagcgattcagacactgactccagccaggaggagaacgaagttaccgagcacacccccctactacgcccccttgcctcggttagcgcccagtcattcggggctttgagtgagtcgcgctctcatcaaaacatgacagaatcgtccgactacgaagaagatgataatgaggatacagacagcagcgacgcagagaacgaaattaacgagcatgacgttgtggtgcagctgcagccgaatggggaaagagactataatattgcaaacaccgtctag

SEQ ID NO: 45611 - DNA, 498 bp, Artificial Sequence
  Description of Artificial Sequence: Synthetic coding sequence
atgctgctgagcatcggcatgctgatgctgagcgccacccaggtgtatactattttgacagtccagctgttcgcgttccttaatctgttgcctgtggaggccgatattctggcatacaatttcgagaacgcctcacaaacctttgacgatctgcccgcccgcttcggctataggctgcctgccgaggggctcaaggggttcttgatcaattctaagcccgagaacgcctgtgaaccaattgtccctcctcccgtcaaggacaatagctccgggacatttattgtactgatacgtaggttggattgcaacttcgacatcaaggtcctgaatgcccaaagggccggctacaaagctgctatcgtgcataatgttgatagtgacgacctcatcagcatggggagcaacgatattgaggttctgaaaaagatagacattccctctgtgtttatcggggagagctccgccaacagcttgaaggacgaatttacctatgaatag

SEQ ID NO: 45612 - DNA, 219 bp, Artificial Sequence
  Description of Artificial Sequence: Synthetic coding sequence
atgctgctgagcatcggcatgctgatgctgagcgccacccaggtgtacacgatccttactgtacagctgttcgccttcctgaacctgctcccggtggaagccgacattctggcctataactttgaaaacgcaagtcagacattcgacgacttacctgccagattcggatatcgcttgcccgcggaaggtctgaaaggcttccttataaatagcaagtag

SEQ ID NO: 45613 - DNA, 492 bp, Artificial Sequence
  Description of Artificial Sequence: Synthetic coding sequence
atgctgctgagcatcggcatgctgatgctgagcgccacccaggtgtatacaatcctcacagtgcagctgttcgccttcctgaatctgctgccagtggaggccgacattctcgcttacaactttgaaaatgcatcgcagacgttcgacgacctcccagcccgctttgggtaccggctgcctgccgaggggttaaagggattcctgattaatagcaagcccgagaacgcttgcgagcctatcgtgcctcccccagtgaaggacaactcctctggtacttttatcgtgttgatccgccgcctcgactgtaattttgacatcaaggtgcttaatgcacagcgagccggctataaggctgctatcgttcataacgtggacagtgatgacctgatctctatgggttctaatgacattgaggtcctgaagaagattgatatccccagcgtcttcataggggagtcttccgccaatagcctcaaggacgaatttacctag

SEQ ID NO: 45614 - DNA, 348 bp, Artificial Sequence
  Description of Artificial Sequence: Synthetic coding sequence
atgctgctgagcatcggcatgctgatgctgagcgccacccaggtgtatacgattctgactgtccagctctttgcttttcttaatctgctgcccgtcgaggcagacatcctggcatataatttcgagaacgcatcacagacctttgatgatctgcccgcgcgcttcggttacagactacccgctgaaggacttaaggggttcttaataaattctaagcccgaaaacgcctgtgaacctatcgtgccccccccagtgaaagacaacagctctgggacctttatagtcttgataaggcgactcgactgcaatttcgacattaaggtactgaatgcacagcgagccggctag

SEQ ID NO: 45615 - DNA, 243 bp, Artificial Sequence
  Description of Artificial Sequence: Synthetic coding sequence
atgctgctgagcatcggcatgctgatgctgagcgccacccaggtgtacaccatcctaactgtgcaactattcgcgtttctgaatttgcttccagttgaagctgatattttggcatataatttcgagaacgcatcccagacctttgatgatcttcccgctcggtttggatacaggctgcctgccgagggcttgaagggcttcctcatcaatagcaaaccggagaatgcctgtgaacctatatag

SEQ ID NO: 45616 - DNA, 273 bp, Artificial Sequence
  Description of Artificial Sequence: Synthetic coding sequence
atgctgctgagcatcggcatgctgatgctgagcgccacccaggtgtacactatattgacagttcagctcttcgctttcctgaacctgttgccagtggaagctgatattctagcatacaattttgaaaacgcgagccagacgtttgatgatctgccggcgcgctttgggtacagacttcctgccgaggggctgaaggggttccttataaactctaagcccgaaaatgcttgtgaacctatagtgcctcctcctgtgaaggacaatagtagttag

SEQ ID NO: 45617 - DNA, 876 bp, Artificial Sequence
  Description of Artificial Sequence: Synthetic coding sequence
atgctgctgagcatcggcatgctgatgctgagcgccacccaggtgtatacaattctcacggtgcagctgttcgcctttctcaacctattgcctgtggaagctgatattttggcttacaacttcgagaacgcctcccaaactttcgacgatctgcctgctcgcttcgggtatcgactgcctgcagagggtctgaaggggtttctgattaattccaagcccgagaacgcctgcgagccaatcgttccaccgcctgttaaggataatagtagtgggacatttatagtcttgattcgacggttggattgcaactttgatataaaagtcctaaatgctcagcgggctggctacaaggcggcgatcgttcataacgtcgactccgatgatctcataagcatggggtctaacgatatcgaggtcctcaagaagatagacattccctctgtgtttataggtgagtcatcagctaattcgctgaaggacgaatttacttatgaaaaagggggtcacctcatcctcgtccctgagtttagtctccctttggagtattacttgatccctttcctcattatcgttggcatttgtttgattctgatagtcatcttcatgattactaaattcgtgcaggatcgacatagggctagaaggaacaggctgagaaaggatcagctgaaaaagctgcctgttcacaagttcaaaaaaggcgatgaatatgatgtttgcgccatttgtttagatgaatacgaagacggcgataaactgcgcatactgccatgctcgcacgcttatcattgtaaatgcgtggatccgtggctcacgaagacaaaaaaaacctgccccgtttgtaagcagaagccaaagcacaagaagaagaagtag

SEQ ID NO: 45618 - DNA, 1260 bp, Artificial Sequence
  Description of Artificial Sequence: Synthetic coding sequence
atgagctgcgccggccgggccggccccgcccggctggccgccctggcattactgacctgctcgctgtggccggcacgcgctgataatgctagccaggaatattacaccgccctgatcaatgtgactgtccaggagcccggaagaggagccccactcacctttcggatcgacaggggaaggtacggattggacagcccgaaggcagaggtaaggggccaggtcttagcacccctgccattgcacggggtcgctgaccacttaggttgtgacccacagactaggttctttgttcctcctaatatcaaacagtggattgctctgctacagcgtggcaactgtacatttaaagagaagatttctagagcagcctttcataacgccgtggcggtggtgatttacaacaacaagtctaaggaagaaccggtgactatgacgcaccccggaaccggcgacataatcgccgtcatgatcaccgaactgaggggtaaggatatcctctcttatttagaaaaaaacatttctgtccagatgacaattgcagttggaacgcggatgccccccaaaaatttctcgagaggaagccttgtcttcgtcagcatcagctttatagttctcatgataatctccagcgcctggcttatcttctatttcattcagaagattaggtacacaaatgcccgcgaccgcaatcagcgccgtttaggagacgctgcaaagaaggctatctctaaactaaccactcgaactgttaagaaaggagacaaggagacagaccctgacttcgaccactgtgctgtatgcattgagagctataaacagaacgacgtggtgagaatattgccgtgcaaacacgtgttccataaaagttgcgtagatccttggctttcagaacattgtacttgccctatgtgtaaactgaacattctgaaggctctcggaattgtccccaacttgccttgcacagacaatgtagctttcgacatggagaggcttactcgaacacaggccgtaaataggcggtccgcgctgggggatctcgccggagacaactccctaggtctcgaaccgttgcgaacaagtggcatcagtccactgccacaggatggcgagttgacacctcggacaggagagattaatatcgctgtcaccaaagagtggtttatcattgcctcattcggcctgctgtcagctcttacattatgctatatgatcattcgggcgacggccagtctgaatgcaaacgaagtggaatggttctag

SEQ ID NO: 45619 - DNA, 1131 bp, Artificial Sequence
  Description of Artificial Sequence: Synthetic coding sequence
atgcacctgctgaaggtgggcacctggcggaacaacaccgccagcagttggctcatgaagttttcggtgctttggctggtctctcagaattgttgccgggctagcgtggtttggatggcttatatgaatatttccttccatgttgggaaccatgtgttgagcgaattaggcgagaccggggtgtttggcagaagttcaacattgaaacgagtggctggtgtcatagtgccaccagaaggcaagattcaaaacgcatgcaacccaaataccatcttctcaaggagcaaatattccgaaacatggctggctctgattgaaagaggcgggtgtactttcactcagaaaatcaaagttgcaaccgagaagggagcctcgggtgtcatcatttacaatgttcccggcactggaaaccaggtctttccaatgtttcatcaggctttcgaggacgtggtggttgtgatgatcggtaacctcaaaggaaccgaaatctttcacctgatcaaaaaaggggtgctgatcacagcagtcgtcgaggtggggcggaagcacatcatctggatgaaccattatctggtctcttttgtgattgtgacaaccgcaactttggcatacttcatcttttatcatattcaccgcctctgcctagcccgaattcagaacagaagatggcagcgtcttactaccgatctccagaacacattcgggcaattgcagttaagggtggttaaagagggcgatgaggaaatcaatccaaatggtgactcttgtgtcatctgtttcgagaggtacaagccgaatgatatagtgagaattcttacttgcaaacatttttttcataaaaactgtatcgacccatggatactcccacatggaacctgcccgatctgcaagtgcgacatcctcaaagtactggggattcaggtagtcgtggagaacgggactgaacctctgcaggtcctgatgagtaacgaactccccgagaccctgagtccatccgaggaggagactaacaatgaagtgtcaccggccgggacttctgataaggtgatccacgttgaagaaaatcccacaagccagaataatgatatccagccccatagcgtcgtggaggacgtccacccttctccttag

SEQ ID NO: 45620 - DNA, 879 bp, Artificial Sequence
  Description of Artificial Sequence: Synthetic coding sequence
atgaccaccacccggtaccggcccacctgggacctggccctggacccactagtgagctgcaagctgtgtttgggtgagtaccctgtggaacagatgactaccattgctcagtgccagtgtattttttgcactctctgccttaagcagtacgtggaactgttgatcaaggaggggctggaaacagctattagctgtcccgacgcagcatgcccgaagcaggggcacctacaagagaacgagattgagtgcatggttgccgctgaaatcatgcagaggtacaagaagttacagtttgagcgggaggttctttttgatccctgcagaacatggtgtccagccagcacctgtcaggcggtatgccagctacaggatgtcggcctccagactccgcagcccgtgcagtgcaaagcctgtcgtatggaattctgctcaacctgcaaagcctcctggcacccagggcaggggtgccctgagactatgcccattacgttcctccccggtgagacgtcagccgcctttaaaatggaagaggacgatgccccaatcaagcgatgcccaaagtgcaaggtttacatcgagagggacgaaggatgtgctcagatgatgtgtaagaactgcaaacacgctttctgctggtattgccttgaatctttggatgatgatttcctgctaatccattacgataaggggccatgcagaaataaactgggtcattctagggcatcagtcatttggcacagaacgcaagttgtgggcattttcgcagggttcggcttattactcttggtcgcctcgccctttctcctgctggcaacccctttcgtactatgctgcaagtgcaaatgttcaaagggagacgatgaccctcttcccacctag

SEQ ID NO: 45621 - DNA, 168 bp, Artificial Sequence
  Description of Artificial Sequence: Synthetic coding sequence
atgaccaccacccggtaccggcccacctgggacctggccctggacccattggttagctgtaagctatgcctcggagagtacccggttgaacaaatgaccacgattgcccagtgccagtgtatattctgtacactctgcctgaagcagtatgtggaactgcttatttag

SEQ ID NO: 45622 - DNA, 597 bp, Artificial Sequence
  Description of Artificial Sequence: Synthetic coding sequence
atgaccaccacccggtaccggcccacctgggacctggccctggaccccttagtcagctgcaaactttgcttgggggagtacccagtcgagcagatgaccaccatcgcccagtgccagtgtattttttgcacactgtgcctgaagcaatacgtggagctgcttatcaaagagggactggagaccgcaataagctgtccagatgccgcctgtcccaagcaaggacatctgcaggaaaatgagattgaatgcatggtggctgccgagatcatgcagcgatataaaaagctgcagtttgaacgggaggtgctgtttgacccatgtaggacctggtgccccgcatctacctgccaggccgtctgccagctccaggacgtgggcctacagaccccacaaccggtgcagtgcaaagcttgtcggatggagttctgtagtacttgcaaggctagttggcacccagggcagggatgtccagagacaatgcctataacttttctgcccggtgagacttcagcggcttttaagatggaagaggatgacgcgccgattaaacgatgccccaaatgttctaaaggcgacgatgacccactccctacatag

SEQ ID NO: 45623 - DNA, 168 bp, Artificial Sequence
  Description of Artificial Sequence: Synthetic coding sequence
atgaccaccacccggtaccggcccacctgggacctggccctggaccccctggtgtcatgtaaattgtgtctcggagagtaccccgtggagcaaatgacaacgattgcacagtgtcagtgtattttctgcactctgtgtctgaaacagtatgttgagttgttgatctag

SEQ ID NO: 45624 - DNA, 912 bp, Artificial Sequence
  Description of Artificial Sequence: Synthetic coding sequence
atgggcagcgccggccggctgcactacctggccatgaccgccgagaacccaacgcccggagacctcgcacctgcccctctgatcacatgcaagctgtgcctgtgtgagcaatctctggataagatgaccacgctacaggagtgtcaatgcatcttctgtaccgcctgtttgaagcagtacatgcagcttgcaatacgagaagggtgtgggtccccaattacttgcccggatatggtgtgcctcaatcacgggaccctgcaggaggcagaaatcgcctgtctggtccccgtagaccagttccagttatatcagaggctcaagttcgagcgagaggtgcacctcgatccctataggacttggtgccccgtggccgactgtcagacggtgtgccccgtggcatcaagcgacccaggccagccagtgctcgttgaatgcccttcctgtcacctgaagttttgctcctgctgtaaagatgcatggcatgctgaggtctcatgtcgagatagtcagcccatcgtgttacctacggaacacagggctttgttcggtaccgatgcagaggctccgattaaacaatgccccgtttgtcgcgtgtacatcgagcggaacgaggggtgcgcacagatgatgtgcaagaattgcaagcacacattttgctggtattgtcttcagaacctcgacaacgatatcttcctgcggcactatgacaaagggccttgcaggaacaagctgggccatagtagggcttcggttatgtggaacagaacgcaggtagtgggaattctggtggggctgggtataatagctctggtgacaagtccactgttgctgttggcaagcccttgcattatttgttgtgtatgcaaaagctgccgggggaagaaaaaaaaacacgacccatctactacgtag

SEQ ID NO: 45625 - DNA, 645 bp, Artificial Sequence
  Description of Artificial Sequence: Synthetic coding sequence
atgctgtggatcaccatgccccaccccgcccacctgggcctgttcatcgcagtgactttgtctgaggttcacctggacccatatcgcacttggtgtcctgttgcagactgtcaaacagtgtgtccagtggccagcagcgaccctggtcaaccagtcctcgtggagtgcccaagctgccaccttaaattctgcagctgttgtaaagatgcctggcacgccgaagtgtcttgtagggatagtcaacctatcgtgttgcctacagagcaccgggccctgttcggcaccgatgccgaagcgcctatcaagcagtgccccgtgtgtagagtctacattgagaggaatgagggctgcgcccaaatgatgtgtaagaactgtaagcatacattttgttggtattgcctgcagaatcttgacaatgatatttttttacgccactacgacaaaggcccatgtaggaacaagctggggcacagtcgagccagcgtgatgtggaatcgcacacaagtggttgggatcctggttggcttggggatcatcgcactggttacgagccccttgctgctgctggcatccccctgtatcatttgttgtgtgtgcaagtcttgtcgcggcaaaaagaaaaagcacgacccatccaccacttag

SEQ ID NO: 45626 - DNA, 2076 bp, Artificial Sequence
  Description of Artificial Sequence: Synthetic coding sequence
atgatgcggaaccaccggatcgccagcagcctgtgcggcgaccaggtttttagcaagaagaaaaaaaaaaagaagaaaaataatatggccgctaaggagaaattggaggcagtcctcaatgtcgccctgagggtcccttccattatgctcttagacgtgttatatcgctgggacgtctcctcgttcttccaacaaatccagcgcagttcactatctaacaatccgttatttcagtacaagtatctcgctcttaatatgcactatgtagggtatattctctcagtggtcctccttactcttccgcggcagcatctggtgcagttgtacctgtacttcctgacagccttgcttttgtatgcaggacatcagatctccagagattacgtgagatcagagttggaatttgcatatgagggaccaatgtacctggaacctctctccatgaaccgattcacaactgctctgatcggccagctcgtcgtgtgcaccctttgttcttgtgtaatgaagacgaaacaaatttggctgttctcagcccatatgctgccgcttctggctagactgtgtctcgtgcccctcgagactatagtgatcataaataaatttgccatgattttcaccggcctagaagtgctgtattttttaggttctaatctgcttgtcccatacaatttagccaagtccgcgtatcgcgagctggtgcaggtcgtggaagtgtatggcttactcgctctcggcatgagcctttggaatcagcttgtcgtgcctgtgctgttcatggtgttctggttagtgctatttgcccttcaaatttattcatacttctcgacgagagaccagccagctagtcgggagaggcttctgtttctgtttttgacctcaatagctgaatgctgtagcaccccatactccctcctggggttggtattcaccgtttcttttgtcgctctgggagtgctgaccctgtgcaaattctacctgcagggctacagggcctttatgaacgatcctgcgatgaataggggaatgaccgagggagtgaccctgctcatcctggccgtccagaccggactgatagagttacaagtggttcaccgggcgttcctgttgtctatcattttatttatcgtggttgcttcgatcctacagtctatgctcgagatcgctgacccgatcgtgctcgccctcggtgcctcacgggacaagtcactctggaagcacttcagagccgtgtccctgtgtctgtttttgctcgtcttcccggcctatatggcctatatgatatgccagttttttcatatggatttctggctgcttatcattatctcctcatctattctcactagccttcaggtgctgggtacactgttcatttacgtgctcttcatggtcgaagaattccgtaaggaaccggtggaaaatatggatgacgtcatatattacgtgaacgggacatataggctactggaatttctggtggcactttgtgtggtggcctatggcgtgtccgaaaccattttcggcgagtggactgtcatgggttccatgataatttttatccattcttactataacgtgtggctgcgggctcaactcggttggaagtccttccttctccgtcgcgatgccgttaataagattaaaagcttgcccatcgctacgaaggaacagttagaaaaacacaatgatatctgtgctatctgttaccaggacatgaagtccgccgttattacaccttgctcccacttcttccacgcaggctgcctaaagaaatggctgtatgtacaggagacgtgccccctctgccattgccacctgaagaactccagccagctgcccggcttgggaactgaacccgtgctgcagccacatgctggagccgagcagaatgttatgttccaggagggaactgagccacccggccaggagcatacacctgggactagaatccaggaagggtcgcgcgataataatgaatacatcgctaggaggccagataaccaagagggcgcttttgatcctaaagaatatcctcatagcgcaaaagacgaggctcaccctgttgagtctgcttag

SEQ ID NO: 45627 - DNA, 2043 bp, Artificial Sequence
  Description of Artificial Sequence: Synthetic coding sequence
atggccgaggtggtgttcagcaagaagaagaagaagaagaagaagaacaacatggcggctaaggaaaagctggaagctgtgctgaacgtggccctgcgcgtgcctagtatcatgctgctagatgtgctgtaccgttgggacgttagctctttcttccagcaaatccagcgaagctctttatctaataatcccctgttccagtataagtatcttgcactgaacatgcattatgtgggatatatactctccgtagtcttgttgaccctgcctcggcaacacttggtgcagctctacctgtatttcctgacggcactccttctctatgccgggcaccaaatctcacgtgattacgtacggagcgagctagaatttgcttacgagggaccaatgtatctggaaccacttagcatgaataggttcactaccgccctcatcggccagctggtggtgtgcacactgtgtagctgtgtcatgaaaaccaaacagatttggctgttcagcgcgcacatgctcccacttctggctcgactgtgcctggttcccctggagaccatagtgatcatcaataagttcgccatgatttttactggccttgaggtgctgtactttctgggatccaatttactcgtgccgtataatcttgcgaagagcgcttaccgcgaactagtgcaagttgtagaggtctacggattgctggccctcggaatgtcactgtggaaccagttggtcgtgccggtgctgttcatggtgttctggttagtcctgtttgctctgcagatatactcatatttttctactcgcgatcagccagccagccgcgaacgccttctgttcttgttcctcacctccattgccgaatgctgctccaccccttatagtctcctgggcctggtgttcacagtgagctttgtagcgcttggtgtcctgaccctgtgcaagttttacctccaagggtaccgcgcattcatgaacgatccagccatgaaccggggcatgaccgagggagtcaccctgttgattctggcggttcagaccgggctgatagagctacaagtagtgcaccgcgcttttttactttctataatactcttcattgtggtggcaagcatactgcaaagcatgcttgagatcgccgacccaattgtgctcgccctcggtgccagccgcgacaaaagcctctggaagcattttcgggccgtgagtctgtgcctattcctgttggtttttcccgcctatatggcttatatgatctgccaattttttcatatggacttttggttgctcattatcatttccagttctatactgaccagcctgcaggtgttaggtaccctgttcatctatgtactcttcatggtcgaagagtttagaaaagagcctgtcgagaacatggatgatgtgatctactacgtgaacggcacctatcgtctgttagagtttctggtggctctctgcgttgtagcctacggcgtgagcgagacaatctttggagagtggactgttatgggatccatgattatattcattcatagttattataacgtgtggctgcgtgcccagctaggctggaagtcattcctcctgcgacgagatgccgtgaacaagatcaaatcccttcctatcgcaactaaagagcaattggagaagcataacgatatttgcgccatatgctaccaagacatgaagagcgcagtaattacgccctgtagccacttctttcacgcgggttgtttgaaaaaatggctctatgttcaggagacatgtcccctctgccactgtcatcttaagaatagcagtcagttgcctgggctggggaccgagccagttctccagccacacgcaggagctgagcagaacgtcatgtttcaagaaggaaccgagcccccaggacaggagcacactcccggtacaagaatccaagaaggctctcgggataataacgagtacattgcacgcaggccagataaccaagaaggcgcattcgacccgaaagaatatccacatagcgccaaggacgaggcccacccagtcgaatccgcttag

SEQ ID NO: 45628 - DNA, 1992 bp, Artificial Sequence
  Description of Artificial Sequence: Synthetic coding sequence
atggccgccaaggagaagctggaggccgtgctgaacgtggccctgcgagtgccatccatcatgctgctggacgtgctgtaccggtgggacgtttctagcttctttcagcaaatccagagaagctctttatcaaacaaccctctgttccaatacaagtacctggccctaaatatgcactacgtgggctatatcctctccgtggtattgttgaccctgccccggcagcatctcgtgcagctgtacttgtattttcttacggcgctcttgctgtacgccggccaccagatttcgagagactatgttcgctccgaacttgagttcgcgtacgaaggtccaatgtacctcgaaccactcagcatgaatagattcacaaccgcgttgataggacagcttgttgtgtgtacactctgctcttgtgttatgaagaccaaacagatctggctcttctccgcacacatgctgcccttgctggcgagattgtgtctcgtgcctcttgagacaattgtaatcattaataagtttgccatgatttttaccgggctcgaagtcctgtacttccttgggtcaaatctgcttgttccatacaacctggcgaagtcagcctatcgtgagttggtgcaggtggtggaggtttatggcctcctggccctgggcatgtccctgtggaaccagttggttgtaccggtgctctttatggtgttctggctggtcctgtttgccttacagatttactcatacttttccactcgggaccagcccgcctccagagaaaggctcctgttcctgtttttgacctctattgccgagtgttgttccacgccctacagtcttcttggcttggtctttacagtgtcattcgtcgctctgggcgtgttgacactgtgtaagttttatctccagggctatcgcgcattcatgaacgacccagccatgaatcgaggaatgactgaaggcgtgactctcctgatcttagcagtgcagaccggcttaatcgagctgcaggtggttcatagagcttttctgctctccatcatcctgttcatcgttgtggcatccattcttcagtcaatgctcgaaattgccgaccctatagtcttggctctgggggcatctcgcgacaagtccctatggaaacactttcgggctgtatccctttgtctgttcctcctggtcttccctgcctacatggcatatatgatctgtcagtttttccacatggacttctggttgctcatcatcatctcatcttcaatcctgacctctcttcaggtgctgggaaccctttttatctacgtgctctttatggtggaggagtttaggaaggagccagttgaaaacatggacgacgtgatctactacgtgaacggaacgtaccgtctgctagaattcctggtcgccttgtgcgttgtggcatatggagtttccgaaacaatctttggtgagtggactgtgatgggaagcatgattattttcatacacagctactacaacgtgtggttgcgggcccagctcggatggaagtcgttcttgttgcggagggatgcggtcaataaaatcaagtcgctccccatcgccacaaaggaacagctcgaaaaacacaacgatatctgcgccatttgctatcaggatatgaaaagtgccgtgattactccttgttctcactttttccatgcagggtgcttgaaaaaatggctctacgtgcaggagacatgcccgctgtgtcattgccatttaaaaaatagctcacagctgccaggactcggcactgagcctgtgttgcagccccacgccggtgccgaacagaatgtaatgttccaggagggcacagagcccccaggtcaggagcacaccccaggcacacggatccaggagggcagccgcgataacaatgagtatatcgctcggcgccccgataaccaggaaggggcatttgatcccaaagagtacccccactcagcaaaagatgaagcccatcccgtagaaagcgcatag

SEQ ID NO: 45629 - DNA, 2082 bp, Artificial Sequence
  Description of Artificial Sequence: Synthetic coding sequence
atgcaccgggaccggatcagccccagcaacagccccacctggagcctccaagtgttctccaaaaaaaagaagaagaaaaagaaaaataacatggctgcaaaggagaagctggaagccgtgctcaatgttgctctacgcgtgccaagtatcatgctactcgatgtactgtataggtgggacgtttcaagcttttttcagcagatacagagatctagcctgtccaataaccctctcttccagtataaatatctcgccctgaacatgcattatgtcgggtacattctgtcagtagtcctgctcacactgcctcggcagcacttggtgcaactgtacttgtatttcctaactgcccttctcctctatgcagggcatcaaatttcaagggattacgtccggtcagagttggagtttgcttacgaagggcccatgtatcttgagcccctgtccatgaatcgcttcacaactgctctaataggccagttggtcgtgtgtacgctgtgttcctgcgtgatgaagaccaagcaaatctggctgttctctgcacacatgctgcctctcttagctaggctgtgtctggtgccactcgagaccatcgtaatcattaataagtttgctatgatcttcaccgggctggaggttttgtatttcttgggatccaaccttcttgtcccatacaacttggcaaagtctgcgtatcgagaactcgtgcaggttgtggaggtctacggtctgctggcccttggaatgagtctttggaaccaactagtggtaccagttttattcatggttttctggctcgtgcttttcgcactgcagatatacagctactttagcacacgagatcaaccagcctctcgtgagcggttactttttctgtttctcacgtcgatcgctgagtgctgttctacgccatactcactcctgggccttgtgtttactgtgagcttcgttgctttgggcgtgctgaccttatgcaagttctacctacaggggtatagagcattcatgaatgatcctgccatgaatagaggcatgacagaaggagtgaccctgctgatactggctgtgcagacaggtctgattgaactgcaggtagtccacagggcgttcctcttgagcatcattctgttcattgtggtggccagcatccttcaaagtatgctggaaatcgctgaccctattgttctcgctctgggcgccagtcgcgacaagtccctttggaaacactttcgcgctgtttccctgtgtctctttttgctcgtgttccctgcatatatggcatatatgatttgtcagttctttcacatggacttttggttactgatcattattagtagttccattctgacatcccttcaggtcctaggaaccctgtttatctatgtgctgttcatggtggaagagtttagaaaggaacccgtagagaacatggatgacgtgatctactacgtgaatggtacctataggcttttggagttcctcgtggcactgtgtgtggtggcctacggcgtgagcgagactatctttggagaatggaccgttatgggcagcatgatcatttttatccactcctactacaacgtgtggctcagagcacagctgggttggaaatcattcctgctccgtcgtgacgccgttaacaagatcaaaagtcttcctattgccaccaaagagcaactcgaaaaacacaacgacatttgtgccatttgctatcaggatatgaaatctgcagttattacaccgtgctcccacttcttccatgcaggatgcttgaagaagtggctctacgtgcaggaaacatgccctttgtgccactgccatctaaagaactcttctcaactcccaggcctgggtaccgaacccgttctgcaaccacatgcgggggccgagcagaatgttatgtttcaggaagggactgagccaccaggacaggagcacacaccgggaacccggatccaggaagggtcacgggacaacaacgaatacatcgccagacggcctgacaatcaggaaggagcattcgatccaaaggaatacccacactcggcaaaggatgaggcccatcccgtggaatccgcatag

SEQ ID NO: 45630 - DNA, 1992 bp, Artificial Sequence
  Description of Artificial Sequence: Synthetic coding sequence
atggccgccaaggagaagctggaggccgtgctgaacgtggccctgcgtgtcccatctattatgctgctcgacgtgctttatcgctgggatgtctcaagctttttccaacaaatccagcgctcatccctcagcaacaaccctttgttccagtacaagtatctggccctgaatatgcattacgtggggtacatactgtcagtggtgttactgaccctaccgcggcagcacttagtgcaactgtatctgtacttcctcacagcacttctactgtacgccggacaccaaattagccgcgattacgtgagatccgagttagaattcgcatacgaaggccccatgtatctggagcccctgtccatgaataggttcaccaccgctctgataggccagcttgtggtctgcacactgtgttcctgcgtgatgaagaccaagcagatttggttgttttctgcccacatgctgcctctgttggcaagactgtgtttagtgcctctcgaaacgatagtgattataaataagttcgcaatgatatttactgggctggaagtgctctacttccttggcagcaacctgttagtgccctataacctggcaaagtctgcgtaccgagagctcgtccaggtggtcgaggtatacggtctgctcgcgctcggaatgagcctgtggaaccaactcgtcgtgcccgtgctatttatggtgttctggctcgtcctgttcgcactccagatatactcttacttcagcacccgtgaccaacctgcatctagagagagactgcttttcctctttctcacaagcatcgccgaatgctgtagcaccccctattccctgctaggcctggtctttactgtttcatttgtcgcattgggggtgctcaccctgtgtaagttctatttacaagggtacagagcctttatgaatgatcctgcaatgaatcgaggcatgaccgagggcgtgacactgcttatcctggccgtgcagactgggctgattgagttgcaagtggtgcacagagcttttctccttagtattatcctgttcatagttgttgccagcatcctgcaaagtatgctcgaaatcgcagatcccatcgtcctggccctgggagcttcgagagacaagagtctgtggaagcattttcgcgcagtgtctctgtgcttgttccttctggtcttccctgcatacatggcttacatgatctgtcaattcttccatatggacttttggctgttaattattatttcaagcagcatcctgacatcacttcaagtgctgggaaccttgtttatctatgtgctgtttatggtggaagagttcagaaaagagccagtggaaaacatggacgacgtgatttattatgtgaacggtacataccggcttctcgagtttctggtggcactttgcgtcgtggcctacggagttagcgaaaccatctttggggaatggactgtgatgggctccatgattatctttatccatagctattacaacgtgtggctgcgcgcgcagcttggctggaagtcttttctcttgcggcgggatgccgtgaataagatcaagtcactccctatcgcaaccaaggaacagctcgaaaaacacaacgatatctgtgccatctgctatcaggatatgaaatctgccgtgatcacaccctgtagccactttttccacgccgggtgcctgaagaaatggctgtacgtgcaagagacgtgcccgctgtgccattgtcacttgaaaaacagttcacagctgcctggcctggggacagagcccgttctgcaacctcacgctggagctgagcagaatgtgatgtttcaggaggggacagagcctcccggacaggagcatacccccggtacccggattcaagaaggctccagagacaataacgaatatattgccagaaggccagacaatcaggaaggggcttttgatccaaaagaatatccacatagtgcaaaggacgaggcccaccctgttgagagcgcctag

SEQ ID NO: 45631 - DNA, 2034 bp, Artificial Sequence
  Description of Artificial Sequence: Synthetic coding sequence
atggtgttcagcaagaagaagaagaagaagaagaagaacaacatggctgccaaggaaaaactggaagctgtccttaatgtggctctgcgagttccctccataatgctactagacgtactgtaccgatgggacgtgagttccttcttccagcagatccagaggagcagtttaagcaataaccctctcttccagtataagtacttggcacttaatatgcactatgtggggtacattctgtcagtcgtactactgactctgccccgacagcatctcgtccagctgtacttgtatttcctgaccgccctacttctgtacgctggccaccagattagccgcgattacgtccgaagtgagcttgagtttgcatatgagggccctatgtatctggaaccactaagcatgaaccgtttcaccactgccttgatcggccagctggtggtctgtactctgtgcagctgtgttatgaaaaccaaacagatatggctattttcagctcacatgttacccctccttgcgagactttgtctggtcccactggagacaatcgtcataatcaacaaattcgccatgattttcacgggccttgaagtactttactttttggggtctaacctgctggtaccttacaatcttgcaaagtctgcgtacagagaactggtgcaggtggtggaggtgtacggtctgttggcgcttggcatgtcgctgtggaatcaactggtggtgcctgtgctcttcatggtgttctggttggtcctgttcgcgctgcagatctattcatacttttcaactagagaccagccagccagcagggaacggctcttgttcctctttctcaccagtatagccgagtgttgttccacaccctactctctactgggcctggttttcacagtcagcttcgtggcactgggtgtactgacattgtgcaagttttatctgcagggctacagggcctttatgaacgatcccgcaatgaacagagggatgactgaaggggtgactcttctgattttagcagtgcaaacggggcttattgaactgcaggtcgtgcacagggcattccttttgtcaattatcctcttcatcgttgttgcttctatcctccagtcgatgctggaaattgccgacccaatcgtcctcgctctgggagccagtcgcgataagagcctctggaaacacttccgtgctgtttctctttgcctattcctgcttgtctttcccgcctacatggcatacatgatttgccagttcttccacatggacttttggctcttaatcattatctcctcctcgatacttacatcgctgcaagtactgggaacactgtttatctacgtgctgtttatggtagaggagtttcgcaaagagccagtcgagaacatggacgacgtgatttattatgtgaacggcacatatagactgctggaattcttggtggcactctgtgttgtggcatatggcgttagtgaaaccatttttggggagtggacagtcatgggaagtatgataatcttcattcattcctactacaacgtatggctgagagcccagctcggatggaaatcctttttactgcggagggatgcagttaataaaattaagtccctgcctattgctactaaagaacagctggagaaacacaacgatatctgtgctatttgctaccaagatatgaagagcgccgtcatcactccatgctcccatttcttccacgccggttgcttgaaaaaatggctctatgtccaagaaacttgccctctgtgtcattgccacctgaagaactcatcacagctaccaggcctgggtactgaacccgtgctgcagcctcacgctggtgccgagcagaatgtgatgttccaggaggggacagagcccccagggcaggaacacacccccggcaccaggattcaggagggttcacgcgacaacaatgaatacatagctcgtaggccagataatcaggaaggagcgttcgatcctaaagagtatccccactccgccaaggacgaagctcatcccgtagagagcgcgtag

SEQ ID NO: 45632 - DNA, 2040 bp, Artificial Sequence
  Description of Artificial Sequence: Synthetic coding sequence
atggccgaggtgttcagcaagaagaagaagaagaagaagaagaacaacatggccgccaaagagaaactggaagccgtactgaatgtagctctgcgcgtccccagtatcatgttgctcgatgtgttgtatcgttgggacgtgtctagcttctttcagcagattcagcgctctagtctgtccaataatcctttgttccagtataagtatttagctctcaacatgcattacgtaggttacatcctaagcgtcgtgctgctcaccctgcctcgccagcacctggtgcagctctatttatatttccttacggctttgctgctgtatgcaggccaccagatttcacgcgattatgtgagatctgagcttgaatttgcttatgaaggacccatgtacctcgagcctttgtcaatgaacagatttacgacggctctaattggccagttggtagtatgcaccttgtgcagctgcgtaatgaagaccaaacagatttggttgttctctgctcatatgctgcctctgctggcgcgactgtgtttggtccccctggaaaccatcgtcatcatcaataagttcgctatgatcttcaccggacttgaggtcctctatttcttgggaagtaacctgttggtcccttacaacctagctaaatctgcttatcgagagctcgtgcaagttgtggaagtgtatggcctgctggccttaggaatgagtctttggaatcagttagtcgtgccagttctgttcatggtgttttggctggtactgtttgctcttcagatctatagttattttagcactcgcgaccagcctgcaagtagggagcggttactctttctattcctcacctctatcgctgagtgctgctctaccccttacagcctcctgggcctggtatttactgtttccttcgtggccctgggagtgttgaccctttgtaaattctacttgcaaggctacagggcatttatgaacgatcctgctatgaatcgggggatgaccgaaggcgtcaccttgctgattctcgctgttcagaccggccttatcgaattacaggttgtgcaccgtgcgttcctcctctctatcatcctgttcatcgtcgttgcctcaattctacagtccatgctggaaattgcagatccgattgtgcttgccctgggcgctagtcgagataagagtttatggaagcatttcagggcagtctctctctgtctattccttctcgtatttcctgcctacatggcttatatgatttgtcagttcttccatatggatttctggctgttaatcatcatttcttctagcattttgaccagtttgcaggttctaggcacactgtttatttacgttctctttatggtggaggaattccggaaggaaccggtagaaaatatggatgatgtgatctactacgtaaatgggacctacaggcttctggaatttctcgtcgctctgtgcgtagtggcctatggagtttcagagactattttcggggagtggactgtgatggggagcatgattattttcatccattcctattacaatgtgtggctgcgcgcccagttaggatggaagtcatttctgctgagacgtgacgccgtcaataagatcaaatctctgcccattgccaccaaggagcagctcgaaaagcataacgacatttgtgcaatctgttaccaggacatgaaaagcgcggtgattaccccctgctcccacttcttccacgctggctgccttaaaaagtggctctatgtgcaggagacatgcccactctgccactgccatctcaagaactcttcccagctccccgggctgggtactgaacccgtcctgcagccacacgctggggctgagcagaatgttatgttccaggagggtactgaaccgccaggacaggaacacactccagggacacgcatccaggaagggtcacgcgacaacaacgaatacatcgcgagacggccagacaaccaggagggtgcttttgatccgaaggagtacccccattcagccaaagatgaagcccaccctgtagaatcagcatag

SEQ ID NO: 45633 - DNA, 1992 bp, Artificial Sequence
  Description of Artificial Sequence: Synthetic coding sequence
atggccgccaaggagaagctggaggccgtgctgaacgtggccctgcgcgtgccaagcatcatgctcctggacgtactgtaccggtgggacgtcagctccttctttcagcagatacaacggtcatctctgtccaacaaccccctattccagtataaatatttggcactgaatatgcattatgtcggctacatccttagcgtggtgctcttgactttacccagacagcatctggtccagctatacctctactttctgaccgccctgttgctgtatgctggccatcaaattagtagggactatgtgcgcagtgaactggagtttgcctatgagggccctatgtatttggagcctctgagtatgaatcgattcactactgccctgatcgggcagttggtggtgtgtaccctgtgctcttgcgtgatgaagactaaacagatttggttattttcagcccatatgctgcccctcctcgcgcgcttatgcctggtccccctcgaaaccatcgtgattatcaacaaatttgctatgatctttactggactggaggtactctatttccttggatctaatctcctcgtgccctacaacttggctaaatccgcctacagggaactcgtgcaggtcgtagaggtgtacggccttcttgcactgggcatgtctctatggaaccagcttgtggtcccggtgctcttcatggtgttctggctggttctgttcgcactccaaatctattcatacttttcgacacgggatcagcctgccagtcgggaacgcttactgtttttatttctcacatcgatcgctgagtgttgttcaaccccttactcactgcttggtctggtttttactgtgtcattcgtcgcattgggagtgctcacactgtgcaaattttacctacagggctaccgtgcatttatgaatgacccagccatgaacagggggatgaccgagggagtgacgcttctcatcctggccgtgcagactggattaatcgagttacaagtggtgcaccgagcatttttgctttccatcatcttgtttattgtcgtggccagcattctgcagagtatgctagagattgctgatccaatagtcctggctttgggcgcttcccgtgacaaaagtctatggaagcactttcgcgccgtttccctgtgtctcttcttgctggtatttccagcctacatggcctatatgatttgccagttttttcatatggacttttggctacttataattatctcgtcaagcatcctgacatccctccaggtgctcggcacactgtttatttatgttctgtttatggttgaggaattcagaaaagaacccgtagagaacatggacgatgtaatctattacgtgaacggcacataccgattgctggagtttctggtcgccctgtgtgtggtcgcctatggggtcagtgagactatattcggagagtggactgtcatggggtcaatgatcatctttatccactcctactataacgtgtggctgagggctcaactgggatggaagtcatttctcctccggcgcgatgccgtgaataagatcaagagcttgcctatagccacaaaggaacaattggagaagcacaatgatatctgcgcgatctgttatcaggatatgaaaagtgctgtgataacgccctgttcacatttctttcatgccgggtgtctaaagaagtggctttacgtccaggagacctgtccactttgccattgccatctgaagaactccagccaactcccgggtctcggaacggagccagtgttgcagcctcacgcaggcgcagagcagaatgttatgttccaagagggcacagaacctcctggtcaagagcatacccctggtacaagaatccaggaaggctctagggacaataacgaatatatcgcccgacggccagataatcaggagggagccttcgacccaaaggaataccctcattccgccaaggacgaggcacatcctgtggaatccgcatag

SEQ ID NO: 45634 - DNA, 918 bp, Artificial Sequence
  Description of Artificial Sequence: Synthetic coding sequence
atgagcttcctgcggatcacccccagcacccacagcagcgtgagctctggtctgctcagactgtccatttttctgttactgagcttcccagactccaatggtaaggcgatctggactgcccacttaaacatcaccttccaagtaggcaacgagattacatccgagctgggggaaagcggagtgtttggcaaccatagccccctcgaaagggtttccggagtggtagccctgccagagggatggaatcagaatgcttgccaccctcttacaaattttagccggcctaaacaagcggacagttggctcgcactcatcgaacgaggaggatgcacattcactcataagattaacgtcgccgctgagaaaggcgcgaacggggtgattatctacaattatcagggtacaggtagtaaggtgtttccaatgtcacaccaaggaaccgagaatattgtcgccgtgatgattagcaacctgaagggcatggaaattctgcacagcattcagaagggagtgtatgtcacagttatcattgaggtcggcaggatgcacatgcaatgggtgagtcactacatcatgtatctgttcacgtttctggcagcgactatcgcttatttctatcttgattgcgtttggcgacttacccctcgagtgcctaactcttttacccgccggagatcacagatcaaaaccgacgtgaagaaagctattgatcagctacaactgcgggttctgaaggagggagacgaggagctcgacctgaacgaggataactgcgtcgtttgttttgacacatacaagccacaggacgtcgtaagaattctcacctgcaagcatttcttccataaagcatgcatagatccctggctgctagctcatcggacatgtccgatgtgcaagtgcgacattctgaaaacttag

SEQ ID NO: 45635 - DNA, 1203 bp, Artificial Sequence
  Description of Artificial Sequence: Synthetic coding sequence
atggcctggcggcggcgggaggccagcgtgggcgcccggggcgtgttagcattggccctactggcactggcattatgtgtgcctggcgccagaggacgagctctagagtggttttctgctgtggtcaatattgaatacgtagatccacagactaatctcactgtgtggtctgttagcgagagcgggaggtttggcgattcatcaccaaaggaaggagctcatggtttagtcggggtgccctgggctcctgggggggatctcgagggttgtgcccctgacacccgctttttcgtcccagaaccaggcggccggggggccgccccctgggtggccctggtggcgagaggcggctgcacattcaaggataaagtcctggtggccgcccgccgcaatgcttccgccgtagtactctataacgaagaaaggtacggcaatatcactctgcccatgtcacacgcaggcaccgggaatattgttgtcatcatgatttcttatcctaaaggtagagaaatcttggaacttgtccagaaggggatccccgtaaccatgaccatcggcgtaggcacaagacatgtacaagaattcattagcggtcaaagcgtcgtgttcgtagccattgccttcattactatgatgattatttccctggcatggttgatattttactacatccagcggttcctgtacaccggaagtcaaatcggctcccaatcacatcgaaaggaaactaagaaggtaatcgggcagctcctgctacacaccgtgaagcatggcgagaaagggattgatgtggatgcagaaaattgcgcggtttgtatcgaaaattttaaagttaaagacattattaggattctgccttgcaagcatatctttcatcggatctgcatagacccctggctcttggaccatagaacctgtcccatgtgcaaactggacgttattaaggccctgggatattggggcgaacctggcgacgtccaggagatgccggctcccgagtctccgcccggcagagatcccgccgcaaatctcagcctcgccctgcctgacgacgacggctccgacgatagctcaccaccttctgcctcacctgccgagtctgaacctcagtgcgatcctagcttcaagggggacgccggcgagaatactgccctcctggaggcagggcgctctgactcgcgccacggaggacctatttcgtag

SEQ ID NO: 45636 - DNA, 1191 bp, Artificial Sequence
  Description of Artificial Sequence: Synthetic coding sequence
atggccatgagcctgatccaggcctgctgcagcctggccctgagcacttggctgttgagcttttgctttgtccatctactctgcctcgatttcacagtcgccgagaaagaggagtggtatacagcttttgtgaacatcacatacgccgagcccgctccggaccctggcgccggcgccgccgggggaggcggcgctgaactccatacagaaaaaaccgagtgcggtcgctatggagaacactccccgaaacaggatgccagaggcgaggtggtcatggcctcatctgcacatgaccgacttgcctgcgaccctaatactaaattcgccgccccaactcgtggaaagaactggatagctctgattccaaaagggaattgcacctaccgcgataagattaggaacgcttttctgcagaatgcaagcgccgtcgtgatattcaacgttggttctaataccaacgagaccattaccatgcctcacgcaggcgtcgaggacattgtcgcgatcatgattcctgaaccgaagggaaaagaaatcgtgagcctgcttgaacggaacatcactgtgactatgtacatcaccataggaaccagaaacctgcaaaaatacaggagattgggagacgcagcaaaaaaagcgatcagtaagctgcaaatacgcactatcaagaaaggagacaaagagaccgagtccgattttgacaattgtgccgtatgcattgaaggctacaagccgaatgacgtggtacgcattctgccctgcagacaccttttccacaaaagctgcgttgacccttggctcctggaccatcggacgtgccctatgtgcaagatgaacattttgaaagctcttggcatccccccaaacgcagactgcatggacgacctgcccacagacttcgagggctccctggggggaccacccactaaccagatcacaggtgcctccgacacaactgttaatgagagtagtgtcacactagatcccgcagtcaggactgtgggcgccttacaggtggttcaagacacagacccaattccacaagagggggacgtgatctttaccacaaactccgaacaagagcccgccgtctcctcggattccgacatttccctcatcatggctatggaggtgggactgtctgacgtggagctctccacggaccaggactgcgaggaagtgaaatcatag

SEQ ID NO: 45637 - DNA, 894 bp, Artificial Sequence
  Description of Artificial Sequence: Synthetic coding sequence
atgagcagccacgcccagcccctgaagctgatcagcccctgcccctatagcctttcaagcggcgtggaagacatcgtggccattatgattccagagccaaaaggaaaggaaatcgtgtcactgctcgagcgaaatataacagttacgatgtacatcaccattgggacccggaatcttcagaagtatgtctccaggacctccgtggtgtttgtttccatttctttcatcgttttgatgatcatctccttggcctggctcgtgttctactacattcagaggttccggtatgcaaatgctcgcgacagaaaccagcgtcgcctgggggacgccgcaaaaaaggccatttctaagctccagattcgcacaatcaaaaaaggagacaaagaaactgagtccgatttcgataactgcgcagtgtgcattgaaggttataaacccaatgatgtcgttagaattctcccctgcagacacctgtttcataagagctgcgtagacccctggttgctagatcatcgaacctgccccatgtgtaaaatgaacatcctaaaagctttaggcatccccccaaatgcagactgtatggacgatctgcccactgacttcgaaggaagcttgggaggaccccccacgaaccagatcacaggagcctcagatacgacagtaaacgagtcaagcgttaccctggaccccgcagtgcgcacagttggcgcgttgcaagttgtgcaggacacggacccaataccccaggagggcgacgtgattttcacaaccaatagcgagcaagaacctgctgtgtcttcagacagcgacattagcttgatcatggcaatggaggtggggttatctgatgtggaactgtcaactgatcaggactgtgaggaagtgaagagctag

SEQ ID NO: 45638 - DNA, 894 bp, Artificial Sequence
  Description of Artificial Sequence: Synthetic coding sequence
atgagcagccacgcccagcccctgaagctgatcagcccctgcccctacagcttaagttctggggtagaggacatcgtagcaattatgatccctgagccaaagggaaaggaaattgtgagcctactagagaggaacatcaccgtgaccatgtacatcacaattgggacacggaacctgcagaaatatgtgtcaaggacttcagtggtatttgttagcattagcttcatcgtgctgatgatcatcagcctcgcatggctggtgttctactacattcagcggttcaggtacgcgaacgcacgagatagaaatcagagacgactcggagacgcagccaagaaggcaatatcaaaactacaaatccgcactataaaaaaaggcgacaaagagacagagtccgattttgacaactgcgcagtgtgtatcgagggttacaagcctaatgacgtggtcaggattctaccatgtcgccatttattccacaaatcctgcgtcgatccttggcttctcgatcacaggacctgccccatgtgcaagatgaacatactgaaggctctcggcattccacctaacgccgactgcatggatgatcttccaacggactttgagggaagtctgggcggcccgcccacgaaccagattacgggagctagtgatactacagtgaacgagtcttctgtgactctggaccccgccgtgcgtacggtaggcgccctacaggttgtacaggatacagatcccataccccaggagggagatgtcatcttcacaacaaactctgagcaggaacccgccgtgagtagcgactcagacatcagcctcatcatggcaatggaggtgggactttcggatgtagagctgtccaccgaccaggattgtgaggaagtgaagtcctag

SEQ ID NO: 45639 - DNA, 1218 bp, Artificial Sequence
  Description of Artificial Sequence: Synthetic coding sequence
atggccatgagcctgatccaggcctgctgcagcctggccctgagcacctggctgctgtccttctgtttcgtacatctactttgcttggattttaccgtcgccgagaaagaggaatggtacaccgccttcgtcaacattacctacgccgagcctgcccccgatccaggggccggtgctgccggcggagggggcgccgagcttcataccgaaaagaccgaatgtgggcgatacggagaacattcacctaaacaggacgcacgcggagaagtcgtgatggcttcatctgcacacgatagactggcctgtgaccctaacacaaagttcgccgcacccactcgtggtaagaattggatcgccttgatccccaagggcaactgcacttacagagacaagattcgtaatgcctttctgcagaacgcctccgctgtcgtgatcttcaacgtgggttcgaataccaacgaaacaattaccatgccgcatgccggcgtggaagacatcgtggctatcatgatccctgagccaaaggggaaagagatagtatcgttacttgagagaaacatcactgtgacaatgtacattacaattggaactcgtaatttacagaaatatgtgagccgcacatccgtggtgtttgtgagcatcagtttcatagtgctcatgatcatttcacttgcctggctcgttttttattacatccagcgctttcgttatgccaatgccagagaccgcaatcagcggcggcttggggatgcggctaagaaagctatcagtaagctccaaatcagaaccattaagaagggcgacaaggagactgaaagcgatttcgacaattgcgctgtgtgtattgaggggtacaagccgaacgacgttgtccggatcttaccttgccgccaccttttccacaagagctgtgtggatccatggcttcttgatcatagaacctgccctatgtgcaagatgaatattctgaaggcactcggaatcccacctaacgcagattgcatggacgacctcccaaccgattttgagggctcgttaggagggccccccaccaaccagatcacaggcgcttcagatacaacggtgaacgagtcatccgtgaccctggatcccgccgtgagaaccgtgggagccttgcaggtcgtacaggataccgacccaattccacaagagggcgatgtgatcttcacaacaaatagcgagttctgtcacacctag

SEQ ID NO: 45640 - DNA, 1317 bp, Artificial Sequence
  Description of Artificial Sequence: Synthetic coding sequence
atggccatgagcctgatccaggcctgctgcagcctggccctgagcacctggctgctctctttctgtttcgtgcacctcctctgcctggactttaccgtggccgagaaggaggaatggtatacggcgtttgtcaacattacgtatgccgaacctgctcctgaccctggagccggggccgccggcggcggcggcgccgagctgcacacggagaagacggagtgcgggaggtacggcgaacacagccccaaacaggatgcccgcggagaagtcgttatggcatcttccgcacacgataggctcgcctgcgatcctaacaccaaattcgccgccccaacacgcggcaaaaactggattgcgctgattcccaagggaaactgtacttatcgagacaaaattagaaacgccttcctgcagaacgcctccgcggttgtaatcttcaacgttggctccaatacaaatgagaccatcacaatgcctcacgcaggagtagaagatattgtggcaatcatgatacccgagccaaaggggaaggaaatcgttagcctgctggaaagaaatattaccgttactatgtatatcaccatcggaaccaggaacctgcagaaatatgtctcccgcacgagcgtggtgtttgtgagcatcagtttcatagttctgatgatcatatctttagcatggttggtattctactatatccagagattccggtacgctaatgcccgcgaccggaatcagcggagattaggagatgcggcaaaaaaagccatctccaaactacagatccgaaccataaaaaagggcgataaggagactgagtctgactttgacaattgcgccgtctgcattgagggctacaaacctaatgacgtggtgcgcattctaccgtgcaggcatctattccacaaatcttgcgttgacccctggctgttggaccatcgaacatgcccgatgtgtaaaatgaatatcctgaaggcacttggcatcccccccaatgccgactgtatggacgatctgcccacagattttgaaggaagcctgggtggccctcccacaaaccagatcacaggtgccagcgatactactgtcaacgagtcctctgttacactggaccccgcagtgcgaaccgtgggagccctgcaggtggttcaggacaccgatccaatcccacaggaaggggacgttatcttcacaaccaattccgaacaggagccagcggtaagctcagacagcgacattagtttgattatggccatggaggttggcctctcggacgtcgagttgagcacagaccaagattgcgaagaggtaaagagctag

SEQ ID NO: 45641 - DNA, 612 bp, Artificial Sequence
  Description of Artificial Sequence: Synthetic coding sequence
atggagaccctgagccaggacagcctgctggagtgccagatctgctttaattactacagcccccggcgcagaccgaagctgttggattgtaagcacacatgttgcagcgtctgtcttcagcagatgcgcacttctcagaaggatgtgcgctgcccttggtgcagaggagtgactaaactgccgcccggatttagcgtttcccaactaccagatgaccccgaggttcttgctgtgattgcgatcccacatacgtccgaacacacccccgtgttcattaagctcccctctaacggttgctatatgctacccttgccaataagtaaagaacgagcattactgcctggtgacatgggttgccggctgctgcccggatcccaacagaaaagcgttaccgtggtgaccatacctgccgaacagcagccgctgcaagggggtgctccgcaagaagctgtggaggaggaacaagaccgcaggggcgtagtgaagtcgagtacttggtccggtgtctgtacggtcatcctggttgcatgtgtgctggtttttctgttgggcatagtgctccacaatatgagctgtatctcaaaaagattcacagtcatctcatgtggatag

SEQ ID NO: 45642 - DNA, 1053 bp, Artificial Sequence
  Description of Artificial Sequence: Synthetic coding sequence
atgcaccccgccgccttccccctgcccgtggtggtggccgccgtgctgtggggtgccgcccccacacggggattgataagagcaacgtctgatcacaatgcatctatggatttcgccgacctgcccgctctctttggggcaactctgtcccaagagggattacaggggttcctagtcgaagcccacccagacaacgcctgttcacctatcgctccgccccctccagctccagtcaacggcagtgtgttcattgctctgctgagacgattcgactgtaatttcgatctcaaggtattgaacgcacagaaagccggctacggggccgcggtcgtgcataatgtgaatagtaacgagctgctgaatatggtgtggaacagtgaggaaattcagcaacaaatctggatccctagcgtgttcatcggtgagcggtcaagcgagtatctgagagccctcttcgtctacgaaaaaggagctcgtgtcctattagttcccgataataccttccctctgggatactatctgatcccgtttactggaatcgtgggcctgctggtgctggccatgggtgccgtgatgatagcaaggtgtatacagcaccgtaagcggctccagagaaatcgcctcacaaaagaacagctgaaacagatcccaacgcatgactatcagaaaggtgatcaatatgatgtctgcgctatctgcctggacgagtacgaagacggcgataagctacgagtcctcccttgcgcccatgcttatcatagtcggtgtgtggatccatggcttacacagacgaggaagacgtgtcccatatgcaaacagcccgttcaccggggtcccggggatgaagatcaggaggaagagacccagggtcaggaggagggcgacgagggagagccaagggaccaccctgcgtcagaacggacccctctgctcgggtcaagtcctaccctgccgacttctttcggatcactcgcccctgcgcccttagtgtttccagggccttctacagacccccccctcagccccccgagcagtcctgtaatcctggtgtag

SEQ ID NO: 45643 - DNA, 489 bp, Artificial Sequence
  Description of Artificial Sequence: Synthetic coding sequence
atgcacctgctgcccctggacagcagcagcaccctgacctgcaccgtcccgtcagcctgtaccaaaccgccctctaggtggcgccctactgtggacatcttttttgtggtgaccctcctcttgacagtgtttggcgaggacgaccagagccaggatgtattgaggctacaccaggatatcaatgactacaatcgtagattctctgggcagcccaggtccattatggagaggataatggatctgccgactctgctgcgccatgcattccgcgagatgttctctgtgggggggctgttctggatgttccgcatccgtatcatcctgtgtctgatgggagcctttttctatctgatatcccctctcgattttgtgccggaggccctctttggcatcctgggattcctcgacgacttcttcgtcattttcttattgttgatttacatctcaattatgtatcgggaggtcatcactcagcggctgactcgctag

SEQ ID NO: 45644 - DNA, 603 bp, Artificial Sequence
  Description of Artificial Sequence: Synthetic coding sequence
atggccaagtaccagggcgaggtgcagagcctgaagctggacgacgactctgtcatcgagggcgtcagtgaccaggtattagtcgctgtggtcgtaagtttcgcattgatcgcaacgctcgtgtacgccctctttcgtaatgtccatcaaaacatacatcccgagaaccaagaactcgtgcgcgtattgcgtgaacagctccagacggaacaggacgctcccgctgccacacggcaacagttttataccgacatgtactgtcctatctgtttgcaccaggcgagctttcctgtggagacaaactgtggtcacctattctgcggggcgtgcatcattgcatactggcgctatggctcctggctaggtgcgattagctgtccaatttgccgccagacagggtcaagcgaaaaatcttcccgggcttcagaacagactcaccaggaggcagtggcgtgcctggacacacaaaacagtccagcctgtacggttggatgtcgtagtggaccacaacacatcccacatgatagaatgctcccatcagctagcccccgcctgtgcttcacgcttttagactgcgtcagcatcctatggttttccggttag

SEQ ID NO: 45645 - DNA, 138 bp, Artificial Sequence
  Description of Artificial Sequence: Synthetic coding sequence
atggccaagtaccagggcgaggtgcagagcctgaagctggacgacgatagcgtgatcgagggcgtgagcgaccaggtgctcgtcgcggtcgtggtttctttcgcccttatagccacattggtgtatgccttgttttag

SEQ ID NO: 45646 - DNA, 777 bp, Artificial Sequence
  Description of Artificial Sequence: Synthetic coding sequence
atggccaagtaccagggcgaggtgcagagcctgaagctggacgacgacagtgtgatagaaggcgtgagcgatcaggttctggtggctgtggtggtttctttcgctctcatcgccaccctagtgtatgcgcttttccgtaacgttcatcaaaacattcatccggaaaatcaggagctggtgagagtactacgcgaacagttacaaaccgagcaggacgcccctgctgcaacacgccaacagttctacactgatatgtactgccctatttgcttgcaccaagcgagtttccccgtagaaaccaattgtgggcacctgttttgcggggcctgtattattgcttattggaggtacggcagttggctgggagccattagttgcccaatttgcaggcagacagtcacactgctgttaactgttttcggggaagacgatcagtcccaggacgtgctgaggctgcaccaggacattaacgactacaatagaagattcagcgggcagcctagatctattatggaacggatcatggatctcccgacactgctgaggcatgcctttcgcgagatgttctctgtggggggactcttttggatgtttagaatacgaataatcctgtgcctcatgggcgcatttttttatctgatctcaccactagatttcgtgccagaggctttgtttgggatccttgggtttctggatgatttctttgttatattcttgctgctaatctatatatctattatgtaccgggaagtcatcactcagcgcctcaccagatag

SEQ ID NO: 45647 - DNA, 348 bp, Artificial Sequence
  Description of Artificial Sequence: Synthetic coding sequence
atggccaagtaccagggcgaggtgcagagcctgaagctggacgacgactccgtaatcgaaggcgtgtctgatcaggtcctggttgccgtcgtggtgagttttgccttgatcgcgacgctggtgtacgcactcttcagaaatgtgcatcagaatattcatccggagaaccaggagcttgtgagggtgttgcgggagcagctgcaaactgagcaggacgcgccggctgctactagacagcagttttatacggatatgtactgtcctatatgtcttcatcaggctagctttccagtggaaacgaactgcggccacctgttttgcggagcttgcattattgcgtactggtag

SEQ ID NO: 45648 - DNA, 777 bp, Artificial Sequence
  Description of Artificial Sequence: Synthetic coding sequence
atggccaagtaccagggcgaggtgcagagcctgaagctggacgacgacagtgtcattgaaggcgtctcagatcaggtgttggttgcagtggtggtgtcattcgccctgatcgcgacactagtatacgcactgttccgaaacgttcatcagaacatccaccccgagaatcaggagctggtcagggtcctgcgcgagcagcttcagaccgaacaggatgctccagccgccaccagacagcagttctatacggatatgtactgtcccatatgtcttcaccaggcatctttccccgttgagaccaattgtggtcatttgttttgtggggcatgcataatagcgtactggcgttacggatcttggctcggggccatttcttgcccaatctgcaggcaaaccgtgacattattgctgaccgtgttcggtgaagacgatcagtcccaggacgtgctccggctgcaccaggacattaacgactacaaccgacgtttctctggccaaccacgaagtatcatggagcgcatcatggacctgcctaccttgcttcggcatgccttcagagagatgttctcggtcggtggactattttggatgttccggatccgaatcatactttgcctgatgggagcgttcttctacctcatcagccccctggacttcgtccccgaggccctttttggcatcttaggcttcctggatgatttttttgttatctttttactgctgatttatatttccatcatgtatcgcgaggtgataacccaaagactcacgcgctag

SEQ ID NO: 45649 - DNA, 525 bp, Artificial Sequence
  Description of Artificial Sequence: Synthetic coding sequence
atgtactgccccatctgcctgcaccaggccagcttccccgtggagacgaattgtggtcatctgttttgtggagcatgcatcatcgcctattggaggtacgggtcgtggctgggcgctattagctgccccatttgccgtcagaccgtgaccctgctcctgacggtattcggagaggatgaccagtctcaggatgttctgaggttacatcaggatattaatgattataaccggaggtttagcggccagccgcggtcgattatggagcggataatggatctgcccacccttttgaggcacgcctttcgggagatgttcagtgtgggcggcttattttggatgttccgtatccggattattctatgcttaatgggggccttcttttatctgatctcacctctggacttcgtgcccgaagcgctcttcggtatcctaggattcctggacgacttctttgtgatttttctgctcctcatctatatctccattatgtaccgagaagtgattacccaaagactcacccggtag

SEQ ID NO: 45650 - DNA, 546 bp, Artificial Sequence
  Description of Artificial Sequence: Synthetic coding sequence
atggccgaccccaccatcctggtgtacaagtggttcctgctgatctacaaactcagttatgcctttggcgtggtcggctatctggcaatcatgttcaccatgtgtgggtttaatctgttctttaagatcaaggccagagatagtatggacttcggtatcgtgagcctcttctacggcttatactacggggtgatggggcgggattttgccgaaatttgcagcgattatatggcgtccacaatcggtttctactcagtgagtagactccccactaggagcttgtcggacaacatctgtgccgtatgcggtcaaaagataattgtagagctggacgaagaaggactgattgagaatacctaccagttgtcatgtaatcatgtgtatccattccagagaaagctgtttggtctacaccaagccagctttttccctccgtcccctcccccaccaccggtgcccatctccagtatccttctgacctttcacgctcaaacaccggtcttgtatccaccagcacagtcctctctcccagtgtgcccgtgctag

SEQ ID NO: 45651 - DNA, 987 bp, Artificial Sequence
  Description of Artificial Sequence: Synthetic coding sequence
atggccgccggcaccgccgcccggaaggccgcccccgtgctggaggccccaccccagcaagagcagctgtcgcataccaaactgtctgccgaggatacatggaacctgcagcaggaacggatgtataaaatgcaccggggccatgactccatgcacgtggagatgattctgattttcctgtgcgtgttggtgatcgcccagatcgtgttagttcagtggcgacaaaggcatggccgaagttataacctggtcactctgctccagatgtgggttgtccctctctatttcacaattaagctgtactggtggcgcttcttgtcaatgtggggcatgttttctgtgatcacctcatacatactgtttagggccacgcggaaacctctcagcgggcgaaccccacggctggtgtacaagtggttcctgctgatctacaagctgagttatgcttttggcgtcgtgggctacttggctattatgttcactatgtgtggatttaatcttttttttaagataaaggcccgcgactccatggacttcgggatcgtgtccctgttctatgggctctattacggagtaatgggtagggacttcgctgaaatatgtagcgattatatggcgtctaccattgggttctattctgtgtcaaggctccccacacgctctctctctgataacatatgcgctgtctgtggccaaaaaataattgttgaacttgatgaagaagggctgatcgaaaacacgtaccaactatcctgtaatcacgtttttcatgaattctgtatccgaggatggtgcatagtcggaaaaaagcagacatgtccttattgcaaagaaaaagttgatctcaagagaatgatctcaaatccgtgggagcgcactcattttctatacggccagattctggactggttgcgatatcttgtggcatggcagcctgtcgtcattggtatagtgcagggaatcatttacagcctgggactggaatag

SEQ ID NO: 45652 - DNA, 1251 bp, Artificial Sequence
  Description of Artificial Sequence: Synthetic coding sequence
atgaagcggagcaaggagctgatcaccaagaaccacagccaggaggagacatctatccttcggtgctggaagtgccgaaaatgtatagcctcctccggctgcttcatggagtacctggagaaccaggttatcaaagataaggacgattcggtagacgcccagaacatctgccatgtctggcacatgaatgtggaggctctgccggagtggattagctgccttattcaaaaagcacagtggactgttggcaagctgaactgccctttttgtggtgcacgtcttggcggatttaacttcgtgtccaccccaaaatgcagttgcggccagctggccgcggtccacttgtcgaaatctcgaaccgactaccagccaactcaagccggccgactcatgcgcccttccgtgaaatatctgtcacacccgcgcgtgcagtcaggctgcgacaaggaggcgctgctgacgggagggggctcggagaacagaaaccacaggttactcaatatggccaggaataataatgatcctggacggctcacggaggctttgtgtctagaggtccgccctacctactttgaaatgaagaatgagaagctcctttcgaaggcttctgaacccaaatatcagctgtttgttccccagctggtcaccggccgatgcgccacacgcgcattccaccggaagtcccatagcctcgatctgaatatcagcgagaaattgactctcctacccactctgtatgagattcacagcaagaccaccgcctactcacgcctaaacgagacccaacccatagatctgagcggcctacctttgcagagcagcaaaaactcgtacagctttcaaaatccctcctcattcgatccatcaatgctgttgcaaagattcagtgttgctccccatgagactcagacgcagcggggcggcgagttccagtgtggcctcgaggcggcttccgtgtactcggaccatacaaacacaaacaacctcacctttttgatggacctgccttcagccgggcgttccatgcccgaagcctccgatcaggaggagcatctcagtcctctggattttcttcactcggccaatttcagcctgggctccattaaccaacgcctcaataaaagggagaggtcgaaattgaaaaatctcaggagaaagcagagacgtcgtgagaggtggttacaaaaacagggaaaatatagtggagtcgggctgctagatcacatggtaagtatctacctcttgatctag

SEQ ID NO: 45653 - DNA, 291 bp, Artificial Sequence
  Description of Artificial Sequence: Synthetic coding sequence
atgaagcggagcaaggagctgatcaccaagaaccacagccaggaggaaacaagcattctccgctgttggaagtgtagaaagtgtattgccagttctggatgcttcatggagtacctggagaaccaggtgattaaggacaaagatgatagtgtggatgcccagaacatatgccatgtttggcacatgaatgtggaagcactgccagagtggatcagctgcttgatacagaaagggaaatattcgggagttggattgttggaccatatggtgtctatatacctcctgatttag

SEQ ID NO: 45654 - DNA, 1779 bp, Artificial Sequence
  Description of Artificial Sequence: Synthetic coding sequence
atgaagcggagcaaggagctgatcaccaagaaccacagccaggaggagacatctattttacggtgctggaagtgtcggaaatgtatagcaagcagcgggtgctttatggagtatctcgaaaaccaggtcatcaaggataaggatgattccgttgatgcacagaatatctgtcacgtgtggcatatgaacgtcgaagcactgccagagtggatttcctgcctgatccagaaagcccagtggaccgttggaaaattaaactgtcctttttgcggcgcccggctgggaggtttcaactttgtgagtacccctaaatgctcctgcggacagcttgctgcagtccacctgtctaaatcacgaacagactatcagccaacccaagctggacgtttaatgcgaccatccgtaaaatacctgtctcaccccagagtgcagagcggctgcgataaggaagccctgttgacaggggggggatcagagaataggaatcacaggctcttaaatatggctcggaacaacaacgaccctggacgcctgaccgaagccctgtgcctggaagtgcggccaacctatttcgagatgaagaacgagaaattactctcaaaagcctcagagcctaaataccagctgtttgtcccccagctagtgaccggcaggtgcgcaacacgcgcattccaccgaaaatcccacagcttggatttaaatattagcgagaagctcaccctgcttcctaccctttatgaaatccattctaaaactacggcctactctaggcttaacgaaacgcagcctatagatctgtccggattgccgctgcagtcctctaaaaactcctactcttttcagaacccgtcttcattcgatccatctatgttgcttcaacggttctctgtggcccctcacgagacacagacacagaggggaggcgaattccagtgcggcctggaagccgccagcgtgtactctgatcacaccaatactaataatcttacttttctcatggacctccctagtgctggcagatccatgccagaagctagcgatcaggaggagcatctcagtcccctggacttcttgcactctgccaattttagcctggggtcaatcaaccagcgtctgaataaaagggagcgctcgaagctgaagaacctgcgcaggaagcagagacgtagggagaggtggctccagaagcagggtaagtatagcggagtcggcttattggaccacatgacgcttaacaacgaaatgtcaaccgatgaggacaacgaatacgcggaggaaaaagattcttacatctgcgcagtgtgcttggacgtgtacttcaatccctacatgtgttatccttgtcaccacatattctgcgaaccatgtctccggacactggccaaagataacccaagttctacgccttgtccgctgtgccgaactataatcagccgcgtgttctttcagacagagctgaacaacgctaccaaaacttttttcacgaaggagtacctgaagattaagcagagcttccaaaagtctaactccgccaagtggcccctgccctcctgtcgcaaggccttccacctttttggaggtttcagacgccatgcagcgccggtaacaagaaggcagttcccccacggcgcgcacagaatggattatttacactttgaagacgacagccggggctggtggtttgatatggacatggtgattatctacatatactcagttaactgggtgatcggcttcatcgtgttttgttttctgtgctactttttctttccattctag

SEQ ID NO: 45655 - DNA, 324 bp, Artificial Sequence
  Description of Artificial Sequence: Synthetic coding sequence
atgaagcggagcaaggagctgatcaccaagaaccacagccaggaggagacgtccatcttacggtgctggaaatgtagaaagtgcatcgccagttctggatgtttcatggaatatctggaaaatcaggtaattaaggacaaagatgatagtgtcgatgctcaaaacatttgtcatgtttggcacatgaacgttgaagccctgcccgagtggatttcatgtttaattcagaaggcccagtggacagtcggaaaattgaactgtcctttctgcggagcacgactaggcggctttaatttcgttagcactccaaaatgttcctgctag

SEQ ID NO: 45656 - DNA, 489 bp, Artificial Sequence
  Description of Artificial Sequence: Synthetic coding sequence
atggccagccagccccccgaggacaccgccgagagccaggccagcgacgagcttgagtgcaagatctgttacaacagatacaatcttaagcagcgtaaacccaaggtgttagagtgctgccacagggtgtgtgctaaatgcctttacaagatcattgattttggagactcgcctcagggggtcatcgtttgccctttctgccggtttgagacttgtctgccagatgacgaggttagctccctgcctgacgataacaatattcttgtgaatctgacgtgtgggggcaagggcaaaaaatgtctcccagaaaatccaactgagcttcttctcactccaaagaggctcgccagtctggtgtccccgagccacacatcaagtaactgccttgttatcactattatggaagtccaaagagagagcagtccaagcctttcatccaccccggtcgttgaattttacagacccgcctcttttgatagcgtaacctag

SEQ ID NO: 45657 - DNA, 249 bp, Artificial Sequence
  Description of Artificial Sequence: Synthetic coding sequence
atggccagccagccccccgaggacaccgccgagagccaggccagcgatgaactcgagtgtaaaatatgttataaccggtataatttgaaacagaggaaacctaaagtacttgagtgttgtcatcgcgtttgcgcgaagtgcctgtacaaaattattgactttggggattcaccgcagggcgtcattgtctgtcccttttgtaggttcgagacctgtctccctgatgatgaggtgtcatctctgccgtag

SEQ ID NO: 45658 - DNA, 42 bp, Artificial Sequence; identical to SEQ ID NO: 21694
  Description of Artificial Sequence: Synthetic coding sequence

SEQ ID NO: 45659 - DNA, 744 bp, Artificial Sequence
  Description of Artificial Sequence: Synthetic coding sequence
atggccagccagccccccgaggacaccgccgagagccaggccagcgatgagctggagtgtaagatctgctataacaggtacaacctcaagcagagaaagcctaaggtgcttgaatgttgtcatcgggtgtgtgcaaagtgtctctataagatcatcgacttcggcgactcgccccagggagttattgtgtgcccattctgtcggttcgagacatgcctcccagatgacgaggtgtcctctctgcctgatgataacaacatcttagtaaatctgacctgtggcggaaaaggaaagaaatgtctacccgagaatcccacggagctgcttcttactccaaaacgcctggcatcgctcgtgtccccatctcacacgtccagtaactgtcttgtgatcacaataatggaagtccagcgtgagtccagccccagcctgtcctctacaccagtggttgaattttatagacccgccagctttgactctgtgactacagtgagccacaactggacagtgtggaattgcacatccctgttgtttcagacctccatcagggtgctggtgtggctcttaggactcctctatttcagttccctgcccctgggtatttaccttctcgtgtccaagaaagtcacattgggcgtggtgtttgtcagcctggtccccagcagcttagttatccttatggtttacggattttgtcagtgtgtctgccatgaatttctggattgtatggctccaccttcttag

SEQ ID NO: 45660 - DNA, 156 bp, Artificial Sequence
  Description of Artificial Sequence: Synthetic coding sequence
atggccagccagccccccgaggacaccgccgagagccaggccagcgacgaacttgagtgcaaaatttgctataaccgatacaacctcaagcagcgaaagcctaaagtcctggagtgctgccacagggtctgtgcgaagtgcctctataagatctag

SEQ ID NO: 45661 - DNA, 744 bp, Artificial Sequence
  Description of Artificial Sequence: Synthetic coding sequence
atggccagccagccccccgaggacaccgccgagagccaggccagcgacgaactggaatgtaagatctgttacaacaggtataaccttaaacagcgaaagccaaaggtgcttgaatgctgtcatcgagtgtgtgccaagtgtctgtacaaaataattgacttcggtgattcaccacagggagtgatcgtgtgtcctttttgcagattcgagacatgccttcctgacgatgaggtgagttccctacccgacgataacaatatcctcgttaacctcacgtgcggagggaaggggaagaaatgccttcccgaaaaccctacagagttactgctgacacccaaaaggctcgcatctcttgttagtcctagccacacgagctccaactgcttggtgattacgattatggaggtccagcgggagtcgagtccatccctgtcctcaacacccgtcgttgaattttatagaccggccagcttcgactccgtcactacggtgtctcacaactggacagtgtggaactgtacgtccctcctctttcagacctctatccgtgtacttgtttggctattgggcctgctttatttttccagcctgccactcggaatttatctcctggtctcaaaaaaggtcacgctgggggtggtcttcgtgtctttagtgcctagttccctcgttatcctgatggtgtacggcttctgccagtgcgtctgtcatgagtttctggactgcatggctcctccgtcgtag

SEQ ID NO: 45662 - DNA, 744 bp, Artificial Sequence
  Description of Artificial Sequence: Synthetic coding sequence
atggccagccagccccccgaggacaccgccgagagccaggccagcgacgagctggaatgcaaaatctgctataatcgctacaatctgaagcagaggaaacctaaggtcctggaatgttgccatagagtgtgtgccaagtgtctgtacaagataatcgacttcggagattcccctcagggagtgattgtgtgccccttctgcaggttcgagacttgtcttccagatgacgaagtgtctagcctgccagacgataataacattcttgtgaaccttacgtgcgggggcaagggcaaaaagtgtctgccggagaatcctacagagctgctgctgactccaaaacgcctggcctctttagtcagtccatcccacacgagctcaaattgcttagtgatcacaattatggaagtccaaagagagtcttcaccatcactgtcatctacacccgtggtggagttttaccggcctgcatcttttgactccgtgaccactgtttcgcacaattggactgtgtggaattgcaccagtttgctgttccagacctccattcgggttctggtgtggctcctgggactgctatatttttcctctctcccccttggtatttaccttctggtctccaagaaggtgactcttggagtggtcttcgtctcgttggttccaagctccctggtgatcctgatggtgtatggcttttgtcagtgtgtgtgtcatgaattcctggattgcatggcccccccatcttag

SEQ ID NO: 45663 - DNA, 744 bp, Artificial Sequence
  Description of Artificial Sequence: Synthetic coding sequence
atggccagccagccccccgaggacaccgccgagagccaggccagcgacgaactcgagtgtaaaatttgttataaccgctacaacctgaaacagcgtaagcccaaggtgttggagtgctgccaccgtgtgtgtgcaaagtgcctctataagatcatcgattttggggattcaccccagggtgtaatagtgtgtcccttttgtagatttgagacctgtctgccagatgacgaagtctccagtttgccagacgataataacattctggtcaatctaacttgtggcggaaaggggaaaaagtgcttgcccgaaaatcccaccgaattgctgctcaccccaaagagactggcctccctcgtgtccccttcccacaccagtagcaactgtcttgtgataacgattatggaggtgcagcgggagagcagcccttctttatccagtacccctgtggtggaattctatcgacccgcgtcattcgactctgttactaccgtgtcccataactggaccgtatggaactgcacttccctgctgtttcaaacctccatccgtgtcctggtatggctgctcggactgttatatttttcctccctgccattgggaatctaccttctggtgtctaagaaagtgacactgggagtcgtttttgtgtcactagtgccctcctccttagtgatcctgatggtttatggattttgccagtgcgtctgtcacgagttcctagattgcatggcacctccctcatag

SEQ ID NO: 45664 - DNA, 579 bp, Artificial Sequence
  Description of Artificial Sequence: Synthetic coding sequence
atggccagcaagggccccagcgccagcgccagccccgagaacagctctgccgggggaccgagtggctcctctaatggcgccggggagtcagggggccaggattccacattcgagtgtaacatctgtctcgatacagctaaggacgcagtcataagtctatgcggacatctgttctgttggccttgcctgcaccaatggctggaaactcggcctaacaggcaggtgtgtccagtatgtaaggctggtattagtcgggacaaggtaatacccttatacggccgaggatctacgggccagcaagaccctagagagaaaacacctcctagaccacagggtcaaagaccggaacccgagaataggggtggctttcaagggttcggtttcggagacggagggtttcagatgtcttttggaattggggccttccctttcggcatattcgccacagcctttaacatcaacgacggaaggccccctcccgcggtgcccggtacgcctcagtatgttgatgagcagtttctttctagactgtttctgtttgtcgcccttgtgatcatgttttggcttctaatcgcttag

SEQ ID NO: 45665 - DNA, 393 bp, Artificial Sequence
  Description of Artificial Sequence: Synthetic coding sequence
atggccctggcccgggccgagggccggaccgccctgagcagcgccaccagcgcatggacccagccgagaatgcccagcagcgcatgcgtcgccacatcctccgttgggcgagtgtatatcagggaaaaaactccccccagaccacagggtcagcggccagagcccgaaaaccggggcggattccaaggattcgggtttggtgacggaggtttccaaatgtccttcggtatcggagccttcccgtttggcatatttgccaccgcattcaatatcaacgatggccggccccccccagccgtgccaggaaccccacaatacgtggacgaacagttcctatcccgactcttcctttttgtcgcattagtcatcatgttttggctgctgatcgcatag

SEQ ID NO: 45666 - DNA, 474 bp, Artificial Sequence
  Description of Artificial Sequence: Synthetic coding sequence
atggccagcaagggccccagcgccagcgccagccccgagaacagcagtgcgggggggccctctggctcaagcaacggggctggggaaagcgggggccaggactctacgtttgagtgcaatatatgccttgatacggccaaggacgcagtgatttctctgtgcggacacctattctgctggccttgtctgcaccaatggctagaaacccgcccaaatcgccaggtgtgtccagtgtgcaaagctggaatttcccgggataaagtgatccccctttatgggagaggatcaactggccagcaagatccgagggagaagacgccacccagacctcaagggcaacgaccggaacctgagaacagaggggtgaggaacatccttggcgaggcctccacgaacgaactcatggctctcgaggtctccttcctagccctgcagttctttagcctcatcatcaaggtcaaggagaacttgtag

SEQ ID NO: 45667 - DNA, 579 bp, Artificial Sequence
  Description of Artificial Sequence: Synthetic coding sequence
atggccagcaagggccccagcgccagcgccagccccgagaacagcagcgcaggcggcccctcagggtcctctaacggagccggtgagagcggcggacaggacagtacctttgaatgtaatatctgtctggataccgcaaaagatgcagtaatttcgctgtgcggtcaccttttctgctggccatgtctgcaccaatggctcgagactagaccaaacaggcaggtgtgcccggtttgcaaggctggtatatctagagacaaggtcatacccctctacggacgcggaagtactgggcagcaggacccgagggagaaaacaccccccaggccccagggacagcggcccgagcctgagaaccggggaggctttcaggggttcggattcggagacggtggtttccaaatgtccttcggaataggcgcgtttccctttgggattttcgccaccgctttcaatatcaatgatggaagacccccccccgccgtcccaggcacgccacagtacgtcgacgagcagttcctcagccggctgttcttgttcgtagccctcgtcattatgttttggctgctaatcgcgtag

SEQ ID NO: 45668 - DNA, 411 bp, Artificial Sequence
  Description of Artificial Sequence: Synthetic coding sequence
atggccagcaagggccccagcgccagcgccagccccgagaacagcagtgccggcggcccctcagggagctccaatggggcaggggaaagcggtggtcaggactccacttttgaatgcaatatttgcctagacaccgcgaaagatgcagtaatttctctttgtggtcacctgttctgctggccatgtctccaccaggggtttcaggggtttggattcggggatgggggctttcaaatgagcttcggaatcggcgcgtttcccttcgggatatttgcgactgcttttaacataaatgacgggcgtccacctccagcggtgcccggcaccccccagtatgtggacgagcagtttctgtctcgcctattcctttttgtggcattagtgattatgttttggttgctcattgcttag

SEQ ID NO: 45669 - DNA, 2517 bp, Artificial Sequence
  Description of Artificial Sequence: Synthetic coding sequence
atgcaggagcaggagatcggcttcatcagcaagtacaacgagggcctctgcgtgaacactgaccctgtgtccattctgacatctatcctggatatgtcactccatcggcagatggggtcagaccgcgatctacagagcagtgcttcctctgtgtctctcccttcagtcaagaaagcccctaaaaagcggcgaatcagtattggttcactgtttagaagaaagaaggacaataaacgaaagagcagagagctcaatggcggtgtcgatgggattgcaagcattgagagtatccattccgagatgtgtactgataaaaatagcattttctcaacaaacacctcgtcagataatggcctgacctctatttcaaaacagattggcgattttatagagtgccccctctgccttctaaggcacagcaaggataggttcccagacataatgacgtgccaccatcgctcttgcgttgattgtctgaggcagtatcttcggatagaaatcagcgaatctagggtgaatatctcatgcccagagtgcaccgaacggttcaacccccatgatatcagacttattttgtcagacgatgtattgatggaaaagtatgaagaatttatgctgcgcaggtggttagtcgccgaccccgactgcaggtggtgccctgccccggactgtggatatgccgttatcgctttcggctgcgcaagctgccccaagctgacgtgcggacgagagggatgcggaactgaattctgttaccactgcaagcaaatatggcatccaaatcagacctgcgacgccgccagacaggaacgtgcccagtcattgcgactgaggactatccgctcatccagtatctcatattctcaagaatcaggggcagcagcagatgatattaagccatgtccacgctgtgcagcctacattatcaagatgaatgacgggtcctgtaatcatatgacttgtgcagtgtgcggctgcgaattctgttggctgtgcatgaaggaaattagcgacctccactatctgagcccttctggatgcaccttctggggcaaaaaaccctggagccgcaagaaaaagattctgtggcagcttggtactctggtcggcgcgccagtgggcattgcgctgattgcgggaatagctattccggcaatgattataggcatccctgtctatgtcggccggaagatacataaccgctacgaaggaaaggatgtctccaagcacaaacgcaacctagcgatcgcaggtggagtgaccctgagcgtgatcgtatcacctgtggtcgctgccgtgaccgtgggcatcggagtgccaattatgctggcctacgtctacggtgtagtcccgatcagtctttgccgcagcggcggctgtggcgtttctgctggcaacggcaaaggcgtgcggatcgagtttgacgatgaaaacgacataaacgtagggggcactaatactgctgtcgatactacaagcgtagccgaggcaagacacaacccatccatcggcgagggctcagtcggtggactcaccggctctctgtcagcatccggctcacatatggaccgcatcggcgcaattagagacaacctgtctgagacggcctccactatggccctggcaggagcatctatcactggatctttaagcgggtcagcaatggttaattgtttcaatcgcttggaggtccaggctgacgtccaaaaagaaagatactcactctctggtgaatcagggactgtttctctgggtaccgtttccgacaatgcttccacgaaagccatggcggggtcaatcctgaactcctacattcccctcgacaaagaaggcaattccatggaggttcaggttgacatcgaatccaagccctctaagttcagacataattccggaagttctagtgttgatgatggaagcgccacacgctcccacgcgggcgggtcatcatcaggtcttccagagggtaaatcaagcgctaccaaatggtcaaaggaggccactgccggcaaaaaatcaaagtccggaaaacttagaaagaaggggaatatgaagatcaacgaaaccagggaggacatggacgcccagttactggagcaacagtctaccaactcttcggagttcgaagccccctccctgagcgattcaatgccctccgtcgcggacagccactcttcccacttcagtgagtttagctgctctgatttagaatctatgaaaactagctgtagtcacggatcctcagactatcacactaggttcgctaccgtgaatatattaccagaggttgagaacgacagactcgaaaactcccctcatcagtgctctatttccgttgtgacgcaaaccgccagttgctccgaagtgtcccagttgaaccatattgctgaggagcatggcaacaatgggattaaacccaatgtagacctttactttggcgatgccttaaaagagacaaacaacaatcacagccaccagaccatggagttaaaagtcgccattcagacagaaatctag

SEQ ID NO: 45670 - DNA, 270 bp, Artificial Sequence
  Description of Artificial Sequence: Synthetic coding sequence
atgcaggagcaggagatcggcttcatcagcaagtacaacgagggcttgtgcgtgaatacggatccggtttctatcttgactagcatcttagatatgagtctccacaggcagatgggttcagacagggatctacaatccagcgcctcctcagtatccctgccctccgtgaagaaagcacctaaaaagcgtcgaatttctatcgggtctctcttcagacgcaaaaaagacaataagaggaagtctcgcgaactgaatggtggagtggactag

SEQ ID NO: 45671 - DNA, 2517 bp, Artificial Sequence
  Description of Artificial Sequence: Synthetic coding sequence
atgcaggagcaggagatcggcttcatcagcaagtacaacgagggcctgtgtgttaacaccgatccagtctcaattttgacatccattcttgatatgtccctgcatcggcagatgggatctgaccgggatcttcaatcatcagcctcttcagtttccctgcctagcgtgaagaaagctcccaaaaaaaggcgcatttctattggtagcttgtttaggcgcaaaaaggataacaaacggaaatctcgagagttgaatggtggggttgatgggatcgctagcatcgagagcattcatagcgaaatgtgtactgataaaaatagtatcttttcgactaatacgtcaagcgataacggcttaacaagcatttcaaaacagattggcgatttcattgagtgtcctctctgtttactaaggcactctaaggatagattccccgatatcatgacatgtcaccacagaagctgtgtggattgcctacggcagtatttgcgtatcgagataagcgaaagtcgggtcaacatcagctgtccggaatgcaccgagcgatttaatcctcacgacataagactgatcttgtctgatgacgttctgatggagaagtatgaggaatttatgctgcggcgctggctcgtcgcagaccctgactgccgctggtgccctgcaccagattgtgggtacgcagtcattgcgttcggctgcgctagctgtcctaagctaacctgtggcagggaggggtgtggcaccgagttctgctatcactgtaaacaaatttggcatccaaatcaaacctgtgatgctgcccgtcaggaacgcgcccagagccttaggttaagaacaatacggagctccagcatcagctacagccaggagtccggagctgcagccgacgatattaagccatgccctcgctgcgcagcatacataataaagatgaatgacggatcatgcaaccatatgacttgtgccgtatgtggctgcgagttttgttggctctgtatgaaggagattagcgacctacattacctttcacccagtggttgcactttctggggaaaaaagccttggagcagaaagaagaagattctctggcagctcggaactctggttggcgctccagtggggatcgcattaattgccgggattgctatccctgccatgattatcggcatacccgtgtacgtcggccgcaagatacacaaccggtacgagggcaaggatgtgagcaaacacaagagaaatctggctatcgccggcggggttactctgagtgtgattgtgagccccgtagtcgcagcggtcacagtcgggattggcgtgcccataatgcttgcatacgtgtacggagtggtgcctatatcactttgtagaagtggaggctgtggcgtatccgctggaaacggaaaaggggttcggatcgagttcgacgatgagaatgacatcaacgtcggaggcacaaatacagctgtcgacactacatctgtggcggaggcacggcacaacccgtctatcggggagggctccgtgggaggcttgaccggatcactcagcgcgtctggaagccatatggatcgtattggcgccattcgggataatttaagtgagactgccagcaccatggcccttgccggggcatctatcacaggcagtctgagcgggtctgccatggtaaattgcttcaatcgcctggaagtgcaagctgatgttcagaaagagcgctatagtttgagcggcgagtccggcaccgtgtctttgggcactgtctcggacaatgccagtaccaaagctatggccggctctatcctgaatagctatattccactggacaaggaaggcaattcgatggaggtgcaggttgatatcgagtccaaaccgagtaaattcaggcacaatagcgggtctagttccgtggacgacggttcggcgacaaggtctcatgccggcggctcttcttctgggttacccgagggaaagagttccgcaaccaaatggtccaaggaggccactgccggcaaaaagtctaagagcgggaagctgcggaaaaaaggtaatatgaaaattaatgaaacacgggaagatatggacgcccagcttctggagcagcagagcactaattcttctgagttcgaggcccccagtctgtctgattcaatgccatcggttgcggatagccatagtagccacttcagcgaattttcctgtagtgacctggaatccatgaaaaccagttgttctcatgggagttccgattaccacacacgattcgcaaccgtgaatatcctccccgaagtagagaacgatcgtttggaaaatagtccccaccagtgcagtatcagtgtagtgactcagacagcctcctgctctgaggtctctcaattgaaccatattgcagaagagcatggcaataatggcatcaagccgaatgtggacttgtattttggcgatgccctaaaggagaccaacaataatcattctcatcagaccatggagctaaaagtggctatccagaccgagatttag

SEQ ID NO: 45672 - DNA, 498 bp, Artificial Sequence
  Description of Artificial Sequence: Synthetic coding sequence
atgcaggagcaggagatcggcttcatcagcaagtacaacgagggcctgtgtgtgaataccgatcccgtatccatcctcacgagcatcctcgatatgtctctgcacaggcagatggggagcgaccgggatctacagagcagtgcatccagcgtcagccttcctagtgtcaaaaaagctcccaagaagcgaaggattagcattggatctctgttccgcaggaagaaggacaataaacggaaatctcgcgaactcaacggcggtgttgacggtatagcatccatcgagtctatccactcagagatgtgtactgacaaaaacagtattttcagtactaacaccagctctgataacgggctgacttctatcagcaagcagatcggcgactttatcgagtgcccactgtgcctcctgcggcacagtaaggaccggttccctgacatcatgacttgccaccacagatcttgtgtcgattgtctccggcagtatttgcgaatttag

SEQ ID NO: 45673 - DNA, 342 bp, Artificial Sequence
  Description of Artificial Sequence: Synthetic coding sequence
atgcaggagcaggagatcggcttcatcagcaagtacaacgagggcctgtgcgtgaatactgacccggtttcaattcttacgtctattctggatatgagtctgcacaggcagatgggcagtgatcgggacttgcagtcttccgcatctagtgtgagcttacccagcgtgaaaaaggcaccaaagaaacggcgcataagcattggcagtctctttcgtcggaagaaggataacaaacgtaaaagcagagagctaaatggaggagtggacgggatcgcttcaattgagagcattcatagcgaaatgtgcaccgacaagaactcaatcttctctacgaacacgtag

SEQ ID NO: 45674 - DNA, 471 bp, Artificial Sequence
  Description of Artificial Sequence: Synthetic coding sequence
atgcaggagcaggagatcggcttcatcagcaagtacaacgagggcctgtgtgtgaatactgatccggtttctatcctcactagcatcctagacatgtcccttcatcgacaaatgggatcagatagagacctccagtctagcgcgtcctccgtttctctgccaagtgtgaaaaaagcgcctaagaagcgtcgcatcagtataggaagtctgtttaggcgcaagaaagataacaaaaggaagagccgcgagctgaatggcggcgttgacgggatcgcatcaatcgagtcgatccacagtgaaatgtgcaccgacaagaattctatattctctaccaacacttctagcgataacggccttacctccatcagcaagcagattggggatttcattgagtgccctctttgtttactgcggcatagcaaggaccgcttcccagatataatgacatgccatcaccgctcatgtgtctag

SEQ ID NO: 45675 - DNA, 48 bp, Artificial Sequence; identical to SEQ ID NO: 21711
  Description of Artificial Sequence: Synthetic coding sequence

SEQ ID NO: 45676 - DNA, 1029 bp, Artificial Sequence
  Description of Artificial Sequence: Synthetic coding sequence
atgcggaaggagacccccccccccctggtgccccccgccgcccgggaatggaacctgccgccaaacgccccggcttgcatggagaggcaactggaggcagcccgatatcggtcggatggagccctcctgctaggcgccagctccctgagcggcagatgctgggccggcagcctttggttgttcaaagatccgtgtgccgcacctaacgaaggcttctgtagtgctggcgtccagacagaggcaggggttgctgatttgacatgggtcggtgagcggggaatcctcgtggcatctgatagtggggccgtggaactgtgggagctggatgaaaacgaaaccctgatagtgagtaaattttgtaagtacgagcacgatgacattgtgtcgactgtgtccgttctgtccagtggcacccaggccgtgtctggatccaaggatatttgcattaaggtctgggacctggctcagcaagttgtcctgagctcgtatcgcgcccatgccgcccaggtaacatgcgtggctgcatctcctcataaggattctgtgtttctgtcatgcagcgaggacaaccgaatcctcttgtgggacactcgttgtcccaaaccagcctcccagattggatgttcagcccccggctaccttcctacgtctctggcatggcaccctcaacagagcgaggtgttcgttttcggcgatgagaacgggactgtctccttggttgatactaagtctacgtcctgtgtgctgtcctctgctgtgcattctcagtgcgtcacgggactggtgttctctcctcacagcgtgcccttccttgcctcgctgtctgaggactgttctttggctgttcttgattccagtctcagcgagttattcagaagtcaagcccacagggactttgtgagggatgccacgtggtcgccactgaatcactcactgcttactaccgtggggtgggaccatcaggtagtgcaccacgtggtccccacggagcctctgccggctccggggcccgccagcgtgacagagtag

SEQ ID NO: 45677 - DNA, 1764 bp, Artificial Sequence
  Description of Artificial Sequence: Synthetic coding sequence
atgggcagcgagaaggacagcgagagcccccggagcaccagcctgcatgcagccgcgcccgaccctaagtgccgtagtggtggtaggcgtcgcaggctcaccctgcatagcgtgttctccgcatcggcaaggggaagaagggctcgggccaaaccacaggcggagccaccacctcccgccgcacaaccccctccagctccagcccctgccgctgcacagggccccccccctgaagcactccccgccgaaccagcggctgaggctgaagccgaggccgccgccgcggctgcggaaccaggtttcgacgacgaggaggcagctgagggtggggggccaggggccgaggaggtcgagtgcccactatgtttggttaggctaccacctgaaagagctcctaggctgctttcttgccctcatcgcagctgccgggattgccttagacattacctgcggcttgagatctccgagagccgcgtgccaatctcctgccccgaatgctccgagcggctcaacccccacgatataaggctgttgctcgccgacccaccgctcatgcacaagtacgaggagttcatgctgcgccgatacctggctagcgatcccgattgccgttggtgtcctgcccccgactgtggctacgccgtgatcgcctacggatgtgcctcctgtcccaagttgacatgtgagcgggagggttgtcagaccgagttctgctatcattgtaaacaaatctggcaccccaatcagacctgcgacatggcgcggcagcagagggcacagaccttacgtgtcaggactaaacacacctcaggactaagttacggccaagagtctggcccagacgacatcaagccctgcccccggtgtagtgcatacataatcaagatgaacgacggttcttgcaatcatatgacatgcgcagtgtgtgggtgtgagttttgttggctgtgtatgaaagagatatccgatctgcactatctgagtccctccgggtgtacattctggggaaagaagccatggtcccggaaaaagaaaatcctttggcagctcgggacactgattggcgcgccagtagggatctccttaatcgccggtatcgccatacctgccatggtgattggtattccagtgtatgtggggcggaaaatccattcccgttatgaaggtagaaagacttccaaacacaagagaaacttagccattacaggaggggtcactctaagcgttatcgcctcgccggtgatagctgctgtttccgtgggcatcggggtgcccatcatgctagcatacgtctacggcgttgtacccatttcactatgtcggggcggggggtgtggagtcagtacagctaacggaaagggggtgaaaatcgagtttgacgaagatgatggaccaatcaccgtggcagatgcctggagagcattaaagaatccttctatcggggagtcatccatcgaggggctgacctctgttctgagtactagcggctcacccaccgacggtttaagcgttatgcagggcccttactccgaaactgcctcttttgccgccctgtccggcggaactctcagcgggggcatcctgtcctcagggaagggcaagtattcacgcctggaggtccaggccgacgtccagaaggagatatttccaaaagatacggcctcactgggagcaatctctgacaacgcctctactcgcgcgatggctgggtccataataagtagttacaatccacaagatagattttccatgatccacgcgtag

SEQ ID NO: 45678 - DNA, 2199 bp, Artificial Sequence
  Description of Artificial Sequence: Synthetic coding sequence
atgggcagcgagaaggacagcgagagcccccggagcaccagcctgcatgctgctgcccccgaccccaaatgccgcagcggtggccgcaggagacggcttaccctgcatagcgtcttcagcgccagcgccagagggcggcgggctcgcgctaagccacaggccgaacctccccccccggcggctcagccaccaccagcccccgccccagccgccgcacaaggtccaccccccgaggccctaccagccgaaccagctgcggaagccgaggccgaagctgccgcggcggcggctgagccgggatttgacgacgaggaggctgctgaggggggaggtcctggggccgaagaggtggagtgtcccctgtgcttggttcggcttcccccagaaagggcaccacggctcctatcgtgccctcaccgttcctgtcgcgactgccttcggcattatctacggctggaaatttctgaatctagggtccctattagctgccctgagtgttccgagcggctgaaccctcacgacatcaggcttttgctggcggaccccccattaatgcataagtatgaggagttcatgctgcggcggtacctcgcttctgaccctgactgtcgttggtgtcctgcccctgattgcggctatgccgtgatcgcgtatggatgtgcctcttgccccaagctgacttgtgagcgcgaggggtgccagactgagttctgctaccattgcaaacagatttggcacccaaaccaaacatgcgacatggcgcggcagcagagagcccagacccttcgcgtgaggactaaacatacttccgggctgtcctacggacaggaaagtggaccagctgacgatatcaaaccctgtcctcgctgcagcgcctatatcataaagatgaacgacggaagttgcaatcacatgacatgcgccgtatgcggctgcgagttttgttggctctgcatgaaggaaatctccgatctgcattacctttccccttctggttgcaccttctggggcaagaagccgtggtcccggaagaaaaagatcctttggcaactgggcactctcattggtgcccccgtggggattagtttgatcgctggcattgcgataccggctatggtgataggaattcccgtgtacgtgggaagaaagattcactcacggtacgaaggccgcaagacaagtaagcacaaacggaacctcgcaatcactggaggggtgactctaagcgtcatagcgagccctgtcatcgctgctgtatccgtggggatcggggtgcccatcatgcttgcttatgtgtatggcgtggtgcccatttctttgtgtaggggaggcgggtgcggggtcagcacagccaacgggaagggtgtgaaaatcgagttcgacgaagacgatggaccaatcactgtcgctgacgcatggagagctctaaaaaatccgagcatcggagaatctagtatagagggtttaacctccgttctctcaacctcagggtcccccaccgatggtctgtctgttatgcagggaccttattcagaaaccgcatcctttgccgccctcagcggtggtacgctcagtggtggcattctttcctcgggcaaagggaagtatagcaggttggaagttcaggccgacgtacagaaggaaatttttccaaaagacacagcaagtcttggggctatttcagataatgctagcacccgcgccatggctgggtctatcatatcctcttacaacccgcaggatagggaatgtaacaacatggagatccaggtggatatcgaagctaagccgtcccactaccagttagtttccgggagttccactgaagattctctccacgtgcacgcccaaatggcagaaaacgaagaggagggcagtggtggtggtggcagcgaggaagaccccccgtgtcgccaccaatcttgcgagcaaaaggattgcctagcaagcaaaccttgggatatttcactggcccaacctgagagtatccgctctgacctggaaagctcggacgcccaatctgacgacgtcccagacataacctctgatgaatgtggttccccaagatcacatacggccgcctgcccatccacccctcgggcacagggagctccatcgccctccgcccacatgaatctgtccgccctagccgaagggcagacagtgttgaagcccgaaggaggcgaagctagagtttag

SEQ ID NO: 45679 - DNA, 1461 bp, Artificial Sequence
  Description of Artificial Sequence: Synthetic coding sequence
atgggcagcgagaaggacagcgagagcccccggagcaccagcctgcacgccgctgccccagatcccaagtgccggtctgggggtcggagacgcaggctgctcagctgtccccacaggtcgtgccgagactgtttgaggcattacttaagactagagatcagtgaatccagggtgccaatatcgtgcccagaatgcagcgaacgcttgaatccccacgacatacggctcttactagctgatccacccctgatgcataaatacgaggaattcatgctcagacgttaccttgcaagcgatcccgactgtagatggtgtcccgcgcctgattgcggatacgctgttattgcttatggctgtgcttcctgtcctaaactcacctgcgagcgtgagggatgccaaaccgagttttgttaccattgcaagcagatttggcacccaaatcagacgtgcgacatggcgagacagcagagggcacagaccctcagggttcgcacaaagcatacctccgggctcagctacggccaagaaagcggccctgacgacattaaaccctgcccacgttgttccgcttatattatcaagatgaatgacggaagttgcaatcacatgacatgtgcagtgtgcggatgtgagttctgttggctgtgcatgaaagaaatttccgatttgcactacttatcccccagcggctgtaccttctggggcaaaaaaccctggtctcgtaagaaaaagatactgtggcaactgggcactcttattggggccccggttgggatcagcctcattgctggaatcgctatcccggcaatggtcattggaatcccagtgtatgtggggcggaagatccatagtcggtacgaaggaaggaaaacatcaaagcacaaacgtaacttagccatcactggcggtgtgacccttagcgttatcgcctccccggtaattgcagctgtgtccgtgggcatcggagttcccatcatgctggcctacgtatacggtgttgtgcctataagcctgtgtcgagggggcggttgcggcgtttctacggctaacggtaaaggcgtcaagatcgagttcgatgaggacgacgggcccattaccgtggccgacgcctggcgggctttaaagaacccgagtatcggggagtcctctatcgagggactgacatccgttctgagcacatccgggagtccaacagatggcctgtccgtaatgcagggtccctattctgagactgcttcgtttgcagctttatccggcgggacactctctggcggcatcctaagctccggtaaaggcaagtattcccggctggaagtgcaggctgacgttcaaaaggagatctttcccaaagatacggcttctttaggagcaattagtgataatgcttcaacacgggctatggcaggatcaattatatcttcttacaatccccaagaccgatcgtccatgccgcacgtgtag

SEQ ID NO: 45680 - DNA, 1134 bp, Artificial Sequence
  Description of Artificial Sequence: Synthetic coding sequence
atgggccccgccgcccggcccgccctgcggagccccccccccccccccccgcccccacctagtcccttgctgctgctcctaccactcctacccctttggctcgggcttgcaggcccgggcgccgccgctgatggcagcgagcccgcagccggcgccgggcgggggggtgcccgtgctgtaagggtggacgtgagactgcctagacaggatgcactagtcctggagggagtacggattggttccgaggccgatccagcaccactgctaggtggacgattactcctaatggacattgttgatgccgagcaagaagcgccagtcgaaggttggatagctgtggcgtacgttggaaaagagcaagcagctcagtttcatcaagaaaataaagggagcggaccccaagcctaccctaaggctctcgtgcagcagatgcgccgggccctgttcttgggcgcatccgctcttctgttgctgattctgaaccacaatgtggtacgcgaactggacatttcacagctgctactccgccctgtgattgtgctccattattcctccaacgtgacaaagctcctggatgcgctgctacagaggactcaagccaccgctgagattacaagcggagagtcactgtccgccaatatagagtggaagctaacgctgtggacgacctgcggcttaagcaaggatggctatggagggtggcaggacctcgtgtgcctggggggctctagagcacaggagcagaagcccctgcagcagctttggaacgccatcctactggttgcgatgctcctgtgtacaggcctcgtagtccaagctcaacggcaggcaagccgacagagtcagagggaactcggcggtcaagttgatctgttcaaaagacgcgtggtgcgccggctagcatcacttaagactaggcgctgccggctgtcgcgtgctgcccagggactccctgatcccggggcggagacctgcgccgtttgtctcgactatttttgcaataagcagtggctcagggtcttaccgtgcaaacacgagttccatcgggactgcgtggacccttggctgatgcttcagcagacttgtcctctttgcaagtttaatgtactgggtaatagatattcagacgattag

SEQ ID NO: 45681 - DNA, 561 bp, Artificial Sequence
  Description of Artificial Sequence: Synthetic coding sequence
atggccccctgcaccgagaccaagatcttcgtgctgtgcgacgagcagattcagtgccctacttgccagtttgtgtggtgctttaagtgtcactcgccctggcatgagggggttaactgtaaagagtacaaaaagggggacaagcttttgcgccactgggccagcgaaatcgagcatggacagagaaacgcccaaaagtgcccaaaatgtaagatccatatccaacgaaccgaaggctgcgaccacatgacctgctcgcaatgcaatacaaacttctgttaccggtgcggggagcgctaccggcagctgaggttttttggcgaccatacatctaatttaagtatttttggttgtaagtatcggtatctgccagagcgcccgcacctgcgccggcttgtcagaggatctgtgtgcgcagggaagctattcatcgctccactgatcatggtattggggctcgctctgggcgccatagcagtggtcatcggcctgtttgttttccccatttattgtctgtgtaaaaagcaacgcaaacgttcacgaacaggtatgcattggtag

SEQ ID NO: 45682 - DNA, 828 bp, Artificial Sequence
  Description of Artificial Sequence: Synthetic coding sequence
atgaaggtgcagctgggccaggtggagatcaagtgccccatcaccgagtgctttgaatttctggaggagacgaccgtcgtgtacaatctaacccatgaggacagcattaagtacaaatacttcctggaactaggcaggattgattcctccaccaaaccatgtccccagtgtaagcactttaccacattcaaaaaaaaggggcacatccctacaccgtctcgcagtgaatctaagtacaagatccaatgtcctacctgccagttcgtgtggtgctttaaatgccactcaccgtggcacgagggcgtgaactgtaaagagtacaagaaaggggacaaactgctacgccactgggcttcggaaattgagcatgggcagcgcaatgcccaaaaatgcccgaagtgcaagatccacatccagcggacagagggttgcgatcacatgacctgcagtcagtgcaacacaaacttttgttacaggtgtggcgagaggtacaggcagctgcgattttttggagatcacacttctaacctatctatctttggatgcaagtatcgctatcttcccgagcgaccccacctgcggcgcctcgtgagggggtctgtgtgtgcgggcaagttgtttatagcgcccctgatcatggtgttagggctcgctctaggggctattgcagtcgtgattgtggaagaaatcaagacctactggaatctgatctctggacgcacccgcaaccagactcagcacctcgctcctcagcctgtccttctgagtgacatgctttattgcctgaagcaagtctttatatgcatttcataccttctccccctttag

SEQ ID NO: 45683 - DNA, 9 bp, Artificial Sequence
  Description of Artificial Sequence: Synthetic coding sequence
atgaagtag

SEQ ID NO: 45684 - DNA, 924 bp, Artificial Sequence
  Description of Artificial Sequence: Synthetic coding sequence
atgcccagcctgctgggcgcccccccctacagcggcctgggcggcgtcggagacccttacgtgccattgatggtactgatgtgtcgggtatgtttagaggacaagcctatcaagcctctcccctgctgcaagaaggcagtgtgcgaggaatgtttaaaagtctacctttccgctcaggtgcagctcgggcaggttgaaattaaatgcccaatcactgaatgttttgagttcctcgaggaaaccaccgtggtctacaacttaacacacgaagattccatcaagtataaatacttcctggagctcggccgcatcgactcatcaacaaagccttgtcctcaatgtaagcacttcacaacctttaaaaaaaagggccatatcccgaccccctcccgatccgaatccaaatataaaatccagtgccctacatgccagttcgtgtggtgcttcaaatgccattccccttggcacgaaggggtgaactgcaaagaatataaaaaaggagacaaactattgcgtcattgggcatctgagatcgagcatggacaaaggaacgcacaaaagtgccctaaatgcaagattcacatccaacgcacagagggctgtgatcatatgacctgctcgcaatgcaatactaatttttgctatcggtgcggggagaggtatcggcaattgaggttttttggcgaccatacaagtaacctttctattttcgggtgcaagtataggtacctgcctgagaggccacacctccggaggcttgttcggggcagcgtttgcgctggaaaattgtttatcgcacccctgattatggtgctcggactcgccctgggtgccatagccgtcgtaattggcctcttcgtcttcccaatctattgcctgtgcaaaaagcaaagaaaaagaagcagaactgggatgcattggtag

SEQ ID NO: 45685 - DNA, 750 bp, Artificial Sequence
  Description of Artificial Sequence: Synthetic coding sequence
atgagcagcggccagcaggtgtggcacaccgccgtgccccccccccggaggtctagctcaatcgcgtcaatgccgcgcagtccctcatcagctgggagcccaaggtcacccggaactcccggctcagaacgcgtggccagtcccctggaatgctcaatatgtttctccggatacgataacatttttaaaacccctaaggagctctcctgtacacacgtattttgtctcgagtgcttggctagactagccgcagctcagcccgttggcaggcccggcggcgaggccgttccctgcccattctgccgccagcctacagcagtaccacctgcaggggccccggctttgtgcacatcacggcaattgcaagcgcgcatgcctgctcacttgcgacgcgaggaaccggtgtggctcgaagggacgaaattgtgttgccagcccctgcccacaactcctggcagagagcccggcttcgtgtgtgtggatgtcggacttagtaaaccggccgaacccccagctccagcccgagaccctgcgcctcgcaggggtagattggctagatgctgggccaggtgtagggactggagacggatggcgttagttagcgccttgctactcatgttattctgtgtagccctgtggcctgtgcagtgcgccttgaagacgggcaacctccggtgcttgccccttcccccgagaccgcctgccaccagcacagcagcctcacccctgggtcctctgaccgacaactag

SEQ ID NO: 45686 - DNA, 3006 bp, Artificial Sequence
  Description of Artificial Sequence: Synthetic coding sequence
atgagcggccccggcaacaagcgggccgccggcgacggcggcagcggaccacctgaaaagaagctcagcagagaggagaaaactactacaactttgattgaacctattaggcttggaggtatttcttccaccgaggagatggatttaaaagtccttcagttcaagaataaaaaattggccgagaggctcgaacaacggcaagcttgtgaggacgaattgagagagcgcattgagaaactggaaaagcggcaggcgaccgatgatgccacattgctgatcgtcaaccgatattgggcccaacttgacgaaaccgtggaagccctgctgagatgccatgagtctcagggcgaactgtcttctgccccagaggcacctggtactcaagaaggccctacctgcgacggaacccctcttcctgaacctggcacctccgagctgagagacccattactcatgcaattacggccccccttgtcggaaccagcgcttgcctttgtagtggcactgggcgccagctctagtgaggaagtggagttggagcttcaaggcagaatggaattcagcaaggccgctgtgtcaagggtggtagaggcctccgacaggctgcagagacgagtagaagagctatgccagagggtgtactcacgtggcgactccgagccactctccgaagcagcccaggcacacacccgggaactgggtagagagaataggcgtctacaggacctcgccacccagcttcaggagaagcatcacaggatctcactggaatatagcgagctccaagataaggtgactagtgccgagacaaaggtgctcgagatggaaacaacagtcgaagatctccaatgggacatcgagaaactacgcaagcgcgagcagaagctaaataaacatttagcagaggcacttgagcagctgaatagcggctactatgtttccggctctagcagtggattccaaggaggacagataacactaagtatgcaaaaattcgaaatgcttaatgctgagctggaggagaaccaggagttagctaattcaaggatggctgaactcgagaagctccaggccgaactgcagggggcggtgagaacaaatgagaggttgaaggtggctttaagatcgctgcctgaggaggtcgttcgcgaaacaggggagtatagaatgctccaggctcaatttagtttgctatacaatgaaagtctccaggttaaaacccagctagacgaagctagggggttgctgctggcaacgaagaatagtcacctgcgacatatcgaacacatggaatctgacgagcttggactgcagaaaaagctccggaccgaggtgattcagttggaggacaccctcgcccaggttaggaaggagtatgagatgctcaggattgagtttgaacaaaatcttgcagccaatgagcaggccgggccaatcaaccgtgagatgagacaccttattagtagcctgcaaaatcataaccatcagctgaagggagacgcccaaagatataagcggaagctccgcgaggtgcaagcagaaatagggaaactgagggcacaggctagtgggtcggcccactctacacccaaccttggacacccagaagactctggtgtctccgcacctgctccaggaaaagaggagggcggacctgggcccgtgagtactcccgataatcggaaggagatggcccccgtaccggggacaacaaccacaaccacaagcgtcaagaaagaagaactcgtgccctccgaagaggactttcagggcattacacctggcgctcaaggaccgtcatcacgtggtcgtgagcccgaagcccgtcctaaaagggagctgcaagagcgcgagggcccatccttgggcccacccccggtcgccagcgccctctctcgggcagatagggagaaggccaaagtggaggaaacaaaacgaaaagagagcgagttactgaagggcctgcgagctgaactgaagaaagcccaggaatcccagaaggaaatgaagctcctcttggacatgtataagagtgctcccaaggagcaaagggataaggtgcaactaatggcagccgagcgcaaggcgaaggcggaagtggatgagttgagatcgcggatacgggagttggaggaaagggacagacgcgagtcaaagaaaatcgctgacgaggacgcgctacgtcgcattaggcaggccgaggagcagattgagcatctgcaacggaaacttggagccacaaaacaggaagaagaggctttgttatctgaaatggatgtaactggtcaggcctttgaagacatgcaggagcagaacggtcgcctgctccagcagttgcgggaaaaagacgatgccaacttcaagttgatgtccgagcggatcaaagcgaaccagattcacaaactactcagggaggaaaaagacgagttgggcgaacaagtccttggactgaagagtcaggtggacgcccagctgttgaccgtacagaaattggaggaaaaggagcgggcactccagggctctctaggtggagtcgagaaggagctgaccctcaggtcccaggctttggaactgaataagcgtaaagccgtggaagccgctcagctcgccgaagacctaaaggttcagttagagcacgttcaaactcggctgcgggaaatccagccctgcctggccgagagccgggcggcccgggagaaggagagctttaatctgaaaagagctcaggaggacattagtagactgcgaagaaaattagaaaagcagaggaaggttgaggtatacgcggacgctgatgaaattctgcaggaggaaatcaaagagtataaggcccgactgacatgtccttgttgcaatacccggaagaaagatgccgtcctgaccaagtgtttccacgtgttctgcttcgaatgcgtgcgcggcagatatgaagctcgacaaagaaagtgtcctaagtgtaacgctgcatttggcgcccacgacttccacagaatctatatatcttag

SEQ ID NO: 45687 - DNA, 2706 bp, Artificial Sequence
  Description of Artificial Sequence: Synthetic coding sequence
atgagcggccccggcaacaagcgggccgccggcgacggcggcagcggccccccagagaaaaagttgtcacgtgaagagaaaacaacaactaccctgattgagcccatcaggctgggtggaatcagcagtacagaggaaatggaccttaaggttctgcagttcaagaacaagaagttggcagagagacttgagcaaaggcaagcatgcgaggatgaactaagggagcggattgagaagttagaaaaacgacaggcaacagacgatgccaccctcctgatcgtgaaccggtattgggctcagctggacgaaacagtggaagcactgctgagatgtcacgagagtcagggagagttaagttccgccccagaggcaccaggaacacaggaggggcccacttgcgatggtaccccccttcccgagccaggcacgagcgaactgcgggaccccctcctgatgcagctgcggccacctctctctgagcccgctctggccttcgtggtggccctgggggcttcctcgagcgaggaagtggaactggaactgcagggacgcatggaatttagtaaggccgcagttagcagagtggttgaagccagcgatcgactgcagaggcgggtagaggagctgtgccaacgcgtgtactcacggggcgacagcgaacctctgagcgaagcggcacaggcacacacacgggaactcggcagggagaataggcgactgcaggacctggccacccaactacaggagaaacaccacaggattagcctggagtattcagagcttcaggacaaagtcacctctgccgaaacgaaggtgctagagatggaaactactgtggaagatctacaatgggatatcgagaagctgcgaaagagggagcagaaactgaacaagcatctggcagaagccctggagcagctgaactcgggatactacgtctccggcagttcgtccggatttcaggggggacaaatcaccctgagcatgcagaaatctgacgagctgggcctgcaaaagaagctcaggactgaggtgatccaactggaggacaccctcgcccaggtccggaaagagtacgaaatgctgaggattgaattcgagcagaaccttgccgctaacgagcaggccgggccaattaatcgggaaatgcggcaccttattagctccctgcaaaatcataatcaccagcttaagggggatgctcagcgctacaaaagaaaactgagagaagttcaagctgagatcggaaaactgagggctcaggcttccggttccgcacactcaaccccaaatcttggccaccccgaagatagtggagtctctgcccctgcccctgggaaggaggaaggcggcccaggtcccgtaagtacgcctgataataggaaagagatggcccctgtccctggcaccaccactaccactaccagtgtcaagaaggaggagcttgtgccgtctgaagaggacttccagggcattactcccggggctcaaggcccgagttctaggggacgagaaccagaagctcggccaaagcgcgagttacaagagcgcgagggaccctctctaggacctcccccggttgctagtgctctgtctagagccgatcgggaaaaagccaaagttgaggagaccaagcggaaggaatctgagctgcttaagggactgagggctgaattgaaaaaggctcaagagtcccaaaaggaaatgaagctactcctggacatgtataaatctgctccaaaggagcagcgagataaagtacagctgatggcagcagaacgaaaagcaaaggccgaggtcgatgagctgagatcccggattagagagctcgaagagcgagatcgccgcgaatccaaaaagattgcggatgaggatgccctgcggagaatcagacaggctgaggaacaaatcgaacatctgcagaggaagcttggggccacaaagcaggaggaggaggctctgctctccgagatggatgtcacaggccaagcattcgaggatatgcaagaacagaatggtaggttgctgcagcaactgcgcgagaaagacgacgcaaatttcaaactgatgtccgagcgtattaaggcgaaccagatccacaagttactgcgtgaggagaaggacgaactcggagaacaggttctggggctgaagtcccaggtggacgcccaattactcactgttcagaaactcgaggaaaaagagcgtgcccttcaaggcagccttggcggcgttgagaaagagctcacccttaggagtcaggctcttgaactgaataaacgaaaggccgttgaggccgcccaattagcagaagatctgaaggtacagctcgagcacgtgcagacccggctgcgcgagatccagccttgcttggctgagagtagggccgcgagggagaaggagtccttcaacttgaaaagagctcaggaagacatttctcgcctgaggcgaaagttggagaaacagcgaaaggtggaggtttacgccgatgccgacgaaatcctccaggaagaaattaaggagtacaaggcaagattaacttgcccttgttgcaacaccagaaagaaagacgctgtgctcactaagtgcttccacgtcttttgttttgagtgtgttaggggccgctatgaggctagacagaggaagtgccccaagtgcaatgctgcctttggcgcccacgacttccacagaatctacattagctag

SEQ ID NO: 45688 - DNA, 2082 bp, Artificial Sequence
  Description of Artificial Sequence: Synthetic coding sequence
atgagcggccccggcaacaagcgggccgccggcgacggcggcagcggtccccctgagaagaagttgtcccgggaagaaaaaaccacaaccacactgatcgagccaatccggctcggggggatatcgagtaccgaggaaatggatctcaaggtcctgcagttcaagaacaagaaactagccgagagactcgaacagagacaagcctgcgaagatgaactgcgggagcggattgagaagctggaaaagcggcaagcacagttcagcctcctgtataacgaaagcttacaggtgaaaacccaactggatgaagcccgaggccttctccttgccacgaagaacagtcacctacggcacatcgaacacatggagagcgacgaactcgggctccaaaagaagctccgcacggaggtcattcaattggaagacactctggcccaggtaaggaaagaatatgagatgctcagaattgaattcgaacaaaacctcgctgctaacgagcaagcaggacccatcaatcgcgagatgcgacatctgattagcagtctgcagaaccataatcatcagctgaaaggggatgctcagcgctacaagagaaaactccgggaagtgcaggcagagatcggcaaactaagggcacaagcgtcagggtcagctcattccacacctaacctcggtcaccccgaagatagtggcgtctcagctcctgcacctgggaaggaagaaggcggccccgggcctgtatcaacccccgataacagaaaagaaatggcccctgtacccggcacaaccaccacgaccaccagcgtgaagaaagaagagctggttccgtctgaagaggactttcagggtattacgccgggggcacagggcccatcatcgagaggtcgtgagccggaggccagacctaagagggagctccaagaaagggaggggccctccctgggcccaccacccgtggcttccgccctgagcagggccgatagagaaaaggcgaaggtggaagagactaaaaggaaagagtcagaattgctcaagggactgcgagcagagcttaagaaggcgcaggaatcccagaaggagatgaagttgttattggatatgtataagagtgcacccaaggaacagcgggacaaggtgcagttgatggctgccgagagaaaggctaaagccgaggtggatgagctgagatctagaatcagggagctagaagaaagagaccgccgagagtccaaaaagatcgccgacgaggatgctctcaggagaatccggcaggccgaggaacagattgaacatctgcagcgcaaactaggagcaaccaaacaggaagaagaagctttactatccgaaatggacgtgactggtcaggcattcgaggatatgcaggagcagaatggtagactgctgcagcaactccgcgagaaagacgacgctaattttaagcttatgagcgagcggatcaaagctaatcagatccataaactgttacgtgaggagaaggacgaactcggtgaacaggtcctgggcctgaaatcccaggtagacgcacagttgctgactgtccaaaaactagaggagaaggagagagcactccaggggagcctggggggggtagaaaaagaactaactttgagaagccaggctctcgagctcaacaaacggaaagcagtagaggcagcccagttggccgaagatctcaaagtgcagctggagcacgtgcagaccagattaagggagattcagccatgtcttgctgagtctagagccgcacgcgagaaagagagcttcaaccttaaacgagcccaggaggatatttctagactacgcagaaagcttgagaaacagaggaaagtagaggtatatgctgacgcggacgaaatcttgcaagaggaaatcaaagaatataaggcacgtctcacatgcccatgctgcaacacccggaagaaggatgccgtactgactaagtgttttcacgtgttttgttttgagtgtgttcgtggacgctatgaggccaggcagagaaaatgccccaagtgtaatgctgctttcggcgcccacgattttcatcggatctacatcagctag

SEQ ID NO: 45689 - DNA, 693 bp, Artificial Sequence
  Description of Artificial Sequence: Synthetic coding sequence
atgcagctgcggccccccctgagcgagcccgccctggccttcgtggtcgccctaggggcgagttcaagcgaagaggtggaattagaactgcagggccgaatggagtttagcaaggctgctgtgtcccgtgtggtggaagcgtctgataggctccagcgccgggtggaggaactgtgtcaacgagtctattcgcggggagattctgaaccgctctcagaagccgctcaggcacacactcgggaactggggagagagaaccgaagactccaagatctcgccactcaattacaggaaaagcatcataggatcagtctggagtacagcgagctgcaggacaaagtcacatcagctgaaaccaaggtcttagaaatggaaacaacagtggaggacctgcaatgggatatagaaaagctgcggaaacgggagcaaaagctgaataaacatcttgctgaagcgttggagcagctgaatagcggatattatgtgtctgggtcttcaagcggctttcagggtggacagatcactctcagtatgcagaaattcgagatgttgaacgcggagctggaggagaaccaggaactggccaactccagaatggctgagttagagaaactgcaggcggaactccaaggggccgttaggaccaacttccaaagtttccaactagaggaactccccccggatactttgtag

SEQ ID NO: 45690 - DNA, 924 bp, Artificial Sequence
  Description of Artificial Sequence: Synthetic coding sequence
atgaagctgctgctggacatgtacaagagcgcccccaaggagcagcgcgacaaagtgcagcttatggctgcagagcggaaggcgaaagccgaagtcgacgaattgcgttcacgtataagagaactggaagaacgagacagaagagagagtaagaaaattgcagacgaagatgcactgcgaaggatccgccaggctgaggagcagattgagcacctgcagcgcaagttaggggctacgaagcaggaggaggaggccctgctgtctgaaatggatgtaactggccaggccttcgaggatatgcaggaacagaatgggagactactccagcaactgcgggagaaggatgatgccaactttaagctcatgtcagaacggattaaggccaaccaaatccataagctactgcgcgaagaaaaagatgaactaggagaacaggtcctgggcctgaagtcacaagtcgacgcacagcttttgacagttcaaaagctcgaggaaaaagagcgggccctgcaagggagcctcggcggcgttgagaaggagctgacactcagaagccaggcgctagaattaaataagcgcaaggctgtggaggccgcccagttagctgaagacctcaaggtgcagttagagcacgtgcagacaaggctgcgggagattcagccctgcctggcagagtcacgggcagcaagggagaaagaatcttttaatctcaagcgagcccaggaggatatctctcgactccgtaggaaacttgaaaaacaaaggaaggttgaggtctatgccgacgccgacgagatcctgcaggaggagataaaggagtataaggtgggcttgtgggcaaagctgtgtcccattcatctccggatcgtcgatgccggccttctgcgcttggtcgaatccctgggtacactggaagtcatgtag

SEQ ID NO: 45691 - DNA, 1308 bp, Artificial Sequence
  Description of Artificial Sequence: Synthetic coding sequence
atgcccctgttcctgctgagcctgcccaccccccccagcgccagcggccatgaacggagacaaaggccggaggccaaaacatcaggatctgaaaagaagtatctgagagctatgcaggctaataggagccagctgcatagccctcctggcacagggtcttctgaagacgctagtaccccacaatgcgttcacaccaggctgacaggcgaaggaagctgccctcatagcggtgatgtgcatattcaaatcaactcaattcctaaggaatgcgcggagaacgcgtcctctcgcaacatccgaagtggtgtccactcatgtgctcacgggtgcgtacactcccgccttcgggggcatagccacagcgaggctaggctgacagacgacacggccgctgagagcggcgaccacgggtcttcttcttttagtgaattcaggtacctgttcaaatggctgcagaaatcactcccatacatattaatcctgagcgtcaaacttgtcatgcaacacataaccggcatcagtctggggatcggactgctcacaacttttatgtacgctaacaaaagcatagtcaatcaggtgtttttgcgagaacgtagcagtaaaatacagtgtgcttggctgcttgtgttccttgcggggtcctcagtattgttgtactacactttccattcccagtccctgtattactcattgatattcctcaatcctacactcgaccatctaagcttttgggaagtcttctggattgtcggcataactgacttcattctaaagtttttcttcatgggcctgaagtgcttgatcttattggtcccaagtttcataatgccatttaaaagcaaaggctattggtatatgttattggaagaactttgccagtattatagaaccttcgtgcccatcccggtttggtttcggtatcttatttcatatggagaattcggtaatgttacacgttggtcattggggattctgcttgccctcctttacctaatactgaaactgctggaatttttcgggcatcttcgcacttttagacaggtcctgcggatctttttcacccaaccatcttacggcgtggccgcctcaaagcgtcagtgtagcgatgtggatgatatctgctctatctgtcaagccgaatttcagaagcccatactgttgatttgtcagcatattttctgtgaggagtgtatgacgctttggtttaacagggagaaaacttgtcctctgtgtagaactgtgatttccgaccacatcaacaagtggaaggacggtgcgaccagtagccacctccagatctactag

SEQ ID NO: 45692 - DNA, 408 bp, Artificial Sequence
  Description of Artificial Sequence: Synthetic coding sequence
atgcaggccaaccggagccagctgcacagcccccccggcaccggcagcagtgaagatgcctccacaccccagtgcgtgcatacacgattaaccggggagggcagctgcccccactcaggcgatgtacatatccagatcaactccatccctaaagagtgtgcagaaaacgcctcttcaaggaacatcagaagtggggttcatagttgtgcccatggttgcgtgcacagtaggctgcgcggacacagccactctgaagcccgtcttacggatgacaccgcagccgagtcaggagatcacggctccagttctttcagtgagtttcgttatctgttcaaatggctccagaagagcttgccctatatcctgattttgtctgtcaagcttgtcatgcagcacatcacggcttag

SEQ ID NO: 45693 - DNA, 1335 bp, Artificial Sequence
  Description of Artificial Sequence: Synthetic coding sequence
atgtggctgttcaccgtgaaccaggtgctgcggaagatgcagcggcgccatagctccaacaccgacaacatcccgcctgaacggaaccgctcccaggccctgagctccgaggcatctgttgatgaggggggcgtcttcgaatcactcaaagcagaggccgccagcccacctgccctgttctctggcctgagtggctctcttcccacctcttcgtttccgagcagccttgtgctgggatcaagcgccggagggggcgatgtctttatccagatgcccgctagtcgcgaagagggcggtgggcgaggggaaggaggagcgtatcaccacagacagccccaccaccatttccaccatggagggcaccgtgggggcagcttactgcagcacgtgggaggagatcaccgaggtcactccgaggagggcggtgatgagcagcctgggacccccgcgcctgcactctccgagcttaaagctgtgatctgttggctccagaagggcctccctttcattctaatcctgctggcgaaactgtgctttcagcataaattgggaatcgcagtttgcattggcatggctagcacttttgcctatgccaactccactttgagggaacaagtctcattaaaggaaaagagaagcgtcctggtcattctatggatacttgcttttctggcaggcaataccttgtacgtcctttacacattttcctcacaacagttgtataactctctgatctttttgaaacccaatctcgagatgctggatttctttgatctgctgtggatagtgggaatagccgactttgttttaaaatacatcactattgctctgaagtgccttatcgtagctctcccgaagattatattagcagtaaaatcaaaagggaagttctatcttgtaatcgaggaactgtcccagctgtttcgaagtctggtgccaattcagctgtggtataagtacataatgggcgatgactccagcaacagctattttctcggaggagtgctgattgttctgtacagcttgtgcaagtctttcgacatctgtggtagagtgggcggtgtgagaaaagcactcaagctcctgtgcacatcgcagaattatggtgtgcgggccacaggacaacaatgtaccgaagcgggagacatctgcgccatctgtcaggctgagtttagggaacccctgatactgttatgtcagcatgtgttttgtgaggagtgcctctgcctgtggctggatcgagaacggacttgtcccctgtgcaggtccgtggcagtcgacactctgcggtgttggaaagacggcgcgacttcggcccatttccaggtatactag

SEQ ID NO: 45694 - DNA, 1335 bp, Artificial Sequence
  Description of Artificial Sequence: Synthetic coding sequence
atgtggctgttcaccgtgaaccaggtgctgcggaagatgcagcggcggcactcctcaaacactgataatattcccccagaacgtaatagatcgcaggctctgtcctccgaggcctcagttgacgagggaggcgtattcgaatctctgaaggccgaagccgcctcacctcccgccctgttttctggtctaagtggcagtctgcctacgagttcatttccgagctcactagtgctcgggtcttccgcaggtggaggcgacgtgttcattcagatgcccgcttctcgcgaagaagggggcggtcgcggcgagggcggagcttatcaccaccgtcagccccaccaccacttccatcatggtggtcatagaggtggctccctcttacagcatgttgggggtgatcacaggggacattcggaagagggaggagatgagcagcctggtacacccgccccagctctttcagagttaaaggctgtgatctgctggttacagaaaggattgccattcattcttattctcctggccaagttgtgttttcaacacaagcttgggattgcggtgtgcattggtatggcctcaaccttcgcgtacgccaactctacacttagggagcaggtttcactcaaagaaaaaagatctgtcctagtgatcttatggatactggccttcctggcaggcaataccctgtatgttctctacacatttagtagccaacagctctataactccctgatctttctcaaacctaatcttgagatgctggacttctttgacctgctctggattgtcggaatcgcggatttcgttctgaagtatatcaccatagcactaaagtgcctgatcgtcgcgctgcccaagatcattttggccgtcaaatctaagggcaagttctacctggtcattgaagaactgagccagctgttcagatctctggttccaattcagttatggtacaagtatatcatgggggatgacagttcgaactcctatttcttgggtggggttctcatcgtgctctattcactctgtaaatcattcgatatttgtggacgagtgggtggcgtacgaaaggctctgaaactgctctgcacttcccagaattacggcgtacgtgctaccggacagcagtgtacagaggccggcgatatatgtgcgatatgccaggccgagttccgggagccccttatcctcctgtgtcagcacgtgttctgtgaagaatgtctctgtctgtggttggacagagagcgcacctgccctctgtgccgcagtgtggcagtggatacgctgagatgttggaaggatggggctacatccgcgcattttcaggtgtattag

SEQ ID NO: 45695 - DNA, 1263 bp, Artificial Sequence
  Description of Artificial Sequence: Synthetic coding sequence
atgtggctgttcaccgtgaaccaggtgctgcggaagatgcagcggcggcactcatctaacacagacaatatccccccagagaggaatagaagtcaggcattgtcttctgaggcctcggtcgacgaaggcggtgtgttcgaaagcctgaaagccgaagccgcctctcccccagctctcttcagcgggctgtccggcagtctacccacctcttcttttcctagctccttggtgctgggctcctcggccggcgggggcgacgtctttatacagatgcctgcaagtcgcgaggagggcggcggaagaggcgagggaggcgcttatcaccaccgccagccccaccaccactttcaccacggtgggcatcgcgggggaagtctgcttcagcacgttggcggcgatcatcgaggccattccgaggaagggggagacgagcagccgggtactccagctcctgctctcagtgaactgaaggcggttatttgttggctgcaaaagggtctcccttttatactgattctattggcaaagctgtgcttccaacataaacttggaatcgccgtgtgcattggaatggccagcacatttgcctacgccaactcgactctccgcgagcaggtgagcctaaaagaaaagcgtagcgttttagtgatcttatggattttagcatttctcgccgggaacacattgtacgtcctgtatactttttccagtcagcaactctacaacagtctgatctttctgaaacctaatctggagatgctggacttctttgatctgctctggatcgtagggatcgctgatttcgtgttaaaatatattacaatcgcgctcaaatgccttattgtggccctgcctaagattattcttgccgtgaaaagcaaggggaaattttacctggttattgaggagctttcacagctttttcgaagcctggtgccaattcagctgtggtacaaatacatcatgggtgacgatagcagtaacagctacttcctcggcggtgtccttatcgtgttatactccttatgcaaaagttttgacatatgcggccgcgtaggcggagtgcgcaaagcacttaaattgctgtgcacttctcagaattacggcgttagggctaccggccagcagtgcaccgaggccggagacatttgcgctatttgccaggccgagttccgagagcctttgatcctcctgtgccagatgctgctgaaaggacacaaaaaactggagcttgagaaaatagatgagagcgctggcgtgtag

SEQ ID NO: 45696 - DNA, 1212 bp, Artificial Sequence
  Description of Artificial Sequence: Synthetic coding sequence
atggccgccttcctgaagatgagcgtgagcgtgaacttcttccggccttttacgcgattcctagtccctttcactctccacagaaagcgcaataatttgacaatcttgcagcggtacatgtcttctaaaattcccgccgtcacgtacccgaagaacgaatctaccccgccctccgaggagttggagctggacaagtggaagaccaccatgaaatcatctgtgcaggaagaatgcgttagcaccatcagctcctctaaagatgaggaccctctggctgcaacacgcgagtttatagagatgtggagattgctcggtagagaggtgcctgagcatattacggaggaggaacttaaaactctgatggagtgtgtcagcaatactgccaaaaagaaataccttaaatacctgtacacaaaagaaaaagtgaaaaaggctcgtcagattaaaaaggagatgaaagctgcagccagggaagaggccaagaacatcaagctcttagagaccaccgaagaggataagcaaaagaactttttattcctgagactgtgggacagaaatatggacattgctatgggatggaagggcgcacaggccatgcagttcgggcaacccctcgtcttcgacatggcatacgaaaactatatgaaaagaaaagaactccaaaatacggtcagtcagctattggagtctgagggctggaaccgcagaaatgtcgatcccttccatatctatttctgcaatctcaagatcgatggcgcgctgcacagagagctggtcaagaggtatcaagagaaatgggacaaactgctgctgacatcaacagagaagtcccacgtagacttgttcccgaaggactctatcatctatctgacagccgacagccctaatgtcatgacaacttttaggcacgataaggtttacgtgatcgggagctttgtcgacaaatccatgcaacccggaaccagccttgcaaaagctaagaggctgaatctggccaccgagtgtctccctctggacaagtacctgcagtgggaaatcgggaacaaaaacctgacattggatcagatgataaggatcctgctgtgcctgaagaataacgggaactggcaagaggcgctgcaatttgtgcccaaaagaaagcacacagggttcctagaaatctcacagcatagtcaggagtttatcaacaggttaaaaaaggcaaaaacttag

SEQ ID NO: 45697 - DNA, 939 bp, Artificial Sequence
  Description of Artificial Sequence: Synthetic coding sequence
atggccgccttcctgaagatgagcgtgagcgtgaacttcttccggccctttacacggttcctggtccctttcacgctccacagaaaaagaaataaccttactatccttcagcgctatatgtctagcaaaattcccgccgtcacatatcctaagaacgagtctacgcctccctcagaggagttggagctcgataagtggaagacgacaatgaagagttcagtgcaggaagagtgtgtgagcacaatctcctctagtaaagatgaggacccgttggctgcaacccgcgagtttatcgagatgtggaggctgctgggcagggaagtgcccgagcacatcactgaggaggaattgaaaactctgatggaatgcgtgagtaacaccgccaagaagaagtatctcaaatacttatacaccaaagaaaaggtaaaaaaggcccggcagatcaagaaggagatgaaagcagcagcccgtgaggaggcaaagaatattaagctgctcgagaccacagaagaagataagcagaagaatttcctttttctgcggctgtgggatcgcaatatggatatagccatgggctggaagggagcccaggcgatgcagttcggacaaccactagttttcgacatggcctatgagaattatatgaagcggaaggaactccagaacacggtgtctcagctcctcgagagtgagggctggaatcgcagaaacgtggacccctttcacatatacttctgcaacttgaaaatcgacggtgctcttcaccgggaactcgtgaaaaggtaccaggaaaaatgggataagctcctgcttaccagcacagagaagtctcacgtcgatctgttccctaaagacagcatcatctatcttactgccgatagcccaaatgtgatgaccacatttaggcacgacaaagtttatgtaataggcagtttctag

SEQ ID NO: 45698 - DNA, 1134 bp, Artificial Sequence
  Description of Artificial Sequence: Synthetic coding sequence
atggccgccccccggtggagcgccagcggcccctggatccggggcaacggtcagggatgcggtagtctctttactctggtttcgaagccgttttgtgcagctgccgccgctagcacagcgatcaacgcgcagcgtcttgcagagaaactgagggctcagaaacgtgagcaggacaccaaaaaggaacccgtaagcacaaatgctgttcaaaggcgcgtgcaggagattgtgaggtttactcgtcaacttcagagagtccaccccaatgtgctggctaaagccttgactaggggaattctccatcaggacaagaacctcgtagtgattaataaaccctacggtctcccagtgcatggcggacccggcgtgcagctgtgtatcaccgacgtactgcccatcctggcaaaaatgctccatgggcataaagcagagccgctccacctgtgccacaggctcgacaaggagactacaggggtcatggtactcgcttgggataaggatatggcgcaccaagtacaagaactatttcgcacccgtcaggtagtgaagaagtactgggccataaccgtgcacgtgccaatgcccagcgctggtgtggtcgacatccccatcgtagaaaaagaagctcagggccagcaacagcaccacaaaatgacactctcacctagctataggatggatgatggcaagatggtcaaagtacggagatcacggaacgcacaggtcgctgtgactcaataccaggtattgtcatctactttgagctctgccctagtggagttacagcccattactggcatcaagcaccagctccgagtacacttgtccttcggactggattgtccgattctgggggaccacaagtactccgattggaacaggttggccccccagaaattatcagtgggaactcttaaaaagctggggttggaacagtcaaaggcaagatacatccccttgcatctacacgcgcgtcagttgattctgcctgcgcttgggtctggcaaggaggaactgaatttggtctgtaaacttccccggtttttcgtccactcactgcatagactgcgtcttgagatgcctaacgaggaccagaacgaaaataatgaagccaaatgtcttggcgcccagtag

SEQ ID NO: 45699 - DNA, 1041 bp, Artificial Sequence
  Description of Artificial Sequence: Synthetic coding sequence
atggccgccccccggtggagcgccagcggcccctggatccggggcaacggacagggctgtggatctcttttcactctcgtaagtaagcccttttgtgccgccgctgcggcttctacagccattaatgcacagaggctggctgaaaaactgagagcacagaaacgtgagcaggacaccaagaaagagccagtctcaacaaatgctgtgcagagaagggtgcaggagattgtcagatttacacgccaacttcagagggtgcaccctaatgtgctggcgaaagccctgacccggggaatcctgcatcaagataaaaatctggtggtgataaacaaaccgtatggcttgcccgtccacggaggccccggggtgcagctttgtattacagacgtgctgcctatcctggccaaaatgctgcatgggcacaaagcggaacccctccatctgtgccacaggttggataaggagacaaccggggtaatggtgctagcttgggacaaggatatggcacaccaggttcaggagttgttcaggacaagacaggtcgttaagaagtactgggccatcactgtccatgtgccgatgccatccgcaggcgtcgtcgatattcctatagtagaaaaagaagcacaggtggctgttacacaataccaggtgctgagcagcactttgtcgagcgctctggttgaactccaacctatcactggtattaagcatcagctccgggtgcatctcagttttggactcgactgccctattttaggggatcataaatactccgattggaacagactggcacctcagaaactgtcagtgggcacgctgaagaaactgggccttgagcagtccaaggctcggtacatccccctgcatctgcacgcacgacagctgattcttcctgcccttggttctggcaaagaggaactgaacctagtgtgtaagctgcctaggttctttgtccacagcttacaccgactaaggctggagatgccaaatgaggatcagaacgagaacaacgaagctaaatgtctgggggcgcaatag

SEQ ID NO: 45700 - DNA, 1098 bp, Artificial Sequence
  Description of Artificial Sequence: Synthetic coding sequence
atggagggccagagcgtggaggagctgctggccaaggccgagcaggacgaggcagaaaagctgcagcgtataacagtccataaggaactggagctgcagtttgacctcgggaacctgctggcatcagaccgtaaccctccgaccggactgcggtgcgctggtccgaccccagaggcggaacttcaggcgctcgctcgggacaatacccaactcctaattaatcagctttggcagttgcccaccgaacgagtcgaggaagccatcgtggcacgcctgccagagcctacgacgagactgcccagggagaaaccgttgcccagacctcggcctctcactaggtggcagcagttcgcgcgcttaaaagggattagaccaaagaaaaaaacaaacttagtttgggacgaggtctcaggccaatggcggagacgttggggctaccagcgggcccgagacgacactaaggagtggctgatagaggtcccaggcaacgccgatcccttagaagatcagttcgccaagagaattcaggccaaaaaggaaagggtagccaagaatgaattgaacaggctgcgcaatctagcccgggctcacaaaatgcagttaccatctgcggctggcctgcatccaaccggccatcagagcaaggaggagctaggtagggccatgcaagtggcaaaggttagcacggcatctgttgggaggttccaggaaaggctaccaaaagaaaaagtgcctagaggttccggtaaaaagaggaagtttcagccactctttggagatttcgcggctgagaaaaagaaccagctggagctgctgcgagtgatgaactctaagaagccccaattggacgtgactcgcgctacaaataaacaaatgagggaggaagaccaggaagaagccgcgaagcgtcgcaaaatgtcccagaaaggcaagagaaaggggggcaggcaggggcccggtggaaaacggaaggggggacccccctcacagggcggcaagcgcaaaggcggcttaggggggaagatgaattcaggccccccgggtttgggcgggaagcgtaagggcggtcaacggccagggggaaagcggagaaaatag

SEQ ID NO: 45701 - DNA, 2127 bp, Artificial Sequence
  Description of Artificial Sequence: Synthetic coding sequence
atggccgaccgggagggcggctgcgccgccggccggggccgggagctggagcccgagctcgagccaggtccaggccctgggtctgccttggaacctggcgaggaattcgagatcgtggaccgcagccagttacccgggcccggtgatctcagaagcgcaacgcgacctcgcgcagccgagggctggtctgcacctatcttgaccctggcaagaagagccaccggcaacttgtccgccagctgtggatccgcattacgggcggctgctgggctcggtggtggcgactcaggggatggtaccgctcgcgcagcctctaaatgtcagatgatggaggaacgcgctaacctcatgcacatgatgaagctgtccatcaaagtgctgctgcagagcgccctcagtttaggacggagtttggatgccgatcacgctccgcttcagcaatttttcgtggtcatggaacactgtctgaaacatggccttaaggtgaagaaatccttcattggccaaaataagagcttctttggccctctggagctggtggagaagctgtgccctgaggccagcgatatagccacttcagtgagaaacctgccagagttgaagaccgccgtgggccggggacgagcttggctgtaccttgccctgatgcagaagaaactagccgactatctaaaagtgttgattgataataagcatctcctctcagagttctatgagccggaggccttaatgatggaggaggaaggaatggtcatcgttggcctcctcgtgggacttaatgtattggatgctaatctgtgtttgaagggggaggaccttgactcacaggtgggcgttatcgacttcagcctttatctgaaggatgtccaggacttggacgggggaaaagagcacgagcgaattacagacgtgcttgatcagaagaattacgtggaggaactcaaccggcacctgtcttgtaccgtgggtgacctccagactaagatcgatgggctcgaaaagactaactccaagttgcaagaggagctttcagctgctaccgataggatctgttcactccaagaggaacagcaacaactgcgagaacaaaatgaattaatccgtgaaaggagtgagaagagcgtcgaaatcaccaaacaagacacaaaagtcgaactagagacatacaagcagacgcgtcagggccttgacgagatgtactctgacgtatggaagcagctcaaggaggaaaaaaaggtcagattggaactggaaaaggagctggaacttcagatcggtatgaagactgaaatggagatcgctatgaaactgctggaaaaggatacacacgaaaagcaagacactttggtggcactccgccaacaactggaagaggtgaaggcaatcaatctgcagatgttccataaggcacagaacgctgaatcctctctgcagcagaagaacgaagccatcacgagcttcgaagggaaaacgaatcaggtgatgtcgtctatgaaacagatggaggagcggttgcagcactccgaaagggcaaggcagggggccgaagagaggtctcataagcttcaacaggagctgggaggacgcattggcgcactgcagttacaactctctcagctgcacgaacagtgctcgtctttagaaaaggagctgaagtctgaaaaagaacagaggcaagctttgcagagagaattgcagcacgagaaggacaccagctctttactgaggatggaactgcagcaagtagaaggactcaagaaggagctcagggagctccaggatgagaaggccgagcttcagaagatttgtgaagaacaagaacaagccctccaggagatgggtttgcacctcagccagagcaaacttaagatggaagacattaaagaggtcaatcaggcccttaaggggcatgcttggctaaaggatgatgaggccactcactgtaggcagtgtgagaaggaattctcaatatcacggcgcaaacatcattgcaggaactgtgggcacatattctgcaacacctgtagcagtaacgagcttgcccttcctagctaccctaaacccgtgagggtgtgcgatagttgccacactctgctgctccaaagatgctcatctacagcttcatag

SEQ ID NO: 45702 - DNA, 933 bp, Artificial Sequence
  Description of Artificial Sequence: Synthetic coding sequence
atgtacagcgacgtgtggaagcagctgaaggaggagaagaaggtgagactggagctggagaaggagctcgaactgcaaattgggatgaagacagagatggaaatcgctatgaagctgctcgaaaaggatacacacgaaaaacaggatacattagtggcgctgcggcagcagcttgaggaagtgaaggccattaacctccaaatgttccataaagcccagaatgccgagtcaagtcttcagcagaagaatgaagctatcacaagctttgaaggcaaaaccaatcaggtgatgtcgtcgatgaaacagatggaggagcgtttgcagcactcggaaagagcgaggcagggtgccgaggagcggagccataaactgcagcaggagctgggaggccgcataggagcactccaactccaattgtcgcagctgcacgaacagtgcagctcgctcgagaaagagctaaagagcgagaaggagcagcgccaggccctgcagcgagaactccagcatgagaaagatacgagttctctgttgcgaatggagttgcagcaggtggagggattaaagaaggaacttagggagttgcaggatgagaaggcggaattgcagaaaatatgtgaggagcaggaacaggcgctgcaggaaatgggactacatctgagtcagtctaagctgaaaatggaggatatcaaggaggtaaaccaagctctgaaaggtcatgcatggctaaaggacgatgaagccactcattgccggcagtgtgaaaaggagtttagtatatctaggcgtaaacatcactgccgtaactgtgggcacatcttctgcaatacctgtagcagcaacgagttagccctgccaagctatccgaaaccagttagagtctgtgatagctgccacacgctgctgctacaaaggtgctcctcaacagccagctag

SEQ ID NO: 45703 - DNA, 1239 bp, Artificial Sequence
  Description of Artificial Sequence: Synthetic coding sequence
atggccgaccgggagggcggctgcgccgccggccggggccgggagctagaacccgaactcgagcctggacctggcccaggatctgccctggaaccaggggaagagtttgagatagtggatcggtcccagctccctgggcctggcgacctacggtcagctacgcgccccagagctgcggaaggctggagtgcccccatcctgacccttgctagacgggccaccgggaatttatcagcctcatgcggatccgctctcagagccgccgcggggctaggcggcggcgactctggggacgggacagccagagcggccagcaaatgtcagatgatggaagagagggcgaacctgatgcacatgatgaaactgagtattaaagtgttgttacagtcagctttgtcgttggggcgatcactagatgcggatcacgccccactccagcagttcttcgtcgttatggaacactgtctgaagcacggcttaaaggtcaagaagagttttataggtcagaacaaaagcttctttgggcccctggaactggtcgagaagctgtgcccagaggccagcgatattgccactagcgtgagaaacctccctgaactcaagacggcagtcggtcgggggcgcgcctggctgtatctggcactcatgcagaagaagctcgccgactatctgaaggtccttatcgacaataagcatctgttatccgagttctacgagcccgaggcactgatgatggaggaggagggcatggtgatcgttggcctgttagtcggtttgaacgtgttggatgcgaatctctgtctgaagggcgaggacttggattcccaggtgggcgtgatcgactttagcttgtacctaaaagacgtgcaagatctagacgggggcaaagagcacgagaggatcaccgacgtgcttgaccagaaaaactacgtggaagagctaaaccgacacctcagctgtacagtaggagatctccaaaccaagatagatgggttggaaaagaccaacagcaagttgcaggaagaggaggagcgaatgaaaggccaggataaggggggactttctcggggccgcgaactagcggcatcttgtccagccgtaagtctgctcgatactagctgtctcctgcttgccggcggcggatgcagcgcattgctgagattatccacagcattttcatgcaataggcccaatctcctcacttcccgacgcacagctgccgtaaaaaggaccaagtag

SEQ ID NO: 45704 - DNA, 1803 bp, Artificial Sequence
  Description of Artificial Sequence: Synthetic coding sequence
atgatggaggagcgggccaacctgatgcacatgatgaagctgagcatcaaggttctgctgcaatccgctcttagcttgggaaggagcctggacgccgatcacgccccactccagcagttctttgttgtcatggaacattgtctgaaacacggactgaaggtgaaaaagtcttttattggacagaacaaaagcttcttcggcccgctggagctggtcgaaaaactgtgccccgaggcttcagatatcgctacctcagtcaggaatctccccgaactcaagacagccgtcggaagaggaagagcctggctgtacttggctctaatgcaaaaaaagttagctgactacttaaaagttctaatcgacaataaacacctcttgtctgagttctatgagcctgaagctctcatgatggaagaggaagggatggtgatcgtgggcctacttgtgggactgaacgtcctggacgcaaacctgtgtttaaaaggagaggacctagattctcaagtgggtgtgatcgatttttcgctctaccttaaggacgtacaagacctggacggtggtaaggagcatgagaggattactgatgtgctggaccagaagaactacgtggaggagcttaacagacatctgagctgtactgtcggggatctgcagactaaaatagatggattggagaaaaccaacagtaagctgcaagaagaactctcagctgccaccgataggatctgcagtctgcaggaagagcaacaacagctccgggagcagaatgagctaatcagagaaaggtctgagaagagcgtcgagatcacaaagcaggacactaaggtcgaattggaaacttacaaacaaacgcggcaaggactcgacgaaatgtactctgacgtgtggaaacagctgaaagaggagaaaaaagtacgcctggagctggaaaaggagctcgagcttcagatcgggatgaagaccgaaatggagattgccatgaagttactggagaaagatacccatgaaaaacaggataccctggtggcgctgaggcagcaacttgaggaagtaaaggctatcaatctgcagatgtttcataaggcgcagaacgctgaaagttcactgcagcagaaaaacgaggccattacatcgttcgagggcaagaccaatcaagtgatgtcatcaatgaagcaaatggaagaacgtctgcagcactctgagcgtgctcgtcaaggcgcagaggagaggagccacaagctgcagcaggagctaggaggacgaattggcgcgctgcaactacaactctctcagctgcacgagcagtgctcttccctggaaaaggaactgaagtccgagaaggagcagaggcaagcattacaaagagaactgcagcatgagaaagacacatcctctttgttgaggatggagcttcagcaggtcgaagggctgaagaaggagcttcgcgaattgcaggatgagaaggcagagctgcagaagatatgcgaagaacaggagcaggctctgcaagaaatgggactccacctgtcacagtccaagttgaagatggaggacattaaggaagttaaccaggccctgaagggccacgcgtggctaaaggacgacgaggccacccattgccgccagtgcgagaaagaattctccatttcccgccgaaagcaccattgccgaaactgtgggcatattttctgtaatacctgctcatccaacgaactggcattgccctcctaccccaaacctgtgcgggtttgtgacagctgtcataccctgttgctgcagagatgttcttcgacggcaagttag

SEQ ID NO: 45705 - DNA, 1803 bp, Artificial Sequence
  Description of Artificial Sequence: Synthetic coding sequence
atgatggaggagcgggccaacctgatgcacatgatgaagctgagcattaaagtgcttctccagtcagctttgagtcttggacgcagtctcgacgccgaccacgctcccctccagcaattcttcgtggtaatggagcactgcctcaaacatgggcttaaagttaagaaatcctttataggccagaataagtcattctttgggcccctggagctggtggaaaagttgtgtcccgaggctagcgatatcgctacctctgtaaggaatctgccggaactgaaaactgctgttggccgcgggagagcatggctgtatctggcccttatgcaaaagaagctcgctgactatctgaaagtactgatagataacaagcacctgttgagtgaattttacgagcctgaagctctgatgatggaggaggaagggatggtcatcgtggggctgttagttgggctcaacgtgctcgacgctaacttgtgtctcaagggagaggacctcgatagtcaggtgggtgtgatagacttttccctgtacctgaaggacgtccaggacctcgatggtgggaaggagcacgaacgtatcactgatgttctggatcaaaagaattacgtggaagagctgaacaggcacctctcctgtactgtaggagatctccagactaagattgacggtctcgagaagactaattcgaagcttcaggaagaattatccgcggcaaccgatcgcatctgttcactgcaggaggagcaacaacagttgcgcgaacaaaatgaactcattcgggagagatcagagaagagcgtggagatcaccaaacaggataccaaggtagagctcgagacctataaacagacgcgtcagggcctggacgagatgtacagcgacgtgtggaagcaacttaaggaggaaaagaaagttagactggagctggaaaaggagctcgaactgcagataggcatgaaaacagaaatggagatcgctatgaaactcctggaaaaggacacgcatgaaaaacaggatacactggtggctctccgtcaacagttggaggaggtgaaggcaattaaccttcaaatgtttcacaaggcgcagaatgccgaatcttctctgcagcaaaaaaacgaggccatcacctccttcgaggggaaaacaaaccaggtgatgtcttccatgaaacagatggaagagaggcttcaacatagcgagagagcccggcaaggcgcagaagagcggagccacaaattgcagcaggagttgggcgggcgcattggagccctgcagctccaactgtcccagctccatgagcagtgttcctcactggagaaggagctcaagagcgaaaaagagcagcgccaagcccttcagagggagctgcaacatgagaaggacacttcatcacttctaaggatggaactgcagcaggtagagggcttgaagaaagagcttagagagctgcaggacgagaaagccgaacttcaaaagatttgcgaagaacaggagcaggcgttacaggagatgggccttcatctgagccagtccaagctgaaaatggaggacatcaaggaagtcaatcaggcactgaaaggacacgcctggctgaaagacgacgaggctacccattgccggcaatgcgagaaggagttttctatctcacgccgtaagcatcattgccgtaactgtggccacattttttgcaatacttgttcatcaaatgagctggcattaccgagttatcctaaacccgtcagagtttgcgattcgtgtcacacactgctgctgcagaggtgctcgtccacagccagctag

SEQ ID NO: 45706 - DNA, 1827 bp, Artificial Sequence
  Description of Artificial Sequence: Synthetic coding sequence
gcctgggccgcccggctgggccggcccggccggagctgcctgcccggcgctagagggcgggctcctccaccaccacctctgttgctactcctggctcttctcccactcctgcccgctccgggggccgcagcagcccccgctcctcgtccccccgaactgcagtcagccagcgctggccccagcgtgtcactataccttagcgaggatgaggttcggcgtctgatcgggctcgatgcagagctttattacgtaagaaacgatctaatttctcactatgccttatctttttccctgttggttccctctgagaccaactttctacattttacatggcatgcgaaatcgaaggtggagtataagctgggcttccaggtggataatgtgttagcgatggacatgccacaggttaatatttccgtgcaaggggaagtgccccgcacactgagcgttttccgcgtagagctatcatgcacggggaaggtcgactcagaggttatgattctgatgcagttgaatctgactgtcaatagttctaaaaatttcacggtgctgaattttaagcgcaggaagatgtgttacaaaaaacttgaagaagtgaaaacatctgcccttgacaaaaacacttccagaacaatatatgatcccgttcacgctgctcccacgaccagtactcgcgttttctacattagcgttggcgtatgctgcgccgttatctttctggtagcgatcatccttgccgttctgcacctgcacagcatgaaaaggattgaactggatgacagtatatctgcgagttcatcttctcagggactgtcacagccttcaacacagaccacacagtacttgcgagccgatacccctaataatgcgactcccatcacatcaagccttggctaccctaccctccgcattgagaaaaacgacctccggagcgtgacgctgcttgaagcgaaggggaaggtcaaggacatcgccatttcccgtgagagaattacacttaaggacgtgctgcaggagggaaccttcggaagaatttttcatgggattttgatcgatgaaaaggaccctaacaaagagaagcaggccttcgttaagactgtgaaggatcaggcatccgaaattcaggtgaccatgatgctgaccgagtcgtgtaagctgcgagggctgcaccatagaaacctcctgccaatcacacatgtctgcatcgaagagggcgagaaacctatggtcatcttgccctatatgaattggggtaacctgaagttattccttagacaatgcaagcttgttgaagctaataacccgcaggcaattagccagcaggatctggtgcatatggccatccaaattgcgtgtggaatgagctacctagcccggagagaggtgattcataaagatctcgccgcgcgaaactgtgtaatagatgacacgctacaggtcaagattaccgataacgcgctgtcacgggacctctttcctatggactaccattgcttgggtgacaacgaaaatagaccagttcggtggatggctttggaaagtctggtgaataacgagttcagctctgcgagcgatgtctgggcattcggcgtgactctatgggaactgatgacactggggcaaaccccatacgtcgatattgacccattcgaaatggccgcctaccttaaagatggctaccgtattgcacaacctattaactgtccagacgaactttttgccgttatggcctgttgttgggcgctcgatcctgaagaaagacccaaatttcagcagctggttcagtgcctcactgaattccatgccgcactgggagcttacgtgtag

SEQ ID NO: 45707 - DNA, 1257 bp, Artificial Sequence
  Description of Artificial Sequence: Synthetic coding sequence
atgtgctacaagaagctggaggaggtgaagaccagcgccctggacaagaacacgtcccgaactatctacgaccctgtgcatgcagcacctactacttccacgagagtgttttacatatccgtaggcgtctgttgcgccgttatcttcttagtggccataatacttgcagtccttcacctgcactccatgaaacgaatcgaacttgacgattctatctctgcctccagctcctcgcaaggactatcccagccctcaactcaaaccacccaatacttgcgtgctgatactcctaataacgccactcctatcacaagcagcttaggctatccaacactgcgaatcgagaagaacgaccttcgtagcgtcacgctgctcgaagccaaagggaaagtgaaggacatcgctatttcccgtgagaggatcactctgaaagacgtcctccaggaaggaacatttggtaggatctttcacggtattctcatcgatgagaaagaccctaacaaggagaagcaggcattcgtgaaaacagtgaaggaccaggcctctgagatccaggtgaccatgatgctcactgagtcatgcaagctgaggggcttgcaccataggaatcttctcccgatcacacatgtgtgtatcgaggagggcgaaaaaccgatggtcatcttgccttacatgaattggggaaacctcaaattgttcctaagacagtgcaagcttgtcgaggccaataacccccaggctatcagccaacaggacctcgtgcatatggccatccaaattgcttgtggcatgtcctacctagcccgacgggaagtgatacacaaggatctggcagccagaaattgcgtgatagacgatactcttcaggtaaagatcacggataatgccctaagtcgggacctattccccatggattatcactgcctgggcgacaatgagaatcggcccgtccggtggatggctctcgagagcttggtgaataacgaattctcctctgcatcagatgtctgggctttcggtgtcactctgtgggagctgatgacattagggcagactccttatgtggacatcgacccatttgaaatggctgcctacctgaaagacggatatcgaattgcacagccaattaactgcccagatgaactgttcgcggtgatggcatgttgttgggcgctcgaccccgaggaaaggcccaagtttcagcagctggttcagtgtcttaccgaattccacgcagccctcggtgcctatgtatag

SEQ ID NO: 45708 - DNA, 1764 bp, Artificial Sequence
  Description of Artificial Sequence: Synthetic coding sequence
tgacgggcccccccccccccccccctgctgctgctgctggccctgttgcctctgctgcccgcccccggagccgcagctgcacctgctccacggcctcccgagctgcagtctgcttcggctggaccctcagtcagtctgtacctcagcgaagacgaagtacgccgcttgatcggactggacgctgaactgtactatgtgcgcaacgatctaatctcccactatgctctgagcttcagtctgttggtcccctcggagaccaatttcctacacttcacgtggcacgcgaaaagtaaggtcgaatataaactgggctttcaggttgataatgtgttggccatggatatgccacaggtcaatattagcgttcaaggggaagttccaaggaccctctccgtgttccgggtggaattgtcctgcactggcaaagttgattctgaggtcatgatcctgatgcaactcaatctgaccgtcaactcaagtaaaaattttacggtgctcaatttcaagaggaggaaaatgtgctataaaaagttagaagaggtgaaaacctcagcactcgacaagaatacttctagaacgatatatgaccctgtccatgctgctccaaccacctccaccagagttttctacatctccgttggtgtatgttgcgccgtgattttcctggtggctataatactggccgtcctacatctgcatagcatgaagcggatcgagctagatgatagcatcagtgccagttcctcctctcaggggttgtcacagccttcgacccagactacacagtacctaagggcggatacccccaataatgcgacaccaatcacgagctatcctacactgcgaatagaaaaaaacgatctgagaagcgtgacactgctagaggcaaaaggaaaggtgaaggatatcgccataagccgagaacggattacccttaaagacgttctgcaggaaggaacatttggcagaatcttccatgggatccttattgacgaaaaggaccctaataaggagaaacaggcttttgtgaagacggttaaggaccaggcttcagaaatccaggtcacaatgatgctcaccgagtcctgtaagctgcgcggactccaccaccgcaacctgcttcccattacacatgtttgcattgaagagggtgagaaaccgatggtcatcttgccatacatgaattggggcaatctgaaactcttcctcagacagtgcaaactcgtggaagccaataatccacaggctatatcacaacaagatctcgtacatatggctatccagattgcctgtggcatgagttatcttgcccggagagaggtgatccataaggacctggccgctcggaattgtgtgatcgacgacacactgcaggtgaaaattacagacaatgctttgtcccgcgacctgttccctatggactaccattgcctgggggataacgaaaacagacccgttcggtggatggccctagagtcactggtgaataatgaattctctagcgcaagtgacgtgtgggcgttcggtgtaacgctgtgggaacttatgacgctgggccagacgccgtatgtggacatcgacccctttgagatggcagcatacctgaaagacggctacagaattgctcagcctatcaactgtcccgacgagctctttgctgttatggcttgttgttgggccctggatccggaagagcgacccaagttccaacagttggtgcagtgcctgacagagtttcacgccgctctgggggcctacgtgtag

SEQ ID NO: 45709 - DNA, 240 bp, Artificial Sequence
  Description of Artificial Sequence: Synthetic coding sequence
atgagcaccaagaagagccccgaggagctgaagcggatcttcgagaaatacgccgcaaaggagggcgatcccgaccagctgtctaaggacgaattaaagttattgattcaagcggagtttccttccctactgaaaggccctaacaccctggacgacctgttccaggagttagataagaatggagacggcgaagtatctttcgaagagttccaagtccttgtgaagaaaatcagccagtag

SEQ ID NO: 45710 - DNA, 726 bp, Artificial Sequence
  Description of Artificial Sequence: Synthetic coding sequence
atgaacggcaccctgaccgccgtggagagcttcctgaccatccacagcggccctgaaggactttccatccacgatgggacttggaagtcagcaatatatgggtttggtgaccaaagcaaccttagaaaactcaggaatgtgagcaatctgaagcccgtcccgctcatcgggcctaaactcaaaaggcgctggcctatctcttactgcagggaactgaaaggctactcaattccattcatgggctccgatgtgagtgtggtgcggcgaacccaaagatatctctatgaaaacctagaggaatccccagttcaatatgccgcttatgtgacagtcggcggaatcactagcgtaattaagttgatgtttgcggggctattctttctcttctttgtgcgcttcggaattggacgtcagttgctgattaagatagatgcagctagcttcaccctaactttttttggccagggctattcacagggcaccggcacagataagaataaaccaaatattaaaatctgcacacaggtgaaaggacccgaggccggatatgtagccactcccattgctatggttcaggccgctatgacattgctttccgatgcctcgcatcttcctaaagctggaggcgtctttactccaggcgctgcattctctaaaaccaaattaatcgacaggctgaataagcatggaattgaatttagtgtgattagctcctctgaagtttag

SEQ ID NO: 45711 - DNA, 1290 bp, Artificial Sequence
  Description of Artificial Sequence: Synthetic coding sequence
atggccaccgagcagcggcccttccacctggtggtgttcggcgccagtggcttcaccggtcagtttgtcactgaggaagtggcacgggaacaggttgatcccgagcgttcatccaggctgccgtgggctgtggctgggcggagcagggaaaagctccagcgggtgctggaaaaggccgctttaaagctgggccgacctacactctctagcgaggtcggtatcatcatttgtgatatcgcgaatccagcatctcttgatgaaatggcaaagcaggctaccgtagtcctgaattgtgtgggaccgtatagattctacggcgaacccgtgatcaaggcttgtatagaaaacggggcctcctgcattgacatttccggggagccacagttcctggagctcatgcaactgaagtaccatgagaaggccgccgacaaaggcgtgtacatcatcggatcctccgggttcgactctattccagccgacctaggggtcatatatacacgcaacaagatgaacggcactctgaccgccgtggagtctttccttaccattcactccggaccagagggactgtccatccatgacggaacatggaagagcgccatttatgggttcggcgaccagtccaatctcaggaagctccgcaacgtctctaacttaaaacccgtgccactgatcgggccaaaattgaagcgcagatggcccatcagctattgcagggaactgaagggctactccattcctttcatgggatctgacgttagtgtcgtgaggagaacccagcgatatttgtacgagaatctcgaggagtctcccgttcagtacgccgcatacgtgaccgtagggggaattaccagtgtgataaaactgatgtttgccggccttttcttcctgtttttcgtgcgcttcggcataggcaggcagctcctgattaagtttccatggtttttttcctttgggtacttttcaaagcaaggccctacacagaaacagatagatgctgctagctttacactcacattttttggccagggctattctcaaggcaccgggaccgataaaaacaaaccgaatatcaaaatttgtacccaggtgaaaggacctgaagctgggtatgttgcaacacccattgcgatggtacaggctgccatgacgctcctatccgatgcctctcacctgcccaaggctggtggggtattcaccccaggggccgccttttctaaaactaagctgattgataggctcaataagcacggcatcgaattctctgtaatatcctcatccgaggtttag

SEQ ID NO: 45712 - DNA, 1074 bp, Artificial Sequence
  Description of Artificial Sequence: Synthetic coding sequence
atgagcggcaagaccaaggcccggcgggccgccatgttcttccggaggtgttccgaagacgcaagcggttcagcatcagggaacgccttactttctgaggatgagaatcccgacgcaaacggggtgactcgaagttggaaaattatcctgtccacgatgttaactctcacctttctcttagttggcttgttgaatcaccaatggctaaaagaaactgatgtgccacagaagagcagacagctgtacgcaattatcgccgaatacggatctcgtttgtataagtatcaggcacgattgaggatgcctaaagagcagcttgaactcctgaagaaagagagtcagaatttagagaacaactttcggcagatactcttcttaattgagcagattgacgtgttaaaggcattgttaagggacatgaaagacgggatggataataatcataactggaatacacatggtgaccctgtggaagaccctgaccacaccgaagaagtgagcaatcttgtcaattatgtcctcaaaaaactgagggaggaccaggtggaaatggctgactatgccctgaagtctgctggtgcgagtatcattgaggccgggacttccgaaagctacaagaacaacaaggccaagctctactggcacggaattggtttcctaaaccatgagatgcctccagatatcatccttcagccagacgtgtatcccgggaagtgctgggctttcccagggagccagggtcatactctgattaagctcgctaccaagattatccccaccgccgttacaatggagcacataagtgagaaagtgagtccctcaggcaacattagctccgccccgaaagagttcagcgtatatggaatcactaagaagtgtgagggagaggaaatctttctgggacagttcatctataataaaacaggaacaacggttcagacgtttgaactgcagcatgctgtgagcgaatacctgctgtgtgtgaagctgaatatattcagtaattggggtcaccctaaatatacatgtctgtacaggttcagggtgcatggtacacccggcaaacatatatag

SEQ ID NO: 45713 - DNA, 1074 bp, Artificial Sequence
  Description of Artificial Sequence: Synthetic coding sequence
atgagcggcaagaccaaggcccggcgggccgccatgttcttccggcgatgttccgaggacgcatctggctcagctagcggcaacgccctgctctcagaggacgaaaaccccgacgccaatggcgtgacccgctcctggaagattatcctgagcaccatgctgaccctaacctttctcttagtggggctgctgaatcatcagtggttgaaggagaccgacgttcctcagaagagtagacagctgtacgctatcattgcggagtacggatctagactgtacaagtatcaagcccgcctcagaatgcccaaagaacagctggagctcctgaagaaggaaagccagaaccttgagaacaattttaggcagattctcttcctgatcgagcagatcgatgtcctgaaggcattactgagagatatgaaggatgggatggacaacaaccataattggaacacacacggcgacccagtggaagacccagaccacaccgaagaggtatccaatttagtgaattatgtgcttaagaaacttcgtgaggatcaggtcgagatggctgactatgccttaaaatcagctggggcctcgatcattgaggccggaaccagcgagagctataagaacaataaggcgaagctgtattggcacggaatcgggttcctgaatcatgaaatgccacctgatataatccttcagcctgatgtttatcctgggaaatgttgggctttccccgggtcccaaggacacacgctaatcaaattggctacaaagatcatccccaccgcggtcacaatggagcacatctccgaaaaagtgagtcccagcggtaacatctcctccgcacccaaggaattctccgtctacggaattacgaaaaagtgtgaaggggaggagatcttccttgggcagttcatttataacaaaacaggtacaactgttcaaaccttcgaactccaacatgcggtttcagagtacctcctgtgcgttaagttgaacatcttcagcaactgggggcaccccaagtatacatgtctgtataggttccgggtccacggcacacccggaaagcacatctag

SEQ ID NO: 45714 - DNA, 810 bp, Artificial Sequence
  Description of Artificial Sequence: Synthetic coding sequence
atgcccaaggagcagctggagctgctgaagaaggagagccagaacctcgaaaacaatttcagacaaatcctgtttttgatcgagcagatcgacgttcttaaagccctgctgagggatatgaaagacgggatggacaacaatcacaactggaatacccacggtgacccggtggaggatccagaccacactgaagaagtgtctaacctggttaattatgtgcttaaaaagctgcgggaagatcaggtggagatggctgactatgctcttaagagcgctggagcctcgattatcgaagccggaaccagcgaatcatacaaaaacaacaaagctaagctgtactggcacggcattggcttcttgaatcacgaaatgcctcccgacattattctccagccggatgtataccctggaaagtgttgggcttttcccgggagtcaaggccacactttgataaagctagcgacaaaaataatccccactgccgtcaccatggaacacatctctgaaaaagttagcccatcaggtaacattagctccgcccccaaagaattctcggtgtatgtgcagcgctacatgtgcaggtttgtgattcaggcagggattacgaaaaaatgtgagggcgaggaaatttttctaggccagtttatctataataagacgggcactacagttcaaacatttgaattgcaacacgcagtgtccgagtacctcctgtgtgtcaaacttaatatcttctccaattgggggcaccctaaatatacttgtttgtacaggttccgagtacacgggacacccggcaagcacatctag

SEQ ID NO: 45715 - DNA, 810 bp, Artificial Sequence
  Description of Artificial Sequence: Synthetic coding sequence
atgcccaaggagcagctggagctgctgaagaaggagagccagaacttggagaacaattttagacagattctttttcttatcgaacaaatcgacgtactgaaggccctcctcagggacatgaaagatggaatggacaataaccacaattggaacactcatggcgatcctgtcgaagaccccgaccatacagaggaagtttctaacttggttaactacgtccttaagaagctgcgagaagatcaggtcgaaatggccgattacgccctgaaatccgctggggcatccatcattgaagcaggaacttctgaaagttacaagaataacaaagccaaactgtactggcacggcatcggctttctcaaccacgaaatgcctcccgatataatccttcagcctgatgtttatcccggtaaatgctgggcctttccaggcagtcagggacacacactcatcaagctcgcaactaaaattatcccgacggccgttacaatggaacatatttctgaaaaagtttcccctagcggtaatatcagttcagcccccaaggagttttccgtttatgtgcaaaggtacatgtgtcgctttgttattcaagccgggatcacaaaaaagtgcgaaggtgaagagatcttcttgggtcagtttatctataataaaactggaaccacagtgcaaacttttgagctccagcatgcagtgtccgaatatctgctgtgcgtcaagcttaacatctttagcaattggggtcacccaaagtacacatgtttatatcggttcagggttcatgggacccccgggaaacacatttag

SEQ ID NO: 45716 - DNA, 846 bp, Artificial Sequence
  Description of Artificial Sequence: Synthetic coding sequence
tgatacgccatcatcgccgagtacggcagccggctgtacaagtaccaagctcgattaaggatgccaaaagagcagctggagctgcttaaaaaagagagccagaacctcgaaaataatttccggcagatcttgttcctcatcgaacagatcgatgtactgaaagctctccttagggacatgaaagatggaatggacaataaccacaactggaacacccatggcgaccccgtcgaagatccagaccatactgaggtgctcgacgaggaagtcagcaatctagtgaattatgtcctgaagaagctcagagaagatcaagtagagatggccgactatgccctgaagtccgctggggcctcaataatcgaggccggtactagcgagtcctataaaaataataaggcaaagttgtattggcacggcatcggttttctgaaccacgagatgccccctgatatcatactccagccagatgtctatccaggaaagtgctgggcttttcctgggtcccaggggcataccctgataaagctggccacaaaaatcatccccaccgctgttaccatggaacacatttccgaaaaggtgagtccaagcggcaacatttcttcggcacctaaggagttctcagtctacggaatcaccaagaaatgcgaaggggaagagatatttctgggacaattcatatacaacaagacgggcactacagtccagacattcgaactacagcacgccgtgtccgaatacttactctgtgtgaaactgaacatctttagtaattggggtcaccctaagtacacttgcctctacaggtttagagtgcacggtacccctgggaagcatatatag

SEQ ID NO: 45717 - DNA, 1038 bp, Artificial Sequence
  Description of Artificial Sequence: Synthetic coding sequence
atggaggactacagcaagtacaacgcctacaccgacttcagcagctgtcgtttggagtgtagcggggctattctggctcactgcaatctccacctgcttggcagtagcatttcaccagctagcgcttcaagggttgccgggaccacagggctgcttaatcaccagtggctcaaagaaaccgacgtcccccaaaagtcacgccagctgtacgcgattattgctgaatatggaagtaggctctataagtaccaggcgagattgcgcatgccaaaggagcaattggagctgttgaaaaaggaaagccagaatctcgaaaacaactttaggcagattctcttccttatcgagcagatagatgttcttaaggcgctgctgcgagatatgaaggatgggatggataacaatcacaactggaacactcacggggacccagttgaagatccagatcacaccgaggaggtgtctaatctggtgaactacgtcctgaagaaactgagggaggaccaggtggagatggccgactatgccttgaagtccgcaggggcttccataatcgaggccggaacctccgaatcttataagaataataaggcgaagctgtactggcacgggattggtttccttaatcacgaaatgccacccgacatcatcttgcagccagatgtttaccctgggaagtgctgggcttttccaggatcccagggtcatacgctgattaagctggcgaccaagatcattccaactgctgtgacaatggagcacatttcagagaaagtttcgccctcgggcaacattagtagcgctccaaaggaatttagtgtgtatggtattacaaagaagtgtgagggcgaggagatcttcttgggtcagttcatatacaacaagacagggaccaccgtgcagaccttcgaattgcagcatgccgtgtccgaatacctgctgtgcgtgaagctgaatattttcagtaactggggccaccccaaatatacctgcctatatcgtttcagagtgcatggcactccaggcaagcacatatag

SEQ ID NO: 45718 - DNA, 939 bp, Artificial Sequence
  Description of Artificial Sequence: Synthetic coding sequence
atggaccggagcaccaacctggacatcgaggagctgaagatgaccagagagcagtacatattggctacgcagcaaaacaatctgcctcgtaccgagaacgcacagctttaccccgtgggcatctatggctggaggaagcgctgcctgtatttcttcgttctgttattgctcgtgactatgatagtgaacctcgccatgacaatctggattctgaaagtaatgaacttcaccgttgacggcatgggaaacctgagggtgacgaagaagggcatcaggctagaggggatttcggagttcctcctacccttatatgtgaaagaaattcattcacgcaaggatagtcctctggtcctccagtctgaccggaacgtgactgtgaacgcaaggaatcatatgggtcagttaactggacaactcactattggagcagacgctgttgaggcacagtgtaaacggtttgaggttcgtgcttctgaggacggaagggtgcttttttctgcagacgaagatgagatcacaattggcgccgagaaacttaaggtgacgggaaccgagggcgccgtgtttgggcacagcgttgagaccccccatattagagctgaacccagtcaggacttgaggctcgagtcgccaacaaggtctctgattatggaagcgccgaggggcgtccaagtgtccgcagccgcgggagattttaaggctacatgcaggaaggagctgcatctccagtccaccgaaggcgagatctttttgaatgcagaaaccattaagctgggcaacctgcccactggatctttctccagtagcagcccatcttcttcaagttcccgccagaccgtgtacgaactctgtgtctgccccaatggcaaactctacttatcacctgcaggtgttggctccacatgccagtcatccagtaatatttgtctctggtcttag

SEQ ID NO: 45719 - DNA, 798 bp, Artificial Sequence
  Description of Artificial Sequence: Synthetic coding sequence
atgacccgggagcagtacatcctggccacccagcagaacaacctgccaagaaccgagaatgctcagctgtacccagtcggcatttatgggtggcggaagcggtgcctctacttcttcgttctgctactcctagtgacaatgatcgttaacttggccatgaccatttggattctgaaggtaatgaactttactgtggattcccctctggtcctgcagagcgacaggaatgtgactgtgaacgctcgtaaccacatgggccagctcactgggcagctgaccattggcgctgatgccgtcgaagcccagtgtaagcggtttgaagttagggcttcagaagacggtcgcgtgctctttagcgcggacgaggatgaaataaccattggcgccgagaaactaaaggtcaccggaactgagggggcagtcttcggacatagcgtggaaactccccacattcgcgctgagccatcccaggatctgcggctagaatcccccactcgcagtttaataatggaagctccacggggggtccaggttagcgccgccgctggggactttaaggccacctgtaggaaggaactgcaccttcagagcactgagggtgaaatcttcctgaatgccgaaaccataaagctcggcaatctccctaccggttcattctcatctagctcaccttcgagctcctcctcgaggcaaacagtgtatgagctgtgtgtgtgtcccaatgggaaactgtacctctcacccgccggggtaggaagcacctgccagtcttcctccaatatttgtctttggtcttag

SEQ ID NO: 45720 - DNA, 2436 bp, Artificial Sequence
  Description of Artificial Sequence: Synthetic coding sequence
atgcccagcgccctggccatcttcacctgccggcccaacagccaccctttccaggaacgccacgtttacttggatgaacctatcaaaattggcaggtccgtggcccgatgtcggccagcacaaaacaacgctactttcgattgtaaagtgctgtccagaaaccatgctctggtatggttcgatcataaaacaggtaagttttatctgcaagacacaaaaagctcaaacgggaccttcattaattcacagcggctctcgagaggatccgaagaatcacctccatgtgaaatcctaagcggagacattatccaatttggtgtggacgtgacagagaacacacgaaaagtcactcacggctgtattgtttcgaccataaagttgttccttcctgacggcatggaggcccgtctgcgttcagacgtgatccatgcaccactcccaagccccgtggataaggtagccgctaataccccctccatgtactctcaagagctgtttcagctcagtcagtatctgcaggaagcgctccatagagagcaaatgttggagcagaagcttgccacgctccagaggctattagccatcacacaggaggcttctgataccagctggcaggctctaattgatgaggacaggctgctcagtcggttagaagttatgggaaaccagctgcaagcctgttccaagaaccaaactgaggatagcttacgcaaagaactgatagctctgcaggaagataagcacaattacgaaacaaccgccaaggaaagcctgaggagggtcctgcaggaaaagatagaggtcgtgcggaaactgagtgaggttgaacggagcctgagtaacacggaagacgagtgcactcacctcaaagaaatgaatgagcgcacacaagaggaactccgggaattggctaataagtacaacggggcagtgaacgaaattaaagacttgagtgataaacttaaagtcgcggaggggaaacaagaagagatccagcagaagggccaagccgagaagaaggagctgcagcacaaaatcgatgagatggaggaaaaagagcaggagctgcaagctaagatcgaggcgcttcaggcagacaatgacttcactaatgaacgccttactgcactgcaggaacatctgctttcaaagtcaggtggggactgtacttttattcaccagttcattgaatgtcaaaaaaagctgatcgtggaagggcacctcactaaagccgtagaggagacaaaattgtctaaggagaaccaaacccgagccaaggagtccgacttctcagatacgctctcaccgagtaaagagaagtccagcgacgacaccactgatgcccagatggatgagcaagacttgaatgaaccactggccaaagtctccctgctgaaggatgaccttcagggtgctcagtctgaaatcgaggctaagcaggagatccagcacctcagaaaggagctaatcgaggcccaggaattggcacgtacaagcaagcaaaaatgcttcgagttgcaagcactcctggaggaagagcgtaaggcttacaggaatcaggtcgaggaatccacaaagcagatccaggttttacaggctcagctacagcgtttgcacatagacaccgagaacctgcgagaggagaaagacagtgaaatcacaagcacccgcgacgagctgctgtcagctcgagatgaaatactcctcctccaccaggccgccgccaaggtagcctctgaacgggacacggatatagcttccctgcaggaagagctgaagaaagtccgcgccgaactggagcgctggcgcaaggccgctagcgaatacgaaaaagaaattacatccttgcaaaattccttccaactgcgatgtcagcagtgtgaagatcagcagcgagaggaggccactcgactccagggagagctggagaaactgcggaaggagtggaacgccctcgaaacagagtgccactctctgaagagggagaacgtactcctgtccagcgaactgcaacgtcaggagaaggagctccacaactcccagaagcagtctcttgaactcacatctgaccttagcattttgcagatgtccagaaaggaacttgaaaatcaagtgggatcgctgaaggagcagcatctcagagattccgctgacctcaaaactctcctgagcaaagccgaaaaccaggcaaaagacgtgcagaaagaatacgagaagacccaaactgtcctgtcagagctgaaactaaaattcgagatgacagaacaggagaagcagagcatcaccgacgagctgaagcagtgtaagaataacctgaaattgctgagggagaaggggaataacaaaccttggccttggatgccaatgctcgccgcccttgtcgcagtcacagctatcgtcttgtatgtgcctggactggccagagcaagtccctag

SEQ ID NO: 45721 - DNA, 2436 bp, Artificial Sequence
  Description of Artificial Sequence: Synthetic coding sequence
atgcccagcgccctggccatcttcacctgccggcccaacagccacccgtttcaggaacgccatgtgtatttggatgaaccaatcaaaattggtcgatccgtggcccgctgtagacctgcccagaataatgcaacgtttgactgcaaggtcctgtcacggaatcacgccttagtatggttcgatcataaaactgggaagttttacctgcaggacaccaagtctagcaacggcacctttattaactctcaaagattgtcgaggggctccgaggagtcacctccttgtgagatactgagcggggacatcatccagtttggggtcgatgtgactgaaaatacacgcaaagtgacgcacggatgcatcgtctccacgatcaagctgtttctgcccgacggcatggaggccaggctgaggtcggatgtcatccacgctcctttgccaagccctgtggacaaggtggccgcgaacacgcccagtatgtacagccaagagctgttccagctctcccagtacctgcaggaggctttgcacagggagcaaatgctcgaacagaaacttgccactctccagcgtctcctcgccataactcaggaggcctcagatacgagttggcaggctcttatagacgaggatagactgctgtctagactggaggtgatgggaaatcagctacaggcttgtagcaagaaccagacagaagatagcctgcggaaggagcttatcgctctccaagaagataagcacaattatgaaactactgctaaggagagcttgaggagggtgcttcaggagaagattgaggtggtgcggaagctgtccgaggttgagcgtagtttatccaatacggaggacgagtgtacacatttaaaggaaatgaacgaacgtacccaggaagagctgagagagctggccaacaaatacaacggcgctgtgaatgagatcaaggacctaagcgataagcttaaggtggcggaaggaaaacaggaagagatacagcaaaagggccaggccgagaaaaaagaactgcaacataagatagacgagatggaggagaaggagcaagagttgcaagctaagatcgaggctctgcaagccgacaacgactttacgaacgagagactaacggctctccaggagcatctcctgagtaagtctggaggagattgcacattcatacatcagtttatcgagtgccagaaaaagcttatagttgaagggcacctaaccaaggccgtggaggagacaaagctatctaaggagaaccagacccgggccaaggagtccgacttctctgacactctttcgccctcaaaagaaaaaagttccgacgacaccactgatgcccagatggatgaacaagacctgaacgagcctcttgcaaaagtttctctcttgaaagacgacttgcagggcgctcagtcagagattgaagcgaaacaggaaatccaacacctcagaaaagagctcatagaggcacaggagttggctcgcacttcgaaacagaaatgcttcgaattgcaggcactgctcgaggaggaacgtaaagcatacagaaatcaagtcgaggaaagcaccaagcagattcaggtgcttcaggctcaactgcaacggctgcacatagatacagaaaatctgagagaggagaaagatagcgagattacctctacaagggacgagctgctcagcgctagggatgaaatcttgctcctgcatcaagcggcggcgaaagtcgccagcgagagagacaccgatatcgcttccctgcaggaggaactgaaaaaagttcgtgccgaactggaaaggtggcggaaagcagcttccgagtatgagaaggagataaccagcctgcagaatagctttcaacttcgatgtcagcaatgtgaagaccagcaacgagaagaggccacccgacttcagggcgagctggaaaagttgagaaaggaatggaacgcactcgagaccgagtgccactctctcaaacgggaaaatgtactgctcagtagcgaactccaacggcaggagaaagaactccacaattcccagaagcaaagcctggagttgacttcagacctgtctattctgcagatgtcgcgtaaggagctggaaaaccaggtaggatcattaaaagagcaacacctccgcgattctgccgatcttaagaccctattaagtaaagccgagaaccaagctaaagatgttcaaaaggaatacgaaaaaacacaaacagtcctttcagaacttaagctcaagtttgaaatgaccgaacaggagaagcaatcgataactgatgagctcaagcagtgcaagaacaatctcaagctactccgggaaaaaggaaacaataagccatggccttggatgcccatgctggcagcactggtggccgtgacggcgatcgtcttgtacgtgccgggactggcccgggcatctccttag

SEQ ID NO: 45722 - DNA, 1521 bp, Artificial Sequence
  Description of Artificial Sequence: Synthetic coding sequence
atgcccagcgccctggccatcttcacctgccggcccaacagccaccccttccaggaacgccacgtctatctcgatgagcctattaaaattggaagaagcgtggcccggtgtcgccccgcacagaacaacgcgacctttgattgcaaagtcctcagtagaaatcacgccctggtctggttcgaccataagaccggtaaattttacttgcaagacacaaagtcctctaatggtacctttattaattctcagagattatctagagggtcagaggaaagccctccttgtgagatcctaagcggggatatcatccagttcggagttgatgtgactgagaacacccgaaaggtaacacacggatgtatcgtgagcacaatcaaactcttcctgccggacggtatggaggcgcgactgcgctcggacgtgattcacgcacccctcccgtcccccgtggacaaggtcgccgccaacacaccatccatgtactcacaggaactcttccaactgtcccagtacctccaggaagccttgcaccgcgagcagatgctcgagcaaaaacttgccactctgcagagactcctggccattacacaggaggccagcgatacttcctggcaggcacttattgacgaggaccggctcttgtcgaggctcgaggtaatgggaaatcagcttcaagcttgtagcaagaaccagacagaagacagtttgcgtaaagaactgattgctctgcaagaagacaaacacaactacgaaactactgccaaggaaagcctgaggcgtgtgctccaagagaagattgaggtggtgcgtaaattaagcgaagtggagcgttccctctctaacacggaggatgaatgcactcatttaaaggagatgaacgaacggacacaagaggagttaagggagttggccaataagtataacggtgctgtcaacgagattaaagacttatcagataagctcaaagtggccgagggcaaacaggaagaaatccagcagaaaggacaagctgaaaaaaaggaactgcagcataagattgatgagatggaggagaaggaacaggagctgcaggctaaaatcgaggctctgcaggctgataacgacttcacaaacgagagactgaccgccctgcaggtgcgacttgagcatttacaggagaaaacgctcaaagaatgttccagcctgggcatacaggttgatgacttcctgcccaagattaacggctcaactgaaaaggaaaagcttatcgtcgagggccatctaactaaagctgtggaggagacaaaactctcaaaggagaaccaaacccgggccaaggagtcagacttctctgacacactcagccctagcaaggaaaagtctagcgacgataccacggatgcccagatggacgagcaggacctgaacgagcccttggcaaaagtaagcttgctcaaagggaccctcacttgcttttatgacatagtcaatcagggcataaaaagcccattcgcaattaagagcgttttggacatcatgtag

SEQ ID NO: 45723 - DNA, 816 bp, Artificial Sequence
  Description of Artificial Sequence: Synthetic coding sequence
atggacgagcaggacctgaacgagcccctggccaaggtgagcctgctcaaagccttactggaggaggaacgcaaagcttaccgcaatcaagtggaggaatctacaaaacagattcaagtgttgcaggcacagctgcagagacttcacatcgataccgagaacttacgagaggaaaaggacagcgagattacttccacaagggatgagttgctgtcagcaagagacgaaattctgctgctccatcaggccgcagcgaaggttgcaagcgaaagagacaccgacatagcttccctgcaggaggagctgaagaaagtgagggccgagctggaaagatggcgcaaggctgcatccgaatatgagaaggaaattactagcctgcagaattcatttcaactgcgatgccagcagtgcgaagaccagcagagggaggaggcgaccaggctgcagggcgagctggagaaactgcgcaaggagtggaacgctcttgagaccgagtgccattctctcaagcgcgagaatgttctgttatcctctgagctgcagcggcaggagaaggaactgcataattcccagaagcagtctcttgaactcacctcagacctgagtatactgcagatgagtaggaaggagctggagaatcaagtgggaagtttgaaagaacagcacctcagagacagtgccgatttgaagactttactctccaaagctgagaaccaggccaaagatgttcagaaagaggtgaaacgaaaggatatcatgagccccattatggtgggactgaaggccaaaagtaagagcgacattcacgctagctag

SEQ ID NO: 45724 - DNA, 1230 bp, Artificial Sequence
  Description of Artificial Sequence: Synthetic coding sequence
tgaaagctgatcgtggagggccacctgaccaaggccgtggaggagaccaagttatcgaaagaaaatcagacacgagcaaaagaaagcgacttcagtgataccctgtctccctccaaggaaaagagcagcgatgacacgacagatgctcagatggacgagcaggacttgaatgagcctcttgccaaagtgagtctcctcaaagacgatcttcagggcgcacaaagtgaaatcgaagccaaacaagaaattcaacacctgaggaaggaattgatcgaagcccaggaactggcacgcacatcgaagcagaagtgttttgagttgcaggccttgctggaggaagagaggaaggcctaccggaatcaggtcgaagagtcaactaagcagatccaggtccttcaggctcagctccagcgactgcatatcgatactgagaatctccgcgaggaaaaagacagcgagattacctccacccgtgatgaactcctcagcgcccgcgacgagatcctgctcttacaccaggcagccgccaaggtggcttccgaacgcgatacagatatcgcctctcttcaagaggagctaaagaaagtgcgtgcagagcttgaacggtggagaaaagcagcttccgaatatgagaaggaaattacgagcttgcagaattcctttcagctccggtgtcaacagtgtgaggaccaacaaagagaggaggctacccgactgcagggggaactggagaaactgagaaaagagtggaacgccttggagactgaatgtcatagtctaaaaagagaaaatgtgttattaagttctgaactccagagacaggaaaaagagcttcataacagccaaaagcagtccctagaacttaccagcgacctgagcatcctccaaatgagcagaaaagagctcgagaatcaggtcggttcccttaaagaacagcatttgagagatagcgcagacctgaagacgctgctcagtaaagctgaaaaccaggcaaaggatgtgcagaaggagtacgagaaaacccagaccgtcctcagtgaactcaaactaaagttcgagatgaccgagcaggagaaacagtcgattaccgatgagttgaagcaatgtaagaataacctgaagttgctgagggagaaagggaacaatcccagtattctgcaaccagtacccgccgtatttattgggctctttctggcctttctgttctggtgcttcggccctctgtggtag

SEQ ID NO: 45725 - DNA, 2487 bp, Artificial Sequence
  Description of Artificial Sequence: Synthetic coding sequence
atgcccagcgccctggccatcttcacctgccggcccaacagccaccccttccaggagagacacgtgtacctggatgagcctatcaagatcggtcgcagtgtcgcaagatgtaggccagcacagaataatgccacttttgattgcaaagtgttgtctaggaatcacgccctagtctggtttgaccacaaaaccggaaagttctacctgcaggataccaaatcttcgaatggaacattcattaattctcagcgactgtcgcgcggtagcgaagagtcaccaccctgcgagattctttccggcgacatcatccaatttggcgtggacgtcaccgagaatactcgaaaggtcacccacgggtgtatcgtgagcactatcaagctgttcctgcctgacggaatggaagcacggctgcgctcagacgtaatacatgccccccttccaagcccagtggataaagtggctgccaacaccccatcaatgtacagccaggagcttttccaattgtcacagtacctgcaagaggccttgcatcgtgagcagatgctcgaacagaaattggccacattgcagcgcctcttagccattacacaggaggcctcagatacaagttggcaggccctgatagacgaggacaggctactgtccaggctggaggtgatgggcaaccaactccaggcttgttctaaaaaccagacggaagactcccttcgcaaggagctcattgctttgcaggaagacaagcataactatgagaccactgcaaaggaatccctgcgccgtgtcctccaggagaagattgaggttgtccgcaaactgtcagaagtggagagatccctcagcaacactgaggacgaatgcacccatctgaaggagatgaacgagcgcacccaagaggagctacgagaattggccaataagtacaatggagccgtgaatgaaattaaggatcttagtgacaaactcaaggtggccgaaggtaaacaggaggaaatccagcagaagggccaggctgagaaaaaggagctgcaacacaagatagatgaaatggaagagaaagagcaagaattgcaggctaaaatcgaagccctccaggctgataatgatttcaccaatgagcgcctgactgcgctgcaggtgaggcttgagcatcttcaggagaagacactgaaggagtgttcatccctggagcatcttttgtccaagagcggaggggactgtacatttattcaccagttcatcgagtgtcagaagaaacttatcgtggagggtcatctcactaaagctgtcgaagagacaaagttgtctaaggagaaccagacccgtgccaaggaatcggacttcagtgacacgctgtccccttccaaagaaaagagcagtgacgacaccaccgacgcgcaaatggacgagcaagacttaaacgagcctctagcaaaagtcagtttattgaaagacgaccttcagggcgcccagagcgagatagaagccaagcaggagatccagcatctccgcaaagagttaatcgaagcccaggagctggcaaggacttccaaacagaaatgcttcgagctgcaggctcttctagaagaagagcggaaagcctaccgcaaccaggtggaggagagcaccaagcagatccaagtgctgcaggcacagctccagcggctgcatatagatacggaaaacctgagagaggagaaagattctgaaataactagtacccgggacgagctgctgtccgccagagacgagatccttctgctacaccaagccgctgctaaggtcgcctcagagcgagacaccgatatagcctcccttcaagaggagttaaaaaaggtacgcgcagaactcgaacggtggcgcaaagctgcatctgagtatgagaaagagatcaccagccttcagaactcatttcaactacggtgccagcagtgtgaggaccaacagagagaagaagctacacgactacagggcgagctcgagaagctcagaaaagagtggaatgcattggaaaccgaatgtcactccctgaaacgggagaacgtccttctgagcagcgagctccagcgccaggagaaggaactccataatagtcagaagcagtctctggaattgacatccgacctttccatcctgcagatgagccgtaaagaactggagaatcaggtcggatctttgaaggaacagcaccttcgcgatagcgccgatctgaagacccttttatcaaaggcagaaaaccaggccaaggacgtgcagaaggagtacgagaagacacagaccgttttgtctgaattaaaactgaaatttgaaatgacagaacaggagaagcagtcaatcaccgacgagctgaaacagtgcaagaataacctcaagttgctgagagagaaagggaataacaagccctggccctggatgccgatgctggcagctctagtagctgtaacagcgattgttctctacgtcccaggactcgcccgtgcttccccctag

SEQ ID NO: 45726 - DNA, 951 bp, Artificial Sequence
  Description of Artificial Sequence: Synthetic coding sequence
tgaggccacctgaccaaggccgtggaggagaccaagctgagcaaggaaaaccagacccgagcaaaagagtccgacttctcggacacgctctccccgtccaaggagaagagtagcgatgacacgactgatgcccagatggatgaacaagatctgaatgagcctctggccaaggtttctctgcttaaggccctgctggaggaggaacggaaggcttataggaatcaggtagaagaatccactaaacaaatccaggtgttgcaggcgcagctgcaaagactccacatcgacactgaaaatctgagagaggagaaggactccgaaattacttccaccagggacgagctacttagtgctagagatgagatcctcctactgcaccaggccgcagctaaggtggccagtgaaagagacaccgacatcgcctccctgcaggaggagctcaagaaggttcgcgctgaactcgaacgttggcggaaagccgcatctgaatacgaaaaggaaatcacatctctgcaaaactccttccagctcagatgtcagcagtgcgaagaccagcagagggaggaggcgaccaggttgcagggtgagctggagaaactgcggaaggagtggaacgcccttgagacagagtgccactctctgaagcgggaaaacgtcctactgtcctccgagctgcaaaggcaggagaaggagctgcacaacagccagaaacagtctctggagctcaccagcgatctgagtatcctccaaatgtcgcggaaggaattggaaaatcaggtcgggagcttaaaggaacagcaccttcgagacagcgctgatctgaagacgctgctcagcaaggccgaaaaccaggcgaaagacgtccagaaagaggtcaagcgcaaagacatcatgagtccgattatggtggggcttaaggccaagtctaagtccgacattcatgcctcctag

SEQ ID NO: 45727 - DNA, 891 bp, Artificial Sequence
  Description of Artificial Sequence: Synthetic coding sequence
atggacgagcaggacctgaacgagcccctggccaaggtgagcctgcttaaggcacagctgcagcggctccatatcgataccgaaaatctgagagaggaaaaagactcagaaattacatcaactcgggatgagctgctctcagcacgggatgaaatactgctgctgcaccaagctgccgccaaggtggcttccgagagagacacggatatagcgtcactacaggaggaattgaagaaagtgcgcgccgagttagagagatggcggaaggccgcttccgagtatgaaaaagagatcacttctctgcagaatagcttccagctgcgctgtcagcaatgtgaagatcaacagcgcgaggaggccacacgcctgcagggcgagttagaaaagctcagaaaggagtggaatgcgctagagacagaatgtcacagcttgaaaagggaaaacgttctgttgagcagcgagctgcaacgccaggagaaggagctccacaattcccagaagcagtcattggagttgacttcagacctgtctatcctgcagatgtcccgcaaggagctcgagaatcaggtcgggagtctaaaagagcaacacttgcgcgatagcgccgaccttaagacactgctttcgaaggctgagaatcaggctaaggacgttcagaaggaatacgaaaaaacacaaacagtgctgtccgaactgaagcttaagtttgagatgacagaacaagaaaaacagtcaattaccgacgaattgaagcagtgcaaaaacaatttgaagctgctgcgggagaaaggaaacaacaagccctggccttggatgccgatgttagctgcactggttgccgtgacggccatcgtgctgtacgtgcccggtcttgctcgagcatcaccatag

SEQ ID NO: 45728 - DNA, 2373 bp, Artificial Sequence
  Description of Artificial Sequence: Synthetic coding sequence
atgcccagcgccctggccatcttcacctgccggcccaacagccaccctttccaggagagacacgtctacctcgacgaaccaatcaagataggtaggagcgtggcgaggtgtcgtcctgcacagaacaacgcgacattcgactgtaaggtattgtcaaggaaccatgccctggtttggtttgatcacaagactggtaaattctacctgcaagacacgaagtcgagcaatggaacattcatcaactcacagcgcctgtcgcggggctctgaggagtcccctccatgcgagattctttctggcgatattatccagtttggggtggatgtgacagaaaacacaaggaaagtgactcacgggtgtatcgtgagcaccataaagctatttttgcctgacggcatggaagcacgcctgcggagcgacgttatacatgcaccgctcccctctcctgtcgacaaggttgccgccaacacaccctccatgtatagtcaggaactattccagctgtcccagtatctgcaagaggcactacaccgagaacagatgctcgagcaaaagttggctacactgcagcgtctactggctattactcaggaggcttctgacacgagctggcaggctttgattgatgaggatcgcttactctctaggttggaagtcatgggcaaccagctccaagcttgtagcaaaaatcagacagaggattcactccggaaggagctaatcgccctacaggaggataaacataactacgaaacgactgctaaagagagtcttaggagggttcttcaggagaaaatcgaggtggttaggaaattaagcgaggttgaaaggtcactgagcaacacagaagatgagtgtacccacctcaaagaaatgaatgagaggacccaggaggagctgagggagttggccaataagtataacggagctgtcaacgaaatcaaggatttaagtgacaagcttaaggtggcagagggcaagcaggaggaaatccagcagaagggccaggcggaaaaaaaagaattgcagcataagattgatgaaatggaggagaaagaacaggaactccaggccaagatagaagctctgcaagctgataacgatttcactaacgagcgcctcaccgcccttcaagagaagctcatcgtagaagggcatctgaccaaagccgtcgaagagacaaagctttcaaaggaaaatcagaccagggctaaagaaagcgattttagtgatacattatcccccagcaaagaaaagtccagtgatgataccacagatgcacagatggatgagcaggatcttaacgaaccactagccaaagtgagcctccttaaagacgatctccagggggcccagtcagaaattgaggccaagcaagaaatccagcacctgcggaaggagctgattgaagcccaggagctggccaggacctccaaacagaagtgtttcgaactccaggccctgctagaggaggagaggaaagcctatcgaaaccaggtcgaggagtcaactaaacagatccaggttctccaagcccagctgcagcgcctccacatcgacaccgaaaatttgcgcgaggagaaagactcagaaatcacatctaccagagatgaactgctgtctgcccgggatgagatactgctgctgcatcaagccgcggcaaaagttgcttcagagagagacactgatatcgccagcctccaagaggagcttaagaaggtccgggccgagcttgagagatggcgaaaggctgcctctgagtacgagaaagagataacctcactccagaacagctttcagctgagatgccagcaatgtgaagatcaacaacgggaggaggccacacgcctccagggagagctcgagaagctgcggaaagaatggaacgcccttgagacagagtgccacagcttgaaaagagagaatgttcttctgagttcagagcttcagcggcaggaaaaggaattacataactcccaaaaacaatcgctcgagctaaccagcgatctttctatacttcagatgagccggaaggagctggagaatcaggtcgggtccctcaaagaacagcaccttcgggacagtgccgatctaaagacactcttgtctaaggcagaaaatcaagcaaaagatgtgcagaaagagtacgagaagacccagaccgtcctaagcgagctaaagctgaaatttgaaatgaccgaacaggagaaacagtccatcactgacgagctgaagcagtgcaagaacaacctgaagcttttgcgggaaaaaggtaataacaagccctggccatggatgcctatgctcgctgcactcgtggccgtgacagccatcgttttgtacgttccaggactggcccgggcctcgccgtag

SEQ ID NO: 45729 - DNA, 957 bp, Artificial Sequence
  Description of Artificial Sequence: Synthetic coding sequence
atggacgagcaggacctgaacgagcccctggccaaggtgagcctgctgaaagccctgctcgaagaggagcgtaaggcgtacaggaaccaggtcgaagaaagcacaaaacagattcaggttctccaggcgcaattgcagcgcctgcacatcgacaccgaaaatctgcgcgaggagaaagattctgagattacctccacccgcgatgaactcctgtcggcccgtgatgagattctcctcctccatcaagcagccgctaaggtggcttctgagagggacactgacatcgcatccttgcaggaggagctcaagaaagtaagggccgagctcgaacgctggcgcaaggcggcgagtgagtacgaaaaagaaatcacatctctccagaacagttttcagctgcgttgccagcagtgtgaagaccagcagcgggaagaggccacccgacttcagggagagctggagaagttacgcaaggagtggaatgccctggagaccgagtgtcacagcctgaaacgggagaacgtactgctgtcaagcgagctgcagagacaggaaaaggagctccataattcacagaaacagtcgctggagctgacatccgacttatctatcctgcaaatgagcaggaaagagctggagaaccaagtgggatccttaaaggaacagcatttgcgggacagtgccgacctgaagacgctgctgagtaaagccgaaaaccaagctaaagacgtccaaaaggaatatgaaaagacccagaccgtcctgtccgagttgaagctgaagttcgagatgacggagcaggagaagcagagcattaccgatgagttgaagcaatgtaagaataacttgaagctactgagggaaaaagggaataacccttccatactgcagcctgtacccgctgtatttattggactattcttggccttcctgttctggtgctttggccccctctggtag

SEQ ID NO: 45730 - DNA, 1089 bp, Artificial Sequence
  Description of Artificial Sequence: Synthetic coding sequence
atggacgagcaggacctgaacgagcccctggccaaggtgagcctgctgaaagacgatttgcagggagctcagagtgagatcgaagccaaacaagagatccagcatcttaggaaagagttgattgaagctcaggagctggctcggacctccaaacagaaatgcttcgagctgcaggcgctgctcgaggaggagcgcaaggcctacaggaatcaggtagaggagagtactaagcagatccaggtgttgcaggcccagctgcagcgtctgcacattgacaccgagaatttacgggaagagaaagattcagagattacttccacccgggacgaactgttatccgcgcgggacgagatcctgctcctacaccaggcggccgctaaggtcgccagtgaacgtgatacagacatcgcatcactccaagaggagctcaaaaaggtacgagccgaactcgaaagatggcggaaggcggcgtccgagtacgagaaagaaattacaagtttgcagaatagttttcagttaaggtgccaacagtgcgaggaccagcagcgagaagaagccaccagactgcagggcgagctggagaaactcaggaaagaatggaacgctctcgaaaccgagtgccattcactgaagagggagaacgtcctgctgtcaagcgaactccagagacaggaaaaagaactgcacaattctcagaaacaatcattagagctgacttccgatttgtcaattctgcagatgagcaggaaggaattggagaaccaagtggggtccctcaaagaacagcaccttagagacagcgcagatctgaaaaccctcctttctaaagccgagaatcaagccaaagacgtgcagaaagagtacgagaagacacagaccgtcctgagcgaactcaaactgaagtttgagatgacagaacaggagaaacagtcaattacggatgaactcaagcaatgcaaaaacaatctaaagctgctgcgagagaaaggcaacaacaaaccatggccttggatgccaatgctcgctgctctcgtcgcggtgactgccatagtgctctacgtgccgggcctggctcgggcttcaccatag

SEQ ID NO: 45731 - DNA, 1356 bp, Artificial Sequence
  Description of Artificial Sequence: Synthetic coding sequence
atggaggagaaggagcaggagctgcaggccaagatcgaggccctgcaggcagataacgactttaccaatgagaggctgactgctttgcaagagaaccagacccgtgctaaagaaagcgacttttctgacacattatccccctccaaggaaaaaagctccgatgacaccactgatgcgcagatggacgaacaagacctgaacgagccactggccaaggttagtctgctgaaggatgatttgcaaggcgcgcaaagtgagattgaagccaaacaggagattcagcacctacgtaaagaactgatcgaggcacaagaattggctaggacttctaaacagaagtgcttcgaactgcaggcattgctggaagaagaacgtaaggcatatcggaaccaagtggaggaatctaccaaacagatccaggtactgcaagcccagctccaacgcctccacattgacacggagaacctccgggaagagaaggattctgaaattacgagtacaagagacgagctgctcagcgctagagacgaaatcctcctactgcaccaggctgccgcaaaggtcgcttctgagagagacacagatatcgcctccctccaagaggaacttaaaaaggttagggccgaactcgagcggtggcgcaaggccgcatctgagtatgaaaaagagataacaagtttgcagaactcctttcagttgagatgtcagcagtgcgaagaccagcagagagaggaagccacgcgattgcagggagaactcgaaaagctgcgcaaagaatggaacgcgctcgaaaccgagtgccactcattgaagagagaaaacgtcctcctgagctcggaactgcagcggcaagaaaaagaactccataacagtcaaaagcagtcattagagctaactagcgacctgtctatcctccagatgtcacgcaaggagttggagaatcaagtcggatccctgaaagaacaacacctaagggactcggccgaccttaagactctgctgagcaaagcagagaatcaggcaaaggatgtccagaaggagtatgagaagacccagacagtgctcagtgagttaaagctgaagttcgagatgactgaacaagagaagcaatcaataacagatgaactcaaacagtgcaaaaataaccttaagctgctccgagagaagggaaataatccctccattctgcagcccgtacccaggatccataggcctatcccgggcttcccagtgctggtgttcagaagtatagtagtcgagcagaaaccttggccatggatgccaatgctggctgcgctggtagccgtgaccgctattgtgctatacgtccccgggctggcacgtgcttcaccatag

SEQ ID NO: 45732 - DNA, 2427 bp, Artificial Sequence
  Description of Artificial Sequence: Synthetic coding sequence
atggccggcaccgtggtgctggacgacgtggagctgcgggaggcccagcgtgactatctggacttcctggatgatgaagaagatcagggaatttaccagagtaaagtgcgcgagctgatatcggacaaccagtaccgcctgatagtgaacgtgaatgatttgaggaggaagaacgaaaagagagccaataggctgctgaataacgcctttgaagagctggtcgcatttcagagagccttgaaagacttcgtggccagtattgacgccacctatgctaaacagtacgaggagttctacgtgggactggaaggatcttttgggtccaaacacgtgagccctcgtacccttactagttgctttttgagttgtgtggtctgcgttgagggaatcgtcaccaagtgttccctggttcggccaaaagtggtccggagcgtgcattactgcccagcaaccaagaaaaccatcgaaaggaggtacagcgacctgacaactctcgtggctttcccctccagcagtgtttacccgaccaaggatgaagagaacaaccctcttgagacagaatacggtctttccgtgtacaaagaccatcagacgatcacaatacaagaaatgcctgagaaagccccggcgggccagctgcctcgcagcgtagatgtcatcctggatgatgatctggtcgataaagcaaagcctggcgaccgggttcaagtggtgggaacatatcgatgtctgcccggaaagaagggaggatataccagcggaacctttagaactgtcctaatagcttgtaatgtcaagcagatgagcaaagatgctcagccgagctttagcgcagaagatatcgccaaaatcaaaaaattcagtaagactagaagcaaagacatcttcgatcagctggccaagtccttagctccatctatacacgggcatgattatgtgaagaaggcgatcttgtgtttgctgttgggaggagtcgagagggacctcgagaatgggagtcatataaggggagacatcaatatcctgcttataggggatccgagtgtagccaagagtcagctgctacgctatgttctatgtaccgccccccgagccatccctacgaccggacgagggtctagcggcgtgggtctgacagccgccgtgacaaccgaccaggaaactggtgagcgtcgcctggaggcgggcgccatggtgctagccgatcgcggcgtggtgtgtatagacgagtttgataagatgtccgacatggaccgcactgccattcacgaggtgatggagcagggccgggtgacgattgcaaaggcggggatacatgccagactaaacgcccgatgctcagtgctggccgccgccaatcccgtgtatggcagatacgaccagtataagacacctatggagaacatcggattgcaagattcactgctgtcacgcttcgacctcctgttcataatgcttgatcagatggatcctgaacaggaccgggagatcagcgaccacgtgctaaggatgcaccggtaccgtgctccgggagaacaggacggtgatgccatgccactgggcagcgccgtagatatactagccacagatgatccgaatttttcccaggaggaccagcaagatacgcagatttacgagaagcacgataacctactgcacggtactaagaaaaaaaaagagaagatggtgtccgctgccttcatgaaaaagtacattcacgtggcaaagattattaagcctgtgctcacacaagagtccgcaacttatatcgccgaggagtattcacgcctacgatctcaggactcaatgtccagcgacactgctcgaacctctccagtgaccgctcgcaccctggaaactctcatccggctggccaccgcacacgctaaagcaagaatgtccaagaccgtcgatctccaagacgctgaagaggccgtggagctggttcagtacgcatactttaaaaaggtccttgaaaaagagaagaagaggaagaagcggtcagaagacgagtcagagacggaagacgaggaagaaaagagccaggaggatcaggaacaaaaacggaagagaaggaaaaccaggcagcccgacgcaaaagacggcgatagctatgatccctacgatttcagtgacaccgaagaagagatgcctcaagtccacacacctaagaccgcggactctcaagaaacaaaagagtcccagaaggtggaactgtctgagtcccgactgaaagccttcaaagtagccctgctggacgtattccgcgaggcgcatgcacaaagcatcgggatgaatagactgacggaatcaattaatagggactcggaggaaccctttagttctgtcgaaattcaggccgccctctctaaaatgcaggacgataaccaggtgatggtttccgaaggtattatcttccttatttag

SEQ ID NO: 45733 - DNA, 351 bp, Artificial Sequence
  Description of Artificial Sequence: Synthetic coding sequence
atgctggaggccgcccagccccagggcagcaccagcgagaccccctggaacacagctataccactgccctcgtgctgggatcagtccttcttgaccaatatcaccttcttgaaagtcttattgtggcttgttctcctcggccttttcgtagagctggagtttggcctggcctactttgttttgtctctcttctactggatgtatgtgggtacgagaggacctgaagagaagaaggaaggggagaaaagcgcatactcagtgttcaacccaggatgcgaagctattcagggcacactgactgccgagcaattggagagggagctgcagctaagacctctcgccggccgctag

SEQ ID NO: 45734 - DNA, 1074 bp, Artificial Sequence
  Description of Artificial Sequence: Synthetic coding sequence
atggagaacaaggccatgtacctgcacaccgtgagcgactgcgacaccagttcaatctgtgaagactcattcgatggaaggtctctgtccaagctgaatttgtgtgaggacgtttctaggcctcggtcgtcccccgacgacctcaaggcattgacaagaaacgtcaatcggctgaatgagagttttagagatttgcagttgcggctcctgcaagcccccctccaagcggatctgactgagcaagtctggaaggtccaggatgccctacaaaatcagtccgactcgctgttagctctcgctggggccgtacagaggctggagggggctttgtgggggctacaggcgcaagccgtgcaaacagagcaggcagtggccctcctacgggacagaacgggtcaacagtccgatacggcccaactcgaattgtaccagttacaagtcgaatctaattccagtcagcttctcttaagaagacacgctggtctgctcgacgggctcgcacgccgagtaggcattctgggtgaagaactggccgatgttgggggggtcctccggggattgaatcactccctgtcatatgacgtggccctccaccgaactcggctccaggacctgagggtccttgtctcaaacgcctctgaggatacccggcggctaaggctggctcatgttgggatggagttgcaactcaaacaggaacttgctatgcttaatgcagtgacagaagacctgagactcaaggattgggagcacagcatcgcccttcgaaatatctcattggccaaggggcccccaggccctaagggcgaccaaggggacgaggggaaggagggccgtcctggcatacctgggctccctggcctcaggggcttgcccggcgaaaggggcacacctggcttgcctgggcccaagggagacgatggaaaactcggagcaactggacctatgggcatgaggggttttaaaggcgaccgtgggccaaaaggggaaaaaggcgagaagggtgaccgagcgggggacgcatccaaagatatcctcctaggaccatgggatatggtcctggcacagggatag

SEQ ID NO: 45735 - DNA, 1488 bp, Artificial Sequence
  Description of Artificial Sequence: Synthetic coding sequence
atggagaacaaggccatgtacctgcacaccgtgagcgactgcgacacatcgtctatctgtgaggacagttttgatgggaggagcctttcaaagctaaatctgtgcgaagacggaccctgtcataaacggcgggcatcaatttgttgcacgcaacttgggagtttgtcagctctgaagcacgctgtgcttggcctgtacctcctcgtgtttctgatactggttgggatctttatccttgctgtgtcgcgacccaggtcttcacccgatgacctgaaggccctgaccaggaacgttaatcgactgaatgagtcctttcgggacttgcagctgcggctgttgcaagctccactgcaggccgatcttaccgaacaggtgtggaaggttcaggacgcactccagaaccagagcgacagtctgttggcactggccggagcagttcagcgcttggagggggcactgtgggggcttcaggcccaggctgttcaaactgaacaggccgttgcgctcctgagggatcgtactggacagcaatcagacacagcacagctcgaattataccagctccaggtggagagcaattctagccaactgctgctccgccggcacgctggactcttggacggccttgcgcgtagggtaggtatactgggggaggagcttgccgacgtgggtggggtacttagaggactgaaccatagtctcagttatgatgtggctctccaccgtactcggttacaggatctacgcgtattagtctccaacgcctccgaagacactcgccgtctgagacttgcgcacgtcgggatggaattgcagctcaagcaggaactggcgatgttgaatgctgttacagaagacctacgactgaaagactgggagcattccatagctctgagaaacatttcgttggcgaaggggccccctggacccaaaggcgaccaaggcgacgagggtaaagagggccggcccgggattcccggcctgcccggtctgagagggctgcccggagagcgcggcacacctggtctgcctggcccaaagggagatgacggcaagctgggcgcaaccgggcccatgggcatgagaggcttcaaaggggacagaggacccaagggcgagaaaggcgaaaagggcgatagagcgggagatgcaagcggagtagaagcacccatgatgatacggctggtgaacggttccgggccacatgaggggagggttgaagtttatcatgatagacgctggggcactgtatgcgacgacgggtgggacaagaaagacggggatgttgtttgccggatgctgggctttcggggcgtggaggaagtgtaccggaccgctagattcggacagggaactggacgtatttggatggatgatgtggcctgcaaaggaacagaagagaccatattccgctgctctttcagcaagtggggtgtgacaaactgcggacacgcagaggacgccagcgtgacatgcaataggcactag

SEQ ID NO: 45736 - DNA, 813 bp, Artificial Sequence
  Description of Artificial Sequence: Synthetic coding sequence
atggagaacaaggccatgtacctgcacaccgtgagcgactgcgacacctcttccatttgcgaggactcttttgacgggcgaagtctatccaaactcaacctttgtgaagacggaccgtgccacaaacggagagctagtatttgttgtacccagctgggaagcctttcagcgttgaaacatgccgtgcttggcctgtacctgctggtcttcttgatcttggttggcatcttcatattggccggtcctcctggaccaaagggtgatcagggggacgagggcaaagaggggaggcccggtatccccggacttccaggattacgcgggcttccaggagaacgaggcactcctggccttcccggcccaaagggagacgatggaaagctgggcgccacagggcccatggggatgcgcggcttcaaaggagaccggggaccaaagggcgagaagggggagaagggtgaccgcgccggggacgcaagtggagtggaagctccaatgatgattcgacttgttaacggctctggcccacacgaaggccgtgttgaggtataccacgaccggcgatggggcaccgtttgtgacgatggatgggacaagaaggatggtgatgtagtctgtcggatgctgggcttccgtggagtcgaagaggtgtaccgaactgcccggttcggacagggaactggaagaatttggatggatgacgtggcctgcaaagggacagaggagactatttttcgctgtagcttttccaagtggggggtgacaaactgcggacacgctgaagacgcctctgtaacatgtaacaggcattag

SEQ ID NO: 45737 - DNA, 1074 bp, Artificial Sequence
  Description of Artificial Sequence: Synthetic coding sequence
atggagaacaaggccatgtacctgcacaccgtgagcgactgcgacacaagctcgatttgcgaagattcatttgacggacgaagcttgagcaaactgaacttgtgtgaagatgttagtaggccgcgcagtagtcccgacgatcttaaagcactgacccgcaacgtgaaccgattaaatgaaagcttcagggatctgcagttgcgattacttcaggctcccctgcaggccgatctcacagaacaagtctggaaagttcaggatgcactgcagaatcagagcgattccctcctcgctctggccggtgcagtgcagagacttgagggtgcactttggggactccaggcccaggctgttcagacagagcaggccgtggcgttgcttcgggacaggactggccagcagtctgatactgctcagctggagctgtaccagctccaggtagagagcaacagtagccagctcctgctccgccgtcacgcgggtctgctggatgggcttgcccgcagggtgggtattctgggagaggagctggcggacgtgggtggggtgctgcgcgggttaaaccattccctgtcttacgacgtagccctacatcgcactagactgcaagatttgcgcgtcctggtcagcaacgcctctgaggacacgcgaagactgaggcttgctcacgtagggatggaactgcagttgaaacaggagctggctatgttgaatgccgtcacagaagacctgaggctaaaggactgggaacactctattgcactgaggaatatttctcttgccaagggacctccaggcccgaaaggggaccaaggcgacgagggcaaggaaggccggcctggaattccaggcctgcctggcctgcggggtttgccgggtgaaaggggtacgcctggtttgccaggaccgaagggcgacgacggcaagctcggggctacaggacctatgggaatgcggggtttcaaaggcgacaggggccccaagggcgagaagggagagaagggcgaccgggcaggcgacgcatccaaagatatcttgctcggcccatgggacatggtgttagcccaggggtag

SEQ ID NO: 45738 - DNA, 1203 bp, Artificial Sequence
  Description of Artificial Sequence: Synthetic coding sequence
atggagaacaaggccatgtacctgcacaccgtgagcgactgcgacacctcctctatctgcgaagactcctttgacggacggagtttgagcaagctgaatttgtgcgaggacggaccctgtcacaagaggcgggcctccatatgctgtacccagctgggtagcctgagtgctctgaaacacgccgtattagggctgtacctcctagtgtttctgattcttgttggaatcttcatcttggctgttagccgcccgcgcagtagcccggacgacctgaaggccctgactcgcaatgtgaacagattgaacgaatcattcagggacttgcaattgaggctactgcaggctccactgcaggcagatttaacagagcaggtttggaaggtccaggacgcccttcaaaatcagtcagattcactgttggctttagcaggcgcggtacaacgactggaaggagcactttggggactgcaggctcaggccgttcagacagagcaggctgtcgcattacttagagataggaccggccagcagagtgacactgctcagctggagctgtatcagttacaggtggaatccaactcttctcagttgcttctgcgtagacatgcgggactactggacgggttagctcgtcgggttggcatactgggagaggagcttgccgacgtaggaggcgtgttgcgggggctgaaccatagcctgtcttatgatgtagcgctgcatcgcacacggctccaggatcttagggtcctcgtttccaacgcctctgaggatacccggcggcttcgtctcgctcacgtagggatggagttgcagctgaagcaagagctggccatgctgaatgccgtgactgaggacctccggctcaaggactgggaacattctattgccctgcgcaacatcagtctggctaaggggcctcctggcccgaagggcgaccagggagatgagggtaaagaaggaaggccaggaattccggggctgccaggtcttagaggactgccaggggagcgcggtacgcctggtctgccagggccaaagggggatgacgggaagttgggagccacaggccccatggggatgagaggctttaagggggaccgaggtcctaaaggagaaaagggtgagaaaggcgatcgagccggggacgcttccaaggacattctgctcggcccttgggacatggttctcgctcagggatag

SEQ ID NO: 45739 - DNA, 1002 bp, Artificial Sequence
  Description of Artificial Sequence: Synthetic coding sequence
atggtgcacggcaacatcacccccgagaacatcatcctgaacaagtctggtgcatggaagatcatgggatttgatttctgcgtttcatcaaccaacccaagtgagcaggagccgaagttcccctgtaaagagtgggaccccaatctgccgtcgttgtgtctgcccaaccccgagtatctagcgcctgaatacatcctgagtgtcagctgcgagactgcatccgatatgtacagccttggcaccgtcatgtatgctgtgtttaacaagggaaaacctattttcgaggtcaacaaacaggatatttacaagagcttctccaggcagctcgatcagctgagccggctcggctcttccagtctgacaaacatccctgaggaggtgcgggagcatgtcaaactcctcctgaatgtcacaccgaccgtccgcccagacgctgatcagatgaccaagatccctttcttcgacgatgtcggggcagtgacactgcagtatttcgatacattattccagagagataacttgcagaagtcccagttcttcaaaggtctgcccaaggtcctgcctaaactgcctaagcgggtaatagttcagcggatcctcccctgcctgacaagcgagtttgtgaaccctgacatggtgccattcgtcttgccgaatgtgcttctgatcgcggaagagtgcacaaaggaggagtatgtcaagctgattctgcctgagctgggaccagtgttcaaacagcaggaacccattcaaatcctgctgatcttcctgcagaaaatggacttactcttgaccaagaccccgccagacgagattaagaattcagttctgcccatggtgtaccgagcattggaagccccctcaattcagatccaggagctttgccttaatattatacccacttttgcgaacttgattgactacccgtccatgaagaacgccctcataccgcggatcaagaacgcctgttacaagcaccttccgctccgatttcagcagtag

SEQ ID NO: 45740 - DNA, 2790 bp, Artificial Sequence
  Description of Artificial Sequence: Synthetic coding sequence
atggagagcatgctgaacaagctgaagagcaccgtgaccaaggtgaccgccgatgtaacgtccgcagtgatgggaaaccccgtaacccgcgagtttgatgtcgggaggcacattgcgtcaggaggcaacggtctagcctggaaaattttcaatggaacaaagaagtctactaagcaggaggtggccgtgtttgtgttcgacaagaaacttatcgataagtatcagaagttcgagaaagaccaaataattgattccctgaagaggggcgtccagcagttgactaggctgcgacatcctcgactgctcactgtgcagcatcccctggaagagtcgcgggattgtctcgctttctgtacagaacccgtattcgccagcctcgcaaacgtgttgggcaattgggagaatctgcctagcccaatctctcctgacatcaaggactacaagctctatgatgtcgaaaccaagtacggattgctacaggtctcagagggtctgagttttctgcacagctcggtcaaaatggtccacggaaacatcacccctgagaacataatattaaacaagagcggggcgtggaaaatcatgggtttcgatttctgcgttagtagcactaatccctcagaacaagagcctaaatttccatgtaaagaatgggatcccaacctgcccagcttgtgccttcctaatccagagtacctggctccggagtacattctgagcgtttcatgtgaaaccgcgagtgacatgtactctttgggtacagtgatgtatgcagtttttaacaagggaaagcccatattcgaggtcaataagcaagacatctataagagcttctcgcgtcagctggaccagctgtctcggctgggttccagcagccttactaatatccccgaagaagtaagagaacacgtgaagttgctcctgaacgttaccccaacagtccgaccggacgctgatcagatgaccaaaatcccgttttttgacgacgtgggcgctgtcacgctgcagtacttcgacacacttttccaacgagacaacctgcagaagagccagttcttcaaaggtctgcctaaggtcttgcctaaattgccaaagcgagtcatcgttcagagaatcctcccttgcctgaccagcgagttcgtcaatcccgatatggtgcccttcgtgctgccaaatgtactcttgatcgccgaggaatgtactaaggaggaatacgtgaaactcatcctcccagagctgggacccgtattcaaacagcaagagccaatccagatcctcctcatattcctgcagaaaatggatctgctactgacaaaaacacccccagatgagataaaaaactccgtgctcccgatggtgtatcgcgccctcgaagcgcccagcatccaaattcaagagttgtgtttgaatatcatccctaccttcgctaatctcatcgactaccccagcatgaagaacgccttaatacctcgtatcaaaaatgcatgtctgcaaacctcttctctggctgtccgtgtcaacagcctggtgtgccttggaaagattttggaatatctcgacaaatggttcgttctggatgatattctgccattcctgcagcagatcccatcgaaggagcctgctgtgcttatggggatcctgggcatatataaatgtacttttacccacaagaaactcggcatcaccaaggagcaacttgcaggtaaagttctgccccatctgatccccctcagtatcgagaacaaccttaatctgaatcagttcaactccttcatatcagtgataaaggaaatgcttaatagactggagtccgaacacaaaacgaagctcgaacagctgcacataatgcaggagcagcagaaatcattagatatcggcaatcagatgaatgtgagcgaggagatgaaggttaccaacataggaaaccaacagatcgacaaggttttcaacaacattggcgccgacttacttactgggagcgagagcgagaacaaggaagatggacttcagaataagcacaagcgcgcatccctcaccctcgaggaaaagcagaagctggctaaagaacaggaacaggcacagaaacttaaatcacaacagccactgaagccgcaggtacacacacccgtcgccactgttaaacagaccaaggatttaactgacactctaatggacaacatgtcgagtttgacgagcctgtccgtgtctacgcctaagagttcagcatcatcaacattcactagtgtcccaagtatgggtatcggcatgatgtttagtacaccgaccgacaataccaagagaaacctgacgaatgggctgaacgccaacatggggttccagacaagtgggtttaatatgccggtgaatacaaaccagaatttttactctagtcctagtaccgtcggcgtcaccaagatgactctgggaactcctcctaccctgcctaacttcaatgccctgtcagtccctcctgcaggggccaagcagacgcaacaaagacctacagacatgtccgcgttaaacaaccttttcggtccacagaagccaaaagtgagcatgaatcagcttagtcagcagaaaccgaaccagtggttaaaccaatttgtgccaccccaggggagtcctactatgggcagttcagtgatgggcactcagatgaacgtaatcggccagtccgcctttgggatgcaaggtaatccctttttcaatcctcagaatttcgcgcagcctcccacaaccatgacgaattcctcatctgcctctaacgatctgaaagatctctttggatag

SEQ ID NO: 45741 - DNA, 2046 bp, Artificial Sequence
  Description of Artificial Sequence: Synthetic coding sequence
atggagagcatgctgaacaagctgaagagcaccgtgaccaaggtgaccgccgatgtaaccagcgccgtcatgggaaaccccgtgactagggagttcgatgtgggacggcatatcgcttctgggggcaatggcctcgcttggaaaatcttcaacgggactaagaaaagtaccaaacaggaagtggctgtgtttgtgtttgacaagaagctcatagataagtatcagaaatttgaaaaggatcagatcatcgattccctgaaaagaggtgtgcagcagctgactcgcttgcggcatccaagactacttacagtgcagcaccccctggaagagtctagggactgtctcgccttctgtacagaaccagtctttgctagtttggccaatgtcctgggcaactgggaaaacctgccttctccgatatccccagatattaaggactacaaactgtatgatgtggagaccaagtacgggctgttgcaggtcagcgaaggcttgagcttccttcactctagtgtcaagatggtccacggcaacattaccccggagaatattatcctgaacaagtctggggcctggaagatcatgggtttcgacttctgtgtgtccagcacaaatccgtctgagcaggagcccaaattcccctgcaaggagtgggaccccaatctgccctctctatgtctgccaaaccccgagtatctagcccctgagtatattttgagcgtgagctgcgagactgcctctgacatgtatagcttgggcactgtgatgtacgctgttttcaacaaagggaaaccaatattcgaagttaataaacaggatatttacaagagcttctctaggcagctagatcaactctcacggctaggttcctccagcctgactaatattcctgaggaagtcagggaacacgtgaagttgctgttgaatgtcacacctaccgttagaccagacgcagaccaaatgaccaagataccttttttcgatgacgttggtgcagtgacgctgcagtatttcgatacactttttcaaagggacaatctgcaaaaaagccagtttttcaaaggcctccccaaggttctgcccaagctccctaagagggtcattgtgcagcgtatacttccttgcctcaccagcgaatttgtaaaccccgacatggtacccttcgtgcttcctaacgttctgctcatcgccgaggagtgtacaaaggaagaatatgttaagctcatcctgccagagctggggcccgtttttaagcagcaggaaccaatccaaatcctgctcattttcttacagaagatggatttgctccttacaaagacccccccagacgaaatcaaaaattccgtgctgcctatggtgtacagggctctcgaggcccctagcatccagattcaagagctttgtctaaatatcatccctacttttgcgaatctgatagactacccttctatgaaaaacgcactcattcctagaatcaaaaatgcctgtctgcagaccagcagtttggcagtgagggtgaactccttggtgtgtctgggaaaaatcctggaatacttggataaatggttcgtgctcgacgatattctcccatttttacagcaaattcctagcaaggagcccgctgttctgatgggtatattgggaatttataagtgcacctttacccacaagaaactgggaattacgaaagagcagctggccgggaaagttctccctcatctgatccccttaagtatagagaataacctaaatctgaatcagttcaacagcttcatttccgtaatcaaggagatgctcaacagactcgaatctgagcacaagacaaaactggagcagcttcacataatgcaagaacaacagaaatctctggatattggaaaccagatgaacgtgtccgaggaaatgaaagtgacaaatattggaaatcagcaaattgataaagtctttaataacattggggccgatctgctaacagggtctgagtccgaaaacaaagaagacggactccagaataagcataagcgcgccagcctcacactggagtag

SEQ ID NO: 45742 - DNA, 1653 bp, Artificial Sequence
  Description of Artificial Sequence: Synthetic coding sequence
atgcccaccgaggagaacatcgaccggatgtgccaggacctgcggaaccagctgtacgagagctactacctcaactttatttccgctatcagtagaagtaaactagaagacatcgcaaacgcagcgttggccgcgtctgcggttacccaggtcgcaaaggtctttgaccagtatctaaattttatcaccctcgaggacgacatgttcgtgctgtgtaaccaaaataaggaattggtttcctacagggcaataaataggcccgatataacggataccgaaatggagacagtgatggacaccattgtggacagcctcttttgtttttttgtgactctaggtgccgtgcctatcatccgatgctctagggggaccgccgccgaaatggtggcggtgaaactagataaaaagctgcgtgagaaccttcgcgacgcgcgaaactccttatttacaggagatactctgggggctggtcaattcagttttcagaggcctctcctcgtcctcgtagaccgaaacatcgatctggccaccccgctgcatcatacttggacctatcaggcactggtacatgacgttctggacttccacctcaatagagtgaatctggaagaaagcagcggagtggaaaattctcctgccggggctcgccccaaaagaaagaacaaaaagagctacgacctgacaccagttgataaattctggcagaaacacaagggatcaccattccccgaggtcgccgagtccgtgcagcaggagctcgagtcctacagagctcaggaggatgaggtgaagcggctgaaatctattatggggctggaaggtgaagacgagggagccatttctatgctctccgataatacagccaagctgacctccgccgtgtcgagcctgcccgagctcttggagaagaaaagactgattgatcttcatactaatgtggctacggctgttctcgagcatattaaggcccggaagcttgacgtatattttgaatacgaggaaaaaataatgtccaaaaccaccctggacaaaagcctgttagatatcataagtgatccagacgccggaactccagaagataagatgcgactcttcttgatctattacatctctacgcagcaggcccccagtgaagcggatctggagcaatacaagaaagcactgaccgatgccgggtgtaatctcaatccactgcagtacattaagcagtggaaggcgttcacgaaaatggcgtcagccccagcttcctacggctcaacaactactaaacctatgggacttctgtccagagttatgaatactggatcacagtttgttatggaaggcgtgaagaatctagtgctaaaacaacagaacctgcccgttacaaggatcttggacaatctgatggagatgaagtccaatcctgagacggatgattaccggtatttcgatcctaagatgcttagaggcaacgattcatctgtgccacggaataagaatcccttccaggaggccatcgtcttcgtggtgggcggtgggaattatattgaatatcagaacttagtagactatattaaaggcaagcagggtaagcacattttatacggttgtagtgagctgttcaacgcaacccaattcattaagcaattatcacagctcggacagaaatag

SEQ ID NO: 45743 - DNA, 1752 bp, Artificial Sequence
  Description of Artificial Sequence: Synthetic coding sequence
atgtgcctgatcctgaagaccgcccaggagaaccagtacggccggttgttacacagtgatcgagaccctatcccggacgtccccgccgtgtactttgttatgcctaccgaggagaatattgaccgcatgtgtcaggatctgaggaaccaattatacgagtcttactacttgaattttatctctgcgatctcccgctccaaactggaggacattgccaacgccgccttagctgcctctgccgttactcaggttgctaaagtgtttgaccagtacctgaactttatcacactggaggatgatatgttcgtgctgtgcaaccagaataaggaactagtttcctaccgtgcgataaaccggcctgatattaccgacacagagatggagactgttatggataccatagtcgacagtcttttctgtttctttgttactttgggcgctgtgccaatcattagatgttctcgtggcacagcagccgaaatggtggcagtgaagctggacaagaaactaagggagaatctccgggacgcaaggaactcgctcttcaccggggatacactaggagctggtcagtttagcttccaacgccctttattggttctagtggacagaaacatagacctggcaacgccccttcatcacacctggacctatcaagccctggttcacgatgtgctggatttccatctgaacagagttaatctggaggaaagttcgggagtggagaattcccctgctggtgctcggcctaaaaggaagaacaagaagtcttatgacctaaccccagtggataaattctggcagaagcataagggatcaccattccccgaagtagctgagtccgtccagcaagagctcgagagctacagagcccaggaggatgaggtgaaaagactgaaatctatcatgggacttgaaggagaggacgaaggcgctatttccatgctatctgataacaccgccaagctgacctctgcagttagtagtctacccgagttgcttgaaaaaaaaaggcttattgacttacataccaatgtggccacggccgtactggaacacataaaggctcgaaagctggacgtgtacttcgagtatgaggagaaaatcatgtcaaaaactaccctcgacaagtctctgctggatattatctccgaccctgatgcaggaacccctgaggacaaaatgcgtcttttcctgatttattacatctcgacccaacaggcgccatctgaagccgatttagagcagtacaaaaaagccctgaccgacgctggttgtaatctcaaccctctgcaatacatcaaacagtggaaagcctttaccaagatggcttccgcaccagcatcatacggatcgactacaactaagccaatgggattgctgagccgcgtaatgaataccggatcccaattcgtgatggagggtgtgaagaacctggtgttaaaacagcagaacctgccagtgacacggatcctggataacctaatggagatgaagagcaaccccgagacggatgattatagatattttgaccctaaaatgttacgtggtaatgactcaagcgttccaagaaacaagaatccatttcaggaagcaatagtttttgtggtgggaggtgggaactacatagaataccaaaacctggtggactacattaaagggaaacagggcaagcacattctgtatgggtgctctgagctattcaacgctacccaatttatcaagcagctgtctcagctggggcagaagtag

SEQ ID NO: 45744 - DNA, 1929 bp, Artificial Sequence
  Description of Artificial Sequence: Synthetic coding sequence
atggccgccgccgccgccgccaccgccgccgccgccgccagcatccgagagcgacagactgtcgccctgaagagaatgctgaatttcaatgtgccacacatcaaaaactccaccggggagccagtgtggaaggtgctgatctatgatcggttcggccaggatattatcagcccacttctgtccgttaaggagctgcgcgacatggggatcacacttcatctgctgctacatagcgaccgtgaccccattccggacgtgcctgctgtgtacttcgtgatgccaacagaggaaaacattgacagaatgtgtcaagacctgcgcaatcagctgtacgagtcatactatctgaactttatatctgccataagcagatctaagctagaggacatcgctaacgcagctctcgcagcttccgccgtgacacaggtggcaaaggtctttgaccagtacctcaatttcataaccctggaggacgatatgttcgttctgtgcaaccaaaacaaggagttggtatcctaccgggctataaatcgtcctgatattacagatacggaaatggagaccgtgatggacactatcgttgacagtctcttctgtttcttcgtaacgctgggcgccgttcctattataaggtgcagccgcggaactgccgccgagatggtcgccgttaagctcgacaagaaattgagggagaatctgcgcgacgcccggaacagcctgttcacaggcgacacactgggtgcaggacagtttagttttcagaggccactccttgtgctcgtggatcgcaatattgatctggctacgccccttcaccacacatggacctaccaggccctggtccatgatgtgctagacttccaccttaatagagtgaacctggaagagagttcaggtgttgagaactcacctgcaggagctcggcctaagcggaaaaataagaaatcatatgaccttacccccgtagacaagttctggcagaaacataaaggctctccgtttcctgaagtcgcagaatcagtgcagcaagagctcgagtcttatagagctcaggaagacgaagtgaagcgactgaagagcatcatgggcctggaaggtgaggacgagggagccatcagtatgctttcagataatacagcgaaactaacgtccgccgtgtcttcactgcccgaattgcttgaaaagaaacggttgattgatttacacacgaacgtcgccaccgcagtgttagagcatattaaagctcgcaagcttgacgtctactttgagtatgaggagaagataatgtccaagacgacgcttgataaatcactgctggatatcatatcagaccctgatgctgggaccccggaggacaagatgagactttttcttatctattatattagcactcagcaggctccatctgaggccgaccttgaacagtacaaaaaggccctgacagatgctggatgcaacttaaacccactgcaatacataaagcagtggaaagccttcactaaaatggcctctgctccagctagctacggctcaaccacaactaagccaatgggacttctttctcgagtaatgaatacgggaagccagttcgttatggagggcgttaaaaatcttgtgttaaagcaacagaatctgccggtcacccggatcctagataatctgatggaaatgaagagcaatccggagaccgacgattaccggtatttcgatccaaaaatgctgcgtggcaatgacagctcagtcccccgtaacaagaaccccttccaggaggccattgtcttcgtagttggcggcggcaactacatagagtaccagaatctggtcgactacataaaaggtaagcagggaaagcacatcctgtacggatgctctgagctcttcaacgctacacaatttatcaagcagctttcacaactgggtcagaagtag

SEQ ID NO: 45745 - DNA, 1374 bp, Artificial Sequence
  Description of Artificial Sequence: Synthetic coding sequence
atggagaccgtgatggacaccatcgtggacagcctgttctgcttcttcgtgacccttggcgccgtccctatcatcagatgttctcgcggcacagccgcggagatggtggctgtgaaattggataaaaaactgcgagagaatctgcgagatgcacgaaatagtttgttcacaggcgacactttgggagccggacaattttcctttcaacgtccactgctggtgcttgtagacaggaacattgacttagcaaccccgttgcatcacacatggacataccaagccttggtgcacgatgtgcttgacttccacctcaaccgggtcaaccttgaggagtcatcaggcgttgagaactcccctgctggcgccaggccaaaacgcaagaacaagaaatcctacgatcttacccccgtagataagttctggcagaagcacaagggatccccttttcccgaggttgccgaatctgtacagcaagagctggagtcttacagggcgcaggaagatgaggtgaaacgcctgaagtccataatggggctcgagggtgaagatgagggtgctatatctatgctgagtgacaacacagccaagctgacgagcgctgtgtctagcttgcccgagctgttagaaaaaaagaggctgattgatctccataccaacgtggcaactgcagtccttgagcacataaaggcaagaaagctggatgtgtacttcgaatatgaggaaaaaataatgtccaaaaccacgctggataagtctctgctggacattatctccgatcccgacgctgggactcccgaggataaaatgcggctttttttaatctactacatttcaacacaacaagccccctccgaagcagatctggaacagtacaagaaggctttgactgatgctggatgcaatctaaacccactgcagtacattaagcagtggaaggcgttcacaaagatggcaagcgctcccgctagttacgggagtacgaccacaaaaccaatggggctgctgagccgcgtcatgaacacaggctcccaatttgtcatggaaggagtgaaaaacttagtgctgaagcagcagaacctgcctgttactaggatcttggataacttgatggagatgaaaagtaacccagagacggacgactaccgttattttgaccctaaaatgctccgaggcaatgacagttctgtgccaagaaacaagaatccctttcaagaggccattgtctttgtagtagggggagggaattacatcgagtatcagaatttggtggactatataaaaggcaaacagggcaaacatattctgtacggatgtagcgagctcttcaatgctacccagtttatcaagcaactctcccagctagggcaaaagtag

SEQ ID NO: 45746 - DNA, 1728 bp, Artificial Sequence
  Description of Artificial Sequence: Synthetic coding sequence
atgggcatcaccctgcacctgctgctgcacagcgaccgggaccccattcccgatgtacccgccgtatattttgtgatgcccaccgaggagaatattgatcgtatgtgccaggatttaaggaaccaattatatgaaagctattacctgaatttcatttcagcgatctcaaggtctaagcttgaggatatagctaatgctgcactggcagcgagcgccgtgactcaggttgctaaggtgttcgaccagtatcttaactttataacgcttgaagatgatatgttcgtactgtgcaaccagaataaagagttggtgtcctacagagcgattaacagacccgacattacagatacggagatggaaactgtaatggacactattgtcgacagcctgttctgcttcttcgtcaccttaggcgccgtccctatcatccgatgttctagagggactgcagctgagatggtggctgtgaaactcgataagaagctgcgagagaacctgcgggatgccaggaactccctgtttacaggagacacgctgggggctggccagttctccttccaacgacccttactcgtccttgtggatcgcaacattgaccttgctactcccctgcaccatacgtggacttaccaggctttggtgcacgacgtgctggactttcacctaaaccgggtgaaccttgaggagagcagtggggtggaaaatagccccgccggcgcccggcctaaaaggaaaaataagaaatcttacgacttaacaccggtggacaagttttggcagaaacacaaaggctctccttttcccgaggttgcagaatccgtgcaacaagagcttgagtcttaccgggctcaggaggacgaggtaaaaaggctgaagagtattatgggattggagggcgaggacgaaggggccataagtatgctgtccgacaacaccgccaagctgacctctgctgtgtcatctttgcccgaattactggagaaaaagcgcctgatagatctgcataccaatgtcgctacagctgtgcttgagcatattaaggctcgaaaactagatgtgtacttcgagtatgaggagaagattatgagtaagaccaccctggataagagccttctggatatcatctcagatccggacgcggggacgcccgaggataagatgagactgttcttgatttactatatttcaactcagcaagcacccagcgaggctgacttggagcaatacaagaaggcactcaccgatgctggatgcaatctgaaccccctgcaatacatcaaacagtggaaagccttcaccaaaatggctagtgcccccgcatcttacggctcaaccactacaaagcccatgggactactcagtagagttatgaatacaggcagccagttcgttatggaaggcgtcaagaacctggttctcaaacagcagaacttgcctgttacaagaattttggataatctcatggaaatgaagtccaatccggaaactgatgactaccgatactttgatcctaagatgttgaggggcaatgactcgtccgttcctagaaataagaatccatttcaggaagctattgttttcgtggttggtggcgggaattacatcgagtatcagaacttggtagactacattaaaggaaaacagggaaagcacatcctgtacgggtgctctgagctgtttaatgccacccagtttataaaacagctttcccagctcggtcagaagtag

SEQ ID NO: 45747 - DNA, 540 bp, Artificial Sequence
  Description of Artificial Sequence: Synthetic coding sequence
atgctgagcctggacttcctggacgacgtgcggcggatgaacaagcgccaactgtattatcaggtactaaattttggtatgattgtttcttctgctctaatgatatggaaggggttaatggtcataaccggatcggagtcaccaatcgtggtggttctttcaggttccatggaacctgcgttccatcgcggggatctgctgttcctgacgaatcgagtcgaagacccaattcgggtgggcgagatcgtggtgttccgaatcgagggtagggagatcccaattgtgcaccgggtcctgaagatacacgaaaaacagaacgggcatatcaaatttttgacaaagggcgataacaacgcggtcgacgaccgaggcttgtataagcagggacagcactggttggaaaaaaaggatgtagttggaagggcaagggggtttgtgccatacataggcatagttacgattctgatgaatgattacccgaagttcaagtacgcggtcctgttcttgctgggcctcttcgtgcttgtacatcgagagtag

SEQ ID NO: 45748 - DNA, 462 bp, Artificial Sequence
  Description of Artificial Sequence: Synthetic coding sequence
atgatcgtgagcagcgccctgatgatctggaagggcctgatggtgatcactggcagtgaaagtcctatagtcgttgtcctaagcgggtctatggaaccagcctttcacagaggagacctcttgtttttaacaaaccgagtggaagatcccatccgtgtgggagagattgtggtgttcaggatcgaggggagggaaatccccatcgtccacagggtgctgaagatacacgagaaacagaacgggcacatcaaattcctgacaaagggcgataataacgctgtagacgataggggactgtataagcaaggtcaacactggctggaaaaaaaagacgtggttgggagagctagggggtttgtcccttacatcgggatagtgacaattctcatgaacgattaccccaagtttaagtacgcagttctcttccttctggggcttttcgttctcgtgcaccgcgaatag

SEQ ID NO: 45749 - DNA, 579 bp, Artificial Sequence
  Description of Artificial Sequence: Synthetic coding sequence
atggtgcgggccggcgccgtgggcgcccacctgcccgccagcggccttgacatctttggagaccttaagaaaatgaataaaagacaattgtactaccaggtgctgaacttcgccatgattgtgagttccgccttgatgatctggaaaggactgattgtgctgaccggctctgagtcccccattgtcgtggtgctctcaggctctatggaaccagcctttcaccggggcgacctgctatttcttactaactttcgggaagatcccattagggctggggaaattgtagtgttcaaggtggagggccgcgatattccgatcgtgcaccgagtcattaaagttcacgagaaagataacggggatataaaatttttaactaagggggacaacaatgaggtggacgatagaggcctttataaggagggccagaattggttggagaaaaaggacgtcgtcggccgcgcccgaggttttttgccttatgtgggcatggttactatcattatgaacgactaccctaagtttaagtacgctttactggctgtgatgggagcttacgtgctacttaaacgcgaatcatag

SEQ ID NO: 45750 - DNA, 471 bp, Artificial Sequence
  Description of Artificial Sequence: Synthetic coding sequence
atggtgcgggccggcgccgtgggcgcccacctgcccgccagcggcttggacatctttggggacctcaaaaaaatgaacaaacgacaattatattaccaggttttgaatttcgccatgatagtgtctagcgcgctgatgatatggaaagggctgattgtcctgaccggtagcgagtcaccaatagtggtggtgttatcggggtctatggagcctgcatttcacaggggagatctgctgtttctgacaaacttccgggaggacccaattcgagcaggagaaattgtcgtgtttaaggtggaaggccgagatatccccattgtgcatagggtaatcaaggtacacgaaaaggataatggagatatcaaattccttactaagggggacaataacgaagtggacgatagaggattatataaagaaggccagaattggctcgaaaaaaaagacgtggttggtcgggcccgcgggtag

SEQ ID NO: 45751 - DNA, 579 bp, Artificial Sequence
  Description of Artificial Sequence: Synthetic coding sequence
atggtgcgggccggcgccgtgggcgcccacctgcccgccagcggcttggacatcttcggggacttaaaaaaaatgaataaacggcagttgtattatcaggtgttaaattttgctatgattgtatccagtgccctaatgatctggaaggggcttatcgtcctgactggatcagagtccccgattgtggtggttctctcaggatcaatggagccagcatttcaccgcggcgatttgctgtttctgacaaattttcgagaggaccccattcgggctggcgagatcgtcgtttttaaggtggaggggcgggacattcccattgtccaccgtgtgataaaagtgcacgagaaggataatggagacataaagtttcttactaagggggacaacaacgaggtggacgaccggggtctctacaaagagggtcaaaactggctggaaaagaaagatgttgtgggacgggcgcgaggttttctgccctacgttggtatggtcacaattattatgaatgactaccctaagttcaagtatgcactgctggccgtcatgggggcctacgtcctgctgaagagggagtcatag

SEQ ID NO: 45752 - DNA, 2091 bp, Artificial Sequence
  Description of Artificial Sequence: Synthetic coding sequence
atggaggccagcgtgatcctgcccatcctgaagaagaagctggccttcctctctgggggcaaggatagacggtcggggttaatcctcactatcccgctatgtctcgaacagactaacatggacgagctgtcggtgacattggactatctgttgagcattcctagtgaaaagtgtaaagcccgtggatttaccgtgattgtggacggacgcaaatcacaatggaacgtggtgaaaacggtagtcgttatgctacagaatgtggtacccgccgaagtgtccctggtgtgcgtagtgaagcccgacgagttctgggacaaaaaggttacccatttttgtttttggaaagagaaggacaggctggggtttgaggtcatcctggtaagcgcaaacaagcttactaggtacattgagccctgccagctgacagaggactttggaggctctctcacgtatgatcatatggactggctgaataaacggctggtgtttgaaaagttcacaaaagagtctaccagcctactggatgaactcgcgcttattaacaacggaagcgataagggcaaccagcaggaaaaggaacgttccgtcgaccttaacttcctgcctagtgtggaccctgagacggtgctgcagactgggcatgagcttctgtccgagctgcagcagcgccgatttaatggttccgacggtggggtgagttggtcccccatggacgatgagctgctggcccagcctcaggtaatgaagctgcttgactcactgcgcgaacagtacaccaggtaccaggaggtttgtcgtcagcgcagcaagcgtacccagctggaagagatccagcagaaggtcatgcaggtcgtgaattggctggagggtcccggctcagagcagcttcgcgcacaatgggggattggcgatagcataagggcatctcaggccctgcagcagaagcatgaagaaattgaaagccaacactctgagtggttcgccgtttatgtcgaactaaaccagcagatcgcggccctcttaaatgctggagatgaagaggatcttgtggaactcaagagtctccaacagcagctaagcgacgtgtgttatcgtcaggcgagccagttggagttcaggcagaacttgttgcaggccgccctggagtttcatggcgtggcccaggatttgtcccagcaactggacggactgctgggaatgctgtgtgtggacgtcgcccccgccgatggcgcttccatccagcaaaccctgaaactgctggaagaaaaactgaagagtgttgacgtcggactccaggggttgcgcgagaagggtcaaggcctgctggatcagatatctaatcaggcgtcgtgggcatacggcaaagacgtcactatcgagaacaaggagaacgtggatcacatccagggcgtcatggaagatatgcagctgcgcaaacagagatgcgaagacatggtcgatgtacgccgactcaagatgctccagatggtgcagctttttaaatgcgaggaggatgccgctcaggcagtggagtggctctctgagcttctggatgccctacttaagacgcacatcagattgggagatgacgctcaggagacaaaagttctgctggagaagcataggaagttcgtggacgtagcacagagcacctacgactacggtagacagctgctgcaggcgactgtggttttgtgtcaatcattacggtgtacatccagatctagtggtgatacactcccccggttaaatagggtgtggaaacagtttaccattgcgagcgaggaacgagttcatcggctcgaaatggccatcgcctttcactcaaatgctgagaagattcttcaggattgcccagaggaacccgaggctattaacgatgaggagcagttcgatgaaatcgaggccgtgggtaaaagcttgctggatagacttaccgtacctgttgtgtacccagatggaactgaacagtacttcggttctccttcggatatggcgagtactgctgaaaatattcgggaccgcatgaagctagtcaatcttaagcggcagcagctgaggcatcccgagatggtgaccacggagtcctag

SEQ ID NO: 45753 - DNA, 432 bp, Artificial Sequence
  Description of Artificial Sequence: Synthetic coding sequence
atggaggccagcgtgatcctgcccatcctgaagaagaagctggccttcctgtccggaggtaaggaccgcaggtcaggactcattcttactatacccttgtgtttggaacaaaccaacatggacgagctgtctgtgacccttgattacttgcttagcataccctcagaaaagtgtaaggccaggggctttaccgttatcgtagacggaaggaagagtcaatggaatgttgtaaaaacagtcgtggtgatgcttcagaacgtggtcccggcagaagtctctctcgtctgtgtagtcaagcccgacgagttttgggataaaaaagtgacacatttctgtttttggaaggagaaagaccgactggggttcgaggtcattctggtttcagcgaataaactaacacgttatatcgaaccctgtcaactaaccgagtag

SEQ ID NO: 45754 - DNA, 441 bp, Artificial Sequence
  Description of Artificial Sequence: Synthetic coding sequence
atggaggccagcgtgatcctgcccatcctgaagaagaagctggccttcctttcaggaggcaaagatcggcgctcaggcctcatacttacgatccccctatgtctcgaacagaccaacatggacgagcttagcgttacactcgactacttgcttagtattccaagcgaaaaatgcaaggcacgcgggttcactgttattgtggacggtaggaaatcacaatggaatgttgttaagaccgtggttgtgatgttgcagaacgtcgtgccagccgaggtgagcctggtgtgtgtggtcaaaccggacgaattctgggacaagaaagtgacccacttctgcttttggaaggagaaagatcgtctcggctttgaagttattcttgtaagtgcaaacaagcttaccagatatattgagccttgccaacttaccgaagacttcggatag

SEQ ID NO: 45755 - DNA, 2160 bp, Artificial Sequence
  Description of Artificial Sequence: Synthetic coding sequence
atggtgcagaagtaccagagccccgtgcgggtgtacaagtaccccttcgagctgatcatggctgcctatgagaggcgttttccgacctgcccactcatcccgatgtttgtgggcagcgacaccgtgaatgagttcaagagcgaggatggggctatccacgtgatcgagcgcaggtgcaaactcgacgtggatgctccacgcttgctaaaaaagatcgccggagtagactatgtctattttgttcaaaagaatagcctcaactcccgggaaagaaccttacatatcgaagcctacaacgagaccttctccaaccgggttattatcaacgagcactgctgttacaccgtgcatccagaaaatgaagactggacctgttttgagcagtcagcgtctctggatattaagtctttctttgggtttgagagcactgtggagaaaattgctatgaaacagtacacttctaacattaagaaaggcaaggaaataatcgaatactacctcaggcagcttgaggaggaaggcattactttcgtccctcgctggtccccaccctcaatcaccacaagctctgagacatcctccagctcgagcaaaaaacaggctgcctccatggccgtggtgatcccagaggcagcgttgaaggagggactgtccggcgatgctttgtcatccccttccgctcccgagcctgtcgtggggacacctgatgacaagctggacgccgactacatcaagcggtacctgggcgaccttacacccctccaggagtcctgcctgatccgtctgcgtcagtggcttcaggaaacccacaagggcaagatcccaaaagatgagcacattctgcgtttcctgcgggctagagacttcaacattgataaggctagagagatcatgtgccagagcctgacgtggcgcaaacagcaccaggtggattatattttggaaacttggactccaccgcaggtgctccaggactactatgccgggggctggcaccaccatgataaggacggacgacccctgtatgttctgagattaggtcaaatggatacaaaaggtctcgtcagagctctgggcgaagaagccttactccggtatgtcctgagtatcaatgaagagggccttagacgctgtgaggagaacactaaagtgttcggtcgtccaatctcatcatggacgtgtctggtcgatcttgaaggcctcaatatgagacacttgtggaggcctggggtaaaggctttgctccgtatcattgaagtcgttgaggccaactatccagagaccctcggcagactgttaattttgcgcgccccgagggtgtttccagttctgtggacactcgtcagtccattcatagatgataatacccggcgcaaatttcttatctacgccggaaatgactaccagggcccaggtgggttgctcgactacattgataaagaaattatccccgatttcttaagtggggagtgtatgtgtgaagtgccggaaggcggccttgtgcccaaatctctttaccgaacagccgaggagctggagaatgaagatctgaagttgtggaccgaaaccatttatcagtcagcttcggttttcaagggggctccccatgagatcctgatccagatcgtggacgcgtccagcgtcatcacatgggatttcgatgtatgtaagggggacatcgtattcaacatctatcattccaagaggtctccccagccccctaagaaggactctctaggagctcattcaattacatcccccgggggaaacaacgtccaactgattgataaagtgtggcagctaggaagagactactctatggtagagtctcctttaatttgcaaagagggcgagagtgtgcagggcagccatgtgacccgctggcctggtttctacatactgcagtggaagttccacagtatgcccgcctgtgctgctagctccctaccacgggtggacgacgtgctggcatcactccaagttagcagtcataaatgcaaggttatgtattacacagaggtgatcggaagcgaggacttccgcggttcaatgacctccctcgaaagctcccactctggtttcagccagctctcagcagccacaaccagcagctcacagtctcactcttcctccatgattagtcgctggaggttttgctag

SEQ ID NO: 45756 - DNA, 2148 bp, Artificial Sequence
  Description of Artificial Sequence: Synthetic coding sequence
atggtgcagaagtaccagagccccgtgcgggtgtacaagtacccctttgaattgatcatggctgcatatgaaagacgttttccaacgtgccctctgattccgatgttcgttggaagtgacacagtgaacgagttcaaaagcgaggacggagccatccacgtgatcgaacgccggtgcaagctggacgtggacgcccccagactgctcaaaaagatcgctggtgtggactacgtgtacttcgtgcagaaaaactcactgaattcccgagaaagaaccctacacatagaagcttacaatgaaacttttagtaatagggtcattattaacgagcactgctgctataccgtgcaccctgagaatgaagactggacttgttttgagcaaagcgccagtctggatatcaagtcttttttcggatttgagtccactgtagaaaaaattgctatgaaacagtatacatccaatattaagaaggggaaagaaatcattgagtactacctacggcaactcgaggaggaaggcatcacattcgtgccccgctggtcacccccatctatcaccacctcgtcagagacctcatccagtagctcaaagaaacaggccgcctccatggctgttgttatccccgaagccgcacttaaagaggggctgtctggcgatgccttaagttctcccagcgctccagaaccagtggttggaacacctgatgacaagctggacgccgattacattaagaggtacctaggcgacctgacccctctgcaagaatcctgtcttatccgccttaggcagtggttacaggaaacccataaaggaaaaattccaaaagacgagcacattctgaggttccttcgcgcacgggactttaatatagataaggcacgcgaaatcatgtgtcagagtctaacctggcgcaaacaacaccaagtggactatattctcgagacctggacgcccccacaggtgctccaggattattatgcaggaggttggcaccaccatgacaaggatggccgccccctgtacgtacttcgccttggccagatggacactaaaggactggtaagagctctcggagaagaagcactgctacggtatgttttatcaattaatgaggagggcctcaggagatgtgaggagaatacaaaggtctttggcaggccaataagctcttggacgtgcttggttgacctcgagggcctcaacatgcgccacctgtggagaccaggggtaaaggcactgttaagaatcatcgaggttgtggaagcgaattatcccgagaccctgggaaggctgcttatactgcgcgcgcctagggtcttccccgtactatggacactggtctcaccctttatcgatgacaacacccgacgaaagttccttatatatgccgggaatgattaccagggacccggcggcttgctcgactatatcgataaagaaattatcccggactttctcagtggcgaatgcatgtgcgaagtgccagagggtggtctggtaccaaaaagtctatatcgtacagccgaagagctcgagaatgaagacctgaagctctggaccgaaactatttatcagtctgcctcagtgttcaaaggggctccacacgagattctgatccagattgtggacgcgagcagcgtgattacctgggatttcgatgtgtgcaagggggatattgtgttcaacatctatcactctaaaagaagtccacagccacccaaaaaggactccctaggtgcccatagcataacttctccaggcggcaataacgttcagctcatcgacaaagtttggcagttgggccgcgactactcaatggtcgaatctccacttatatgcaaggaaggcgagtcagtccagggcagtcacgtcacccgctggccaggcttttatattcttcagtggaaatttcattcaatgcccgcatgcgcagctagctcactcccccgggtggatgacgtgctggctagcctacaggtgtcatctcacaaatgcaaagttatgtactacactgaggtcattggaagtgaggactttcgcggatctatgacaagtcttgagagcagtcactctgggttttctcagctgtccgccgccacgacctcaagttcacagtcccacagctcttccatgatcagccgctag

SEQ ID NO: 45757 - DNA, 2148 bp, Artificial Sequence
  Description of Artificial Sequence: Synthetic coding sequence
atggtgcagaagtaccagagccccgtgcgggtgtacaagtaccccttcgagttaattatggcggcctacgagcgccggtttcccacgtgcccccttatccccatgtttgtcggtagtgatacagtgaatgagtttaagtctgaggacggagcaatccacgttattgagcggagatgcaagctggacgtggatgccccccgcctccttaagaagattgccggagtggactacgtgtatttcgtgcagaaaaactcacttaactctagagagcggacacttcatatagaggcgtacaacgagacgttttctaacagggtgatcattaatgaacactgctgttatacggtacacccagagaacgaggactggacatgtttcgaacaaagcgcatccttggatataaaatcctttttcggctttgagagtacagtggaaaaaatcgccatgaagcagtatacctctaacatcaaaaaaggcaaggagattatcgaatattatctgcgacagcttgaggaagagggcattaccttcgtcccccggtggagtccccccagcatcactaccagttctgagacatcatcctcctcatctaagaaacaagcagcttctatggccgttgtgattccagaggccgcgctcaaggaaggattgtcaggagacgcgctgtcctccccgagcgcaccagaacctgtggttgggacaccagatgataagcttgatgctgactatattaagaggtacctgggcgatctgacaccattgcaggaaagttgtctcatacgactgcgccagtggctccaggagacccataagggcaaaatcccgaaggacgaacacatactgagattcctacgcgcaagggattttaacatcgacaaagctcgggagattatgtgtcagtctctgacatggcggaagcagcaccaggtggactatattcttgagacatggaccccacctcaggtgctccaggattattatgccgggggttggcaccatcacgacaaggatggtcgccctctctacgtgctacgccttggccaaatggataccaaaggcctcgtgcgcgcattgggcgaagaagcgcttcttcggtatgtgttgagtataaacgaggaagggctgaggagatgtgaagaaaacactaaagtttttgggcggcccatttcatcttggacctgtctcgtggatcttgagggactcaacatgagacacttgtggcgtccaggggtcaaagctttgctcagaataattgaggtcgttgaagcaaactatcccgagaccttaggccgccttctcattcttcgggcaccacgggttttccccgtcttatggacactggtctctccctttattgatgataacacaaggcgtaaattcctcatctacgctggaaatgactaccagggcccgggtggattgctggactatatcgataaggagattattccggatttcctgtctggagaatgcatgtgtgaagtgccagaaggagggctggttcccaagagcttatacagaaccgctgaagagctggagaacgaggatctgaaattgtggaccgaaacaatctatcagtcagcctccgtgtttaagggagctccacacgagattctgatccagatagttgatgcttccagcgtcattacttgggattttgacgtgtgcaagggcgatatcgtgtttaacatctatcacagcaagagaagcccgcagcctcccaagaaagattccttaggtgcacactcgataacctcaccaggagggaacaatgtccagttgatagataaagtgtggcagttaggacgcgactacagcatggtagaatcacccctcatctgtaaagagggcgaatcggtgcagggcagtcacgtgacccgatggccgggcttctatattctccaatggaaattccattctatgcccgcctgcgccgcctcctcgctacctagagtggacgacgtgctggcttcactgcaggtcagctcccataagtgcaaggtgatgtactataccgaagtgatcggttctgaagactttaggggaagtatgacaagcttggagtcatcacactcaggtttcagtcagctgtctgctgccacaacttccagctctcagtcccattcgagtagtatgatcagcaggtag

SEQ ID NO: 45758 - DNA, 2046 bp, Artificial Sequence
  Description of Artificial Sequence: Synthetic coding sequence
atgttcgtgggcagcgacaccgtgaacgagttcaagagcgaggacggcgccattcacgtcatagagcgccgctgtaagctggacgtagacgccccaagattgttgaagaaaatcgcaggggtggactacgtttattttgtacagaagaattccttaaactctagagagcggactttgcatatcgaagcctacaatgaaacattttcaaacagagtcatcatcaatgagcattgctgctacaccgtgcaccccgagaatgaagactggacctgttttgagcaatccgcctccctagacatcaagagtttcttcggcttcgagtcaaccgtcgaaaaaatagccatgaagcagtacactagtaacatcaaaaaaggaaaagagattatcgaatattacctgagacagctggaggaagaaggcatcacgttcgtcccgcgttggagcccacctagcatcacgacatctagcgagacatcctcaagttcatccaagaaacaggctgcgtccatggccgtcgtcatccctgaggcagccctgaaggagggcctgtctggagatgcactgtcgtctccctcggcacccgaacccgtggtgggtacacctgacgataagctcgacgctgactacatcaagcggtacctgggtgatctgactccgctgcaagaaagttgcctgatcaggctcagacagtggcttcaagagacgcataaggggaaaatccccaaggacgagcacattctcaggtttcttcgggctagggatttcaatattgacaaggctcgggaaattatgtgtcagtctctgacgtggaggaagcagcaccaggtggactatattctagaaacatggacaccaccccaggtccttcaggactattacgccggcggttggcaccaccacgataaggacggacggccactgtatgtgctccggttagggcaaatggataccaaaggtctcgtccgggcactgggggaggaggcccttcttaggtatgttctgagtataaatgaggagggcctgcggaggtgcgaagaaaacaccaaggttttcggtaggcctatctccagctggacctgtttggtggatctagaaggactaaacatgagacacctctggcggccgggagtcaaagcactgctgagaatcatagaagtggtggaggccaactatccagagactctgggaaggctgttaatcctgcgagccccccgcgtgtttccagttctctggacactggtgagccccttcattgatgacaacactaggcgcaagttcttaatttacgccgggaacgactaccaggggcctggcggcctcctggattacattgacaaggaaattatcccggatttcctttccggcgagtgtatgtgcgaggtgcctgagggtggcctggtgcccaaatctctctatcggactgccgaggagctggagaatgaggatttgaaattgtggaccgagactatctatcagagtgcctctgtcttcaaaggagccccacacgaaattcttattcagatcgttgacgcgtcgagcgtgattacatgggactttgatgtctgcaaaggggatattgtcttcaatatctaccactctaagcgcagcccccagccacctaaaaaagatagcctaggtgcccacagcatcacctcccctgggggcaataatgtccagcttatcgataaagtgtggcagctgggacgtgattacagcatggtcgagagccctctcatctgtaaagaaggtgagagtgtgcagggtagtcacgtgactcgctggccggggttttacatattgcagtggaagtttcacagcatgccagcttgtgcggccagctcactcccccgggtggatgacgtgctcgccagtctccaggtgtcttcccataagtgtaaagtcatgtattataccgaggtcatcgggtctgaggactttcgcgggagcatgactagcctggaatcgtcccattcaggattttcacagctgagtgccgccaccaccagtagtagccaatcgcactcatcaagtatgatttctcgctag

SEQ ID NO: 45759 - DNA, 2148 bp, Artificial Sequence
  Description of Artificial Sequence: Synthetic coding sequence
atggtgcagaagtaccagagccccgtgcgggtgtacaagtacccctttgaacttattatggccgcatacgagcgccgattccccacctgccccctgatccccatgttcgtcgggagtgatacggtgaacgaattcaaatccgaagatggggcaatccatgtcattgaaagacggtgtaaactcgacgtggatgctccacgcctgctcaagaaaattgctggagtggattacgtgtacttcgtgcagaaaaactcactgaacagccgagagcggacactgcatatcgaggcctataatgagactttctcgaatagggtgattatcaacgagcattgctgttacactgtgcatccggagaacgaggactggacctgctttgagcagtcagcatccctcgatatcaagtccttctttgggttcgaaagtacagtagagaaaatcgctatgaagcagtacacctctaacatcaaaaaaggaaaggaaataatcgaatactacctgcgacagttggaggaagagggtatcactttcgtgcctcgctggtcgcccccaagcatcacaaccagttcagagacctccagcagtagcagcaaaaagcaggccgccagtatggcagttgtgattcctgaagccgctctcaaagagggtctcagcggagacgcccttagctcgccttccgcacccgagcccgtcgtggggacgcctgacgataagctggacgccgattatattaagcggtacttaggagatctgaccccgctccaagagtcctgcctgatcagactgcgacagtggctgcaagagactcacaagggcaaaattcctaaagacgaacacattctgcggttcctgagggctagggatttcaatatagacaaggcccgagagattatgtgccagagcttgacctggcggaagcagcaccaggtggactacatcctcgagacatggacccctccacaggtcttacaagattattacgcagggggatggcaccaccatgacaaggatggccgaccactctatgtccttcggctcggccaaatggacacgaagggcctggtgagagctctgggggaggaggcgttgctgaggtatgtcctctctatcaatgaagaggggctgaggcgctgtgaagaaaatactaaggtgttcggtcgcccaatcagtagctggacctgtctagtcgatctagaggggcttaacatgaggcacctatggcgaccgggcgtgaaagcgttactgaggatcatcgaggtcgtggaggctaattatcctgagactctgggaaggctgctcatcttacgtgcccctcgcgtattccccgtcctgtggacactggtgagtccattcatagacgataatacccggcgcaaattcctgatctatgcgggcaacgactaccagggacctggggggctgctcgactacatcgacaaggagattatcccagactttcttagtggcgagtgcatgtgcgaagtgccagagggtggccttgtgcctaagtccctgtatagaaccgctgaggaacttgaaaatgaggacctgaagctatggactgaaaccatctatcagtctgcgagtgtcttcaaaggagcccctcatgaaatccttatccagatcgtggatgcctcatctgtaatcacttgggacttcgacgtttgcaaaggtgatattgttttcaatatctatcattcaaaacggtctccccaacctcccaagaaggatagcctgggcgcccattcgatcacctccccgggcggcaacaatgtgcagctcatagataaggtctggcagttgggccgcgattatagcatggtggagagtcccctcatctgcaaggagggcgagagcgtgcaagggtcccacgtgacacgctggccaggattttatatattacagtggaagttccacagcatgcccgcctgcgcagcctctagtctccctagagtcgacgacgtccttgcctctttgcaagtatcctcccacaagtgcaaagtgatgtactacacggaggttattggatctgaagatttccgagggtccatgacatccctggaaagctctcattcaggcttcagtcagttgtctgctgcaactacaagcagctcccagtcgcacagctcctccatgattagcaggtag

SEQ ID NO: 45760 - DNA, 2160 bp, Artificial Sequence
  Description of Artificial Sequence: Synthetic coding sequence
atggtgcagaagtaccagagccccgtgcgggtgtacaagtacccctttgagctgataatggctgcctacgagagacgattcccaacttgcccccttattccaatgttcgtcggctctgatacggtgaacgaattcaagtcagaggatggcgcaatccacgttattgagcggcggtgtaaacttgacgtggacgcccccagattactgaagaagattgccggagttgactacgtgtacttcgtccaaaagaatagcttaaactctcgtgagagaactctccatatcgaggcttataatgagacctttagcaatagagtcatcattaacgagcattgctgttacacagtgcaccccgagaacgaggactggacctgtttcgagcagagcgcgtctttggatataaaatcatttttcggttttgagtcaacagtcgaaaagatcgccatgaagcagtacacttctaatatcaaaaaagggaaagaaattattgagtactacctgaggcagttagaggaggagggtataactttcgtcccccgctggagtccgcctagcatcacaacttcctccgagacttcctcaagcagttcaaagaaacaggctgcttcaatggctgttgtgatccccgaggcagccctgaaagaagggcttagtggagacgccctatccagcccctcggcacctgagccagtggtcggcaccccggatgacaagctggacgcagattacattaagcgttatttgggagatctcacacccctccaagagagctgtcttatacggctccggcaatggcttcaggagacgcacaagggcaagatccccaaggacgaacatattttacgctttctaagggcccgggacttcaatatcgataaggctcgggaaatcatgtgccagtccctcacctggcggaagcagcaccaggtggattacatactggagacctggactcccccccaggtactccaagattactacgctggtggatggcaccaccatgacaaagatgggcggcctctgtacgtgcttagacttgggcagatggataccaagggtctagtcagggctctcggcgaagaagctctcttgcggtacgtcctctcaattaacgaggagggtctgcgacgctgcgaggagaatactaaggtgtttggtagacccatctcatcctggacatgcttggtggacctcgaaggacttaacatgcgccatctttggcgccccggagttaaggccctgttacgcatcatagaagtcgtcgaagccaattacccagagacactggggcgccttctgattcttagagctccacgggtctttccagttctttggacactggtgtctccattcatcgacgataatacacgtagaaagtttctgatatacgccggcaacgactaccaggggccgggcgggctcctggactacatcgacaaggagataatccccgatttcctttccggcgaatgtatgtgcgaagtccctgagggaggcttagtgcccaagtctttgtatagaacagcagaagagctcgagaacgaggacctgaagctgtggaccgagacaatctatcagtccgcgtcagtcttcaaaggagctccacatgaaatcctcatccagatagtagatgcttcctctgtgattacttgggatttcgatgtatgtaaaggggacatcgtctttaatatctatcattccaagcggtccccacagcctcctaagaaggattcccttggcgcacactctataacctctccaggcggaaataacgtgcagctgattgacaaggtctggcagctcgggcgcgactactccatggttgagtcccccctgatatgcaaagaaggtgagtcggtccaaggctcacatgtgaccagatggcctggattttatatattgcaatggaagttccactccatgcctgcttgcgctgcctcctctttgcctagggtggatgatgtactggcctcccttcaggtttcgagccacaaatgtaaagttatgtattatacagaagtgattgggtcagaggactttcggggctcgatgacttcacttgagagctcccactctgggttttctcagctcagcgcagccacgacatcctcgagccagtctcactcgagcagcatgattagcaggtggcggttttgctag

SEQ ID NO: 45761 - DNA, 2091 bp, Artificial Sequence
  Description of Artificial Sequence: Synthetic coding sequence
atggtgcagcggtaccagagccccgtgcgggtgtacaagtacccctttgagctggttatggctgcctatgaaaagcgctttccaacatgcccacaaataccagtattcctcggtagcgaagtcctccgggaaagccgctctcccgacggagctgtgcatgtggttgagcggtcctgcagactgagagtggacgctccgaggttactgcgcaagattgccggggtggaacatgtggtatttgtccagacaaatatcttaaattggaaagagagaacgctgctaatcgaagcacataacgagacattcgccaatcgcgtggttgtaaacgagcactgttcttatactgtgcatccggaaaacgaggattggacttgctttgagcagagcgcctcactggatattcgttcattttttggcttcgaaaacgcactggagaaaatagctatgaagcagtacacagccaatgttaagcgcggcaaggaggtgatcgaacattacctgaatgaactaatctcacagggtaccagccacattcctaggtggaccccggcacccgtgcgggaggaggacgctaggaatcaagcggggccgcgtgatccatcctcactcgaagctcacggaccacgatccacactgggaccagccctggaggccgttagcatggacggtgacaagctggatgctgattatatcgagcggtgtctgggccatctaacacccatgcaggagagttgtctgattcaactgcgacattggctgcaggagacccataaagggaagatccccaaagatgagcatatccttcgcttcctgagggcccatgactttcatctcgacaaggccagagaaatgttgaggcagagccttagctggcgcaaacagcaccaagttgacttattgttgcagacgtggcagccacctgcactgctcgaggagttttacgccggcgggtggcactaccaagatattgacggcagaccattgtatattctgcgattagggcaaatggacacaaaaggtttaatgaaagccgtgggtgaagaagccctcttgaggcacgttttgtccgtgaatgaggaaggccagaaacggtgcgaaggttctactaggcagctgggacggccaatatcctcctggacatgtctgcttgacctggagggtttgaacatgcgccacttatggaggccaggcgttaaggccctactcaggatgattgaagtagtcgaggacaactatccggaaacactgggccgactcttgattgtgcgggctccaagggtttttcccgtgctgtggaccttgataagcccgttcataaacgaaaacaccaggcgaaagtttcttatatactcagggtctaactatcagggccctgggggccttgttgattatctggatcgggaggtgattccagattttcttggtggagagtcggtatgcaacgtgccagagggtggcctggtgcctaaatcactgtatatgaccgaagaggaacaggagcacaccgaccaactgtggcaatggtcagaaacatatcactcagcatccgtgctacgcggagccccacacgaagtggctgtggagatcctggagggagaaagtgtcattacctgggatttcgatattttgcgcggtgatgtggtgttctccctgtatcacaccaaacaagccccccgactcggtgctagagaacctggcacacgcgcgtctggacagttaattgacaagggctgggttcttggtagagattattcccgcgtggaagccccgctggtttgccgggaaggggagagcattcagggaagtcacgtgacgaggtggcccggggtgtacctcctccagtggcaaatgcacagtcctccaagctcagtcgcctgctctctccctggggtggacgacgtcttgaccgctttgcacagccctgggcccaaatgtaagcttctttactactgcgaggtgcttgcaagcgaggatttcaggggatctatgagcagcctggagtcttgtacaagtggattcagccagctgtccgctgccacctcttctagtagcagcggccaatctcactcctccagcctggtgagtcggtag

SEQ ID NO: 45762 - DNA, 912 bp, Artificial Sequence
  Description of Artificial Sequence: Synthetic coding sequence
atgagcgtgatcttcttcgcctgcgtggtgcgggtgcgggacggccttcccctcagcgcaagcaccgacttttaccacacgcaagattttctggaatggcggaggaggctgaagagtctcgctctgcgactggcacagtaccccggtcgcggctcagccgaaggctgcgattttagcatccacttctctagttttggcgatgttgcctgtatggccatttgttcctgtcagtgccccgccgccatggcattctgtttccttgagaccctctggtgggaattcaccgcctcttacgacaccacatgtataggtcttgccagtagaccttatgccttcctcgagtttgattccatcatccagaaagttaagtggcatttcaattatgtctcctcatcccagatggaatgcagtctcgagaaaattcaagaagagcttaaattacaaccgcctgctgtcctgactctggaggatacagatgttgccaatggagttatgaatggccacacccccatgcacctggagcccgctcccaatttccgaatggaacccgtcaccgccctggggattctcagcctgattttgaatatcatgtgcgctgctctgaacctgatccggggagtgcacttagctgaacacagtctgcaggtggcgcacgaggagatcggtaatattcttgcatttttggttccctttgtggcatgtatttttcagtgttacctgtacctgttctattctccagccaggactatgaaggtggtgttgatgcttctgttcatctgtctgggtaacatgtatctccatggcctcaggaacctgtggcagatactgtttcatataggtgtggcgtttctaagttcataccaaatcttgacgagacagttgcaagagaagcaaagcgactgcggagtctag

SEQ ID NO: 45763 - DNA, 753 bp, Artificial Sequence
  Description of Artificial Sequence: Synthetic coding sequence
atgagcgtgatcttcttcgcctgcgtggtgcgggtgcgggacggcctgcccctgtctgcctctacggacttctaccacacacaggactttctggagtggcgaagaaggctgaagtccctggccctgcgccttgctcagtacccaggacgcggctccgccgaggggtgtgatttcagcattcacttttcttccttcggagatgtggcatgcatggcgatttgttcctgtcaatgtcccgccgcgatggcattttgcttcctggaaacattatggtgggaattcacagcgagttacgataccacatgtatcgggctggcatcgagaccctacgccttcctagagttcgatagcatcatccaaaaagtgaagtggcatttcaattatgtctcatcatcccagatggaatgttccctggaaaagattcaggaagaacttaagctgcagcccccagccgtgctcactcttgaagacaccgatgtggcgaatggggttatgaacgggcacactccgatgcacctggagccagccccgaactttcggatggaaccggttacagccctggggatcttaagcctgatcctcaatataatgtgcgctgctctgaacctgattcggggtgtgcacctggctgaacattcactgcaagtggcacacgaggaaatcggaaacatcctggcctttctggtaccttttgtggcttgcatctttcaggaccctagaagctggttctgttggctagatcagacctcttag

SEQ ID NO: 45764 - DNA, 753 bp, Artificial Sequence
  Description of Artificial Sequence: Synthetic coding sequence
atgagcgtgatcttcttcgcctgcgtggtgcgggtgcgggacggcctgcccctctccgcgtcgaccgatttctaccatacccaggattttctggagtggaggagaaggttaaagtcactggcgctgaggctggctcagtacccggggcggggttctgctgaaggctgtgacttttcaatacatttcagcagcttcggtgatgtagcatgtatggccatttgctcttgtcaatgtccagcagcaatggctttttgctttctcgagaccctgtggtgggagtttaccgcctcttatgacactacctgcatcggactagcaagtcggccctatgccttcctggagtttgattcaattatacagaaagtcaagtggcactttaactacgtgagcagttctcagatggagtgttcactagaaaagatccaggaagagttgaagttgcagccacccgcagttctgacgttggaagatacagatgttgccaatggggtgatgaacgggcatactccgatgcacctcgagccagctcccaatttccggatggaacctgtgaccgcattaggcatattaagtttaatattaaacatcatgtgcgctgccctcaatctgattagaggcgtgcatctagccgagcacagcttgcaggttgcccacgaagagattggaaatatcctggcatttttggttccctttgtcgcctgcattttccaggatccccgtagctggttctgctggctggaccagacctcatag

SEQ ID NO: 45765 - DNA, 687 bp, Artificial Sequence
  Description of Artificial Sequence: Synthetic coding sequence
atgagcgtgatcttcttcgcctgcgtggtgcgggtgcgggacggcctgccccttagtgcttctaccgatttctatcacacccaggattttctagagtggcgtagaagactgaagtcactggccttgagactggctcagtaccctggaaggggatcagccgaaggctgtgattttagtatccattttagttcttttggggacgtggcctgcatggccatctgctcctgccagtgccctgcagccatggctttttgtttcctggagacgctgtggtgggaattcactgcctcttacgacactacctgtatcggactcgcgtcccgaccatacgccttccttgaattcgatagcatcatccagaaagtgaaatggcattttaactacgtatcaagtagtcagatggaatgtagcctagagaaaatccaggaagagttgaaactgcaaccacccgccgtcctgaccctcgaagacactgatgtggccaatggcgtgatgaatggacatactccaatgcacctggaacccgctcccaatttcaggatggagccagtgacggctctgggtattttatccttaattctgaatattatgtgtgcagccctgaatctgatccgcggcgtccacctcgctgagcatagtctgcaggatcctcgctcctggttttgttggttagaccagacttcctag

SEQ ID NO: 45766 - DNA, 543 bp, Artificial Sequence
  Description of Artificial Sequence: Synthetic coding sequence
atggccatctgcagctgccagtgccccgccgccatggccttctgctttctggaaaccttatggtgggagttcacagctagttatgacactacctgcatcggactcgccagtcggccgtacgcctttctggaattcgatagcataatccagaaggttaagtggcatttcaactatgtgagttcctctcaaatggagtgtagtttggaaaagatccaggaagaactaaagctccagccaccggcagttttgacattagaggataccgatgtggcaaatggcgtcatgaatggacatacccccatgcacctggaaccggctcccaacttcaggatggagccagttaccgccctgggaatcctgagcctgattctgaacattatgtgtgcagcgctcaacctgataagaggcgttcaccttgcagaacactccttgcaggtcgcgcatgaggaaataggaaatatcctggctttcttagttccgtttgttgcatgtatttttcaggatccacgcagctggttttgttggctcgaccaaacctcctag

SEQ ID NO: 45767 - DNA, 1842 bp, Artificial Sequence
  Description of Artificial Sequence: Synthetic coding sequence
atgagccagcccggcatccccgccagcggcggcgcccccgccagcttgcaggctcagaacggggccgcactggccagcggtagcccatacactaacggcccagtccagaatgctctactaagtagccaagagtctgtatctcagggatacaacttccagttgccaggatcgtatccacacccaatccccgccaaaacactgaatccagtctccgggcagagcaactacggggggtcccagggatccgggcaaaccctgaacaggccccccgttgcgtcaaatcccgttaccccttctctgcacagtggaccagccccccggatgcctctcccagccagtcagaacccagcaacaacaccaatgcctagcagttcatttctaccggaagccaatcttccccctcccctcaactggcagtataactaccccagcactgcgagtcaaacaaatcattgtcccagagcctccagtcagcccactgtaagtggcaatacatctttgactactaatcaccagtacgtaagctccggataccccagcttacagaattcattcatcaaaagcgggccgtcggtccctcccctggtgaatccacccctacccaccacgtttcagcctggcgctccacatggtccaccacccgcaggcgggcccccccctgtccgagcactgactcctcttacctcctcctaccgggatgtcccccagcccctctttaactcagccgtcaatcaggaaggcattacttcgaacactaacaacggctctatggtcgtgcactctagttacgacgagatagaaggtggcggattgcttgccacgccccagctaaccaacaaaaatccaaagatgtcccgatctgtgggctatagttaccctagtctgcccccaggttatcagaatactaccccacccggggccactggcgtccctccgtcctctctcaattatcccagtgggccacaggctttcactcaaaccccgctaggcgccaaccacttaactacaagcatgagcgggctgtccttgcagccagagggcctgagagtagtcaacctgttgcaggaaaggaacatgcttccttccacacccttgaagcctcctgtaccaaatctccatgaagatatacaaaaactcaattgcaatcctgagctgtttagatgcacattgacctcaatcccacaaacgcaggcgctgctcaataaggccaagctcccgttaggtctcctactccacccttttaaagacctcgttcagctcccagtagtcaccagcagtacaatagtgcggtgtcgatcctgtcgtacatacattaacccatttgtctcctttctggaccagcgtaggtggaagtgcaacctatgctatcgcgttaatgatgttccggaagagtttctgtataacccactgacacgggtgtatggcgagcctcatcggcgtccagaggtgcagaatgctactatcgaattcatggcaccatctgagtatatgctcaggccgccacagccccccgtctatctgttcgttttcgatgtgtctcacaacgctgtggaaactggatacctgaactcagtgtgtcagtccctgttagacaacctggatcttctgcctggcaatacaaggacgaaaattggcttcataacctttgattcaacaatacatttttacggcttgcaggagtctctgtcccaacctcagatgctgatcgtgtcagacattgaggacgtgttcatcccaatgcctgagaatctgctggttaaccttaacgagtccaaggaaagcgtaataggcgtctcgagcgaggagacgctaattacatgcctggaaatagcaatgagatag

SEQ ID NO: 45768 - DNA, 3282 bp, Artificial Sequence
  Description of Artificial Sequence: Synthetic coding sequence
atgagccagcccggcatccccgccagcggcggcgcccccgccagcctacaggctcagaacggcgcggccctcgcctccggctctccctacacaaatgggcccgtccagaatgcattactgtcaagccaggagtctgtgagtcaaggatataattttcaattgccggggtcttatcctcaccctataccggccaagacactgaaccctgtgtctggacagtctaactacggaggaagccagggatctggccagacactcaacagacctcccgtcgcatcgaaccctgtaactccttccttacacagcggccccgcgccccgcatgcctctgccagcatcacaaaacccggccaccacgccaatgccttccagtagttttctgccggaagcaaacctgcccccccccctgaattggcagtacaattatccctcgaccgcatcgcagactaatcattgcccaagggcatcctctcaacctaccgtaagtggcaatacatcccttacaacaaaccaccagtacgtctcctccggttatccgtcccttcagaattcttttataaaatcaggacctagtgtccccccacttgtgaacccgccactgcccaccactttccagccaggcgcaccgcatggcccacccccagccgggggacccccacctgttagagctctgaccccactgacttcctcttaccgggacgttcctcagcctctcttcaactccgcagtgaaccaggaggggatcacctccaatacaaacaacgggtctatggtcgttcacagtagctacgatgagatcgaaggaggcggccttcttgccactccacagttgacaaataagaaccctaagatgtcaagatcggtgggatactcttatccatcactgccacctggataccagaacaccactcccccaggcgctacaggcgttcccccttcctccctgaactacccctccggtccacaagccttcactcagaccccactcggtgccaaccacctcacaacttcaatgagtggtctctctctccagccagagggccttagagtggtcaatctgctgcaagagaggaatatgctgccaagcacgcctctgaagccacctgtccccaacctgcatgaggacatacaaaagctcaactgtaatcctgaactgtttcgctgcacccttacatcgatccctcagacacaagcccttctgaataaagccaagcttccactgggccttcttctacatcccttcaaggacttagtgcaactgcccgtggtaacctcgagcacaatcgtacggtgtagaagttgccggacttatattaatccctttgtgagcttcctcgatcagcgccggtggaaatgtaacctgtgttaccgagtgaacgatgttccagaggagttcctgtacaatccgctgaccagggtgtatggcgagcctcaccggcggccggaggtacaaaacgcaacaatagagtttatggctcccagtgaatacatgctacgccccccgcagcctccagtatacctcttcgtgtttgacgtgtctcacaatgccgtggagaccgggtatcttaattccgtgtgccagtctctgctcgacaatttggacttactcccaggaaatactcggacaaaaatcgggtttattacgttcgattcaaccatccacttttacgggctccaggagtctctgtcccagccacagatgcttatagtatctgacatcgaagacgtgttcatccccatgcctgaaaatctactcgtgaatctgaacgaatcaaaagagctggtgcaagatctgctgaaaaccctgcctcagatgtttactaaaacactggaaacccagtctgcactggggcccgccttgcaagctgcctttaagttaatgtctcccacggggggtagaatgagcgttttccaaactcagttgcccactctgggcgtgggtgccttaaaaccacgggaggagcctaaccacaggtccagcgccaaggacatccacatgaccccctccactgacttctataagaaacttgccttggattgcagtggccagcaggtggctgtcgatctcttcttgctgtccggtcagtacagcgacttggcgagcctaggctgcatttcaaggtactccgcaggatccgtctattactatcctagctaccaccatcaacataatccagttcaagtgcagaagctccaaaaggaactccagcgctacctgacacggaaaatcggatttgaagctgtcatgcgcatccgatgcacaaaaggtttgtcaatccacacattccatgggaatttcttcgtgagatcgaccgacctgcttagcctcccaaatgttaaccctgatgccggatatgccgtgcaaatgagcgtagaagagtcgttgacagatactcagctggtgtcctttcaatccgcccttctttacacctcatctaaaggagagcggcggattagggttcataccctttgtctgccagtcgtatcaaccctgaatgatgtatttttgggcgccgatgtccaggccatcagcggtctgctggcgaacatggcagtggatcgtagcatgactgcctctctgagcgacgcaagggatgccctagtcaacgccgtcatcgactcactttccgcatatagatcttcggttctttcaaatcagcagcctgggctgatggttccattttctctccggctatttcctctatttgtgttggctctccttaaacagaaatctttccagacgggaaccaatgcacgccttgatgagagaatcttcgcaatgtgccaggtaaagaaccagccacttgtttacctcatgttaaccacacatcccagtttgtatagagtggataacctgtctgatgaaggcgctttaaacatttcagataggacaattccccagccacccatcctgcagttgagtgttgagaagctttctcgggatggggccttcctgatggacgctggaagcgtactgatgctctgggtggggaagaactgtacacagaacttcctgtctcaggtccttggtgtccaaaactatgcatctatcccccagccaatgactgaccttcccgagctggacaccccggagagtgccaggattatcgcctttatttcttggttgcgcgagcaaaggcctttttttccgatattatatgtgatccgagatgagtccccaatgaaggccaactttcttcagaacatgatagaggaccggacagagtccgcgttgtcttactatgagttcttacttcacatccagcagcaggttaataagtag

SEQ ID NO: 45769 - DNA, 3807 bp, Artificial Sequence
  Description of Artificial Sequence: Synthetic coding sequence
atgagcgcccccgccggcagcagccaccccgccgccagcgcccggattccgcccaaattcgggggagctgcagtgtccggagcagctgcccccgccggccctggagcagggcccgcaccccatcaacaaaacggccctgctcagaaccaaatgcaggtaccttcagggtacggactacaccaccagaattatatagccccaagtggtcactattcccagggccctggcaaaatgacgtccctgcctcttgatactcagtgcggcgactactacagtgcgttatacaccgtcccaacacagaatgtgacacccaacactgtgaatcagcagccaggggcacagcaactatactctcgaggacctcccgcgccccacattgttggatccacccttggttcattccagggggctgcctcttccgccagccacctacatacgagtgcatcccagccttattccagtttcgtgaatcactataacagccctgccatgtacagcgcgtcctcctctgtggctagccaaggcttcccctccacatgtggtcattatgcaatgagcacagtgtccaacgctgcttatccttcagttagctatccttcactacccgcaggtgacacgtatgggcagatgttcacgagccaaaatgctcccactgtgcgccctgtaaaggacaacagcttcagtgggcagaacacagctatcagccaccccagccccctgccacctctgccttcgcagcaacatcatcagcagcagtctctgagtggctatagtacgctcacctggtcatctccaggtctcccttctactcaagacaatttaatccgaaaccatactggatctcttgcggtcgcaaataataatcctacaatcaccgtggcggattcgctgtcttgccccgtcatgcagaatgtccaacctcctaaatcctcacctgtggtttccacagtattgagcgggtcctctggctcttcctcaacaagaacgcctccaacagcaaatcaccctgtggagcccgtgacgtcagttacgcagccttccgagctcctccaacaaaaaggagtgcagtatggagagtacgtcaacaatcaggcctcttctgctcctactcccctgtcttctacttctgacgacgaggaagaggaggaggaggacgaagaggcaggcgtggacagttcatcaaccacatcttctgcctccccgatgcctaacagttatgacgcgttggaaggcggctcttaccctgacatgctgtcttccagtgcgagttcacccgccccagaccccgccccagaacccgaccctgcatcagcacccgcacccgcctcagcccctgcacctgtcgtgccccaaccaagtaagatggccaaacccttcggctatggctaccctacccttcagccaggttatcagaacgcaaccgcaccactcatatcaggagttcagccctctaaccctgtgtattcaggcttccaacagtaccctcagcagtatcccggcgtcaatcagctctcttcgtcaataggaggtctatccttgcaatccagcccacagccagagagcttgcgccccgtgaatttaacccaggagcggaatatccttcctatgactcccgtgtgggccccagtgccgaatcttaacgctgacctgaaaaagctgaactgttcccctgattcatttaggtgcaccctaactaacatccctcagacacaggccctcctaaacaaagcaaaactgccacttggattactcctgcacccttttcgggatctaacccagctcccggtgattaccagcaatacaatcgtgaggtgccgttcctgcagaacctatatcaatccctttgtcagcttcatcgatcaaagaaggtggaagtgcaacttatgttacagggtgaatgacgtgcctgaggaattcatgtataacccgctgactcggagctatggcgagcctcacaaacgtcctgaagtccaaaacagcactgttgaattcatagcttcaagtgactacatgttacgacctccccagccggcagtttacctttttgtcctggacgtctcccataacgccgtggaggctgggtatctgactatcttatgccagagtctgttagagaatttggacaagctgccgggagactctcgcacacgtattggtttcatgaccttcgactccactatccatttctacaatctgcaggagggactgtcacagccccagatgctgattgtgtccgacatcgatgacgtgttcctcccaacacctgactcattgcttgtgaatctgtatgaatccaaagaactgattaaggatctcctgaatgcattgcccaacatgttcacaaatacacgtgagacccacagcgctttgggacccgcactgcaagcagcctttaagctcatgtctcccaccggaggcagggtgtccgtttttcagacccagcttccctctctcggtgcaggtttactccagtcccgggaggaccccaaccagagaagcagtaccaaggttgtacagcacctcggtcccgccacagatttctataagaagcttgctctggactgcagtggacagcaaactgccgtcgatctgttcctactctcttcccaatatagtgatctcgcgagtctggcatgtatgagtaagtatagcgccggatgtatatattactatccaagttttcattacactcataatccgtcccaagccgaaaagttgcaaaaagatctgaaacggtacctgacaaggaagatcgggtttgaggccgtgatgcgcataagatgcactaaaggtctatcaatgcacacatttcacggcaacttttttgtgaggagcaccgatctcctcagccttgctaatatcaaccctgacgctgggttcgccgtccagctctccatcgaggaaagcctgactgatacaagcctggtgtgctttcaaacagcactgttgtacacttcctccaagggagaacggaggattcgtgtccacaccctgtgtctgcctgtggtttcgagtctggctgacgtgtacgccggagttgacgtacaggctgccatttgcttgctggctaacatggcagtggatcgctctgtgtccagctctctgtccgatgctagggatgcgctggtaaacgccgtcgtggattcactgtcagcatatggctctacagtgtctaacctgcagcattccgcgctgatggctcctagttcgctaaagctgtttcctctgtatgttttggcacttttgaagcagaaagccttccggactggcacaagtacacgtttggacgaccgcgtgtatgctatgtgtcaaatcaagtcgcagcccctcgtgcatttaatgaaaatgattcacccgaacctctatcgcatcgacaggctcaccgatgaaggtgcggtccacgtcaacgaccgcattgtccctcagccccctctgcagaaattgagtgcagagaaacttacccgtgaaggagccttcttgatggactgcggttcagtattctacatctgggtgggtaaaggctgcgacaacaacttcatagaggacgtactgggatacacaaacttcgcctccattccccaaaagatgacacacttgcccgaactcgatacattgtctagcgaaagggcacgcagctttataacctggcttagggattcaaggcctctgagtcccatccttcacatcgtgaaggacgaaagcccagccaaagcagaatttttccagcaccttatagaggatcgtaccgaggctgctttttcgtactacgagttcctgcttcacgttcagcagcagatctgcaagtag

SEQ ID NO: 45770 - DNA, 3702 bp, Artificial Sequence
  Description of Artificial Sequence: Synthetic coding sequence
atgagcgcccccgccggcagcagccaccccgccgccagcgcccggataccaccaaagttcgggggagcagctgttagcggggcagcagcaccggccggcccaggggctggtcctgcaccacaccagcaaaatgggcccgcccagaatcagatgcaagtgccatcggggtacggtcttcaccaccaaaactatatcgctccgtctggccactacagccagggacccgggaagatgacatcactcccactggatactcagtgcggcgactactatagtgccctctataccgtacccacacaaaatgttacccctaacaccgtcaatcagcagccaggagcccagcagttgtattcccgcgggcctccagctccccacatagttggcagcacactggggagcttccaaggtgcagccagttctgcaagccacctccacacctccgccagtcagccgtactcttcgttcgtcaatcactacaattcgccagcaatgtactcagctagctcatccgtggccagccagggattccctagcacctgtggacactacgccatgagcacagtgagtaatgccgcctatccttcagtgtcctacccgtcacttcctgccggcgacacttacggtcagatgtttacttcacaaaatgcccccacggtacggcccgttaaagacaactcctttagcggccagaataccgctatctctcacccatcgccactgcctcctctcccttcacagcagcaccaccagcaacaaagcttgtccggatatagcactctcacatggtcttcccccggtctcccttctacccaagacaacctgatccgcaatcatacgggatccttagcagtcgccaacaacaatcccactatcaccgtcgcggactcattgtcctgccctgtcatgcagaacgtgcagccacccaaatctagccccgttgtatctacagtgctgtctggctcatctggctcctcctctacgagaactccacctaccgcgaaccatcccgtcgagcccgtcacaagcgtcactcagccatcagagcttcttcagcaaaagggcgtagatagctcttctactacctcttccgcctcgcccatgcccaacagctatgatgcccttgagggcggttcttacccagatatgctgagttcctcggccagttcccccgcccctgatccagcacccgaaccagatccagcctctgcaccagctcccgcatctgcccctgcacccgtcgtccctcaaccttctaaaatggccaaaccgttcggatacggctatccaacattacagcccggataccagaatgctacagcccccctaatttccggggtccaacccagcaacccggtgtacagcggctttcagcagtatcctcagcagtatcctggcgtcaatcagctctctagctctatcgggggcctctctctgcaatcctcccctcagcccgaatctttgcgtcccgttaacctgacacaagaaagaaatatcctcccgatgacccctgtatgggcccccgtcccaaatctgaatgctgaccttaagaagttgaattgtagccccgattcctttcgatgcacattgacaaacattcctcaaacacaagccctcctcaataaggcgaaattacccctcggactgctgctgcacccctttcgggacctcacgcaactgccagttataacttcaaacacaatcgttaggtgcagaagttgtagaacatatattaatccttttgtgagctttatcgaccaaagacgctggaagtgtaacctgtgttatcgagtgaacgacgtgcctgaggagtttatgtataaccctttgactcgcagctacggtgagccccataagcgtcctgaggttcagaactcaacagtggaatttatcgccagctcagattatatgctgcgacccccccagccagcagtgtacctctttgtgctcgacgtttcgcataatgcagtcgaggccggatacctgactatcctgtgtcagtctctgctggaaaacctggacaaactcccgggcgacagtcgtaccagaataggattcatgactttcgacagcaccatccatttttacaatctccaggagggcctctcacagccgcagatgctgattgtgagtgacatcgacgacgtcttcctgcctacccctgatagcctccttgtgaacttatacgaatccaaagaactgattaaagaccttctgaatgccttacctaacatgtttacaaacactagagagacacacagcgcattgggacccgctctgcaggccgcattcaaacttatgtcccctaccgggggtcgtgtgagtgtattccagactcaactccctagcctgggagctggactcctccaatcaagagaagatcccaatcagagatcctccaccaaagtggtacagcatctgggccctgctaccgacttttataagaaactcgccttggattgttcaggccagcagactgctgtggatctcttcttgctaagttcgcagtatagtgatctagccagtcttgcctgcatgtcaaagtacagcgcggggtgtatctattactaccccagtttccattacacccataatcctagccaggcggaaaagctacagaaggatttgaagcggtatctgacacgcaagattggttttgaagcagtaatgcgcattagatgtactaaaggcctctcaatgcacactttccacggtaacttctttgtgcgttccaccgaccttcttagcctcgctaacatcaatccagacgccggatttgcagtgcagctctccatagaagaaagtctgactgatacttccctggtgtgtttccaaacggccctgttgtatacgtcaagcaagggggagcgtaggatccgggtacacaccctatgtctgcctgtagtcagctccctggcggatgtgtatgctggagtggacgtgcaagccgctatttgcctgctggctaacatggccgtcgaccgatcagtaagcagcagtctgtccgacgcacgggacgccctcgtcaatgcggtggtggattctctgtcagcgtatggttccaccgttagcaacctgcagcactcggcactaatggcgccatcaagccttaagttattccccctgtacgttcttgcgcttctcaaacagaaggcgtttagaaccggaacaagcactcgtctcgacgaccgtgtttacgcaatgtgccagatcaaaagccagcctctggttcacctcatgaagatgattcaccccaacctgtaccggatagaccgactgaccgacgagggcgctgtgcacgttaacgaccggatcgtgccccagccacccctgcagaagctatcagctgagaaactgaccagagagggagcttttctcatggattgcgggagcgtattttacatctgggtcggtaagggctgcgacaacaatttcattgaggatgtactgggctacactaactttgccagcatccctcagaaaatgacacatctccctgaactagacactttgagtagcgaacgtgccaggtcgttcatcacctggctcagggacagccggcctctttctcccattctccacatcgtgaaggatgaatcacccgctaaggcggaattttttcagcacctcatcgaggatcggaccgaggcagctttcagctactacgagtttctccttcacgtccagcagcagatctgtaagtag

SEQ ID NO: 45771 - DNA, 3897 bp, Artificial Sequence
  Description of Artificial Sequence: Synthetic coding sequence
atgagcgcccccgccggcagcagccaccccgccgccagcgcccggatccctcccaaattcggaggcgcggccgtatccggcgccgctgccccagcagggcctggagccggcccagcgccgcatcagcaaaatgagactgggttccatcatgtcgctcaggcctccctagagctactcgacccctcaaatctcccagcatctgcatctcaaatcgcggggagcacaggccctgctcaaaaccaaatgcaagtaccaagcggctacgggctgcatcatcaaaactatattgcaccctcaggacactactcccagggccccggcaagatgacttcattgccgctcgatacccaatgcggtgattattattccgctctgtatacggtaccgacccaaaacgtaacccccaacaccgtgaatcagcagcccggggcccagcaactgtattctcgaggaccccctgccccccacatcgttggcagcactctgggctccttccaaggcgccgcttctagcgccagccatctacacacatccgcttctcagccttattccagttttgtgaaccattacaatagtccagctatgtactctgctagcagtagcgtcgcttcccaaggtttcccctctacatgtgggcactacgcaatgtctacggtcagtaacgctgcttatccaagtgtgtcatatccctctttaccagccggcgatacctacggccagatgttcacttcccaaaacgcccctactgtcagacccgtgaaggataatagttttagcggtcagaatacagcgatttcacaccctagccctctcccccctctgccgagccagcagcatcatcaacaacaaagcctaagcggttattcaacactgacatggtcttccccaggtttgccatccacacaagacaacctgatcaggaatcatactggaagcctggctgtcgcaaataacaacccgaccatcacggtcgcagactccctgtcatgtcctgtgatgcagaacgtgcaacccccaaagtcttccccagtagtctctactgtattgtccgggagcagtggctcctctagtactaggacccctcctaccgctaaccatccagtcgagccggtgacctccgttacccagccttctgaactgctacagcagaaaggagtccagtacggagagtatgtgaataatcaggcatccagcgcccccacaccactgagcagtactagcgatgacgaagaagaggaggaagaggacgaggaggccggagttgacagttcatcgacaacatcttctgcctcccccatgcctaactcttatgatgccttagaaggcggctcctaccctgacatgctgagcagcagcgcttcctctccagcaccagaccctgcacctgagccagaccccgctagcgctccagctcccgcatccgccccagcccccgtggtcccgcagccttccaaaatggcaaagccattcggttatggctatcctacactgcagcccggctaccagaacgccactgcacctttgattagcggcgtccagccttctaaccctgtatacagcggttttcagcagtacccgcaatatccaggggtcaatcagctgtcaagcagcattggcgggttatcccttcagtcatcaccgcagccagaatccctgcgtcctgtcaatcttacccaggaacgcaatatcctccctatgacacctgtttgggcccccgtgccaaatttgaatgctgatcttaaaaagctgaattgtagcccagattcttttcggtgtaccttaactaacatccctcagacacaggccctccttaacaaagcaaagttaccactcgggttactcctgcatccgtttagggacctcactcagctgccagtgatcacctccaacactatagtcaggtgccgaagctgccgaacatatattaatccgttcgtttctttcattgatcaaagaagatggaaatgtaatctgtgttatagggtgaacgacgtccctgaggagtttatgtataatccactaacacgcagttatggtgaaccacacaaaagacctgaggttcagaatagcaccgtggagttcattgcctcctcggactacatgctgagaccacctcagcctgccgtgtatctgttcgtgttggatgtgtcacataatgccgtagaggccggctatttgactattctgtgccagagcctgctggagaaccttgataagctgccaggcgatagccgaacacggattgggtttatgacctttgactcaaccattcatttttacaatctgcaagagggcctcagtcagccgcagatgctgattgtgagtgatatcgatgatgtgtttctccctactccagatagcctgctagtgaacttatacgagtccaaggaactcattaaagaccttcttaatgccctgcctaatatgtttacaaacacacgagagacgcacagtgctcttgggcccgctttacaggccgcctttaaactcatgtcccccacaggaggccgggtatctgtgttccaaacgcagttaccgagcctgggagccggcctgctacagagccgcgaggaccctaatcaaagaagtagcactaaggtagtgcagcatctgggcccagccacggatttttataagaaactcgctctagactgctcgggtcaacagaccgctgtagaccttttcctgctgagttcacaatatagcgaccttgcttccttggcttgtatgtccaaatattccgcgggatgtatatactactatcctagctttcattacacacataacccaagccaggcagaaaaactgcagaaggaccttaaacgctacctgacacgaaagattggattcgaggccgtgatgagaatcaggtgtacgaagggcctgtcgatgcacacattccatggtaatttttttgtgaggagcacagatctgctgagcctggcaaacatcaacccagatgcaggtttcgctgtgcaactctccatcgaggagtctttgacagatactagcctggtgtgttttcagactgccctcttgtacactagttctaaaggtgagcgccgaattcgagtacacacactatgtcttcctgtcgtgagtagcctagccgatgtgtacgccggagtggacgtgcaggccgccatttgtttgctggctaatatggcggtggaccgttcggtctcatcgtcactttccgatgctcgagatgctctggtgaacgccgtcgttgatagtctctccgcctacggaagcactgtttctaatcttcagcacagcgcactgatggccccaagttctctgaaactcttccctttgtacgtgctggctctgctgaagcagaaagccttccggacaggaacctctacgcgtctcgatgatcgcgtgtatgccatgtgtcaaataaagtctcagccactggtgcacctgatgaaaatgattcaccctaatttatatcgtatcgaccgtctgacagatgaaggcgccgtgcatgtgaacgatcgtatagtaccccagcccccccttcagaagctgtccgcagagaaacttaccagggaaggagcctttctgatggactgcgggtctgttttctatatttgggtgggtaagggatgcgacaacaactttattgaagacgtgctcggctatacaaactttgcttcaattcctcagaagatgacacacctgcctgagctcgatacattatcttcagaacgggcacggagtttcataacatggctgcgtgatagccgccctttgagtcccattctgcacattgtgaaagatgaatcaccagccaaggctgaattcttccagcacctcatcgaggaccggacagaagcagcgtttagctattacgagttcctccttcacgtccagcaacagatctgcaagtag

SEQ ID NO: 45772 - DNA, 3285 bp, Artificial Sequence
  Description of Artificial Sequence: Synthetic coding sequence
atgaacgtgaaccagagcgtgccccccgtgccccccttcggccagccccagcccatatatcccggctaccaccagtcgtcctacggtggacagtccggcagcacagcacctgccatcccttacggtgcctacaacgggcccgtgcccggctatcagcaaacaccacctcaggggatgtccagagcccctccatcgtccggggccccaccggcctccactgcccaggctccgtgtgggcaggcggcatatggacaattcggccaaggtgatgtccagaacgggccatcttccaccgtgcagatgcagagactgcccggtagccagccttttggatccccgctggcccctgtcggaaatcagccgcccgtgctccagccctatggccctccacccacatctgctcaggtcgccactcagttgtccggaatgcaaatttcaggcgctgtagcacccgcgccgccgagcagtggactcggcttcggaccccctaccagcctggcttctgcgtccggctctttccctaatagcggcctctacgggtcctacccccagggacaggccccccccttatcgcaagcgcaggggcaccctggcattcagaccccacagcggagtgcacctagccaggcctcctcattcacaccacccgcctcaggcggcccgagactgccaagcatgaccggccctcttctgccagggcagagctttggaggcccgtccgtttcccaaccgaaccatgtgagtagcccaccccaagctctgccacccgggacgcagatgacaggccccctgggccctctgcctccaatgcacagcccccagcagccggggtatcagcctcaacagaacgggtcctttggacccgcccgtgggccacagagtaactacggcgggccttaccctgccgctcccacttttggaagtcagcccgggccgccccagcccttgcccccaaagagattggatcccgatgctatcccatcccctatccaggtgattgaggatgaccgcaataataggggcacagagcccttcgttaccggggtgcgcgggcaggttcccccgctggtgacaactaacttcttggtgaaggatcagggaaatgctagtccacggtatatccgctgcacctcttataatattccatgtacctcggatatggccaagcaagcccaggtcccactggccgctgtgattaagccccttgcccggctgcctcctgaagaagcttcaccgtatgtggtcgaccatggggagagcggccccctcaggtgcaacagatgtaaggcctatatgtgtcctttcatgcagtttatagaggggggacgcaggttccagtgctgcttctgttcatgcatcaatgatgttcccccccagtacttccagcaccttgaccacacgggcaagagagtggacgcttatgaccgccctgaattgagtttaggctcatatgaatttctagcgacagtggactactgtaagaataacaagtttccttcgccccctgcattcattttcatgatagacgtgagttacaacgctattaggacagggctggtacgcctcctctgtgaagaacttaaaagcctgctggatttcctccctcgggaaggaggtgccgaggagagcgccattcgcgtgggcttcgtgacctacaacaaagttctgcatttctataatgtgaaatcatctctggctcagccgcagatgatggtcgtcagcgatgtggctgatatgttcgtgcctcttctagatggcttcttagttaacgttaacgagagtcgggcggtaattacctctttacttgatcagatccccgagatgtttgctgacacacgggagacagaaactgtttttgttcccgtcatccaagcgggtatggaagccctgaaagccgccgagtgcgctggcaaactgttcctgttccacacctccctgccaatcgctgaagcccctgggaaactgaagaatagggacgataggaagctcataaacacagataaggaaaagacactgtttcagccccagaccggtgcgtaccagacactcgcgaaagaatgcgtagctcaggggtgttgtgtggatctgtttctctttcccaaccaatatgtagacgttgctacactgagtgtcgtaccacagttaaccgggggcagcgtgtataaatatgccagcttccaagtggaaaatgaccaggaaaggtttttgtcagacctcaggagagatgtacaaaaagtggtagggtttgatgccgttatgcgcgtacgcaccagtacaggtattcgagccgtggattttttcggcgctttctacatgtccaatacaacagatgtagaattagcgggcctggacggtgacaagacagtgacagttgagttcaaacacgacgaccgactcaacgaggagagtggagccctgctgcaatgtgctcttctctatacaagctgcgcgggacagcgaaggctgaggatccacaatttggctctgaattgctgcacccagctcgccgatctgtacagaaactgtgagaccgacacactgattaactacatggccaagttcgcttatcgaggtgtcttgaactcacccgtaaaagccgtgagagatacattgatcacacaatgtgcccaaatactcgcctgctacaggaaaaactgtgcctctccaagttccgctggtcagctgatccttcctgagtgtatgaagttgctgcccgtttacctgaattgcgtgctgaagtctgacgtactccagcctggggcagaggtaacaactgatgacagagcgtatgtgcgccagcttgtgacttccatggatgtcacagaaactaacgtgttcttctatcctcgcctgcttcctctgaccaagtcacctgtggaatccaccaccgagccacccgcggtgcgcgcaagcgaggagcgactgagcaacggggatatttacctgcttgagaatggacttaaccttttcctgtgggtgggagccagcgtacaacaaggcgtagtccagagtttgttctccgtctcatccttctcacagatcacatctggcctaagtgttttgccagtcctggataacccgctgagcaagaaggtgcgggggttaatcgactctcttcgcgcccagagatccagatacatgaagctgaccgttgtcaaacaagaagataagatggagatgctattcaagcatttcctcgtggaggataagagcctttccgggggcgcgtcctatgtggacttcctttgccatatgcataaagagatacggcagcttctgagttag

SEQ ID NO: 45773 - DNA, 3285 bp, Artificial Sequence
  Description of Artificial Sequence: Synthetic coding sequence
atgaacgtgaaccagagcgtgccccccgtgccccccttcggccagccacagcccatttatcctggttatcaccagtcctcttatggcggacagagtggaagcaccgcccccgccatcccgtacggggcttacaacggacctgttccaggttaccaacagactcccccgcaaggaatgtcaagggcccctccgagttctggcgctccacctgcaagtaccgcacaagcaccatgtggccaagccgcctatggccagtttggacagggcgacgtgcagaatgggccatcaagcaccgtgcagatgcaacgcctgcccggatcccagccttttggatctcctttagctcctgtgggtaaccagccacctgtgttgcagccttatgggccgccccctaccagtgcacaggtcgcaacacaactcagcggcatgcagataagcggagccgtggcccccgccccaccttcaagcggtttgggcttcggtccccctacaagcctggcctcagcctcaggtagctttccaaactctggactgtatgggagttacccacagggacaagctcctcctttgtctcaggcacagggacaccccgggattcagacccctcagcgatcagcgcctagccaggccagctcctttactcccccggcgagtggcggcccgagactgccctcgatgaccggcccactccttccaggacagagtttcggcgggccttccgtttcccagcccaatcatgtgtcctcccctccccaagccctgcctcctgggactcaaatgacaggtccactcggtcctttaccccccatgcactccccccagcagcctggataccaacctcagcagaacgggagttttggaccagcgcgtggccctcagtccaactacggaggcccgtatccagctgctccaaccttcgggagccagcccggacctccacagcccctgcccccaaaaagacttgatccagacgccatcccttcccctatacaagtaattgaggacgataggaacaaccgaggcaccgaaccttttgtgactggtgtccgaggccaggtaccccccctcgtaacgacgaatttcctggtgaaggatcagggcaatgccagtcccagatacatccggtgcacatcatataacatcccctgcacctctgatatggctaagcaggcccaagttcctttagctgctgtcataaagcccctagccagactcccccccgaggaagcatccccttacgtggtggatcacggggagagtgggcctttgcggtgtaacaggtgcaaggcttacatgtgcccatttatgcagttcatagaaggaggacgaaggttccaatgctgcttttgtagctgtatcaatgacgtgccaccccagtactttcagcatctcgaccacactggcaagcgggtggacgcttacgatagaccagaactctccctcgggtcctacgagtttctagcgacagtggattattgtaagaataacaagttcccctcgccaccggccttcatattcatgattgacgtttcttacaacgccatcaggactgggctcgtgcggctgctgtgcgaggagctgaaaagtctccttgacttcctgccacgggagggaggcgcggaagaatcggccatacgtgtcggctttgtgacctacaataaggttttacacttctataacgtgaaatcatcattagcgcagccccaaatgatggtcgtgtctgacgtagcagacatgttcgtgcctctcttagacggttttcttgtcaatgtgaatgagtcgcgcgccgtcattacctccttgctcgatcaaataccagagatgttcgccgatacgagggagacagagacagtgttcgtaccagttattcaggctggcatggaggcgttgaaggctgcggaatgtgctgggaaactttttctctttcatacatcacttccgatcgctgaagctcccgggaaactcaagaatagagatgatcggaaactaattaataccgataaggagaaaacgctctttcagccacagactggtgcctatcagaccctcgctaaagaatgcgtggcacagggttgttgtgttgacctcttcttgttccccaaccagtacgttgacgtggctaccctgtccgtcgtgccacagcttacaggtggatccgtgtataagtatgcaagcttccaggtggagaatgatcaagaacggttcttgagtgatctgcgtcgagacgtccagaaagtcgtcggcttcgatgccgtgatgcgcgtccgcacaagcactggcataagggccgtcgacttcttcggagcgttttatatgagcaatactaccgacgtggaattggctgggttggacggtgacaagaccgtgaccgtggagttcaaacacgatgacagacttaatgaagagtctggagcgctgttacaatgtgccctgttgtacacctcttgcgctggccagaggcgactgcgtattcacaacctggctcttaattgctgcacccagctcgctgatctctacagaaattgtgagacagataccctgattaactacatggccaaatttgcctaccgaggggtgctgaactcccctgtgaaagccgtgcgcgatacactgataacgcagtgtgctcaaatactggcctgttataggaaaaactgcgcttctccttcatctgccggacaactgatattgccagaatgtatgaagctgctgccagtgtatcttaactgtgtgctaaaaagcgatgtgctccagccaggggctgaggtgactaccgacgacagagcgtacgtaagacagctggtgacatcaatggacgtgactgagacaaatgtgtttttctaccctcggttacttccactgaccaaaagccctgtggagagtaccaccgagccacctgctgtgcgagcatccgaggagagacttagcaacggcgacatatacctgcttgaaaacggcctgaacctgtttctgtgggtgggagcgtccgttcagcagggagtggtgcaaagcctgttctctgtgtcatctttctcacagattacctccggccttagtgtgttacccgtcctagacaacccattgtcaaaaaaagttagaggcctcatagattccttgagagctcagcggagccggtacatgaaattgaccgtcgtgaagcaagaggacaaaatggagatgctctttaagcacttcctggtagaggataagtctcttagtggcggggcttcctacgtggactttctctgtcatatgcacaaagaaatcaggcaactgctttcttag

SEQ ID NO: 45774 - DNA, 2928 bp, Artificial Sequence
  Description of Artificial Sequence: Synthetic coding sequence
atgcagatcagcggcgccgtggcccccgccccccccagcagcggcctcggattcgggcctcccacttccctagccagcgcttccgggtccttccccaactccggactctacggcagctaccctcaagggcaagcacctcccctctcccaggcccagggccatccgggtattcaaacgccgcagcggtctgcaccctctcaggcatcaagtttcacaccccctgcctctggaggaccgcgcttaccttctatgacgggcccactgctccccggccaatctttcgggggacctagcgtatcacagccaaatcatgtatccagtcctcctcaagctcttcctccgggcacacagatgacaggacctctcggacccctgccacctatgcattcaccacaacagcctgggtatcagccccagcagaacggcagcttcgggccagccagaggcccccagtccaactatggaggaccttacccagccgcccccacatttgggtctcagcctggccccccccagcctctgccgcccaaacggcttgatccagacgccattcctagtccacagctttcagaactgcccccacagcaaaagacacgccatagaatcgaccctgatgccatccccagccccattcaagtcatagaggacgaccggaataatcggggaacggagccatttgtgactggagtccgcgggcaggttccaccactggtgaccacaaatttcctggtaaaagaccagggtaacgcctcaccgcgatatataaggtgcacttcatacaacatcccttgtacttctgatatggctaagcaggcccaggttcccttagccgcagtgattaaacctctggcccgactgccccccgaagaggcttctccatatgtggttgaccacggcgaaagcggacctctacgatgtaaccgatgtaaggcctacatgtgtccattcatgcaatttattgaaggtgggcgcaggttccagtgttgcttttgtagttgtatcaacgacgtcccgccgcaatactttcaacatttagatcataccggaaagagggttgatgcttatgatagaccagagctgtcgctgggctcttatgagttcctggccacagttgattactgtaaaaacaacaagtttccttcaccgcctgcatttattttcatgattgacgtttcttataacgctatcaggaccggcttggtgagactcctgtgcgaagaactaaaatcacttctggatttcctgccccgggagggcggtgcagaggaatcggccataagggtggggtttgtgacttacaacaaagtgcttcacttctataatgttaagtcctctttggctcagccgcagatgatggtggtatcagatgtcgcggatatgtttgtccccctgttggacggcttcctggtgaacgtgaatgaatctagagccgtgataacatcactccttgaccagatacctgaaatgtttgctgacacaagggagactgaaactgtgttcgtgcccgtgatccaggcgggtatggaggcactaaaagccgcggagtgtgctggaaagttattcctgtttcacacatccctgcccatcgcagaggctcctgggaaacttaagaaccgggacgaccggaagctaattaacactgataaagagaagaccctcttccagccccagacaggtgcctaccaaacattggctaaagagtgcgtggcacagggatgttgcgtggacctgtttttgttcccgaatcagtatgtggatgtggcaacactgtcagttgtgcctcagttgacaggtggtagtgtgtataaatacgcttccttccaggttgagaatgatcaggaaagatttctgtctgatctcagaagagacgttcagaaggtggtaggctttgacgctgtcatgagggtgcggacatccacaggtattcgggctgttgattttttcggagccttttacatgtccaacactacagatgttgagctagctggccttgatggggataagactgtcactgtggaatttaagcatgacgataggctaaacgaagagagcggagcactgttacagtgtgcacttctttatacatcttgcgccggtcaacgtcggcttcgcattcacaatctggctcttaattgctgcacccagttggccgatttgtatcgtaattgcgagaccgataccctcatcaattacatggcaaagttcgcatataggggagtgctgaattcgcctgtgaaggctgtcagggataccttgattacacagtgcgctcagattctcgcatgctataggaagaactgtgcttcaccctctagcgccggacaactcattctcccagaatgtatgaagttactgcctgtctatctgaattgtgtgttgaagtctgacgtcctgcaacctggcgccgaggtgaccaccgacgaccgcgcatacgtgcgacagctcgtgacaagtatggacgtgaccgaaacaaatgtcttcttctacccccgtctgctgcccctgacgaagtccccagtagagtctaccactgagccccctgctgtcagagccagcgaggagcgattgtccaatggcgacatttacctcctcgaaaacggtttgaacctattcttgtgggttggggcaagtgtgcagcagggtgtggtgcaatccctgttttccgtcagttctttcagccagatcacaagcggtctgtccgtcctgccggtactagacaaccccctgagtaagaaggtgcgggggctgatcgactccctcagagcacaacgctctagatacatgaagttaacagtggtgaagcaggaggacaagatggagatgctgtttaaacacttcctggtggaggacaaatctctttctggtggcgcgagttatgtcgattttctatgccatatgcacaaggagatccgccagcttctttcgtag

SEQ ID NO: 45775 - DNA, 1029 bp, Artificial Sequence
  Description of Artificial Sequence: Synthetic coding sequence
atgcgggtgcggaccagcaccggcatccgggccgtggacttcttcggtgccttttacatgtccaatacaaccgacgtggagttggcgggtctggacggagataaaaccgttacggtggagttcaagcacgatgacagactgaatgaggaatctggggcactcctgcagtgcgctcttctgtacacatcttgcgccggacagcggcgactccgcatccataatttagccctgaactgctgtacccagttggccgacctgtatcggaattgtgagaccgacacactgatcaactacatggcaaagttcgcttaccgcggtgtattgaattctccggtaaaggcagtgagagacacactcattacgcaatgtgcccagattctggcatgttacaggaagaattgcgcttccccatctagcgccggacagctcatattgcccgagtgcatgaaattactacctgtgtacttaaattgcgtgctgaaatcagatgtgctccagcctggggcagaggtcacaaccgacgaccgggcgtatgtacggcagctcgttactagtatggacgtcacagagaccaatgtctttttctatccaagactccttcctctgacaaaaagtcctgtggagtcaacaacagaacccccagccgttagagcttcagaggagcggctctccaacggggacatatatctgttggagaatggacttaacctattcttatgggtgggcgcttcagtgcaacagggcgtggtccagagcctgttcagtgtatctagcttttcccaaatcacctctgggctatctgtgttgcctgtccttgataatccattgagcaagaaggtgagaggattaattgattcgcttcgggcgcaaaggtctagatacatgaaactcactgtcgtcaagcaggaggacaaaatggagatgctgttcaagcacttcctggtggaggataagagcctgtctggaggcgcttcttatgtcgactttctctgtcacatgcacaaggaaatcaggcaactgctctcttag

SEQ ID NO: 45776 - DNA, 1029 bp, Artificial Sequence
  Description of Artificial Sequence: Synthetic coding sequence
atgcgggtgcggaccagcaccggcatccgggccgtggacttcttcggcgccttctatatgagcaacactaccgacgtggagctcgcgggcctggacggggataagacggtgacagttgagtttaaacacgatgatcggttaaacgaggagagcggggccttattgcagtgtgctctgttgtatacttcctgtgctggacagcgccgcttgcggattcacaatctggcacttaactgttgcacgcagttggctgacttataccggaactgtgagaccgacacactgatcaattacatggcaaaatttgcttacaggggcgttctgaatagtcccgtcaaggcagtccgagacacgctgatcacccagtgcgcccagatcctcgcctgctacaggaagaattgtgcctcgccttcatctgcaggccagctgattctccctgaatgcatgaaactgctgccagtctacctgaattgcgtgttaaaaagcgatgtcctgcagcctggcgctgaggtgactaccgatgatcgcgcttacgttcggcagctggtcacaagcatggacgtaacagagactaatgtgtttttctaccctcgcctgcttccattaaccaaatccccggtggaatctacaacggagccaccagccgtacgcgcatcagaagaacgcttgtctaatggagatatctacctgctggaaaacggactgaatctgttcctgtgggtgggcgcatccgtgcagcaaggggtggtgcagtctctgttctccgtgagctcgttttcacaaatcacaagtgggctgtccgtgctgcctgtcctggacaaccccctttcaaaaaaagttaggggcttgattgatagcctgagggcgcaaaggtctcggtacatgaaactaaccgtggtgaagcaggaggacaagatggagatgctttttaagcacttcctcgtcgaagacaagtctctgtcaggtggcgcctcttacgtggacttcctttgtcatatgcacaaggagatccgccagctgctgagctag

SEQ ID NO: 45777 - DNA, 3099 bp, Artificial Sequence
  Description of Artificial Sequence: Synthetic coding sequence
atgagccagcagggctacgtggccacccccccctacagccagccccaacccggcataggtttaagtcctcctcattacggccactatggtgatcccagccacaccgcttctcctacgggtatgatgaagcctgctggccccctaggagcaactgcaactagaggcatgctgcccccaggtccgccacctccaggaccacaccagtttgggcaaaatggagcccatgccaccggccacccgcctcagaggtttcctggccccccaccggtaaacaacgtggcttcttctcacgcgccttaccaaccctcagcccagagctcgtatcccggaccgatctccacgagcagtgtgacccaacttggctctcagctctctgctatgcaaatcaatagttacgggtcggggatggctcctccctctcaagggccgcctggcccactgagcgcaacgagcctgcagaccccccctagacctccgcagccctctattctccagcctggcagccaggtccttccgccaccgccaaccacacttaatggaccgggcgcttccccgctcccactgcccatgtacaggcccgatggtctttccggaccccctccaccaaatgcacagtatcagccacctcccctgcccgggcagactctgggagctggttatcccccacaacaggccaacagcgggccacaaatggctggggctcagctgtcgtatccaggtggcttcccaggcgggcctgcgcagatggctgggcctccacagccacagaagaagctggaccccgatagtatcccttcaccaatccaggttatcgaaaacgatcgggcctctcggggcggtcaggtctacgctaccaacacccgcggccagatccctccattagtgaccaccgattgtatgatccaggaccaggggaacgcaagcccacgattcattcggtgcaccacatactgttttccgtgcacatccgatatggcaaagcaggctcagatcccgcttgcggcagtcatcaagccatttgcaaccattccttccaacgaatctcccttgtatctggtgaaccatggggaatccggcccagttcggtgcaatcgatgtaaagcctatatgtgtcctttcatgcagttcatcgaaggcggtcgtagatatcagtgcggattctgcaattgcgtaaacgacgtgcctccattttactttcagcacttggatcatatcggccggagacttgatcattacgagaaaccagagttgagcctaggatcttatgaatatgtcgcaacactagattattgtcgcaagtctaagccccccaatccacccgcatttatctttatgatcgacgtgagttatagcaatataaaaaatggactggtcaagctcatttgtgaggaactcaagaccatgctggagaagatccccaaggaggagcaggaagagaccagcgcgatacgggtgggctttattacatataataaagttcttcacttcttcaacgtgaagagcaacctcgcccaaccacagatgatggtggttacagacgttggcgaggtgttcgtgccactgctcgatggtttcctggtcaactaccaggagtctcaatccgttatccacaacctgctggaccagatccccgatatgtttgccgactctaacgagaacgaaacagtgttcgcccccgttattcaggccgggatggaagcactgaaggctgcggattgccccgggaaactgttcatttttcatagcagtctgcccaccgccgaagcaccagggaagctgaagaaccgggacgacaaaaaactcgtaaatactgacaaagagaagatcctattccagccacagactaacgtgtatgactcactcgccaaagactgcgtcgcccatgggtgtagcgtcacgttattcttgtttccttcacaatatgtggacgttgcttcactgggcttagtaccccagttgactggcgggacgttgtacaaatataataactttcagatgcacctggatagacagcagttccttaatgacctgagaaacgacattgagaagaaaatcggctttgacgcaatcatgagagtgcggacaagcaccggcttcagagcaaccgacttctttggcggtattctgatgaataacacgactgacgttgagatggcagcaatcgattgtgacaaggccgtgactgtggagtttaaacatgatgataagctcagcgaagattcgggcgcgctgatacagtgcgccgttctgtacaccacaatcagtgggcagcgtagattgcgaattcacaatttggggctgaactgttccagtcagttggctgacctttacaagtcttgtgaaacagacgccctaatcaacttctttgccaagtcggcctttaaggctgtactgcatcagccactgaaggtcatcagagaaatactcgtaaatcaaactgcccatatgctggcatgctatcggaagaactgcgcttctccaagcgcagcatcccagcttatcctgcctgatagtatgaaagttctgccagtctacatgaattgcctgctgaaaaattgcgtgctgttatcaaggcctgaaattagtacagacgaaagggcgtaccagaggcaattggtaatgactatgggagtggccgattcccagctattcttctatccccagttgctccccatccacacactggatgtgaaaagtactatgctccctgcggctgtccgctgtagtgaatcacgtttatcagaggaaggaattttcctgcttgcaaacggactccacatgttcctgtggctaggcgtgtcaagcccgccggagttaatacagggaatcttcaatgtgccaagttttgcccacataaatactgacatgactcttttacctgaagtgggtaacccttatagccagcaactaaggatgatcatgggcattattcagcagaagcgtccttattccatgaagctgaccattgtgaaacagagagaacaaccagaaatggtctttcgtcagttcttggtggaggacaagggtttatatggaggaagttcctacgtcgacttcctgtgttgcgttcataaagaaatctgccaattgctcaactag

SEQ ID NO: 45778 - DNA, 3102 bp, Artificial Sequence
  Description of Artificial Sequence: Synthetic coding sequence
atgagccagcagggctacgtggccacccccccctacagccagccccagcctgggatcgggctctcaccaccccactacgggcactatggagacccctcacacacagcctcaccaactgggatgatgaaacccgcaggaccccttggtgcaactgccacaagaggtatgctgccgcctgggccgccaccacccggcccacatcagtttgggcagaatggggcccatgccaccggccaccctcctcagcggttcccgggccccccccccgttaataacgttgcatctagtcatgcaccctaccagccgtcagcccaatcctcttacccagggccaatttccacctcttccgtgacacagctagggtcacaactgtctgccatgcagatcaattcttacggttccggtatggcgcctcccagccaagggccccctggtccactgtcggcgacttcactgcagaccccaccccgtcccccacagcctagcatccttcagccaggaagccaagtgcttcccccaccccctaccacacttaacggcccaggcgcaagcccactcccactccctatgtaccggccagatggcctgagtggccccccccctcctaatgcgcagtatcaaccgcccccgttacccggacagacgctgggggctggatatccaccacagcaggcggctaactccggaccacagatggcaggggctcagctatcctatcccggtggattccccggtgggcctgctcagatggccggcccaccgcaaccccaaaaaaaactagatcccgactccataccaagccctatccaggttattgagaacgatagagcctctcgcggcggacaggtgtatgccacaaacacgagaggtcagattcctccgctcgtcaccacggattgtatgatccaggatcagggtaacgcaagtccacgcttcatccggtgtacaacatactgcttcccctgtactagtgacatggcaaagcaagcacagatccccctggccgcggtgatcaagccctttgccaccatccccagcaacgagtcacccctctatctggtcaaccatggcgagtccggtccagtccgatgcaatcgatgcaaagcctacatgtgtccctttatgcagttcattgaaggggggagaagatatcagtgcggcttttgcaattgcgttaatgacgtgcctcctttttatttccagcacttagaccatatcggaaggaggctggatcactacgaaaagcctgagctctctctagggagctacgagtacgtagcgaccctggactattgccgaaaaagtaagccgcccaaccccccagccttcatctttatgattgacgtcagctattcaaacatcaagaacggcctggtaaagctgatttgcgaagagcttaaaaccatgttggagaaaattccgaaggaggagcaggaggagaccagcgctataagggtgggctttattacatacaacaaggtgcttcatttctttaatgtgaagtctaatcttgcacaaccccagatgatggtggtcacggacgtgggagaggtgtttgtgcccctgcttgatggttttctagtaaactatcaagagagccagagcgtcatccataacctattggatcaaattccagatatgttcgcagacagtaacgagaatgagactgtgtttgctcccgttattcaggcaggcatggaagccttgaaagctgccgattgtccgggcaagctgttcatctttcatagcagcctccctaccgcagaagccccaggcaaactgaaaaatcgggatgataagaagctcgttaatacagacaaggagaagatccttttccaaccgcagactaatgtctacgatagcttggctaaggactgcgtggctcatggctgttccgtaacactgtttctcttcccctcacaatacgtggacgtagcaagcttggggctggttccacagctgaccggcggtactctctacaaatacaacaacttccagatgcatctcgatcgacagcagttcctgaacgacctgcgtaacgacattgagaaaaagatcggctttgatgctattatgagagtgaggacttctaccgggtttcgagcgacggattttttcggcgggatcctcatgaacaacacaactgatgtggaaatggccgccattgattgcgataaggctgtgaccgtggagttcaaacatgacgataaactctctgaggatagcggggccctaatacagtgcgccgtgctgtacacaacaattagcggccagaggaggttaagaattcataatctgggactgaattgtagctctcagctcgcggacctctacaagtcctgtgagaccgacgctctaatcaacttttttgcaaaatccgcttttaaagccgtcctgcatcagcctctgaaggttatccgggaaatccttgttaatcagacagctcatatgttggcatgctaccgaaaaaattgcgcgagcccctcagccgcaagccagctcatcctccccgacagcatgaaagtcctgccggtgtacatgaactgcttgctgaaaaattgcgtgttactgagcagacccgagatttctacggatgaaagggcgtatcaaagacagctggtcatgaccatgggagttgcagattctcagctcttcttctaccctcaattactgcctatccatactctcgacgttaagtctaccatgctgcccgccgccgtgcggtgctcagagtcccggctttcagaggaagggattttcttactcgccaacggcctgcacatgtttctgtggttaggcgtttctagtccaccggagttaatccaaggaattttcaacgttcctagcttcgcccatatcaataccgacatgaccctgctgcccgaagtaggcaacccatatagccagcagctgcgcatgatcatggggataatccagcagaagaggccctacagcatgaaactgactattgttaagcagcgtgagcagccagagatggtatttagacagtttctggtggaggacaagggtctgtacggcgggagctcttatgtggacttcctgtgttgtgtgcataaggaaatttgccagctcctgaattag

SEQ ID NO: 45779 - DNA, 1182 bp, Artificial Sequence
  Description of Artificial Sequence: Synthetic coding sequence
atgatcgacgtgagctacagcaacatcaagaacggcctggtgaagcttatctgtgaagaactgaagaccatgttagaaaagatcccgaaagaagaacaggaggaaacaagtgccatcagggtcgggtttatcacttacaacaaggtattgcacttcttcaacgtgaaaagcaatctggcccagccacaaatgatggtcgtcacagatgtaggggaagtcttcgtccccctgctcgatgggttcctggtcaattaccaagagtcccagtctgtaatccacaatcttctggatcaaatcccggacatgtttgccgattcaaacgagaatgagacggtcttcgcaccggttattcaggctggtatggaggcgctcaaggcagctgattgtcccggcaagctcttcatctttcatagttccctcccaacggctgaagcccctggtaaactgaagaatcgggatgataagaaactggtcaatacagacaaggaaaagattctttttcagccacagacaaatgtgtacgattctctggctaaagactgcgttgctcacggctgcagcgtgacgctattcctcttcccgtcacaatacgtggatgtggcctcactgggtcttgtcccacagctgactggcggcaccttgtataagtataacaactttcagatgcatctggaccggcagcagtttttgaatgaccttagaaatgacatagagaagaagatcgggtttgacgccataatgagagtgcggacgagtaccggctttagagccactgatttctttggggggattcttatgaacaataccacagatgtggagatggcagcgattgattgtgacaaagcagtgacagttgaattcaaacacgacgataaactgtccgaggatagcggcgccctgatccaatgtgccgtcctgtacacaacaattagtgggcagcggcgcttgagaattcacaatctgggtctcaattgtagcagccaactagcagatttatacaaaagctgcgaaactgatgctctgattaattttttcgccaagtcagctttcaaagccgtccttcaccagcccctgaaagtgattagggaaattctggtgaatcaaactgcccacatgctggcatgttaccggaagaactgcgcctctcctagtgctgcctctcaattcacgtgcgagaagtag

SEQ ID NO: 45780 - DNA, 1182 bp, Artificial Sequence
  Description of Artificial Sequence: Synthetic coding sequence
atgatcgacgtgagctacagcaacatcaagaacggcctggtgaagttgatttgcgaggaactcaagacaatgttggaaaaaatccccaaagaagagcaggaggaaaccagtgctatccgggtcggcttcatcacttacaataaggtcctgcattttttcaacgtcaaatcgaatctcgctcagcctcagatgatggttgtcaccgacgtgggggaagttttcgtgccactcctggatggattcctcgtgaattaccaggagtctcaatccgtgatccacaacctgctagatcagattccggatatgtttgctgactcgaacgagaatgagacagtgtttgcaccggtaatccaggcagggatggaagctctgaaagccgccgattgcccaggaaaactgttcatttttcatagctccctgccaaccgctgaggctccaggcaagctaaagaatcgcgacgataagaagctggtcaatacggataaagagaagatcctcttccaaccacagaccaatgtttacgactccctggccaaggattgcgtcgctcatggctgtagcgtgacactattcctgttccctagccagtacgtcgatgtggcctcactgggactggtgcctcagctcacaggtgggactctatataagtacaataattttcagatgcatctcgatcgccagcagtttctcaatgacctgcggaacgatatagagaaaaagatcgggttcgacgccattatgcgtgtgcggacttccactgggttccgtgcaacggacttctttggaggaatcctaatgaataatacgacggatgtcgaaatggccgctatcgactgtgataaagctgtcacagtggagtttaagcacgacgataaactgtcagaggacagcggcgcactgattcaatgcgccgtgctgtacactacaatctctgggcagcgtaggctgcgaatccataaccttggtctcaattgcagcagccagctcgccgatttgtacaagagctgtgagaccgacgctctgattaactttttcgccaagagcgcctttaaggccgtgctccaccagccactgaaagtgatccgggagattctggtcaatcagaccgcgcatatgctggcgtgttataggaagaactgcgcaagtccttccgccgcttctcaattcacatgcgagaaatag

SEQ ID NO: 45781 - DNA, 2910 bp, Artificial Sequence
  Description of Artificial Sequence: Synthetic coding sequence
atggtgaagctggtgctgctgagcatcgtgctgctgaaggtgaccgtacctaagctgagcaatgatctgctgcaactcgacttcatgcccattcaccgggggatcttggccattgcatggtcgatggcggatcctgaactactgctatcttgcggtaaggacgctaaaatattgtgttccaatcccaatactggagaggtcctttacgagctgccaacgaacacacagtggtgctttgatattcagtggtgtcctcggaacccggcagtgctgagcgctgccagttttgatggcagaatcagcgtctactcgattatgggaggcagtacggacggactcagacaaaaacaggtggacaaattgtcctcatcctttggcaaccttgacccctttggcaccggccaacccctgcctccattgcagataccccagcaaacggctcagcactcgatcgtattgccgctgaaaaaaccgccgaagtggataaggaggcccgtgggcgcaagtttttcgttcggaggcaagctcgtgacatttgaaaacgtcagaatgccaagccatcagggcgcagaacaacagcagcaacagcaccacgtttttatatcacaggtcgtaaccgaaaaagagtttcttagtaggtctgatcagctgcagcaggctgtccagtcccagggtttcatcaactactgccaaaagaagatagacgcctcccagacagagttcgagaaaaacgtatggtccttcctcaaagttaatttcgaggatgatagccgcgggaaatacctggagttactgggctatcgcaaggaagaccttggaaaaaaacacataaaggaagaaaaggaagaaagcgagtttctgcccagttcagggggcacttttaatattagcgtgagcggagatatagacgggctaattacccaggccttacttaccggaaattttgagtcagccgtggatctatgcctgcacgacaatcgcatggccgacgcaatcatactggccatcgctggcggacaggaactgctcgcaagaacgcagaaaaagtatttcgcaaaatcccagtcgaagattacccggctgatcactgctgtggttatgaagaactggaaagagattgtggagtcatgcgatctgaagaactggagagaggcactggccgcagtcctaacctatgctaagcccgatgagtttagtgccctgtgtgacctgctggggactagactggaaaatgagggtgacagcctcctccagactcaggcgtgcttgtgttatatttgtgcaggaaacgtagaaaaacttgttgcatgctggactaaggctcaggatggatcccatcctctgtcactgcaggatctgatcgaaaaggttgtgatactgcggaaggccgtccagctcactcaagcaatggatacaagcactgtcggagttctcctggcagcaaagatgtcacaatatgctaacctgctcgccgcccaggggtcaatcgctgctgccctagccttcctaccagataataccaatcagccaaatataatgcaactgcgcgacagactgtgcagagctcagggtgaaccagtagccggccacgagtcgcccaagattccttacgaaaaacagcagttacctaaggggagaccagggcccgtagctggacaccaccagatgcctagagtacagacccaacagtactaccctcatgtgagaattgcccctactgtgacaacctggagcaacaagactccaaccgctttaccctctcacccacccgcggcgagcccctccgatacgcagggtgaaaaccccccgcccccaggttttatcatgcacggcaacgtgaaccctaacgcagctggccagttgccaactagcccaggacacatgcacacacaggtgcctccttatccccagccacagccttaccaacccgcccagccctacccgtttgggaccggggggtccgccatgtaccgcccccagcagccagtcgcacctcccacgtctaatgcttatcctaacactccctatatctcttccgcctcgagttacactggacagtcacagctctatgcagcgcagcatcaagcctcaagcccgacctccagtcccgcaacaagctttccgccaccacccagttctggtgcatcttttcagcacggcggaccaggtgcacccccatcatcatcggcttatgctctgcctcctggcaccactgggccgcaaaacgggtggaacgaccctccagccttgaatcgggtgcctaaaaaaaagaagatgccggaaaacttcatgcctcccgtcccaatcaccagcccgataatgaaccccttgggagacccacaaagccaaatgctgcagcagcagccatccgcccccgttcccctaagtagccaatcttcatttccccaaccacacctcccagggggacagcccttccatggggtacaacagcctctgggtcagactggcatgcctccaagtttttccaagccgaatatcgagggagcgccgggcgccccaatcggaaatacctttcaacacgtgcagagtctgccgacaaaaaagatcactaagaagccaatccctgatgaacatctcatactgaagactacgtttgaggatctgattcaacgctgcctatcatccgccactgacccccagaccaagcggaaacttgatgacgccagcaaaaggttagaattcctctacgataagctgagagaacagactctctcgccgaccatcacctcagggcttcacaacatcgccagatccattgaaacaagaaattattccgaaggactcactatgcacacccatatcgttagcacatctaatttctcagaaacttcggccttcatgcctgtgctgaaagttgtattgactcaggctaataagctcggcgtttag

SEQ ID NO: 45782 - DNA, 3321 bp, Artificial Sequence
  Description of Artificial Sequence: Synthetic coding sequence
atgaagctgaaggaggtggaccggaccgccatgcaggcctggagcccggcccagaaccatccaatttacttagctacaggtacatccgctcaacagttggatgcaaccttttccaccaatgcttcgctcgaaatattcgagctcgatctgtctgatccttccctggacatgaagagttgcgctacctttagttccagccatcggtaccacaaattaatctgggggccatataagatggacagcaagggcgatgtctccggcgtgctcatcgccggcggtgaaaacggaaatataatcctgtatgaccctagcaaaattatagctggcgacaaagaagtcgtcatcgcacagaacgataagcacacaggtcccgtgcgtgcgctggatgtaaatatcttccagacaaacctggtcgcgagcggggccaacgaatccgagatctatatctgggacttgaacaacttcgccacacctatgacccccggggcgaaaacacagccaccagaagacatctcatgtatcgcttggaaccggcaggtgcagcacatccttgcctctgcatcaccttccgggcgagccactgtgtgggacttacggaaaaacgagcctatcatcaaggtgtccgaccattccaaccggatgcactgtagtgggctggcgtggcaccctgatgtagctacacaaatggtactggctagcgaagacgacaggcttcccgtgatccagatgtgggatttacgctttgcctcttcgccgttgagggtcctggagaatcatgcgagggggatcctggccattgcatggtcgatggcagaccctgaattgctgctttcctgcggcaaggacgcaaaaatcctttgctcaaaccctaacacgggcgaggtcctttatgaactgcctaccaacacacagtggtgtttcgacatccaatggtgcccgaggaacccggccgttttgtcagctgccagctttgatggccggatcagtgtttactccattatgggtgggagtactgacgggttaagacagaaacaagtagataaactgagctccagtttcggcaacctcgatccttttggcactggccagcctctgcctccattgcaaattcctcagcagacagcccaacactcgatcgtgcttcctctcaaaaaaccacccaaatggatccgtcggcctgtgggggcctctttcagcttcggtggcaaactggtcacgtttgagaatgtccggatgccctctcaccaaggggcagaacagcagcagcagcaacatcatgtcttcatttcgcaggttgttaccgagaaagaattcctctcccgaagtgatcagctgcaacaggcagtccagtcacaagggttcatcaactactgccagaagaagatcgatgcctctcaaaccgagtttgaaaagaatgtctggagttttctgaaggtgaactttgaagatgactcacgaggaaaatacctggaactgctgggttaccggaaggaagatctcgggaagaagatcgcactcgccctaaacaaggtggacggggctaacgtcgccttgaaggactcggaccaagtcgcacagtcggatggcgaggagtcaccagcggccgaagagcagctgctcggtgaacatattaaagaggagaaagaggagtcagagttcttgcccagtagcggtgggacatttaacattagtgtgtccggcgacatagacggccttatcacgcaggcattgctgactggaaacttcgagagcgccgtggatctgtgcctacatgacaatagaatggcagatgccataattctcgccattgccggcgggcaggaactcctggccagaacccagaagaaatacttcgcaaagtcacagagcaagatcacccgcttgatcacagccgtggtcatgaagaattggaaggaaatcgtggagtcttgcgacctgaagaactggagagaagcgcttgccgcggttctgacatacgcaaagcctgacgaattcagcgccctctgcgacctgctagggacaaggctggagaatgagggtgactctcttcttcagacgcaggcatgtctgtgttacatctgcgcgggaaacgtagagaaactggttgcctgctggactaaagcacaggacgggagccacccccttagtctgcaggacctgattgagaaggtcgtcattcttcggaaggccgtgcagttaacgcaggccatggatacttccactgtgggcgtcttactggctgccaagatgagtcagtacgcaaacctacttgccgcacagggtagcatcgctgccgccctggcgtttctccccgacaacaccaaccagcctaatataatgcagttgcgagacaggctttgcagagcccagggagagccagtggccggccacgaatcaccaaaaatcccgtatgaaaaacagcagctgcctaaaggcaggccaggacccgtcgctgggcaccaccagatgccgagagtacagacccaacagtattatccccacggggagaacccccctccacccgggttcataatgcacggaaatgtgaatcctaatgccgcaggacaactacccacttcacctggtcacatgcacacccaggtccctccatatccccagcctcagcggccgcagaatgggtggaacgacccccctgcccttaaccgagtacctaagaaaaagaaaatgccagagaatttcatgccccctgtgcccattacctccccaatcatgaaccccctgggggacccccaatcacagatgctacagcagcagccctcagcccctgttccactcagcagccagtcctcctttcctcagcctcatctgcctggcggccagccattccacggggtgcaacagcctctgggacaaacagggatgcctccatcattttcaaagcccaacattgaaggagcccccggcgctcccatcggaaacaccttccaacatgttcagtctttgcccactaagaaaatcaccaagaaacctatacccgatgagcaccttatcctgaaaactacattcgaggacctgattcagaggtgtctcagcagcgctacagacccccagaccaaaaggaagctggatgacgcctccaagcgcctggagttcctctatgataaactgcgcgaacagactctgagccctacaataacatcggggctgcacaatatcgcaagatcaatcgagactaggaattatagcgaagggttgactatgcacacgcacatagttagcacaagtaatttcagtgagacatccgctttcatgccggtactgaaagtggtactcacgcaagcaaataagttgggggtctag

SEQ ID NO: 45783 - DNA, 3546 bp, Artificial Sequence
  Description of Artificial Sequence: Synthetic coding sequence
atgaagctgaaggaggtggaccggaccgccatgcaggcctggagccccgcccagaaccaccctatatacctcgctacaggaaccagcgcacagcagcttgatgctacattcagtaccaatgcctctttggagattttcgaactggacctgagcgacccctcactggacatgaagtcttgcgccacgttctcctcctcccatcgataccacaaactaatttggggcccctacaaaatggattctaagggcgatgtttcaggggtgttaattgcagggggtgagaatggcaacatcattctgtatgatccctctaagataatcgccggggacaaagaagtggtcattgcacagaacgataaacatacaggacccgtgagggccttagatgtcaacatcttccagaccaatttagtggcttcaggggctaacgaatccgagatttatatttgggatcttaacaacttcgcgacccctatgactcccggcgccaagacccagccacccgaagatatctcctgcatagcctggaataggcaagttcagcacatcctcgccagtgctagcccgtctggccgtgccactgtctgggacttacgtaagaacgagccaattattaaagtctctgatcactccaacagaatgcactgctccggcttagcgtggcaccccgacgtggctactcagatggtcttggcctctgaggatgaccgtttacctgttattcaaatgtgggacctgaggttcgcttcttctccattgcgcgtgctggagaaccacgctagagggatcttagccatagcatggtcaatggccgacccagagctcctgttgagctgcggcaaagatgctaagatattgtgttccaatcccaacaccggtgaggttctctatgagctgcccacaaatacacagtggtgttttgacatccagtggtgtcccaggaatcccgctgttctgagcgcggcctcctttgacggccggataagcgtctactccatcatgggcggatccaccgacggtctccgacagaaacaggtcgacaaactttcatcatcattcggcaacctcgatccatttggcactggacagcctctgccccctctgcaaatcccacagcaaaccgcccagcatagcatcgtgcttccactgaaaaaaccacctaaatggatccgaagaccggtcggcgcctccttctcttttggcgggaagctcgtgacctttgaaaatgttcgcatgcctagccaccaaggagccgaacagcagcagcagcaacaccacgtctttatctcccaggttgtaacagaaaaggagttcctgagccgctctgaccagctccaacaggccgttcagtcccagggcttcatcaattattgtcagaagaagattgatgcgagtcagactgagttcgaaaagaacgtatggagtttcttgaaggttaacttcgaggatgatagcagaggtaagtacctcgagcttctcgggtatcgaaaagaggatctcggaaaaaaacatattaaagaggagaaagaggagagcgagtttttgccgtcttccggagggacttttaatatcagtgtttcgggggatattgatggcttaatcacacaggccctcctgactggaaatttcgagagtgcagtggatctgtgcttacatgataaccgtatggcggatgctatcatcctcgcgatagccggaggccaggaactgttagctcggacccagaagaaatacttcgcaaagtcccagtcaaagattacgagactgattaccgcggtggtgatgaagaattggaaagagattgtcgagtcttgcgatcttaaaaactggagggaggccctggccgctgttctaacctatgcgaagcctgatgagttcagcgctctgtgtgatcttcttggtactcgtctggagaatgaaggcgactctcttcttcagacccaagcatgcctgtgctacatttgcgcaggcaatgtggagaaactagtggcctgttggaccaaggcacaggatgggtcccaccccctctccctgcaggatctgattgagaaagtggttatcctgcgaaaagccgttcagctgactcaggccatggacacgtctacggtaggcgtgctgctggctgccaagatgagccagtacgcgaatctgctcgccgcccaggggtcaattgccgccgcactggcattccttccggacaatactaatcagcccaatattatgcaattgagggataggttgtgccgagcacagggcgaacccgtggctggccacgagagtcctaagattccttatgaaaagcagcagctcccaaaaggcaggcccggccctgtggccggacaccatcagatgccacgggtgcaaacccagcagtactaccctcacggagaaaatccgcccccaccagggttcatcatgcatggcaatgtgaatcccaatgctgcagggcagcttccaaccagccccgggcacatgcatacacaggtccccccctacccacaaccccagccctaccagcctgctcagccctatccattcgggacagggggaagtgccatgtacaggcctcagcagccggtggctccaccaactagcaacgcttaccctaacactccttacattagcagtgcaagttcctacaccggtcagtcgcagctgtacgctgcccagcatcaggcttctagtcctaccagttctcctgcaacttccttcccacccccaccgagcagcggcgcctcattccagcatggggggcctggcgctcctcctagtagttcagcatatgctctgccacccggtacgaccggcacactaccagctgcttccgagctccccgcttcccagcgcaccggtccacagaatggatggaacgacccgcccgccctgaatagggtgcccaagaagaaaaaaatgccagagaattttatgcccccagtgccaatcacaagccctatcatgaacccattaggcgatccacagtcacagatgctgcagcagcaacccagtgcacctgtgccactgtctagccagagctcatttccacagcctcatctcccaggtggtcaacccttccatggcgtgcagcagcctctcggccaaacagggatgccgcccagtttcagtaagcctaatatcgaaggagcaccaggagcacccatcggcaacactttccaacacgtccagagtctgcccaccaaaaagatcaccaagaagccaattcctgacgagcacctgatcttgaagacaacatttgaagatctgattcagagatgtctgtcaagcgctacagatccccagacgaagcgaaagcttgatgatgcatcaaaaagactggaatttctgtatgacaagctgcgcgagcaaaccctcagtcctacgatcacttcaggcttacataacatagcacggtcaatagagactcgcaactacagcgaaggcctaaccatgcatactcacattgtcagcaccagcaacttctccgagacatccgcttttatgcctgtacttaaggtggtccttacacaagccaataagctcggagtgtag

SEQ ID NO: 45784 - DNA, 3546 bp, Artificial Sequence
  Description of Artificial Sequence: Synthetic coding sequence
atgaagctgaaggaggtggaccggaccgccatgcaggcctggagcccagcccaaaaccatcctatttacctcgccaccggcaccagcgcacaacaactggatgccacgttttctactaacgccagcctcgagatcttcgagctggacctctcggacccttcactggacatgaaaagctgcgcgaccttctcttcgtcccatcgataccataagctgatttggggcccctacaagatggacagcaaaggagacgtgtccggcgtcctcattgctggcggagaaaacggaaatattatcctttacgacccatcaaagatcatcgctggtgacaaggaggtggtaattgctcagaatgataagcacactggcccagtgagggctcttgatgtgaatatcttccaaacaaacctcgttgcctcaggcgccaatgaaagcgagatatacatctgggatcttaacaatttcgcaactccaatgactccgggagcgaaaactcagcctcccgaggacatatcctgcatagcctggaatagacaggtgcagcacattctggcctctgcttccccttctggccgtgcaaccgtctgggatctccgcaaaaacgagcccataattaaggtgtcggaccattcaaacaggatgcactgttccgggcttgcctggcatcctgatgtcgctacccagatggtcttggccagcgaagatgatagactgccggttattcagatgtgggaccttagattcgcgagcagcccgctgagagtgcttgagaatcatgccagaggcatactggcaatcgcttggagcatggctgatcctgagttattgctgtcttgcgggaaagatgccaagatcctgtgtagcaacccaaacacaggggaggtactatatgagctgcctaccaatactcaatggtgtttcgatatacagtggtgtccacggaatccagcggtattatctgctgcttcctttgacggacggatcagcgtatattctatcatgggagggtccactgacggcttgcggcagaagcaggtggacaagctatcttcttcctttggcaacctggaccccttcgggactggtcagcccttacctcctttgcagattccccagcagacggcccagcacagtatcgtgctgcctctgaagaaacctcccaagtggatccggaggcctgtcggtgccagttttagcttcgggggaaagctcgtaaccttcgagaacgtgcggatgccgtctcatcagggagcggagcagcagcagcagcagcaccacgtgtttattagccaggtggtcacagaaaaagagtttctgagccgctctgatcagctccagcaggcggtgcagagccagggtttcatcaattactgccagaaaaagatcgatgcttcgcagacagaatttgaaaagaatgtttggtcctttctgaaagtgaatttcgaagatgactcccgtggaaagtacctagaattactcggctaccgcaaagaggatcttgggaagaagcatataaaggaggaaaaggaagaatccgagttcctaccgtcgtccgggggcacatttaacatttcagtgagcggggacatcgatgggcttattacccaggctcttctcaccggaaatttcgagtccgcggttgacctgtgtctccatgacaaccgtatggctgatgcaatcatcctggctatcgctggtggccaggagctgctcgctcggactcagaagaagtatttcgcaaaaagccagagcaagattacccgtctcataactgctgtggtgatgaaaaactggaaggagatagtcgagagctgtgatctgaaaaactggcgagaagccttggccgccgtgttgacttatgccaagccagacgagttcagcgccctttgtgacttgttggggaccagactggagaacgagggggatagtcttttacagacccaggcctgcctgtgctatatttgtgccgggaacgtggagaagcttgtggcttgttggactaaagcgcaggacggctctcaccccttgagtctccaggatctgatagagaaagtggtaatcttgagaaaggccgtacagcttacacaggccatggatacatctaccgttggcgtgctgttggcagccaaaatgtcccagtacgcgaatctcctagctgctcagggatccattgccgccgcattggccttccttcctgacaacactaaccagcccaatatcatgcagctgcgggatcgactctgccgcgcacagggcgagccagtcgctgggcacgagtccccaaagataccatacgagaaacagcagctcccaaaagggagaccaggaccagtggccgggcatcatcaaatgccacgggtgcagacccagcagtattacccacacggcgaaaatccccctcccccaggcttcattatgcatggcaacgtcaatcccaatgcagcaggtcagttgcccacatcacctggacatatgcacacgcaggtgcccccttatccccagccgcagccgtatcagccagctcagccttatccatttggtaccggcgggtctgcgatgtatcggccccaacagcctgtggcccctcccacctccaatgcctatccaaatacaccctatatctctagtgcgagttcatacacgggccagtctcagttgtacgctgcgcagcaccaagccagcagccccacatcctctcctgccacctccttccctccaccaccttcaagcggagcgagttttcagcacggaggccctggagcccccccctcttctagcgcatacgccctcccacccgggaccactggtaccttacccgcggctagtgagctaccagcaagtcagcggacggggccacagaacggctggaacgatccacctgctttgaatcgggtgcctaaaaagaagaaaatgcctgagaatttcatgccaccggttccaattaccagccccattatgaatcccttaggtgatccgcagtcacaaatgctgcaacaacagccaagcgcacccgtccccctgtcttcacagagtagcttcccgcagcctcacctccctggcggccagccatttcacggagtccagcagcccctcggtcaaaccggcatgcctccctctttttcaaagccaaatattgagggagcacccggcgctcctatcggaaatactttccaacatgtgcagagtttgccaactaaaaagattactaaaaagcctatcccagacgagcatctcatccttaaaaccaccttcgaggacctgatccaaaggtgtctcagctctgccaccgatccccagactaagaggaaactggacgacgcaagtaagaggctcgagttcctgtatgataagctgcgcgaacaaaccttgtcccccacaatcactagtggccttcacaatatcgccagaagtattgaaacacgtaattattcagaaggcctgaccatgcacacacatatagtttccacatcaaatttctccgagactagcgcctttatgcccgtcctcaaagttgtcctgacgcaggccaacaagcttggcgtatag

SEQ ID NO: 45785 - DNA, 3663 bp, Artificial Sequence
  Description of Artificial Sequence: Synthetic coding sequence
atgaagctgaaggaggtggaccggaccgccatgcaggcctggagccccgcacagaaccatcctatatacctggctactgggacctcagctcagcagttggacgccacgttctccacaaatgcgagcctggaaatttttgagttggatctcagtgatcccagcctggacatgaagtcctgtgcaacattctcatcctctcacagatatcacaagctcatctggggaccttacaaaatggattccaagggcgacgtgtccggagtgctcatcgctggaggtgaaaatggcaacattatcctgtatgaccccagcaaaattattgcaggtgacaaagaagtcgttattgctcagaatgacaagcacactggcccggtgagggctttggatgtaaacatcttccaaaccaatctggtagcatccggggccaacgagagtgagatatatatttgggatctgaataatttcgcgacccctatgacccctggtgcgaaaacacagccccccgaggatatttcatgcatcgcctggaatagacaagtgcagcatattctggcgagtgcgtcgccctccggccgggctacagtgtgggacctacgcaagaacgaacccattattaaagtgagtgatcacagcaatcggatgcactgtagcggactggcttggcatccggacgtggcaacccagatggtgttggctagcgaagatgacaggttgcccgtgatacagatgtgggaccttaggttcgcaagctccccgcttagggtgctcgagaaccacgctcgcggcattctcgcaatcgcatggagcatggcagacccagaactccttctctcctgcggaaaggacgctaaaatcttatgcagcaatcctaacaccggtgaagtgctgtatgaactgcccaccaacacccagtggtgctttgatattcaatggtgtccccgaaacccggccgtgttatccgctgcctccttcgacgggcgcatttcagtctactccatcatgggaggtagtacggacggactgcgccagaaacaagtcgacaagcttagctcaagttttggcaacttagatcccttcggcaccggacaacctctcccaccattgcagatcccacagcagaccgcacagcatagcatcgttctgccactcaagaaaccacccaagtggatccgtagaccggtcggggcttcattttccttcggtggcaagctggtaaccttcgagaacgtaaggatgcctagtcaccagggcgctgaacagcagcagcaacaacaccacgtgtttatctctcaggtggtcacagagaaggaatttctaagcagaagcgaccagcttcagcaggctgtccagtcccagggctttattaattattgccagaaaaagatcgacgcctcccagaccgaatttgagaagaacgtgtggagcttcctaaaggtcaacttcgaggacgactcacgcggaaagtatctggaactgctggggtaccgaaaggaagacttgggcaagaagatagcccttgctctgaacaaggtcgatggtgcaaacgtggctctcaaggacagcgaccaggttgcacagagtgacggcgaggagtctcctgctgcagaagagcagctcctgggagaacacattaaggaggagaaagaggaaagcgaatttcttccaagctccggggggacatttaatatttctgtctcaggtgacatcgacgggctgataacacaggcgctgctaactgggaacttcgagtcagccgtagacttatgtctgcacgataataggatggcagacgccataatacttgctatcgctgggggccaagaactgctggcacgcacacagaagaagtactttgccaagtcccagagtaaaattacccggctcatcacggctgtggtgatgaaaaattggaaagagatcgtcgagtcatgtgacttgaagaattggagggaagctttggccgctgtgcttacatacgctaaacctgacgagttctccgcgctatgtgacctgttgggcacgcgcctcgaaaatgaaggagattcactattacaaacacaggcctgcctgtgttatatttgcgccggcaatgtggaaaaactggttgcttgttggaccaaggcccaggatggcagccatccattgagcctccaggatctcatcgagaaagttgtgattttacgcaaagcagtccagctaactcaagcaatggacacaagcactgtcggcgtcctgttagcggcaaaaatgtcgcagtatgctaatcttctggccgcacagggaagtatcgcagcggcattggcgtttctcccagacaacactaaccagcctaacattatgcagttgagagacaggttgtgtcgtgcccaaggggagccagtggctggacacgagtcaccaaaaatcccatatgagaagcagcagctccccaaggggcgccccgggcccgttgccggccaccatcagatgccccgagtccagacacagcagtactacccacacggcgagaatcccccacctcccggctttattatgcatgggaacgtcaatccaaacgccgcagggcagctgccgacttctcctggccatatgcatacccaggtaccaccataccctcagccgcagccgtaccagcctgctcagccctatccttttggcaccggaggtagtgcaatgtaccggcctcagcagccagtcgcaccacctacatccaacgcctatcctaatactccgtacatcagttctgcatccagctacactggccagtctcagctgtacgctgcccagcaccaggcatccagccctacctctagtcctgccactagcttccctcccccacctagctctggagcctcttttcagcatgggggtcccggggcaccaccaagcagcagtgcatatgcccttcctcctgggaccaccggtactctgcctgcagcctcagagctgcccgcctcccaacgcaccggaccacagaacggatggaatgacccccctgccctcaaccgggtccccaagaagaagaagatgcctgagaatttcatgccccctgtgcctatcactagtcccattatgaacccattaggggatccacagagccagatgcttcaacagcagcctagtgctcctgtaccactcagctcgcaatcctcattcccgcagcctcacctaccaggtggtcagcccttccatggtgtgcagcagcccctgggtcagaccgggatgccaccatctttttccaagccaaacattgaaggggcccctggcgctcctatcggaaacacgttccagcatgtgcagtcgctccctaccaaaaagattacgaaaaagccaatccctgacgaacacctcatcctcaaaactactttcgaagatctgattcaaagatgcctgagcagcgccactgacccccaaacaaaaaggaagctggacgatgcctctaagaggttggagttcctgtatgacaaactgcgcgaacagacactgtcgccaacgatcacctcaggtctccacaacatagctcgctctattgagaccaggaattacagcgaaggtctcaccatgcacacccacatcgtgagtacttcaaacttttccgaaacttcggcctttatgcccgtgctaaaagttgtgcttacccaagccaataagttaggcgtgtag

SEQ ID NO: 45786 - DNA, 3663 bp, Artificial Sequence
  Description of Artificial Sequence: Synthetic coding sequence
atgaagctgaaggaggtggaccggaccgccatgcaggcctggagcccagcccaaaaccacccaatctacttagccacggggacaagtgcccaacagttagatgccacctttagtaccaacgcctccctcgagattttcgaactcgatctcagcgatccttcgctggacatgaagagttgcgccacctttagttcaagccaccggtaccacaagctgatttgggggccctataagatggacagtaagggcgatgtgagcggtgtgctgatcgcgggtggagaaaacggaaatatcatcctctatgatcccagcaagattatcgcaggcgataaagaggttgttatcgcacagaatgacaaacatactggtcccgtgcgagctctcgatgttaatatcttccagactaacctggtggctagtggcgcaaatgagtcagagatttacatttgggatctcaacaattttgcaacaccaatgactcccggtgcaaaaacccaaccacccgaggacatatcatgcattgcttggaaccgtcaggtgcagcacattttggcttctgcctcccccagtggaagagcaactgtgtgggatctgcggaaaaatgaaccgatcatcaaggtatcggaccacagtaaccgcatgcattgcagtggcttagcgtggcatccggacgtggcaacccagatggtgctggcctcagaagatgataggctgcccgttattcagatgtgggacctgcgattcgcaagctcacctctgcgcgttctggagaaccacgcacgtgggatccttgccatcgcttggagtatggccgatcccgaattactgttatcttgcgggaaagacgcaaagattttatgttctaaccccaatacaggcgaggtgttatatgagctgcctaccaatacccagtggtgcttcgatatacaatggtgtccacgaaaccctgctgtgctatcggccgcgtctttcgatgggcggatatcagtttattctataatggggggaagcacagacggactgagacagaagcaagtagacaaattgtcaagctcattcgggaacctggacccctttggcacaggccagccactgcctcctttgcagataccacaacagactgcacaacactctatcgtccttccacttaaaaagccccctaagtggatcaggcgcccagtgggcgctagcttcagtttcggcgggaaactcgtgacattcgagaatgtgcgtatgccttcacatcagggggctgagcagcaacagcagcaacaccacgtgttcatttcacaggtcgtgactgagaaggagtttctttcccgctctgaccagcttcagcaagctgtgcaaagccagggctttataaattactgccaaaagaaaattgacgcttcacagacggagttcgaaaaaaacgtttggtcgttcctgaaggtgaactttgaggatgattcaaggggaaagtatcttgaactgctgggatatcgaaaagaggatctgggcaagaagattgcactggccttgaacaaagtggatggcgctaacgtggcactcaaagattccgaccaggtggctcagtccgatggcgaggagtctcccgccgccgaagagcagcttctgggggaacacatcaaggaggaaaaagaagaatcagaatttctcccgtcttctggaggaacattcaacatctccgtcagcggcgacatcgacgggctgatcacgcaggcccttctgacagggaactttgagtctgcggttgatctttgtttacacgataaccggatggccgatgcaatcatcttggcgattgcaggcgggcaggaacttttagcccggactcaaaaaaagtactttgcaaagtctcaaagcaagattacaaggctaataaccgctgtcgtgatgaagaactggaaagagatagttgaaagttgcgaccttaaaaactggagagaagccctcgcagccgtgctcacctatgccaagcctgacgagtttagcgcactatgcgatttactaggtactcggcttgaaaacgagggagattccctgttgcagacgcaggcctgcctgtgctatatttgtgccggaaacgtggagaaacttgtagcgtgttggaccaaggcacaagatggttcccaccctctttcactccaggatcttattgagaaggtggtcatcctccgcaaagctgtgcagctgactcaagccatggatacttccacggtgggcgtcctcctcgccgctaagatgtcacagtacgcaaacttgttggccgcacaaggcagcatagcagcagctctggccttcctgcccgataacacaaatcagccaaacattatgcagttacgggatcgcctttgccgcgcgcagggcgagcctgttgcaggccatgagtccccgaaaattccttacgagaagcagcagctgcctaagggtcgccccggccctgtagcagggcatcatcagatgcctagagtccagacccagcagtactacccgcacggagagaatcctcctccacccggcttcatcatgcacgggaacgtgaaccccaacgccgcgggccaattgccaacaagtcccgggcatatgcacacacaggtgcctccgtacccgcaacctcagccttaccagcctgcacagccataccccttcggaacggggggaagcgcaatgtataggcctcagcagcccgtcgcccccccaactagtaacgcctacccaaacaccccatacattagcagcgcctcaagttacactggacagtcccagctctatgccgcccaacatcaggcttcctcaccaaccagcagccccgcaacctcctttccccctcccccctcatcgggggcatcattccagcacggggggccgggtgcccctccaagctcgtctgcctatgccctgccgcctggaactacaggcacattacctgccgcctcagagttgccagcctcccagaggactggccctcaaaatgggtggaatgacccgcccgctttgaacagagtcccaaaaaaaaagaagatgccagaaaattttatgcctcccgtgcccatcaccagcccaatcatgaatcccctgggggaccctcagtcacagatgcttcaacagcagccatctgcccccgttccccttagcagccagtcttctttcccccagcctcatctgcctggagggcagccatttcatggcgtccagcagcctctcggccagacaggtatgcctccaagcttctctaagccaaatatcgaaggggccccgggcgctcctatcgggaatacgtttcagcatgtgcaaagcttgccaactaaaaagatcactaagaaaccaatcccggatgaacatctcatcctcaagactacgtttgaagacctgatccaaagatgcctctcttccgcaaccgatccacagaccaaaaggaagctcgacgatgcctctaaaaggctcgagttcctgtacgataagctgagggagcagaccttaagccccaccattacatccgggctgcacaatattgcacggagcatagagaccaggaattattccgagggcctcactatgcatactcacatcgtgtctaccagcaatttttccgaaacctcagcgttcatgccggtgttgaaggtggttctgacccaggccaacaagctgggtgtttag

SEQ ID NO: 45787 - DNA, 3702 bp, Artificial Sequence
  Description of Artificial Sequence: Synthetic coding sequence
atgaagctgaaggaggtggaccggaccgccatgcaggcctggagccccgcacagaatcatccaatctaccttgccacaggtactagcgcacagcagctggacgctacgttttccaccaacgcatccttagagatcttcgagctcgacttgagcgatccttctcttgatatgaagagctgtgctactttcagttcctcacataggtaccacaaactgatatggggcccttacaagatggattccaaaggggatgtgtctggcgtcctcatagccggaggcgaaaacggtaatatcattctctacgacccctccaaaatcatcgccggggacaaggaggtagttattgcacagaacgataagcacacaggaccagttcgtgccttggacgtcaacatcttccagacaaatttggtagcgtccggagccaacgagtcagaaatttatatctgggacctgaacaacttcgccacgcccatgacccctggagccaagacccaacccccggaagatatctcctgcatcgcatggaatagacaggtccagcacatactcgcaagtgctagcccctccggacgcgctacagtgtgggacctgaggaaaaacgaacccatcataaaagtgagtgatcattccaataggatgcactgtagcggcctggcctggcacccggatgtagccacccagatggtgctcgccagcgaggacgacagactccccgtcatccaaatgtgggatctgagatttgcctccagtccattgcgggtcctggagaaccatgctaggggtatacttgcgatcgcctggagcatggccgatcctgaactgctgctctcatgtggcaaggacgctaagattctttgctcaaaccccaacacgggggaagtactgtacgagctaccgactaacacccaatggtgctttgatatccaatggtgcccaagaaatcctgcggtgttaagcgccgcttcctttgacggaagaatttctgtgtatagcatcatgggtggctccacagacggcttaaggcagaaacaggtggataaactttcttcatcctttggcaatttggatccatttggaacgggtcaacccctcccacccctacagattccacagcaaacggcccaacactctattgtcctcccacttaagaaacccccaaagtggatccggcgtcccgtgggcgctagcttttcattcggtggaaagttggtgacgtttgagaacgtccggatgccctctcatcagggtgctgagcagcagcagcagcagcatcatgtattcattagccaggttgtaactgagaaggaatttctgtcccgctcagaccagcttcagcaggccgtgcagagtcagggattcataaactattgtcagaaaaagatcgacgcctctcaaaccgagtttgaaaagaatgtgtggagcttcttgaaggtgaatttcgaggatgatagccgaggcaagtacctggagctgctcggttacaggaaggaggacttggggaagaagatcgccctcgcgctcaataaagtcgacggcgcaaatgtggcgttaaaagacagcgaccaggtggcccagtccgatggtgaagagtcccctgcagccgaagaacagctactcggtgagcacattaaggaggagaaagaggaaagcgaattcctacctagtagcggcggcactttcaatatctcggtgtcgggagatatagacggactcattacgcaggcgttactcactggcaacttcgagagcgcagtcgatttgtgtctgcacgataaccgaatggccgatgcgatcattttagccatcgccgggggccaggaattacttgcccgcactcagaaaaaatactttgcaaaatcccagagcaaaattacccggctgatcaccgctgtcgtcatgaagaactggaaagaaatcgtcgagagctgtgacctaaagaactggagggaggccctggccgcagttttgacctacgcaaagccggacgagttctccgctctgtgtgaccttctcggcacacgcctcgaaaatgaaggcgatagcctgttgcaaactcaggcctgtttgtgctacatctgtgcaggaaatgtagagaagctggtcgcatgctggacaaaggcacaggacgggtcccatccattgtctcttcaggatctgatcgaaaaagtggtgattctgcgaaaagccgttcagctcactcaggctatggacacctccaccgtaggcgtcctgctcgctgcaaaaatgtcacagtacgcgaacttgctggcagcacaggggagcatcgctgccgccttagcgttcctccccgataacaccaaccagccaaatattatgcaactacgcgacaggctgtgccgcgcacagggtgaacctgtggctggccatgagagccctaaaatcccatatgaaaagcaacaactgcctaaaggccgtcccgggcccgttgctggccaccaccagatgcctcgcgtacaaacgcagcagtattatcctcacggcgagaaccctcctcctcctggatttatcatgcacgggaatgtcaatcccaatgctgccggtcagttgcccacatccccaggtcacatgcatacgcaggttcccccttatccacaaccacaaccatatcaacccgcccaaccgtacccttttggaactggcggttccgcaatgtaccgaccacagcagcccgtggcacccccgacctctaacgcatatccgaatacgccatatatctcctcagcatccagctatactggccagtctcaactgtatgctgcacagcatcaagccagctctcccacttctagccctgccactagcttcccacccccgccttcaagcggcgcaagcttccaacatggagggcccggtgcccctccatctagcagcgcgtatgctctgccacctggtacgaccggtactctgcccgctgcctccgaactgcccgcctctcagaggacagagaaccagtcgattcaagatcaggctccaatgttggaggggcctcagaatggatggaacgacccgcctgccctcaatcgcgttccaaagaagaaaaaaatgcctgagaacttcatgccccctgtgcctatcacttcacctatcatgaacccattaggcgacccccaatcacagatgctgcagcagcagcccagtgctccagtgcccctgtcatcacagtcctccttcccacaaccacacctgcccggcggccagccctttcacggagtgcagcagccactgggccagaccggcatgcccccgtcattttccaagcctaacattgaaggcgctcccggtgctccaattggaaataccttccagcatgtccagagcctgcccacaaaaaaaattaccaagaagcccatccctgatgagcatctcatcctgaagactacattcgaggacttgatccaaaggtgcttgagctcagctacagatccacagactaagagaaagctcgacgatgccagcaagcgtctggagttcctctacgataaactccgggaacagacactgtccccaacaattacaagcggtttacataacatcgcccggagcatagaaacccggaactattctgaagggctgacaatgcacacccatatcgtttctacctccaatttcagcgagacatctgcgttcatgccggtactgaaagttgtgctgacacaagcaaacaaactcggtgtctag

SEQ ID NO: 45788 - DNA, 3663 bp, Artificial Sequence
  Description of Artificial Sequence: Synthetic coding sequence
atgaagctgaaggaggtggaccggaccgccatgcaggcctggagccctgcccaaaaccatccgatctacctagctacggggacctccgcacagcaactggatgcaacgttctccaccaacgccagccttgagatttttgagctcgacctttccgatccttccctcgacatgaaaagctgtgcaaccttctcatcttcccaccgctaccacaaactcatttggggcccgtataagatggactctaaaggagacgtctccggcgtgctgatcgccggaggcgaaaacggcaatatcattttgtatgatccgagcaaaataattgcgggcgacaaggaggttgtgattgcacagaacgataagcacaccgggccagtgagggcactcgatgtgaatatatttcagactaaccttgttgcgagcggagccaacgagagcgaaatctatatctgggacctaaacaattttgccacacccatgacccccggtgctaaaacacaacctcctgaagacatctcttgtatcgcatggaaccgtcaggtccaacacatactggccagcgctagcccaagtgggcgggcaaccgtgtgggacttgcgaaaaaacgagccaataattaaggtgagtgatcactctaaccgaatgcactgctctggactcgcttggcatccagatgtggcaactcagatggtgctcgcctccgaggacgatcggctgcccgtcattcagatgtgggatctgcggttcgcatctagcccattgcgggtcctggaaaaccacgccagagggattctggcaattgcatggtctatggccgatccagaattgcttcttagttgtggcaaggacgctaaaattctgtgctctaatccgaatacaggcgaagttctctacgagcttccgacgaacactcagtggtgttttgatatccagtggtgtcccaggaatcccgctgtcctttcggctgcaagttttgacggtagaatctcagtgtattcaatcatggggggttccacagatgggctccggcagaaacaggtggataagctttcgtcctcctttgggaacctggaccctttcggcaccggacaaccactccctcccttacagatcccccaacaaacagctcagcactcaattgtgctgcccctcaagaagcctcccaaatggattcggcgtcctgttggcgcctcttttagtttcggaggcaaactcgttacatttgaaaacgtccgcatgccatcgcaccagggggctgagcagcagcagcagcaacaccacgtcttcattagccaggtggtgacagaaaaagaattccttagcagatccgatcagttgcagcaggctgtccagagccagggctttatcaactattgtcagaaaaagatcgatgcgtcacagactgagttcgagaaaaacgtttggagcttcttaaaggtaaactttgaagacgactctcgaggcaagtacttggagctgttgggctaccgcaaggaagacctgggtaagaagattgccctggcactgaacaaggtcgacggcgccaacgtcgcattaaaagactctgaccaggtcgcccaatccgacggagaggaatcgcccgctgctgaggaacaactgctgggagagcatataaaggaagagaaggaggagtctgagtttcttccttccagcgggggaaccttcaacattagcgtgtcaggcgatatagatggactgatcacacaagcactacttacgggaaactttgagagtgccgtggacttatgtcttcatgacaatcggatggcagatgccatcattctcgccattgctggaggacaggaattactcgcccggactcaaaaaaagtacttcgcaaaatcccagtcaaaaattactcgacttattactgcggttgtgatgaagaattggaaggaaatcgtcgagagttgcgatcttaagaactggcgggaagcgctcgcggccgtgctcacgtatgctaagccagacgaattttccgcactctgcgatcttctcggcactcggctggagaacgaaggcgattcgctactgcagacccaagcatgtctatgttatatatgtgctggcaacgttgagaaactggtcgcgtgctggacaaaggctcaggacggaagccatcccctgagcttgcaggatttgattgaaaaggtggttatcctgaggaaagctgttcagctgacgcaggcaatggacacttccactgtgggtgttctcctggccgcaaagatgtctcagtatgcgaatctgctggcagctcagggaagcatcgctgccgctctggccttcttgcctgataacacaaaccaacctaacattatgcagctgcgggatagactgtgccgagcgcagggcgagcctgtggccggccatgagtctcctaagattccttatgaaaaacagcagcttcccaaggggaggcccgggcccgtggctggccaccatcagatgcctagagtccagacccaacagtactacccccatggcgagaaccctccacctccagggtttatcatgcacggcaatgttaaccccaatgccgccggacagctgccaacttctccaggtcatatgcatacccaggtccctccatacccccagccgcagccttatcagccagcacagccttacccatttggtactggcggaagtgcaatgtatagacctcaacaaccggttgcccctccaacttctaacgcctacccaaacaccccatacataagttctgcctcctcctacacagggcagtcacaactctacgctgcccagcatcaggccagctctcccaccagtagccccgctacctcttttccacctcctcccagttccggggcatcatttcagcacggtggaccaggggccccacctagctctagtgcctatgcccttccccccgggactacaggtactttgccagccgccagcgagctgcccgctagccagcggacaggccctcagaatggatggaatgatccgccagccctcaacagggtgccgaagaaaaagaagatgcccgaaaacttcatgcccccagtgccgataacaagtcctatcatgaacccactcggcgatccacagagtcagatgttgcaacagcaacccagcgctccagtgcctctgtcatctcaaagcagttttcctcagccccatctgcccggaggtcagcctttccatggagtgcagcaaccactgggccaaaccggcatgcctcctagtttttctaagcctaatatcgagggcgcccccggcgcaccaattggcaacactttccagcatgtccaaagcctgcctactaagaagattaccaagaaaccaataccagacgagcacctgattctcaagactacctttgaagatctcattcagagatgtttgtcttccgctaccgacccacaaaccaagaggaaattggacgacgcctccaaacgtctggaattcttgtatgacaagctgagagaacaaaccctgtctccgacgataacaagtggattacacaacattgcccgaagtatagagacgaggaactactcagaaggactcactatgcacactcacattgtgagtacttctaacttcagcgagacctcggcctttatgccagtgttaaaggtcgtcctaacccaagcgaataagctcggagtgtag

SEQ ID NO: 45789 - DNA, 3204 bp, Artificial Sequence
  Description of Artificial Sequence: Synthetic coding sequence
atgaagctgaaggaggtggaccggaccgccatgcaggcctggagcccggcccaaaaccatcccatctatctagcgactggcacatctgctcagcagctggacgctaccttctctacaaacgcctcgctggaaatcttcgagttggatctgagcgatcccagccttgacatgaaaagctgcgcaacattcagcagtagtcatcggtaccataaactcatctggggaccctataagatggattctaagggggatgtgagcggagtgctgatcgccggaggcgaaaatgggaacattatcctgtacgatcccagtaagatcatcgcaggggataaggaggtcgtgatcgcccagaatgataaacacaccggaccagtcagagccctggatgttaatatttttcaaactaatctcgtggccagcggggccaacgagtctgagatatacatctgggatttaaacaactttgccactcccatgactccaggcgcaaagacacagcccccagaggatatctcctgcattgcctggaaccggcaggtgcagcacattctcgcgtctgcctcccccagcggccgggctactgtctgggatctcagaaaaaatgagcctattatcaaagtgagcgatcactcaaaccgtatgcactgctccggacttgcttggcacccagacgtcgccacacaaatggttctggcaagcgaggacgatcgactccctgtaatccagatgtgggaccttagatttgccagcagccctctgagggtcctcgaaaatcacgctcgggggattcttgccatcgcctggtcaatggccgatcccgagcttctgctcagctgtggaaaagatgctaagatactctgtagtaatcctaacacaggtgaggtgctgtatgaactgccaacaaacacacagtggtgtttcgatatacagtggtgccccaggaatcccgcagtgttgtcagcagcctctttcgacggcagaatcagtgtgtacagcatcatgggaggctctactgacggactgcggcagaaacaggtggataaactgtccagctcatttgggaatctagatccattcggcactggacagcccctgccacccttacaaattcctcaacaaaccgcacaacactccatagtgctccctctgaagaaaccaccaaagtggattagacgtcccgtgggcgcttccttcagtttcggagggaagctggtgacattcgagaacgtgagaatgccgagtcaccagggcgcagaacaacagcagcagcaacatcatgtgttcatcagccaagtcgtgacagagaaggaattcctcagtaggtcagatcaacttcagcaagcagtccagagccaaggtttcataaactactgtcagaagaagatcgatgccagccaaactgaattcgaaaagaatgtgtggagcttcttgaaggttaacttcgaagacgactcaagaggaaagtacctcgagctgttagggtaccgcaaggaggacctcggaaagaaacacatcaaggaagaaaaagaggaatccgagtttctccccagctcaggtggcacctttaacatcagtgtaagcggagacatagacggactgatcacacaggccctcctgaccggcaattttgagtcggccgtcgacctttgtctgcacgataacaggatggctgacgccatcatacttgcaatcgctggcggccaggagctcctcgcaagaactcagaaaaaatatttcgctaagagtcaaagtaagatcacacgcctgatcactgcagtggtgatgaaaaattggaaagaaatcgtggagtcctgtgatcttaaaaattggcgcgaggctctggctgccgtactcacctatgcaaaacccgacgaatttagcgctttatgtgatctgctgggaactcgcttggagaacgagggcgattctttgctccaaacacaagcctgcctctgctacatatgtgccggaaatgtcgagaagctggtggcttgctggaccaaagcccaggacggaagccatcccctgagcctgcaggacctcatcgagaaagtggtcatactgcgtaaggccgtgcaacttactcaggcgatggacaccagtacagtgggggtgctgctggctgctaagatgtcccagtatgcaaatctgcttgccgctcagggctcaatcgctgcagccctggcattcctgcccgacaacaccaatcagcctaatatcatgcagctgcgcgatcgcttatgtcgggcacaaggcgagcctgtagctggccacgagagccccaaaataccttacgagaagcagcaactacccaaaggtaggccaggacccgtggccggtcaccaccagatgcccagagtacaaacacaacaatactatccacacggcgaaaatcctccccccccaggatttatcatgcatggcaacgtgaacccgaacgccgccggccaactcccaacttcccccgggcacatgcatacacaggttcctccctatccacagccacagaggccccagaatgggtggaatgacccccctgcactgaaccgtgtccctaagaagaaaaagatgcccgagaatttcatgcctcccgtgcccataacctccccgattatgaatccattgggggaccctcaatcccagatgctccaacaacaaccctccgcccctgtgcccctcagcagccaatcatcatttccacaaccccacctccccggcggacagccctttcatggcgtacagcagcctttgggccagaccggcatgcccccatcattctcaaagcctaatatcgagggcgctccgggtgctcctattggaaataccttccaacacgtacagtctcttccgactaagaaaatcaccaaaaaaccaatacccgacgagcatcttatcctgaaaactaccttcgaggatctgattcaaaggtgcctgtccagcgcgaccgaccctcaaacaaagcgcaagctggatgacgcgtctaagcggctggagtttctgtatgataaactgagagagcagaccttaagtcccactataacgtcagggttacataatatcgcgaggtctattgaaactcggaactactctgagggcctgacgatgcacacacacattgttagcacctctaacttctctgaaacttcagcgtttatgcccgtgttaaaggtggtcctgacccaggctaacaaactgggggtgtag

SEQ ID NO: 45790 - DNA, 246 bp, Artificial Sequence
  Description of Artificial Sequence: Synthetic coding sequence
atgaagctgaaggaggtggaccggaccgccatgcaggcctggagcccggcccagaaccatccaatctacctggctactggcactagtgcccagcagctggacgccacattctcaaccaatgctagcctcgagatatttgaactggatttaagcgatccctccttggacatgaagtcctgcgctactttttcatcctctcacagataccacaagctgatctggggcccatacaagatggattcttag

SEQ ID NO: 45791 - DNA, 201 bp, Artificial Sequence
  Description of Artificial Sequence: Synthetic coding sequence
atgaagctgaaggaggtggaccggaccgccatgcaggcctggagcccggcacagaaccacccaatctatctggccaccgggaccagcgctcaacaactggatgccactttctccaccaatgcttctctcgaaatcttcgagttggatctgtccgaccccagcttggacatgaagtcctgcgcgactttttctagctcctag

SEQ ID NO: 45792 - DNA, 3501 bp, Artificial Sequence
  Description of Artificial Sequence: Synthetic coding sequence
atgaagctgaaggaggtggaccggaccgccatgcaggcctggagcccagctcaaaatcacccaatctacctggcaacaggcacttcggcacaacagttggacgccacgttctccaccaacgccagcttggagatttttgaacttgatctgagcgacccgtcactggacatgaaaagctgtgccacgttttcttcatcacataggtaccataaacttatctgggggccatataagatggattccaaaggagatgtcagtggagtgctgatcgctggtggggagaatggcaacataattctctatgatcctagtaaaatcattgccggagataaagaagttgttatagcccagaatgacaaacatacggggccagtgagagccttggatgtgaatatatttcaaaccaatcttgtagcttcaggggccaacgaatccgagatttatatttgggacttgaataactttgctaccccaatgactccgggcgccaagacacaacctccagaggatattagttgtattgcatggaatcgtcaagtgcagcacatcctggcaagtgcctccccgtctggtagggccacagtatgggatcttaggaagaacgagcctattattaaagtgtccgatcatagcaatcgaatgcattgcagtggtctggcctggcatccggatgtggcaacccagatggttctcgcgtccgaggacgatagactcccagtcatccagatgtgggatctgcgtttcgctagctctcccctgcgagtccttgaaaaccatgcgcgcgggattctggccatcgcctggtcgatggcagacccagagctgctgctgagttgtggcaaggacgccaaaatcctgtgtagtaaccccaatactggagaggtactgtacgagctgcctactaatacccagtggtgctttgatattcaatggtgccctagaaatcccgcggtgttgtcagcagcgtctttcgatggaagaatctccgtgtactctatcatgggggggtcaaccgacgggcttcggcagaagcaagtcgataagctttcgagtagctttgggaacctcgacccgtttggtacaggacaacctcttccccctctgcaaatcccccagcagacagcccagcatagtatcgtgctgccgctgaagaagcctcccaaatggatcaggcgtcctgtgggtgctagcttttccttcggtgggaagttagtgactttcgagaacgtgaggatgccctcccaccaaggcgcagaacagcagcagcagcagcaccatgtgtttatcagtcaggtcgtcactgaaaaagagtttctgtcacgttctgaccaactgcagcaggctgtccagtctcaagggtttataaattactgccagaaaaagatcgatgcctcacagactgaattcgaaaaaaacgtgtggagcttcctgaaagtgaacttcgaggatgatagcaggggcaagtaccttgagttgctgggatatagaaaggaagaccttgggaagaagcatatcaaagaagagaaggaagagagcgaattcctgcccagctctgggggcaccttcaacatctcagtgtcaggggacatagatgggcttatcacccaggctctactgacaggaaacttcgagagcgctgtcgacttgtgcctgcatgacaatcggatggccgacgcgattattctggctattgccggaggtcaagagctgctggcgagaacccaaaagaagtacttcgccaagtctcagtcaaaaattacgcgcctgatcacagctgtggtgatgaagaactggaaagagatcgtcgagtcctgtgatctcaagaattggcgtgaggctctagccgcagttctcacttatgcaaagccggatgagttctccgccctctgcgacttgttaggcaccagactggaaaatgagggcgatagtttgctgcaaacccaagcttgtctttgttatatttgcgcaggcaacgtggaaaagcttgttgcttgctggactaaggcacaagacggctcccaccccctgagcctgcaagacctgatagagaaagtcgttatattgcggaaggccgttcagttaacccaagccatggacacctctacagttggcgtgttactggcagctaagatgtcacagtacgcaaatctgcttgctgcccaaggctctatcgcagcagccctcgctttcctgcccgataacacaaatcagccaaacataatgcagttgagggataggctgtgtagggctcagggagaaccagtggcaggacatgaaagccctaaaatcccatatgaaaaacagcagttacccaagggaaggccagggcccgtggctgggcaccatcagatgccccgcgtgcagacccagcagtactatcctcatggcgaaaatccccccccccctggatttataatgcatggcaacgtgaaccccaacgcagctggccagcttcctacctctcccgggcatatgcatacccaagtccccccttacccccagcctcagccgtaccaaccggcccaaccttatccattcggcacaggaggctccgctatgtatcggcctcagcagcctgtagctccccccacaagcaacgcctaccccaatacgccttacatttcatctgccagctcctataccgggcaaagtcagctgtacgcagctcagcatcaagcatcatctcctacctccagccccgccacctcttttccccccccaccaagcagcggtgcaagctttcagcacgggggaccaggtgcacccccctcatccagcgcctacgctctgccccctggcactactggtcctcaaaacgggtggaatgacccaccggctctcaatagggtgcctaagaagaaaaagatgcccgaaaacttcatgcctccagtcccaataacctcaccaataatgaatcctttgggcgatccccagtctcagatgctgcaacaacagccatccgccccagtccccctctcctctcagtcctcctttccccagcctcacctccccggagggcagccgtttcatggggtgcagcagccattaggtcagactggcatgcctcccagcttttccaagccaaacatcgaaggtgcgcctggggctccaatcggcaacaccttccagcatgtgcagagcctcccaacaaagaaaattaccaagaaacctattccagatgagcaccttattctgaagaccactttcgaggatcttatacagcgatgcctctcttcagccaccgacccccagacgaaaaggaagctggatgatgcgtcaaagcgcctggagttcctttacgataagctcagagaacagacattgagccctactatcacatcagggttgcacaatatcgcgaggagtatcgagaccagaaattactcggaaggactgactatgcatacacatatcgtctctacctcaaactttagtgagacgagcgcctttatgcctgtgctgaaagtggtgctgacacaggccaacaagcttggggtgtag

SEQ ID NO: 45793 - DNA, 84 bp, Artificial Sequence
  Description of Artificial Sequence: Synthetic coding sequence
atgaagctgaaggaggtggaccggaccgccatgcaggcctggagccctgctcagaatcatccgatataccttgcaaccgggtag

SEQ ID NO: 45794 - DNA, 3618 bp, Artificial Sequence
  Description of Artificial Sequence: Synthetic coding sequence
atgaagctgaaggaggtggaccggaccgccatgcaggcctggagccccgctcaaaaccaccctatctacctggctaccggtacttcagcccaacagctggatgccaccttctcaacaaatgccagcctggaaattttcgaattagacctgagtgatccttccctggacatgaagtcttgcgccaccttttccagctcccatcgatatcataaactgatatggggcccctacaagatggactctaagggagacgtgtcgggggttctgattgctggaggagagaatggcaacattattctgtacgatccctcaaaaatcatcgctggggacaaggaagtggtcatcgctcaaaacgacaagcatactggtcctgttcgagcgctggacgtcaatatctttcaaacaaacctggtggcatcaggcgcaaacgaatccgagatctatatttgggatctgaacaattttgctacgcctatgacacctggtgctaagacccagcctcctgaagatattagttgtatcgcttggaataggcaagtgcagcatatcctcgccagcgcttccccatccggtcgcgccaccgtttgggaccttcgtaaaaacgagcctataatcaaagtgtcggaccatagcaacagaatgcattgcagcgggctagcatggcatccggacgttgctacccaaatggtgttggcttctgaggacgatcgcttgccagtgattcagatgtgggatttgcggtttgcatccagccctctccgcgttctggagaaccacgcaagggggatactcgctattgcatggtcaatggctgacccagagctgcttctaagctgtggaaaagacgcgaagatcctgtgtagcaaccccaacacgggagaggtgctctatgaactccctactaatacgcaatggtgttttgacatccagtggtgccccaggaaccccgccgtgttatctgccgcttcttttgacgggagaatcagtgtgtactccatcatgggcgggagtacagacggcctgagacagaaacaggtcgacaaattgtcctcatctttcggcaatcttgaccccttcggcacgggccagcctttgcccccgctgcaaatcccacagcagactgctcagcattcaatcgtgctgcctctcaaaaaaccaccgaaatggattcgcaggcccgtgggcgcaagcttctcctttggggggaagcttgttactttcgagaatgttcgcatgccttcacatcaaggagctgaacagcagcagcagcagcatcacgtgttcatctctcaggtggtcacggagaaggagtttttatcccgttcagatcagctgcagcaggccgtacagtcacagggtttcatcaattactgccagaagaaaattgatgcctcacagaccgaatttgaaaaaaacgtttggtcgttcctgaaggttaatttcgaagacgactccaggggcaagtatctcgagcttctaggctataggaaggaggacttaggaaaaaaaattgcattggctctaaacaaggttgatggagccaacgtggccctgaaggattctgatcaggtggcccagtcagatggagaggagtcaccagccgctgaagagcaattgctcggcgagcatataaaagaggagaaggaagagagtgagttcctgccctcctctggcggtacctttaacattagcgttagtggagatattgacggcctgattacacaagcactccttactggaaacttcgagtccgctgtagatttgtgtcttcatgataatcgtatggccgacgcaataatactagcgatcgcgggtggacaggagctcttagcacggacccagaaaaagtacttcgccaagtctcaatctaaaatcacacgtctgattacagctgtcgtgatgaaaaattggaaagagatcgtcgaatcatgtgacttaaaaaactggcgggaagcccttgccgcggtgttgacatatgccaagcctgacgagttcagcgccctctgcgatttgttggggaccagacttgagaatgaaggcgactcactcctgcagactcaggcctgtttgtgctacatatgtgcaggaaacgtcgaaaaattagtcgcatgctggacgaaggcccaagatggatcacatcctcttagtctgcaagacctcattgagaaggtagtcattctgaggaaggcggtgcagctgacccaggctatggatactagcaccgttggggttctcctggcggccaagatgtcacagtacgctaatctgctggccgctcagggatctatagccgcagccttggcatttttacccgataatacaaaccaaccaaacattatgcaactgcgtgatcgcctgtgccgcgctcagggcgaacctgtagcaggacacgagagtcctaaaataccctatgagaaacagcagctgcctaagggcaggcctgggccggtagcgggtcaccatcaaatgcccagagtacagacacagcagtattacccccacggcgagaaccctccacccccgggctttatcatgcacgggaatgtgaaccctaacgcagccggccagctccccacaagccctggccacatgcacacacaggtccccccatatccacagcctcagccttaccaaccagctcagccgtatccgttcggaaccggagggagcgctatgtacaggccacagcaaccagtcgccccgcctacgtctaatgcctacccgaatacgccatatatcagctctgctagtagttatactggtcagtctcagttgtatgccgcgcagcaccaggcttcctcacctacctcttcccctgctaccagcttcccaccaccaccatccagcggcgccagcttccagcatggtggccccggggcccccccttccagctccgcatatgctctacctccagggaccactggaccgcagaacggatggaatgatccccccgccctgaacagagtgccaaaaaagaagaaaatgccagagaacttcatgccccctgttccaataacttcacccataatgaatcctctgggcgatcctcaaagtcagatgctccaacagcaaccaagcgctccagtgcctctttcgtcccagtcttccttcccccaacctcacctaccaggcggccagccatttcacggcgtgcagcaaccattgggacagacaggcatgccgccctcattctctaagcctaatattgagggagcccccggtgctccaattggcaataccttccagcatgtacagtccctgccaactaaaaagatcaccaaaaaacccatccctgacgaacatctgatcctcaagaccacatttgaggacctgattcagcgctgtttgtcctccgctacagatcctcaaaccaagcggaagctagatgatgctagcaaaagactcgagttcttgtacgacaaactgcgggaacagacccttagcccgaccattactagcgggctgcacaacattgcccggtcaattgaaactcggaattattccgagggattgacgatgcatacacatatcgtgtccacttctaattttagcgagacctcggcctttatgcccgttttgaaggtggtgcttactcaagccaataagttgggagtttag

SEQ ID NO: 45795 - DNA, 3321 bp, Artificial Sequence
  Description of Artificial Sequence: Synthetic coding sequence
atgaagctgaaggaggtggaccggaccgccatgcaggcctggagcccagcacagaaccatcccatctatcttgctactggaaccagcgcccaacagttggacgccaccttttccactaacgcgagcctggagatcttcgaattggatctgtcagaccccagtttggatatgaagtcttgcgcaacattctcgtcctctcacaggtaccataaactcatctgggggccttacaaaatggactccaagggcgatgtcagtggcgtcctgatcgctggaggcgagaacggcaatataattctgtacgatccatcaaagatcattgctggcgacaaggaagtggttattgcccaaaatgataaacacaccggtccggtcagggccctcgacgtcaatatctttcaaacgaatctcgtggcatctggggcaaatgagagtgagatttatatatgggacctgaataacttcgctaccccaatgacgcccggggcaaaaacacagcctccagaagacatcagctgcatcgcctggaaccgacaagtccaacacattttggcctctgccagtccttcaggacgagccacagtgtgggatctgaggaagaacgagccgattatcaaagtgtccgatcatagcaatcgaatgcactgtagtggtctcgcatggcatcccgacgtcgccacgcagatggttctggctagtgaggacgaccgcctcccggtgattcagatgtgggacctgcgcttcgcatcaagtccgttacgcgttctcgaaaaccatgctcgcggaatcctagctatcgcctggagcatggccgatcccgagcttctcctctcctgcggaaaagacgctaaaatattgtgcagtaatcctaacaccggcgaagtcctttatgagctccctaccaacactcagtggtgttttgacattcagtggtgtcctaggaaccccgcagtgttatctgccgcaagtttcgacggcaggatttcagtatattccatcatgggcggctccacggatgggctccggcagaagcaggttgacaagctgagctcttccttcggaaatctggatccatttgggacagggcagcccctgccacccctacaaatcccgcaacagactgcgcagcactccatcgtcctgcccttaaagaaaccacccaagtggatccgcagacctgtcggcgcgtctttttccttcggaggcaaactcgtgactttcgaaaatgtgcggatgccatctcaccaaggcgccgagcagcagcagcagcagcatcacgtattcattagtcaagtggttaccgaaaaagagttcctgtccagatccgatcagctccagcaggccgtccagtctcagggatttatcaattactgtcagaagaaaatcgacgcatcacagaccgaattcgaaaaaaatgtctggagcttcttgaaggtcaatttcgaggacgattctagaggcaagtacctcgagctgcttgggtatcggaaggaagatctgggaaagaaaattgctttggctctgaataaagtggatggtgctaatgtcgcgcttaaggactctgaccaagtggcacagtctgacggtgaagaatcacccgcggcggaggagcagttgttgggcgaacacatcaaggaagaaaaagaagagtctgagttcctgccatctagtggcgggaccttcaatatctcagttagcggagacatcgacgggcttattacacaggctcttcttacaggcaacttcgaatccgctgttgacctgtgtctccacgacaatcgcatggcagatgccattatactggctatcgcaggcggtcaggaactgctcgcgcggacccagaaaaagtactttgctaaatcccaatcgaagatcactcggctgatcacggccgttgtcatgaagaattggaaggagatcgttgaatcctgtgaccttaagaattggagggaggcactggccgccgtcctcacttacgcgaaacccgacgaatttagcgctctctgtgacctgttgggaaccaggctagagaatgagggcgattcactgctgcaaactcaggcttgcctctgctacatctgtgcaggaaatgtcgagaaactggtggcttgctggaccaaagcccaagatggaagccaccccttaagcctgcaagatttaatcgaaaaagtggttattttgcgcaaagcggtacagctgacccaggccatggatacatctaccgtgggagttcttttggctgccaagatgtcacagtacgcaaacctgctggcagcccaaggaagcattgctgctgctctcgctttcctgcctgacaatacaaaccagcccaatataatgcagcttagggaccggttgtgccgcgctcagggggagcctgttgctgggcacgaaagtcctaaaatcccctatgagaagcagcaacttccaaaaggtcggccagggcctgtggcgggacatcaccaaatgcctcgagtccaaactcaacaatactaccctcatggtgaaaatcccccaccacccggattcataatgcatggaaacgtgaacccgaacgctgctgggcagctccccacttcacctgggcacatgcatacacaagtcccaccctatccacagcctcagagacctcaaaatggttggaatgacccccctgcattgaatagagtacctaaaaagaagaaaatgcctgagaactttatgccccccgtgcccattacatcccccatcatgaacccgctgggggacccacaatcacaaatgttacaacaacagccatcggccccagtgcccctcagtagccagagtagcttcccccagcctcatctgccgggaggtcagcccttccatggtgttcagcagccactcgggcaaaccggaatgcccccctcttttagcaagcccaacatagaaggtgccccaggggcccccatcggaaacacctttcagcatgtgcagagcctgcccaccaagaagattacgaaaaagcccattccagacgagcacttgatcctcaagaccaccttcgaagacttaattcagcgttgcctgagtagcgccaccgatccacagacaaaaaggaaactggatgatgccagtaaacgcctggaattcctctatgacaagttgcgggagcaaaccctgtcccccaccattacttctggtcttcataacatcgcgcgcagtatcgaaacacgcaactattcagaagggttaactatgcacacccacatcgtgagcacttccaacttctctgaaacttccgcctttatgccagtgttgaaagttgttctgacgcaagctaataaattgggggtctag

SEQ ID NO: 45796 - DNA, 498 bp, Artificial Sequence
  Description of Artificial Sequence: Synthetic coding sequence
atgaagctgaaggaggtggaccggaccgccatgcaggcctggagccctgcccagaaccaccccatctacttagcaaccggaaccagtgcgcaacagttggacgctactttctctacaaacgcatccctcgaaatctttgagctggacttgagcgatccttcactcgatatgaagtcatgtgcgaccttcagctcctcgcacaggtaccacaagctaatctggggaccgtataaaatggacagcaagggcgatgtgtctggagtattgattgctggcggggagaatggcaatatcattctctacgacccatctaagatcattgccggagataaagaggttgtcattgctcagaacgacaaacacactgggcccgtaagagcactcgatgtgaatatattccaaaccaaccttgtggcatctggagccaacgagagcgaaatttatatatgggatttgaacaacttcgctacccccatgacaccaggagcgaagacttag

SEQ ID NO: 45797 - DNA, 501 bp, Artificial Sequence
  Description of Artificial Sequence: Synthetic coding sequence
atgaagctgaaggaggtggaccggaccgccatgcaggcctggagcccagcacagaaccacccaatctacctggccacagggacctccgcacagcaactcgatgccaccttctccacaaatgcctctctcgaaatttttgagctcgacctcagcgacccaagcctggacatgaagtcttgcgctaccttctctagctcacaccgatatcataagttaatctggggcccatataagatggatagtaagggagacgtcagtggcgtgctgatcgctggcggagagaatgggaacattattctgtacgatccgtccaaaatcatcgccggagacaaggaggtggtcatcgcacagaatgataaacatacaggaccggtgcgtgctttagatgtgaacatctttcaaactaacctcgtggcctccggtgccaacgagtccgaaatctatatctgggatttgaacaacttcgccactcctatgacccccggcgcaaaaacacaatag

SEQ ID NO: 45798 - DNA, 3603 bp, Artificial Sequence
  Description of Artificial Sequence: Synthetic coding sequence
atgctgggcgagagcgacgagcggtgcaccaacgccggcagcggctgcagaagaagttcacccggaacctccgcccaacagctcgatgctaccttctcgaccaacgcttcattggagatctttgagctggatctcagcgacccatcattggacatgaaatcctgcgccacattttcctccagccacagataccataagctgatatggggcccctataaaatggattcgaagggcgacgtgtcaggagtgttgatcgcgggaggtgaaaacggcaacatcatcctgtatgacccgtcaaagatcattgccggggataaggaagtagtaattgcacagaacgacaaacataccggacccgtgagggctctggacgtcaacatatttcaaaccaacctagtggcctctggcgcaaacgaatctgagatttacatctgggacctgaacaacttcgccactccaatgacgcccggggccaaaacacagccaccagaggatattagctgcatagcttggaaccggcaggtgcaacacatcctggcttcagcaagtccttccgggcgagccactgtgtgggatctgcgcaaaaatgagcccatcatcaaagtgagcgaccactctaatcggatgcactgcagcggcctggcatggcaccctgacgtggccacacaaatggtcttagcttccgaagacgatcgattgcctgtgatacagatgtgggatcttcgctttgcatcgtctcccctgagggtgctggagaatcacgccagaggtattcttgccattgcgtggtccatggccgatcctgaactgctgctgtcatgcggaaaggacgctaaaattctttgcagtaatcccaatactggagaagtcctatacgaactgccaaccaacactcaatggtgttttgacattcagtggtgtccaaggaatcctgccgtgctttctgccgcttctttcgatggcaggatcagcgtgtattcaattatgggaggtagcactgacggcttgcggcaaaagcaggtggacaagctgagcagctcctttgggaacctggatcctttcggcacagggcagccactgccccccctgcagatcccccaacaaactgcacagcactccatagtcctgcctctgaagaagcccccaaagtggatccggaggcctgtgggcgcctcattcagctttgggggaaaactggtgacctttgaaaacgtacgcatgccctcccaccagggagcggaacagcaacagcagcagcatcacgtctttatctctcaggtcgtgaccgagaaagaatttttatctagaagcgaccagctccagcaagctgtgcagtcccagggcttcataaactactgccagaagaagattgacgcgtcccaaactgaattcgagaagaatgtgtggtcgtttttgaaagtaaactttgaggacgactctcgcggcaaatatctggagctgcttggatacagaaaggaggatttaggaaagaagatagccctagcgctgaacaaggtggacggcgcaaacgtggctctgaaggattccgaccaagtcgcacaaagtgacggtgaggagtctcccgccgcggaggagcagctgttgggcgaacacataaaggaagagaaggaggaatctgaatttcttccctcctcaggagggaccttcaatattagcgtgtccggggacatagacgggcttataacccaggctctgctcacagggaattttgaatcggctgtcgacctatgtctgcacgacaaccggatggctgacgccataatcctggctatcgccggagggcaggagcttcttgcccgaacacaaaaaaaatactttgccaagagccagtcgaagatcacccgactgattacggccgtggtgatgaagaattggaaagaaattgttgagtcgtgcgacctgaagaattggagagaggccctggctgcagtgttgacttatgcgaagcctgatgaattcagcgccctatgtgacctcctaggaaccagacttgaaaatgagggagactccctgctgcagactcaagcttgcctgtgctacatttgcgccggcaatgtagagaaactcgttgcttgttggaccaaggcccaagatggatctcaccccctgtccctccaggatcttatcgaaaaggttgtcattctcaggaaagctgtgcaactaacgcaggctatggatacttccactgtaggtgtcctccttgccgcgaagatgagccaatacgcgaatcttcttgcagcccagggtagcattgctgccgcactggcttttctcccagataatacaaaccagcccaatatcatgcagcttcgggaccgactttgccgcgcccagggggagcctgtcgctggccatgaatcccccaaaattccctacgagaagcagcagttgccaaaagggcgccctggtccagtggctgggcaccatcagatgcctagagtccagacgcaacaatattacccccatggcgagaacccaccaccgcctggcttcattatgcatggtaatgtgaatcctaatgctgcaggacaactaccaacatcgccggggcacatgcacacccaggtgcccccatatccccagcctcagccctaccagccagcacagccatacccctttgggacagggggctccgcaatgtaccggccgcagcagcctgtagcacccccaacaagtaacgcgtatcccaatactccctacatttcttccgcttcatcctataccgggcaatcacaactctacgctgcgcaacaccaggcctcttcgcccacaagttccccggctacctcttttccaccacctccctcctctggggccagcttccagcacgggggaccaggggcaccaccaagtagcagcgcctacgccttgcctcctggcaccacagggccccagaatggctggaacgacccgccggctctgaaccgcgtccccaaaaaaaagaagatgccggaaaactttatgccgccagtgccaataacttcaccgattatgaatcctctcggagatcctcagtctcagatgctgcagcagcagccatccgcccccgtgccactgtccagccagagcagctttccccagccccaccttccgggggggcagccatttcatggtgtgcagcagcctcttggccagaccggtatgcctcctagcttctctaaacctaatattgaaggagctccgggagctccaattggtaatacattccagcatgtacaaagcctccccaccaaaaagatcactaaaaaacctataccagatgaacaccttattttgaagacaacatttgaggatctcatacaaaggtgcctgagtagcgctacagatcctcagaccaaacgtaagttggacgatgcctccaaacgtttagagttcctgtatgacaagcttagggaacagacgctatcaccaaccattactagtgggctacacaacatcgcacggtcgatcgagacccggaattatagcgagggcttaacgatgcacacacatatcgtgtcaaccagcaacttcagcgaaacgtctgcattcatgccagtgctcaaagtcgtacttactcaggcgaacaagctcggagtgtag

SEQ ID NO: 45799 - DNA, 1431 bp, Artificial Sequence
  Description of Artificial Sequence: Synthetic coding sequence
atggccatcaagttcctggaggtgatcaagcccttctgcgtgatcctgccagaaattcagaaacccgaacgaaaaatccagtttaaagagaaagttctgtggaccgctatcacattgttcatctttctggtgtgttgtcagatacccctgtttggaattatgtcatcagatagtgccgatcccttctactggatgcgagttatcctggccagtaaccggggcaccctcatggaattaggtatctctcccatcgtgacaagcgggctgatcatgcaacttctggctggcgcgaagattatcgaggttggcgacacccctaaagatcgggccttatttaacggcgctcagaagttattcggcatgatcataacgatagggcagtcaatcgtatatgtgatgacagggatgtacggtgatccttccgaaatgggtgccggaatctgtctccttatcactatacagctgttcgtggccggcctaatcgtgctgctccttgatgaacttctgcagaaggggtacgggctgggaagtgggattagcctatttattgcaaccaacatttgcgagaccatagtgtggaaagcctttagcccgacaactgtcaacacgggcaggggcatggaattcgagggtgcaattatcgcactgttccaccttttggcgactcgtaccgacaaagtaagggctctccgtgaggcattttatcgtcagaacctgcctaacctgatgaacctcatcgccactatcttcgtatttgccgtggtgatatattttcaggggttcagagtggacctgccaattaagtctgcacgatatcggggccaatacaatacctaccctattaaattattctacacaagcaacatccccattatccttcagtccgccctggtcagcaacctctacgtcatatctcagatgcttagcgcacggttttctggaaacctgttagtatctctcctgggtacttggagcgacacgagttccggtggcccggcaagagcctaccccgtgggcgggctgtgctattacctatccccaccagaatccttcggttccgtcctggaagaccccgtgcatgcagtcgtgtatatcgtgtttatgctgggaagttgcgcattttttagtaagacatggatcgaggtctccggctcatccgccaaagatgtcgcaaagcagctgaaagaacagcagatggttatgcgaggccatcgtgagaccagcatggtacacgaactcaaccggtacatccccacagcagctgctttcggggggctgtgtatcggagcactgagcgtgctggctgactttctgggggccatcgggagcgggaccggcatccttctggccgtgactatcatttatcaatatttcgaaatcttcgtcaaggagcagtcagaagtcggcagcatgggcgcactcttattctag

SEQ ID NO: 45800 - DNA, 1071 bp, Artificial Sequence
  Description of Artificial Sequence: Synthetic coding sequence
atgatcatcaccatcggccagagcatcgtgtacgtgatgaccggcatgtatggagatcccagcgaaatgggagccgggatttgccttcttatcacaatccagttattcgtagcggggcttattgtattgctgctcgatgaactgctccagaaaggctacgggctgggcagcggaatttctttgttcattgccacaaatatctgtgagaccatagtctggaaggccttctccccaacaaccgttaacacgggcaggggcatggaatttgaaggagctatcatcgcactgttccacctgctagctacgaggactgacaaagtgcgtgccctccgagaagcgttctaccgtcagaacttgccaaatttaatgaaccttatagctaccatcttcgtcttcgctgtggtcatatatttccaaggatttagagtagacctgcctatcaagagcgcccgatatcgggggcagtataatacctatcctatcaaattattttataccagcaacatccccatcattcttcagtctgcactcgtctctaatctttatgtgatttctcaaatgctgtccgctcggtttagtggcaacctcctggtgtccctcctggggacgtggtcagatacctctagcggcggacctgcacgggcttaccccgttggggggttgtgctactatctgagtcctcctgagagttttggttcagtcctggaggatccagtgcacgccgttgtttatattgtgtttatgctcgggagctgtgcatttttctctaagacttggatcgaggtgtccgggagctccgcgaaggatgtggcaaaacagctgaaagagcagcagatggttatgagaggacacagagaaacctcaatggtccatgagctaaatcgctacatacccacagccgcagcttttgggggcctgtgtattggggctctgagtgtgcttgctgacttcttgggggctattggctccggcactgggatcctcttggctgtcactattatttaccagtattttgaaattttcgtgaaggaacagtctgaagttgggtctatgggagctctgctgttctag

SEQ ID NO: 45801 - DNA, 1449 bp, Artificial Sequence
  Description of Artificial Sequence: Synthetic coding sequence
atgacccagaccgcccgggtgctggtgaagttcctggaggtgatcaagccattttgtgtgatccttcctgagatccaaaaaccagaaagaaagatacagtttaaggagaaagtgctttggaccgcaatcaccctgtttattttccttgtgtgttgtcagataccactgtttgggatcatgtcgtctgactctgctgaccccttctactggatgagggtgatcctcgcatcaaatcgggggacactcatggagctggggatctcacctattgtgaccagcggcctgatcatgcaactactggccggcgccaaaataattgaggtgggcgatacccccaaggacagggcactctttaatggggcgcagaagctgtttggcatgatcatcaccattggccagagcattgtctacgttatgacaggcatgtatggagaccccagcgagatgggagctggcatatgccttttaattaccattcaattattcgtggccggactcatcgttctgcttctagatgagctgctgcagaagggctatggactcggtagtggcatctccctgtttattgcaacaaacatatgcgaaaccatcgtgtggaaggcattctcgcctactactgtgaacactggaaggggcatggagtttgaaggagccataattgctctgttccacctgctcgccacgagaaccgataaggttagggccctaagagaggctttctaccggcagaacctgccaaacctgatgaatctcattgctacgatctttgtattcgccgttgtcatctattttcagggattccgagtggacctgccaattaaatccgcccgataccgagggcaatataacacctaccctataaaactcttctacacctcgaacattccgatcatcctgcagagtgccctcgtgagtaacctgtacgtaatcagccagatgctcagcgctagattcagcggcaacttgctggtcagccttcttggaacgtggtccgataccagctccggaggccctgcccgtgcttaccctgtgggaggcctgtgctattatctgtcaccccccgaaagcttcggctccgtgttggaggatccagttcatgccgtggtctacatcgtattcatgctcggtagctgtgccttttttagcaagacttggattgaggtgagtggaagcagcgcgaaggatgtggccaaacagctgaaggaacaacaaatggtgatgcggggccaccgtgagacctctatggtgcacgagcttaatcgatatattcccaccgctgccgcttttggcggcttgtgcattggcgcactgtctgtcctcgcggactttctgggcgctattgggagtgggacaggcattctcttagccgtgaccatcatttaccagtactttgagatttttgttaaggagcaatctgaagtagggtctatgggcgcactgttgttttag

SEQ ID NO: 45802 - DNA, 1431 bp, Artificial Sequence
  Description of Artificial Sequence: Synthetic coding sequence
atgggcatcaagttcctggaggtgatcaagcccttctgcgccgtgttgccagagatacagaagcccgagcgtaagattcagttccgggaaaaggtactttggaccgccattacattgtttatttttctggtgtgttgccagatcccgctttttgggattatgagctctgattccgcagacccattctactggatgagagtgatcctggcaagtaaccgagggacactcatggagctaggcataagcccaattgtcaccagtgggctgattatgcagctacttgcaggggctaagattattgaagtcggcgacaccccaaaagatagggccttgttcaacggagcccagaagctcttcgggatgatcatcaccattgggcaggccatcgtgtatgtgatgactgggatgtacggcgatccagcagagatgggagcaggtatttgcctgctgattataatccagctctttgtagccggccttatcgtgcttttactggacgagttgctccagaaaggttatggcctgggaagtgggatttctctatttatcgctacgaacatttgcgaaacaattgtgtggaaggcctttagccccaccacgatcaatacagggcggggcacggagttcgaaggcgcagtcatcgcactctttcacttgctagccaccaggactgacaaagttagagccctccgggaggcattttacagacaaaaccttccgaacctgatgaacttaatcgctactgttttcgtgttcgccgttgtaatatactttcagggcttccgggtggatctcccaattaaaagcgccaggtacagaggtcagtattcatcatatcctatcaagttgttttacacgtccaacataccgatcatcctccagagcgctctggttagcaatctctacgtcattagtcagatgctctctgttcgtttctccggcaatttcctagtaaacctgctcggtcagtgggctgacgtcagtggtggcgggccggctaggtcttaccccgtgggcgggttatgttactaccttagccctcccgagtctatgggagccatcttcgaggaccccgtacatgtagtggtttatatcatttttatgcttggaagctgcgccttcttctcaaagacctggatcgaggtaagcgggtcaagcgccaaggatgtggcgaagcagctcaaggaacagcagatggtcatgcgtggtcatcgggacacgtctatggttcatgagctgaataggtacatccctactgccgccgcatttggcggcctgtgcatcggcgccctcagtgtgttggccgacttcttaggcgcaataggatccgggaccggcattctcctggccgtcacaattatctatcagtatttcgagatatttgtgaaggagcaggctgaagtcggcggaatgggggccttgttcttctag

SEQ ID NO: 45803 - DNA, 1314 bp, Artificial Sequence
  Description of Artificial Sequence: Synthetic coding sequence
atgggcatcaagttcctggaggtgatcaagcccttctgcgccgtgcttccggagatccaaaaacctgagcggaagatccaattccgagagaaggtgctatggaccgctatcaccttgtttatattcctggtgtgctgccagattcccctgttcggcataatgtccagcgactctgccgaccccttctattggatgagagtgattcttgcatctaacaggggaacactaatggaactcggtatctctccaattgtcacgtccgggctcatcatgcagctccttgcaggtgccaagatcatagaggtgggtgacacccctaaagatcgggctctcttcaatggagctcagaagttatttgggatgatcatcacaatcggacaggcaatcgtttatgtcatgacaggcatgtatggtgatcctgctgaaatgggtgcgggcatctgcctgcttatcatcattcagctgtttgtcgctgggctcattgtgctcttactagatgagctcctgcagaaaggttacggtttaggctccgggatcagcttattcatcgccacaaacatctgtgagacgatcgtatggaaggccttttctcccaccaccataaataccggacggggaaccgaatttgagggggcagtgatagccttattccaccttttggccacacgtaccgataaggttcgggcactgagggaagcattctataggcagaatctgccaaatcttatgaatttaatcgcaaccgtcttcgttttcgctgtggtgatatacttccagggcttccgggtggatctacccattaaaagcgctcgctatagggggcaatactcgtcgtaccctatcaagctgttttacacgagtaatataccgatcatactgcagtcagcactcgttagcaacctgtatgtgatcagtcagatgctgagtgtccgattcagcggcaacttcttagtcaacctgctgggtcagtgggctgatgtctctggcggggggccggcgaggtcatatcccgtggggggcctgtgctactacttatctccgccagaaagtatgggagcaatatttgaggatccagtgcatgttgtcgtatatatcatttttatgctgggctcctgcgcattctttagcaagacctggatcgaggtgtccggatccagcgccaaagacgtggccaagcaacttaaagagcagcagatggtaatgagggggcatagagacactagtatggtacatgaattaaataggcccaaggtgaagctccgacgctggaaaggtgaaggacggcactttacaaaaaggatactgttctattag

SEQ ID NO: 45804 - DNA, 507 bp, Artificial Sequence
  Description of Artificial Sequence: Synthetic coding sequence
atgggcatcaagttcctggaggtgatcaagcccttctgcgccgtgttacccgaaattcaaaagccagaacgcaaaatacaatttcgcgagaaggttctgtggactgccatcaccctgttcattttccttgtttgttgtcaaattcctctgtttggcattatgtcaagtgatagcgcagacccgttctactggatgcgggtaattctcgccagcaacagggggaccctcatggagctcggcatttcccccattgtaaccagtggtctaattatgcaattgctcgccggagctaagattattgaggtgggtgacacacctaaagaccgggctttgttcaacggtgctcaaaaactcttcgggatgattatcaccatcggccaggcgattgtttatgtgatgactggcatgtatggtgatcctgccgagatgggtgccggcatatgcctcttaatcattattcaggctttgttgactcttaaaatatgtgggtataccgaggagttgtag

SEQ ID NO: 45805 - DNA, 1233 bp, Artificial Sequence
  Description of Artificial Sequence: Synthetic coding sequence
atgggcatcaagttcctggaggtgatcaagcccttctgcgccgtgctgcccgaaattcaaaaaccggagcgcaaaattcagtttagagagaaagtgctctggacagccattactctgtttatcttcctcgtatgctgtcagatccccttgtttggtattatgagcagcgactctgccgatcctttttactggatgcgtgtaatcctcgcatccaacagagggacactgatggaactcggtatctctcctatagtaacctctggcctgatcatgcagttgctggccggcgccaagatcatcgaggtgggggatacccctaaagacagagcactgttcaatggggcacagaagctatttggcatgataatcaccattggacaagccatcgtgtatgtaatgaccggcatgtatggcgacccagccgagatgggagcaggcatatgcctgttgatcataatccagctcttcgttgctggactcatcgtacttttgctggacgaactccttcaaaagggctacggtctcggcagcggaatcagcctgtttatcgccacgaatatctgtgagacgatcgtgtggaaagccttcagcccaacgactatcaacaccggacgaggcactgagttcgagggtgcggtaatcgccctattccacttgctggcaacacgcacagacaaggtcagagcactccgggaagctttttatcggcagaatctccctaacctcatgaacctgattgcaacggtgtttgtgttcgccgtggtcatttacttccaggatgtctctggaggagggcccgctcgcagctaccctgttggcggcctgtgctactacttgagtccgcccgagtcgatgggcgcaatttttgaagacccagtgcatgtggtggtttatatcatattcatgcttggatcttgcgcttttttttccaagacatggatagaggtgtcaggctcttctgctaaggacgtggctaaacaactcaaggagcagcagatggtgatgcgcggacaccgcgatactagtatggtgcatgaattaaaccgatacatccctaccgcggcagcctttggggggctctgcataggcgccttgagcgtgctggctgacttcctgggagccatcgggagcggaacgggcatacttttggctgtaacaatcatttaccaatacttcgaaatctttgttaaggagcaggcagaagtaggcggcatgggggctctctttttttag

SEQ ID NO: 45806 - DNA, 1365 bp, Artificial Sequence
  Description of Artificial Sequence: Synthetic coding sequence
atgggcatcaagttcctggaggtgatcaagcccttctgcgccgtgttaccagaaatccagaaacctgagcgtaagattcccctgttcggtatcatgtcatccgattcagcagacccgttttactggatgcgcgtcatcctggcatcaaatagggggaccctgatggaattggggatcagcccaattgtcacctctggtctcatcatgcagctgcttgccggcgcaaagatcatcgaggttggagataccccgaaggatcgcgcactgttcaacggcgcacagaaactcttcggaatgatcattaccatcggccaggctattgtttatgtcatgactggaatgtacggcgaccccgcggaaatgggggctggtatttgtcttctcattataatccagctgtttgtcgctggcctcatagtacttctgctggacgagttactgcagaaaggctacggactgggatctggtatcagtttattcattgccactaatatttgcgaaacaatcgtgtggaaagctttttctcccacaaccatcaataccggaaggggcaccgaattcgaaggtgccgtcatcgcgctgttccatttgctggcgactcggaccgacaaggtgagagcgctgagagaggccttctaccgccagaacctgcctaatctcatgaacctaatcgcaactgtgttcgtatttgcggtggtaatttattttcaaggattccgagtggatctgcccatcaagagcgcccggtaccgggggcaatattcttcttatcctatcaagctgttttatacctctaacatcccaatcattctgcagtctgccttagtaagtaatttatatgttatctcccagatgctctccgtgcgattttcaggcaatttcttggttaacctgttaggtcaatgggcagacgtgagtggtggcggaccagcgagaagctatcccgtgggcggtctctgctactatctgtcaccccccgaatccatgggcgcaatcttcgaggaccctgtgcacgtggtggtctacattatcttcatgctgggtagctgtgcttttttcagcaaaacgtggatcgaagtgagcggttcatccgccaaggacgtggccaaacagctgaaggaacaacagatggtgatgagggggcaccgtgataccagcatggtgcatgagttgaatcgttacattccaacggctgcggcctttggggggctttgcattggcgccctgagtgttctcgcagatttcctcggagccatcggcagcggaacaggcatcctgctggcagttacaatcatctatcaatattttgagatcttcgtgaaagagcaggccgaggtggggggaatgggcgctctcttcttttag

SEQ ID NO: 45807 - DNA, 480 bp, Artificial Sequence
  Description of Artificial Sequence: Synthetic coding sequence
atgggcatcaagttcctggaggtgatcaagcccttctgcgccgtgttacctgaaatccaaaagcctgagcgtaagatccagttcagagagaaggtcctgtggacagctattacccttttcatatttttggtttgttgccagataccactgttcggcatcatgtcttcggattctgctgatcccttctattggatgcgagtgatactcgcctcgaatcggggcaccctgatggaattggggattagccccatagtgacatccggccttatcatgcagctcctggcgggggcgaaaatcatcgaagtcggagacacgccgaaagacagggctctgttcaatggagctcaaaagctgtttggcatgatcatcacgattggccaagccattgtatacgtgatgacaggcatgtacggcgaccccgctgagatgggcgccggtatttgtctcctcataatcatccaggatcaacactcaccatag

SEQ ID NO: 45808 - DNA, 438 bp, Artificial Sequence
  Description of Artificial Sequence: Synthetic coding sequence
tgaagcgacagcgccgaccccttctactggatgcgggtgatcctggcctcgaatagaggaacactgatggagctgggcataagtcctatcgtgacatctggtctcatcatgcagttgctcgctggtgccaagatcattgaagtgggtgatacacctaaggaccgggcccttttcaatggtgcacagaaattgttcggcatgattatcaccattggccaagccatcgtttacgtaatgaccggcatgtatggggacccggcagagatgggcgccggcatctgcctcctgatcatcattcaaggattcagggtagatttaccaatcaaaagcgcacggtacaggggccagtatagctcctaccctatcaaactgttctacacaagcaatataccgatcatccttcagagcgcattggtgagcaacctctacgtcatctag

SEQ ID NO: 45809 - DNA, 687 bp, Artificial Sequence
  Description of Artificial Sequence: Synthetic coding sequence
tgaggcatgatcatcaccatcggccaggccatcgtgtacgtgatgacaggcatgtatggcgatcccgcagagatgggcgcaggtatctgtctgctgattattatccagctcttcgttgccggtctcattgtgctcctcctggacgagctgctgcaaaaaggttacggcttggggtccggcatttcgctctttatcgctaccaatatttgtgaaactatcgtgtggaaagcgttctcaccgaccaccattaataccggcaggggcacagaattcgaaggggcggtgattgctttgtttcacctgttggccaccagaacagataaggtccgagctttaagagaggccttttaccgccagaacctgcccaatctgatgaacctcattgccactgtgtttgtgtttgctgttgtgatttattttcaggttgccaagcagttaaaggagcagcagatggtcatgcggggccacagagacacatcaatggtacacgagctgaatcggtacatacctacagccgctgccttcggcggcctgtgtatcggagcgctgtcagtcttagcagatttcttaggagccatcggctccggcacggggattctgcttgcggtgactatcatatatcaatatttcgagatctttgtcaaggagcaggcagaggtcggcggaatgggtgccctgttcttttag

SEQ ID NO: 45810 - DNA, 633 bp, Artificial Sequence
  Description of Artificial Sequence: Synthetic coding sequence
aagtacaacctgttcaccaagggcttccgggtggacctgcccatcaagtccgcccggtacagggggcaatattcgagttacccaattaagctgttctacacatctaatatacctatcattttgcagagcgccctggtgtcgaatctgtatgttatatcccaaatgctctccgtcagattctccggtaatttcctggtgaatcttctgggacagtgggctgatgtatccggcggcgggccggcccgctcataccccgtcggagggctttgctactacctgagcccccccgaatctatgggagcaatattcgaggatcccgtccacgtcgtggtgtacatcatttttatgctggggtcgtgtgcttttttttccaaaacctggattgaagtatcgggttcgtctgctaaagacgtagcaaagcagctgaaggagcagcagatggtaatgcgagggcaccgggacactagcatggtgcatgaacttaaccgctatatcccaaccgcagccgcatttgggggcctttgcatcggtgcactgtctgtgcttgcggattttctcggtgccattggatctggaacgggaattctcctcgctgttacaatcatctaccagtacttcgagatttttgtgtag

SEQ ID NO: 45811 - DNA, 570 bp, Artificial Sequence
  Description of Artificial Sequence: Synthetic coding sequence
atgggcatcaagttcctggaggtgatcaagcccttctgcgccgtgctgcctgaaattcagaaacctgagaggaaaattcagttcagagagaaggtgttatggactgccattacgctgtttattttcctcgtttgttgccagatcccgctctttggcatcatgagctctgatagtgctgaccctttctattggatgagggtgatactcgccagtaatcgcggcaccctgatggaacttggtatcagtcccattgtcacgagcggcttgataatgcagctgctagctggggccaaaatcatcgaggtcggcgatacccccaaagacagggctctatttaacggtgctcagaaacgcactgaattcgaaggcgctgtgattgccctcttccacctgctggcgacacgcaccgacaaagttcgggccttgcgggaagcattctataggcaaaacctcccaaaccttatgaatcttatcgccactgtctttgtgttcgccgtggttatatactttcagggattccgggttgatctgcctatcaaatccgcaagatatcgggggcagtacagctag

SEQ ID NO: 45812 - DNA, 285 bp, Artificial Sequence
  Description of Artificial Sequence: Synthetic coding sequence
tgattccgggagaaggtgctgtggaccgccatcaccctgttcatcttcctggtgtgctgccagatccctctgttcggaatcatgtcatccgactctgcagacccattctactggatgcgcgtgatcctcgccagcaacaggggcactctgatggagctgggcatcagccccatcgtgacaagtggcctcatcatgcagctgctcgcaggcgccaagattatagaagttggagacacacccaaggaccgggccctcttcaacggcgcacagaagcgagagcactag

SEQ ID NO: 45813 - DNA, 1257 bp, Artificial Sequence
  Description of Artificial Sequence: Synthetic coding sequence
atgggcatcaagttcctggaggtgatcaagcccttctgcgccgtgttacccgagatccagaagcccgagaggaaaatccagttccgggaaaaggtcctttggacggccatcaccctctttatattcctggtgtgttgtcaaatcccactgttcgggatcatgtcaagtgactcggctgaccccttctattggatgcgggttatcctggcctccaacagaggaactctcatggagctcggaataagccctattgttacatccggtctgattatgcaactgctggcaggggccaagattatagaagtcggggacacccctaaggatcgggctctcttcaatggggcgcagaagctcttcggcatgatcatcacaattggtcaggcgatcgtgtatgtgatgactggtatgtacggcgaccccgctgagatgggtgcgggtatctgcctgcttattattatccagctgttcgtggccggtcttatcgtgctgctgcttgatgagctattacagaaaggttatgggctaggctccggcatcagcctttttatcgcgaccaacatttgtgaaaccatcgtttggaaagctttctcacctacgacaattaataccggccgcggcaccgagttcgagggcgctgtcattgccctgttccacctgctggccacgaggacagataaagtgcgcgccctgagagaagctttttacagacagaatctaccaaatctgatgaatctcatagccaccgtctttgtatttgctgtggtgatctatttccaggggttcagagtggacttgcctatcaagtctgccagatatagaggccagtactcctcctaccccatcaaactcttctatacctctaatattccaattatactccaaagcgccctcgtctccaacctctatgtcatcagtcagatgctgtccgtgagatttagtgggaattttctcgtcaacctcttgggccagtgggccgacgtgagcggaggggggccagctcgaagttaccctgtgggtggtctctgctactacctctcgccaccggaatctatgggtgcaatcttcgaagatcctgtccatgtcgtcgtgtacattatattcatgcttgggtcttgtgcgtttttcagcaaaacctggattgaggtctccgggtcatctgccaaggacgttgctaagcagttgaaagaacagcagatggtgatgcgtggccatagggatacttcgatggtccatgaactcaattccgcacgcgcctag

SEQ ID NO: 45814 - DNA, 975 bp, Artificial Sequence
  Description of Artificial Sequence: Synthetic coding sequence
atgctgaagagctgcagccgggccagcttcagccccagcgtgcggaaaccccctttgattctgcgtcgattgctgagtgaagacgtcggcatggatatcccttttgaagaaggagtgctatcaccaagcgcagcagacatgcggcctgagcccccaaatagcttggacctgaacgacactcaccctagaaggattaagctgacggctcctaacatcaatcttagccttgatcagtctgaaggatccatcctgagtgacgacaacttggacagcccagacgagatcgatattaatgtggatgagttagacacacctgacgaggcagacagcttcgaatatactggccatgaggatccaaccgctaataaggacagcggtcaggaatcagaaagtatccccgagtacactgctgaagaggaaagagaggataatagactgtggcggactgtggtgatcggggagcaagaacagcggatcgatatgaaagtaattgaaccatatcgtcgagtgatcagccatgggggatactacggggatggcctgaatgccattatagtgttcgccgcttgttttctgccagattcttcccgggccgattaccattacgtcatggaaaatctgttcctgtacgtgatatcaactctggagctgatggtggccgaggattacatgatcgtctatctgaacggggccaccccaagacggcgtatgccggggcttggctggatgaagaaatgttaccagatgatcgacaggcgtttgcgaaagaacctaaaatcttttattatagtgcacccgagctggttcatcagaacaatactggctgtgaccaggcctttcatctctagtaagtttagctccaagattaaatacgtcaattctctttctgagctgagtgggctgatccctatggactgtatccacatcccagagagtattattaacatcgatcttaaactgaaagaaaagccatag

SEQ ID NO: 45815 - DNA, 207 bp, Artificial Sequence
  Description of Artificial Sequence: Synthetic coding sequence
atggaccaggtgatgcagttcgtggagcccagccggcagttcgtgaaggacagtattaggctggtgaagcgctgcaccaaacctgacagaaaggaatttcagaaaatcgcgatggccactgccatcggctttgccatcatggggttcattggcttcttcgtcaaactcattcatatccccattaacaatattatcgtggggggatag

SEQ ID NO: 45816 - DNA, 207 bp, Artificial Sequence
  Description of Artificial Sequence: Synthetic coding sequence
atggaccaggtgatgcagttcgtggagcccagccggcagttcgtgaaggactctatcagactggtcaagcggtgtacaaagcccgatcgcaaggagtttcagaagatcgctatggccaccgctattggctttgcaatcatgggttttattggcttttttgtgaagctgatacacattccaataaataacattattgtcggagggtag

SEQ ID NO: 45817 - DNA, 207 bp, Artificial Sequence
  Description of Artificial Sequence: Synthetic coding sequence
atggaccaggtgatgcagttcgtggagcccagccggcagttcgtgaaggattctattcggctggtgaagcggtgtaccaaaccagacagaaaagaattccagaagattgcgatggcaaccgcaattggcttcgctatcatggggttcatcggcttcttcgtgaaacttatccatatcccgattaacaacattattgttggaggctag

SEQ ID NO: 45818 - DNA, 207 bp, Artificial Sequence
  Description of Artificial Sequence: Synthetic coding sequence
atggaccaggtgatgcagttcgtggagcccagccggcagttcgtgaaagactctatccgcctggtcaagagatgcacgaagcctgatcggaaggagttccagaagatcgccatggctacggccatcggatttgctataatggggttcatcggattctttgtgaagctcatccacatcccaataaacaatattattgtgggagggtag

SEQ ID NO: 45819 - DNA, 2610 bp, Artificial Sequence
  Description of Artificial Sequence: Synthetic coding sequence
atggccgccgtgcccacccagccccagagcaaggagggcccctggtccccggagagcgagagtccaatgctccggatcacggcccctctgcccccggggcctagtatggcagttcccactctaggacccggggaaattgcatcaactaccccgccctcccgggcgtggacaccaacacaagagggacctggagacatgggcagaccctgggttgctgaagtggtgtctcagggagccggaatagggatccaaggcactatcacgagcagtactgcgtctggtgatgacgaggaaaccactacaactaccaccattataacaaccactatcaccactgtgcagacaccaggcccatgtagttggaacttctccgggcccgaggggtctctggacagtccgaccgacctctcttcgcccacagacgtgggcctggattgctttttttacataagtgtgtatcccggttacggggtggaaatcaaggtgcaaaacatctcactccgggagggcgaaaccgttactgtcgaggggttgggcggccccgaccctttgcctttggcaaatcaatccttcttactccggggacaggtaatcaggtctcctactcaccaggcggcgttgcgtttccagagtctcccccccccagccggccccggaaccttccatttccattatcaggcttatcttctctcctgccattttccaaggaggccggcatacggcgacgtcacggtaacttcgctgcaccctggcgggagtgcaagattccattgcgccaccgggtaccagttaaaaggggcccgtcacttaacttgtttgaatgctacacagccattctgggacagcaaagagccggtttgcatcgccgcctgcggaggagttatcaggaatgccaccacaggaagaatagtctccccgggcttccccggcaattattcaaataacctcacctgtcactggttactggaagccccagaaggtcagagactgcatcttcacttcgaaaaagtctccctggctgaagatgatgaccgactgatcatcaggaatggagacaatgttgaggccccgcccgtatatgacagttatgaagtggagtacttgcctattgaaggacttctttcctctgggaagcatttcttcgtcgaactctcaaccgacagctccggtgccgcagcggggatggccctgcgctacgaggctttccagcagggccattgctatgagcccttcgttaagtacgggaatttttctagcagcactcccacttaccctgtgggtacaaccgtggaattcagctgcgatcctggatacaccctcgagcaggggtctatcataatcgaatgtgttgacccccatgacccccaatggaacgaaactgagcccgcctgcagggccgtgtgctctggtgaaatcaccgactctgcaggtgtggtcctcagcccaaattggcccgagccttacggcagaggacaggactgcatatggggcgtccacgtcgaagaggataagaggattatgctggacatcagggtgttgcgaattgggcccggtgatgtgctcaccttttacgatggagacgatctgaccgctcgtgtactaggtcagtattctggcccgaggagtcactttaaactttttacaagtatggcagatgtcacaatacaattccagagtgacccaggaactagcgttctcggctaccagcaggggttcgtcatccacttttttgaggtcccccgcaacgatacatgcccggaactccccgaaatcccgaacggttggaagtccccaagccagcccgagttggtccatgggactgtggtgacgtatcagtgctaccctggataccaggtggttggatcttccgtgctcatgtgtcaatgggacctaacctggtcagaggacttgccaagttgccagcgggtgacaagctgccacgaccccggggatgtcgagcattccaggaggctgattagctctcccaaatttcccgtgggcgctactgtccagtatatatgtgaccaggggttcgttcttatgggttcctctatcctaacgtgtcacgaccggcaagctggatccccgaagtggtcagaccgggctcctaagtgccttctggaacagttaaaaccgtgccatggactgtccgcgcccgagaacggtgctcggtcaccagagaaacaattacaccccgccggtgctaccattcatttctcttgcgcccctgggtatgtgttgaaaggacaggcttccatcaagtgtgtgccaggccaccctagtcactggtctgatccgcctcctatctgccgcgctgcgagtttagacggtttttataactcccgctcactggatgtcgctaaagccccggccgcttccagtactttggacgccgcccacattgcagcagcaatatttctccctcttgtggcaatggtgctgctagtcggcggtgtatatttctattttagcaggctccagggaaaatcgtcactacagctccctaggccacggcccagaccttataatcggataactatcgagtccgctttcgacaatcctacttacgaaacaggcagtctgtcattcgccggtgacgagaggatttag

SEQ ID NO: 45820 - DNA, 1527 bp, Artificial Sequence
  Description of Artificial Sequence: Synthetic coding sequence
atgcggcccgtggccctgctgctgctgcccagcctgctggccctgctcgcccacggccttagcctggaagcacctacagtcggaaaaggacaggctccaggaattgaagagacagacggggagctcaccgccgctcccactccagaacaaccagagcggggggtgcatttcgtgactactgcacccaccctgaaacttctgaaccaccacccccttttggaagaattcctgcaggaagggctcgagaaaggagatgaggagctgcgccccgccctgccgttccagcctgacccacctgccccctttaccccatcacctttgcctaggctcgctaaccaggactctcgtcccgtgtttaccagccccaccccggctatggccgctgttcctacgcagccacagtcaaaggaagggccttggtcaccagagagtgagagcccaatgcttcgtattaccgccccactcccccctggcccttccatggcagtgcctacattgggcccgggcgagatcgcatctactacccctccttcacgcgcctggacgcctacccaggaaggcccaggagacatggggaggccatgggtggcagaggtcgtgagtcagggggccggaatcggcatccaggggaccattacctcctcaaccgcttccggagacgacgaggagacaacgactaccacgactatcatcacgaccactatcacaaccgttcaaaccccaggcccatgttcgtggaatttttccggccctgaaggttctcttgatagcccaacagacctgagctctccgacagacgtggggctcgactgcttcttttatatctcagtgtacccaggctacggagtcgaaatcaaggttcagaatatttctctgcgcgaaggcgagacggtaaccgtggagggactgggaggcccggacccgctgcccttggcgaaccagtctttcttgctacgaggccaggtgatccgtagtccaacccaccaagccgccttaagattccagagcctcccgcctcctgccgggcctggcacttttcattttcactaccaagcctacctcctgtcctgccactttcctagaaggcccgcgtacggcgatgtgaccgttacatcccttcatcccgggggctcggcccgcttccactgtgcgaccggttatcagcttaagggggcccggcaccttacttgcctgaatgctactcagcccttctgggattccaaggaacccgtgtgtattgcagcctgcggtggcgtgattcggaatgccacaaccggcagaatcgtgtccccgggatttcccgggaactattccaataatctcacatgccattggctgctcgaagctcccgaaggccagcgattgcacttgcatttcgagaaagtgtctttggcggaagacgacgataggttaatcatccgaaatggtgataacgtcgaagccccgccagtctatgactcgtacgaggtcacagctcctccccctcctcccccactacagcctcactatcatcgcgtgagtgtctag

SEQ ID NO: 45821 - DNA, 2985 bp, Artificial Sequence
  Description of Artificial Sequence: Synthetic coding sequence
atgcggcccgtggccctgctgctgctgcccagcctgctggccctgttagcgcacggattgagtctggaagctccaacggtaggaaaaggccaagctcccggaatcgaggagaccgacggcgaattaacagctgcacccacgccagagcaacccgagaggggagtccactttgtgacaacagcccccaccttgaaacttctgaatcatcaccccctcctggaagagttcctccaggagggtttggagaagggggacgaagagcttagacccgcattgccttttcagccggacccacctgctccctttaccccgtctccactgcctagactggccaatcaagactcccggccagtttttacgagtcccacccctgccatggccgcagtgcctactcagccgcagtcaaaggaaggtccttggagcccagagtctgagtctcctatgctgaggattacagccccgttgccccctgggccatcaatggcagtgccaacactcggcccaggagagatcgccagcaccacccccccttccagagcgtggactcctacacaagagggcccgggtgacatggggcgaccctgggtggccgaggtagtgtcacagggcgcaggaatcggcattcagggcactatcactagcagcaccgcatccggcgacgatgaggagacaacaaccacaacaacgatcataaccaccaccattacgaccgtgcagacacctggaccttgtagctggaacttttcaggacccgagggctcccttgatagccccactgacctttcatcgcctactgacgtgggcctcgactgctttttttatatttccgtgtatccgggctatggggtcgaaatcaaggtgcaaaacatcagcttgcgggagggagaaaccgtaaccgttgaggggctgggcggccctgatccactccccctagcaaatcaatcgtttcttctccgtgggcaggtgattcgcagtcctacgcatcaggccgccctccgtttccagagtctgcctcctccagcggggcccggaacctttcactttcactatcaggcgtatttgctgagctgtcattttccacggagaccagcctatggggatgtgaccgtaacctcccttcaccccgggggatctgcacgttttcactgcgccacgggctaccagttgaagggagcgagacacctgacttgtctgaatgcgacacagcccttctgggatagcaaagagcccgtgtgcatcgctgcctgtggtggagtaattcggaatgcgaccacaggccgaattgttagtccaggcttcccgggcaattactcaaacaacctcacttgccactggctgcttgaggctccggaaggacaaaggctccacctccactttgagaaggtcagtctcgccgaagacgatgatcgcttaattatccgcaatggcgacaacgtggaggctcctccagtctatgactcgtacgaagtagaatacctgcctatcgagggcttgcttagctcggggaaacacttttttgttgaattatccactgatagttctggggctgcagccggaatggcattaaggtacgaggcatttcagcaggggcattgctatgagccctttgtgaagtacgggaattttagctcaagtacaccaacttaccccgtggggaccaccgtggaattctcttgtgaccccgggtatacacttgaacaagggtctatcatcatcgagtgcgtagacccacacgatcctcagtggaatgaaaccgagcccgcctgtcgggcagtgtgttcaggagagatcactgacagtgccggcgtggttctgtcccctaactggcctgaaccctatggccgaggtcaggactgcatctggggggtacatgtggaggaggataaacgaatcatgctggatatcagggtgcttcgaatcgggccaggtgatgttctgaccttctatgacggagatgacttaaccgctagagtccttggtcagtattccggccctagatcacattttaaactgttcacttccatggccgacgttaccattcagtttcagtcagatccaggaacatctgtgcttggttatcagcaggggttcgtcatccatttttttgaggtccctcggaatgatacctgtccagaattgcccgagattccaaacgggtggaagtcaccatcgcagccagaactcgttcacggaacagtggtgacgtatcagtgctatccgggctatcaggtagtgggatccagcgtcctgatgtgccaatgggatctaacctggtcagaagacctgccctcgtgtcagcgcgtgacttcttgccatgatcccggagatgtcgagcactctagaagactgatttctagcccaaaatttccagttggcgccaccgtccagtacatctgcgaccagggttttgtccttatgggcagctctatactgacatgccatgatagacaggcaggcagtcctaagtggagcgaccgcgctcccaagtgcctgctagaacaactgaaaccgtgtcatgggctgagtgccccagaaaacggggctcgatctcctgagaagcagctccaccctgcgggtgctaccatacacttctcatgcgcccccggctacgtcctgaaaggccaagccagcatcaaatgcgttccaggtcatccatcccactggtctgatccaccgcctatctgcagagctgcttccctcgacggattttacaactccaggagcttggacgtggccaaagccccagcggccagcagtactcttgatgcagcccacatagcggccgctatatttctcccacttgtggccatggtgttgctcgtgggcggcgtgtacttctacttctccaggctgcagggcaaatcaagcctgcaactgccgagacctcgaccgcgtccttacaataggatcactattgaatcggctttcgataacccaacctatgagactggctcactgagttttgctggcgatgagcgcatttag

SEQ ID NO: 45822 - DNA, 2982 bp, Artificial Sequence
  Description of Artificial Sequence: Synthetic coding sequence
atgcggcccgtggccctgctgctgctgcccagcctgctggccctgctagcccatggtctctccctagaggctcccactgttggaaaaggacaggcaccggggatcgaagaaaccgacggggaactcacggccgcccccaccccagagcagcctgagagaggtgtgcacttcgtgaccactgcccccactctgaagctactgaatcatcaccctctgctggaagaatttttgcaggagggactggagaaaggggatgaggaactcagaccagctcttccatttcagccggatcctcccgcaccgttcaccccaagtccactgccgcgcctggccaaccaagactcgaggcccgttttcacatcccctacccctgccatggctgcggtacccacccagccacaatctaaagaagggccgtggagtccggagtctgaatcgccgatgctgcgcatcaccgctccattgcctccaggtccctctatggcagtgccgactctgggccctggagaaatcgcctctaccaccccaccctcccgagcgtggacgccgacacaagagggccctggcgatatggggcgaccatgggtggccgaggtcgtgagccagggcgcaggtatcggcattcaaggaacaataacgagcagtacggcaagcggcgacgacgaggaaaccaccacaacaaccaccatcattacgacaaccatcacaaccgtccagaccccagggccttgtagttggaatttttccgggccagagggctcgctcgattcacctaccgacctcagtagtcccacagatgtgggcttggactgtttcttttatattagtgtttatcctgggtacggcgtggagatcaaggttcagaatatcagcctgcgcgaaggcgagacagtcaccgtggagggactcggtggaccagatcctctgcccctcgcgaatcagtccttcttgctgcgaggccaggtgatccgctctcctacacatcaagcagctcttcgattccagtccctccctcctccagctggtccagggacgtttcacttccattatcaggcctacctcctgtcatgtcatttcccgcgccgcccggcatatggggacgtcactgtgacctccttacaccctgggggctccgccagatttcactgtgccaccgggtaccagttaaagggggcgcgacacctgacttgtctgaacgccacgcagccgttctgggatagcaaggagcccgtttgcatcgcagcatgcgggggagtcatcagaaatgctacaaccgggcgcatcgtttctccagggtttccaggtaattacagcaataacctgacgtgccactggctgttggaggctcctgagggtcagcggcttcatttacacttcgagaaggtttcgctcgctgaggatgatgatcggctgatcattaggaacggagacaatgtggaggccccgcccgtgtatgacagctacgaagtagagtatttacctattgagggtctgttgagtagcggtaaacacttctttgtagagctaagcaccgatagcagcggggcggctgccggtatggccttacgatacgaagcctttcagcaggggcattgttacgagcccttcgtgaagtatggtaacttttctagttctactccaacttatcctgtggggactacagtggaattttcctgcgatccggggtacactctggagcaaggcagcataataatagagtgtgttgatccacacgatcctcaatggaatgagaccgagcctgcctgcagagctgtctgttcaggcgagattaccgactctgcaggtgtagtcctgtcccctaattggccagagccatatggtcggggccaggactgtatatggggcgtccatgtggaagaagacaagagaatcatgctggacatccgggtgttacggattggccctggtgatgtactcacattttacgatggggacgacctgaccgctcgtgtgctgggccagtattcaggaccccgctcccactttaagcttttcactagcatggcagacgttacaattcagtttcagtccgacccagggacaagcgttctgggctatcaacagggctttgtaatccattttttcgaggtgcctaggaatgatacctgcccggagcttccagagatccccaatggttggaagagtccatcacagcccgagctcgtgcatgggacggtggttacttaccaatgctatccagggtatcaagtagtggggtcttctgttttaatgtgccagtgggacctgacatggagcgaagatcttccaagctgccagagagttacttcatgccacgaccccggcgacgtggaacattctcgcagattgatatcctcaccaaagttccccgtgggtgcgactgtccagtatatctgtgaccagggcttcgttctgatggggtcatcaatcctgacttgtcacgaccgacaggctggcagtcccaagtggagtgacagagctccaaaatgccttttggaacagctcaagccctgtcacggcttgtccgcccctgagaatggagccaggtccccagagaagcagctgcacccagccggtgcgactattcacttctcttgtgctcctggatacgtgctaaaaggtcaggcatccatcaagtgcgtgccagggcaccctagccattggagtgacccacctcccatttgtcgggctgcatccttagatggattttacaactctcgttctctagatgttgccaaagctcctgcagccagttccaccctggacgcagctcacattgcggcggctatttttttgcctctcgtggcaatggtactgctggttggcggtgtgtatttttatttcagccggcttcagggcaagtcgtcactccagttgccccgccctagacctcgcccatataatcggatcacgatcgagagcgcctttgataatcccacctacgagacaggcgaaacacgggagtacgaagtgagtatttag

SEQ ID NO: 45823 - DNA, 2733 bp, Artificial Sequence
  Description of Artificial Sequence: Synthetic coding sequence
atgggcaccccccgggcccagcaccccccccccccccagctgctgtttttgatcttactttcttgtccttggattcaggggctgccacttaaggaagaagaaatcctgcctgagcccggcagcgagacacccaccgtagcaagcgaagctctggccgagttgctgcatggagcccttcttaggcgcgggcccgagatgggctatttgccggggtctgatcgcgatccaaccctcgcaacacctcccgctggtcaaacgctggccgtcccatcactccccagagcaacggagcccggcaccggccccttgactacggcagtgacacctaatggcgtcagaggggctggccccactgcgcctgagttactgaccccgccccctgggacaaccgcgccccccccaccctcaccagcgtcaccaggcccccctctgggccctgaggggggcgaagaggaaacgactactacaataattactaccaccacagtgacgactacagtaacatcacccgtactctgcaacaataacatatcggaaggggaggggtatgtggagagtcctgacctgggcagccccgtcagccggactcttggcttgttagattgtacttactccatccatgtctacccgggttacggaatcgagatccaggtccagaccctcaacctgagccaggaggaggaactgcttgtgctcgcaggcggcggatccccagggttggccccaagactgctcgccaatagttccatgcttggagaaggacaggtgctaagaagcccaaccaatcggctcttactgcatttccagtccccacgtgtcccccgcgggggtggattcagaatccattatcaggcatacctgctgtcctgcggcttccccccccggcctgcacacggggacgtgagcgtcaccgatttgcaccccggagggactgcaacattccactgcgactcaggttatcagctgcaaggcgaagagactctgatctgcttgaatggtacgaggccgtcctggaacggagaaaccccttcctgtatggcaagttgcgggggcaccatccataatgcgacactggggagaatagtgagtcctgagccaggaggtgccgtgggccctaatttaacctgcagatgggttattgaggctgccgagggcagacggctccaccttcactttgagagggtgtcccttgacgaggacaacgatcgccttatggtccgaagcggaggttctcctctgtctccggtgatttacgatagcgatatggacgacgtgccagagagagggctgatatctgacgctcaatccctctacgttgaactgctttctgagacccccgccaatcccctcctgttgtctttgcggtttgaggcattcgaggaagatcgctgcttcgcccccttccttgcccacggcaatgtgaccacgaccgatccagagtaccggcccggcgccctggccacctttagttgtttgcccggctatgccctggaaccgcccggcccgcctaatgctattgaatgtgtcgaccccaccgagccacattggaatgacactgaacccgcctgtaaagccatgtgcggcggcgagttatccgagccggcaggtgtggtgcttagcccggattggccccagtcctattcacccggccaggattgcgtgtggggcgtgcatgtgcaggaggagaaaaggatactattgcaggtagaaatcctgaacgtgcgggagggggacatgctcactttattcgacggtgatggcccaagcgcgcgcgtactcgcacagttacgcggtccccaacccaggcgccggcttctgtccagcggtcccgacttaaccctgcaattccaggccccacctggccccccgaacccagggctgggacagggatttgtccttcacttcaaagaagttccccgcaacgatacctgccctgagctcccgcctccagaatggggatggcgaacagcaagccatggcgacctcatcagaggcacggttctcacgtaccagtgtgagcccgggtatgagttactggggagcgacattttgacctgtcaatgggatctttcctggtcagccgccccgccagcctgccaaaagatcatgacctgcgctgaccctggcgagatcgccaacggacacagaacggcctctgatgccgggtttcccgtgggttctcatgtgcagtatcgctgcttacctggttactctctcgagggcgcagcaatgctaacatgctatagccgagacactgggactccgaaatggtcagatagagtgcccaaatgtgctctcaaatacgagccgtgtttgaatcctggggtgcctgagaacggataccagacgctgtacaaacaccactaccaagccggcgagagcctgaggttcttctgctatgagggttttgaattgattggcgaagtgacgattacctgtgtcccaggccacccttctcagtggactagccagcctcccctgtgtaaggtcacccagaccaccgaccccagtagacagctggagggcggcaatctggccctggcaatcctcctacctctgggcctcgtgattgttctgggatccggcgtgtatatttattacacaaaattgcagggaaaaagtctgtttggattctctggttcccactcatattcaccaatcaccgtggaatccgatttcagcaaccctctgtacgaggcaggtgacaccagagaatatgaggtgtctatctag

SEQ ID NO: 45824 - DNA, 2430 bp, Artificial Sequence
  Description of Artificial Sequence: Synthetic coding sequence
atgggcaccccccgggcccagcaccccccccccccccagctgctgtttcttatcctgttgtcctgcccctggattcaagggttgcccctgaaggaggaagagatcctgcctgagccaggatcagaaacgccaaccgttgctagtgaagctctggccgagctgctccacggagccctcctccgcagaggtcctgaaatggggtatttgcctgggtctgatcgagatccaactctggcaacacccccagccggccagactctggcagttccttccctgccacgggctacagaaccaggcacagggcccctgactactgctgttactcctaacggggtgcggggggccgggccgacagcgcccgagctgctcacacctccacccggaactaccgccccccctcctccctcccccgcatcgcctggacctcccctggggccagagggaggggaggaggaaactaccactacaatcatcactactactacagtcactacaaccgtcacttcgcccgcctacctgctgagctgtggcttcccgccccggcccgcccacggagatgtatctgtgactgacctacaccctggcggcacagctaccttccactgcgattctggctaccagttacagggagaggagacccttatttgccttaacggaacacgcccaagctggaatggtgagaccccaagctgcatggcctcatgcggaggcacaatccataatgccacactaggccgcatcgtttctcccgagcccggtggggccgtaggacctaatcttacatgtagatgggtgattgaagctgcggagggcaggaggctacatcttcactttgaacgtgtctctctggacgaggacaacgacaggctgatggtacgcagtggaggctctcctctgtcacctgtgatttatgactctgacatggacgacgttcccgagagaggcctgatctctgacgcccagtcgctatacgtggagctcttaagtgaaactcctgctaacccactcctactgtctctccgtttcgaggccttcgaagaggatcgttgtttcgcacctttcctggcgcacggaaacgtgacaaccacagaccctgaataccggccaggggctctcgccaccttctcttgtcttccaggatacgcactcgaacctcctggccctccgaatgcaatcgaatgcgttgacccaacagagcctcattggaacgataccgagccggcctgcaaagccatgtgcggtggtgagctctcagaacctgccggggtcgtgctgtcccccgactggccccagagctattcccccgggcaggactgcgtctggggagttcacgttcaagaagaaaaaaggatccttctccaagtagaaattctgaatgtaagggaaggggacatgctgaccctttttgatggggacgggccatctgcccgggtgctggcgcaactgcggggcccccagcctcggaggaggctgttgagtagtggacctgatctgactttacagtttcaggcccctcccggcccccctaacccaggacttggacaggggttcgtgcttcattttaaggaagtgccacggaatgatacttgtcccgagctcccaccccctgaatggggctggcgaacagcctcccatggcgatctcattagaggaacagtcctcacttaccagtgtgaacccggatacgaactgctgggaagcgatatcctaacctgccagtgggacttatcttggtccgcagcgcccccggcctgccaaaaaattatgacatgtgcggatcccggcgagattgctaacggccacaggacagcctccgatgccggatttccagttgggtcacatgtacagtacaggtgcttacccggatacagcctggaaggggccgccatgctcacctgttattctagagacaccgggactcctaagtggagtgatagggtgccaaagtgcgcccttaagtacgagccctgtctgaacccaggagtaccagaaaacggctaccagacgctgtataagcaccactaccaagccggtgagtccctcaggtttttttgctacgaaggcttcgagcttatcggcgaggtgactattacatgcgtcccagggcatccgagccagtggaccagccagccaccactctgcaaagtggcatatgaggagttactcgacaatagaaagttggaggtgactcagacaacagacccttcaagacagttggaaggaggcaacctggcactcgccattctgctcccgctaggactggttatcgttctaggaagtggggtgtatatctactacactaagctgcaaggaaagagtctgtttggttttagcggcagtcattcctacagtcccattaccgtcgaaagtgacttcagcaaccccttatacgaggctggagacactagggaatacgaagttagcatttag

SEQ ID NO: 45825 - DNA, 2562 bp, Artificial Sequence
  Description of Artificial Sequence: Synthetic coding sequence
atgggcaccccccgggcccagcaccccccccccccccagctgctgttcctaattttgcttagctgtccatggatccagggactcccattgaaagaagaggaaatccttccagagcccggttcggagacacctaccgtggccagtgaggcgctggctgagctgcttcacggggctctgctacggcgggggcctgaaatgggatatttgcccggaccccccttaggccccgaaggcggtgaagaagaaaccaccaccacgattattactaccactaccgtgacaaccactgtgacatcccccgtcttgtgcaataataatattagcgaaggcgaagggtacgtagagtctccagatctcggctcacccgttagccggacactgggactgctggattgtacatactccatccacgtatatccgggttatggaatagagatccaggtgcagacccttaatttgagtcaagaagaggagctgttagtgctagctggaggaggatctccagggttagcgccccgtctgctggccaatagctccatgttaggagaagggcaggtgcttcgctcaccaaccaatcggcttttgttgcatttccagtctcctcgggttccgagaggtgggggcttcagaattcactaccaggcctatctcttatcctgtggattccccccacggccagctcacggtgacgtctccgtgaccgatttgcaccccggggggacagccacatttcattgtgactctggctatcagctgcagggcgaagagaccttaatttgtctcaacggaacacggcccagctggaatggggagacaccttcctgtatggcaagctgcggaggaactatccacaatgctaccctgggccgaattgtgtctcctgagccggggggtgcggttgggcccaatctgacctgccgctgggtaatagaagccgcagaaggcaggcgactgcacctgcactttgaacgggtgagtctagacgaggataatgacaggttgatggtgagatctgggggtagtccacttagtcctgtgatatatgatagcgatatggacgacgttccagaaagaggcctgatatcagatgctcagagcctgtacgtggagcttcttagtgaaactcctgccaatccactgctgttgtccctgagatttgaagcttttgaggaggatcgctgcttcgctccgttccttgcccatggtaacgttaccaccacagaccccgagtatagaccaggggccttggccacgttctcttgcctgcccggatacgcattggagcctcccgggccaccgaatgccatcgaatgcgtcgaccctacagaaccccattggaacgacaccgaacctgcgtgtaaagctatgtgcgggggggagctgtcggagcccgccggggtagtcctgtccccagactggccccaatcctatagccccggccaggactgtgtgtggggagttcatgtccaggaggagaagaggatcttattgcaagtggagatcctcaacgtcagagagggcgacatgctgacgctgtttgatggggacggcccttccgccagagtgcttgcccagctaaggggaccccaaccgcgtcgtaggcttctatcatccggcccagatctgactttacagttccaggcccctcccggccctccgaatcctggcctgggccagggatttgtgttacatttcaaagaagttcccagaaatgacacatgcccagagctgcctccgcccgaatggggctggcgaacggctagtcacggagatctgatccgcggcacggtcttgacataccagtgcgaacctggatacgagctgctaggtagtgatattttgacctgccaatgggacctcagctggtctgccgcgccaccagcctgccagaaaataatgacctgcgcagatccaggggagatcgctaatgggcatcgcaccgcctctgacgccggttttccagtgggtagccatgtacagtacagatgccttcctgggtatagcctggaaggagctgcaatgctaacctgctactcacgcgatacgggcaccccaaagtggtcggaccgcgtgccaaaatgcgctctcaagtacgaaccttgtttaaaccctggagttcccgaaaacgggtaccagaccttgtacaagcatcactaccaggctggagagtccctgaggttcttttgttatgagggttttgaactgatcggcgaagtgaccattacttgtgtcccagggcatccaagtcaatggacttctcaaccaccactgtgcaaggtcgcatatgaagaattactggataatcgcaaactggaggtgacccagactacagatccttcccggcagctggagggcggcaacctcgctcttgcaattctgctgccgctggggcttgtgattgtgctgggcagcggcgtttacatctactatactaagctgcagggaaagtctctgttcggcttttcaggttctcacagctattcccctattacggtcgagagcgacttctcaaaccccctgtacgaagccggcgatactcgagaatacgaagttagcatctag

SEQ ID NO: 45826 - DNA, 2640 bp, Artificial Sequence
  Description of Artificial Sequence: Synthetic coding sequence
atgggcaccccccgggcccagcaccccccccccccccagctgctgttcctcatactgctctcctgtccctggatacaggggtcggatagagaccccacactagccactccccctgcggggcagaccttggcagtgccttctttaccaagagctacagagccggggacaggccccctgactacggcagtgacccctaacggcgtccgtggggctggaccaacagctcctgaattgcttacgcccccaccgggaactaccgcaccgcctcccccttcacccgcaagtcccgggcccccactcggtcccgaagggggggaagaggagaccactaccactataatcacgacgacaacagtgaccacaaccgttactagcccagtgctgtgtaataacaacatctctgagggggaaggctacgtggaatctccagatctgggatcgcctgtatccagaactctcggcctccttgattgcacctatagtattcatgtataccctggctacgggatagaaatacaggttcagaccttaaacctgagtcaggaggaagagttgttagtgctggctgggggcggttcgcccggcctggctcctaggctactcgccaattcttccatgcttggggaaggccaggttctcaggtcacctacgaaccggctcctgctccacttccaatcaccgcgggtgcccagaggtggggggttcagaatccattaccaagcttatctgttaagctgtggctttccacctaggccagcgcatggggatgtgtcagtgaccgacctgcacccaggcggtacagcaacatttcattgtgattcggggtaccagttacaaggggaggaaaccctgatatgcctaaacggcactaggccatcctggaacggcgaaacacccagctgcatggcgagctgcggggggaccattcataacgctacactcggtaggattgtttcacccgagccaggcggggcagtgggacctaacctgacatgccggtgggtaatagaggcggctgagggcaggagactgcatcttcactttgaaagggtctcgcttgacgaagataacgatcggctgatggttcgttcggggggctctcctctgtctcctgtgatctacgatagcgacatggatgatgtgccagagcggggactcatctccgatgcccagagtctctacgtcgaactgctcagtgagacccccgccaaccccctcctgctgagtctgcgatttgaggcgttcgaagaggaccggtgttttgcaccttttctggcccatggaaacgtgactacaacagacccagagtaccgtcccggggcacttgccaccttcagctgtctccccggctacgctttggagccccctggcccaccaaatgcaatcgagtgcgttgacccaactgagccacattggaatgataccgaacccgcatgcaaagccatgtgcgggggcgagttgtccgagcccgccggggtggttttaagccctgactggcctcaatcgtactctcctggtcaggactgcgtgtggggcgtgcatgtgcaggaagaaaagaggatcctgttacaggtcgagatcctcaatgtgcgcgagggcgacatgcttactctgtttgacggcgacggtccaagtgccagagtacttgcgcagttaagaggcccacagccacggcggaggctgctgtcttccgggcccgacctaactctgcaattccaggcacccccagggccgccgaatcctggtctgggtcagggtttcgtgctccacttcaaagaggtacctaggaatgacacctgcccagagctgccaccacccgagtgggggtggagaacggccagccacggagacttgatccggggaactgtgcttacctaccagtgcgagccaggatatgagctcctgggctcagacatcctgacctgccaatgggacctgtcctggtcggcagcccccccagcttgccagaaaatcatgacctgcgccgaccctggagaaatcgccaacggtcatcgaacagccagcgatgccggattcccagtcgggtctcacgttcagtatcgctgcctgccgggttacagcctcgaaggggctgccatgttgacttgttactccagagacactggaacccccaagtggagcgaccgggttcccaaatgtgcccttaaatatgaaccatgtcttaatccaggagtgcctgagaacggctatcagacactgtacaagcatcactaccaagctggcgaatccctgcgctttttctgttacgaaggattcgagcttataggcgaagttaccattacatgtgtacctgggcaccccagccaatggacctcccagccccctttatgcaaagtggcctatgaggagctccttgacaatcgcaaactggaggtaacccaaacaacagatccaagtcggcagttggaagggggaaatctcgcacttgccattttactgccactgggcctggtcattgtgcttggttccggcgtatacatctattacactaagctgcagggtaaaagcctcttcgggtttagtggctcccactcatatagccccatcaccgtagagagcgatttctctaacccattatatgaggccggggacacccgcgagtatgaggtgagcatctag

SEQ ID NO: 45827 - DNA, 3294 bp, Artificial Sequence
  Description of Artificial Sequence: Synthetic coding sequence
atggccccccggcccaagaagcagcccgacaagaaccccctgcacggacgggaactcaatgtcgtgccctccctcggtagacagaccagtctgacaacctcagtgatccccaaggctgagcagtcagtggcttataaggacttcatctatttcaccgtgtttgagggcaacgtgagaaatgttagcgaggtgtcagtagagtacctatgtagccagccttgtgtagtgaacctcgaggcagtcgtgagttcagaattccgctcatccattcctgtgtataaaaaacgatggaaaaatgagaaacatttacatacatcaaggactcagatcgtgcacgttaagttcccttcaataatggtgtatcgagacgattattttattcgacattctatttcagtgtcggcagtgattgtccgggcctggattacccataagtattcagggagggactggaacgtgaagtgggaagagaatcttctccacgccgttgcgaagaactacacactgctgcaaactatccctccattcgagcgccctttcaaggatcaccaagtgtgtcttgaatggaacatgggatatatttggaatctgcgagcaaataggatacctcaatgtccgctcgagaacgacgtggtagccctcctagggttcccatacgccagcagcggagagaacactggaatcgtgaagaagttcccccggttccgaaatagggaactcgaggccaccagacggcaacggatggactatccagtgtttaccgtatctttgtggctatatctcctgcactactgcaaggccaacctctgcggaatcttgtacttcgtggatagcaacgagatgtatgggacgccttccgtgttcctgactgaggaagggtatttgcacatccaaatgcatctcgtcaaaggggaagacctggccgtgaagacaaagtttatcatccccctgaaggaatggtttagactggatataagcttcaatggcggtcaaattgtcgttactacctctatcgggcaggacctgaaaagctatcataatcaaaccatatctttccgggaagacttccactataatgacaccgccggttactttataattggcggcagccgttacgtggctgggattgagggtttttttggtccactgaagtattaccggctgaggtcattgcatccggcccagatttttaaccctctgttggagaagcagctcgcagaacaaatcaaactctattacgagaggtgtgcggaagtgcaagagatcgtgagcgtgtatgcttcagccgccaaacatggcggcgagaggcaggaggcttgtcatctgcacaatagctatctcgatctccagagacgatacgggagaccaagcatgtgtagggcatttccctgggaaaaggagctcaaggataagcatccatcactattccaagcgctgctggagatggatcttctgaccgtccctaggaatcagaacgagagcgtgtccgagattggcggaaaaatatttgagaaggcagtgaagcgcttgagctctatcgatgggctccaccaaatctctagtatcgtccctttcctgacagatagctcttgctgtggataccacaaagcctcttactatctcgcagtgttctatgagaccgggcttaacgtcccacgagatcagctccaaggaatgctgtattcattagtcggcggacagggcagtgagagattatcaagcatgaatctgggatataaacattaccagggaatcgacaactacccactcgattgggagttgtcctacgcgtactactctaacatcgctacaaagactcctctagatcagcatactctgcagggcgaccaagcttacgtggagactatcaggctgaaggatgacgagatccttaaggtgcagacgaaggaagacggcgatgtattcatgtggttgaaacatgaagctacccgcggtaacgctgccgcccagcagcgcctggctcagatgttgttttgggggcagcaaggcgtggcaaaaaatcccgaggccgctatcgagtggtatgctaagggcgctttagagaccgaagatccggctttaatctacgactacgccattgtcctctttaagggtcagggagtgaaaaagaaccggaggctggcactggaactcatgaagaaggccgcgtccaaaggtttgcaccaggctgtcaatgggttgggatggtattatcacaaatttaagaaaaactacgccaaagccgctaaatactggctgaaggcggaggaaatgggcaaccccgatgctagctataatttaggcgtcctgcatttagatggtatttttcctggggtaccaggaagaaatcagaccctggcaggcgaatactttcacaaagcagcacagggagggcatatggaaggaaccctgtggtgttctttgtactacatcaccggcaacctcgaaacgttccctcgagaccccgaaaaggccgtggtctgggcaaagcacgtggcagagaaaaatggctatctggggcatgtgatcaggaagggccttaacgcttatctggaaggctcttggcacgaggccctactctactatgttcttgcagcagaaaccggcattgaagttagtcaaaccaacctcgcgcatatttgtgaggagaggccggacctggcaagacgttaccttggagtgaattgcgtttggagatactataactttagtgtgtttcagattgacgcaccgtcttttgcttacctgaaaatgggcgatctatactattacggtcatcagaatcagtctcaagatttggagctgagtgtacagatgtatgctcaggccgccctggatggtgacagccaggggttcttcaacttggctctgcttatcgaggaaggtactatcatccctcatcacatccttgactttctcgagatagactcgacacttcacagcaacaacattagcattttgcaggagttatatgagaggtgttggagccactcaaacgaagagtcttttagcccctgcagcctggcctggttatatctccacctgaggttgctgtggggcgccatcctgcattcggcactcatctattttctgggcacatttctgctgtcaatcctcattgcctggacggtgcagtattttcaatcagtgtccgcgagcgacccaccgcccaggccttctcaggcgtcccccgacacggcaacaagtaccgcctctcctgcagtcacccctgcagccgacgcatccgaccaggaccagcccacagtgaccaataacccagagcctaggggctag

SEQ ID NO: 45828 - DNA, 3399 bp, Artificial Sequence
  Description of Artificial Sequence: Synthetic coding sequence
atgcagcggcggggcgccggcctgggctggccccggcagcagcagcagcagccccccccactcgccgttgggccacgcgcagccgcgatggtgccctctggaggcgtaccccagggcttgggaggtagaagcgcttgcgccctgttgctcctttgctatctgaatgtggttccttccctgggccgccagaccagcctgacaacctcagtcattccgaaagcagagcagtcagtagcctataaggattttatctattttacggtcttcgagggcaacgtgcggaacgttagcgaagtgagtgtggagtatctgtgtagccaaccatgcgtggtgaacctggaagccgtggtcagcagcgaattccggtccagtatccccgtatacaagaaaaggtggaaaaatgagaaacatctccacactagcaggacccagatagttcatgtgaaattcccttccattatggtctacagagatgactactttattcgacattctatcagtgtgagcgcagttattgtgcgggcttggattactcacaaatactcaggacgcgactggaacgtaaagtgggaggaaaacctgctgcatgcagtggcgaaaaactataccttgctgcagacaatccccccctttgagaggcctttcaaagatcatcaggtgtgtttagaatggaatatggggtacatttggaatctgagagccaacaggatacctcagtgtccccttgagaacgacgttgtggcgttgctgggtttcccatacgcatctagtggggaaaacacaggaatagtgaagaaatttcctcgctttcggaaccgcgagctcgaagccacccgtaggcagcgcatggattaccctgtcttcacagtctctctgtggctgtacctgctccactattgcaaagctaatctgtgtggtatcctgtacttcgtcgacagcaatgagatgtatggaacgcccagtgtcttcctcaccgaagagggatacttacatattcagatgcaccttgtcaaaggcgaggatctcgccgtcaagacgaagtttattatccccctcaaggaatggtttaggctcgatatttcgttcaatgggggtcagatcgtggtcaccacatctatcggccaggatttgaagagctaccacaaccagactattagctttcgcgaggatttccactacaacgacacagcaggatattttatcattggggggagtagatatgttgcaggcattgaaggatttttcggccccctcaagtattatcggttaagaagtctccatcccgcgcaaatttttaatcctctgctggagaagcaactggccgaacaaataaagctgtactatgaacggtgcgccgaggtgcaggagattgtgagcgtatacgcctctgcggccaaacacggcggagagaggcaagaagcttgccatctacataattcttacctggatctgcaacggaggtacggccgcccaagcatgtgcagggctttcccctgggagaaagaacttaaggacaagcatccttccttgttccaggcacttttagagatggacctgcttacagtgccccgaaatcaaaacgaatccgtaagtgaaattggcggaaagatctttgaaaaggcagtcaaacgcctgtcatctatcgacggactacaccagattagttccattgtgccttttctgaccgattcttcctgttgtggttatcacaaggctagctactacctcgcagtcttctatgagacagggctgaacgttccccgggaccaactgcagggcatgctttactctctggtgggcggccaggggagcgagaggctgtcctccatgaatcttggctataaacactaccagggaatagacaattatcctcttgattgggaactttcctacgcctattatagcaacatagccacgaagacacccctggaccagcatacactgcagggagatcaggcatatgtggaaacaatcaggcttaaagatgacgaaattctgaaagtacaaactaaagaggatggcgacgtgttcatgtggcttaaacatgaggccactagagggaatgcggcagcacagcagcgcttagctcaaatgctcttttgggggcagcagggggtggccaaaaaccctgaggcagcaatcgaatggtatgctaagggggccttagaaacagaggatcctgctttgatatatgattacgcgatcgttttatttaaaggccagggagtgaaaaaaaaccgacgtctggccctcgagcttatgaagaaggctgcctccaaaggcctccaccaagcagtaaacggcctcggctggtattatcataagttcaaaaagaattacgccaaagccgcgaaatactggctgaaagctgaggagatgggcaatccggacgcatcctacaatctgggggtgctgcatttggatggaatttttccaggggtaccaggtcggaaccagacactcgcaggagagtacttccacaaagcagcccagggagggcacatggaagggaccctatggtgttctctgtattacatcactggtaacctggaaacttttcccagggatccagaaaaggcggtggtttgggcaaagcacgtggccgaaaagaatggctacctgggccacgttattcggaagggactcaacgcgtacttagaggggtcttggcatgaggcgctcctgtactacgtgctggctgcagagactggcatagaggtgagtcaaactaacttggcacacatctgcgaggagcgtcctgacctggctcggcggtatctgggggtgaactgtgtatggcgctattataacttttctgtgttccagattgatgcgccatcgtttgcttacctgaagatgggagacctctattattatggccatcagaaccagagccaggacctcgagttaagtgttcagatgtatgcccaggcagcgctagacggcgactcccagggctttttcaacctagcccttctgatcgaggaaggtactatcatccctcatcatattctcgattttctggagattgactctacgttgcactcaaacaatatcagcatacttcaggagctttacgagagatgttggtctcactctaatgaggaatcctttagtccttgtagtctggcgtggctgtacctgcacctgcgactactctggggcgcaatacttcattccgctctcatctattttctggggaccttcctgctgtctatcttgatcgcctggactgtccagtacttccaaagcgtttccgcctctgatcccccaccccgcccctcccaagcctcgccggacaccgcgacatccaccgcttctccagcagtgaccccagctgccgacgcgtccgaccaagatcaaccgaccgtaacgaacaatcccgagccacgtgggtag

SEQ ID NO: 45829 - DNA, 2940 bp, Artificial Sequence
  Description of Artificial Sequence: Synthetic coding sequence
atggtgtaccgggacgactacttcatccggcacagcatcagcgtgtccgccgtgattgtcagagcttggattactcataaatacagtggacgcgactggaacgtgaagtgggaggagaaccttcttcatgccgttgctaaaaactatactctcctacaaaccattccccctttcgaacgtcccttcaaggaccaccaggtctgcctcgagtggaatatgggatacatctggaacctgcgggcaaacagaataccccagtgccctctcgaaaatgatgtcgttgcgctgcttggcttcccatacgcaagtagcggtgagaataccggcatcgtgaagaaattccctagattcagaaatcgtgaacttgaagccacacgtcgtcagcgcatggattatccggtgttcactgtctccctctggctttatctgttgcactattgcaaagcgaatctttgtggtatcctgtactttgtggattctaatgaaatgtacggcactccaagtgtttttctcacagaggagggttatcttcatatacaaatgcacctagtcaaaggggaagatttggccgtcaagacaaaattcattataccgcttaaagagtggttcaggctggatattagctttaatggtgggcagatcgttgtcacaacctctataggacaggacctcaagagttatcacaatcagaccatcagtttccgggaggatttccattataatgacacagccgggtacttcatcatcgggggaagccgatacgtggccgggatcgaaggcttttttggcccgctcaagtattaccgattgcgcagccttcaccctgcccaaattttcaacccccttctggaaaagcagctcgccgaacagatcaagctgtattacgagaggtgtgctgaggtacaggagatcgtctcggtctacgcaagcgctgccaagcacggcggtgaacgacaagaagcctgccatttgcacaatagctatttggatcttcagagacggtacggcagaccaagtatgtgtcgagctttcccttgggaaaaggagctcaaggacaaacacccttccctgtttcaagccctcttggaaatggatttacttactgtccctcggaatcagaacgaatccgtatccgagattggagggaaaatctttgagaaggctgtcaagaggcttagtagtatcgacggcctccatcaaatctcttctatagtgcctttcttaactgacagcagctgttgtggctaccacaaggcatcctattacctcgctgtattttatgagaccggtctcaatgtgccccgtgaccagctccagggtatgctttactccttagttggagggcagggttcggaacgattgtcctccatgaacctgggctacaagcattaccagggaattgacaattaccccctagattgggagctgagttatgcctactatagcaatattgctactaaaacacccctggaccagcatacactgcagggggatcaggcctacgtcgagaccataaggctcaaagatgacgaaatcctcaaggtacagacaaaggaagacggagatgtctttatgtggctaaagcacgaagccacccgaggcaacgcggctgctcagcagcggctggcccaaatgctcttctggggccaacaaggcgtagcaaaaaaccccgaggcagctatcgagtggtacgcaaagggagccctagaaaccgaagatccagccctcatatacgattatgccattgtgctgttcaaagggcagggtgtgaaaaagaatcgcaggctggctctggaacttatgaaaaaggcagcctctaaagggctgcaccaggctgtgaacggcttgggctggtactatcacaaatttaagaagaattacgctaaagcagctaaatattggctgaaagctgaagaaatggggaatcctgatgcctcctacaatttaggcgtcttgcacctagacgggattttccccggtgtgcccggaaggaaccaaacactggctggtgagtattttcacaaggctgcccaaggcgggcatatggaaggcactctgtggtgttctctgtactacatcacagggaatttggagactttcccaagggatcccgagaaagcggtggtctgggcaaagcacgtggcagaaaaaaatggatacctaggccacgtaattcgcaaggggctaaatgcctatctcgagggtagctggcatgaagccttgctgtattacgttttggcggcagaaactggtattgaagtgtcgcagacgaacctggcacacatctgcgaagagagacccgacctcgccaggagatatttgggtgtgaattgcgtgtggagatattacaatttttccgtttttcagattgacgccccttctttcgcctatctcaaaatgggagacctctactactacggccaccagaaccaaagccaggatcttgagctgagtgtccagatgtacgcgcaggctgccttggatggagactcacaaggattcttcaatttggcgcttctgatcgaagagggtaccatcatccctcaccacattttggacttccttgagattgattcaaccttgcactcgaataatattagcatcctgcaagaactgtacgaacggtgttggtcccattcaaatgaggagtctttttcaccctgctccctggcttggctgtaccttcacttgcggctgctgtggggcgccatcctgcattcagccctaatatatttcctgggaacctttctcctctccatcttgatcgcctggacagtccagtattttcagagtgtgtccgcgtccgacccccctccgcggccgtcgcaggcatcacccgacacagcgacctctacagccagtcctgctgtgacacctgcagccgacgcctctgatcaggatcaacctaccgttaccaacaaccctgagccaagaggttag

SEQ ID NO: 45830 - DNA, 228 bp, Artificial Sequence
  Description of Artificial Sequence: Synthetic coding sequence
atggtgtaccgggacgactacttcatccggcacagcatcagcgtgtccgcagtaatcgttcgtgcatggatcactcataaatattctggaagggattggaacgtgaagtgggaggaaaatctgctgcacgccgtggctaagaactacacactgttgcagacgatacccccttttgaacggccctttaaagaccaccaagtctgcttagagtggaatatggggtattag

SEQ ID NO: 45831 - DNA, 189 bp, Artificial Sequence
  Description of Artificial Sequence: Synthetic coding sequence
atggtgtaccgggacgactacttcatccggcacagcatcagcgtgtccgcagtcatcgtgagagcgtggatcacccacaaatactctggccgcgattggaacgtaaaatgggaggagaatctgctacatgcagtcgcgaagaactataccctccttcagacaattcccccgtttgagagacctttctag

SEQ ID NO: 45832 - DNA, 108 bp, Artificial Sequence
  Description of Artificial Sequence: Synthetic coding sequence
atggtgtaccgggacgactacttcatccggcacagcatcagcgtgtcagccgtaattgtccgcgcctggatcacgcataagtattccgggcgtgactggaacgtatag

SEQ ID NO: 45833 - DNA, 570 bp, Artificial Sequence
  Description of Artificial Sequence: Synthetic coding sequence
  Description of Combined DNA/RNA Molecule: Synthetic coding sequence
atggagcggcaggaggagagcctgagcgcccggcccgccctggagaccgagggtctcagatttctacataccacagttgggtcactgctcgcaacgtatgggtggtacatcgtcttttcctgtatactgctgtatgtcgtttttcagaagctcagcgcccgcctcagagctctcagacaacggcagctagaccgcgcggctgccgcagttgagccagacgtggtggtcaagaggcaagaagctttggcggctgcccgcctgaagatgcaagaagagctgaacgctcaggtcgaaaagcataaagaaaagctgaagcagttggaggaggaaaaacgaagacagaagatagaaatgtgggacagcatgcaagagggcaaatcatacaaagggaatgcgaaaaagcctcaggaagaggacagccctgggccgtcaacctcctccgtcctgaagagaaaatccgacagaaagcctctgagaggggggggttataacccgttgtccggagaaggcggcggagcatgctcatggaggccgggcagaagagggccctctagtggcggaugaggctag

SEQ ID NO: 45834 - DNA, 570 bp, Artificial Sequence
  Description of Artificial Sequence: Synthetic coding sequence
  Description of Combined DNA/RNA Molecule: Synthetic coding sequence
atggagcggcaggaggagagcctgagcgcccggcccgccctggagacagaaggcttgagattcctgcatactacggtgggatcactgttagcaacatatggctggtacatcgtgttctcttgcattttgttatacgtggtattccagaagctgtcggcccggctgagggctcttcgacaacgtcaactggacagagcagctgccgccgtggagccagatgttgtcgttaaaagacaggaggctctggctgctgcgaggttgaagatgcaggaagagctcaatgcgcaggtggagaagcacaaggagaagcttaaacaacttgaagaggagaagcgccgacaaaagatcgagatgtgggacagcatgcaagagggcaagtcttataaaggtaatgcaaaaaagccccaggaggaggatagcccaggccccagtacctcatccgtgcttaaaagaaaatccgacagaaagcctctcagggggggcggatataatccactttcaggcgaagggggaggtgcctgttcctggaggccagggcgccgcggaccatctagtggcggaugaggctag

SEQ ID NO: 45835 - DNA, 564 bp, Artificial Sequence
  Description of Artificial Sequence: Synthetic coding sequence
atggagcggcaggaggagagcctgagcgcccggcccgccctggagactgaaggcctccgcttcttgcatacgacggtcggttccttgctggcaacgtatggatggtacatcgttttctcttgtattctcctgtacgtggtgtttcagaagctctcagcacggctgagggcccttcgccagaggcaactggacagggccgctgctgctgtggagcctgacgtcgttgtaaagcgccaggaggccctggctgccgctcgtctgaaaatgcaggaggagctcaacgcccaggtcgagaaacacaaggaaaaactgaaacagctggaagaggagaagcgtcgtcagaagatcgagatgtgggatagcatgcaggaaggtaaatcctataaggggaacgcgaaaaaaccacaggaagaagactctccagggccctcaacatcgagcgtgttaaaaaggaaaagcgaccgaaaacccctgaggggggggggttacaaccctttgtctggggaggggggtggcgcttgttcatggaggccagggagaagaggcccatctagcggaggctag

SEQ ID NO: 45836 - DNA, 2667 bp, Artificial Sequence
  Description of Artificial Sequence: Synthetic coding sequence
atgcagaccccccgggccagccccccccggcccgccctgctgctgctactgctgctgctgggcggtgcacacggcctattcccggaggagccccctccactgtcggtcgctcccagagattacttgaaccactatcccgtgtttgtaggatccgggcccggcagactaacccctgcggagggtgctgacgacctgaacattcaacgggtgctgcgagtgaatcggactctattcattggcgaccgcgacaatctttaccgagtagaactggagcctcctactagtaccgaactgaggtatcagagaaaacttacttggcgtagcaacccctccgatataaatgtgtgtcgtatgaaaggtaagcaagagggagagtgccggaattttgtaaaggtcctactcctgcgcgatgaaagcacattatttgtgtgcggatccaatgccttcaatccagtctgcgctaactatagtatagacaccctccagcccgtcggggacaatatcagtggcatggcccggtgcccctatgacccgaagcacgctaacgttgcgttgttctccgatggtatgctgtttacagccactgtcaccgatttcctggccatagacgctgtcatttatcgatcactgggagaccgtcctacactgaggacagtcaaacatgattccaagtggttcaaggaaccgtacttcgtgcacgccgttgaatggggttcccatgtgtattttttttttagggagatagctatggagttcaactatctcgagaaggttgtcgtttctcgggtggccagggtatgcaagaatgacgtgggtggatctccaagggtgctggagaagcagtggacatcctttctgaaggcaaggctgaattgttcagtgccaggagactcacatttctacttcaacgttctgcaggccgtgacaggtgttgtcagcttaggcggacggccggttgtcttggccgttttctccacaccttccaatagcatccccgggtcagccgtgtgcgccttcgacctgacgcaggtggcagctgtattcgaggggcgctttcgcgaacagaagtcgcctgagtccatttggacaccagtgcccgaagaccaagtccctagaccgcggcccggttgttgtgctgcccctgggatgcaatacaacgccagttccgcacttcccgatgacatcctcaattttgtaaagacgcatcctcttatggacgaagcagtgccttctctgggacatgctccctggatacttcggaccttgatgcgacaccagctcactcgagttgccgtcgatgttggcgccggtccctggggtaaccagactgtcgtgttcttgggctcagaggccggtacagtcctgaagttcctggtgagacctaacgccagtaccagtggaacttctggactgtctgtgtttctggaggagtttgagacctacaggcctgaccgttgcggacgaccaggcgggggagagactggacagcggctgttgtcgctggaacttgacgcagcttccggcggacttctggctgcattccctcgctgtgtcgtcagggtccctgtggctcgttgccagcagtatagcgggtgcatgaaaaactgtatcgggtcacaagacccttactgcggctgggctccggacggaagttgcatctttctgtctccaggtactagggcggcctttgagcaggatgtgtccggcgctagcacctccggcttgggagactgcacaggcttattgcgggctagcctcagcgaggaccgggctggcttggtctccgtgaacctgctggtgacctcctcagtggctgcatttgtcgtaggcgccgtcgtgtccggtttttcagtaggctggtttgtgggcttgagggaacggagggagctggctagacgtaaggacaaggaagcaatactcgctcacggcgctggcgaggcagtattatctgtgtcacgcttgggagagcgacgcgcgcagggtcctggcggccgaggcggtgggggcgggggcggcgccggggttcccccagaagctctgctcgcgccgctcatgcaaaacgggtgggccaaggccactcttttgcaggggggcccacatgacctagactctggtcttttgcctacaccggagcagacgcccctgcctcaaaaaaggctgccaacaccgcacccgcaccctcatgcgttaggcccccgcgcgtgggatcatgggcaccctctgcttcccgcatcagccagtagtagcctgctgctactggcacccgcgagagcccctgaacagcctcccgcgccaggcgagcccactccagatggccggctctacgccgcgcgtccaggccgcgcaagccatggggacttccctctgactccgcacgccagcccagatagacggcgcgtcgtgagtgctccaacagggcctttagaccctgcaagtgctgccgatggattgccacgtccatggagtccgcctcccacaggttctttgaggcggcccctggggcctcacgcccctccagctgcaacattgagaagaacccatacctttaactccggcgaggcccgccctggcgaccggcaccgcggatgtcatgccagacccggtactgacctggctcacctgttgccctacggcggtgctgacagaaccgcccccccggttccctag

SEQ ID NO: 45837 - DNA, 2358 bp, Artificial Sequence
  Description of Artificial Sequence: Synthetic coding sequence
atgctggtggccggcctgctgctgtgggccagcctgctgaccggcgcctggccttccttcccaacacaggatcatttgccagcaactcccagggtaaggttgagctttaaggaattgaaggctaccggcactgcccatttcttcaattttttgctgaacaccaccgattatagaattttactgaaggacgaagaccacgatcgtatgtacgtcgggagcaaagattacgtgcttagcctggacctccacgacatcaacagggaacctctaattattcactgggcggcgtcccctcagcgcatcgaggagtgtgtgctttctggaaaagacgtcaacggcgaatgcgggaacttcgtgagattaatccagccttggaaccgtacccacctctacgtttgcggcacaggcgcgtacaaccctatgtgcacttatgtcaatcgggggagaagggctcaggccactccgtggacccagactcaggccgttagagggcggggcagccgtgcaacagatggcgcattgcgccccatgcctacggccccaagacaggactacattttttacctggagcccgaaagacttgagtcaggcaagggaaagtgtccttatgacccgaagctggacactgcatcagccctgatcaacgaggaattgtacgcgggggtttacatcgacttcatgggaaccgatgcagccatttttcgcacccttgggaagcagacagccatgaggacagatcagtacaactccaggtggctcaatgatccctccttcatacacgctgaacttatcccagactctgctgaaaggaacgacgacaaattatacttcttcttcagggaaaggtctgccgaagcccctcagtctcctgccgtgtacgctcgaatcggcaggatctgcctcaacgacgacggcgggcactgctgtttagtgaacaagtggagtacctttttgaaggcacgcttagtctgctcagtgccgggggaagatggtatcgagactcattttgacgagctgcaagacgtcttcgtgcagcaaacacaagacgtgcgcaatcctgtgatctacgcagttttcaccagctccggttcagtctttagagggagtgcggtgtgcgtctactctatggctgatatacggatggtctttaacggccccttcgctcataaagaaggtccgaactatcagtggatgcctttcagtggcaagatgccctacccacgcccgggcacctgtcccggcggaacttttaccccttccatgaaatcaaccaaagactacccagacgaggtcataaattttatgcggagtcacccattgatgtatcaggcggtgtaccctctgcagaggagaccccttgtagtgaggacaggcgctccataccgtttaaccaccatcgctgtcgatcaggtggatgcagcggatggacggtacgaggtgctgtttctgggtaccgacaggggtaccgttcagaaggtgatcgtcttgccaaaagatgaccaggagctagaagaactgatgctggaagaagtagaggtcttcaaagaccctgcacccgttaaaaccatgacaatttcaagtaaaaggcagcagctgtacgtggccagcgccgtcggtgttacccacttatcactgcatagatgccaggcatacggagccgcatgcgctgattgttgcctggcccgcgacccgtattgtgcatgggacggacaagcctgcagtagatacactgcctcatccaagcggcgctcacgccgccaggacgtgaggcacggtaatcccatacggcagtgtcgaggtttcaattcaaatgctaacaaaaacgctgttgagtcagtgcaatatggcgtcgcaggcagtgctgcattcctcgaatgtcaaccacgatccccacaggccacagtaaaatggctctttcagcgtgatcccggcgataggcggcgtgagatcagagccgaagataggtttctgcgaaccgagcaaggcctactgctcagagctctccagcttagtgacagaggcctctattcctgcaccgcgacagagaacaacttcaaacacgtcgttactagggtccagctacacgtgctgggtcgggacgctgtccacgcagctctttttccccctttatccatgtccgcccctcccccaccaggcgcaggccctcccacacctccctatcaggagctggcacagttactggctcaacctgaagtcggtctgatccaccagtactgccaagggtactggcgacacgtgcctccttcaccccgtgaagctccgggggcgcctagatccccagagccccaggatcagaaaaagccgcgcaaccgccgtcaccatccgccggacacctag

SEQ ID NO: 45838 - DNA, 795 bp, Artificial Sequence
  Description of Artificial Sequence: Synthetic coding sequence
atgctggtggccggcctgctgctgtgggccagcctgctgaccggcgcttggccctctttccctacacaagaccatttgcctgcaacacctagggtgcggttgagcttcaaggagctgaaggcaaccggaacagctcatttcttcaatttcttgctcaacacaacggactaccggatccttctgaaggatgaagaccacgataggatgtatgtgggctctaaagattatgtgctaagcttggacctgcacgatatcaaccgggagcccttgatcatacattgggctgcctctccacagcggatcgaggagtgcgtgctgagcggcaaagatgtgaatggcgaatgtggaaatttcgttcgtctgatacagccatggaataggacgcacctctatgtatgcggcacaggcgcctacaatccaatgtgcacatacgttaatcgtggtcgacgcgcccaggattatattttctacttagaacctgaaaggctggaaagcgggaagggcaaatgcccctatgacccaaagttagatacagcatccgccctcatcaatgaggaactgtacgcaggtgtctacattgattttatggggaccgatgctgctatcttcagaacgttggggaagcagacggcaatgaggactgaccaatataactcccgctggttaaacgatcccagtttcattcatgcggagcttatacccgattcagctgagcgcaacgacgacaaactgtacttctttttcagagaaaggtcggcagaggctccacagagtccagcggtttacgcccgctag

SEQ ID NO: 45839 - DNA, 279 bp, Artificial Sequence
  Description of Artificial Sequence: Synthetic coding sequence
atgctggtggccggcctgctgctgtgggccagcctgctgaccggcgcgtggcctagctttcctacacaggatcacctcccggcaacacctcgggtgcgattgtctttcaaggaactcaaggctacgggcaccgctcattttttcaattttctgcttaacactaccgactaccgaatactgctgaaagacgaagatcacgaccggatgtatgtgggcagcaaagactacgtattgagccttgatcttcatgatataaaccgcgagccactgattgtgtag

SEQ ID NO: 45840 - DNA, 2265 bp, Artificial Sequence
  Description of Artificial Sequence: Synthetic coding sequence
atgctggtggccggcctgctgctgtgggccagcctgctgaccggcgcctggccaagctttccgacccaagaccatctacccgctacaccccgcgtgcgattgtcttttaaagaacttaaagcaactggcacagcccattttttcaacttcctgcttaacaccactgactatcgcatactgttaaaggacgaggatcacgacagaatgtatgttggcagcaaggactacgtgctttccctggatctacacgacatcaaccgcgaacctctgattatccattgggccgcttctcctcagaggatcgaagagtgcgtccttagtggaaaagacgtgaacggagagtgcggcaattttgtgaggttaattcagccctggaacagaacacacctctacgtgtgcggaacgggggcttataacccaatgtgtacgtatgttaatcggggtagaagagcccaagattacatcttctacctggaacccgagcggctggaatccgggaaaggcaagtgcccgtacgatcccaagctggatactgcttccgccctcatcaatgaggaactgtatgcgggcgtgtatattgattttatgggtacagacgccgcaatcttccgcaccttggggaaacagaccgcaatgaggaccgatcaatataactcaagatggcttaatgacccatcattcatccacgcggagctaatccccgattccgctgagagaaacgatgacaaactctatttctttttcagagagcggtccgcggaagcgccccagtctcctgccgtatacgcccggattggcagaatttgtttaaatgatgacggtggacattgctgtttggtgaacaagtggtctaccttcctgaaggcaaggctcgtctgcagtgttcctggtgaagacggaatcgaaacacacttcgacgaactacaggatgtgtttgtgcagcagacccaggatgtacggaacccagtgatctacgccgtgttcacgtctagcggctccgtctttcggggttccgccgtatgcgtgtactcaatggcagatatccggatggtcttcaacggaccattcgctcacaaggaaggtcccaattaccagtggatgcctttttcaggcaagatgccctatccacgacctggtacttgcccagggggaacctttacccccagcatgaaatcaaccaaggattatcccgacgaagtcatcaactttatgcgatctcaccccttgatgtatcaggccgtgtacccactgcaacgtagaccactggtggtgcgcacaggggctccttatcgcctaaccaccatcgctgtggatcaggtagacgcagccgacggtcgatacgaagtcttgttcctgggcaccgaccgcgggactgtgcagaaggtcatcgttcttccaaaggacgaccaggaactagaggaacttatgttggaggaagttgaagtttttaaagatcccgcccctgtgaaaaccatgacgatcagctccaagcggcagcagctctacgtagcatctgccgtgggggtcactcacctgagtttgcatcggtgccaggcctatggtgccgcctgtgccgattgttgcttggcgagggatccatactgcgcctgggatggccaagcatgcagcagatacaccgcctctagcaagaggcgatcgcggaggcaggacgtgcgacacgggaatcctattcgacaatgtcggggttttaacagtaatgcaaacaaaaacgctgttgagtctgttcagtacggtgtagccggcagtgccgcgtttctcgagtgccagccaaggtcccctcaagccaccgttaaatggctgttccaacgcgaccctggtgaccgacggagggagatacgggctgaagatcgtttcctccgtacggaacaaggacttttgttgagggcgttacagttatctgatcgcggtctatattcgtgcacggccaccgaaaataatttcaaacatgtggtcaccagggtgcagcttcacgtgctgggcagggacgcagtgcacgcagccctattcccaccgttgtccatgtctgctccgccaccacctggcgcaggccccccgacacctccttaccaggagctcgcccagttactggcacagcctgaggtcggcttgattcatcaatattgtcaaggctattggcgacatgtgccacccagccctcgggaggcacccggcgctcctcgcagtccggagccccaggatcagaaaaagccacggaaccgacgacatcatccaccagacacatag

SEQ ID NO: 45841 - DNA, 1143 bp, Artificial Sequence
  Description of Artificial Sequence: Synthetic coding sequence
atgctggtggccggcctgctgctgtgggccagcctgctgaccggcgcatggccttcattccccacacaggaccacctgcctgctacaccccgagttcgcttgtcttttaaagagctgaaggccacgggaaccgcccacttcttcaacttcctccttaatacaactgactaccgtatccttctgaaagacgaagatcatgatcgcatgtatgtcgggtcaaaagactatgtgctaagcctggacctccatgacattaacagggaaccgttgatcattcactgggccgcctccccccaacgcattgaagagtgcgtgctcagtgggaaggacgtgaatggcgagtgcggtaatttcgttcggctgatccaaccttggaaccgaacacatctgtatgtttgcggaaccggagcatacaatcccatgtgcacttacgtgaacaggggaaggcgggcccaggactatatattctacctcgaacctgagagattagagtccgggaagggcaagtgtccatacgacccaaaactcgacaccgcctccgctttgattaatgaggagctgtacgctggcgtgtatatcgattttatgggaacagatgctgctattttccgaaccctggggaagcagaccgcgatgcgcaccgaccaatataactcaagatggctgaacgatccaagtttcatacacgctgaactgatccccgattctgcagagcgcaacgacgataagctgtatttcttcttccgtgagcgctccgctgaagccccccagagccctgccgtgtacgctcggattggccgcatctgcttaaacgacgacggcggccattgttgcctggtcaacaaatggtcaaccttcctaaaggcccgcttggtgtgcagcgtgccgggggaagacggcattgagacccacttcgacgagctgcaggatgtgtttgttcagcagacacaggatgtccggaaccctgtgatatatgccgtcttcacttctagtggtagcgtgttcagggggtcggccgtatgcgtgtatagcatggctgacatacgcatggtcttcaacgggcccttcgcacataaggagggacctaactatcagtggatgccgtttagcggaaagatgccatacccaagacccgggacctag

SEQ ID NO: 45842 - DNA, 2514 bp, Artificial Sequence
  Description of Artificial Sequence: Synthetic coding sequence
atgctgcggaccgccatgggcctgcggagctggctggccgccccctggggggctttgccaccccgtccccccttgctcctccttctgctgttgctgctactcctccagcctcccccccccacctgggccctctccccgagaattagtctgccactgggcagcgaggaacggcccttcttaagattcgaagccgagcacatttccaattatacggccctgctgctctctagagacggccgcactctgtacgtcggggctagagaggctctttttgcgttgagctccaatttatcttttcttccaggcggtgagtaccaggagctgctttggggagctgatgctgaaaagaaacagcagtgttctttcaaaggaaaggatccacagagagactgtcaaaattatatcaagatactgctgcctctcagtggctcacacctgttcacttgtggaacagccgcttttagtcctatgtgcacctacataaatatggaaaactttaccctggcacgcgacgaaaaagggaacgtgttgttggaagatgggaagggcaggtgtccatttgacccgaattttaaaagcaccgctctggttgttgacggcgagctgtatacaggaaccgtgtcatccttccaggggaatgaccctgccataagccgatcgcaatctctgcggcccacaaagacagagagctccctgaattggctccaagaccctgccttcgtcgcttccgcttatatccccgaatcgttaggtagccttcaaggcgacgatgataagatttacttctttttcagcgagaccggacaagagtttgaattctttgaaaacaccatcgtctctcgcatcgcaagaatatgtaagggcgacgagggaggagagcgcgtgttgcaacaacgttggacgtcctttctcaaagcccagctgttatgctctcggcccgacgacggatttccatttaacgtcctgcaagacgtcttcactctgagcccatcaccacaggactggagggataccctgttctatggggttttcacgtctcagtggcatagaggaaccactgaaggctccgccgtctgtgtcttcacaatgaaggacgttcagagggttttttcgggcctctacaaggaagtaaatagagaaacacagcaatggtatacagtgacacatcccgttcccacaccccgtcctggtgcctgtatcaccaatagtgctcgggaacggaaaatcaacagtagcttgcagctccctgatagggtgctgaactttctgaaggaccattttctgatggacggtcaggttcgaagcagaatgttacttctgcagcctcaggcccggtatcagagagtcgccgtgcatcgcgtacctggcctgcatcacacttacgacgttctattcttgggtaccggagatggtcgtctccacaaggcagtaagcgttggaccgagagtgcacatcattgaagaactgcagatcttctccagtgggcagcctgtgcagaacctcctgttggatacacacagaggtcttctgtacgctgcctctcactctggcgttgtccaggtacctatggcaaactgcagtctgtatagatcatgtggagattgccttttggctagagacccctactgtgcttggagcggatcgagttgtaagcatgtgagcctctatcagccacaactcgccaccaggccctggatccaggatatcgagggggcctcggctaaagatctgtgttccgcctcttcagtggtctcgcccagttttgtgcccaccggagagaagccttgtgaacaggtgcagttccaacccaacaccgtgaacactttagcctgccccctgctctcgaatctcgccactcgtttgtggctgcgcaatggagcccccgtaaacgctagcgccagctgtcacgttttaccaacaggcgacctgctgctcgtcggcactcagcagctgggcgaattccagtgctggtcactggaggaggggtttcagcaattggtagccagctactgccctgaggtggttgaagatggcgtagcagatcaaactgatgagggcggcagtgtccccgttatcatttccacgtcgcgcgtgagcgcccctgcaggcggtaaggcctcatggggtgccgatagatcatattggaaggagtttctggtaatgtgcaccctcttcgtgctcgcggtccttctccctgttctatttttgctttaccgccaccgaaatagcatgaaagtgtttctgaaacagggcgagtgcgctagcgttcaccctaaaacctgtcccgtagtactgcccccagagactcgccctctgaacggcctcggacccccttccactccgttggaccaccgcggctatcagtctctaagtgattcacctcccggcagcagagttttcactgagagcgagaaacggcccctgtcaatccaggatagtttcgtggaagttagccctgtgtgcccacgcccccgcgtgaggctaggcagcgagattagggattctgttgtgtag

SEQ ID NO: 45843 - DNA, 2214 bp, Artificial Sequence
  Description of Artificial Sequence: Synthetic coding sequence
atgggcctgcggagctggctggccgccccctggggcgccctgcccccccgtccaccccttctgctcctcctcctcctgcttctcctcctacaaccgccccctcctacatgggcattatcaccaagaatatctctccccctgggcagcgaagagcgcccctttctccgtttcgaggccgagcatatctcaaattacaccgctctgctccttagcagggacggccgcactctctacgtgggtgcacgtgaagccttgttcgccttgagctccaatttgagcttcctgccggggggtgagtatcaggagctgctctggggtgcggacgcagaaaaaaaacagcagtgtagttttaagggcaaggacccccagagagattgccagaactatatcaaaatcctgctgccactgtccggatcccatctcttcacttgtggaacagcagccttttcccccatgtgcacctatatcaacatggagaattttaccctggctcgcgatgaaaaaggcaacgtgctgttagaggacgggaaggggaggtgcccctttgatcccaactttaagtccactgctctcgtggttgatggagaactctacacaggaacagtcagtagctttcaggggaacgacccggcaatcagccgttcacaaagtctccggcctaccaaaactgagtcctcactgaactggctacaggaccctgcctttgtggcaagcgcctacattccagaaagtctggggtccctgcaaggcgacgatgacaaaatttacttcttttttagcgagacaggccaggagtttgagttttttgagaacactattgtgtccagaatcgcacgaatttgcaagggagacgagggcggggagagagtgttacagcagcgatggacatcatttctgaaggcccagttactctgtagtagaccggatgacggctttcctttcaatgtcctgcaagatgtatttaccctctcgccttccccccaggactggagagacacacttttttatggggtcttcacctcgcaatggcacaggggtacaacagaagggagtgcagtgtgcgtgtttactatgaaggacgtgcagcgggtttttagcggtctctataaggaagtcaatcgggaaacccagcagtggtatactgtgactcacccagtgcccacacctcgtccaggcgcttgtatcactaatagtgctagagaacgcaagatcaatagcagcctccaactgccggacagggtcctcaacttcctaaaggaccacttcctcatggacggacaggtccgcagtaggatgctcctcctgcagcctcaggcaaggtaccagagagtcgccgttcatagggtccccggactgcatcacacctacgacgtgctctttctaggcacgggagacggacggttgcacaaagcagtctctgtcggccccagggtacatattatcgaagagttgcagatcttcagcagtggtcagcccgtgcagaatctactacttgatacccaccgaggattactgtacgccgcttcgcattccggagtggttcaggtgccaatggccaattgcagtttataccggagctgcggtgactgccttttagcccgcgacccatattgcgcgtggagtgggtccagttgcaaacacgtgagcctgtaccagccacagctcgcaacaaggccttggattcaggatattgagggagcttccgcaaaagatctttgtagcgctagtagtgtggtgtccccatcctttgtgcctacgggtgaaaagccctgcgaacaagtgcagttccagcccaatactgtgaatactctggcatgtccactgttatcaaatctcgccacacggttgtggttgaggaacggcgcacccgtcaatgccagtgcttcatgtcatgtgctgcctacgggggaccttctgcttgtgggcactcagcagctcggcgaatttcagtgttggtcacttgaagaaggctttcagcaacttgtcgcatcatactgcccagaagtggtagaggatggcgtggctgaccagacagatgagggcggcagtgttccggtgattatctctacaagccgggtgagcgccccagccggtggcaaggcgagctggggcgcggaccgatcatgggctcgcactcagttgttagatcttagttctctctaccaggccgtggcaaccagggaggactcagctagctccggcgaaataagctag

SEQ ID NO: 45844 - DNA, 2514 bp, Artificial Sequence
  Description of Artificial Sequence: Synthetic coding sequence
atgctgcggaccgccatgggcctgcggagctggctggccgccccctggggcgccctgcccccaagacctcccctcttgctgctgcttcttctgctgttgctgttacaacctcccccacctacatgggccctgtcacctcgaataagcctccctctcgggtcggaggagaggccctttttgaggttcgaggcggagcacatttccaactatacagcacttctgttatcacgggacgggaggactctctatgtcggagcccgggaggccctttttgctctgtcgtcaaatttgtcattcctgccgggcggggaataccaggagctgctttggggggcggatgccgagaagaagcagcagtgctcctttaaaggaaaagacccgcagcgcgactgccagaattatattaaaattctccttccactgagcggcagtcatctctttacttgtggcacagctgccttctctccgatgtgtacctatattaatatggagaatttcactcttgctcgagatgagaaaggaaacgtacttctcgaggatggaaaaggccggtgtccgtttgacccaaattttaagtccactgctctggtcgtcgatggcgaactctacactggcacagtatctagctttcaaggaaatgacccagcaatcagccgctctcagagtctgcgtccaacaaagaccgagtcttcactgaactggctccaggatccggcttttgtcgcctccgcctatatcccggaaagccttggatctctgcagggagacgatgataagatttacttctttttctccgaaacgggtcaagaatttgaattctttgaaaataccattgtgtcccgaattgctcgcatatgcaagggtgacgaaggaggagagcgagttcttcagcagagatggacttcctttctgaaagcccagctgttatgtagccgacccgacgacggcttcccctttaacgtcttgcaggacgtcttcaccctcagtcccagtccccaagactggcgcgataccctgttctatggtgtgttcacttctcagtggcaccgtggcactaccgaagggagcgcagtctgcgtatttaccatgaaggacgtgcagcgcgttttcagcgggctctacaaggaggttaacagagaaactcagcaatggtacactgtgacacatcctgttcctactccacgacctggagcatgtataacaaactccgccagagaacggaaaatcaacagctccctacagctgcccgacagagtactgaatttcttgaaagaccatttcctcatggacggacaagttaggtctcgcatgctcctcctccaaccacaggcccgataccagagagtggctgtccacagagtgcccgggctgcatcatacctacgatgtcctattccttggaactggtgatgggcgacttcacaaggccgtctcggtggggccaagagtacatattattgaagagttacaaatattttctagcgggcaacctgtccaaaacctgctgctggacacgcatcgcggtctgctgtatgcggcgtcccactctggcgtcgttcaggtccctatggccaactgttctctgtataggagctgtggtgactgtctgctagcccgggacccttattgtgcatggtctggatcttcctgcaaacatgtatcactctatcaaccccagttggcaacccgaccgtggatacaggatattgagggagcaagcgccaaagacttatgctccgcctcctccgtggtgtccccctcctttgtgcctaccggcgagaagccctgcgaacaggttcagttccagcccaatacagtgaacacactggcatgccccctactcagcaacctggctactcgcctctggctgcgcaacggtgcaccggtaaatgcctccgcatcctgtcacgtgctgcccactggggacctgctactggtaggaacacagcagctgggggagttccaatgctggagcctggaggaggggtttcagcaactcgttgcttcctattgtcctgaggtggtggaggacggcgttgcagatcagacagacgaaggaggatcagtccctgtgatcatatcgactagccgcgtgagcgctcctgccggaggcaaggccagctggggcgcggacagaagttattggaaggaatttctggtaatgtgcactcttttcgtgttagccgtgttgttgcccgtactgttccttctctacaggcatcgtaactcaatgaaggtctttctgaaacagggcgagtgtgcttccgtacatccaaagacgtgccccgtcgttctgcctcccgagacacgaccacttaatgggcttgggccaccaagtacccctcttgaccatcggggctaccagagcctcagtgacagcccacctgggtcccgcgtcttcactgaatccgaaaaaagaccgctctctattcaggattccttcgtggaagtgtcccccgtgtgtccacgtccaagggtgcggctgggctccgagatcagggacagcgttgtttag

SEQ ID NO: 45845 - DNA, 276 bp, Artificial Sequence
  Description of Artificial Sequence: Synthetic coding sequence
atgctgcggaccgccatgggcctgcggagctggctggccgccccctggggcgcactccctccccgcccccctttgctattacttctcctgctgctgcttcttctccagcctcccccccccacctgggccctcagccccagaatctcgctgcccctggggagtgaggagaggcccttccttagatttgaggcggaacacatttctaattacaccgctctcctgctctcacgggacggtaggacattatatgtgggcgcgcgagaagccctgttctag

SEQ ID NO: 45846 - DNA, 345 bp, Artificial Sequence
  Description of Artificial Sequence: Synthetic coding sequence
atgctgcggaccgccatgggcctgcggagctggctggccgccccctggggtgctctgcctcctcgcccccctctgctgcttctgcttctgttgctgctcctcttgcagcctccaccccctacttgggccctgagcccaagaatttccctgccattgggctctgaggaaagacccttccttcggttcgaggccgagcatataagtaactataccgccttgctgctctccagggatggaaggaccctatatgtgggagcccgggaggcgctgttcgccttatcttcaaacctgtcgttcttacccgggggggagtaccaggaactcctttggggcgctgatgcatag

SEQ ID NO: 45847 - DNA, 366 bp, Artificial Sequence
  Description of Artificial Sequence: Synthetic coding sequence
atgctgcggaccgccatgggcctgcggagctggctggccgccccctggggcgcattacccccccggccccctctgctcttacttttgcttttactcctgctgctgcagcctccacctcccacatgggccctgtctcccaggatttccctcccattgggctccgaggaaagaccattcctgcggttcgaggcggaacacatcagcaactacaccgccttgctgctgtctcgggatggaagaacattatacgtcggcgccagggaggcgttattcgcactgtcctccaatcttagcttcctacccggcggtgagtaccaggaactcctttggggggctgacgcagaaaaaaaacagcagtgtagctag

SEQ ID NO: 45848 - DNA, 2502 bp, Artificial Sequence
  Description of Artificial Sequence: Synthetic coding sequence
atggccccccactgggccgtgtggctgctggccgcccggctgtgggggttaggaattggcgcggaagtttggtggaacctggtgcctcgcaaaactgtctcaagtggtgagttggccactgtcgtaaggaggtttagccagaccggcatacaggactttctgaccctgacccttacagagcctacaggcctcctgtacgttggagcacgggaggctttgttcgccttttccatggaggccctggaactgcagggggcgatatcctgggaggcccccgtcgagaagaagacagaatgtattcaaaaggggaagaataaccagactgaatgttttaactttattaggtttctccaaccctacaatgcctctcacttgtacgtctgcggtacctacgcattccagcctaagtgtacatacgtgaacatgctcaccttcactctcgaacatggggaatttgaggacggaaagggaaaatgtccttatgacccagccaaagggcatgcaggcctgctcgtggatggtgagctctactcggcaacgcttaataattttctgggaacagagcctataatactgcgcaacatgggaccccaccactctatgaagactgaatacttagccttttggctgaacgagccccactttgtggggtctgcctacgtgccggaaagcgttggatctttcaccggagatgacgacaaggtctatttttttttccgtgagagagccgttgaatcagattgctatgccgaacaggttgtagctcgagtggcccgtgtctgcaagggcgacatgggtggcgctcgcaccctccagcggaaatggaccacattcctgaaggcgaggttggcttgtagtgctcccaattggcagctgtactttaaccagctgcaggcaatgcacaccctacaagatacctcgtggcacaacaccaccttctttggggttttccaagctcagtggggggacatgtacctcagcgctatctgtgagtaccaactggaagagattcaacgagtgtttgagggaccctataaggagtatcacgaggaggcccagaagtgggatagatatacggacccggtgccgtcgcctcggcctggttcatgcatcaataactggcataggaggcatggatataccagcagtttggagctgccagacaatatcttgaactttgttaagaagcatcccctgatggaggagcaagttggaccccggtggtccaggcctttactggtcaagaaaggcacaaactttacacatctcgttgctgacagggtgactggtcttgacggcgcaacatataccgtactgttcattggtactggggatggctggcttctgaaagcagttagcctcggcccgtgggtccaccttattgaggagcttcagttgttcgaccaggagcccatgagatccctggtactatcacagagcaaaaagcttctcttcgccggcagtagatctcagcttgttcagcttcccgtcgccgactgtatgaagtaccgatcttgtgcagattgcgttctcgcacgcgacccctactgtgcctggtctgtaaatactagtcggtgtgtggcagtgggggggcattctggaagtttattgatacagcacgtcatgacctccgacacttctggcatctgcaatctgaggggaagtaagaaagtccgacccacccctaagaacatcacagtggtggctggaacagatctggtcctgccctgccatctctcttccaatctggctcacgctagatggaccttcggagggcgggacttaccagccgagcagccaggatccttcctgtatgatgctagactgcaggctctggtggtgatggcagcacagcctaggcacgcaggcgcgtaccactgcttcagcgaagagcagggagctcggctagctgcagaaggctacctggtggccgtggtggccggcccaagtgttaccctggaggctagagcccccctcgagaacttaggcctcgtgtggttggcagtcgtcgcactgggagcggtgtgtctcgtgctcctactcctggtactatcactgaggaggcggctgcgggaagagttggaaaagggggccaaggcgacagaaagaactttggtgtaccctctagagctgcctaaggaaccaacttcgcctccattcagaccatgtcctgagccagacgagaaattgtgggacccggttggatactactacagcgacggatcactaaaaatagtgcccggtcacgcgaggtgccaacccgggggcggacctcctagcccaccacctggcatccccggacagccactgccttctcctacccggcttcacttgggcggaggaagaaatagcaatgccaatgggtacgtgcggctccagctggggggagaggataggggagggctgggccacccactgcctgagcttgcagacgagttaaggcgtaagcttcaacagcgccagccgctgccagactccaatcccgaggagagctcagtctag

SEQ ID NO: 45849 - DNA, 606 bp, Artificial Sequence
  Description of Artificial Sequence: Synthetic coding sequence
atggccccccactgggccgtgtggctgctggccgcccggctgtggggacttgggataggggctgaggtctggtggaacctggtgccacggaaaacagtctccagcggggaattggctacagtcgtgcgaaggtttagtcagaccggcatacaagatttccttacgctgactctgacggaaccgaccgggctactttatgtcggtgcaagggaagccttgttcgccttttccatggaagcactggagctgcagggcgcaattagttgggaggcccctgtggagaagaagactgagtgtatccaaaaggggaagaataatcagaccgaatgctttaattttattcggtttttgcaaccatataacgcctcacatctgtatgtctgcggcacctacgcgtttcagcccaagtgcacatatgtaaatatgctgacgtttactctagagcatggtgagtttgaagatggaaaaggaaaatgtccatatgatccggcaaaaggacatgccggcctgctggtcgacggtgagctgtattctgccacactaaataatttcctcgggacggagcctatcatcctgcggaacatgggtcctcaccactctatgtag

SEQ ID NO: 45850 - DNA, 423 bp, Artificial Sequence
  Description of Artificial Sequence: Synthetic coding sequence
atggccccccactgggccgtgtggctgctggccgcccggctgtggggtctgggcattggagccgaggtttggtggaacttagtacctcggaagacagtctccagcggggaactggccacagtggtccgcaggttcagtcaaaccggcatacaagatttcctgaccctgactctgaccgagcccacaggactgctttatgttggcgcgagggaggcactctttgccttctcaatggaagcactggaattgcagggagcgatcagctgggaggcacccgtggagaaaaagactgagtgtattcagaaaggtaaaaataaccaaaccgagtgttttaattttattaggtttctgcagccatacaatgctagtcacctgtatgtgtgtggcacctatgcttttcaaccgaagtgcacctacgtttag

SEQ ID NO: 45851 - DNA, 2217 bp, Artificial Sequence
  Description of Artificial Sequence: Synthetic coding sequence
atgcggatgtgcacccccatccggggcctgctgatggccctggccgttatgtttggcacagcgatggctttcgcacccattcctcgaatcacatgggaacaccgggaggtgcaccttgtgcagtttcacgaacctgacatttacaactattccgctttgctcctgtctgaagacaaggataccctctacataggggcaagagaggccgtgttcgcagtgaatgctctcaacatatccgagaagcagcatgaggtgtattggaaagtcagcgaggataaaaaggcaaaatgcgccgagaagggtaagtccaaacagaccgagtgcctgaactatatacgggtgttacagcccctatccgcgacgtccctgtacgtgtgtggaaccaatgcttttcagcctgcctgtgaccatctgaatcttaccagcttcaagtttcttggtaaaaatgaagatggaaagggccgatgtccttttgaccccgctcacagttacacaagcgttatggtggatggggagctgtactcggggactagttacaatttcctcgggagcgagcccatcatcagtcgaaactcttcccactctcctcttcgtacagagtatgcaattccatggctaaatgaacctagctttgtatttgccgacgtgatccgcaaaagtcccgatagcccagacggggaggacgacagggtctattttttcttcaccgaggtgagcgtggaatacgagttcgtgttccgggtgctcatccctcggatcgccagagtttgtaagggtgatcaaggaggactaaggacccttcaaaaaaagtggacatcatttcttaaggctcggctgatatgctcgcggcccgatagtgggctcgtcttcaatgttctgcgcgatgtgtttgtactgcggtctccagggcttaaagttcccgtcttttacgctctgtttacaccccagctgaacaatgtggggctgagtgccgtttgtgcttacaacctgtcaacagctgaggaagtgtttagccacggcaaatacatgcagtccacaaccgtggagcaatctcacacgaagtgggttcgttacaacggtccagtgcccaagcccagaccaggtgcgtgcattgatagtgaagcccgcgccgccaattacacttcgtctttgaacttgccggataagactctccagtttgtgaaagatcaccccttaatggacgacagcgtcaccccaattgataaccgcccccgactgattaaaaaggatgtgaactacacacagattgtggtcgacaggactcaggccttagacggtaccgtctatgacgtaatgttcgtatctacagatagaggcgccttgcacaaagccatatccctggagcacgcagttcacataatcgaagaaacacaactcttccaggacttcgagcccgttcagaccctgctcctgtcgtctaaaaagggcaacaggttcgtgtatgctggcagtaattctggtgtggttcaggcgccattagccttctgtggaaagcatggaacctgtgaggattgcgtcctggcaagggacccatactgcgcttggtcccctccaacagctacctgcgtggctcttcatcaaaccgaaagtccgtctcgaggactgatacaagagatgagcggcgacgccagtgtctgccctgcgtctagtccgaagccattgcccccgcccgggtccagcagcctgtcgtgcctcgggcacgttggggatagacgactcagctccccatggaccccatggccagcgtccggcgccggtcctgactcctcgtcccgagtgtctctgttgccgcctttcttgagcgatcaggcccagcacgtgcatgcccttggcaatttttatctgttttgtcaggctactggcccagccgacatcaggtttgtttgggagaagaacggccgggcgttggagacctgcgtcccggttcaaacacatgcactgcccgatggaagggctcacgccttgtcttggttgcaggatgcaataagagaatctgcagaatatcgctgtagcgtcctaagttccgctggaaacaagacctccaaagttcaggttgccgtgatgagaccggaagtgacacatcaagagagatggacccgtgaactatccgcctggcgggccgttgccggggagcatgatcgcatgatgcagagttggaggaaggcttgggagagctgttcaaaggatacactatag

SEQ ID NO: 45852 - DNA, 2589 bp, Artificial Sequence
  Description of Artificial Sequence: Synthetic coding sequence
atgcggatgtgcacccccatccggggcctgctgatggccctggccgtgatgttcggcactgccatggccttcgctcctattcccaggatcacttgggaacacagggaagtgcacctcgttcaattccatgagccagacatctataattattctgctcttctactatcagaggacaaggacacattgtatataggagctcgcgaggccgtgttcgcggtgaacgcactcaacatctcagagaagcaacacgaggtgtattggaaagtgagcgaagacaaaaaggcgaagtgtgcagaaaaaggaaaatccaagcaaacggagtgcctgaattacattcgagtgcttcagccactcagcgctacatccctgtacgtgtgtggaactaacgcctttcagcccgcctgcgatcacttaaatttaacaagctttaagttcttgggtaagaacgaggacggaaagggcagatgccctttcgatccagctcactcgtatacatctgtcatggtggatggcgaactatactctgggacatcatataacttcctcggtagcgagcccatcatttcacggaatagttcccactcaccccttcgaacggagtacgcaatcccctggctcaatgagccatccttcgtgtttgcggatgtgattaggaagagccctgatagtccagatggcgaagacgacagggtgtatttcttcttcactgaggtgagtgtggagtatgagtttgtcttcagggtgctgattccccgaatcgcaagggtttgcaagggagatcaagggggcctgcggaccctccagaaaaagtggacaagtttccttaaggcccgcctcatctgttcacgtcctgactctgggttagtgttcaatgtcttacgtgacgtgttcgtgctgagaagtcccggcctcaaggtgcctgtgttttacgctctgtttaccccgcagctcaacaatgtcgggcttagtgcggtgtgcgcctacaatctgagcacagccgaggaggtctttagccacgggaaatacatgcaaagcaccaccgtcgaacagtcccacactaagtgggtccggtataacggaccggtgcctaagcctaggcccggagcctgtatcgacagcgaggctcgggccgccaattacacctcctccctcaaccttcccgacaaaactctccagtttgttaaggatcacccactcatggatgattcagtgactcccatcgataaccgtcctcgtttaatcaaaaaggatgtcaattacacgcagattgtggtcgatcgtacacaggctctggacgggacagtctacgatgtcatgttcgtttcgacagatagaggagctttacataaagctatcagcctagagcatgcggtacatatcattgaagagacacagttgtttcaggactttgagcctgtccaaaccctcctcttgtcttccaaaaagggaaaccggttcgtttatgccggctctaactccggcgttgtgcaggccccgctcgccttctgcggtaagcacgggacttgtgaggactgtgttctcgctagagatccatactgtgcttggagccccccaaccgccacatgtgttgcgctccatcagaccgagtcaccatctaggggattaattcaggaaatgagtggggatgcatctgtgtgccccgataaatctaaaggttcttacagacagcatttcttcaagcacggtggaacggccgaactgaagtgttcacagaaatccaacctggctagggtgttttggaagtttcaaaacggggtactcaaagcagaaagtcctaagtatggccttatgggcagaaaaaacttgctgatttttaatctgagcgaaggtgactcaggagtttatcaatgtctcagcgaggagagggtcaaaaacaaaaccgttttccaagtggtcgctaagcacgtgctcgaagtgaaggtagttcctaagcccgtcgtcgcgcctactctgtccgtagtccagacagaaggtagcagaatcgccactaaggttctggttgccagcacacagggatcgtcaccacctacacccgctgtccaggcaacatcttccggggcaatcacactgcctcccaagcctgccccaacagggacctcctgtgaacccaagattgtgataaatactgttccccagcttcactcggaaaagaccatgtacttaaagtcctccgataatcgcctactgatgtctctttttctgttcttcttcgtgttgttcttatgtctgttcttctataattgctataaaggctatctaccccggcagtgtctgaaatttcggtccgccctgctcatcggcaaaaagaaacccaagtctgacttctgcgatagggagcaatcgctgaaggagacactcgtggaaccaggtagctttagtcagcaaaatggcgaacatcctaaaccagccctggacaccggttatgaaacggagcaagatactatcacttccaaagtcccaacagatcgcgaggactcccagagaatcgacgatctcagcgcaagggacaaaccctttgacgtaaagtgcgagctcaaattcgccgacagcgatgccgacggggactag

SEQ ID NO: 45853 - DNA, 180 bp, Artificial Sequence
  Description of Artificial Sequence: Synthetic coding sequence
atgcggatgtgcacccccatccggggcctgctgatggccctggccgttatgtttggcacggctatggccttcgcacctatcccaagaattacctgggaacaccgggaggttcacctcgtgcagttccatgagccagacatttataattattccgccctcctgctgagtgaggataaatag

SEQ ID NO: 45854 - DNA, 372 bp, Artificial Sequence
  Description of Artificial Sequence: Synthetic coding sequence
atgtggacccagcggtggaagcggagcgtgagccccggccccgccgacatccggtttgtgtgggaaaaaaatgggcgggctctcgaaacctgtgtgccagtgcagactcacgccctgcctgatggccgagcccatgccctcagttggttgcaggatgccatcagggagagtgcggaatacagatgtagcgtgctcagcagtgcaggtaacaagacgtccaaagttcaggtggctgtcatgcgcccagaggtgacccatcaggagagatggacgcgggaactgtccgcatggcgggccgtggcaggggaacacgatagaatgatgcagtcttggcgtaaggcctgggagagctgctcaaaggacactctgtag

SEQ ID NO: 45855 - DNA, 6 bp, Artificial Sequence
  Description of Artificial Sequence: Synthetic coding sequence
atgtag

SEQ ID NO: 45856 - DNA, 441 bp, Artificial Sequence
  Description of Artificial Sequence: Synthetic coding sequence
atgcggatgtgcacccccatccggggcctgctgatggccctggccgttatgtttggtaccgccatggcgttcgcgccaattccgcgtataacttgggaacacagagaggtgcacttggtccagttccatgaaccagacatttataattacagcgcgctgctgctctctgaagataaagacacattatacattggcgctagagaggccgtcttcgctgttaacgcactgaacatctccgaaaaacagcatgaagtttattggaaggtgagtgaagataagaaggccaagtgcgctgaaaaggggaagagcaagcaaaccgagtgtttaaattatatccgcgtcctgcaacctctgtcggctacgagcctgtacgtgtgtggcaccaacgcctttcagccagcctgcgaccacctaaatctcaccagtttcaagtttctgtag

SEQ ID NO: 45857 - DNA, 2217 bp, Artificial Sequence
  Description of Artificial Sequence: Synthetic coding sequence
atgcggatgtgcacccccatccggggcctgctgatggccctggccgtcatgttcggtactgctatggcttttgcccccatccctcggatcacctgggaacatcgcgaggtccatctggttcagttccatgagccagacatttacaactattctgccttactcctctctgaggacaaagacaccttatatatcggggctcgcgaggccgtgtttgccgtgaatgctctgaacatctcagagaagcagcacgaagtttactggaaggtcagcgaggacaagaaggcaaaatgcgcagaaaagggtaaaagcaagcagaccgagtgtctgaactatattcgcgtgctgcagcctctatcagcaacctctctctatgtgtgcggcactaacgcattccagccagcttgtgatcatctaaaccttacctcattcaagtttttgggaaagaatgaggacgggaaggggagatgcccctttgatccggctcattcatatacttctgtgatggtggatggtgaattatattccgggacgagctataattttttaggcagcgaacccataattagtaggaacagctcacactccccattgagaactgaatacgcgatcccatggcttaacgagcctagcttcgtgtttgcagatgttattaggaaatcccccgacagccccgacggcgaggatgaccgagtctatttcttttttaccgaagtttctgtggagtacgagttcgtattccgggtactcatcccaagaattgccagagtgtgcaagggagaccagggcgggctcaggactttacaaaagaaatggacttcttttttaaaagctagactgatctgcagtagacccgattccgggctggtcttcaacgttttaagggatgtgtttgtgttgaggagtcctggtctcaaagttccggtgttctacgccctgttcaccccacaactgaacaatgtaggcctatccgcggtatgtgcctacaacctgtccactgccgaagaggtgttctcccacggtaagtacatgcaatctactacagtcgaacagtcccacactaagtgggtcaggtacaacggacctgtgccaaagccccgccctggggcgtgcattgattcagaagcccgggccgccaactacaccagttctctgaatcttcctgacaaaaccctgcagtttgtgaaagaccatcctctgatggacgatagcgtgacgcctattgataatcggcccaggctgataaaaaaagacgtgaactacactcagatcgtggtcgatcgcacccaagctttggacggcaccgtctatgacgtcatgttcgtgagtacagataggggggctttacacaaagctatttccttagagcacgccgttcatatcatcgaggagacccagctctttcaggactttgaaccagtccagaccttgcttctatccagcaagaagggaaatcgttttgtgtacgctggtagcaacagcggtgtggtgcaggcccccctggccttttgtggcaagcacggaacgtgtgaagactgtgtcctggcccgtgatccttattgcgcgtggtcaccacctacggcaacgtgcgtggccttgcatcagaccgagtcaccaagcaggggccttatccaagagatgtcgggcgatgcttccgtgtgccctgccagtagccctaagccactgccaccaccaggcagcagttccctatcttgtctgggtcatgttggcgatcgtcgactcagtagtccatggacaccttggccagcgagcggcgccggaccggattcctcatctcgagtttccctgcttcccccgtttctatccgatcaggctcagcatgttcacgcactgggaaacttctatctcttttgccaggccaccggacccgccgacataaggtttgtctgggaaaagaatggtcgggcactggagacctgcgtgccggtgcagacgcacgctctgcctgatgggagagctcatgcgctgtcttggttgcaggacgcaatccgcgagtctgcagagtaccgctgcagcgttctgagttccgccggcaacaagaccagtaaggtgcaagttgcggtgatgcgaccggaggtaacccatcaggagagatggacacgcgagctgtccgcctggagagccgtggccggtgagcacgatagaatgatgcagagttggcgcaaggcatgggaaagctgcagtaaagataccctgtag

SEQ ID NO: 45858 - DNA, 2589 bp, Artificial Sequence
  Description of Artificial Sequence: Synthetic coding sequence
atgcggatgtgcacccccatccggggcctgctgatggccctggccgtaatgttcggcacagccatggcattcgctcccattcctcgaataacctgggaacaccgggaggtccacctcgtccaattccatgaacccgacatttacaattatagcgcgctcctcctcagcgaagataaggatacactgtatatcggcgcacgcgaggccgtgttcgccgttaatgctctcaacatcagcgaaaaacaacacgaggtgtactggaaggtaagcgaggataagaaagctaaatgtgccgagaagggaaagtcgaagcaaaccgaatgcttgaattacatcagggttttgcaacccctctctgccacatccctctacgtgtgtggaacgaatgcattccaaccggcatgtgaccacttaaatttgacctctttcaagttcctaggtaaaaacgaggacgggaagggtcgatgtcctttcgacccggcccactcatacacctcagttatggtggatggagaactgtactctggcacaagctacaatttcctgggatctgaacccatcatatcaaggaactcatcccatagccccctgagaacagaatacgccatcccttggttaaatgagccttcattcgtgttcgccgacgtcatacggaaatcacccgatagtcctgatggtgaagacgacagggtatacttcttcttcactgaggtgtctgtcgagtacgaattcgtcttcagagtgcttattccaagaattgccagggtctgcaaaggcgatcaggggggcttgcgcaccttgcagaaaaagtggactagcttcctcaaagccagactcatctgctcccggcccgacagcggactggtttttaacgtccttagagacgtctttgtgctgagatctccaggtcttaaggtccccgtgttttacgcgctgtttaccccacaactcaataacgtgggactgagcgctgtgtgcgcctacaacttgtccaccgccgaggaggtcttttcccatggaaagtatatgcagtctaccacagtggagcagtcacatacaaagtgggtcaggtacaatgggccagtccccaagccgcggccaggggcttgcatagattcagaagctcgggcagcaaactatacttcttcccttaacctacccgataagacgctgcaattcgtgaaggatcacccactaatggatgatagcgtcactccaatcgataacagaccccggctcattaagaaggacgtgaactacactcaaatagtcgttgatcgaacgcaggcactggacgggaccgtctacgacgtaatgttcgtctctaccgacaggggggctttgcacaaagctatcagtttggaacacgctgtccatattatcgaagaaactcagctgttccaggactttgaacccgtccaaacgcttcttctcagctccaaaaagggcaaccgattcgtctatgccggcagtaactcgggggtcgtgcaagcacctctggccttctgtggcaaacatgggacatgtgaggattgcgtcctggcgagggacccctattgtgcctggagcccaccaaccgccacttgtgtcgctctgcaccaaacagagtcaccatcaagggggctgattcaagaaatgtccggagatgcttccgtgtgccccgataaaagcaaaggaagctataggcagcacttcttcaagcacggcggcactgccgagctgaaatgctcgcaaaaaagcaacctcgcacgagtattctggaagttccagaacggcgttctgaaagcagagagtccgaagtatggcctgatgggtaggaagaacctgcttatcttcaaccttagcgagggagacagtggggtgtaccagtgtctttcagaagaacgcgtgaagaacaagacggttttccaggtggttgcaaagcacgtactggaagtcaaggtagttcctaaaccggtcgtcgcccccactctgagtgtggtgcagactgaagggtctagaatagccacaaaggtgctggtcgcaagtactcagggctcctcaccaccaactccagcagtgcaggctacatccagcggggccattacactgccacccaagccggcacctaccggcacctcttgcgagcccaagatagttattaacacagtgccacagttgcattccgaaaaaactatgtacctgaagtccagcgacaataggctcctcatgagccttttcctgttcttctttgtgcttttcctgtgcctttttttttataactgctacaaagggtatctgccgaggcaatgcctgaaatttagaagcgctctcttgatcgggaagaaaaagccaaagagcgacttctgcgacagggagcagtcactgaaggaaacactggttgaaccaggctccttttctcagcagaacggcgagcatcctaagcccgctctagataccggctatgaaacagaacaggacaccatcacaagtaaagttcccacagaccgggaggactctcagcggattgacgacctttccgccagagataaaccatttgacgtgaagtgcgaactaaaattcgcggactcagatgcagatggagactag

SEQ ID NO: 45859 - DNA, 231 bp, Artificial Sequence
  Description of Artificial Sequence: Synthetic coding sequence
atgcggatgtgcacccccatccggggcctgctgatggccctggccgtcatgtttgggactgcaatggcatttgctcccataccaagaatcacctgggaacatcgggaagttcacttagtgcagtttcacgagccagatatttacaactactccgctcttctgctgtccgaggataaggatacgctgtacataggcgcgagagaggccgtgtttgccgtgaatgccttgtag

SEQ ID NO: 45860 - DNA, 2589 bp, Artificial Sequence
  Description of Artificial Sequence: Synthetic coding sequence
atgcggatgtgcacccccatccggggcctgctgatggccctggccgttatgttcggcaccgctatggcatttgcccccattcctagaataacttgggagcatagagaggtccatcttgtgcagttccacgaaccagatatatataattacagcgctctcctactgtccgaggataaggatactctgtatatcggtgccagagaggccgtctttgcggtcaacgctttgaacatctcagaaaaacagcacgaagtctactggaaggtttccgaggacaagaaggccaaatgcgctgaaaagggtaagagcaagcaaaccgagtgcctaaactacatcagggtgttgcagccgcttagtgcaacttctctctacgtctgcggtactaatgcgttccagccagcctgtgatcacctaaacttgacttcctttaagttcctgggcaaaaatgaggacggcaaaggccgctgtccatttgatcctgcccattcctacacttctgtcatggtcgacggtgaactgtactccgggacaagttacaattttctcggaagtgaacccattatctcgcgtaatagctctcacagccctttgcgaacagaatatgccattccatggcttaatgaaccgtcattcgtattcgccgacgtgatccggaagtctcccgattctcccgatggcgaagatgaccgagtgtattttttctttaccgaggtgagcgtagagtacgaatttgtgtttcgagtgctcattcctcgtatagcacgtgtttgcaaaggcgaccagggagggctgcggacattgcagaagaaatggacgtccttcctgaaagctcgcctaatctgttcccgccccgactcgggtttggtgttcaatgtactaagggatgtgttcgtcttgcggagccccgggcttaaagtgcctgtgttctacgccctttttactccacaactgaataatgtgggcttgtccgcggtctgcgcctataacctctctaccgcagaggaggtttttagccatggcaagtatatgcagtcaacaacggttgagcagtctcacacaaagtgggtgcggtacaatggtccagtgcctaagccaaggcctggtgcttgtatagatagcgaggcccgagcggctaattatacgtcaagtctgaaccttcctgacaagacacttcagtttgtgaaagatcatcctttgatggatgactcagtcacacccatcgacaatcggcctagactcataaagaaggatgtcaactatacccagatagtggtcgatagaacacaggccctggatggtacagtctacgatgttatgttcgtctctacggatcgcggcgctctgcataaagctatcagcctggaacatgcagttcacattatcgaagagacgcagctgttccaggattttgagcccgtccagactctcctgctgtcctctaaaaagggaaacagattcgtgtatgcaggcagcaatagcggtgttgtgcaggcccctctcgctttctgtggcaagcacggaacctgtgaagattgcgtcctggctagagacccttactgtgcctggtcccctcctaccgctacgtgtgtggctctgcaccagactgaatccccgtcccgcgggctgatccaggagatgtctggagacgcctccgtctgccctgataaaagcaagggttcctacagacagcacttcttcaagcacggcggtacagccgagctcaagtgttcacagaaaagcaacctagctcgggttttctggaagttccagaacggcgtgttgaaggccgaatcgcccaagtatggactgatgggaaggaaaaacctgttaatctttaacctgagcgaaggtgatagtggcgtgtatcagtgcttgtcagaggagagagtcaagaacaagaccgtgttccaggttgttgcaaagcatgtgctggaggtaaaagttgtgccaaaaccagttgtggccccgacactgagtgtcgtccagactgagggtagtagaattgccactaaagtgctggttgcttccactcaaggaagcagcccccctaccccggcagtacaggccacctctagtggggccatcactctccctcctaagcccgcacccaccggcacgtcttgcgagcccaaaatagtaataaacaccgttccacagctgcatagcgagaagaccatgtacctcaagagcagtgacaaccgactcctgatgtccctgtttctgttcttctttgtcctatttctctgccttttcttctacaattgttataaaggctatctacccagacagtgtctaaaatttcgttctgctctgttgataggaaaaaagaagccaaaatctgacttctgtgacagagaacaaagccttaaagagaccctcgttgagccgggtagcttctctcagcagaacggagagcaccccaagccagcactagacacggggtacgaaactgaacaggatactatcacctcgaaggtgcccaccgatcgggaggactctcagagaatcgatgatctaagcgccagggacaaaccatttgacgtcaagtgcgagctgaagttcgccgatagtgacgccgatggtgactag

SEQ ID NO: 45861 - DNA, 2589 bp, Artificial Sequence
  Description of Artificial Sequence: Synthetic coding sequence
atgcggatgtgcacccccatccggggcctgctgatggccctggccgtcatgttcggtacagccatggccttcgccccaatcccgcgaatcacatgggagcaccgggaggtccacttagtgcagttccacgaaccagacatatacaactactcagcccttttgctgagtgaggataaagatactctctatattggcgcaagagaggccgtgtttgccgtaaacgccctgaacatcagtgaaaagcagcacgaagtgtattggaaagtgtctgaagacaagaaggcaaagtgcgcagaaaaaggtaagagcaagcagacagagtgccttaattacattagagttctccagccactctccgccacctctctctatgtgtgcggaacaaacgccttccaacctgcgtgcgatcacttgaacctgacaagtttcaaattcctgggaaagaatgaagatgggaaggggcgctgcccctttgaccctgcacactcttacacatccgtcatggtagacggggaactctactccggaaccagctacaatttcctcggaagcgagcctatcataagcagaaactcatctcactccccgctcaggacagaatatgccatcccttggctcaacgagcctagtttcgtgtttgccgacgtcattagaaagagccccgattcaccggacggcgaagatgatcgggtgtacttctttttcactgaggtgagtgtagagtacgaattcgtgtttagggtgctcattccccgcatcgcacgagtgtgtaaaggggaccagggaggactgcggactctgcaaaagaagtggacgtcatttctcaaagcccgcctgatttgttcaagaccggacagcggcctagtgttcaacgtgctgagagacgtgtttgttctgcggtcccctgggctcaaggtgcccgtgttttacgctctattcacgccccagctgaataatgtagggttgtctgctgtttgcgcctacaacctctctacagccgaagaggtgtttagccatggaaagtacatgcagtccacaacagtcgagcagagccatactaaatgggtcaggtacaacgggccagtgcctaagccacgcccaggtgcttgtattgactctgaagcgcgggctgctaattacacttcctccctgaatctgccggacaagaccttgcagttcgtcaaagaccatcccttgatggacgactcggttacccctatcgacaacaggccccgactgatcaagaaagatgtcaactacacccagattgtggtggacaggacgcaggcccttgacgggaccgtgtacgacgtgatgttcgtgtctaccgatcgcggggcgttgcacaaggcaatatctctggaacacgctgtacatatcatcgaggaaactcaattgttccaagatttcgagcctgtccaaactctgctcctttcatctaagaaaggcaatcgcttcgtctacgcggggagcaattccggagttgtgcaggctccactggccttctgtggcaaacacggcacatgtgaggattgcgtcctggctcgcgacccttactgtgcctggtctccaccaacagccacgtgcgtggctctccatcagacagaatctccctcccgcggtctcattcaggaaatgagcggcgacgccagcgtgtgtccggacaagagcaagggctcttataggcagcatttctttaaacatggcgggacagcagagctgaagtgtagccaaaagtctaatctggcgagggtgttctggaagttccagaacggggtcctgaaagccgaatcacccaagtacggattaatgggcagaaagaatctcctgatttttaatctgagcgaaggagacagcggtgtgtaccagtgtctgtccgaagagagagttaagaataagacagtgttccaggttgttgccaaacacgtcctggaagtgaaagtagtaccaaagcccgtggtggcccctaccctgagcgtggtgcaaacagaaggcagccggattgccaccaaagtcctagtggcttccacccagggctcctctccccccacgcccgcagttcaagctaccagttcaggagccatcaccctgcccccaaaacccgcacctaccggcacatcatgtgaacccaagatcgtgattaacactgtcccacagttgcactcggagaaaaccatgtacctcaaaagttcagataaccgcctgctgatgagcctgttcctcttcttctttgtgctgtttctgtgcctgtttttttataactgctacaaaggctacctgccacgtcagtgtctaaaatttcgatcggccctgttgatcggtaagaagaaacctaaatcagacttttgtgatagggaacagtccctcaaggagacccttgttgagccaggatcgttttcccagcagaacggcgagcaccctaagccagcccttgatacggggtatgagacagagcaggacacaatcaccagcaaggtacccactgacagagaggactcgcagagaatcgatgatttgagcgcccgggataagccattcgatgtgaaatgtgaactcaagtttgctgatagtgatgcggacggggactag

SEQ ID NO: 45862 - DNA, 201 bp, Artificial Sequence
  Description of Artificial Sequence: Synthetic coding sequence
atgcggatgtgcacccccatccggggcctgctgatggccctggccgttatgtttgggaccgccatggcgttcgccccaatccctagaatcacctgggagcaccgagaagtgcatttggtgcagtttcatgagcccgatatttataactacagcgccctgctcctgagcgaggataaagacaccctgtacatcggagcttag

SEQ ID NO: 45863 - DNA, 2313 bp, Artificial Sequence
  Description of Artificial Sequence: Synthetic coding sequence
atgcccgccagcgccgcccggccccggcccggccccggccagcccaccgcatccccttttcctctgctgcttcttgctgtgttgagcggacccgtgtccggccgggtcccaaggtcagtgccacggacctccctgccaatctctgaagcggactcttgccttacaagattcgctgtgccgcatacgtacaactactcagtattgctggtcgatcccgcttcacacacattgtatgtgggagccagagatactatctttgcactgtctctgcccttcagtggtgagaggcctagaaggatcgattggatggtgcccgaggctcaccgacagaattgcagaaagaagggcaagaaggaagacgagtgccacaattttgtccagattctagcgatcgcaaatgcgagccatctactgacatgcggtacctttgctttcgatcccaagtgtggagtgatcgacgttagtcgcttccagcaggtggaaaggctggagtccggccgcggcaaatgcccgttcgagcctgctcagcgaagcgcagctgtcatggctggtggggtgctatacgccgccactgttaagaactacctaggcacagagcccatcatcacacgtgccgtgggccgggctgaagactggatccgtacagataccctcccctcttggctcaatgcccccgcctttgtcgccgccgtggcactgtctccggcagagtggggggatgaggatggggatgatgaaatttatttcttttttacagagacgagtcgggcattcgacagttacgagaggatcaaagtgccgagggtagctcgtgtgtgcgcgggcgacctgggcgggaggaagacattgcaacaacgatggactacattcctcaaggcagatttactgtgcccaggcccagagcacggtagagcctccagcgtactccaggatgtggctgttctgcgacctgagctgggggctggcacccctatcttctacggcatcttttcctcccagtgggagggtgctacaatttctgccgtctgcgccttcagaccccaagacatcaggactgtcctgaatggcccattccgagaactaaagcacgactgtaacagaggcttgcccgtcgtggacaacgacgtcccccagcctcgtccaggcgaatgtattaccaacaatatgaaactgcggcactttgggagcagcttgagtctccccgacagggtcttgaccttcattagggaccatcccttgatggacagacctgtgttcccagccgacggccacccactccttgttacaacagacacagcctatctcagggtagttgcccatagagtcacctctctctccggcaaagaatatgacgtgctgtacctgggtaccgaggatggccatctgcatcgagcagtcagaatcggggcacagctaagcgtgctcgaagaccttgcactgttcccagagccacagcctgtcgagaacatgaaactctatcactcatggctgctcgtgggcagcagaacagaagtgacccaggtgaatacaacgaattgcgggcggctgcagagctgttctgaatgcatcctcgctcaggatcccgtgtgcgcctggtcgtttcgcttagacgagtgcgtcgcccacgctggggaacaccggggcctagtccaggatatcgagtccgcagatgtcagctcactctgtcccaaggagcccggagagagacccgtggttttcgaagtgcccgttgcgacagccgcgcacgtggtgctaccatgtagcccctcctcagcttgggcctcttgtgtgtggcatcagccaagcggcgtgaccgctctgacgccccggcgcgacggcctcgaagtagtagtgacaccgggggcgatgggagcatacgcctgcgaatgccaggaagggggggctgcccatgtggtggcagcctacagccttgtgtgggggtcccaacgggacgcgccctcccgagctcacacggtcggcgctggcctagccggtttcttcctcggcatactagctgcatcactgacattaatcctgataggaagaaggcagcagcgccgcagacaacgcgaacttctcgcccgtgacaaagtgggtctcgacctcggagcccccccctctggtaccacgtcctattcacaggacccaccctccccctcacctgaggacgagcggctccccctagccctcgctaagcggggatcgggtttcggaggattctctcccccgtttctgctggatccatgcccgagcccagcacatataagactgacaggcgctcccttggcgacctgtgatgagacctctatctag

SEQ ID NO: 45864 - DNA, 384 bp, Artificial Sequence
  Description of Artificial Sequence: Synthetic coding sequence
atgcccgccagcgccgcccggccccggcccggccccggccagcccactgcttcacccttccccttgctactgctagcggttctcagtggcccagtgtcaggccgggtgcccagatcagtcccacggacttcattgcccatctccgaggccgattcttgtctcacaaggtttgccgtcccccatacttataactactccgtactgctggtcgatcctgcttctcatactttgtatgttggtgcgcgtgatacaatttttgctctgtctctgcccttctctggggaacgacctaggcgaatcgactggatggtccccgaagcacatcgacaaaactgtagaaagaagggcaagaaggaggggggcagctcgatgcttccactctag

SEQ ID NO: 45865 - DNA, 1080 bp, Artificial Sequence
  Description of Artificial Sequence: Synthetic coding sequence
atgcccctggagctggagctgtgccccggccggtgggtgggcggccaacatccttgctttatcatcgccgaaatcggccagaatcaccagggggacctggacgttgcaaaaaggatgattaggatggccaaggaatgcggagctgactgtgcaaagttccaaaaaagtgaactcgaatttaagtttaatcgtaaggcgctggaacgcccttatacatctaagcattcttgggggaagacatatggtgagcataaacgacatttggagttctcccacgatcaatatagagaacttcagcggtacgcagaagaggttggtattttttttaccgcttctggcatggacgagatggccgtggaatttctccacgagctgaacgttccattcttcaaggtgggctcaggggataccaacaacttcccctatttggaaaagacagccaaaaaagggagacctatggtcatatcaagcgggatgcagagtatggacaccatgaagcaagtgtatcagatagtcaaaccattgaatccgaatttttgtttcctccaatgcacttcagcctacccactccagcccgaggacgtgaacctgcgcgtgatcagtgagtaccaaaagttgttcccagacattcccataggctacagcggccatgaaactgggatcgccatctcggttgccgccgttgcgctcggcgctaaagtgttggagaggcacataactctggacaaaacctggaaaggaagcgatcatagcgcgtccctcgaaccaggcgaactggccgagctggtgcgctctgtccggctggtagagagggcactcggatcccctacaaaacagctgctgccctgcgaaatggcctgtaacgagaagttgggtaaatctgtcgtggcaaaagtgaagattcctgagggaacaatccttacaatggacatgctcacagtcaaggtgggggaacctaagggatacccgccagaggacatttttaatctggtgggaaaaaaggtcttggtcacggtggaagaggatgatacaatcatggaggagctggtcgacaatcatggcaaaaagatcaaaagctag

SEQ ID NO: 45866 - DNA, 2517 bp, Artificial Sequence
  Description of Artificial Sequence: Synthetic coding sequence
atgtggggccggctgtggcccctgctgctgagcatcctgaccgccaccgcggtccccggtccttctctcagaaggccctctagagagctggatgctacaccacgaatgacaatcccctatgaagagctgagcgggacccgacactttaagggccaggctcagaattacagtacccttctgctggaagaggccagcgcccgcctgctggtgggggcaagaggagccttgttttcgctgtctgccaatgatatcggtgacggtgcccataaggaaattcactgggaggccagccctgagatgcagagcaagtgtcaccagaaaggcaaaaataatcaaacagaatgctttaaccatgtgcgcttcctgcagcgtctgaatagtacgcatctgtacgcctgcggaacgcacgcctttcaacctctgtgtgcagcaattgatgctgaggcctttactctgccaacaagtttcgaagaggggaaggagaaatgtccgtatgatccagccagggggttcacaggactgatcattgatggcggtctgtacaccgccacccggtacgagtttcggtccatacccgatataaggcgctctcgacatccacattcactgcggacagaggagacaccaatgcattggctaaacgatgccgagtttgtgttttccgtgctggtaagggaatcgaaggcaagcgcagtaggggacgacgacaaggtgtactatttctttacagaacgtgctacagaggagggttctggctcttttactcagagtagatctagtcaccgggtcgcccgtgttgcacgggtgtgcaagggcgacctcggcggcaaaaagatattgcagaaaaagtggacctccttcctgaaagcccgtctcatctgtcacatccccctgtacgagacgctcaggggagtgtgttcactcgacgccgaaacatcatctaggactcatttttacgccgcatttaccttgtcaactcagtggaaaaccctggaggctagcgcaatttgccggtatgatctggcagaaatccaggccgtttttgctggcccttatatggagtaccaggacggatccagacggtggggcagatacgaaggcggagtgcctgaacctagacccggtagctgcattactgattctcttaggtcacaggggtacaattcgtcacaggacctgccatccctcgtgctcgactttgtgaagctgcaccctctgatggcacgtcccgtggttccaactagaggaaggccccttttactgaaacgcaatattaggtacacccacctcacaggcactcctgttacaacacccgccgggcccacatatgacttacttttcctcggaaccgccgacgggtggatccacaaagctgtggtcctgggaagcggaatgcacataatagaggagactcaggtttttcgcgaatctcaatcagtggaaaatctggtcatcagtcttctccagcatagtttatatgttggtgccccctcgggagttattcagctgccattgtcatcctgttctcggtaccgcagttgttatgattgcatccttgcccgtgatccatactgtggttgggaccccgggacccacgcttgcgcagccgccacaactatcgcaaaccgcaccgcgctcattcaggatatcgaacgcggaaataggggatgcgagagctctcgcgatacaggccctcctccacctctaaagacacgctcagtccttcggggtgacgacgtgctgttaccctgtgaccaacctagtaatctcgccagggcgctctggttactgaacggttctatggggctctcagatggacaggggggatacagggtgggcgtagacggtctcctcgtcactgatgcccagccggagcatagcgggaactatgggtgctacgctgaggaaaacgggctaagaacgctgcttgcaagctactctttgactgtgagacctgcaacaccagcgcccgcccctaaagcacccgccactcctggggctcagttagcccctgatgtgcgtctcctctatgttctagccattgctgccctcgggggactttgcctgatcttggcttcatccctcctttatgtagcctgcttgagggagggacggagagggcggcgccgtaaatacagtttggggcgcgccagtagagctggaggctccgccgtgcagcttcaaacagtatccggccaatgtccaggcgaggaagacgaaggggacgatgagggagctggaggtctggagggttcatgccttcagatcattccaggagaaggcgcacctgcgccaccaccgccgcctccacctcctccccccgccgaattgaccaacggtctggtggcactgccatccaggctccgtcgaatgaatggaaacagctacgtcctattgagacagtctaacaatggtgttcccgccggaccctgctcgttcgctgaggagctcagtaggattcttgaaaaacgcaaacacacccagttggtcgaacagttggacgaatccagcgtgtag

SEQ ID NO: 45867 - DNA, 1659 bp, Artificial Sequence
  Description of Artificial Sequence: Synthetic coding sequence
atgtggggccggctgtggcccctgctgctgagcatcctgaccgccactgctgtgccaggaccctcactccgacgtccgtctcgcgagctagacgccaccccacgtatgaccattccatacgaagagctgagcggcacgcgtcatttcaaggggcaggcccagaactattccacattgctgctggaggaggcgtctgccagattactggtcggtgcacgcggagctctgttttcactgagcgcgaatgacattggggatggcgctcataaggagatccattgggaggcttctccagagatgcagtccaaatgtcaccagaaaggcaaaaacaaccagacagagtgtttcaatcatgtcagattccttcagagacttaattcaacacatctttacgcgtgcgggactcatgcctttcagccgttgtgtgccgccattgacgctgaggctttcaccctaccgacgtcttttgaggagggcaaagagaagtgcccatatgacccagccaggggcttcacaggcttgatcatcgacgggggactgtataccgcaacacgatacgaatttcggtccatccctgacatccggcgaagccgccacccacattccctccggactgaggagacgccaatgcactggctcaacgacgccgaattcgttttctccgtcctcgtgagggaatcgaaagcctctgctgtgggggatgacgacaaggtttactatttttttactgaacgcgccaccgaggaggggagcgggtccttcacccagtctagatcaagccatcgggttgccagggttgcaagagtttgtaagggcgacctggggggcaagaaaatcctacagaagaaatggacctcctttctgaaagccaggttgatctgccatatcccactgtatgaaacgctccgcggtgtgtgctccctggacgcagagacttcctcccggacccacttttatgccgcattcaccctaagtactcagtggaaaaccctggaagccagcgctatttgccgctacgatttggctgaaatccaggctgtctttgcaggtccttacatggagtatcaggatggatccagacgttggggtcgctacgagggcggcgtccctgaacccaggccagggagttgtatcacagattccctgagaagccagggatataatagtagccaagacttaccatctctggtgctggactttgttaagcttcaccccctcatggcaagaccagttgtgcctaccagaggtcggccactgttgcttaaaagaaacatcaggtatacacacctgacgggcactccagtgaccacaccggccgggcccacatacgacctgctgttcctgggcactgccgacggttggattcacaaggccgtcgttttaggatccgggatgcatattattgaagaaacacaggtgtttcgcgagtcccagtccgttgagaacttagtaattagcctgctgcagcactccctgtacgtgggtgccccaagtggagtaatccagttacccctgtcttcatgtagtcggtacagatcctgttatgactgcatactcgcacgcgacccctactgccatatcctgtccggccccctgccacaaccccacgttgtgacatcactcagcagggcctgggaacgggcctcactagggcgatag

SEQ ID NO: 45868 - DNA, 2109 bp, Artificial Sequence
  Description of Artificial Sequence: Synthetic coding sequence
atgtggggccggctgtggcccctgctgctgagcatcctgaccgccaccgctgtgcctggcccatccctaaggcggccctcacgcgagcttgacgccactccccggatgaccatcccctacgaggaattgagcggtacccgtcattttaaaggacaggcccagaactactctactctcctcttggaggaagcgagtgcaagattacttgtcggtgcccgcggagccttgttttcgctgtctgcgaacgatataggtgacggcgcgcataaggagatccactgggaagcctcgccagaaatgcagagtaagtgtcaccagaagggaaagaacaatcagactgaatgtttcaaccacgtcaggtttctgcagaggctgaacagcacacacctgtacgcctgcgggactcacgccttccagcctctatgcgctgcgatagacgcagaggcttttacactgccgacctcattcgaggaaggtaaagaaaaatgtccctatgacccagctcgcggcttcaccggcctcataatcgatggcggactctataccgccacccgatatgagtttcggagcatccctgatattaggaggagccgacatccgcattcgcttaggacagaggaaactcccatgcactggctcaatgacgcagagtttgttttctcagtgctggtgcgcgagtctaaggcatctgccgttggcgatgacgacaaggtgtattactttttcactgagcgcgcaaccgaggaaggctcaggaagcttcacgcagagtagaagttctcatcgagtcgccagagtggcacgcgtctgcaaaggagatctcggcggtaaaaagatccttcaaaagaaatggaccagttttttgaaggctagactgatctgtcacatcccactctacgagactctgcgcggagtttgttccctcgacgccgagacatcttcccggactcacttttacgcggcgttcaccttaagcactcaatggaaaaccctcgaggcttccgccatctgtcgttacgatcttgccgagatccaagccgtcttcgccggcccatacatggagtaccaggatggtagccgacgttggggtcgatatgaaggtggggtccccgagccacgcccaggaagttgcattactgattcactgcgttcacagggctataacagctctcaggacctgccctcactggttctggattttgtgaagctccacccgttgatggctagaccggttgttcctactcgtggccgtccactgctgctgaagaggaatataaggtacactcaccttacagggactcctgtaacaacccctgctgggccaacctatgacctgttgtttctgggtactgccgacgggtggatacataaagccgttgtgttggggagtggtatgcacataattgaagagactcaagttttcagggagtcccaatctgtcgaaaacctagtcatttcactactgcaacattctctttatgtcggtgcacccagcggggtcatacagctgcccctaagttcctgttccagataccgatcctgctacgattgtattcttgcccgggatccttactgcgggtgggacccgggtacccacgcatgtgctgcagcaactaccattgcaaacagaagccagggctcaaggacagccctaatccaggacatcgagagggggaatcgggggtgtgagtcttcacgagacaccggccgcgccttgcaggtccacatgggttccatgagtccacccagcgcgtggccctgtgtgttggacggccccgagactcggcaggacctgtgtcaacctcctaagccatgcgtccatagtcatgctcatatggaggagtgtttgagtgccggcctgcaatgtcctcacccccaccttctgctggtgcattcatgctttataccagcatctggcctaggggtccccagccagctgccccaccccatctggtcctcttcacctgcaccatgcggtgacctgttcgtaaaatctcttggaacagggcaaccaggtgaagtgcgcttacaccactctccgccattaccctcttgtgtagctctggtgaaccagcctcctcatagcccttggagcttttccagggtctag

SEQ ID NO: 45869 - DNA, 513 bp, Artificial Sequence
  Description of Artificial Sequence: Synthetic coding sequence
atgtggggccggctgtggcccctgctgctgagcatcctgaccgccaccgctgtaccgggaccctctctgaggagaccttcacgagagctggacgctaccccaaggatgacaattccatatgaggagctgtccggaaccaggcattttaaggggcaggcccagaattactctacattgctgctcgaggaggcctcagcccggctcctcgtgggtgcccggggggccctattctctctctccgccaacgacattggcgatggggctcataaggagatccactgggaggcctccccggaaatgcaatcgaagtgtcaccagaaagggaaaaataatcagacggagtgttttaaccatgtccgatttctccagcgtctgaactcaacccacctgtacgcttgtggaacgcacgcattccagccgctgtgcgccgccatagatgcggaggcatttactctgcctacttcctttgaagaaggaaaggagaagtgtccttatgatcctgcccgcggatag

SEQ ID NO: 45870 - DNA, 1569 bp, Artificial Sequence
  Description of Artificial Sequence: Synthetic coding sequence
atgtggggccggctgtggcccctgctgctgagcatcctgaccgccactgccgtgcctggaccctccctacgcagacctagtagggaacttgacgccacccctcgtatgaccatcccctatgaggaactctcgggcaccaggcactttaagggccaggcacagaattattcaacgctgctcctcgaagaagcgagtgccagactgctggtcggggccagaggcgccctcttttcgctgtccgctaacgatataggtgatggggcccataaggaaattcattgggaagcttcaccggaaatgcagtcaaagtgtcaccaaaagggcaaaaataaccagacagagtgtttcaatcacgtgcggttcctgcaacggcttaacagcacccatctttacgcatgtgggacccacgcattccagccgttatgcgccgcaattgacgcagaggccttcacgttacccacctcttttgaggaaggtaaggagaagtgcccatatgacccagccaggggatttaccgggctgattattgacggcggcctgtatacagcaacaagatatgagtttcggtccatccccgacatcagaaggtccaggcacccgcacagcttgcggactgaagagacgccaatgcactggctgaacgatgcagagtttgtgttcagcgtgctcgtacgagaaagcaaagcttcagccgtgggagacgacgacaaagtttactatttcttcacagaaagagcgactgaagagggaagtggctccttcactcaatctcgtagttcacaccgggtcgctagggtcgctcgagtgtgtaagggggacttggggggcaaaaaaatactgcagaagaagtggactagctttcttaaggcaagactgatttgtcacatcccgctatatgaaactctgcgtggtgtgtgctctcttgacgccgagaccagttcgcgcacccacttctacgccgcatttaccctctctacacaatggaaaaccctcgaagcatccgctatatgccgctacgatctggccgagatacaagccgtgttcgcaggcccatatatggagtatcaggacgggtccagaagatggggtcgctacgagggcggcgtcccagagcctcgccccggttcctgcatcactgactccctgaggtcacaggggtataactcctctcaggatcttccctcgctggtcctcgatttcgttaagctccatccactcatggcgcggcctgtggtacccacacgcggacgccctctgctgctgaaacgaaacatccggtacacccacttgaccgggacacccgtgaccacccctgccggacctacttatgacctgcttttcctaggcactgccgatggctggatacataaggcagtggtgttaggtagtgggatgcatataattgaggagacacaggtgttcagagagtctcaatcagtggagaacctggtcattagtctcttacagcattcactgtatgttggagcccccagtggggtgattcagctgccgctgtcttcttgtagtcgctacaggagttgttatgattgtatactcgcccgtgactag

SEQ ID NO: 45871 - DNA, 2517 bp, Artificial Sequence
  Description of Artificial Sequence: Synthetic coding sequence
atgtggggccggctgtggcccctgctgctgagcatcctgaccgccacggcggtgcctggaccgtccttacgaaggccttctagagaacttgacgccacaccaagaatgacaataccctatgaggaattgtccggaacaagacatttcaagggacaggctcagaactactcaaccctgctgctggaagaagccagcgcacgactactggtgggtgcgaggggcgctctattttctttaagtgcaaacgatataggagacggagcacacaaggagatccactgggaggccagtcccgagatgcagagcaaatgccatcaaaaagggaagaataatcaaacggaatgttttaatcacgtgcgttttttacagcgtctcaattcaactcacctctacgcatgcggaacacacgctttccagcccctctgtgcggcaatcgacgccgaggctttcaccttgccaacctccttcgaggaaggcaaagagaaatgcccctacgatcccgctagaggttttacagggcttataattgacggcgggttatacacggctactagatatgagtttagaagcattccagatattagaaggagtcgtcatccccattctttgaggaccgaggagactccaatgcactggctgaatgacgccgagtttgtgttctccgttctagttagagaatccaaggcaagcgccgtgggggatgatgataaagtgtactactttttcacagaacgcgcaactgaagaaggaagtggaagcttcactcaatcaaggagttctcatagagtagccagagtggcccgtgtctgtaagggagacttagggggcaagaagatcctacagaagaaatggactagcttcctcaaggcgcgacttatttgccatattcctctgtacgaaaccctacgcggtgtttgttctctggatgcagaaacatcaagtcgtacacacttctatgccgccttcacattaagtacgcagtggaaaacactggaagcttccgcaatctgtagatacgacttggctgagattcaggcagtgttcgccggtccctacatggagtatcaggacggaagcaggcgttggggtagatacgaaggcggggtgcccgaacccaggcccggtagttgtatcacagacagccttaggagtcagggctacaattcaagtcaggatctgccctctctcgtcctggactttgtaaagcttcaccctctgatggcacgcccagttgtgcctacaagagggagaccattactcctcaagaggaacatcaggtacacacacctgacgggtacaccagtgaccacgcccgccggccccacgtacgatttactgtttctgggcaccgcagatgggtggatccacaaagccgttgtgctgggatctgggatgcatatcatcgaggaaacgcaggtgtttcgggagtctcagagcgtggagaatcttgtgatttcactcctgcagcattccctctacgtcggcgctcctagtggagttattcagctaccactgagtagttgttctaggtacagaagttgttacgactgcatactggcacgagacccctactgcgggtgggaccccggcacccatgcctgtgccgcggccacaaccatcgccaacaggaccgccctgatacaagacatcgaaagaggtaacaggggatgtgaaagctcgcgagacaccggtccgcctcctcccctaaaaacaagaagcgtccttaggggggacgatgtcttactcccatgcgaccaaccatctaacctggctagggctttgtggctgttaaatgggagcatgggcctgtctgacggccagggaggctaccgcgtgggggttgatgggctgctagtaacagatgcccagccagagcattctggaaattatggctgctacgcggaggaaaatggactgcgcacgctcctggccagttacagtctgactgtgcgaccggctaccccagctcctgctcctaaagcgcctgctactcccggagctcagctcgccccagatgtacgcctgctctatgtgctggccatcgccgcactcggcggactctgtttaatacttgcctcgagtctgctgtatgtggcgtgtttgcgcgagggtcgccgggggcgaagacgtaaatactctctgggcagggcttctcgtgccgggggatccgctgtacaactgcagaccgttagcgggcagtgtcctggggaggaggatgagggagatgacgaaggtgcgggtggcctggagggcagttgcctgcagattatccctggcgagggtgcgccagcccctcccccgccacctcctccgccacctccagcagaattgacaaatggcctggtggctctgccttctagactgagacgtatgaatggtaatagttacgtgttgttacgacagagcaacaacggggtccctgcggggccttgcagctttgcagaggaactcagccggatactggagaaacggaagcatacgcaactggtcgagcagttagacgaatcttctgtgtag

SEQ ID NO: 45872 - DNA, 3279 bp, Artificial Sequence
  Description of Artificial Sequence: Synthetic coding sequence
atgccctgcggcttcagccccagccccgtggcccaccacctggtgcccgggccgccagacactccagctcagcaactgaggtgcgggtggacagtcggcggatggcttttgtcactagttagagggctcctcccctgcttgccgccgggtgcccggactgccgagggacccatcatggttctggctgggcctctggcagtaagcttattattgccttccctgacacttttggtgtcccaccttagctctagccaggacgtctcctcagagcccagtagtgaacagcagctgtgcgcccttagcaaacaccctactgtcgcttttgaagacctgcaaccctgggtgagtaatttcacctatccgggggcccgcgatttcagccagctcgctctggatccgtcagggaatcaactgatcgtgggggctcgcaattatctgttcagattatctttggctaacgtgagcttgttgcaggccacggagtgggcctcctcagaagatacgaggagaagctgtcagtcgaaggggaaaactgaggaagagtgtcagaactatgtgagagttttaatcgtggccggtcggaaggtgtttatgtgcggcactaatgccttcagccccatgtgtacttcaagacaggtgggcaacctatctcggaccattgagaagattaacggcgtagcccgctgcccttacgacccacgccacaactctactgccgtgatatcgtcccagggcgagttatatgcagctacagttatagacttctcagggagggacccagccatctaccgctcactcggctctggaccgcctctgaggacggctcagtacaactcaaagtggctgaacgaacctaattttgtagccgcgtatgatatcggactgttcgcatacttctttttgagagaaaatgcagtggagcacgattgtggacgcactgtctactctagggtcgcgagggtctgtaagaacgatgtcggtggtcgattcctgctggaagatacttggactaccttcatgaaagcaaggttgaactgttctcgccctggagaggtgccattttactacaacgaactccagagcgcttttcatctaccagaacaagacctaatctatggcgtttttaccaccaacgttaatagtatcgcggcaagtgctgtgtgcgcttttaacctatccgctatatctcaggcctttaacggtccatttcgctaccaggagaacccaagggccgcctggttgcctattgcaaatccaattcccaatttccagtgtggcaccctccccgagacaggccccaatgagaatctcaccgaacggagcctccaggacgcccagcgcctgttccttatgagtgaggccgtacagcccgtcacccctgagccctgcgtgacgcaggattcagtaagattctcacatctcgttgtggatctggtccaggctaaagataccctctaccatgtgttgtatattgggactgagagtggcacaattctgaaggctctgtctaccgcgagcagatccctgcatggatgctatctcgaggagctgcatgtgctccctcccggacgtcgcgagcctttgaggtccctgagaatccttcatagcgctcgagctctctttgtggggctgcgggatggtgtgctgcgggttcccctagaacggtgcgcagcataccggtctcagggcgcatgcttgggcgccagagatccctattgcggatgggatggcaagcagcagcgctgttctaccctcgaagacagctctaacatgtcactatggacacaaaatatcaccgcatgcccggtgagaaatgttacacgcgatgggggatttgggccatggtcaccctggcagccatgcgaacatttagacggggataacagcggctcttgtctgtgtagggcacgctcttgcgatagccctcggccccgctgcgggggactggattgcttgggacctgcaatacacatcgctaattgcagcaggaacggcgcctggaccccatggtcctcctgggccctgtgctccacctcctgcggtattgggttccaggtgcgacagagaagctgcagtaatcccgccccccggcatggcggtcggatctgcgtcgggaagtccagagaagagcgcttttgcaatgaaaatacaccatgtccagtgccgatcttttgggcttcatgggggagctggagtaaatgctcaagcaattgcgggggcggcatgcaatccagaagacgcgcttgtgagaatggtaatagctgcttgggctgcggagaatttaagacatgcaacccagaggggtgtccagaggtgagaagaaacacaccctggactccttggcttcctgtcaatgttactcaaggcggtgcccgccaggagcagcgcttccgattcacgtgtcgcgctcccctagcagatccgcacggtttacagttcggaaggaggcggaccgagactagaacatgtccagccgatggcagcgggtcctgtgacaccgacgcattggtggaggtgctgctccggtcaggctctacctcccctcacaccgtctctggcggttgggctgcatggggcccgtggtcttcttgtagcagggattgtgaactggggttcagagtccgcaagaggacctgcacaaatccagagccgcgcaatgggggtcttccttgtgtaggagatgcagcagagtatcaggactgtaaccctcaggcctgccctgtgcgcggcgcatggagttgttggacctcttggagtccttgttccgcatcatgtggtggaggtcattatcaaaggacaagaagctgcacttccccagctccttcgccgggcgaagacatctgcttaggtctgcatacggaagaggctttgtgtgcaacgcaagcctgtcctggatggagtccctggtctgagtggagtaagtgcacggacgacggggcccaaagtagatctcgccactgcgaggagctcctgcccgggtcttccgcctgtgccggcaacagttcccagagcagaccttgtccatactcagagattcccgtcattttgcccgcttcctccatggaggaggccaccgattgtgcgggcaaacggaaccgcacctatctgatgcttaggagctcccagccgtctgggacgcctcttcagtccctggatagcttccacattctcctccagaccgccaagctgtgctggggtccccattgtttcgaaatgggctccatttcgagcacatggtggccaagagcctctcccgccagctgggccctcggctcttag

SEQ ID NO: 45873 - DNA, 3456 bp, Artificial Sequence
  Description of Artificial Sequence: Synthetic coding sequence
atgccctgcggcttcagccccagccccgtggcccaccacctggtgccagggccgcctgacacaccagcccagcaattgcggtgcggctggacagtagggggctggctgttatcattggtaagagggctgcttccctgtcttccccccggtgctagaacggctgaaggtccgatcatggtacttgcgggtcctctggcagtaagtctgcttctcccaagcctgacactactggtgtcccatctgagtagctctcaagatgtctctagtgagccaagcagcgaacaacagttgtgtgccctctctaagcaccccaccgtggccttcgaagacctgcaaccctgggttagcaatttcacatatcccggtgccagggactttagccagctggcacttgatccgtcaggcaaccagctcatcgtcggcgccagaaattatcttttcagactgtccctggcaaatgtgtccttgctgcaggcaactgaatgggcctccagtgaagacacgcgacgctcgtgtcaatctaagggcaaaaccgaagaagaatgccaaaactacgtgagagtgctgatcgtggctggccggaaagtttttatgtgcggtaccaacgcattcagccctatgtgcacatcacgccaggttggaaacctttcacgcaccatagaaaaaatcaatggagtggcaaggtgcccttacgacccaagacataactccacagctgttatctcatcacagggagagctttatgccgccacggtaattgactttagtggacgggaccctgccatttatcggagcctgggtagtggtccacctctcagaacagctcaatacaacagcaaatggttgaatgagcctaacttcgtcgccgcctatgacatcggcctgttcgcatatttcttccttcgggaaaacgcagtggagcatgattgcggcagaactgtgtattcaagagtggcccgagtatgcaaaaatgacgttggaggccgatttttgctggaggatacgtggaccacttttatgaaagcacgtctaaactgctctagaccgggtgaagttcccttctattataacgaattgcagagtgcgttccatctacctgaacaggacttaatttatggggtgtttactaccaatgttaatagcattgctgcctctgccgtgtgcgcttttaacctctccgcgatctctcaggcctttaacggcccatttcgttatcaggaaaaccctagggcggcctggctcccgatcgctaatcctatccctaacttccagtgtggcacgctccctgaaacaggccccaatgagaaccttactgagagaagcctgcaggacgctcagcgactgttcctgatgtcagaggccgtgcagcctgtcactcccgagccgtgtgttacacaagacagtgtaaggttctcacaccttgtggtggacctcgtgcaggccaaagataccctgtaccatgtcctgtacatcggtactgagtccggaaccattttgaaggccctgtctaccgcttcacggtccctgcacgggtgttacctggaggaactgcacgttctcccccccggccgcagggaaccccttcgatcattgagaatattacactccgccagggcgttgttcgtgggcttgagggatggggtgctgagggtacctcttgaacgatgtgcggcttatagatcccagggggcttgcctgggggctagggacccctactgtggctgggacggaaagcagcaacgatgtagtactctggaggacagtagcaacatgagcctgtggacccaaaatattactgcgtgtcccgtccggaatgtgacacgcgatgggggcttcggtccgtggtccccctggcagccctgtgaacacctggacggcgacaattctggttcttgtttgtgtagggcacgcagttgcgactcccccaggcctcggtgcggaggtctggactgcctgggccctgctatccacattgccaattgctcaaggaacggcgcttggacaccatggtcctcatgggcattatgctcaaccagctgtgggattggcttccaggtgaggcaacggtcctgtagcaaccccgccccgcgacacggcggacggatatgcgtcggtaagagccgcgaggaaaggttctgtaacgagaataccccctgccctgtcccaattttctgggcgtcttgggggtcatggtcaaagtgcagctccaactgtggcgggggaatgcagagcaggcgcagggcctgcgaaaatggcaactcctgccttgggtgtggcgtggagtttaaaacctgcaatcctgagggatgtcctgaggtgcgccgcaacacaccctggaccccttggttgcctgtgaatgtcacacagggaggtgctcgccaggagcaacggttcaggttcacgtgccgtgctcctctggcagacccccacgggctccagttcggccggagaagaacggagactcgaacatgcccggcagacggctcaggatcttgcgatacagacgccctcgtggaggttttattgaggtccggaagtactagtccgcacacggtgtcgggcggctgggctgcttgggggccctggagctcttgttcacgggactgcgagctgggctttagggtacgcaagcgcacttgtaccaacccagagcctcgaaatggaggcttgccctgtgtcggcgacgctgctgaataccaggactgcaacccacaggcctgccccgtgaggggagcttggtcttgttggacatcttggagcccatgttccgctagctgtggtgggggacattaccagcgtaccaggagctgtactagccctgctcctagccctggagaagacatctgcctgggcctccatactgaagaagccctgtgtgccacccaggcatgcccagagggatggagcccatggtccgagtggtctaaatgcacggatgatggagcccagagcaggtctcggcattgcgaggagctcctacctggtagctccgcatgcgctggaaattcctcccagtcgaggccatgtccttactccgagattcctgtcattcttcccgcctccagcatggaagaggccacagactgcgctggcttcaatcttattcacctggtagccaccggcattagttgttttcttggttccggtttattgaccctagcagtctacttgtcttgtcagcactgccagcgtcagagccaggagtctaccttagtccatcctgccacccccaaccatctgcactacaaagggggcggaacaccaaaaaatgaaaaatacacgccaatggaatttaaaacattaaataaaaataacctgatcccagacgacagagctaatttttacccactgcagcagaccaacgtatacacaacaacatattaccctagcccacttaacaagcactcatttcgccccgaggcttcaccaggccagcggtgctttcccaattcatag

SEQ ID NO: 45874 - DNA, 3267 bp, Artificial Sequence
  Description of Artificial Sequence: Synthetic coding sequence
atgccctgcggcttcagccccagccccgtggcccaccacctggtgccaggcccaccagacactccggcccagcagctgcgctgcggatggacagtgggaggatggctgttgagcctcgtgaggggcttactgccatgtctgccacctggggctagaacagcggagggtcctatcatggtgctggcgggccccctggctgtgtctcttcttctcccctcgcttactctcttggtgtcacatctgtcatcctcccaggatgtgtccagcgagccaagttccgagcaacagctgtgcgcactgagcaagcacccaacagtcgctttcgaagacctgcaaccctgggtatcaaatttcacctaccctggagcccgtgatttctctcagctggctttagatccctcaggaaatcaactgattgttggagccaggaactacctgtttagattgtccttggccaacgtgtcacttttgcaggcaacagaatgggctagtagcgaagacactcgacggagctgccagtctaagggaaagaccgaggaggagtgccaaaattacgtacgggtcctgattgtagcagggcggaaggtgtttatgtgtgggacaaatgcattttctccgatgtgcacttctcgccaggtgggcaacctcagccggaccatagaaaaaatcaatggggtcgctaggtgcccatatgaccccagacataattcgaccgcagtcataagcagtcagggcgagctgtatgccgccacagtgattgactttagtgggcgcgaccccgccatctatcgcagcctaggctccggcccaccacttagaacagctcagtacaattccaaatggctgaacgaaccgaactttgtggcggcttacgacatcggcctgttcgcctatttcttcctgcgtgaaaacgcggttgagcacgattgtggacgaactgtgtacagcagagtggctagagtttgcaagaatgatgtcggtggaaggttccttctcgaggacacatggacgacatttatgaaggcgaggcttaactgctctaggccgggggaagttcctttttattataatgagttacaaagcgctttccacctgccagagcaggacctcatctacggagtgtttacaactaatgtcaacagcatcgcggccagcgccgtctgtgcttttaaccttagtgccatcagccaggcctttaacggcccctttcgttatcaggagaaccccagagcggcctggctgcccattgccaaccctatccccaattttcagtgtggcactcttcctgaaactgggcctaacgagaatctcaccgagcgatccctccaggatgcacagcgtctcttcttaatgagcgaagccgttcaacctgtgacccctgagccgtgtgtgactcaagatagcgtccgattcagccacctcgttgttgacttggttcaagcaaaggatacgttataccacgtcctctatattggcacggaaagtgggacgatcctgaaagcactctctactgcatcacgaagcctccatggctgctacttggaggaattgcacgtgctccccccaggcagacgtgagccactgaggtctctacgcattttgcactcggccagagccttgtttgtcggactgcgggacggggtactgagggtccctctggagcgctgtgccgcatacagatcccagggagcctgccttggggccagggatccctactgtggttgggatggcaaacaacagcgatgttcaacacttgaggattcttctaacatgtcactgtggactcaaaatataacagcctgccccgtgcgaaatgtgacacgggacggaggatttggtccctggagcccgtggcagccatgtgagcacctcgacggcgataattccggaagttgcctgtgtcgtgccaggagctgtgatagccctcggccacgctgcggtggtctcgattgtttggggcctgccatccatattgctaattgctcccgcaacggtgcctggacaccctggtcaagttgggcattgtgtagcactagttgcgggattggcttccaggtgcgtcagaggagctgctctaacccagccccgagacacggcggccggatctgcgttggaaagagcagggaagagaggttctgtaatgagaacactccctgccctgtcccaattttctgggcgtcctggggctcatggagtaagtgctccagtaactgcgggggtggcatgcagagccggcggcgggcctgcgagaatgggaacagctgccttgggtgtggagtggagtttaagacttgtaatcctgaggggtgcccagaggtgaggaggaacacaccctggacaccttggctcccagtaaatgttacccagggaggtgcccggcaggaacaacggttccggtttacatgtagagccccacttgcagatccacacggccttcagtttggacggcgacggacagagacacggacctgcccggcagatggttctggcagttgtgatacagatgccctcgtggaggttcttctgaggtctgggagcacttccccccacactgtgtccggcggatgggccgcctggggaccatggagctcctgttcgagggactgcgaactggggtttcgcgtgcgtaagagaacctgtaccaaccccgagccacggaacggaggcctcccctgcgtgggcgacgcggctgagtatcaggattgtaacccacaggcgtgcccagtgaggggtgcatggtcgtgctggacatcctggtccccttgcagcgcgtcctgtggtggcggccactatcaacgaacccgcagttgcacttcacccgctccctccccaggagaagacatctgtctgggtttgcatactgaagaagctctgtgcgccacccaggcctgcccagaaggctggagcccatggagcgagtggagcaagtgtacagatgatggcgctcagagcaggagccgacactgtgaagaactcctgccaggcagcagtgcttgtgcgggcaacagcagccagagcaggccatgtccatatagtgagatccccgtcatactacccgcaagtagtatggaggaagcaaccgactgtgctggattcaacttgatccatctcgtggcaacaggcattagctgcttcctcggcagtggtcttcttaccctagctgtatacctgtcttgccaacattgccagcgccagtctcaagaatcaacattggtgcacccggcgacacctaatcacctccactataagggcggcggaaccccgtag

SEQ ID NO: 45875 - DNA, 3174 bp, Artificial Sequence
  Description of Artificial Sequence: Synthetic coding sequence
atggtgctggccggccccctggccgtgagcctgctgctgcccagcctgacactgctggtaagccacctgtccagcagccaggacgtgtcatccgaaccatcttctgagcagcagctttgcgccctttccaagcaccccacagttgctttcgaggatttgcagccatgggtgtcgaattttacttacccgggggcccgggatttctcgcagctagccctggatccatccggcaatcagctgatcgtaggtgcccggaattatctgtttagactctctctagccaacgtatcactgctccaagccacagagtgggcttccagtgaggatactagacgatcatgccagtccaaggggaagacggaggaagagtgccaaaactatgtaagggtactgatcgtggcagggagaaaagtttttatgtgcggtacaaatgctttttctccgatgtgcaccagccgccaagtgggaaatttgtccagaacaatcgagaaaattaatggagttgctaggtgtccctacgatcctcgccacaatagcacggcggttatcagctctcagggcgaactctatgccgctactgtgattgattttagtgggagagacccagcaatctatagaagcctgggatccggcccaccccttaggactgctcagtacaactcaaaatggctcaatgaaccgaacttcgtcgctgcatacgatattggtttgttcgcctactttttccttagggaaaatgccgtagagcacgactgtggtcgtactgtgtactccagagtagcacgtgtctgtaagaatgatgtaggggggcgatttttactcgaggacacttggactacctttatgaaagcaaggctcaattgcagccggccaggcgaggtgcccttctattataacgagttacaatccgcgttccacctgccagagcaagatctgatatatggggtctttacgaccaacgttaactcgatagcggctagcgcagtgtgcgcatttaatttatcagctatcagccaggcattcaatgggccgtttcgctatcaagagaaccctcgggcagcatggctgcccatagcaaatcccattcccaacttccaatgcgggactctgcccgaaactgggcccaacgagaacttaaccgaacgatccttgcaagacgcgcagagattgtttctcatgtcagaagcagtgcagcctgttacacctgagccttgcgtgactcaggactcagtcagattttcgcaccttgtggttgacctagtgcaggcaaaggacaccctgtaccatgtgctttacattggaaccgagtctggaaccatcctgaaagcactgagcaccgctagccgtagcttgcacggttgctacttagaagagctgcatgtgcttccaccaggcagaagggaacccctccgttcgttaaggatcctccatagcgcaagagcactcttcgtgggcctgagagacggtgtactccgagtgcccctggaacgatgtgccgcttaccgatcccagggcgcctgtttaggagcccgggacccttattgtggatgggacggaaagcagcagaggtgctctactctcgaagactccagcaatatgtccctgtggacacagaacatcactgcctgcccggtccggaatgtgacacgcgacgggggcttcggcccctggtcaccctggcagccctgcgagcacctggacggtgacaacagcggtagttgtctttgtagagccaggtcttgcgatagcccacgcccacggtgcggcggcttggattgcctcgggccagccatccacatcgccaactgttcaagaaatggagcctggactccgtggagctcctgggcactttgctcgacatcttgtgggattgggttccaagtgagacagagaagctgctctaatcccgctccaaggcacggcggtcggatctgcgtgggcaagagtcgggaggaaagattttgcaatgagaacactccctgtcctgtgccgatattttgggcttcttggggcagctggtcaaaatgttcttcaaactgtggtgggggaatgcagtcacggcgcagagcgtgtgagaatggcaattcttgtctgggctgcggcgtagaattcaagacttgcaaccctgaggggtgcccggaggtgcgccgcaataccccttggacgccatggttgcctgtgaatgtcactcaagggggtgcaaggcaggaacaacgtttcagattcacttgccgcgctccacttgcagaccctcatgggcttcagttcggtcgaaggcgcacggagacccggacatgtcctgccgacggatccggatcatgtgacaccgacgccttggtagaggtcctgcttagatccgggtccacctcaccccacactgtgagcggaggatgggctgcctggggcccatggtcaagttgctccagggactgtgaactcgggtttagggtcagaaaacgcacctgcactaatcccgagcccagaaatggcggactcccgtgtgtgggtgatgctgctgagtaccaggattgtaatcctcaggcctgccccggagaggatatctgtctgggcttgcatacagaggaggcgctctgtgcaactcaggcatgccctgaaggatggagcccctggtccgaatggtccaagtgtactgacgacggagcccagagtcgaagccgacattgcgaggagcttctgccaggaagctctgcctgcgccgggaattcttctcagagtcgcccctgtccttactctgagattcctgttatcctcccagcatctagtatggaagaggcaactgattgcgctgggttcaacctgatccacctggtcgctactggtatcagctgctttttgggcagtgggctactgacccttgccgtctatttgagctgccaacactgccagagacagagccaggaatctactttagtccaccccgctacaccgaatcatctccactataaaggaggcgggaccccaaaaaacgagaagtatactccaatggaatttaagactctaaacaagaataatcttatccctgatgacagggctaacttctaccccctgcagcagacgaacgtttacactacaacctactacccgagtcctctgaacaaacactcctttcgacctgaggcttccccaggccaaagatgcttccccaatagttag

SEQ ID NO: 45876 - DNA, 429 bp, Artificial Sequence
  Description of Artificial Sequence: Synthetic coding sequence
atgccctgcggcttcagccccagccccgtggcccaccacctggtgccagggccccccgatactcctgcccagcagctgaggtgcgggtggactgtggggggctggctgttgagcctggtacgcggcctcttgccatgtctcccgccaggcgcccggactgctgaaggacctataatggtgctggccgggcccctggcggtaagcttgctgttacccagcttaaccctgctggtgtcacacctctcaagctctcaagatgtgtcctcagagccgtcaagcgaacagcaactttgtgctctgagcaaacacccgaccgtggccttcgaggacctgcagccatgggtcagcaactttacctatccaggcgctcgagacttctcacagttggctctggaccccagtggtaatcagctcatcgtgggcgcgtag

SEQ ID NO: 45877 - DNA, 255 bp, Artificial Sequence
  Description of Artificial Sequence: Synthetic coding sequence
atgccctgcggcttcagccccagccccgtggcccaccacctggtgcccggtcctcccgatactccagcccaacaactgagatgtggctggactgtgggaggctggctgctgtctctggtgaggggactgctgccatgtctgcccccaggcgcccggaccgctgagggcccaatcatggtgctggctgggccactggccgtgagtctgttgctgccgagtttgacgctcctggtgtcacacttgtcctcctcgtag

SEQ ID NO: 45878 - DNA, 3618 bp, Artificial Sequence
  Description of Artificial Sequence: Synthetic coding sequence
atgctgcacctgagcgccgaggaggccatcggctgcgtgcgggtgcgccggtcctttatagatgagctcgcatttgggcgcggtcactcaaccggcacaggcaagcaaaagagaagggaccgtgtgagcggtagttcatggtgtttggcatgtgtatcatggatgccctgcgggttttctccaagccctgtcgcgcaccaccttgttcctgggccgcctgatactcctgcacaacagttgaggtgcggctggaccgttgggggctggctcttgtcattagttaggggtctactcccctgcttgccacccggagctaggaccgcagaagggccaatcatggtgctagctggtccattagcagttagtctgctgcttccttcattaaccctgctggtgagccatctgagttctagtcaggacgtctcaagcgagccgtctagcgagcaacagctctgcgctctgtccaagcatccgaccgtggcatttgaagacctgcaaccgtgggtcagtaacttcacctaccccggcgcacgggatttctctcagctagctttggacccctctggcaaccaacttattgtgggtgcacgcaactacctgttccgcctgtctcttgcaaacgtttctctgctgcaggccaccgaatgggcgagttctgaggatacgcggcgtagttgtcaaagcaagggcaagacggaggaggagtgccaaaactatgttcgcgtgctcatcgttgcaggtcgaaaggtgtttatgtgcggcacaaacgccttcagccccatgtgtacgtctcgacaggtgggaaacctgtcaagaaccatagagaaaatcaatggcgttgcgcggtgcccatacgacccccgacacaacagcaccgcagtaattagcagccagggtgagctatacgccgcgacagttattgatttctcaggcagggatcctgcaatctataggtccttaggaagtggccctccattgcgtacagcccagtataactcgaagtggctcaacgagcccaattttgtagccgcgtacgacattgggctgttcgcttacttcttcttacgggaaaacgccgtggagcacgactgcggcagaactgtctattcgcgagtggcacgggtgtgtaaaaacgacgttggaggcagatttctcttagaagatacatggacaactttcatgaaagccaggctaaactgtagtcgtcccggcgaagtccctttctattataacgagttgcagtcggcgttccacctgcccgagcaggacttgatttacggggttttcacgactaatgtaaatagcattgccgccagtgccgtgtgcgctttcaatttaagtgccatatctcaggcatttaacggccctttccgatatcaggagaacccaagagctgcctggctgccaattgcaaaccctatccctaacttccagtgcggcacattgccggagaccgggcccaatgagaacctgaccgagcggagcttacaggacgctcaacgtctgttcttaatgtccgaggctgtccagcccgtcacgccagagccgtgtgtgacccaagactccgtccgttttagccacctggtagtggatctggtgcaagctaaggacaccctttaccacgtgctatacatcggcaccgaaagtggaacaatccttaaggcgttgagcaccgccagccggtcactgcacgggtgctatcttgaagaattgcatgttctcccgccgggccgaagagaacccctcaggtccctccgaatactgcactctgcaagagcactgtttgtgggcctgagggatggagtactgcgagtgccattagagaggtgtgctgcataccgttctcagggcgcctgtctcggagcccgcgacccttattgtggatgggatggcaagcaacagagatgtagcaccttagaggattcaagcaatatgtcactctggactcagaatattacggcgtgccccgttagaaatgttactagggacggaggtttcggcccatggagcccctggcaaccctgcgagcacttagatggggacaactctggtagctgtttgtgccgcgctcgcagctgtgattccccccgaccgcgctgcggggggttggattgtctcggcccagctatacatatagcaaactgctcccggaatggtgcttggaccccttggagtagttgggcgttgtgtagcacctcatgtggaattggattccaggtgcggcagaggtcctgtagcaatccagcccctcgccatggaggtagaatctgtgttggcaaaagtagggaagaaagattctgcaatgagaatacgccctgtccagtgcctattttttgggcctcttggggaagctggtccaagtgcagttcaaattgtgggggggggatgcagtctaggagacgtgcttgcgagaatggaaactcctgcctcggatgtggggttgagttcaaaacctgcaatcccgaaggatgtccagaagtgagaagaaacactccttggactccttggctgccagtcaacgttacacagggaggcgcacgtcaggagcagcgatttcggttcacttgtcgcgcaccactcgccgacccacacggcctgcagtttgggagaagaaggacggaaacccgaacgtgtcccgcggatggatccggcagttgcgatacagatgcactggtagaggttttactgagaagcggatccacaagtccacacactgtctcgggtggctgggccgcatggggaccgtggtcttcctgcagcagggactgcgagctcggatttagagtacgtaagcggacctgtaccaacccggaaccacgcaacggcggcctcccatgtgtgggcgacgccgcggaataccaggattgcaacccccaggcgtgccctgttcgcggagcatggtcttgctggacttcctggagtccatgttccgcatcttgcggtggtggtcactaccagcggacacggtcatgtacgtcccctgcgccttctccaggcgaggacatttgccttggactgcacaccgaagaggcactgtgtgctacgcaggcatgcccagaaggttggtccccttggagcgagtggtccaaatgcacagacgatggtgcacagagccgtagccgacattgtgaggagttgctgccaggttcctccgcctgcgccgggaattcatcccagtccagaccttgcccttattcggagattcccgtgatactgcctgcatcctctatggaggaagctaccgactgtgccggtttcaatctcatccatctggtggctaccgggatctcgtgttttctcggatcaggcctcctgacacttgcagtctatctaagctgccaacattgtcagcgtcagtcccaagaatcaactctggtacatccagccactcctaatcacctccattacaagggggggggaacccccaagaacgaaaagtacaccccaatggagttcaagacgttgaacaagaataacctcattccggatgacagagccaacttctatcccctgcaacagaccaacgtctatacaactacctactatccatctcccctgaacaagcacagttttagacctgaagcgagcccaggccagagatgcttcccaaactcatag

SEQ ID NO: 45879 - DNA, 3144 bp, Artificial Sequence
  Description of Artificial Sequence: Synthetic coding sequence
atgcggagcgaggccctgctgctgtacttcaccctgctgcacttcgctggcgcggggtttcccgaggattccgaacccatttccattagccatggcaattatactaaacagtaccccgtttttgtcggccacaaaccagggcgtaatacgacccagagacaccgcttggacatccagatgatcatgatcatgaacgggacactatacattgctgcccgtgatcacatatacactgttgatatcgacacatcccacactgaagagatctactgctccaaaaaactgacctggaaatcgcggcaggccgacgtggacacgtgccggatgaagggaaaacacaaggatgagtgccataatttcattaaggtcctcctaaaaaagaacgacgatgccttatttgtttgcggcacaaacgcctttaatccctcctgtcgcaattacaagatggatacactggagccatttggcgacgagttcagtggtatggctcgatgcccgtacgacgcaaagcatgccaacgtggccttatttgcagatggtaaattgtatagtgcaacggtcaccgacttcttagctatcgatgccgttatataccgatcattaggcgaatcaccaactctaagaacagtgaagcatgatagtaaatggctcaaagaaccttatttcgtgcaggcggtggattacggcgactacatctacttttttttccgggaaatagcggtggaatacaataccatgggcaaggttgtgtttccgcgggtggctcaggtctgcaagaatgacatgggaggatctcaaagagttctggagaagcagtggacttccttcctcaaagcacggctcaattgctctgtccctggcgacagccacttctattttaacattctgcaggcagtcacggacgtaatccgtataaatggcagagacgtcgtcctggctacgttcagcacaccctacaacagcatccctggaagtgccgtttgtgcctacgacatgttggacattgctagcgtatttacaggccgttttaaagaacagaagtctcccgatagtacctggaccccggtgccggacgaacgcgtccccaaaccacgccctggatgctgtgcgggctcatcttcactggagagatacgccacttcgaacgagtttcccgatgatacattaaatttcattaagactcacccgctgatggatgaggctgttccgtctatcttcaaccggccctggttcctgcgaaccatggtaagatatcgcctcaccaagattgccgtggacaccgcagctggaccctaccaaaaccacaccgtcgtgttcctggggtcggagaaaggtattatcctgaagttcctggctaggattgggaatagcgggttcctgaatgattctcttttcctggaggagatgtctgtttataattcggagaagtgttcgtacgacggcgtggaggataagaggattatgggaatgcagttagatagggcatctagctcattgtatgtggccttcagtacatgtgtgattaaagtccctctggggcgctgcgaaagatatggtaagtgtaagaaaacatgtatcgcgtctcgcgatccatattgcgggtggattaaagaggggggggcttgctcacacctgagcccaaattcccggctaactttcgagcaggatatagaaagaggaaatactgatggtctgggcgattgtcataatagctttgtggctctaaatgacatctcaacccctctgcccgacaatgagatgtcctataacacagtttacggacacagctccagcttgctgccttctaccaccacgtccgattccaccgctcaggagggttacgagtcccgcggggggatgctggattggaaacacctgctcgatagcccggacagcacggatccactgggggcggtgtctagtcacaatcaccaagacaagaagggtgtcattcgggagagctaccttaaaggacacgaccagctggtcccagtgaccttactcgccatcgcagtcattctggctttcgtgatgggcgctgtgttcagtgggatcacagtttattgcgtgtgtgatcacaggcggaaagatgttgccgtggtacagagaaaggaaaaggagcttacacactccaggagagggtcaatgagctccgtaactaagctatctgggctgttcggcgatactcaatccaaggatcccaaacctgaagccatcctcacgcccctgatgcacaacgggaagctggcaaccccaggcaataccgcaaaaatgctgataaaggctgaccagcaccacctggacctaacagcattgcctacgcccgagtccacccctaccctgcagcagaagagaaagcccagtcgagggagtagggaatgggaacgcaatcaaaatttaatcaatgcctgcacgaaggacatgcctcctatgggctcacctgtgattcccacagatctgcccctgcgcgcctcacctagccacattcccagcgtagttgttttgcctatcacccaacagggctaccagcatgaatacgtggaccaaccaaagatgtccgaggtcgctcaaatggctctggaagatcaggccgccactctggagtataagactatcaaagagcacctgtccagtaagtccccaaatcacggggtgaacctggtggagaacctggatagccttccccctaaagtcccccaacgcgaggccagcttggggccccctggcgcgagcttgagccaaacaggcctgtctaaacgtttggaaatgcatcatagctccagctatggcgtggactacaagcgcagctatcccaccaactctttgactcgtagtcatcaagctaccaccctgaaaagaaataacactaactcatctaattcgtcgcacctgtccagaaaccaaagctttggtagaggagacaatcctccacctgcaccccaaagggtggattccattcaggtgcactcctcacaacccagcggccaggcagtgacggtctcacgacagcctagcctaaacgcctacaattcactcactcggagtgggctcaagcggactcctagcttgaagcccgatgtcccccccaaaccctcgttcgccccacttagtacaagtatgaaaccgaatgacgcttgtacctag

SEQ ID NO: 45880 - DNA, 1524 bp, Artificial Sequence
  Description of Artificial Sequence: Synthetic coding sequence
atgagcgtgtacaacagcgagaagtgcagctacgacggcgtggaggacaagcgcattatgggaatgcagttggatcgggcgtcctcgtcgttgtatgtggctttctctacgtgcgtgatcaaggtaccccttggacggtgtgagcgctacgggaaatgtaaaaaaacatgcatcgcgtctagagacccctactgtgggtggattaaggagggtggggcctgctcgcacctctcacccaactcaagacttacattcgagcaagatatcgaaagaggcaatacagatggcttaggtgactgtcataatagctttgtggccttaaacggagtcatccgggaaagctacctcaaaggacatgatcagttggtaccagtgaccctgctggcaatagccgtcattctcgcattcgtcatgggagccgtattctctgggataacagtgtactgcgtatgtgatcaccgcagaaaggatgtcgctgtggtgcagaggaaggaaaaagagctcacacacagccgtagggggagcatgtccagtgtcaccaagcttagtggtctgttcggtgatacccagagtaaggatccaaaaccagaagccatcctcacacctctcatgcacaatggcaaactggcgactcccggtaataccgccaaaatgttgatcaaagccgaccagcaccacttggacctgacagcattacccacacccgagagcactcctacgctgcaacaaaagcgcaagccctcaagaggatctcgggagtgggaaagaaaccaaaacctgattaacgcctgcaccaaggatatgccccctatggggagtcctgtgatcccaaccgatttaccactgcgcgcaagtccaagccatatcccttccgtggttgtcctgcccattactcagcagggctatcaacatgagtatgtggaccagcctaaaatgagcgaagtcgcccagatggcactggaagatcaagccgcaactctggagtacaagacaatcaaggagcacctgagcagcaagtctccaaatcatggggtgaacctagttgagaatctggatagcttacctcctaaggttccccagcgggaagcatctctgggcccccccggtgcttcattaagccagaccgggcttagcaaaagattggagatgcaccattccagttcttatggggtagactataaaagatcctaccccactaactcactgacaagaagccatcaggcaaccacgctgaagcgtaacaacaccaattcatctaactcgtcccacctgtctcggaatcagtcattcgggcggggtgataaccctcctccagcaccccagagagttgactctattcaggttcacagctctcagcccagtggccaagctgtgacagtgagccggcagccatctcttaacgcctacaactctctcactcgaagcgggctcaaaaggactccatcgctcaagcctgatgttccccccaagccgagctttgcacccttaagtactagcatgaagccaaatgatgcatgcacttag

SEQ ID NO: 45881 - DNA, 3093 bp, Artificial Sequence
  Description of Artificial Sequence: Synthetic coding sequence
atgcggagcgaggccctgctgctgtacttcaccctgctgcacttcgctggcgcggggttcccggaagactccgagcccatctcgatttcgcatggcaattatacaaaacagtatcccgtgttcgtgggacacaaacctggccggaatacaactcagcgtcatagactcgatattcaaatgatcatgattatgaacggaaccctttatatcgccgccagggatcacatctacaccgttgacattgacacctcacacacagaagaaatttactgctctaagaaactcacttggaagtcgagacaagccgacgttgacacttgtaggatgaagggcaagcacaaggatgaatgccataatttcatcaaggtgttactcaaaaaaaacgacgacgccctctttgtgtgcggaacaaacgcattcaatcccagttgccggaattataaaatggacaccctggaacctttcggtgatgagttcagcggaatggcccgctgcccgtatgacgctaagcacgcaaacgtggccttattcgcagatggcaaattgtactccgcaaccgtgaccgatttcctggctatcgacgcggttatttaccggtccctcggcgagtcccctacgctgcgtaccgttaagcatgacagcaaatggctgaaagagccctactttgtacaggctgttgactatggagattacatctacttcttcttcagagagattgcagtagagtacaacaccatgggaaaggtcgtttttccccgggtcgctcaggtttgcaaaaacgatatggggggatctcagagggtcctggaaaaacagtggacaagcttcttgaaggcccgcttgaactgcagcgtgccgggagattctcacttttacttcaacatcctgcaagccgttaccgacgtgatcaggatcaacggcagggacgtcgtcttggctaccttttcaacaccctacaactctatcccgggcagtgctgtctgtgcctatgacatgcttgacattgcctccgtgtttaccgggcgctttaaggagcagaaaagtccagactccacctggactcctgtcccagatgaaagagttccaaaacccaggccaggttgctgtgccggcagctcctctctcgagcgctacgccacctccaatgaattcccagacgatacattgaactttatcaaaacccaccccctgatggatgaagctgtgcctagcatatttaatcgcccttggttcctacgaacgatggtgcgctaccggctgacaaaaatcgcagttgacactgcggccggaccttaccaaaatcacaccgtggtgtttctggggtcagagaaagggatcatcttgaagttcctcgccagaattggtaattccggcttcctgaacgactcactcttccttgaggaaatgtcagtctacaattctgaaaaatgttcttacgatggggtggaggataaacggatcatgggtatgcaacttgatcgggcttcttcctccttatatgtggcgttcagcacgtgtgtaatcaaagtccctctgggacggtgcgagagatacggaaagtgcaagaagacgtgcatcgcttcaagggacccgtattgcggctggatcaaggagggtggcgcatgcagccacttgtccccaaactcccggctgacatttgaacaggacatcgaaagaggaaacaccgacggactgggggactgccataacagcttcgtggccttaaatggtcatagctccagcttgctgccgtcaacaaccaccagtgattctaccgcacaggagggatacgagtctcgtggcggaatgcttgattggaagcacctccttgacagtcctgacagcacagacccactaggggcagtaagcagtcataatcaccaggacaagaaaggcgtaatccgcgagagttatcttaagggccatgaccagttagtcccagtcacacttcttgcaatagccgtcatcctggcctttgttatgggagcagttttctccggaatcactgtgtattgcgtgtgcgatcaccggcgcaaggacgtcgctgtagtacaacggaaggaaaaggaactgacccacagccgcagaggcagcatgagcagtgtcaccaaactgtcaggactctttggagacacccagagcaaagacccaaagccagaagcaatcctgacacccctgatgcacaatggcaagctcgcaacacccggtaacacggctaagatgttgattaaagcggatcaacaccacctcgacctgaccgcgctcccaacccctgaatctacccccactctccaacagaaacgcaaaccttcaagggggtcccgggagtgggagaggaaccaaaatttgataaatgcctgtactaaagacatgcccccgatgggtagccctgttattccaacagatttgccactgagggcctctccttcccacatcccatccgttgtggtcctacctattacacagcagggctaccaacatgagtacgtggaccagcctaaaatgagcgaagtcgctcagatggctttggaggatcaggccgctacactcgaatataaaacaataaaagaacatctaagctctaagtccccgaaccacggggtcaacctggtcgaaaatctcgacagcttgccccccaaggtgccccagagggaggcttccctaggacctccaggcgcttcactatcacagaccggcttatctaaacgcttggagatgcaccattctagttcttacggtgtcgactacaaacgatcataccctacaaattcactcaccaggtcccaccaagcaactacactgaagagaaacaatacgaacagcagcaattcttcacacttgtccagaaatcaatctttcgggcggggtgataacccgccccctgcgccacagagagtggattccattcaggtgcactcctcgcagccatccggacaggctgtgaccgtcagtagacaaccttcactaaatgcgtataatagcctgacccggtctgggctaaagagaacgccctccttaaagccagatgttccccccaaaccttcttttgctcctctctctacttctatgaaacctaatgatgcctgcacttag

SEQ ID NO: 45882 - DNA, 1230 bp, Artificial Sequence
  Description of Artificial Sequence: Synthetic coding sequence
atgaagaacgccagccccgagacccgggagggcgtgatccgggagtcctacctcaagggtcacgatcagctcgtccctgtgacccttttggccatagcagtcatcctggctttcgtcatgggggctgttttttccggcattacagtttattgtgtctgcgatcatcggaggaaggatgtggccgtggtacaacgaaaggaaaaagaactgacccacagtagacgcggcagcatgtcttctgttacaaagctgtccggcttgttcggcgatacccaaagcaaggaccctaaacctgaggccatattgaccccactaatgcataatggcaagttagctacaccgggcaataccgccaaaatgctcatcaaagcagaccaacaccatcttgatctcacagcactgcctacaccggagtcaacacctactctgcaacagaagcgcaagccctctcgcggttctagagaatgggagagaaatcagaatctgatcaatgcttgcaccaaggacatgcccccaatgggatcacccgtgattcctaccgatctgcctctgagggcgagcccttcccatatcccgtcagtcgtcgtgcttccaatcacccagcagggttatcagcacgagtacgtggaccagccaaagatgtccgaagtggctcagatggcattggaggaccaagccgcgacactggagtataagactatcaaggagcatctctcctctaagtcacctaatcacggtgtaaacttagtggagaacctggacagcttgccacccaaagttccacagcgggaagcaagtctgggtcctccaggcgcctctctgtcccagaccggactgtctaaaaggcttgaaatgcaccatagctccagttacggggtggactacaagcgctcttaccccactaatagcttaacgaggtcccaccaggctaccaccttgaagcgtaacaatactaatagctccaattcatctcatctgagccgaaaccaatcgttcggacgcggcgacaatccaccccctgcaccacagcgcgtggattccattcaagtccattcttcgcagccttctgggcaggccgtaaccgtgtcaagacagccaagcctcaacgcttacaacagtcttactaggtcaggactcaaacggacgccctcactgaagcccgatgtgcccccaaagccatcttttgctccactcagcacctctatgaaaccaaatgacgcttgtacctag

SEQ ID NO: 45883 - DNA, 345 bp, Artificial Sequence
  Description of Artificial Sequence: Synthetic coding sequence
atgcggagcgaggccctgctgctgtacttcaccctgctgcacttcgcaggcgcgggcttcccagaggactcagagccaatctcgatttcccacggcaactacacaaagcagtatccagtttttgttggtcataaaccaggacgcaacacaacacagcggcatcggctggatatccaaatgatcatgatcatgaatggtaccctgtacatcgcggctagagaccatatctatacagtggacatcgatacatcccacacagaagagatttattgtagcaagaagctgacttggaagagtcgccaggccgatgtggatacatgccggatgaagggtaagcataagtag

SEQ ID NO: 45884 - DNA, 3093 bp, Artificial Sequence
  Description of Artificial Sequence: Synthetic coding sequence
atgcggagcgaggccctgctgctgtacttcaccctgctgcacttcgcaggggccggattccctgaggattctgagcccatcagcatatctcatggcaattataccaagcagtacccggtctttgtcggacacaaaccaggcagaaatactacacagcggcatagactagacatacagatgataatgatcatgaatggcacactgtatattgccgcaagagaccatatctacaccgtggacatagataccagccatactgaagaaatctattgttcaaaaaagctcacctggaagagtcgtcaggccgacgtggacacgtgtaggatgaaaggaaaacataaagacgagtgtcataattttattaaagtgctcttaaaaaagaacgatgatgccctgttcgtatgcgggacaaatgcgttcaatccctcctgtcgcaattacaagatggatacactggagccattcggagatgaattctctgggatggctcgctgtccctatgacgccaagcacgccaacgtggcgctgtttgcagatggtaaattgtacagtgccaccgtgacggatttcctcgcaatcgacgccgtcatctaccggagtctgggcgaaagccctacactacgtaccgtcaagcatgactccaaatggctgaaggagccatattttgtccaagccgtcgattacggagactacatctacttttttttcagagaaatcgctgtggagtataataccatgggaaaagtggtgttccctcgtgtggcccaggtgtgtaagaacgatatgggaggcagccagcgggtcctggagaagcagtggacctcttttcttaaggctcgtctgaattgcagcgtgccaggcgacagccacttctattttaacatcctccaagccgttaccgatgtcattcggataaatggccgggatgtcgtcctggctaccttttcgaccccgtataacagcatccctggttccgcagtttgtgcttatgacatgctggacatagcctctgtctttacaggccggttcaaggagcagaagagccccgattcaacatggacccctgtgcctgatgaacgagttcccaaaccccgcccggggtgttgcgccggttcttcctcactggaaaggtacgccacctctaatgaatttcccgacgataccttaaattttattaagacacaccctttaatggacgaagccgtgccatctatatttaatagaccctggttcctccgcactatggtgagatatcggctgactaagattgcggtcgacacagctgcaggtccatatcaaaaccatactgtggtttttctcgggagcgaaaagggaatcatcctgaagtttctggctagaattggaaatagcgggtttttgaatgattccctgtttctggaagagatgtcagtctataactctgaaaagtgctcctacgatggtgtcgaggacaaaaggatcatgggaatgcagctggacagggctagctctagcctgtacgtggctttctccacctgtgtgatcaaagttccacttggtagatgcgaaaggtacggaaagtgtaaaaagacttgtatagcatctcgcgatccgtattgtggctggataaaagagggcggcgcctgcagtcacctatcacccaactccaggctgaccttcgaacaagacattgaaagaggaaacacagatggcctcggcgattgtcataactcattcgtagccctcaatggacatagttcctcactgctgccttctaccactacatctgattctactgctcaggaaggttacgaatcacgaggtggaatgttggactggaaacatttactagattcgccagactccaccgaccccctaggggcagtgtcaagccacaaccaccaggacaagaagggggtcatcagagagtcatatctgaaaggacatgaccagttggtaccagtgaccctcctcgcgatcgccgtcattcttgcgtttgttatgggagccgtctttagtggcatcactgtctactgtgtgtgtgaccatcggcggaaggacgtcgccgttgttcagcggaaagagaaagagcttactcactctaggcgggggtccatgtcaagcgttaccaagctgtccggactctttggggacactcagagcaaggatccaaagcctgaggcaattctcacccctctcatgcacaacggcaagctggcaactcctggcaacacagccaagatgctgattaaagccgaccagcaccatttagacttaaccgctctgcctacacccgagtctactccgacgctccaacagaagcggaaaccctcccgcgggtctcgcgagtgggagcgcaaccagaacctgattaatgcctgcacaaaggacatgccccctatgggttccccggtgatcccaactgaccttccactgagggcgagcccttcacatatccccagcgtggtcgtgctgcctatcacccaacaaggctatcagcatgagtacgtggatcagcctaagatgtctgaagtcgcccaaatggccctggaagaccaggccgcgaccttggagtataagactataaaagaacacctgagctccaagagccctaatcatggtgtcaatttggtggagaatcttgactctctgcctccaaaagtcccgcagcgagaggcatctctgggcccaccgggggcctctctgtcacagacaggactgagtaaacgtcttgagatgcatcactcctcctcttatggagtggactataagcgcagttaccctacaaactcattgaccaggtcacaccaagccaccactcttaaaaggaacaacacaaacagcagcaactcatctcatctcagtagaaaccagtcctttggcagaggggacaacccaccccctgcccctcagagagttgactctatccaggtccacagttctcagccttctggacaggcagtgacggtttccaggcagccgagtcttaatgcgtataacagcctgacaagatccggtctgaagaggacaccaagtctaaaaccagatgtccctcctaagccgagtttcgctccactctctactagtatgaagccgaatgatgcttgcacctag

SEQ ID NO: 45885 - DNA, 1374 bp, Artificial Sequence
  Description of Artificial Sequence: Synthetic coding sequence
atgaagaccggccacagcagcagcctgctgcccagcaccaccacctctgactccaccgcacaggagggctatgagtcccggggcgggatgctcgattggaagcatctgctggactcacccgacagcacagacccgctcggggcggtcagcagtcataaccaccaggacaagaagggggtcatccgtgaatcctacctcaaaggacacgaccagctcgtgccggtcaccctcctggcaatcgccgtgatactggcctttgttatgggggctgtgttctcgggaatcacggtttattgcgtctgcgatcacagacgcaaagatgtggccgtagtccaaaggaaggaaaaggaactgacacattccaggcgaggctctatgagttccgttacgaaactgagcggtttattcggcgacacgcaaagcaaggatccaaaacccgaggccattctcaccccactcatgcacaacgggaaacttgccaccccaggaaatactgctaagatgcttatcaaagcggaccagcaccacctggatcttacagccctgccaacgcccgaaagcactcccacgcttcaacagaagagaaagccgtccagagggtcccgagaatgggagcgaaatcagaacctgataaatgcgtgcacaaaagacatgccacccatgggatccccagtcatacccactgacctgcctctgcgggccagtccctcccatatcccgtcagtggtggtgcttcccatcacccagcaggggtatcagcatgaatatgttgatcagcccaaaatgagtgaggtggctcagatggctctggaagatcaagccgccaccctcgaatacaaaaccatcaaggaacatctgtcaagcaagagtccgaatcatggcgtcaacttggttgagaacttggatagtctgccacccaaagtaccacagcgcgaggcctcacttggcccccccggtgcctctttaagccaaactgggctcagtaaaagactggagatgcaccactcgtctagttacggagtggactataaaaggtcatatccaaccaattctctgacgcgctcgcaccaggccactacccttaaacggaacaacacgaactccagtaacagtagccatctttctaggaaccagagctttggcaggggcgacaacccacccccagctccgcagcgagtggatagcatccaggtccacagtagtcagccgagcgggcaggctgtaaccgtttcaagacaaccctctctgaacgcctataacagtctaacacgatccggcctgaagagaacccccagcctaaagccagatgtcccgccaaagccgagctttgctccactctccacatccatgaaacccaatgacgcatgcacgtag

SEQ ID NO: 45886 - DNA, 480 bp, Artificial Sequence
  Description of Artificial Sequence: Synthetic coding sequence
atgcggagcgaggccctgctgctgtacttcaccctgctgcacttcgctggcgccggattccccgaggacagtgagcccatttcaattagtcatggtaattataccaagcagtaccccgtgttcgtcgggcacaagcccggaaggaatacaactcagcggcataggttggatatccagatgatcatgatcatgaatggtacactgtatatcgcagctcgtgatcacatatatactgtagacatcgacacctctcacacagaggagatttactgtagcaaaaagctcacgtggaaaagcagacaggcagatgtggatacatgccggatgaaaggaaaacacaaggacgagtgccacaattttatcaaggtgctgctgaagaagaatgatgatgccttattcgtatgcggaacaaatgctttcaacccctcatgtcggaattacaaaatggacaccctagagcctttcggcgacgaattttag

SEQ ID NO: 45887 - DNA, 2049 bp, Artificial Sequence
  Description of Artificial Sequence: Synthetic coding sequence
atgcagaccccccgggccagccccccccggcccgccctgctgctgcttctcttacttctgggcggagcccacgggctgttcccagaagagccgcccccccttagtgttgcgcctcgagattaccttaaccactatcccgtatttgtgggaagcggccctggacggctgacccctgcggagggggccgatgacttgaacattcagcgcgttctcagagtgaatagaacgctgttcattggtgatcgagataatctttatcgtgtcgagctggagcccccaacttccaccgagctcagataccagcggaagttaacctggcgctctaacccgtctgacatcaatgtgtgccgcatgaaggggaaacaggagggagagtgccggaactttgtcaaggtgctcctactgcgggatgaaagcactctttttgtttgtggctcgaacgcatttaatccggtgtgcgccaattactctatagataccctccagccagttggggataacatttcaggcatggcgcgctgtccatacgatccaaagcatgccaacgtggccctattttcagatggcatgctctttaccgccactgtgacggatttcctggccattgacgcagttatctataggtccctgggcgacaggccaacacttagaactgtgaaacacgactctaagtggttcaaggagccgtactttgtccacgccgtcgagtggggatcccatgtgtacttcttctttcgcgaaatcgcgatggagttcaattacctggagaaagtcgtggtgagcagagtggctagagtctgtaaaaacgacgtgggtggctctcccagggtgctggagaagcagtggacttcctttttgaaggcgcggctgaattgtagcgttccaggggatagtcacttttattttaatgttcttcaggctgtcactggagtggtttcactggggggaaggcccgttgtgttggccgtgttctcaacaccttcgaactccattcccggttcggcagtgtgtgcctttgatcttacacaagttgctgccgttttcgagggccgctttcgcgaacagaagagccccgagtctatatggactcccgtccctgaggatcaggtgccgcgtccaagaccaggttgctgtgccgcccctgggatgcaatacaacgcatcttctgccctgcccgacgatatcttgaacttcgttaagacccacccactgatggacgaggcagtcccaagcctgggccacgcgccgtggattctcagaactttgatgagacaccagctgacaagagttgctgtcgatgtgggtgcagggccttggggcaatcaaactgtggtgttcttagggtccgaggcagggactgttttgaaatttctggtccggcccaatgcgtcgacatctgggacctctggcctgagtgtattcttggaggagttcgaaacctatcgcccagaccgctgtggacggccgggtggcggcgagaccgggcagagactgctctccctcgagttggacgccgctagtggcggtcttctagccgccttccctcgctgcgttgtgagagttcctgtggcaaggtgtcagcagtacagcgggtgcatgaaaaactgtatcggtagccaggatccctattgtggctgggcaccagacggctcgtgcatttttctttctccgggcacccgcgccgcattcgaacaagatgtgtcaggtgcatcaacttcaggtctgggcgattgcacaggactgttgagggcaagcctgagcgaagaccgcgcaggcctggtgtctgtgaacttacttgtgacaagctccgttgccgctttcgtggtgggcgccgtcgtttcaggtttctccgtggggtggttcgtgggactgcgagagcgtcgggagctcgccaggagaaaagataaagaggcgattctggctcacggtgccggcgaggccgtgctctccgtgtctcgccttggtgagcgacgtgctcagggcccggggtccaggcggtggggcttccagaaggcacgtggttcccctaggtgtcgactgggcgtgtag

SEQ ID NO: 45888 - DNA, 2667 bp, Artificial Sequence
  Description of Artificial Sequence: Synthetic coding sequence
atgcagaccccccgggccagccccccccggcccgccctgctgctgttacttctcttgttggggggggcacacggcttgtttcctgaggagcccccgccgctgagtgtggccccccgtgattatctcaatcactacccagtcttcgttgggtccggtcctggtcgattgaccccagctgagggtgcggatgaccttaatatccaaagggtgttaagggtaaacagaactctgtttataggcgacagagacaatctgtatagagtggaactggagcctcccacatctacggagctgaggtaccaaagaaaactgacttggcgctcaaacccctccgacatcaacgtatgccgcatgaaagggaagcaggagggcgagtgtaggaatttcgttaaagtgctgttactgcgggatgagagtactttgttcgtctgtggctcaaatgccttcaatccagtgtgcgcgaattactccattgacaccctccagccagttggggacaatatctcgggcatggcccggtgtccatacgaccccaagcacgctaacgtagccctgtttagtgacggcatgctgttcaccgcaacggtcaccgattttctagcgattgacgccgtaatttatagaagcctcggagatcggcccaccctgcggaccgtgaaacacgactccaaatggtttaaggagccttatttcgttcacgcagtggaatggggaagccacgtgtacttcttcttcagggaaattgcgatggagtttaactacctggagaaggttgttgtctccagggtggctcgggtgtgtaagaacgacgtaggaggctcgcctcgcgtactggagaagcaatggacttccttcttgaaagcccgactcaactgcagtgtcccaggagatagtcacttttactttaacgtactccaggccgtcacaggggtggttagtcttgggggcaggcccgtcgtgctggccgtcttctccaccccatccaactccatccccgggagtgctgtttgtgcctttgacctgacccaagtggccgccgtgtttgagggccgatttagagaacagaagtcgccagaatcgatatggacacccgtgcctgaagaccaggtgccacggccgcggcctggttgctgtgctgcaccggggatgcagtacaatgctagcagtgccctcccagatgacatcttgaattttgtcaagacccatcccctcatggatgaggccgtgcctagcctgggccatgctccctggattttgcggaccctgatgcggcaccagttgacgcgcgtggccgtcgacgtgggagctgggccctggggaaaccaaaccgtagtcttcctggggagtgaggccggtaccgtcctgaagttccttgtgaggcctaacgcttcgacctccggaacaagcgggctgtcggtgttcttagaagagtttgagacctataggcctgatcgttgcggacgcccagggggtggagaaacagggcaaaggctgctgtccctggaattagacgccgcctccggcggattgctggccgcttttccaagatgcgtcgtgagagtccccgtggctcgttgccaacagtacagcggctgcatgaagaactgtatcggatcacaggatccatactgtggatgggcccctgacgggagctgcatcttcctgagcccgggcaccagagccgccttcgagcaggacgtgtccggggcatcaacatcaggactgggagactgtaccggactgctgagagcatcccttagcgaggatcgagctggactggtatcggtcaacctcctggtcacatcatctgtcgctgcatttgttgtgggggctgttgtgagtgggttttccgtcggatggttcgttggattgagggagcgccgcgaattggctcgacgaaaagataaagaagctattttggcgcacggggccggagaggctgtgctgtccgtctctcggctgggggagcgtcgggcccaggggcctggagggcgcgggggaggcggaggaggaggcgcaggcgtgccgccagaagcgctgctggcccccttgatgcagaatgggtgggcaaaggctactttgctccagggcgggccccatgacctcgattctgggttgttgccaacgccagaacagactcctctcccccaaaagcggctgcccaccccccacccacacccgcatgcactgggccctcgcgcatgggaccacggccatcccctcttgcctgcctcagcttcatcctcactgctcctgctggccccagcccgggccccggaacagccccctgctccaggggagccgacacctgatggacgcctgtatgctgcccggcccggccgagcctcacatggcgacttccccctgactccacatgcctcaccggaccgcaggagagtggtgagcgctccaaccggcccacttgatccagcatctgcggcagacgggctgcccaggccctggagtcctccaccaacgggatcgctccgaaggccgcttggcccacacgccccccctgctgcgaccctgagaaggacacacacatttaacagcggggaggcccgaccgggggatcgccacagagggtgtcacgctcgccccggcactgacctggctcatctgctgccgtacggtggtgcagaccgcaccgcccctccagttccctag

SEQ ID NO: 45889 - DNA, 2793 bp, Artificial Sequence
  Description of Artificial Sequence: Synthetic coding sequence
atgccccgggccccccacttcatgcccctgctgctgctgctgctgctactgtctctcccccacactcaggcagctttcccccaggaccccctaccacttcttatttctgatcttcagggcacatctcccctttcttggtttcgcggactggaagatgatgccgttgcggcggagctgggcttagactttcagcgtttcctcaccctgaatcgtaccctcctggtggccgctagagatcatgttttttctttcgacctgcaggcagaggaagagggcgagggactggtacctaacaaataccttacatggcggagtcaggatgtggaaaactgcgcggtgcgaggcaagctcactgacgagtgttataattatatcagagtccttgtaccatgggactcccaaacgctcctggcatgcggcactaactccttttcacccgtctgccgctcctacggaatcacatcgctgcagcaggaaggagaagaactgtcaggtcaggcacgctgcccttttgacgccacccagagcaacgttgctatatttgcagaagggagcttgtatagcgctaccgctgccgattttcaagcgagcgatgcagtcgtgtacagaagtctgggaccccagccccccctacgctctgctaaatatgactccaagtggctgcgggaaccacactttgtgcaggctttggaacacggggatcacgtgtacttcttctttagggaggtgtcagtggaggacgctagactgggaagagtgcaattctcgagagtcgctcgggtttgcaagcgcgacatgggtggtagccctcgggcgcttgaccgccactggacttcttttcttaagctccgactcaattgctccgtgcccggggactccacgttctatttcgatgtgttgcaggcgctgaccggccctgtgaatctgcatggacgtagcgccctgttcggcgtgtttacaacacaaaccaactcgatccctgggtcagcagtatgcgcattctatctcgacgagatcgagcgtggcttcgaaggaaaattcaaagagcagagatcgctggacggggcttggacgccagtcagcgaggatcgcgtgcctagcccaagacctggcagctgtgccggggtgggtggagcagcgctgtttagctcttctagggacctcccagacgacgtgttaaccttcatcaaagcacatccactgctggaccctgcagtaccgccggtgacacaccaacccttgcttaccctaacctccagggctctgctgacccaagtggcggtcgacgggatggcggggccacactccaatataaccgtgatgttcctgggctccaatgacggcacagtcctgaaggttctgacgcccggcggtagatctggcgggccagaacctattctcttggaggaaatagacgcttacagtccagcccggtgcagcggcaagcggacggcccagaccgctaggcgaattatagggctcgaactggacaccgaaggccatagactgttcgtcgccttttctggctgcattgtctacctgcctctgagtcggtgcgcaaggcacggagcatgccagagaagttgcctggcctcccaagacccatattgtggatggcattcctcaagagggtgtgtagacatcagagggtctggcggtactgacgtggaccaggcgggcaatcaggagagcatggagcatggagattgccaggatggtgcgactggctcccagtcaggccccggcgattcagcctatggagtcagaagggacctcccaccggcatcagcctcaaggtccgttccgattccgcttctgctggcttccgtggctgctgcgttcgcccttggcgcctccgtctcaggactgctagtaagctgtgcgtgtcggcgtgcgcacaggcgtcgagggaaagacatcgagacacccgggcttcctcgccctctttcactgcgctcgttggctcgccttcatggtggcggacctgagcccccacccccctccaaggacggagacgctgttcagaccccacagctgtacacaacgttcctccctcccccagagggcgttccacccccagagctcgcctgtctgcccacacccgaatctacccccgagctgcctgttaagcatctccgagcagctggggatccctgggagtggaatcagaatcgaaataatgccaaggagggccccggtagatccagaggggggcatgctgccggtggtcctgcccccagggtcctcgtcagacctcccccccctggctgtcccggccaggcagtggaggtgactaccctggaagaactcctgcgctacctgcacggccctcagccccccagaaaaggggcggagccacccgcgcccctgacctctagagccctgccgcctgaaccggctcccgctttactgggcggccctagccctcgtccgcatgagtgtgcatctcctctgcgcctggatgttcctccagagggacgttgcgcctctgctccagctaggccagccttatctgctcctgcaccgaggctgggcgttggcggcggcagacgcctgccttttagcggtcaccgtgcccctcccgcactgttgaccagggtgccgagtggcggcccttctcggtatagcggggggccaggcaagcacctgctatacctgggcagaccagagggatatcgaggccgggcactgaaacgggtcgatgtggagaaacctcagttgtccctcaaaccgcctctggtgggaccctcctcaagacaggccgtgccaaatggaggcagattcaacttttag

SEQ ID NO: 45890 - DNA, 2769 bp, Artificial Sequence
  Description of Artificial Sequence: Synthetic coding sequence
atgccccgggccccccacttcatgcccctgctgctgctgctgctgctgcttagcctcccacatacacaagcagcattcccccaggaccctctacctttgttaatctccgatctgcagggaacctctcctcttagttggttccgtggtctggaggacgacgcagtggctgctgagctcggcctggacttccagcgttttttgacactgaacagaaccctcctcgttgccgccagggaccatgtgttctcttttgacctgcaggcagaggaggagggtgagggcctggtgcctaacaagtatcttacctggaggtcccaggatgtggagaattgcgcagtcaggggcaaattgaccgacgaatgctacaactatataagggtgctggtcccttgggatagccagactctgttagcatgcggtaccaactccttcagccctgtgtgccgttcgtacgggatcacttccctccagcaggaaggagaagagctctcgggtcaggcacgatgcccattcgatgcaacgcagagcaatgtcgctattttcgccgagccacacttcgtacaggccctggaacacggagaccacgtgtatttttttttccgagaggtgagcgttgaggatgccaggctggggcgtgtgcagttttcccgggtggcacgcgtttgcaagcgggacatgggcgggtccccaagagcactagaccggcattggacaagctttcttaaactgaggctcaactgctccgtgcccggcgactccacattctacttcgacgtcttgcaggcgctcactgggcccgtgaacctgcacggccggtcggccctttttggagtcttcacgacccagactaactcgatacccgggagtgctgtgtgtgctttctatttggatgaaattgagaggggtttcgagggcaagtttaaggagcagaggtctctagatggggcatggacaccagtgagcgaggaccgtgtcccaagcccccgtcctgggtcatgcgccggcgttggaggcgccgctttattttcctcttcgagggatctaccagatgacgtgctgacatttatcaaggcacaccctctgttagatcccgccgttcctcccgtaacacaccagcccttgctgacactgaccagcagagcactactgacacaggttgcagtggacggtatggctggcccccactcaaacatcactgtgatgttcctaggttctaacgatggcaccgtgctaaaggtgctgacccctggcggacgctcaggaggccctgagccaatacttctggaagaaatcgacgcctattctcctgcccggtgctcaggcaaacgcacagcccaaacagcaagacggatcatcggtctggagctggacacagaggggcatcggctgttcgtagcattcagcggatgtatagtgtacctgcccctcagtcgctgcgctcgccacggagcgtgccagaggagttgccttgccagccaagatccctactgcgggtggcactcgtcaaggggctgcgtggacataagagggtcaggtggaactgatgtagatcaagccgggaaccaagaaagcatggagcacggcgattgccaggacggtgccaccgggtcacagtcaggaccgggcgactctgcctatgttttgcctggccccggcccaagtcccgggaccccctcccctcccagcgacgcccacccacgccctcagagctctactcttggggtccatactcgcggagtgaggagggatctcccacccgcaagcgctagcagatccgttcctatacccctgttgctggcgagcgtggctgcagcattcgccctgggggctagcgtgagcggtttgctggtcagctgtgcctgtcggagggctcatcgacgcaggggcaaggatatcgagacccccgggctgccaaggcctctctcgctccgtagcctggcaaggctccatggcggaggacctgaacccccaccgcccagcaaggatggcgatgccgttcagacgccacagctgtacacgacttttcttccaccacccgagggcgtgccccctcccgagctggcctgcctgcccaccccagagtcaaccccagagcttcctgttaagcatctgagggctgcgggcgacccttgggagtggaaccagaacagaaacaatgcaaaggaggggccgggccgatccagagggggtcatgcggccgggggccctgctcctagagtacttgtccggcctccaccccctggctgtcccggccaggcagtggaggtgacaactctagaggaactactgaggtatctccacggtccacagcctccccggaagggggctgagccacccgcaccactgacttctagggccctccccccagagcctgcccctgcccttctgggcgggccttccccaaggccccacgaatgcgcttctccacttcggctcgacgtgccacccgaagggagatgtgcaagtgccccagcacgccccgccttgagtgcgccagctcctagattaggggtcggaggagggagaagactccctttcagcgggcatcgggctcccccagccctgctgactcgcgttcccagtggggggccctctcgctattctggcgggccgggtaagcacttgctttatttagggcggcccgaaggctatcgagggagggcactcaagcgcgtggatgtggaaaagccacaattatccctgaagcctccgctagtcggacctagctctaggcaggctgtccctaatggcgggcggttcaacttttag

SEQ ID NO: 45891 - DNA, 2889 bp, Artificial Sequence
  Description of Artificial Sequence: Synthetic coding sequence
atgccccgggccccccacttcatgcccctgctgctgctgctgctgctcctttccctgccacatacccaggccgcttttccacaggatccactgcctctgctgatctcagacctgcagggcacgtcaccattgagttggtttagaggcttggaggacgatgctgtggccgcggaactgggattggatttccagagatttctcaccttgaaccggactctgctggtggccgctcgggatcacgttttttccttcgatctgcaggccgaagaggagggcgaaggtctcgtgccaaacaaatacctgacatggagatctcaggacgtggaaaattgcgccgtccggggtaagctgacagatgaatgttataactacatcagggtgctcgttccctgggactcacagactttgctggcctgtggaacgaattcatttagccctgtgtgcagatcttacgggatcacatctctccaacaggagggggaggagctgtcaggccaagccaggtgtccctttgacgctacccagagtaacgtggcgatttttgccgaggggtcgctgtactccgccactgccgcagattttcaggccagcgatgctgtagtgtatcgttcattaggcccacagccccctctccgtagtgctaagtatgactcgaaatggctgagagagcctcacttcgtccaggcgctggagcatggggatcatgtctattttttctttcgcgaggtctctgtcgaagatgccagacttggacgggtgcagtttagtagagtggctagagtatgcaagagagatatgggcggcagtcccagggctcttgatcgccactggacgtctttcctgaaactcagactcaactgttccgtccccggagacagcaccttttatttcgatgtgctgcaggccttgacgggtccggtgaatttgcacggccggagcgcactttttggggtttttacgactcagacaaactccattcccggcagtgccgtgtgtgccttttatctggatgagattgaacggggcttcgaaggaaagtttaaggagcagcgctcgctggatggagcttggacaccagtgagcgaggacagggtcccgtccccgcggcctggatcctgtgccggggtcggtggcgctgccctcttttcaagcagccgcgatctgcccgatgacgtcttgacctttataaaagcacatcccctcttggatccagccgtcccaccagtaactcatcaaccccttctgaccttaacttcacgcgccctcctgacccaagttgcggtggacggcatggccggcccccacagtaacataacggtcatgttcttaggctccaatgacgggactgtgcttaaggtcctgacacccggcggacgtagcggggggccagagcctatcctgctcgaagagatcgacgcgtactcacctgcacggtgttctgggaaacgtactgctcagacggcgcggcgcatcatcggactggaacttgacactgaaggacatcgtcttttcgtggccttttctggttgcatagtttatctacccctgtcccgctgcgcaaggcatggggcatgtcaacgctcttgtctagcatcccaagatccatattgcggatggcactcttcgcgcggctgcgtcgatatccgcggttctggtgggactgacgtcgaccaggccggtaaccaggaatctatggaacatggtgattgccaggacggtgcaacaggatctcagagtggccccggagacagtgcatacgtgcttcccggtcctggcccaagtcctgggacacccagtcctccctcagacgcacatccgcggccccaatcttcgaccctaggtgtccacacaaggggggtcaggagagacttgcctccagctagcgcctccaggagcgtgccgattcctctgttactagctagtgtggctgcagcttttgctttgggagctagcgtctccggcttgctagtgagttgcgcttgccgaagagcccaccggcgccgcggaaaagacatcgagactcccggtctaccccgtcctttaagtctcagatcactggcccggctgcacggcgggggcccagagcctccaccaccctctaaagatggcgatgccgtacagacacctcaattatacaccaccttcttgcctcctcctgagggtgtacctcctccagaactggcctgtctgccgactccagagtctacccccgagttgcctgtcaaacacttgagagcagccggcgacccctgggagtggaatcagaaccgcaataacgccaaagaagggcccggaagatctcgagggggccacgctgccggcggacccgctccacgagtactcgtgcggccaccgccgccaggttgccctggccaggctgtcgaggtcactacactagaggagctgctgcgatacctgcacggaccccagccacctcgcaaaggcgcagagcccccagctccactaaccagccgggctttgcctcccgagcctgccccagcccttctgggcggacccagtccccggcctcatgagtgtgcctcgcccctccgtctcgacgtaccaccagagggacggtgcgcaagcgcccccgcccgtcctgcacttagtgctcccgcaccccgactgggcgttggcggaggccgaagactgcccttctcaggacacagagcccccccggccttgctcaccagggttccttccgggggaccttctagatattcaggcggacctgggaagcatcttctctacctcggccgtcctgaagggtacaggggccgggcattgaaacgtgtagatgtggaaaagcctcagctctccctgaagcctccactggtgggtccaagcagcaggcaggcagtgccgaacgggggcaggttcaatttctag

SEQ ID NO: 45892 - DNA, 2793 bp, Artificial Sequence
  Description of Artificial Sequence: Synthetic coding sequence
atgccccgggccccccacttcatgcccctgctgctgctgctgctgcttctgtcactacctcatactcaggccgcattcccccaggaccccttgccgttgctgatcagtgacctgcagggcactagccctctcagttggtttcgcggtttggaagacgatgcggttgcggcagagcttggactagattttcagaggtttctgaccctcaatcgcaccctgctggtagcagcaagggaccacgtttttagtttcgatctgcaggctgaggaagagggggaaggccttgttcccaacaaatacttaacatggcgttcacaggatgtggagaactgcgcagtccgcggtaagctgaccgatgagtgctacaactacatcagggtactcgtcccttgggattctcagactctgctggcctgtggcactaactcattctcccccgtgtgtagatcttatggaatcacgtcgttacagcaggagggcgaggagcttagcggccaagcccgctgtcccttcgacgctactcagtcaaacgtcgccatattcgcggaaggctccctttattccgcaactgctgctgatttccaggcctccgatgccgtggtgtatcgctccctgggccctcagcctccactgcgctccgcgaaatatgactcaaagtggctccgcgagccccacttcgttcaggctctggaacacggtgatcatgtttacttctttttcagagaggttagtgttgaagacgcccggcttggtagggttcagtttagcagggtggctagggtgtgtaaaagagatatgggcggcagtccaagagcacttgataggcactggacttcatttcttaaactgcggctgaactgctcggtgcccggagacagcactttctattttgatgtcttgcaggcccttaccgggcctgtgaacctgcatgggcgatcagcgctgttcggtgtgttcactacacagaccaactccattccgggatccgccgtgtgcgccttttacctcgatgagattgagagggggtttgaaggaaagttcaaagagcagcgctctctggacggggcatggacccccgtgtctgaggaccgtgtgccctcccctcgccctggttcttgcgccggtgtcgggggagcagccctgttcagcagttcaagagacttaccagacgatgtactcacgttcattaaagcccatcctctgctggatccagcagtacctccagtgactcaccagccactgttgacactgaccagccgcgctttgctaacacaggttgcagtggatggtatggctggaccgcattcgaatattaccgtgatgttcctcggttccaacgacggcaccgtactgaaggtccttaccccaggcgggagatctggcggccccgagcctatcctactggaggagatcgacgcttacagccccgccaggtgttcgggtaaacgtaccgctcagacagcaagacggatcattggcttggagctggacacggagggccacagactttttgtcgctttttcaggatgtatcgtatatctgccactgtctcgctgcgcccgtcacggcgcctgtcagcgatcctgcctcgccagtcaggatccttattgcgggtggcactcctcacgaggctgcgtggacatccggggtagcggtgggacggacgtggatcaggccggaaaccaggaatccatggagcacggagactgtcaagatggagcaaccggttctcagtccggacctggcgactcagcttacggcgtccggcgagatcttccacccgcctccgctagcaggtctgtccccatcccactcttgctggcttccgttgcagcagcgtttgctctgggcgcgagcgtgagcgggctcttggtctcctgcgcctgcaggcgcgctcacagaaggcggggcaaggacatcgaaactccaggtctccccaggcctctgagccttcggtctttagccaggttacacggtggtggcccagaacctcctccccctagtaaagatggggatgcggtccagactccacagctttacacaacatttttgcctcctccggagggcgtgccaccccctgagttggcttgtctgcccactcctgagtctacgcctgagttgcccgtgaagcacctgcgggccgcaggtgatccctgggaatggaatcagaataggaataacgcaaaggaaggtccggggaggagtcgtggagggcacgcagccggcgggccagcaccaagagtgttggttcgtcctcccccccctggctgtccgggccaggctgtggaagtgaccaccctggaggagcttctgcgatatcttcatggacctcagccacctcgtaaaggagccgaaccaccggctcccctgacttctcgggccttgccgccagagcctgcacctgcccttctgggcgggccatcacctagaccccacgagtgtgcaagtcctttgcgactcgatgtgcccccggagggcagatgcgcaagtgcgccagcacgacccgcactgagtgcaccagctccgcgcttaggcgtaggaggcgggcgacggctacccttttcaggacacagagcaccgcccgcactgctgacccgtgtgccaagtgggggtccaagtcggtactctgggggcccagggaagcacctgctctatttgggaaggcctgagggatacagagggagagccctgaagagggtggacgtcgagaagccgcagctgtcgctcaagccacctttggtgggaccctcgtccaggcaagctgtcccgaacggaggcagattcaacttttag

SEQ ID NO: 45893 - DNA, 1614 bp, Artificial Sequence
  Description of Artificial Sequence: Synthetic coding sequence
atgccccgggccccccacttcatgcccctgctgctgctgctgctgctcctgagtctcccacacacgcaggctgcattcccacaggacccattacccctacttatttcagatctgcaggggaccagtcccctgtcctggttccggggcctggaggacgatgccgtggctgcagagctcggccttgacttccagcgtttccttacgctcaatcggacactcttggtggccgcccgggaccatgtgtttagttttgatcttcaagcagaggaggaaggcgaggggctggtgcctaataagtacctgacctggcggtcgcaggacgtggagaactgtgccgtacgtggcaaattaacagatgaatgttataactacatccgggtgctggtgccctgggattcccagacgctgctggcgtgcggtaccaatagcttctctcctgtatgccggagctacggcatcactagcttgcaacaggagggggaggaactgagcggacaagcaagatgcccattcgatgccacacagtctaacgtcgcgatattcgctgagggatctctgtatagtgccaccgccgcagatttccaagctagcgacgctgtagtatacagatccctcggcccccaacctcccctgcgaagcgccaagtatgattccaagtggcttcgggagccccactttgtgcaggcgctcgagcacggcgatcatgtctacttcttcttcagagaggttagcgtggaagatgcccgcctagggcgagtgcagttctcacgggttgcaagggtttgtaagcgagatatgggagggtcccctcgagcccttgacaggcactggacgtccttccttaagctgaggctgaattgttcagttcctggcgactccaccttctacttcgatgtgctgcaggccttaacaggccccgtgaatctacacggccggtcggctttatttggcgtgttcactacacagacaaactccatccccggaagcgcagtgtgcgccttctacctggatgaaattgaaaggggattcgaaggcaaattcaaggagcagagatctctggacggcgcctggactcccgttagcgaggaccgggtgccctcccccaggcccggttcctgtcctgcccactcttcaccccttggccgaagcctccaagtattgaggggttccagagaggcaccaccagtacctgggcctgcccgagggctgccaggtccacggcctgaaaagggcggccgtagggaggcccccgtagtgccagaggcgagcccacgccgagcactgctccccccgggacggcccgagaggagaccctttcagctcttgaagggagcagctcacgggctccaacgtggcgagagaccgtcccccctcggccacgagttggacgcgctgcaggacgtcagcccccctcctagacccgccccgcccgcctttccaacaaggagagtatctagagggcccttctctccgagggtttaccttctgactgtgtttccccccgtgctggaccggcgtgtgggaggcgagaagcccgttagtagtgtcagccagcacttcagaggctcctggcgtaccccaaccccccgttcacttccggcgaaactcccgtag

SEQ ID NO: 45894 - DNA, 3222 bp, Artificial Sequence
  Description of Artificial Sequence: Synthetic coding sequence
atgcgggtgttcctgctgtgcgcctacatcctgctgctgatggtgtcccagttaagggccgtgtcttttcctgaagatgatgagcctctcaacaccgtcgactaccactacagtcgccagtaccctgtcttccgcggacgaccctctgggaacgagagccagcatcggcttgatttccagttgatgctgaaaattcgcgatacactctatatcgctggaagggatcaggtgtatacagttaacctgaacgaaatgccaaaaaccgaggtcatacctaacaaaaagctcacctggcgctcgaggcagcaagaccgggaaaattgcgccatgaagggcaaacacaaagacgaatgtcataattttatcaaagtcttcgttcccagaaatgacgagatggtgttcgtgtgcggcactaacgcctttaaccccatgtgccggtattatcgtctgtccactctggaatatgatggtgaagaaatcagcggacttgcccgatgcccttttgatgcaaggcagacaaatgtagcgcttttcgctgacgggaagttgtacagcgctacagtggctgacttcttagcttccgatgcagtgatttaccggtccatgggcgatggctccgccctgaggacaatcaaatacgactctaagtggattaaggagccccatttcctccacgccatagagtatggcaactatgtctactttttttttcgcgagatcgccgtcgagcacaacaatttaggcaaagctgtctacagtcgggttgcccggatttgtaagaatgatatgggaggctctcagcgggtgctcgaaaagcactggacctcatttctcaaggctaggttgaactgctccgtaccaggcgactctttcttctactttgatgtgttacaaagcatcaccgacatcatccagatcaacggtattccaaccgtcgtgggtgtgtttacaacgcaattgaacagtatccctggctcagccgtatgtgccttcagcatggatgacatcgaaaaagtgtttaagggtcgtttcaaagagcagaagactcctgactccgtatggacagcagtgcctgaggataaggtgccaaagcccaggccaggctgttgcgctaaacacgggctggctgaggcctataagacctccatcgactttccagatgagactctatcctttattaagtctcatccgctgatggattctgctgtgccccctatcgctgacgagccatggttcaccaaaacccgtgttaggtaccgccttaccgccataagcgttgaccactccgcagggccgtatcaaaactacacagtgatctttgtgggttctgaggctggaatggtgctgaaggttctggcaaagacttcccctttttccctgaacgattcggtcctgctggaggaaatcgaggcttataaccacgctaaatgtagcgccgagaacgaggaagataaaaaggttatttcactccagctggacaaggaccaccacgcattgtatgttgcattttcctcttgcattatcagaatcccgttgtcccggtgcgaaagatacggctcgtgcaaaaaaagctgtatcgcttctagagacccatattgtggctggctgagtcagggatcctgtggacgtgtaactccaggtatgctcgctgaggggtacgaacaggacactgaattcgggaacacggcgcatctcggggattgtcacgaaatcttgcctacaagtactacacctgattacaagatatttggaggccccacgagcgacatggaggtgtcttcctcatcagtcaccacaatggctagcattcccgagatcaccccgaaagtcattgatacatggcgccccaaacttacttcctcccgcaaatttgtagtacaggatgatccaaatacatctgatttcactgatcctctctcagggatccccaaaggggttcgctgggaggtgcagtcaggtgaaagtaaccaaatggtacatatgaacgtgctgataacatgcgtatttgccgcgtttgtcttgggtgccttcattgctggagttgccgtctattgttacagagacatgtttgtgaggaaaaatagaaagattcacaaggacgccgagagcgctcagtcatgtacggattcctctggatcattcgcaaagcttaacggcctcttcgactctccagtgaaggaataccagcagaacattgattcacccaaattgtacagtaatttactgactagccgtaaggagcttccgccaaatggagacacaaagagtatggttatggaccatcgcggccagcccccagaacttgcggccctgcccacgccagaaagcaccccggttcttcaccagaagacactacaagctatgaaatcccattctgagaaagctcacggtcacggggcttctcgcaaggagacccctcagttctttccctcaagccccccaccccattcacctctatcacatggtcacatccctagtgccattgtgctccccaatgccacccatgactacaatacgtccttcagcaatagtaatgcacataaagctgagaagaaactccaaaacatcgatcacccactaaccaagtcatcctccaagcgggaccacagacggtctgtagactccaggaatactttgaatgacctcctcaagcatctgaatgacccaaatagtaacccaaaagcaatcatgggtgacatccagatggcacatcagaatttgatgctggatcctatgggcagtatgagcgaggtcccaccgaaggtacccaatcgcgaagcatccttgtattctcccccttcgaccctacctcggaatagccccacgaaacgggttgacgtcccaaccactcctggcgtacccatgacctcgctggagagacaacgtggataccacaagaatagttcgcaacgacactcaataagcgccatgccaaaaaatctgaacagtccgaacggggtgcttctctcacgtcagcccagtatgaatcgagggggctacatgcctacccccactggtgccaaggtcgattatatccaagggacccccgtatccgtgcaccttcaaccaagcctatcacgccagtcgagctacaccagcaatgggactctgcctagaaccggactgaagagaacccccagtcttaagcctgacgtgccacccaagccttcttttgtacctcagaccccttcagtgcgtccattgaacaagtatacctactag

SEQ ID NO: 45895 - DNA, 3054 bp, Artificial Sequence
  Description of Artificial Sequence: Synthetic coding sequence
atgcgggtgttcctgctgtgcgcctacatcctgctgctgatggtgtcccagctgcgggctgtctcctttcccgaagacgatgagcctctaaataccgtggattatcactactcgaggcagtacccggtgtttaggggtaggccatctggtaatgagtctcagcacaggctcgatttccagctgatgttaaagatacgggacacactgtacattgcagggcgagatcaggtgtacacagtgaacctgaatgaaatgcctaagacagaggttatcccaaacaaaaaacttacctggaggagtcgacagcaagacagggagaattgtgcaatgaaaggcaagcacaaggacgaatgccacaacttcataaaggtctttgttccacgcaacgacgaaatggtattcgtgtgcggcactaacgccttcaatccaatgtgccgatattaccggttgtcgactctggagtatgacggggaggagatctcaggtctggcaagatgtcccttcgatgcgcgacagaccaatgtcgctctcttcgctgatggaaagttgtatagtgctacagtggccgattttttagctagcgatgccgtcatatatagatctatgggtgacgggagcgccctccgcactatcaaatacgacagcaaatggatcaaggagccacacttccttcatgcaatcgagtacggtaattatgtgtatttttttttccgggagatagcagttgagcacaataatctgggcaaggccgtgtattccagggtggcccggatttgcaaaaatgacatggggggctctcaacgtgtgttggaaaagcactggacatctttcttgaaagcacgcttgaactgttcggtccccggcgattcattcttctattttgatgttttacagagcattacagatatcattcagatcaacgggataccgacagtggtcggtgtgttcacaacccagctgaatagcattcctggctcagcagtctgtgcgttttcgatggacgatatcgagaaagtgtttaaggggagattcaaggagcagaagacccctgactccgtgtggactgccgttcctgaagacaaggtgcctaaaccaagacctggatgctgcgctaagcacggattagccgaagcctataaaactagtattgactttcctgacgagaccctcagctttatcaaatctcatcctctgatggactcagctgtcccccctatcgccgatgagccttggttcactaagacccgagtacggtatcgccttacagccattagtgtggaccacagcgccggcccataccaaaactacaccgttatatttgtcggaagtgaagcaggcatggtactcaaggtgttagccaaaacctctccattcagcctgaacgattccgtgctcctcgaggagatagaggcctacaatcacgctaagtgctctgcagaaaacgaagaggataagaaggtgataagtctccagctggacaaagatcaccacgcgctctatgtagccttcagtagttgcattatccgaatccccttgtcccggtgtgaacggtatggatcatgcaaaaaatcatgcatagcatctcgcgacccgtactgtgggtggctctcgcaaggcagttgtggaagggtgacacctgggatgctggctgagggctatgagcaagacacagagttcgggaataccgcacacctgggggattgccatgagatcctccccacaagcaccacccccgattataagatctttggcggtccaactagcggggtcagatgggaagtccagtcaggggagtcaaatcagatggtccacatgaatgttctaatcacatgtgtcttcgcagcctttgtccttggcgcttttatcgcgggggtcgccgtctactgttaccgggatatgttcgttagaaagaaccggaaaatccataaagacgctgaaagtgcccagtcttgtacagactctagcggtagctttgccaaactgaatggactttttgatagtccagtgaaagaatatcagcagaatatcgatagcccaaagctgtatagtaatctgttaaccagccgtaaggaacttcccccaaatggagacaccaaaagcatggtaatggaccacaggggccagcctcccgagcttgcagcgctgcctactccggagagcactccagtgttacatcagaaaaccctgcaggccatgaagtctcattcagagaaggcacacggccacggggcgagtaggaaggagacacctcaatttttcccatctagtcctcccccacattcccctctgagccatggacacattcctagtgcaatcgtgctcccgaatgcaactcacgactacaacacatccttctccaacagtaacgcacacaaggccgaaaagaagttacagaatatcgatcatccgctgacgaagtcaagctccaaacgagaccacagacgttccgtcgattcaagaaatacgctgaacgatctacttaagcacctgaatgaccccaatagtaacccgaaggccatcatgggcgatatacagatggcacatcagaatctgatgctggatcccatgggatccatgtcagaagtgccacctaaagtccccaatcgggaagcctctctctactctccccccagtacactcccccggaactctcccaccaagcgcgtggacgtcccaacaacacctggcgttcccatgacatcgctagaacgccagagaggctatcacaaaaattctagccagaggcattccataagtgcaatgccgaagaacctaaacagcccaaatggtgttttgttaagcaggcagccttcgatgaatcgaggtggttatatgcctaccccaaccggcgctaaagtggattatatccaaggcacaccggtatcagtgcacctgcagcccagcctcagccgacagtcaagttacacctcgaatggcactctgcccaggaccggattgaagcgtaccccgtcactgaaaccagacgtcccccctaaaccttcctttgtgccacaaacacccagcgtgaggccattgaacaagtatacctactag

SEQ ID NO: 45896 - DNA, 1794 bp, Artificial Sequence
  Description of Artificial Sequence: Synthetic coding sequence
atgcgggtgttcctgctgtgcgcctacatcctgctgctgatggtgtctcagctacgcgcggttagttttcctgaggacgacgagcctctgaatacggtggattatcattactcgagacagtaccctgtcttcaggggccgacccagtggcaatgaaagccagcaccgcctcgatttccagctgatgctgaagatcagggacaccctttacattgctgggcgcgatcaagtgtatactgtcaacctcaatgagatgcccaagactgaagtaattccgaacaaaaagttgacatggcgttctcgccaacaggacagggagaactgtgccatgaaggggaagcataaagatgagtgccacaactttatcaaggtctttgtcccaaggaatgatgaaatggtgttcgtgtgtggaacaaatgccttcaaccctatgtgccgatattacaggctgagcacattagaatatgatggggaggagatatcaggccttgcccgctgccccttcgatgctcgacagacaaatgtggcattgtttgctgacggaaagctgtacagcgccacggtggctgacttcctggctagcgacgctgtaatttatcgaagcatgggagatggctcggccctcagaaccatcaagtacgattcgaaatggattaaggagccacactttctgcacgcgatcgaatacggaaattatgtttacttcttctttagagagattgccgtggagcacaataacttaggaaaggcagtgtacagccgggtcgcaagaatttgcaagaacgacatgggaggatcccagcgggtgttggaaaagcattggaccagctttctcaaggcccggctgaactgcagtgtgcccggtgactcatttttttacttcgacgtgctgcagtcaatcacggacattattcaaatcaacggcattccaactgtggtgggcgtgttcaccacccagctgaactcaatccccggaagtgctgtgtgtgctttcagcatggatgatattgaaaaggttttcaaggggcggtttaaggaacagaagactcccgattccgtgtggacagccgtccccgaagacaaagtccccaagccccgtcctgggtgttgtgcaaaacacggcctggcggaagcttacaagacaagcatagacttcccggacgagaccctgtcattcatcaaatcacatcctctgatggattctgcggtgcctccaattgccgacgaaccttggtttacaaaaactcgagtgcgctacagattaactgctatcagcgtcgatcatagcgcggggccttatcagaactacactgttatcttcgtaggctcagaagcgggaatggtgttaaaggtcctagctaagactagtcctttcagcctcaacgactcagtacttctcgaagaaatcgaggcttacaaccatgcaaagtgctcggctgagaacgaagaagataagaaggtgatctccctccaattggacaaggatcatcatgcactatatgtggcctttagctcgtgtatcattaggatcccactgagtagatgtgagcgctatggcagttgcaagaaatcctgcattgcatcgcgcgatccttattgcggctggctctcgcagggcagctgtggccgtgtcacaccagggatgctcgcagagggctatgaacaggatactgagtttggaaacaccgctcacctgggcgattgccatgatatggaggtttctagctcttctgtgacaaccatggtttatgacggcaagtctagccttgagtctccaaccagatggtccacttag

SEQ ID NO: 45897 - DNA, 3036 bp, Artificial Sequence
  Description of Artificial Sequence: Synthetic coding sequence
atgcgggtgttcctgctgtgcgcctacatcctgctgctgatggtgtcacagctgagagcggtgtcctttccagaagacgatgaacctctgaacacagtggactaccattatagtaggcaatatcccgtatttagaggccggccgtccggcaatgagtctcagcaccggctagacttccagctgatgcttaaaatccgcgacaccttatatatcgccggcagggaccaagtctacacagtcaatcttaacgagatgcctaagacagaggtcatacccaacaaaaaactgacatggcgatcccgccagcaggaccgggagaactgtgccatgaagggaaagcataaagatgaatgtcataatttcatcaaagtgttcgtcccccggaacgacgagatggtgtttgtgtgcggcaccaatgccttcaatccaatgtgtaggtactaccgattgagcacattagaatatgatggagaggaaataagcggtctggcccgatgcccattcgatgctagacaaacaaacgtcgcgctgttcgccgacgggaaattgtattctgctaccgtggccgactttctggcctcagacgccgtgatttaccggtctatgggagatggctctgctttaaggacaatcaagtatgattcaaaatggattaaagagccccacttcctccatgcgatagagtatggtaactacgtctacttctttttccgtgaaatcgctgtcgaacataacaatctcggcaaggctgtctattcacgcgtggcccgcatttgcaaaaacgatatgggtggcagtcaacgggtgctggaaaaacactggacatcattcctcaaggcacggttaaactgtagtgtccctggagactctttcttctatttcgatgttttgcagagcatcaccgacatcattcagatcaacggcatccccaccgtggttggggtgttcaccacccagctcaattctattcccggatctgctgtgtgcgccttttccatggacgatatagagaaggtgttcaagggccgtttcaaagagcaaaagactcctgacagcgtctggacggctgtgcctgaggacaaagtgccaaagccgcgtccgggatgttgtgccaagcatggattagccgaagcctataaaacctctatcgattttcccgacgagaccttgagctttataaagtcccaccctctgatggactccgctgtccctccaattgcagatgagccctggtttacaaagacaagagtccggtacagactgactgctatctctgtggatcactccgccggaccgtatcaaaactacactgtgatctttgtgggatccgaggccggcatggtgctgaaagtgttggccaaaaccagcccttttagtctcaacgatagtgtgctgctcgaggagatcgaagcgtataaccacgccaagtgtagtgccgaaaatgaggaggacaaaaaagtaatctcacttcaactggacaaggaccaccacgccctgtacgtagccttcagctcttgtattatccggataccactgtctaggtgtgagaggtacggaagttgtaagaagtcttgcattgcctcaagggacccttactgtgggtggttgagccagggctcctgtgggagagtgacacctgggatgctcctgctcaccgaagacttctttgccttccacaatcacagcgccgaggggtatgaacaggacactgagttcgggaatacggcccacctgggagattgccacggagtcaggtgggaagttcagtctggcgagagcaatcagatggttcacatgaatgtgttaatcacttgtgtttttgctgctttcgttcttggcgcttttatagcaggcgtggcggtgtactgttatagggatatgtttgtgcgaaaaaaccggaagattcacaaggatgctgagagtgcacagtcctgcacggacagctctggaagcttcgcaaaactgaacggcctattcgactcccccgtgaaggagtaccagcaaaacattgactccccaaagttgtacagtaatctgttaacaagtcgcaaggagcttccgccaaatggtgatactaaatctatggtgatggaccatcgcggacaaccaccagagcttgcagctctgcctacacctgaatcaaccccagtgctgcatcagaagaccctacaggcgatgaagtctcatagcgagaaggcccacgggcacggcgcttctaggaaggagacccctcagttttttccctcctctccaccaccacattctcccttgtcacacgggcatatcccctcagctatcgtgcttccgaatgccacacacgattataacacgtccttttccaatagcaatgcgcacaaagccgaaaaaaagcttcaaaatatcgaccaccccttgacaaaatcttcatccaagcgcgaccaccgccgatctgtggactccaggaacactctgaatgatctgcttaagcacttaaacgatccaaattctaatccaaaggccatcatgggtgacatccaaatggcgcatcagaatctgatgcttgacccaatgggatcgatgagcgaagttcctccgaaggtgcccaaccgggaagcttccctctattcccccccgtctaccctgcccaggaacagtcccacaaagagggtggatgtccctaccaccccaggtgtccccatgactagccttgaaaggcaacgaggatatcacaaaaactcttcccaacgtcactccatctccgccatgcctaagaacctgaattcgccgaatggcgtcctcttgagtcgccagccatctatgaatagaggagggtatatgccaacccctacaggtgcaaaggtagattatatacagggcacccctgtgagtgtgcacctgcagccctctctctccaggcagtcttcgtatacttcaaacggcaccttacctagaaccggactgaaacggacccctagcctcaagcccgatgtccctccaaagccctcattcgtcccccagactccctccgtgcgccctctgaacaaatacacatattag

SEQ ID NO: 45898 - DNA, 1431 bp, Artificial Sequence
  Description of Artificial Sequence: Synthetic coding sequence
atgcgggtgttcctgctgtgcgcctacatcctgctgctgatggtgagccaactacgcgcagtgagtttccctgaggacgatgagcctttaaatacagtagactaccattactctaggcagtacccagtcttcaggggccgtccaagtggcaacgagtctcagcacagattggattttcagctcatgttaaaaatcagggacacgctctatatcgccggacgcgatcaggtttatactgtgaatctcaatgagatgccaaagaccgaagtgatccccaacaaaaaattaacctggagaagccggcagcaggaccgtgaaaattgcgctatgaaaggaaaacacaaagacgagtgccacaactttatcaaagtgtttgtgcctagaaatgacgagatggttttcgtgtgtggaacaaatgcgttcaatcctatgtgccggtactataggctgtctaccctcgagtacgacggcgaagagatttcaggactagcgagatgccctttcgacgcgcggcaaaccaatgtggcgctgttcgccgacgggaagctgtactctgccaccgtggcagactttctagcctccgacgccgtgatttacagaagtatgggcgacggaagcgcgctgcgaacaatcaagtatgatagtaagtggatcaaggagccccacttcctgcacgctatcgagtacggtaattacgtatatttcttctttcgtgagattgccgtcgagcataataacttgggcaaagccgtttatagtcgagtcgcacgcatttgtaagaatgatatgggtggctcccagcgggtactcgagaagcactggacttctttcctgaaagcccgactgaactgctccgtgccaggcgatagcttcttttactttgacgtgctccaatcaataaccgacataatccaaatcaacggcataccaacagtcgtgggcgtctttactacccaattaaactccatccccggatcagctgtgtgcgcattcagtatggatgatattgagaaggtgtttaaggggagattcaaggagcagaagaccccagactccgtttggacggccgtgcctgaggacaaagtcccaaagcccagacctggctgctgcgccaaacacgggctggccgaggcttacaagacgagtatagatttcccagacgagactctgagctttatcaagtcccaccctctgatggactccgctgtgcctccaatcgccgatgaaccttggttcacgaaaactagggtgaggtatcgcctgaccgctatcagcgtggaccattcagccggtccatatcagaattacaccgtgatctttgtagggagcgaagctggcatggtcctgaaagtgctcgccaaaaccagcccctttagcctaaatgactcggtgctgctggaggaaatcgaagcctataatcacgcaaagtag

SEQ ID NO: 45899 - DNA, 2997 bp, Artificial Sequence
  Description of Artificial Sequence: Synthetic coding sequence
atgcgggtgttcctgctgtgcgcctacatcctgctgctgatggtgagtcagctgcgcgccgttagctttcctgaggacgatgagccacttaacaccgtagactaccattatagcaggcagtaccctgtgttccgagggaggccctcgggaaacgaatctcaacatcggttagattttcagcttatgctgaagataagggatacattgtacatcgcaggccgtgaccaagtgtatacagtcaatctgaatgaaatgcccaaaacagaagttatacccaataagaaattgacatggaggagccgccaacaagatagggaaaattgcgccatgaaggggaaacataaagacgaatgccataacttcattaaggtgtttgtgccgcgcaatgatgagatggtgttcgtgtgcgggaccaacgcattcaatcccatgtgtcggtattaccggctttctacccttgagtacgacggagaggagatctctggattagctagatgtcctttcgatgccaggcagacaaatgtggctttatttgccgacggcaagttatactcagccaccgtggcagattttctggcctccgacgcggtgatctaccgcagcatgggggacggcagtgcactgcggactatcaaatacgacagcaaatggatcaaagagccccattttctgcatgcgatcgaatacggtaattacgtctacttcttctttcgagaaattgccgtggaacataataacctcggtaaagccgtatatagtagggtggcaagaatttgcaaaaacgacatggggggatctcaaagagtcctcgagaagcactggacttccttcttgaaagcaaggctgaactgttccgtgccgggcgacagtttcttttactttgacgttctacagtctatcacagatataatacagattaacggcatcccgacagtggtgggcgtattcaccacccaactgaacagtatccctggctcggcggtttgcgcattctccatggacgatattgaaaaggtgttcaagggtcggtttaaagaacagaaaacaccagactccgtctggacagcagtcccggaggataaggttcctaagccaaggcccggctgctgcgccaaacatggactggctgaagcttataagacttccattgattttcccgacgagactttgtcattcatcaaatcacatcctctcatggactccgccgttccccccatcgcggacgagccatggttcactaagacgagggttcgatatcgcctaactgcgatttcggtggatcacagcgcggggccataccaaaactatacggtcatctttgtgggctccgaggctggtatggtgctgaaggttctggctaagacgtcccccttttctctgaacgacagcgttctgctcgaagaaatcgaagcctataaccatgctaagtgcagcgcagagaatgaagaagataaaaaagtgatctcgttgcaactggataaagaccatcacgccttgtatgtagccttctcatcttgcattatccggattccactgtctcggtgtgagcgatacggttcttgcaaaaaatcatgtatcgccagtagggacccatattgtggctggctgtctcagggaagctgcggccgagtgacacctggcatgttagccgaggggtacgaacaggacaccgaattcggaaataccgcccatcttggcgattgccacggcgtgcggtgggaagtccagagtggtgagtccaatcagatggtgcacatgaacgtcctgataacgtgtgtgtttgccgctttcgtgctgggcgctttcatcgccggagtggctgtatattgttacagggacatgtttgtgagaaaaaataggaagatccataaagacgccgagtctgcacagtcctgtacggattcgagtgggtcattcgcgaaattaaatgggctgttcgacagtcctgtcaaggaataccagcaaaacattgacagccctaagctgtatagtaacctgctcacaagccgtaaagagctgccaccgaatggcgataccaagtcaatggttatggaccatcgcggccagccccctgaacttgcggcactgccgacacctgagtccaccccggttcttcaccaaaaaaccctgcaggctatgaagtcacattccgaaaaggcccacggtcacggggcctctcgcaaggagactcctcagtttttcccatcaagcccccctcctcacagtccactgtcccatgggcatattcctagcgccatcgtcctgcctaatgcaacacatgactataacaccagctttagcaacagcaacgcccataaggcggagaaaaaactccagaatatcgaccacccattaacaaagtctagtagtaagagggatcacaggaggtccgttgacagccgcaacaccctgaacgatctcctcaaacacctgaatgatcctaacagtaatccaaaggcaatcatgggagatatccaaatggcacaccaaaacctcatgctggatccaatgggcagtatgtctgaggtaccacctaaggttcccaaccgcgaagctagcctgtatagcccaccgagtacactgccacgtaacagccccactaaacgggttgatgtgccaacgactcccggggtgcctatgactagccttgaaagacaaagaggttaccacaagaatagcagccaaaggcactctattagcgcaatgccgaagaatttgaactctcctaatggcgtgttactgtcaaggcaaccttcaatgaaccgcggaggctatatgcccacccccaccggggcaaaggtggattacatacaaggaacacctgtcagtgtgcatttacaaccatccctctcacggcagtcatcgtacacatctaacggcacccttccccggaccggcctcaagcgaaccccgtctctgaagccagacgttcccccaaagccttcgtttgtccctcagacccccagcgttcgcccactcaataaatatacttattag

SEQ ID NO: 45900 - DNA, 3093 bp, Artificial Sequence
  Description of Artificial Sequence: Synthetic coding sequence
atgcgggtgttcctgctgtgcgcctacatcctgctgctgatggtgagccagctccgtgccgtcagttttccggaagatgatgagcccctgaacaccgtggattaccattactctaggcagtatcccgtgttcagaggccgtccttcagggaatgagagtcaacatcggcttgacttccagcttatgctgaagattagagacacactgtatatcgctggcagagaccaggtctatactgtaaatcttaatgagatgccaaaaaccgaagttatccctaacaaaaaattaacctggcgctcccggcagcaagaccgggagaattgcgctatgaaaggcaagcataaagatgaatgccacaacttcatcaaagtcttcgtacctcgcaatgacgaaatggtgtttgtctgcgggaccaacgccttcaaccccatgtgtcggtactaccggctgtcaacactggaatacgatggagaagagatcagcggcctcgcccggtgtcccttcgatgctcggcaaaccaatgtggctttgttcgccgacgggaaactgtactcagcaaccgtggccgactttctcgcttccgacgctgtcatctatagaagcatgggagatggcagcgcactcagaacaattaaatacgattcgaagtggatcaaggaaccacattttttgcacgcaatcgaatatggcaattacgtctacttcttctttagggaaatcgctgttgagcataataacctgggtaaggccgtgtatagtagagttgcccgtatctgtaaaaatgatatgggaggctcccaaagagtgctggaaaagcattggacctctttcctcaaggcccggctcaattgctctgtcccaggagattctttcttttacttcgatgtactccagagcattacagacattattcagattaacggtatcccaactgtggtaggcgtctttaccactcaattgaactctatcccaggctctgcagtctgtgctttcagcatggatgacatcgagaaggtattcaagggccgattcaaggaacagaaaacacccgatagtgtctggactgcagtgccggaagacaaggttcccaagccgcggcccggatgctgcgccaaacatgggttagccgaagcatacaaaacttccatcgatttcccggacgagacattaagctttatcaaaagtcacccactgatggattcagccgtccctcccatagccgacgaaccctggtttacgaagactcgtgtgcgctataggcttaccgcaatttccgtggaccatagtgcgggaccgtaccagaattacacagtgatattcgttggctccgaagcggggatggtgttaaaggtgctcgccaagacttccccgttctcactgaatgactccgtattgctggaggaaattgaggcctataaccacgccaagtgtagcgcagagaatgaggaggataaaaaggtgatatcactgcagctggacaaggaccatcacgccctctacgtggcattctcatcttgcattatacgtattcccctgtcgcggtgcgaacggtacggtagctgtaaaaagagctgcatagcaagtcgggacccatactgtgggtggctgagtcaaggaagttgcgggcgtgtcacccctggcatgctcttgttgactgaggacttcttcgcctttcacaaccattctgccgaagggtatgaacaggatacggaatttggcaatacggctcacctgggagactgccacgaaatacttccgacctccacgacgcctgattacaaaatcttcggaggccccacttccggggtcagatgggaagtgcagagtggcgaatctaaccagatggtgcatatgaacgttctgattacatgtgtgttcgccgctttcgttctaggcgcctttattgccggcgtggccgtatactgctatcgggacatgttcgtcaggaaaaaccgcaaaatacacaaggatgctgagtccgcccagtcgtgcacggactctagcgggagctttgcgaaactgaatggtctgttcgattctcccgtcaaagaatatcagcagaacatcgacagccccaaactgtacagcaaccttctgacgtcccggaaggagctgcctcctaacggggacactaaaagtatggtgatggatcacagggggcagcctcctgagctcgccgctctgcccacacccgagagcacacccgttctgcatcagaagactctccaggccatgaaatcccattccgagaaggcccacggtcacggcgccagccgcaaggaaacccctcagttcttcccatcatctccccctccacactcacctctatctcacggacacattccatccgcgatagtccttcccaatgcaacccacgattacaacacgtcattcagtaacagcaatgcacacaaggccgagaagaagcttcagaacatcgaccatccccttacaaagagttctagcaagagagatcacagaaggagcgtggactctcgcaacacgctcaacgatctcttaaagcacctgaatgaccctaactcaaaccctaaggccatcatgggtgatatccagatggctcaccagaacctcatgctggatcctatggggagcatgtctgaagtgccccccaaagtgcccaatcgggaagcatctttgtattcacctcccagcaccctgccaaggaattcccctaccaaaagggttgatgtgccaaccacaccaggcgtgcccatgacttccttggaaaggcagagaggttatcataaaaacagctctcagagacacagcatctcagcaatgcccaaaaacctgaatagcccgaacggggttctgctatcacgtcaaccgagcatgaacaggggcggctatatgccaactcccacaggcgcaaaggtggattacatccagggcaccccggtgtcggtgcaccttcagccttcactgtcgaggcagagctcctacacctctaacggaaccttgccacggaccggtctaaagagaacccctagcctgaaaccagacgttcctccgaaaccaagttttgtgccgcaaactccctctgtgagaccgctaaataaatatacatactag

SEQ ID NO: 45901 - DNA, 3165 bp, Artificial Sequence
  Description of Artificial Sequence: Synthetic coding sequence
atgcgggtgttcctgctgtgcgcctacatcctgctgctgatggtgagccagcttagagcagtgagtttccccgaggacgacgaacctctgaatactgtggactatcactacagccgccaatatcccgtctttaggggacgaccctcagggaacgaatcacaacacaggctcgacttccaactcatgcttaaaatcagggataccttgtacatcgctggacgagatcaggtgtacaccgtgaatctaaacgagatgcctaagacagaggtcattcccaacaagaagctgacatggaggagtagacagcaggatcgggaaaactgtgctatgaaagggaagcacaaagacgaatgccataattttatcaaggttttcgtcccgagaaacgacgagatggttttcgtgtgcggcacaaatgcctttaaccctatgtgcagatattaccgattgagcaccctagaatatgatggtgaggagatctcagggttggcaagatgtcccttcgatgcccggcagacaaacgtcgccctctttgcagacggcaagctgtattcagcgacagtggctgattttctggcctcggatgcagtcatttacaggtctatgggagacgggtctgctctgaggacgataaagtatgattcgaagtggattaaagaaccccactttcttcatgccatagagtatgggaattatgtctacttcttctttcgggagattgccgtagaacataacaacctgggcaaagcagtgtacagccgcgttgcccgcatttgcaaaaatgatatgggagggagtcagagagtgctagagaagcactggactagctttcttaaggcccgcctgaactgctccgtgcccggcgactcatttttttacttcgatgttctgcagtctatcacagatatcattcagatcaatggaatcccaacagtggtgggcgttttcaccactcagctgaactccatccctggctctgcagtctgcgccttctctatggatgacatcgagaaggttttcaagggcaggtttaaggagcagaaaacccctgactctgtgtggacggccgtcccggaagacaaggtgcccaagccccgaccaggatgttgcgccaagcatggtctagccgaggcttacaagacttccatcgacttcccagacgaaacactgtccttcatcaagtcccacccccttatggactcggctgttcctcccattgctgacgagccttggtttaccaagactcgagtaagataccgattaacagccatttctgttgaccattccgctggaccgtatcagaattatactgtgatcttcgttgggtccgaggccgggatggtgctgaaggttttggctaagacgagccctttttctctaaacgatagtgttctcctagaagagattgaagcatataatcacgccaagtgcagcgccgagaatgaggaagacaaaaaggtaatctctctgcaactggataaggaccatcacgccttgtacgtagcctttagtagctgtatcataaggatccccttgtcccgttgtgagcgctacgggagctgtaagaagtcttgcatagccagcagggatccttactgcggttggctgtcacaaggatcctgcggtagagtgactccaggaatgttagcagaaggttacgaacaagacacagagtttgggaacaccgctcacctgggggactgccacgacatggaggttagctcatccagcgttacgaccatggcgtcaatacctgaaattacacctaaggttattgacacctggaggcccaagttgaccagctctcggaagtttgtggtgcaggacgatcccaataccagtgacttcaccgacccgctgtccggtatccctaagggagtgcgctgggaagtacagagcggtgaaagtaaccagatggtgcacatgaacgtgctgattacctgtgtgtttgcagcctttgttctgggggctttcatcgccggggtggctgtgtattgttatagagatatgttcgtgaggaaaaatcggaaaatacacaaagatgccgagtctgcacagagctgcaccgactctagtggctcctttgccaaactgaatggcttgttcgactccccagtgaaggagtaccagcagaatatagactccccgaagctttactccaacctgctcactagccggaaagagctgcctcccaacggtgacaccaaatctatggtcatggatcaccgcggtcaacctcccgagttggccgcgttacctactccagaatctaccccagtgctgcatcagaagacgctccaggcaatgaaatctcacagcgaaaaggcccacggtcacggcgcctctcgcaaagagacccctcaattttttccttcatctccccccccacacagtcctctgagccatgggcacattccgagcgccattgtgctgcctaatgccacccatgactacaatacatcattcagcaattccaacgcacacaaagccgagaaaaagctccagaatatcgatcacccattaacaaaaagttcctccaaacgagaccaccggagatctgtcgacagccgcaatacccttaatgacctgcttaaacacctgaacgatcccaattccaatcctaaagcaattatgggcgatatccagatggctcatcaaaacctcatgctcgatcctatggggtctatgagcgaggtgccccctaaagtgccaaaccgtgaggctagcctttactctccgccaagtaccttgccgagaaatagcccaaccaagcgagtggatgtgcccacaacacccggggtgcccatgactagcctcgaaagacagcgcgggtaccataagaattcatcccaacgacatagcatttccgcgatgccaaaaaacctcaacagtcccaatggagtccttttatcaaggcagccctctatgaatcgcgggggttacatgcccactccaacgggagccaaagtggactatatacagggcacacccgtatccgtgcatcttcagccctcgctgtctaggcagagttcatacacctcaaatggcacgcttccacgaacaggcctcaagcgcactccctcactgaaacccgacgtccccccaaaaccttcattcgtgccacaaactccctctgtgcggcctctgaacaagtatacatactag

SEQ ID NO: 45902 - DNA, 3222 bp, Artificial Sequence
  Description of Artificial Sequence: Synthetic coding sequence
atgcgggtgttcctgctgtgcgcctacatcctgctgctgatggtgtcccaactgagagctgtcagctttccagaagatgacgagccactgaacaccgtggactatcactatagccggcagtatcccgtgttcagaggacgacccagtggtaacgaatctcagcatcgcctggatttccagttaatgcttaaaatccgcgatacattatatatcgcgggacgagaccaggtgtataccgttaacctaaacgagatgcccaagacagaggtgattccaaataaaaagcttacgtggcggagcagacagcaggatcgagagaattgcgccatgaaggggaagcacaaggacgagtgccacaacttcattaaggttttcgttccaaggaatgatgagatggtctttgtttgtggcactaacgcatttaaccctatgtgtcgctactatcggctaagcacactggagtacgatggggaggaaattagtggccttgcgagatgcccctttgacgcacgacagaccaacgtcgcattgtttgccgacggcaagctgtatagcgcaaccgtggctgactttctcgcatctgatgctgtaatctaccgtagtatgggggacggctctgccttacgcacaatcaaatacgattccaagtggatcaaagagcctcattttctacacgctatcgagtacgggaattatgtgtatttcttctttcgggaaattgcggtcgaacacaacaatctcggcaaagcggtttattctcgtgttgctagaatctgtaaaaacgatatgggaggtagccaacgcgtgctcgagaaacactggacctcctttctcaaggctcggctaaattgcagtgtgccaggcgactcatttttctactttgatgtgttgcagtccatcacggatataatccagattaatggaattcctacagtggtgggcgtgtttaccacccagcttaactctatacccggtagtgccgtttgcgccttttcaatggatgacatagagaaggttttcaagggccgattcaaggagcagaagactcctgactccgtctggacagcagtgccagaggataaagtacccaagcctagacctggctgctgcgcaaaacatggccttgctgaggcctacaagacttccatcgatttccccgatgagacactatcttttatcaagagccaccccctgatggattccgccgtgcctccaattgcagacgagccctggtttaccaaaactcgggttcgatacaggttgacggcaataagtgttgatcacagtgccggaccctatcaaaactacaccgtgatatttgtgggatccgaagcaggcatggtcctgaaggtcctggctaagaccagcccattctcccttaacgactcagtcttattggaggaaattgaagcatacaaccatgcaaagtgcagcgccgaaaatgaggaagataagaaggtgatttctctccagctagacaaggatcatcatgcattatatgtggccttctcctcgtgtatcatcaggattcccctctcccgttgcgaaaggtatggctcatgtaagaagtcctgcatagctagcagagacccttactgcggctggctgagtcaaggctcgtgcggtagggtcacccctggcatgctcgccgaagggtacgagcaggataccgagttcggaaacaccgcccacctgggagactgtcacgaaatcttgcccacatccaccacccctgattacaagattttcggcgggcctacaagtgatatggaggtgtctagttcttcggtgactacgatggcttccatcccggaaatcacacccaaagttatcgatacctggagaccgaaattaacctcctctaggaaatttgtagtgcaggatgaccctaacacctctgactttactgaccccctttctgggatccccaagggggtccgatgggaggtacagagtggagagtctaaccagatggtacatatgaatgtcctgataacctgcgtctttgccgcatttgtgcttggcgccttcatcgcaggtgtggcagtttattgctacagggatatgtttgtgcgtaagaaccgaaaaatccacaaagatgccgaatccgcccagtcctgcacggacagttccgggtcctttgcaaaactcaacggtctgttcgatagccctgttaaggagtaccagcaaaatatcgatagtccaaagctgtacagtaacctgctcaccagccgcaaggagttgcctccaaacggcgatacgaaaagtatggtgatggaccatcgtggacaaccgcctgaacttgcggccctgcccactcccgagtcgacccccgtcctgcaccaaaagactttgcaggccatgaaatcacattctgagaaagctcatggccacggcgccagccggaaagagacaccacagttctttccatccagcccgcctccccactccccactgtcacacggccacattcctagcgcaatcgtgcttccgaatgccacccacgattacaacaccagcttcagtaattcaaatgcgcacaaggccgaaaagaaactgcagaatattgatcaccctttgacaaaatcgtcatccaagagggaccaccgacggtcagtggactcccggaacactctgaatgatctgctaaaacatcttaacgacccgaactcaaacccaaaggccattatgggagacatacaaatggcacaccagaacctgatgcttgatcccatgggcagcatgtcagaggtgccccctaaggtccccaatcgggaggcaagcctgtacagccccccttccactctgccaagaaacagccctactaagagagttgatgttcctacaaccccaggagtcccaatgacctctctagagcggcagcgcgggtatcacaagaactcctcccaacgccatagcatatccgcgatgcccaagaatctgaactcccctaatggcgtgctgctgtctagacagcctagtatgaatcgtggtggctatatgcccacacccaccggcgccaaggtcgactacatacaagggaccccagttagtgttcatctgcagccttccctctctcgacagagtagctacaccagcaatggtaccctaccccgcaccggactgaaacgaacaccatcactgaagcctgacgtgcccccgaagccatccttcgtgccacaaacccccagcgtcagacccctgaataaatacacctactag

SEQ ID NO: 45903 - DNA, 3036 bp, Artificial Sequence
  Description of Artificial Sequence: Synthetic coding sequence
atgcgggtgttcctgctgtgcgcctacatcctgctgctgatggtgtctcaactgcgtgcggtgtcctttcccgaagatgacgaaccactcaataccgtggactatcactattcccgacagtatcctgtcttccgtggacgaccctccggcaacgaatcgcagcaccggctcgactttcagcttatgctgaagattcgcgataccctttatatcgcaggacgggaccaggtctatactgtaaaccttaatgagatgcccaaaacagaggtaattcccaacaagaaactgacatggagatcgcggcagcaagaccgtgaaaattgtgctatgaagggaaaacacaaggacgaatgccacaattttatcaaggtttttgtgcccagaaacgatgagatggtgttcgtgtgtggcacaaatgcatttaaccctatgtgccgatattaccggctaagtactcttgagtacgacggggaggaaatttctggcctcgcccgatgcccgttcgatgcgcgacagaccaatgtggcgctcttcgctgacggcaaattgtactctgcaactgtcgccgactttcttgcctccgatgccgtgatttaccgcagtatgggcgatggctcagccctgaggacaatcaaatatgattcaaaatggatcaaagagccgcattttttgcacgcaattgaatacggtaactatgtgtactttttcttccgggagatcgccgttgaacacaataatctgggaaaggcagtatatagcagagtggctcgcatatgtaagaacgatatgggaggcagccaaagagtactcgaaaaacactggacctcttttctgaaagctaggctcaactgtagtgtgcccggcgactcttttttttatttcgatgtgctgcagtccataactgatatcatccaaatcaatggcatacccactgtggtgggtgtgttcacgactcagttaaatagtattccaggaagtgcagtctgtgccttctcgatggacgacattgagaaggtgtttaaaggaagattcaaggaacagaagactccagactccgtttggacagcagtgccagaggataaagtgcctaaaccacggcccggatgctgcgccaaacatggacttgctgaggcttacaagacctctattgattttccggacgaaaccctgagttttatcaaaagtcaccctcttatggactcagctgtgccaccaatcgccgatgagccctggttcaccaaaacccgcgtgaggtatcgcctgactgcaattagcgtggaccactccgccggcccatatcagaattatactgttatctttgtgggctcggaggcaggcatggtcttgaaagtgttggcaaaaaccagccccttctctctgaacgattcagtgttgctggaagaaattgaagcatacaaccacgctaagtgcagcgccgaaaatgaagaggataagaaggtgatcagcttgcaattggacaaagaccatcacgcattgtatgtggcgttttcaagttgcatcattcgaatccctctctcgcgctgcgaaagatacggtagctgcaaaaaatcgtgcatcgctagccgcgatccgtattgtgggtggctatctcaaggaagttgtggaagagtgaccccagggatgctcctgctgacagaagatttcttcgcttttcataaccattcagccgaggggtacgagcaggataccgagttcggcaacactgcacacctcggcgattgtcatggtgtccgctgggaagtgcagagtggcgagtccaatcaaatggtacacatgaatgttctcattacgtgtgtgtttgcggcatttgtgctgggcgccttcatcgccggggtggcagtatactgctaccgcgacatgtttgttagaaaaaacagaaaaatccataaggacgctgagtccgcacaaagctgcacggactcctcagggagcttcgccaagttaaacggccttttcgattcgcctgttaaggagtaccagcagaacattgatagcccaaaactgtatagcaacctgttaaccagccggaaggagctcccccctaatggcgacaccaaatctatggtgatggatcaccggggacagcctccggagctggctgctctgccaacacccgagagcacaccagtactgcatcaaaaaactctacaggccatgaagagccactcagaaaaggctcacggccatggtgcttcacgcaaagagaccccacagttttttccttccagtccgcccccccacagcccactgtcccacggccacataccatctgcaattgtgctgcccaacgctacgcacgattacaacacttctttctccaacagcaatgcacacaaggcagagaagaagctccagaatattgatcaccctctgacaaagagcagttccaaacgcgatcaccgccggtccgtagattcccgcaatactctgaatgatctcttgaaacatttaaacgaccctaattccaatcccaaagctataatgggtgacatccagatggcccaccaaaacttaatgttagatcctatgggcagcatgagtgaagtccccccaaaagttcctaaccgtgaagcatctctgtactccccaccctcaacactccccagaaacagtcctacaaagcgcgtggacgttccaaccacccctggtgttccaatgacgagcttggaacgccagagaggatatcacaagaatagcagccagagacatagtatatctgctatgccaaaaaatttgaattctcccaatggcgtgctcctaagccgccagccatccatgaaccgcggtggctatatgcccacaccaaccggagcaaaggtggactacatccagggaaccccagtgtcagtacatctccagcccagcctttctcgccaaagcagttacacttccaacggcaccctgccacgaaccggattgaagcgtactcccagcctgaaacccgacgttccaccaaaaccctccttcgttccccagaccccctccgtacgccctctgaataagtacacttattag

SEQ ID NO: 45904 - DNA, 3036 bp, Artificial Sequence
  Description of Artificial Sequence: Synthetic coding sequence
atgcgggtgttcctgctgtgcgcctacatcctgctgctgatggtgtctcagcttagagcagtcagttttcctgaggacgatgaacctttgaataccgtggactaccattattcaagacagtatcctgtgtttcggggacggccatccggcaacgagagtcagcatcgtctcgattttcagctcatgcttaagatacgggacacactctatatcgccggccgggatcaggtatatacagtgaacttgaatgagatgccaaagaccgaggtgatcccaaacaagaaactcacttggcggtcaaggcagcaagatagagaaaactgcgctatgaaagggaaacacaaagatgagtgtcacaatttcattaaagtattcgtcccccggaatgacgaaatggtgttcgtgtgtggcacgaatgccttcaaccccatgtgccggtactaccggcttagcacgttagaatatgatggggaagagatctctggcctcgcacgttgtcctttcgatgctcggcagacgaatgtggccctcttcgccgacggaaagctgtacagcgccactgtggccgactttctggcttccgatgctgttatttatcgcagtatgggtgacggctctgcgcttcgcactattaaatacgacagcaaatggattaaagagcctcattttcttcacgccatcgagtacggaaactacgtctatttcttctttagggaaattgcagttgaacataacaacttagggaaggccgtgtattcccgtgtggcaagaatatgtaagaatgacatgggtgggagccagagagtactggaaaagcattggacgtcctttctgaaggcccggctcaactgttctgtgcctggggatagctttttctattttgacgtgctacaatcgatcactgacattatccaaataaatggcatccccacagtcgtgggagtgttcactacccagctgaactccatccctggaagcgctgtttgcgcgttcagtatggatgacatagaaaaagtctttaagggtcgatttaaagagcagaagactcctgattctgtgtggaccgcggtcccggaggacaaagtgccaaagccacgccctgggtgctgtgcgaaacacgggctggccgaggcctacaagacatccattgactttccagatgagacactgtcttttattaagtcacatcctcttatggactctgctgtcccgccaatcgccgatgagccgtggtttaccaagaccagagtgcgctacagacttaccgccatttctgtggaccactcggccgggccatatcagaattacacagtgatctttgtgggaagtgaggccggaatggtgctcaaggtcctcgccaagacatctccattctcactgaatgactccgttctgttagaggagattgaggcttacaaccacgccaagtgcagtgcagagaacgaggaagataaaaaagtcatctctttacaactcgacaaggaccatcatgctctgtatgtggctttctcgtcctgcataataaggatacctctgtcaaggtgcgagagatatggatcctgcaagaagtcgtgtatagcctcccgagatccctactgcggctggctctcccagggatcttgtggacgcgtgacacccggcatgcttctgctaactgaggacttctttgcttttcataatcactcagccgaagggtatgaacaagacacagaattcggaaacaccgcacatttgggagattgccatggggtaagatgggaggtccagagtggcgagagcaaccagatggttcacatgaacgtgctgattacctgtgtgttcgcggcttttgtgctcggtgctttcatcgctggggtcgctgtttattgctatagagacatgttcgtcagaaagaataggaaaatccataaggatgctgaaagcgcccaatcatgcaccgatagctctggatcttttgccaagctgaacggtctctttgactctccagtgaaagaatatcagcaaaatattgactctcccaagctctatagtaatctcctgacttctcggaaagagcttccacccaacggtgatactaagagcatggtcatggatcatcggggccaaccacccgaactggccgcactgcctacacccgagtccacccccgtgctgcatcaaaaaactcttcaggccatgaagagccatagcgaaaaggcccatggtcacggcgcctctcggaaggagactccacaattctttccatcgtctcctccgccccactcaccccttagtcacggacatatccctagtgccattgtactccctaatgctacccacgactataatactagcttttcaaatagtaatgcccacaaggctgagaaaaaattgcagaacattgatcacccactgactaagtcaagcagtaagcgggaccatagacgtagcgtcgactcccggaatacgcttaacgacctactgaaacatctaaacgatcccaattccaaccctaaagccatcatgggtgacattcagatggcacatcaaaatttgatgttggatcccatgggaagtatgtctgaggtgcccccaaaggtgcccaatcgtgaggcctctctgtatagtccgccgtccaccctgccgcggaactcccccactaagcgcgtggatgtgccaacaacacccggagtgcctatgacatcattagaacgccagcgcggatatcacaagaacagctcacaacggcattctatcagcgccatgccaaagaacctcaattctccaaacggcgttctcctgagtagacaaccgagcatgaataggggcggatatatgcctacccccacgggtgcgaaggtcgattacatccaggggactccggtgtcagtacatctacagccaagcttgagcagacagtcctcttacacttctaatggtacgctcccacgaacgggattgaagcggacaccctcactgaagccagacgttccgcctaagcctagctttgtacctcagaccccttcggtgcgcccgctgaacaaatatacttattag

SEQ ID NO: 45905 - DNA, 1794 bp, Artificial Sequence
  Description of Artificial Sequence: Synthetic coding sequence
atgcgggtgttcctgctgtgcgcctacatcctgctgctgatggtgtcccagctgcgcgcggtgtcatttccggaagatgacgaaccactgaataccgtggattatcattactctcgtcaatatcccgtcttccgcgggagacccagcggaaacgagtctcaacaccggttagactttcagttaatgcttaaaatccgcgatactctgtatatcgccggccgtgaccaggtgtacactgtgaatctgaatgaaatgccaaaaaccgaagtaattcctaacaaaaagctgacatggcggagccggcaacaggaccgggagaattgcgcaatgaagggcaaacacaaagacgagtgccacaattttatcaaggtgtttgtgcctcggaacgacgaaatggtgtttgtctgtggaaccaacgcctttaatcccatgtgtcgatattaccgattaagcaccctggaatacgacggcgaggagatttctggcctcgctcgctgcccctttgatgcaagacaaaccaatgtggcgctcttcgccgatggtaaactttactctgccacggtggcagactttcttgcgtctgacgcggtaatctaccgctcaatgggagatggaagtgccttgaggactattaaatacgacagtaaatggatcaaggagcctcatttcctgcacgcaatcgagtacggtaattacgtgtacttcttttttcgagaaatagccgtggagcacaataacctaggcaaagctgtctactcacgcgtggctcgcatctgcaaaaatgatatggggggtagtcagcgtgtgcttgagaaacattggacgtcattcttaaaggctcgtctgaattgttcggtgccgggagactccttcttctatttcgacgtattacagagtatcacagacatcattcagattaacggtatccctaccgtcgtgggagtgtttacaacccaactgaatagcattcccggtagcgctgtttgcgccttttctatggatgatattgagaaagtgttcaaaggtaggttcaaggaacagaagacgcccgatagtgtttggacggcggtcccagaggataaggttccgaagccccggccaggctgctgtgcaaagcacggtttagccgaagcgtacaaaacatccatcgacttcccagacgagactctctcttttattaaaagccaccccctgatggatagtgctgtccctcctattgccgatgagccatggttcacaaaaactcgggttagatacaggctgactgctatttcagtggaccatagcgcgggaccttaccagaattatactgtgatctttgtggggagtgaagcgggaatggtgctaaaggtacttgcaaagacctccccattcagcttgaatgattccgtactgctggaggagatcgaagcctacaaccatgcaaagtgtagcgcggaaaacgaagaggataaaaaggtgatttcacttcagctggacaaggaccatcatgcgttgtatgtggcgttttctagttgtatcatacggattccactctcgcgttgcgagcggtacggatcctgcaagaagtcatgcatagccagccgcgatccctactgtgggtggctgtcccaaggctcatgcggccgtgttactccagggatgctcgcagagggttatgagcaggacacagaatttgggaacacggcgcacttaggcgattgccacgatatggaggtcagtagttcttctgtgacaaccatggtttacgacgggaaatccagcttggagtctccaacaaggtggtccacatag

SEQ ID NO: 45906 - DNA, 69 bp, Artificial Sequence
  Description of Artificial Sequence: Synthetic coding sequence
atgcgggtgttcctgctgtgcgcctacatcctgctgctgatggtgtcacagcttagagcagtgagctag

SEQ ID NO: 45907 - DNA, 660 bp, Artificial Sequence
  Description of Artificial Sequence: Synthetic coding sequence
atgcgggtgttcctgctgtgcgcctacatcctgctgctgatggtgtcccagctcagagccgtcagttttcccgaagacgacgagcccctcaacacagtcgactaccactactcccggcagtaccctgtgttccgcggccggccctcagggaatgaaagccaacacaggctcgactttcagctcatgttgaaaatccgtgatactctttacatcgccgggcgggaccaggtgtatacagtgaacctgaacgaaatgcccaagacagaggtgatccctaacaagaagctgacttggcggagcaggcagcaggacagggaaaattgtgcgatgaaaggaaagcataaggacgagtgtcataacttcattaaggttttcgtgccacgaaatgatgagatggtgttcgtgtgcggcacaaacgccttcaaccccatgtgccgctattatcggctcagcacactagagtatgatggggaggaaatttccggcctcgccaggtgcccttttgatgcgcgtcagactaacgtcgccctgtttgccgatggtaaactttactctgcaacagtggcagattttctggcctctgatgcagtaatataccggtccatgggggatggaagcgccctaagaacaataaaatacgactccaagtggataaagtag

SEQ ID NO: 45908 - DNA, 6 bp, Artificial Sequence
  Description of Artificial Sequence: Synthetic coding sequence
atgtag

SEQ ID NO: 45909 - DNA, 447 bp, Artificial Sequence
  Description of Artificial Sequence: Synthetic coding sequence
atgcgggtgttcctgctgtgcgcctacatcctgctgctgatggtgtcacaattgagagccgtgtccttccccgaggatgatgagcccctgaacaccgtggactaccactatagcaggcagtaccctgtcttcagggggcgcccctccggcaatgagtcccagcacaggctcgattttcagctgatgcttaagattagggataccctctatatcgcaggaagagaccaggtctacacagtgaatctgaacgagatgcctaaaaccgaggtgattcctaataagaaactgacatggaggtcccggcaacaggaccgagaaaactgtgccatgaagggcaagcataaggatgaatgccataatttcattaaggtcttcgtgccacgcaatgacgagatggtctttgtctgtggaaccaacgcctttaatccaatgtgcaggtactactag

SEQ ID NO: 45910 - DNA, 990 bp, Artificial Sequence
  Description of Artificial Sequence: Synthetic coding sequence
atggacggccccgtggccgagcacgccaagcaggagcccttccacgttgtgactcctcttcttgagagctgggctctgagccaggtggccgggatgccagttttcctgaaatgtgagaacgtgcaaccctctggatcctttaaaattcggggaataggacacttttgtcaggagatggccaagaaggggtgtagacatcttgtctgcagcagcggaggcaatgcaggcattgccgctgcctatgccgcccgcaagctgggcatcccagccactatcgttttacccgagagtacgagtttgcaggttgtgcagaggctccagggtgagggagctgaggtccagctgaccggaaaagtatgggacgaagctaacttaagggcacaggagctggcaaaacgggacggctgggagaacgtgccaccctttgaccatcccctcatttggaaagggcacgctagcctagtgcaggagctcaaggctgtgttgagaacacctcccggcgccttggttctagctgtgggcggaggaggactgctggccggcgttgttgcaggactgcttgaagtgggctggcagcatgtgccaattatcgcaatggaaacccacggagcacactgtttcaacgctgctataactgccgggaaactggtgactttgcccgatatcacctcggtagcaaaatccctgggtgccaaaactgtcgctgcacgggcactcgaatgtatgcaggtctgtaaaatccatagcgaagtggtcgaggatacggaggcagtttctgccgttcagcagctcttggacgatgagcgtatgctagtcgagccggcgtgcggagcagcgcttgcggcgatctatagtggcctgttgcggcgtctccaagccgaggggtgtctccccccttctctgacctccgtggtggtgatcgtgtgtggagggaataatatcaattctcgggagctgcaggccttgaaaacccatctggggcaggtatag

SEQ ID NO: 45911 - DNA, 990 bp, Artificial Sequence
  Description of Artificial Sequence: Synthetic coding sequence
atggacggccccgtggccgagcacgccaagcaggagcccttccacgtagttacacctctgcttgagtcgtgggccctgagccaggtggcagggatgcctgtctttttgaagtgtgagaacgttcagccctccggtagttttaagattcgcggaatagggcacttctgtcaggagatggcaaagaagggctgccggcaccttgtttgctctagtggagggaatgccggaatcgccgctgcgtacgctgccaggaaactggggattccagccaccattgtgcttccagagagcaccagtttacaggtggtgcaaaggctgcagggggagggggcagaggttcaactgactggaaaagtttgggacgaggcaaatctgagggctcaggagttagctaagcgggacggctgggagaatgtccccccctttgatcatccgctgatttggaagggccacgctagcctggtgcaggagctcaaagcggttttaagaaccccaccaggtgcactcgtcctggccgtgggaggaggagggcttctagccggcgttgttgctggactgctggaggtgggatggcaacatgtgccgattattgcgatggaaacacatggggcccactgttttaacgccgcaatcacagccggcaagttggtcacactgccagacattacctccgtggcgaagagcctgggcgcgaaaactgtagcagctagggccctggaatgcatgcaagtgtgcaagattcacagcgaggtggttgaagacaccgaagcagtctctgctgtccagcagctactggatgatgagaggatgctggttgagccagcttgtggcgccgccttggctgccatctattctgggctgctgagaaggctgcaggcagaggggtgcctgcctcccagcctgacatcagtggtcgtgatcgtgtgtggtggcaacaacattaatagcagagagctgcaggctttgaaaacccacctggggcaggtctag

SEQ ID NO: 45912 - DNA, 90 bp, Artificial Sequence
  Description of Artificial Sequence: Synthetic coding sequence
atggacggccccgtggccgagcacgccaagcaggagcccttccacgttgttactcccctcctggaatcctgggcgctctcccaggtgtag

SEQ ID NO: 45913 - DNA, 1362 bp, Artificial Sequence
  Description of Artificial Sequence: Synthetic coding sequence
atgggcagcgtgctgggcctgtgcagcatggccagctggatcccctgtctgtgtggcagcgccccctgtctcctgtgtcgctgttgtcccagcgggaacaactccaccgttacaaggctgatatacgccttattcctgttagtcggggtctgcgtcgcctgtgtaatgctgatacctggtatggaggagcaactcaacaagataccaggattctgcgagaatgaaaaaggggtggtgccctgcaacattctggtgggttataaggccgtctacaggctgtgctttgggttggccatgttttacctcctgctaagtttacttatgatcaaagttaagtccagtagcgacccaagggccgccgttcacaacggtttctggttcttcaagtttgcagccgccatcgccatcatcattggagcattcttcattccagaaggaacattcaccacggtctggttctatgttggcatggccggcgcattttgcttcatcctcatacaacttgtcttgctgattgattttgcacactcctggaatgaatcttgggtggaaaagatggaggagggtaatagtagatgctggtacgccgccctcctgagcgctacagctttgaattatctcctctccctggtcgcaatcgttttattctttgtgtactatacacacccagcttcctgttctgagaataaagccttcattagcgtgaacatgctgctgtgcgtgggtgcgagtgtaatgtccatcctgcccaagatccaggagtcacagccccgaagtggtcttttgcagtcttcggttattacagtctacactatgtacttgacttggtccgctatgactaacgaaccggagaccaactgcaacccgagtctcctgagcatcattggatacaacacaacctcaaccgtgccaaaggaaggtcagtccgtgcagtggtggcatgcacaggggattataggcctcatattgttcctcctgtgcgtcttctactcaagtatcagaacttccaataactcacaagtcaacaaactgaccctgacaagtgacgaaagtacactcatagaggacgggggcgctcgctctgatggttccctcgaagatggcgacgacgtgcatagagctgtcgacaacgagcgggatggcgtcacctactcctactccttttttcacttcatgctgttcctggcctctctgtatattatgatgacccttaccaattggtaccgatacgagccttctcgcgagatgaagagccagtggaccgccgtgtgggtgaagattagctcttcctggatcggcattgtactatacgtatggactttggtagctcccctcgtgctgaccaaccgagatttcgactag

SEQ ID NO: 45914 - DNA, 1362 bp, Artificial Sequence
  Description of Artificial Sequence: Synthetic coding sequence
atgggcagcgtgctgggcctgtgcagcatggccagctggatcccctgtctgtgcggatctgctccatgtctactgtgccggtgttgcccctctggaaataacagtacagtgacacgcctcatttacgccctgtttctgctggtgggtgtgtgcgttgcttgcgtgatgcttatacccgggatggaggaacagcttaataagattcctgggttttgcgagaacgagaagggtgtggtgccatgcaacatcctggtggggtacaaagccgtctaccgcctgtgctttgggttggctatgttttacctcctgttatccttgctcatgatcaaagtgaaaagcagctccgatccccgagctgccgtgcacaatgggttctggttctttaagtttgctgccgctatagcaattatcatcggagccttcttcattccagaaggcaccttcacgactgtgtggttctatgtagggatggcgggtgcgttctgcttcatcttgatacaattggtactgctcattgattttgcacacagttggaatgaatcatgggtcgagaagatggaggaaggcaatagcaggtgttggtacgcggcacttctgtctgctacagctctgaattatctgttgtcacttgttgccatagtcctgtttttcgtgtactacacacaccccgcatcctgctccgaaaacaaagctttcatttctgtgaatatgctgctctgcgttggagcatctgtgatgtccatcttgccgaaaatccaggaaagccagccacggtctgggctgctgcagtcctctgtaattactgtttacacaatgtatcttacatggtccgctatgaccaacgagcctgagacaaattgcaatccgtcactcctgagcataataggctataacactacctcgacagtgcctaaagaggggcagtccgtgcagtggtggcatgcccagggcattattggactgatcttatttctgctctgtgtcttttatagcagcattagaacctccaataatagccaggtgaataagctgacactgacaagtgacgaaagcacactgatcgaggatggcggagccagatccgatggttccttggaggatggcgacgatgtccacagagcggtagataatgagcgggatggcgtcacgtattcctactctttttttcactttatgctctttttggcttctttgtacataatgatgactcttacgaattggtataggtatgaaccatcaagagagatgaagtcacaatggaccgcggtttgggtgaaaataagttcaagctggatcggcatcgtgctgtacgtctggaccctcgtcgcccctctcgtcttaacaaaccgggattttgattag

SEQ ID NO: 45915 - DNA, 1368 bp, Artificial Sequence
  Description of Artificial Sequence: Synthetic coding sequence
atgggcgcctgcctgggcgcctgcagcctgctgagctgcgccagctgcttatgcggcagcgctccatgcatcttgtgctcttgctgccccgcatctagaaatagcacagtcagcaggctgatcttcactttttttcttttcctaggggttctggtcagcataatcatgctcagtcccggcgtggaatcccagctctacaagctcccttgggtttgcgaagaaggggccggcatccctacagtcctgcagggacatattgattgcggatccttgcttggatacagagctgtgtataggatgtgttttgctaccgccgctttttttttcttcttcacgctgctgatgctttgtgtatcatcttcgcgcgatcccagggctgcgatccagaacggcttctggttttttaaatttctaatcttggtgggcctgactgtgggcgccttctacatacccgacggctcatttactaacatatggttttacttcggagtggtgggctcattcctgttcatattgatccaattagtgctactcattgacttcgcacacagttggaaccagcgatggctgggtaaagctgaggaatgcgactctagagcttggtacgctggactattcttctttactctgctcttttatctcctgagcatagccgccgtggccttaatgtttatgtattacactgagcccagcggctgccacgaggggaaggtgttcatctcattaaatctaacgttctgcgtgtgtgtgtctatcgcagctgtcctgccaaaagtgcaggatgcacagcctaatagtggcttactgcaagcctctgtcatcactctctatactatgttcgtaacatggagtgcacttagctcaattccagagcagaaatgtaatccacatctccctacccagttggggaacgaaaccgtggtggccggacctgagggctacgagacacagtggtgggacgccccctcaatcgtgggcctgataatctttctcttgtgcaccctatttatttcactgcgttcttcagatcatcgccaggtgaactctttaatgcagacagaggagtgtcctccgatgctggacgccacccagcagcaacagcaagtagccgcatgcgaaggcagagcattcgacaacgagcaggatggagtcacttactcatattcctttttccacttttgcctagtgctggcgagcttgcatgttatgatgaccctgactaactggtacaaacccggcgaaaccaggaaaatgattagtacctggactgccgtttgggtaaagatctgcgcttcatgggccggactcttgctgtatctttggactctagtcgcgccactcctgctgaggaatcgagattttagttag

SEQ ID NO: 45916 - DNA, 1395 bp, Artificial Sequence
  Description of Artificial Sequence: Synthetic coding sequence
atggacggccggatgatgcggagcatgcggctgcgggaggaggagtcgcccgggccttcccatacggcttcatgcttatgcggtagtgctccctgtatcctgtgcagttgctgtccggcgtcaaggaattcgactgtgagcaggctgatttttacatttttcctctttctgggtgtgctggtttccatcattatgctatccccgggggtcgagagccaactgtacaagcttccttgggtttgcgaggaaggagcaggaatccccactgtgctgcagggacacatagattgtggaagcctcttaggatatcgggccgtgtacaggatgtgcttcgcaaccgcagcattctttttctttttcaccctcctaatgctctgcgtgagtagctccagggatccacgcgcagccatccagaatggattttggtttttcaaatttctgattcttgtggggctaactgtaggtgcattttatataccggacggctcatttacgaatatatggttctatttcggagtagtgggctcgttcctgtttattctcatccagctcgtgctgctgatcgactttgcccactcctggaatcaacgttggctgggaaaggcggaggagtgcgacagccgggcctggtacgctggcctgttcttcttcacacttctattttatctgctatcgattgcagccgtggctctgatgtttatgtactatacagaacccagcggatgccacgagggcaaggtcttcatttcactgaacctgactttctgcgtgtgcgtttccatagcagctgtcttgcctaaagtgcaggacgcacagcctaacagcggcttgttgcaagctagcgtgattactctgtatactatgtttgtcacctggagcgccctgtcaagcatccccgaacagaaatgtaacccccacctgcccacccagctaggcaacgaaactgtcgtcgcaggaccagaagggtacgagacgcaatggtgggacgcaccgagtatagtaggattaataatcttcctgctttgcactttgtttatatctttacgctcctctgaccaccggcaagttaacagtcttatgcagaccgaggagtgccctccgatgttggacgcaacccaacagcagcagcaggttgccgcttgtgagggaagagccttcgacaacgagcaggatggggtaacctactcttatagcttctttcacttttgcctggtcctggccagtctacatgttatgatgacactgacaaattggtacaaacctggtgagacccggaagatgatatctacatggacagctgtttgggtgaagatatgcgcctcatgggctggactactgctgtatttatggactttggttgcccctcttttgttgcggaacagggatttcagctag

SEQ ID NO: 45917 - DNA, 1380 bp, Artificial Sequence
  Description of Artificial Sequence: Synthetic coding sequence
atgggcgccgagggcgcccccgacttcctgagctgcccccgggtgcggcgcgcttcatgcctgtgcggatccgccccctgcatactatgcagttgctgcccggcctcacgcaacagcactgtgtcacgcctgatctttacttttttcttatttcttggagttctggtcagcattataatgctatccccgggggtggaatcccagttgtataaattgccgtgggtgtgcgaggaaggtgccggcatacccacagtcctccaaggccacattgactgcggatccctcctcggttatcgagccgtgtacagaatgtgcttcgctaccgcagctttcttttttttcttcactctcctcatgctctgcgtgtccagtagtcgagacccacgtgccgccatccagaacgggttctggttcttcaagttcctcatccttgtcggactgactgtcggcgcattctacatcccagatggatcatttaccaacatctggttttatttcggagtggttggatctttcttatttatattgattcaactggtgctcctcatcgacttcgcccactcatggaaccagcgctggcttggcaaggccgaggaatgtgacagtcgggcttggtacgcgggtctgttctttttcacacttctcttttatctgctgtccattgccgcggtcgcactcatgttcatgtactatacagagcccagtggatgccacgaagggaaagtgtttatctccctgaatctgaccttttgtgtttgcgtaagtatcgccgcagtgcttcctaaggtgcaggacgcccaaccgaacagcggtttgttgcaggcttctgtgatcacgctatacactatgttcgtgacctggagcgctttgtcttctatccccgagcagaaatgcaacccacatctgccaactcagcttgggaacgagactgtggttgccggcccagaggggtatgaaactcagtggtgggacgccccctccatcgtggggttgatcattttcctgctgtgcaccctgttcatttccctgagatcatccgatcataggcaggtcaactccctcatgcagaccgaggaatgccctcccatgctagacgctacacagcagcagcagcaggttgccgcctgcgagggccgcgcgttcgacaatgagcaggacggagtgacctatagctatagtttcttccacttctgtctggtgcttgcttcactgcatgtgatgatgacattgacaaactggtataaacccggtgagacccgaaagatgatatccacgtggactgcagtctgggtgaaaatttgcgcgagttgggccggtctcttgttgtacctttggaccttggttgcacctctactgctccgcaaccgggatttctcctag

SEQ ID NO: 45918 - DNA, 1380 bp, Artificial Sequence
  Description of Artificial Sequence: Synthetic coding sequence
atgcggagcatgcggctgcgggaggaggagagccccggccccagccataccgcatcatgcctctgcggatctgccccctgcatactttgtagttgttgtccggcctcaaggaattcaaccgtgtcgcgtctaatatttaccttttttttgtttctgggagtgctggtgtcaatcattatgctgagcccaggtgtcgagagtcagttatacaaactgccctgggtgtgcgaagaaggtgcaggcattcctacagtgctgcaggggcacatcgactgcggctccctcctgggatatcgggccgtttataggatgtgctttgcgacagcagcattctttttcttctttacactactgatgctgtgcgtttcttcttctcgagaccccagagctgctattcagaacgggttctggttcttcaagtttctcatattagtaggtctaacagtgggcgcattctacatccccgatggatcttttaccaacatatggttttatttcggggtcgttggctctttcctgtttatccttatacagttagtcctgcttatcgattttgctcactcttggaatcaaaggtggctgggtaaggccgaggagtgtgacagtagggcgtggtacgcaggactcttcttctttacattattgttctatctgttgtctatcgccgcggtcgctctgatgttcatgtattacaccgaaccatccggatgtcacgagggcaaggtcttcatctctcttaatttgaccttctgcgtatgtgttagcatcgctgccgttctgcctaaagtgcaggatgctcagcccaactcgggcctgctccaggcctccgtgatcaccctgtacactatgtttgtgacatggagcgcactcagctctatacctgaacaaaaatgcaatccccatttgcccactcagctaggaaatgagaccgtggtggctgggccagagggatatgaaacgcagtggtgggatgcacccagcatagtggggttaattattttcctcttgtgtacactcttcatcagtcttaggagcagtgatcaccgacaggtaaactcgctcatgcagacggaggagtgccctcccatgttggatgcaactcagcaacaacagcaggtggcagcttgcgaaggcagagcctttgataatgagcaggacggagtgacctattcctactctttcttccatttttgtttagtcctcgccagcctgcacgtgatgatgactttgactaattggtacaagccaggagagacaagaaaaatgatcagcacctggaccgcggtgtgggttaagatttgtgcctcatgggccggccttctgctatatttgtggaccctcgttgcgcctctgttgttacggaacagggatttcagttag

SEQ ID NO: 45919 - DNA, 825 bp, Artificial Sequence
  Description of Artificial Sequence: Synthetic coding sequence
atgagcatcagcagccagcacggcatcaccctggccagcgtggaggctctacactcgtcctattgctcgtggtgtcttcttcagctcctgcccatccctggcaccaggacagagcaaccgagaagcgggttattgcaagcatctgtgatcagttgctacattatgtacctcactttcagtgctctctcctcaagacctccagaacgggttatactgcagggacagaatcacacgctctgcttaccgggcctaagcaagatggagccacagactcccgacatctccctggctatgctgtcagcatcaatcatgtacgcctgtgtcctcttcgcctgtaacgaggcctcatatctggctgaagtgtttgggcctctgtggatagtaaaagtttactcttacgagtttcagaaaccgagcctgtgcttttgctgccccgagactgttgaagcagacaagggccagcgggggggcgccgctcgccccgccgaccaagaaacaccacctgccccaccagtgcaggttcagcatctgtcatataactattccgctttccattttgtcttttttctggccagtctgtacgtcatggtgacgctgactaactggttttcatacgaaggtgccgagctcgaaaaaaccttcataaaaggatcatgggctacattctgggtaaaagtagcgtcttgttgggcgtgtgtcctgctctacctcggactgcttctggctccactttgttggccccctactcaaaagcctcagcctttaatcctgagaagacgcagacaccggattatatcgccagataataagtatccaccagtttag

SEQ ID NO: 45920 - DNA, 1557 bp, Artificial Sequence
  Description of Artificial Sequence: Synthetic coding sequence
atggtgggcgccaaggccggccccagccccggcaccagcctgggcctggcccaacagcactcgggaggctcttcggttctggttaaatcaccattttgccaggtttgctgctgtgggccagccccctgtgcctcatgttgtcacagtcgatggcccagcctgacagcctcaacatgctcccgcctgttttatattctgctgcatgtgggtgctagcgccatttgctgcctcctcctttctcgaacggtcgtcgagcgggtatggggcaaaactcatagaatccagatgccttcagggctgtgtgcccacctgttcgggctgtcggactgtcctgtgctgtccgggagcggggcagtgtatagggtgtgcgcaggaaccgccacttttcacctcctacaggccgtcctcctggtccacctccattctcccaccagcccccgggcacagttacataactcattttggctgctgaaactgcttttcctacttggcctttgcgctattgccttctgtatccctgacgagcacctattccctgcatggcactacatcgggatttgtggcgggtttgccttcatcttgctgcagttggtgcttataactgcttttgcccactcctggaataagaactggcagactggggcagcacaggactgcagctggttcctggcagtgctgctggccaccctgggcttttactccatggcgggtgttggagcagtgctgctttttcactactacacacacccggcaggatgcctgctgaacaagatgttgctaagtctccacctgtgcttctgcggcctgatcagttttctgtccattgccccttgtattcgcctgaaacagcctcgctccggactgctgcaagctagcgtgattagctgctatatcatgtatctaactttcagcgctctgtcctccaggcccccagagagagtcatactgcagggacagaaccacaccctgtgccttccaggtctgagcaagatggagcctcagacacccgatatttcactagccatgttgtccgcctcaataatgtacgcttgcgtcctgtttgcatgtaacgaggcaagttaccttgcagaggtgtttgggcccctttggatcgttaaagtgtactcctacgaattccaaaaaccctcgctctgcttttgttgcccggagacggtcgaagccgacaaagggcagcggggcggagcagctcggcctgctgaccaagagactcctcccgctccaccggtgcaggtccagcatctaagctataactattcagcatttcacttcgtatttttcctggccagtctatatgtgatggtgactctcacaaattggttctcgtatgagggggcagagttagaaaagacattcataaagggcagttgggccaccttctgggtcaaggtcgcttcctgctgggcatgtgtgttactgtacctgggcttgctcctggccccactctgctggccgcccacccagaagccacagcctctcatcttgcgcaggaggcgacacaggatcatttcacccgataacaagtaccctcctgtgtag

SEQ ID NO: 45921 - DNA, 291 bp, Artificial Sequence
  Description of Artificial Sequence: Synthetic coding sequence
atggtgggcgccaaggccggccccagccccggcaccagcctgggcctggcccagcagcatagtggcggatctagtgtattggtcaagtcaccgttctgccagcaggttagcacgagcctgccctgcatctgcagtacacctcggtgcgcggcggttgggctgctactggtaccagctgccgccacactgggaggccccctgagccctcaccctctggccgccgcttgctctactagcagcagcatgtgggggccacagcagtccgccgcttcgtgttgtcaagggcaatag

SEQ ID NO: 45922 - DNA, 1269 bp, Artificial Sequence
  Description of Artificial Sequence: Synthetic coding sequence
accggcagctgctgcgtggaccagctggcctgctgctgcggcagcgctgggtgcagcctctgttgtgactgctgccctagaatccgccagtccctgtccacccggtttatgtacgctctctactttatccttgtagtggtactctgctgcataatgatgagcacaaccgtggctcataagatgaaggagcacattccgttctttgaagatatgtgcaagggaattaaggcaggcgacacttgcgagaagctggtaggatatagcgccgtgtatcgcgtttgcttcgggatggcctgcttcttcttcatcttttgtctgctcaccctcaagattaataacagcaaaagctgccgcgcgcatatacacaacgggttctggttctttaagctgctgctgctcggtgcaatgtgttcaggagcctttttcatcccagatcaggacacattcctcaacgcttggaggtatgttggcgctgtgggggggttcctctttatcggtatccagctgctgttactcgttgaattcgcccacaaatggaacaaaaattggactgcggggaccgcttctaataagctgtggtatgccagtctggcccttgttactttgatcatgtatagcatcgcgaccggcgggctggtactcatggcagtgttttatacccaaaaagatagctgcatggaaaacaagattctcctaggagtcaacggaggactttgtctgctgatctccttggttgccatatccccttgggtgcagaacagacagccgcattccggcctgcttcagagtggcgtgatttcctgttacgtcacataccttactttctcggccttaagttccaagcccgccgaggtcgtgctggatgagcatggcaaaaacgtcaccatctgcgtccccgatttcggccaggacctgtacagagatgagaatctggtgactatccttggaacatcactgctcattggttgtattctttattcctgcctcacgagcacaacaagaagcagctcagacgcactccaaggtaggtacgcagctccagaacttgagatcgcccggtgctgcttctgcttctctcctggcggggaggatacagaggagcagcagcctggcaaggaggggccgcgcgtgatctacgacgaaaaaaaggggacagtgtacatttattcatatttccatttcgtgttctttctggctagcctgtacgtcatgatgacggtcacaaattggttcaatcacgtccggtctgcatttcacctacttccgtag

SEQ ID NO: 45923 - DNA, 1272 bp, Artificial Sequence
  Description of Artificial Sequence: Synthetic coding sequence
atgagcgcccagtgctgcgccggccagctggcctgctgctgcggctctgcagggtgctcgctgtgttgtgattgttgccctagaatccggcagagcttgagcacacggttcatgtacgccttgtactttattttagtagtggtgctatgctgtatcatgatgtccacaactgtggctcataagatgaaggagcacatccctttttttgaggatatgtgcaagggtatcaaggcaggcgacacatgtgaaaagctggttggttactccgctgtttacagagtgtgctttggcatggcatgttttttcttcatcttctgtctcctcacactgaaaattaacaactcaaagtcttgtcgggcacacattcataacgggttctggttctttaagcttctgctgcttggggccatgtgcagtggggccttctttatccccgaccaggatacttttcttaatgcctggaggtacgtgggagctgtagggggttttttgtttattggaatccaactgctgctactggttgaatttgctcacaagtggaataagaactggaccgccggcaccgccagtaacaagctgtggtatgcttctctggctctcgtgacactcatcatgtattctatagccaccggaggcttagtactcatggccgttttctacacgcaaaaggatagttgtatggaaaataagattctcctcggtgttaacggcggcctatgtttgctgatctctctcgttgccatttccccatgggtgcagaatagacagccacactcaggtctgctgcagagcggtgtgatctcttgttacgtgacatacctgacattctcagctctgtcttctaaacctgccgaggtggttctcgacgagcatggcaaaaacgtaaccatttgcgtaccagattttggccaggacctttatcgggatgagaacctggtaactatcttgggcactagtcttctaatcggctgcatcctgtactcgtgtctcacatccactacacgcagctccagcgatgcactccaaggccgctatgcagcaccagagcttgagatcgctcgatgctgcttttgtttttcgcccgggggggaagataccgaggaacaacagccaggcaaggagggacccagagtcatttacgacgaaaagaaaggaactgtatatatttattcttacttccacttcgtattcttcctcgcttctctctatgtcatgatgacagtgactaactggtttaaccatgtaagaagcgcattccacctgttgccctag

SEQ ID NO: 45924 - DNA, 1371 bp, Artificial Sequence
  Description of Artificial Sequence: Synthetic coding sequence
atgagcgcccagtgctgcgccggccagctggcctgctgctgcggcagcgcaggctgcagcttatgctgcgattgttgtcccaggatccggcagagcttgagcactaggttcatgtatgccctttattttatcttagtcgtggtcctgtgctgtattatgatgtccactactgtggcacacaagatgaaggagcatatacccttcttcgaagatatgtgcaaggggattaaggccggcgacacttgtgaaaaactcgtgggttacagcgcagtctatcgtgtctgcttcgggatggcatgtttctttttcattttctgtctgcttaccttaaagattaacaatagcaagtcgtgccgggcccatatacacaatggcttttggttttttaagctactcctgctcggcgcaatgtgctctggcgcgttcttcattcccgatcaagatacttttctgaatgcctggcgatacgtcggggccgtcgggggctttctgttcatcggcatccagttgctgttactggtcgaatttgctcataagtggaataagaattggacggccggtaccgccagcaataaactgtggtacgccagccttgcactggtcacgctcatcatgtactccatcgcaacaggaggactcgtgcttatggcagtgttctatacccaaaaggacagctgcatggagaacaagatcctccttggcgttaacgggggcctgtgtctcttgatttctcttgtggcaattagcccttgggtgcaaaatcgccaaccgcattccggccttctgcagagcggtgttatttcctgttatgtgacctacctgaccttttccgccctttcaagtaaaccagccgaggtcgacgagcatggaaagaacgtgacaatctgtgtgccagattttggccaggacctttatcgagatgaaaacctcgtcaccatcctgggcactagcttgctaatcgggtgcatcctgtactcatgcctgacaagtactacacgatcatcatcagacgcactccagggtagatacgccgcacctgaactcgaaatcgcaagatgttgcttctgtttttcacccggtggggaggatactgaggaacaacagccgggcaaggaagggccgcgcgtcatctatgatgagaaaaagggcaccgtctatatttactcctacttccacttcgtattttttttggcgtctttatatgtaatgatgacagtgactaattggtttaaatggagccccactttgctgccccgattagagtactcgggaatgattttagcacactgtaacctgcacctaccagatgtgaagaggtttagctgcctttcactcccaagcagctgggggtataggcatgtacccccatag

SEQ ID NO: 45925 - DNA, 1386 bp, Artificial Sequence
  Description of Artificial Sequence: Synthetic coding sequence
atgagcgcccagtgctgcgccggccagctggcctgctgctgcggctcagccggctgcagcctgtgctgcgactgctgccctaggatcagacagagtctgtcaacgcgcttcatgtatgcattgtacttcatcctggtggtggtgttatgctgcattatgatgtccaccactgtcgcccacaagatgaaggagcatatacctttcttcgaggacatgtgtaagggcattaaagctggagacacgtgtgaaaagctggttggctactccgcggtgtaccgcgtgtgcttcggcatggcctgtttttttttcattttttgtctgctgacactgaagatcaataacagcaaaagctgccgcgctcacatccataacgggttttggttctttaaactgctgctactgggggcaatgtgctcgggagcattcttcatcccagaccaggatactttcctcaacgcctggaggtatgtgggggcggtcgggggctttctgtttattggaatccaacttctgctgctggtagagttcgcccataaatggaacaaaaattggaccgccggcactgcatcaaacaaactctggtacgcttctcttgctctcgttactctgatcatgtactccatagctactgggggattggtgctcatggccgtattctacactcagaaggacagctgcatggagaataaaattctacttggggtgaatggggggttgtgccttctgatctcactcgtcgccatcagcccttgggtccaaaatcgccagccccactccggtctgctccagagtggggtcatcagctgctacgtgacttacctcaccttctctgccctgagttccaaacctgccgaagtcgtgcttgatgagcacggcaagaacgtcacaatctgcgtgcctgatttcgggcaagacttatacagagatgagaacctggtaactatactggggacatctttactgatcggttgcatcctgtactcttgtctaacatccacaactcggtccagtagtgatgcgctccagggccgctatgccgctccagaactagagatcgctcggtgttgtttttgcttcagccctgggggagaggatacagaagaacagcagcctgggaaagagggcccgcgggtgatttacgatgaaaagaagggaaccgtctacatctattcctattttcactttgtgttcttcctagcctccttgtacgtcatgatgactgttactaactggtttaattacgagtcagccaacatcgagtctttcttttcaggctcctggtcaatcttctgggtcaaaatggcatcctgttggatttgtgttctattatatctgtgtacgcttgtggctcccctgtgctgccccactcgcgaattttctgtgtag

SEQ ID NO: 45926 - DNA, 216 bp, Artificial Sequence
  Description of Artificial Sequence: Synthetic coding sequence
atggccggcatggccctggcccgggcctggaagcagatgagctggttctattatcagtatctgctggtgacagctctttacatgcttgagccttgggaaagaactgtcttcaactcaatgcttgtctcgattgtggggatggcactgtatactggctacgtctttatgcctcaacatattatggccatacttcactactttgaaattgtacaatag

SEQ ID NO: 45927 - DNA, 231 bp, Artificial Sequence
  Description of Artificial Sequence: Synthetic coding sequence
atggacctgcggcgggtgaaggagtacttcagctggctgtactaccagtatcaaattattagctgttgtgcggtacttgagccttgggagcgttctatgttcaacactatccttttaactatcatcgcaatggtcgtctatactgcatacgtattcattcctatacacataagactggcctgggagttcttcagcaagatctgtggttatcattcgacaatatctaattag

SEQ ID NO: 45928 - DNA, 231 bp, Artificial Sequence
  Description of Artificial Sequence: Synthetic coding sequence
atggacctgcggcgggtgaaggagtacttcagctggctgtactaccagtatcagatcatcagctgctgtgctgtgttagagccttgggagcgaagtatgtttaatacgatacttctcaccatcatcgctatggtggtgtacactgcatacgtcttcattcctatccatattaggttggcctgggaattcttttccaaaatctgcggataccactcgacaattagcaactag

SEQ ID NO: 45929 - DNA, 918 bp, Artificial Sequence
  Description of Artificial Sequence: Synthetic coding sequence
atgggccacgccctgtgcgtgtgcagccggggcaccgtgatcatcgacaacaagcgttacctgttcattcagaagctgggagaaggaggtttcagctacgtggatttggtggagggtctccacgatggccacttttacgcactgaagaggatcctgtgccacgaacagcaggatcgggaagaggctcaacgggaggcggacatgcaccgactgtttaaccacccaaatatactgcgactcgtggcctattgcctaagagagcgtggggctaaacatgaggcttggctcctcctgccatttttcaaacgcggaaccctgtggaatgaaatagaaaggcttaaagataagggcaacttcctgactgaggatcaaatcctgtggctgctgttgggcatatgccggggcttggaggcgatacatgccaagggatacgcccaccgcgatctcaaaccaacaaacatactgctcggcgatgagggtcaaccggttcttatggacctcgggtctatgaaccaggcttgcatacatgtggagggatcccgacaggccctgactctgcaggactgggcggcacagaggtgcaccattagttaccgagctcccgagctgttcagcgtgcagtcacactgcgtgattgatgaaagaacagacgtgtggagcctcggctgtgtgctgtacgctatgatgtttggcgaagggccctatgacatggtgtttcagaagggagattctgtcgcattggcagtccagaatcagttgtctattccccagagtcctcgacattcatccgctttacgtcaactgctcaattctatgatgacggtggaccctcaccagaggccacacatccccctcctgctctcccagctagaagccctgcagcccccggcacctggtcagcataccacgcaaatttag

SEQ ID NO: 45930 - DNA, 918 bp, Artificial Sequence
  Description of Artificial Sequence: Synthetic coding sequence
atgggccacgccctgtgcgtgtgcagccggggcaccgtgatcatcgataataagagatacctattcatccaaaagctgggtgaggggggattcagttatgttgacttagtagagggactgcatgatgggcatttttacgccttgaagaggatactatgccatgaacagcaggaccgggaggaagcacaacgcgaggccgatatgcatcgacttttcaaccaccctaacatcctgaggctcgtggcatactgcctgcgtgaacgcggcgccaaacatgaagcttggctgctgcttccatttttcaagaggggaaccctctggaacgaaatcgaacgacttaaagataaggggaacttcctcaccgaagaccagatactctggctgcttctggggatctgtagagggctggaggcaattcatgcgaaaggatacgctcacagggacctgaagcccacgaatatactgcttggggatgaaggacagcctgtgctgatggacttaggcagcatgaaccaggcttgtattcacgttgagggaagtcgccaggcactgactttacaggattgggccgcacagagatgtaccatttcatatcgtgccccagagcttttcagtgtgcagagccattgtgtaatcgatgaacggaccgacgtgtggtcactggggtgtgtgctgtatgcaatgatgtttggcgaaggtccttatgacatggtgtttcagaagggcgacagcgtcgcgctcgccgtccagaaccagctgtcaattccacagtctccccgacatagcagtgcgctgcgacaactgcttaacagtatgatgactgtggacccacatcaaaggccgcacattccactgctgttgagccagctcgaggccctgcaaccaccagcaccagggcagcatacgactcagatttag

SEQ ID NO: 45931 - DNA, 1269 bp, Artificial Sequence
  Description of Artificial Sequence: Synthetic coding sequence
atgggcatgacccggatgctgctggagtgcagcctgagcgacaagctttgcgtgattcaggaaaagcagtatgaggtgataatcgttcccactctgctggtgaccatatttcttattcttctgggcgtcatcctttggctgttcatcagagagcagcgtacacagcaacagcgatccggtcctcaagggatcgctcctgtgcctcccccgcgcgatctgtcctgggaagccggacatgggggtaatgtcgccctccccctgaaggagacatcagtagaaaactttctgggagcaacaacccccgctctggccaaacttcaggtacctcgtgagcaattgagtgaggtgctggaacagatttgtagcggatcctgcggcccgatatttcgggctaacatgaacacaggtgacccctcaaaaccaaagtcagttatcctcaaggccctaaaagagcctgccggtttgcatgaggtccaagactttctcggacgaattcagttccaccagtacctggggaaacataagaacctcgtccagctagaaggctgctgtacagagaaactacctctctatatggttcttgaggatgttgcacagggggacctgctgagctttctgtggacctgcagacgggatgtgatgacaatggatggacttctttatgacctgactgaaaagcaagtctaccatatcggcaaacaggtcctgctggccctcgaatttttacaggaaaagcacctattccacggggacgtggcggccagaaacattcttatgcagagcgatttgactgctaaactgtgcggacttgggttagcttacgaagtatacacaagaggggccatcagttcaactcaaaccatcccacttaagtggctggctcctgagaggctgctattgaggcctgccagcatcagggctgacgtttggtcatttgggatcctcctgtatgaaatggtaacattaggggcaccaccctatcctgaagtgcctcccaccagtatactcgagcacttacagcgaagaaagatcatgaagaggccttcctcctgcacgcatacaatgtatagcatcatgaagtcctgttggaggtggcgggaagcagacaggccaagccctagagagctgagactgaggcttgaggctgcaattaagaccgccgacgacgaagctgtcctgcaagtccctgagcttgtcgtccccgagctgtatgccgcagtggccggtatacgggtagagtcccttttttataattatagcatgctgtag

SEQ ID NO: 45932 - DNA, 198 bp, Artificial Sequence
  Description of Artificial Sequence: Synthetic coding sequence
atgggcatgacccggatgctgctggagtgcagcctgagcgacaagctttgtgtcatccaggagaagcagtacgaagtcattatcgtgccaacacttctagtgaccatcttcctcattctgctcggggtgatcctctggctgtttattagagagcagcgtacccaacagcaaagatccggcccccagggcaaggcttag

SEQ ID NO: 45933 - DNA, 252 bp, Artificial Sequence
  Description of Artificial Sequence: Synthetic coding sequence
atgggcatgacccggatgctgctggagtgcagcctgagcgacaagctgtgcgtaatccaggagaaacagtatgaggtgataatcgtgcccactttgctcgtgaccatattcctaatcctgctgggggtgatcctctggttattcataagagaacagcgtactcaacaacaaaggtcagggccccaaggaatcgctcctgtccccccaccaagagaccttagctgggaggcgggccatggaggaaacgtgtag

SEQ ID NO: 45934 - DNA, 126 bp, Artificial Sequence
  Description of Artificial Sequence: Synthetic coding sequence
atgggcatgacccggatgctgctggagtgcagcctgagcgacaagctgtgtgtcatccaggaaaaacagtatgaggtgattatcgtccccacattgcttgtcactatcttcctgattctgctgtag

SEQ ID NO: 45935 - DNA, 264 bp, Artificial Sequence
  Description of Artificial Sequence: Synthetic coding sequence
atgggcatgacccggatgctgctggagtgcagcctgagcgacaagctgtgtgtgattcaagagaagcagtatgaggtcatcattgtaccgaccttgctagtgacaatctttctgattctgctgggcgtcatactttggctgttcattcgagagcaaaggacccagcagcagcgctccggaccccagggcattgctccagtccctcctccacgggacctctcgtgggaagctggccacggcgggaatgtggccttgccactttag

SEQ ID NO: 45936 - DNA, 324 bp, Artificial Sequence
  Description of Artificial Sequence: Synthetic coding sequence
atgagcgagcccgacaccagcagcggcttcagcggcagcgtggagaatggcacattcttggagctcttcccaacaagcctgagcacctccgtggacccatcctcaggccatctgtccaatgtgtacatctacgtctccatatttctgtctctcctggcctttttactgctgctgttgattatagcgctgcaacggctaaaaaacattataagctcaagcagcagctaccccgagtacccctccgacgccggctcgtccttcaccaacctggaagtgtgctcaatctctagccaaagaagcaccttcagcaatctctcatcctag

SEQ ID NO: 45937 - DNA, 1182 bp, Artificial Sequence
  Description of Artificial Sequence: Synthetic coding sequence
atgcccggccacctgcaggagggcttcggctgcgtggtgaccaaccgcttcgaccagctattcgacgacgaaagcgaccctttcgaagtgctgaaagcagcggagaataagaagaaggaggctggcggaggtggcgttggtgggccgggcgctaagtccgctgcccaggccgcagcccagactaatagtaacgccgctggaaagcagctgagaaaggagagccaaaaagatcgcaaaaacccactgccccctagtgtcggggtggtggacaagaaggaggagacgcagcctcccgttgctctgaagaaagagggcatacggagagtcggaaggcgcccagatcagcagttgcagggggaagggaagatcatcgacagaaggccagaacggcggcctccgagggaacgcaggtttgaaaaacctctggaggagaaaggcgaggggggtgagtttagcgttgaccgtcctatcatcgaccggccgatcagagggaggggcggactcggccgagggagaggcggacgcgggcgaggtatgggaagaggcgatgggtttgacagtagggggaagcgggagtttgaccgccattctggtagcgaccgcagctccttctctcattacagcgggctgaaacatgaggacaagagagggggctctgggagccacaattggggaacggtcaaggacgagctcacggaccttgatcagtcaaatgttacagaagaaaccccagaaggagaggagcatcatcccgtcgcggacaccgaaaataaagagaatgaagtcgaggaagtgaaggaggagggtcctaaggagatgacgttagacgaatggaaggctatccagaacaaagatagagcaaaggtggaatttaacatacgaaaaccaaatgagggcgctgacggacagtggaaaaaaggattcgtgctccataagagtaagtccgaggaggcccatgctgaagattcagtcatggaccatcattttcgtaagcctgccaatgatatcactagccaactcgaaattaatttcggtgatctggggcgcccaggaagaggcgggcggggaggacggggggggcgtgggcgggggggacggcccaaccgcggttcaaggactgacaagagcagtgccagtgctccggatgtggatgacccagaagccttccccgccctcgcgtag

SEQ ID NO: 45938 - DNA, 1209 bp, Artificial Sequence
  Description of Artificial Sequence: Synthetic coding sequence
atgcccggccacctgcaggagggcttcggctgcgtggtgaccaaccggttcgaccagttatttgacgatgagagcgacccttttgaagtgctgaaagccgctgagaataagaaaaaagaggctggtggtgggggcgtgggaggccccggcgcaaaatcagctgcacaggcagctgctcagacaaattctaatgccgctgggaagcaactacgtaaggagtcccagaaagatagaaagaatcctttaccaccttccgtgggtgtggtagacaagaaggaggaaactcagccgccggtggcgttaaaaaaggagggaatccggagggtcggaaggaggcctgaccaacagttacagggggaaggaaagattatagacaggagacccgagaggaggccaccacgcgaaaggagattcgaaaaaccgctcgaggaaaaaggcgaaggcggtgagttttccgtggatagaccgatcattgacagacctatacggggccgaggcggtctcggaagagggcgtggcggacgcggaaggggcatgggtcgcggcgacggctttgatagtagaggtaagcgcgaattcgatcgccactcgggcagcgaccggtctggactcaaacacgaggataagcgcgggggctcagggagtcataactggggaactgtcaaggacgaacttaccgaaagcccaaagtacatccagaagcagatttcatacaattactccgacctggatcagagtaatgtgaccgaggagacccctgagggtgaggaacaccaccctgtagccgatactgaaaataaggaaaatgaggtagaagaagtcaaagaagaggggcccaaggaaatgaccttggacgaatggaaggctatccagaacaaagacagggccaaagtggaattcaacattagaaagcccaacgagggggcagacggtcaatggaagaaaggcttcgttttacataaatccaaatcagaggaggcccatgccgaggactccgtgatggaccaccacttcaggaagcccgccaatgacatcacatcccagctggagattaacttcggggatctagggcggcccgggagaggaggaagaggcggccgggggggccgtggcaggggaggaaggcccaatagggggtcaagaacagacaagagcagcgcaagcgcaccggatgtcgatgaccctgaagcttttcccgctctcgcctag

SEQ ID NO: 45939 - DNA, 1164 bp, Artificial Sequence
  Description of Artificial Sequence: Synthetic coding sequence
atgcccggccacctgcaggagggcttcggctgcgtggtgaccaaccgattcgatcagcttttcgacgacgaatccgatcccttcgaagtgttgaaggcggccgagaataaaaagaaggaggctgggggcgggggggtcggagggccgggagcgaaaagcgccgcccaagccgccgctcagacaaactctaatgctgcaggaaagcagcttcggaaagaaagtcagaaagaccgtaaaaaccctctgcccccttctgtaggcgtggtcgacaagaaagaagagacacaaccaccagtggcgctgaaaaaggaggggatacggcgggttggcaggcgccccgaccaacagctacagggtgagggcaaaatcatcgatagacgccctgaacgcagaccaccccgggagagaagatttgagaagcccctagaggagaaaggcgagggaggggagttctccgtagacagaccaatcattgaccggccaatcagaggccgtggaggactcggacgcggtaggggcgggcgcggccgaggcatgggccgtggggacgggtttgactctagagggaagagagagttcgatcggcatagcggctcagaccgcagtgggctgaagcatgaggataagcggggtggtagcggctctcataactggggaacggtgaaagacgagctgaccgacctcgaccagagtaacgtgacagaggaaacgcctgaaggtgaagagcatcaccctgtcgcagacaccgagaacaaggaaaacgaggtcgaggaggtgaaggaagaaggtccgaaagagatgaccctggacgaatggaaggctattcagaataaagaccgggcaaaagtggaattcaacatacgcaagcccaatgaaggcgctgatggacaatggaagaaagggtttgtgctgcacaagtcaaagtcagaggaagcccacgctgaggactctgtaatggaccatcattttcgcaaaccagcaaatgacatcactagtcagttggaaatcaactttggagacctgggccgaccaggtcgtggcggaagaggcgggcgggggggcagggggcggggaggtagacccaaccgagggagtagaactgataagtctagcgctagcgctcctgacgttgatgacccggaagcatttccagccttggcatag

SEQ ID NO: 45940 - DNA, 1227 bp, Artificial Sequence
  Description of Artificial Sequence: Synthetic coding sequence
atgcccggccacctgcaggagggcttcggctgcgtggtgaccaaccggttcgatcaattgtttgatgatgagtccgatcctttcgaagtactcaaagctgctgaaaacaagaagaaggaggccggcggcggcggtgtgggtggaccaggggcaaaatccgcagcacaggcagcagcccagaccaattcaaatgccgcagggaagcaattaagaaaagaatctcagaaggatcgaaaaaaccctctgcccccaagcgtgggggttgtggacaaaaaggaagagacacaacctccagtagcactcaagaaggaaggaataagacgagttgggagaaggcccgaccagcaactgcaaggcgagggaaagataatcgatcgccgccctgaacgccggcctccccgggagaggcgattcgagaaacccctcgaggagaagggcgaaggaggcgaattcagtgtcgatagaccaatcatcgatcgcccaatcaggggtcgcgggggccttggacggggccggggggggaggggaaggggcatgggtagaggtgatgggtttgacagtagggggaaaagggagtttgatcggcactccggtagcgaccgctcttcatttagccattatagtggcttaaagcatgaagacaagcggggtggcagcgggtcccataactggggcaccgtgaaagatgaactgacagaatctccgaagtatatacagaaacaaatttcatacaattacagcgacctggaccaaagcaatgtgactgaagaaacacctgaaggcgaggagcaccatccagtggccgataccgaaaacaaagaaaatgaggttgaggaagtcaaggaggagggcccaaaagagatgaccctggatgagtggaaagccatccagaacaaggatagggcgaaagttgagtttaacatacggaaacctaatgagggcgctgatggccagtggaaaaaagggtttgtgttgcataagtccaagagcgaggaagctcacgccgaagattcagtgatggaccaccatttcaggaagcccgccaatgacataacctctcagctggagatcaattttggagacctgggccgcccaggcagagggggcaggggtgggcgggggggaaggggacggggaggtagacccaacagggggtcccgcaccgacaagtcctctgcttctgcccccgatgttgacgatccggaagcctttcccgcattggcgtag

SEQ ID NO: 45941 - DNA, 813 bp, Artificial Sequence
  Description of Artificial Sequence: Synthetic coding sequence
atgttcttcagcctgcaccgggagacccccaaggagggcatgttcggcgcgaaccttaccactttccatccgacgctgttcatactcctcgggataccaggactggagcagtaccatatctggcttagcattccattctacctgatgtacataaccgccgtattggggaatggagccctaattctggtagtactgagcgagcatacactacacgtttttctgtccatgctggctggcactgatattttactgtcaaccactaccgtccctaaagcactggccatcttttgggtgcatgcaggtgaaatcgctttcgatgcgtgcatcactcaaatgtttttcatacacgtggccttcgtggctgaaagcggcattctgctggccatggcatttgattcatatgttgcaatttgcacgcctttgagatacactacaattctgacctctatggtcaatggtaagatgaccctgaccatttggggacagagcattggcaccatttttccagtaatttttctactcaagcggttgccctactgccagaccaacatcatcccacactcctactgtgagcatatcggcgtcgcacagcttgcgtgcgctgacattacagtcaacatctggtacggcttctccgttcctatggcaagcgtgctggtagatgtcgctttcatcggcttttcttacacactgatcctccaagccgtgtttagactgccttctcaagagtcacagcataaggcactaaacacatgcggctcgaccttggagttgttctccagcagtagctcacatcatttcctgctgtcctag

SEQ ID NO: 45942 - DNA, 678 bp, Artificial Sequence
  Description of Artificial Sequence: Synthetic coding sequence
atgttcgccggcatggacaccttcctgctggccgtgatcgcctacgaccggtttgtggccatatgccatcccttgcagtacatggtgataattaaccctcacctgtgtggtctgctggtcctggcttcttggttcattattttctggttcagcctggtgcatatattgttgatgaagaggttgacgtttagcaccgggaccgagattccacatttcttttgcgagttggctcaagtgttgaaggtggctcgctccgatgctttgctgatcaacatagttctctacgtggcaatggccctgttaggggtctttccggtggccggaatcttgttcagctactcccagatcgtgagcagcctgatgaggatgtcaagcacggaaggtaaatacaaagcctttagcacctgcgggagccatctctgcgttgtcagccttttttatggcacggggctgggagtatacctgagctccgccgtgacgcactcaagtcagagctctagcatggccagcgttatgtacgctatggtgacaccaatgttgaatcccttcatctactctcttcggaataaggacgtgaaaggcgcccttggccgactgctcagccgggctgcctcctgcctgctgaggtacacaacctctgaactgcgcggatgctatggaagtctcaaacaaatgtag

SEQ ID NO: 45943 - DNA, 480 bp, Artificial Sequence
  Description of Artificial Sequence: Synthetic coding sequence
atggagaagctgcggcgggtgctgagcggccaggacgacgaggagcagggcctgacagcacaggtgttagacgcgagtagtttgagtttcaatacccgccttaaatggtttgccatttgtttcgtttgcggagtctttttttccatccttggtacggggctcctctggctgcccggcggtataaaactgtttgctgtcttttacactcttggtaacctcgccgctctcgctagtacgtgctttctcatggggccagtaaaacagctcaaaaagatgttcgaggcgacacgcctgctggctaccatcgtgatgcttttgtgtttcatctttacattatgtgcggctctgtggtggcacaaaaaaggcctcgctgtgctcttctgtattctgcaattcttgagcatgacttggtacagtctatcctacataccttatgccagagatgcagtgattaaatgctgttcttctcttctgagctag

SEQ ID NO: 45944 - DNA, 483 bp, Artificial Sequence
  Description of Artificial Sequence: Synthetic coding sequence
atggacaagctgaagaaggtgctgagcggccaggacaccgaggaccgtagcggcctctctgaggtcgtcgaggcttcctcgctctcctggtccactagaattaagggcttcatcgcatgtttcgctatcgggattctgtgcagcctcctcggcaccgtgttactgtgggtgccaagaaagggtctgcacctgttcgctgtgttctacacgttcgggaacattgcctcgataggctcaacaatctttcttatgggacctgtgaaacagctaaagcggatgtttgaacctacccgccttattgctaccattatggtgctgttatgtttcgccctaacactgtgctccgcattctggtggcacaacaagggtctcgccctcatcttctgcattcttcagtcactggccttgacatggtattcattgtcatttattcctttcgctcgggacgcagttaaaaagtgctttgccgtttgtctggcatag

SEQ ID NO: 45945 - DNA, 327 bp, Artificial Sequence
  Description of Artificial Sequence: Synthetic coding sequence
atggacaagctgaagaaggtgctgagcggccaggacaccgaggaccgctccggcctgagcgaggtcgtggaggcaagctccctgagttggagtacacgcattaaagggtttattgcatgttttgccatcggcattttgtgcagcctccttggtaccgtactgctgtgggtgccaagaaaaggtctgcacctgtttgcggttttctataccttcggcaacatcgcgagcatcggtagctgtgttctccaccttccttgcgtgctgccctttggaggaatcactcgggatctgcatctgtcttctgccttctgttccctgtggcactag

SEQ ID NO: 45946 - DNA, 327 bp, Artificial Sequence
  Description of Artificial Sequence: Synthetic coding sequence
atggacaagctgaagaaggtgctgagcggccaggacaccgaggaccgttcagggctcagtgaggtggtagaggcatcatcattatcgtggtccaccaggatcaaaggcttcattgcctgtttcgccattggaattctttgcagtctgttaggcaccgtactcctctgggtgcctcgaaaaggtctgcatctgttcgctgtgttttacacgtttgggaatattgccagcattgggtcttgcgtgctccatttaccatgtgtgctgccattcggtgggataaccagggatttgcatctctcaagtgcattctgttccttgtggcactag

SEQ ID NO: 45947 - DNA, 648 bp, Artificial Sequence
  Description of Artificial Sequence: Synthetic coding sequence
atggccgacctgcaccggcagctgcaggagtacctggcccagggcaaggcggggggacctgcagccgcagagcccctcctggctgctgaaaaagcggaagaacccggtgaccgcccagcggaagagtggctagggagggctggcctccgttggacctgggcaagatcccccgccgagtctgccgccgccggcttgacttgcctcccaagcgtcacgcggggccaaaggctggcagccggtggaggatgtctcctgctcgctgcattgtgcttcgggttagctgccttgtacgccccggttctgttactgagggcacgcaaatttgccctgctgtggtccctaggaagcgccctcgccctcgctggttccgcactgctgaggggcggcgccgcatgcgggcgcctgctgaggtgtgaggaggccccctctaggcccgccctgctttatatggccgctttgggggccactttgttcgcagcgctggggcttcgttctacactcttgacggtattgggcgctggcgcccaggtggcagctttactcgctgccctggtgggactgttaccatggggcggaggaacagctctccggcttgcgttaggaagacttgggcgtggcgccggtctggcaaaggtgctgcccgtttag

SEQ ID NO: 45948 - DNA, 6486 bp, Artificial Sequence
  Description of Artificial Sequence: Synthetic coding sequence
atgacccacagccccgccaccagcgaggacgaggagcggcacagcgcaagtgaatgccccgaaggcggcagtgagtcagatagctccccggacggcccaggcagagggccacggggcacaagggggcagggaagtggcgcgccaggatctctggcgtccgttagggggctgcaaggacgttctatgtctgtgccggacgatgcccactttagcatgatggtgtttaggatcgggatcccggacttgcaccaaactaaatgcctcaggttcaaccccgatgcaacaatctggactgcgaaacagcaggtgctgtgcgcattgtcagagagcttgcaagatgttctgaattacgggctgtttcaacccgccaccagcggcagggatgctaactttcttgaggaggaacggctgctgcgtgagtatccccagtccttcgagaaaggcgtaccatacctagagttccgctacaagactcgggtctacaaacaaactaatctggacgaaaagcagctagcaaagctccacaccaagaccggattaaagaagttcttagagtacgtacagctcggcaccagcgacaaggttgctagactgctagataaagggttggacccgaattaccatgactccgactcgggggagaccccccttactctggcggctcaaactgagggatctgtggaagtcattcgcaccctctgcctgggaggagcccatattgacttcagggcacgcgacgggatgacagcgctgcataaagctgcctgtgcccgccattgtctcgcactgaccgcactactggacctgggcggcagcccgaattacaaagaccgcagagggctgaccccgttattccatacagcaatggtcggtggtgacccgagatgttgtgagcttctgttgttcaacagagcccagctcggaattgcagacgaaaacgggtggcaggagattcaccaggcttgccagcggggacattcccagcatctggaacacctgctcttctatggtgccgaacctggcgctcagaatgcctctgggaacacagcacttcacatctgtgcgctgtataacaaagagacttgcgcacgaatcctcctgtatcggggtgcagacaaagatgtgaagaataacaacggtcagacgccctttcaggttgctgtgatcgccggcaatttcgagctcggagaactgattcgtaatcatcgcgagcaggatgtggtccccttccaggagagtccaaaatatgccgcaagacggagggggccgccaggaactggactgacagtcccaccagcccttcttcgagctaatagcgacacatccatggccctacctgattggatggtgttctcagcacctggggcggcatctagcggtgccccgggacctacgagtggctcccagggccagtctcagcccagcgctcccaccaccaagctgagcagcgggaccctgaggtctgctagcagcccaaggggagctagagccagaagcccctccaggggccgtcaccccgaggatgccaagcggcagccccgcggtcgtccaagcagcagcggtactcctcgggagggacccgccgggggaaccggaggaagcggcggccccggcggttcattaggttcccggggaaggagacggaagctgtactcagctgtgcccggaagatcttttatggcggtcaaaagctaccaggcccaggccgagggagagatctctctcagcaaaggagagaagattaaggtcctgagcatcggcgagggtgggttctgggaagggcaggtaaagggaagggtcggttggttccccagcgattgccttgaagaagtggccaacagatcacaggagtcaaaacaggagtcaaggagtgacaaagcaaagagactgttccggcactacacggtcgggtcttacgatagttttgacgcccccagtctgatggacggcatcggcccaggatccgactacattataaaagaaaagaccgtcctcctccagaagaaagattctgaagggttcggattcgtgttaaggggggcgaaagctcaaacccctatcgaggagttcactccgacaccggcttttccagccctccagtatctggaatctgtcgatgagggaggagtggcctggcgtgcgggcctccgcatgggcgacttcttaatcgaggtgaatgggcagaacgtcgtgaaagttggtcatagacaggtcgtgaatatgattagacagggcggcaataccctaatggtgaaggtggtcatggtaacccggcatccagacatggacgaggctgtccacaaaaaagcgccgcagcaggcaaagcgcctcccaccacctacaatctccttgcgcagtaaatccatgacctctgaattggaggaaatggagtatgagcagcagccggcaccagtgccctcaatggagaagaaacgtacagtgtaccagatggctctgaacaagcttgacgagatcctggccgcagctcagcaaactatatccgcttctgagtccccagggcctggcgggctcgccagcctgggtaagcaccggcctaaggggttcttcgccacagagtcctcgtttgacccgcaccaccgagctcagccatcctacgagcgcccttcattcttgcctccaggccctggtttaatgctgcgacagaagagcattggcgccgcagaagacgacagaccgtacctggcgcctcccgccatgaaattcagtagaagcctgagtgttccaggttctgaggatatcccaccacctcccacgacatcccccccagagcctccatatagcacacctcccgttccaagtagttctggcaggctgactcctagtccccgaggaggccctttcaacccgggcagtggtggacccctgcccgcatctagcccggcctcctttgacggcccatctccccccgacacaagagtggggagcagggaaaagagcctgtatcacagtggtcccctgccacctgcgcaccatcacccacctcaccaccaccaccatcatgctcccccccctcagccacatcaccaccatgcccaccccccgcaccccccggagatggaaacaggaggctcacctgatgatcccccgcccagactcgcccttggcccgcagccctcgctcagagggtggagaggcggtgggccgtctcccactcctggtgcgccctctccgagccatcacgggagcgccggtggggggggcggcagcagtcagggccctgcgctacggtacttccagctgcccccaagagcggcaagtgctgcaatgtatgtcccggcccggtcaggacgagggcgcaaaggaccacttgtgaaacaaaccaaagttgaaggcgaaccccagaaagggggcggcctgcccccagccccctcccccacttcccccgcttccccgcaaccaccccccgctgtcgccgcccctagcgagaagaatagcattcctatccctactataataattaaagcccccagtactagcagttccggccggtccagccaggggagtagtaccgaagccgaacctccaactcagccagaacctaccggcggtggcggggggggtggctctagtccgtcgcctgcccccgcgatgagtccggtccccccttcaccatctccagttccgacgccggcctccccaagcggccccgcgacgctggattttactagtcagtttggagctgcactggttggagcggccaggcgggaaggtggttggcagaacgaagcacggcgccgctctactctcttcctatctacagacgcaggcgatgaagacgggggggacggcggtttagggaccggagctgctccaggacctagactgcgacatagcaagagtattgatgagggcatgttcagcgcggagccttatctgaggctggagagcgctggctctggagccgggtacgggggttacggcgctgggagtcgtgcctacgggggaggtggtggatcaagcgctttcacctccttcctgccacccaggccacttgtgcacccgctcaccggaaaagcactggaccccgcttctcctttgggcttggctctcgccgcacgcgagagggcgctaaaggagtcgtccgagggcggaggcgctcctcagcccccccccagaccccccagtcctagatatgaggctccacccccgacccctcatcatcactccccacacgcgcaccacgagccagtgttacggctctggggggcttctcccccggatcccgcacgccgggagctgggctaccgggcaggactaggctcgcaggagaagtctctgccagccagtcccccagcagcccgtcgctccctgctccataggctgccacctacagcacctggagtcggcccactcctgttacagctcgggacagaaccacctgctcctcaccctggcgtgagcaaaccctggagaagtgcggctcctgaagagcctgaaagactgcctctccacgtgcgttttctggagaattgccagcctcgggcccccgttacctccggaagagggccaccatctgaagacgggccgggagtgcccccaccctcacctaggcgaagcgtaccgcctagcccaacttccccgcgcgcttcggaggaaaacggactccctctgttagttcttcctcctcctgctccttctgtcgacgtggaggatggggagtttctgtttgtcgagcctcttccccccccactggaatttagtaactcttttgaaaagcccgagtcaccactgactccaggcccgccccatccattgcccgatacccctgccccggccacgcctcttccaccagtcccaccccctgccgttgcagcagccccccctacccttgattctaccgcgagtagcctgactagctatgattctgaggtggccaccctgacacagggtgccagcgcagcaccaggtgatcctcacccgcccgggccaccagcgcccgctgcccctgcacccgccgcgcctcagcccggtcctgacccaccaccgggtaccgattccggcattgaagaggttgatagcagaagtagttcagatcaccctctggaaacaatctcatccgctagtacactctcatccctttccgctgaaggcggtgggagtgccggcgggggcgggggagcaggggctggagtcgcatcggggcccgaactgctagacacttatgtggcctatctagacggccaggcatttggaggatctagcactcccggaccgccgtatcctccgcagcttatgacccccagcaaactcagaggaagggctctcggggcatcgggaggactgcgtcccggtccgtctggtggcctacgggatcccgtcacacctacttctcctacggtgtcagtgacgggcgctgggacagatggtctgttagcactccgggcctgttccggcccacctaccgccggggtggctggagggcctgtagctgtcgaaccggaagtcccgcccgttccgctgccgactgcctcaagtcttcctcgtaaactgctcccctgggaggagggccccggccctcctccccctcccctcccaggacccctcgcgcagccccaggcatccgcactggcaactgtcaaagcatctattatttctgaactttcttcgaaactgcagcagttcggtggctcatcagcagctgggggggccctcccatgggcccgaggtggctctggcggcggaggcgattcacaccatggcggggcaagctacgtgcccgagagaacctcatccttacagcggcagcggctgagcgacgattcacagagtagtcttctgagcaaaccggtctcatccttattccagaactggcctaagccgcccctgccacccctgcccaccggcacaggggtatctcctacagctgctgccgcgccaggggctacatcccccagcgcttcctcaagctctacatctacaagacacctgcagggagtggagttcgaaatgcgccctcccctgttaaggcgggccccatccccctcactgcttcccgccagtgaacacaaggtgagtcccgcccccagaccttctagcctgcccattctgccctctgggcctctctaccctggactgtttgacattcggggatctcctaccggcggagcgggaggaagcgcggatcccttcgcgccagtcttcgtgccaccccacccaggcatttctggaggcctagggggcgcactctccggtgccagtcgttctttatccccaacacgactcctgtctctcccgccggataagccttttggcgctaagccattggggttttggacaaaatttgatgtggcagactggctcgaatggctaggcctggccgagcatagagcacagtttcttgatcatgagattgacggctcccatctgccagctcttacaaaggaggactatgtcgacttgggcgtaacgcgtgtaggccaccggatgaacattgacagagccctgaaattctttctggagcgctag

SEQ ID NO: 45949 - DNA, 6459 bp, Artificial Sequence
  Description of Artificial Sequence: Synthetic coding sequence
atgacccacagccccgccaccagcgaggacgaggagcggcacagcgcttccgaatgcccggaaggtggctcagagtccgacagttctcccgatggcccgggtcgagggccgcgaggcaccagaggccagggctcaggcgcgcctgggtccctggcctcagtgcgggggttgcaggggcgctctatgagcgtgccggatgacgctcatttttcgatgatggtttttagaatcgggattcctgaccttcatcaaacgaaatgcctccgcttcaaccctgatgccaccatctggacagctaagcagcaggtcttatgcgcgctttcagaatccctgcaggacgttctaaactacggcctgtttcagcccgctacatcaggccgcgacgcgaacttcttagaagaagaacgattgctaagggagtacccgcagtctttcgaaaaaggggttccctatctggagtttagatacaagaccagagtgtacaagcagacgaatctcgacgagaaacagctcgccaagttgcacaccaagaccgggttgaagaaattcctagaatacgttcagctgggtaccagtgacaaagtagcaagactgctggacaaagggttggatccaaactaccacgacagtgacagcggggagacaccactgaccctggcagctcagactgagggctctgtcgaggtcatccgcacactgtgtctcggaggcgcccatatagacttccgtgcacgagatggcatgacagccctccataaagcagcatgtgcacgccattgcctggccttgacggcactgctggacctgggaggttcgcccaattacaaggatagaagagggctaaccccgctctttcacacagccatggttggtggtgatcctaggtgctgtgagcttctgctgttcaatagggcccagttagggattgccgacgagaacggctggcaggaaattcaccaggcctgtcaacgcggtcacagtcagcatctcgaacatctcttgttctatggcgctgaaccaggagctcagaacgcctccgggaatactgctctccatatatgcgctctctataacaaagaaacctgcgcgcggatcctattgtatcgcggcgcagacaaggatgtaaaaaacaacaatgggcagaccccattccaggttgcagttattgcaggaaactttgaactcggggaattgatcagaaatcaccgcgaacaagacgtagtgccgtttcaagaatccccaaagtacgccgctcggaggcgtgggcctccagggacaggcctgaccgtcccacctgcccttctccgcgctaattcagatacctctatggccttacctgattggatggtcttctccgctccaggggctgccagttctggcgctcccggcccgacttcaggctcgcaggggcagagccaaccaagtgcccctactaccaagctttcgtctggaaccttgaggtctgcatcgagcccccgtggagccagagctaggtcaccctcgcgaggacggcaccccgaggacgctaaacgccagcccaggggccgccccagttcctcaggaacccctcgcgagggtccggccggggggactggtggcagcggaggaccgggtgggtcattgggatcgaggggtagaagaagaaaactgtactcggcagtgcccggcagatccttcatggctgttaagagttaccaagcgcaggcagagggagaaattagcctgtcaaaaggagagaagatcaaggtcctgagtattggagaaggagggttctgggagggtcaagtaaaaggcagagtggggtggttccccagcgactgtctcgaagaggtagccaataggagtcaggaatctaagcaagagtcacgaagcgacaaggctaagcggctgtttcggcactacacagtaggctcctatgactcctttgatgccccaagcgattacattattaaagagaagacagtgctgttgcagaaaaaagactctgaaggctttggattcgtcctgcggggggccaaggctcaaactcccattgaggaattcactccgacacccgcttttccagcattgcaataccttgaaagcgtggatgaaggtggtgtcgcttggcgggccggactccgtatgggggacttccttatagaagttaacggccagaacgtggttaaggtgggccaccgacaagtggtgaatatgatccggcagggggggaacacactgatggtgaaggtggtgatggttacaaggcacccagacatggatgaggccgtacacaaaaaggcccctcaacaggccaagagacttccaccgcccactattagtctgcgatcaaagtctatgactagtgagcttgaggaaatggaatatgagcagcagcccgccccagtgccctcaatggagaagaagcgcaccgtataccagatggctctaaataagttggatgaaatcttggctgccgcacaacaaacaatatccgcatccgagagcccaggaccaggaggccttgcttcgctgggaaagcatcggcctaaaggattttttgccactgaaagcagcttcgatcctcatcatagagcccagccctcctatgaacggccgagttttttgccaccaggacctgggcttatgcttcgacagaagtctatcggagccgcagaggatgatagaccctacttggctccgccagctatgaaattttcaaggagcttaagcgttcctggcagcgaagatatccccccccccccaacaacaagcccgcctgaacccccttactcgactccccctgtccccagttcaagcggacgattaacgccgagtcctcggggcggccctttcaacccagggtctggaggacccctgcccgccagcagcccagcctctttcgacgggccgagcccaccggacacgcgagtcggttctcgcgagaaatctttgtaccactctggaccactgcctccagctcatcaccatccgccccaccaccatcatcaccacgccccgcccccacagccccaccaccatcatgcccacccgcctcaccccccggaaatggagaccggaggatcacccgatgaccctcctccaaggctggcgctaggtccccagccatccctgcgtgggtggagaggcggcgggccatcaccaacacctggagctcccagtcccagtcatcacgggtcagcagggggaggtggaggatcctcccaaggaccggctcttcgctattttcagctaccaccacgggccgcctcggctgccatgtatgttccggcaagatccggtaggggtcggaagggccctctggttaagcagaccaaagtcgaaggggaacctcaaaaaggaggcgggcttcccccagcccctagcccaacaagtcctgcaagcccccaaccaccacccgctgtggcagcgccgtccgagaagaatagcataccgatccccacaataatcattaaggcgcctagtacatcgtcctccggccgctcatcacaagggtcctcgactgaggctgaaccacccacgcagcccgagcccacaggaggtggagggggaggcggcagctcaccatcacccgcacctgccatgagccccgtaccacctagcccatctccagttcccacccctgcttcacctagcggaccagcaactctggatttcacatcacagtttggtgccgccctcgttggcgctgctaggagagaaggcggatggcagaacgaggctagaagacgaagcaccctcttcctgtctacagacgctggggacgaggatggtggagacgggggactgggaacaggcgcagcaccagggcccagactgcggcatagcaaatccattgatgagggaatgttctccgctgagccctatttgcgattggagtcagccgggtctggagccggctatggaggctatggcgctgggtctcgtgcctacggaggaggagggggaagttccgcctttacatccttccttcctcctaggccccttgtgcaccccctgacagggaaagcactagaccccgcctcccccctgggtcttgcattagctgctagggaacgagctcttaaggagagctccgaaggcgggggagccccacaacctccaccgcggcctccctccccgaggtacgaggcccccccccccactccccatcaccactctccacatgcccatcatgaaccagttttgcgactctggggggcatctcctccggaccctgcgaggagagagctggggtaccgagccgggttaggctcacaggagaagtccttaccggcctctcccccagctgccaggagaagcttgttacaccggttgcctcctactgccccaggcgttgggcccctcctgctccagctcggtacagaaccgcctgccccccatccaggcgtgagcaagccatggagatccgccgctcctgaagagcccgagaggctgccactgcacgtgagattcctggaaaattgtcagcctcgagctccagttacaagtggcagaggccctccctccgaggatgggcctggggtacctccaccctccccaaggaggagcgttccgccatcacctacatccccccgggctagcgaggagaacgggctgcccctactcgtccttcccccgccagcccccagtgtcgacgtggaggacggtgagtttttgtttgtggagcctcttccacctcccctggagttctctaattctttcgagaaacctgagtcgccgctgacaccaggtcctccccaccccctcccggacactcctgcgccagcaacccctctgcccccggtgccgcctccggcggtggcagctgcaccccctaccctcgacagcactgccagtagcctgacttcttacgatagtgaggtggccacgctgactcaaggggcctccgctgcacccggagatccccacccgcctggacccccagctccagctgccccagcacctgcagcaccgcaacccggcccagatcccccacctggcacagattcggggatcgaagaagttgatagtaggtccagctcagatcacccactcgagactattagcagtgcaagcaccctaagcagtttaagcgccgaaggcggaggctccgccgggggtggggggggggccggtgcaggagtggcttccggtcccgaactgctggatacctatgtcgcgtacctggatggccaggcattcggaggttcttccacccccggtccaccatatcccccacaactcatgacacctagtaaactgcgggggcgtgcgctgggggcctccgggggtctcagacccggaccttcagggggtctgcgcgacccagtgacacccacctccccaacagtatctgtgacaggcgccggaacagatgggctgctcgcattgcgggcttgctctggcccccctacggccggagtggcgggaggcccagtagccgtcgagcccgaggtgcccccagttccactcccaacggccagttctttgcctagaaagctcctcccatgggaggaaggccctggcccaccccctcctccgttacctggacctctggcccaacctcaagccagcgctctggctactgtcaaggcctctattatttccgagctgtccagcaagctgcagcagtttgggggatcatccgcggcaggaggcgcgctgccctgggcccggggcggctccggtggtggcggagatagccatcatggcggcgcgagttacgtcccagagagaacctcatctttacagcgtcagaggctgagcgatgactcccagtcctcgctcctctccaagcccgtctcttcactcttccagaattggccaaagccgcccctgccacctctgcccactgggaccggagtgtctcccactgccgccgccgccccaggcgctacctctcccagtgcgtcctcatcttctacatccacacgacatctgcaaggcgtggaattcgaaatgaggccaccattgctcagacgtgccccatcgccatctctacttcctgccagcgagcacaaagtgagccctgcccccagaccgtcctcattacctattctcccttcgggtccgctgtacccaggactattcgatattaggggcagtccgaccggaggggccggtggcagtgcggatccgttcgctcctgtgttcgtgcctcctcacccagggatctcaggcggactggggggggcattgagcggcgctagtagaagcttgtctccaactcgactgctcagtctgcctccagacaaacccttcggagcaaaacccttaggattctggacgaagttcgacgtcgcggattggcttgaatggctgggacttgccgaacatagggcccagttcctggaccacgagattgacggcagccacctgccggccttgaccaaggaagattacgtggatcttggagtgacccgggtgggccacagaatgaacattgaccgggcacttaagttcttcctcgaacggtag

SEQ ID NO: 45950 - DNA, 4647 bp, Artificial Sequence
  Description of Artificial Sequence: Synthetic coding sequence
atgcagctgatggccctggagcagcggttcggcagcggcctgcccggcggcggacagccgctgtgtttgatgatgtctagcccattgcctccacctccaccacatttcagctgtcttcccgcctccgattacatcatcaaagagaagactgtgctcctgcagaagaaggatagcgaaggctttgggttcgtcttgagaggcgcaaaggcccagacgcctattgaagaattcacacctacccccgcattccctgccttgcagtacctggagtctgttgacgagggtggcgtcgcctggagagccgggctgcgaatgggggatttcttgattgaagttaatggccaaaacgtggtgaaggtgggacatcgacaggtggtcaatatgatccggcagggcggaaataccctgatggtgaaagtagtgatggttacgagacatccagatatggacgaggcagtgcacaaaaaggccccccagcaggccaaacgactgcctccacccacaatttcactacggagcaagtccatgacctcagagctcgaggagatggagtacgagcagcagcctgctcctgtgccttcaatggaaaaaaaacgcacagtgtaccaaatggctttgaacaaactggacgagatcctggccgcggcccagcaaacaatcagcgcatctgagagcccaggccccggcggattagccagtctgggaaaacacagacccaaggggttttttgcaaccgagagtagctttgaccctcatcatcgcgcacagccaagttacgagcgcccttcgtttttgcctcctggtccagggttgatgctaaggcagaaaagtattggcgccgccgaagacgacaggccttatttagcccctcctgctatgaagttttctaggagcctgtcagtacccgggtccgaagacattccacccccaccaaccacatcaccgccggagcccccctattcaactccccccgtccctagcagcagcggtcgtctgactccatctcccaggggcgggcctttcaatccaggcagtgggggacctctaccagctagttcaccagccagtttcgacgggccaagccccccggatacccgggtcggctccagagaaaagagcctttaccactccggccccctgcctcccgcccaccaccaccccccacaccatcatcaccatcatgccccacctccccagccgcatcaccatcatgcgcacccacctcaccctcctgagatggagacaggtggctcgcctgacgaccctccaccccggctggccttgggcccccagccatcacttcgcggctggagggggggtggcccatcccccacaccaggcgccccttcaccaagccaccacgggtctgcaggggggggaggtgggagcagccaagggccagctctccgatatttccagctcccaccaagggccgctagcgctgccatgtatgttcctgctcgtagcggaagaggccggaaggggcccttagtaaagcagaccaaggtggaaggtgagccacagaagggcgggggcttgcccccagcgccatctcctacgtcgccggcctccccccaaccaccgccggccgtcgctgctccctccgagaaaaattcgatccccatcccaacgatcatcattaaagcccccagcactagtagcagcggcagaagctcccagggctcctccacggaggcagaaccgccaacccaacccgagccgactggcggaggtggcgggggcggctcaagcccttctcccgctcctgcgatgtctcccgtgcccccttctccgagccccgtgccaacaccggcgagcccctcagggccagctaccctggacttcaccagccagtttggagcggcccttgtcggagccgccaggcgggaaggtgggtggcagaacgaggcccgtcgacggagcaccctgtttttgagcaccgatgcaggggacgaggacgggggtgatggaggcctgggcaccggagcggcccccggtcctcgcttacggcacagcaagtccatcgacgaaggtatgttcagtgcagaaccctatctgaggctcgagtcagcaggaagcggagctggatatgggggttatggcgccggttctcgagcatacggggggggagggggatcatcagcgtttaccagttttttgcctcctaggcctctcgtgcaccctctgaccgggaaagccttagatccagcttccccactgggattggcactggccgcccgagagcgagccctcaaagagagttccgaaggcgggggtgccccacagcccccaccccgccccccatcaccgaggtacgaagcaccccctcccacgccccatcaccacagcccccacgcccaccatgagcctgtcctgcgtctttggggcgcttccccaccggacccagcgaggcgagagctcgggtatcgcgctggattaggtagtcaagagaagtccctgccagctagcccacctgcagctcgacggtcactgctgcacagactgccccctacagctcctggggtgggccccttgttgttgcagttgggaactgaaccacccgcaccccatcccggtgtgtcaaagccatggcgcagtgctgctccagaggagcctgaaagactgcctctacacgtgcgattcctcgagaattgtcagccacgtgctcccgttactagcgggagggggcctcccagtgaagacgggccaggagtacctcctccaagcccgagacgaagtgtgcctccttcgccgacaagcccccgagcttcggaggaaaacgggttaccacttctggtactgcctcctccagctcccagcgtggacgtggaagacggtgagtttctttttgtggagccattacccccacctttggaattctctaacagtttcgagaaaccagagtccccgctgacacccggaccaccacatcctctaccagataccccggccccagcaacaccacttcctcctgtgcctccccccgccgttgccgctgccccacccaccctcgacagcaccgctagctcattgacatcctacgattccgaagtcgcaactctgacacaaggcgcctccgccgctcctggggatccgcaccctcccgggccccctgcgccggccgcgccagcccccgcagctccacagccagggcctgaccctcctccagggaccgactctggaatcgaggaggtggattcccgcagttcatcagatcaccccctcgaaacaatttcaagcgcgagtacactctcatccctgagcgccgaaggcggtggatccgcaggaggaggcgggggcgctggcgccggagttgccagcggcccagagctgctcgatacttacgtcgcttaccttgacgggcaagccttcggtggatccagcacacctggccctccatatccgccccaattaatgaccccaagtaagctgcgcggcagagcactgggggcctccggtgggctacggcccgggcccagtggaggtctgagggatcccgtgacccctacctcacctaccgtgtccgtaactggagctggcacggatggacttctcgctttgcgggcctgctctggccccccaaccgcaggagtggcaggaggacctgtggccgtggagcctgaagttccgcctgtcccactgccaactgcctcctcactgccccgaaaattgttaccatgggaagagggaccaggtcccccccctccgccgctcccaggtccccttgctcagccccaggcctctgccttggctaccgttaaagcttcaattattagcgagctgagttctaaactgcagcagttcggtggctcctccgccgcaggaggggccctcccatgggctcggggcgggagcggcggcgggggtgattctcatcatggaggcgcatcttacgtccctgaaaggacatcctctcttcagaggcagaggctttccgatgacagccaatcaagcctgctgtctaagcccgtgtccagcctattccagaattggcccaagccaccactccccccattgcctacagggaccggtgtctcccctacagccgctgccgctcctggagctacaagtccgagcgcttcctcgagctcaaccagtacgagacacctgcagggggtggagttcgaaatgcgtccccccctgttgcgccgcgctccttccccatcccttctgcctgcctcagagcataaggtcagccccgcacctcgcccatcgtctctgcccatccttccatcaggaccactgtatcccggcctgttcgatattcggggcagtcctacagggggagccggaggatctgccgatccctttgcccccgtttttgttcctcctcaccctgggatctcggggggccttgggggggccttatccggcgcaagccgaagcctgagcccaactcgcctgttgtcactccctcccgataagccctttggtgcaaaacccctggggttctggactaaattcgacgtcgcggattggctggagtggctgggactggctgaacatagagcacaattcctagatcatgaaattgacggatcacatctacccgccttgacaaaggaagattacgttgacctgggcgtcaccagggttgggcatcgaatgaacatcgaccgggcactgaagttttttctggagagatag

SEQ ID NO: 45951 - DNA, 6510 bp, Artificial Sequence
  Description of Artificial Sequence: Synthetic coding sequence
atgacccacagccccgccaccagcgaggacgaggagcggcacagcgcttcagagtgtcccgaaggaggctcagagagcgattccagccccgacgggcccggacgtggtcctagaggcacccggggacaaggaagcggggcccctggtagcctggcaagtgtgcgaggactacaaggcagatccatgtccgttcccgacgatgcacacttctccatgatggtttttaggataggcattccggatctgcaccagactaagtgtttacgttttaacccagatgccacgatatggactgctaaacagcaggtcctctgcgccttgtcggaaagtcttcaggacgtgctgaattacggcttgtttcaacccgcgactagtggcagggacgccaactttctggaggaggaaaggctcctccgggagtatcctcagtcctttgaaaagggcgtgccatacctcgaattccgttataagactagagtatacaagcagaccaacttggacgaaaaacagctcgctaaactccacactaagacggggcttaaaaagtttttggaatatgtgcagctcgggacatccgacaaggtagcacgcctcttggataagggacttgacccgaactatcacgacagtgattccggagaaaccccccttaccctggcggcgcaaacagaaggttccgtggaggtgatccggaccctctgcctggggggggcccacatcgactttagggctcgcgatggtatgacagctcttcataaggccgcctgcgcccgccactgcctggccctgaccgccctgctagacctgggaggaagtcccaattataaggaccggcggggtcttactcctctgtttcataccgctatggtagggggggacccaagatgttgcgagctgcttctttttaacagggcgcagcttgggatcgcggatgagaacggctggcaggagattcatcaggcctgtcaacgtgggcacagtcagcacctcgagcaccttctgttctacggtgcagagcccggcgcccaaaacgcctccggaaacaccgcccttcacatttgtgccctgtacaataaagagacttgcgccaggattctcctatatcgcggggctgataaagatgtaaagaataacaacggccagacaccatttcaagtagccgttattgctggcaacttcgagctcggcgagcttatcaggaatcaccgcgagcaggacgtagttccttttcaggaaagcccaaaatatgccgcacgacgaaggggaccaccaggtactggactcactgttccccccgcactgctccgagctaattctgacacctcaatggcgcttccggactggatggtcttcagtgctccaggggcagccagcagcggggcccccggtccaactagcggatcgcagggacagagccagccatccgcccctactacaaaactgtcctccggaactctcagatctgccagttcacctaggggggctcgggctagatcaccgtccaggggtcgtcacccagaagatgcgaagcggcagccaaggggacggccttcctccagcgggactccgagagagggtccagctgggggcaccggaggcagcggtgggcctggaggcagtctgggcagcagaggtcgtaggcgcaagctctattctgcagtcccaggacgatcttttatggcggtcaaaagctaccaggcacaggcagaaggggagatcagtctgtcgaaaggagagaaaattaaagtgctaagcataggtgagggcgggttttgggaagggcaagttaaaggacgcgtgggatggttcccctctgattgtctcgaggaagtggctaaccgtagccaggaatcgaagcaagaatctcgctccgacaaggccaaacggctctttagacactataccgtcggcagttacgacagttttgatgcgcccagccttatggatggcatcggccctggctctgactacatcattaaggagaaaaccgtgcttctacagaaaaaagattcggaaggattcggatttgttctgcgcggagccaaagcacaaacccctatcgaagagttcacacctacccccgcatttcccgcactgcaatatcttgaatccgtcgatgagggaggcgtggcctggagggctggcttgcggatgggcgactttttaatcgaggtgaacggccaaaatgttgtgaaggtgggacatcggcaggtggtgaacatgatccgccagggggggaatacactgatggtgaaagttgtcatggtcacaagacacccagatatggatgaagcggtgcataagaaggcacctcaacaagccaagcgccttcctccgccaacaatttccctccgctctaagagcatgacatccgagctcgaagaaatggtaagcccctggaagaagaagtctgagtatgagcagcagccagccccagttccctccatggagaaaaagcgcaccgtctaccaaatggccctgaacaagctagatgagatcctcgccgcagcccagcagaccatctctgcctccgagtcacccggacccggtggattggccagtttaggcaaacaccgacccaagggcttctttgcaactgagagctcatttgatccgcaccatcgcgcccagccatcttatgagcgcccttcatttctgccacccggccccggtttgatgctaaggcagaagtcgataggagctgctgaagatgatcgtccttatctggcaccacccgccatgaagttttcacggagcctctcagtgccgggatcggaagacatccccccacccccaacaacatcccctcctgagcctccctacagtacccccccggtaccaagctcgtcaggcaggctcactcccagcccgagaggagggcccttcaatccggggtctggaggaccgttgccagcatcatcaccagctagcttcgatggaccaagtcctcctgacaccagggttggtagtcgggagaagagcctgtatcacagcggacccctcccacccgcacatcaccacccacctcaccaccaccatcatcacgcccctccgccacagccacaccaccaccatgcacaccccccgcatcctccggaaatggagacaggcgggagcccagacgacccacccccaaggctcgcgctgggaccacagccgtcattgaggggatggaggggtggcggtccctcccctactcccggcgcgccgtcaccctctcaccacggtagcgctggtgggggtggcggatcttcccaagggcctgccttgcggtattttcagttacctccccgggccgcttcagccgccatgtacgtgcctgcaaggtccggtagggggagaaagggccctttggtgaaacagactaaagtggaaggcgaacctcagaagggcggcggcctcccccctgctccctcaccaacatcacctgctagtcctcagccaccccctgccgtcgctgcgccgtcggaaaagaatagtatcccaattcccacaatcattattaaggcgcctagcacaagctcatccgggcgctcttcacagggatcaagtacagaagccgagccacctactcagcccgaaccgaccggcggggggggcggcggcggaagctccccaagtccagccccagcaatgagtcctgtgcccccatccccctccccggtgcccacacccgcctcccctagtgggccggccacgctagattttacctcgcaattcggtgcagcactcgtgggcgccgcacgccgtgaggggggttggcagaatgaggctcggagacgcagcactctgtttctatctacagacgctggagacgaagacggaggtgatggaggactcggcacaggggccgctccgggtcccaggttgagacacagtaagtctattgacgaagggatgtttagcgctgaaccatatctcagactagaatctgccggcagtggagccggctacggaggatacggtgctggttcaagggcttatggtggtgggggtggctcatccgcctttacatccttcttgcctcctaggcctctagttcaccctctgacaggtaaggcactggatccagccagcccacttggcctcgccctcgccgcgcgggagcgcgccctgaaagagtccagcgaaggaggaggtgccccacaacctcccccacgacccccttctccccggtacgaggcccctccacctactccccaccaccactctccacacgcccaccatgagcccgttttgcgcctctggggtgcaagtccgccagatccggcacgacgtgagctgggctacagggccggcctggggagccaggagaagtctctgccagcgagtcctcctgcagctagaagatcactgctgcatagactacctcctaccgcacctggcgtgggccccctgttactgcagctcggcactgagccacctgcaccacacccaggggtgtccaagccctggagatcagctgccccagaggaacccgagcggctacccctgcacgtgaggttcttggagaactgtcaacccagagcacctgtgacctccggcagaggtcctccatccgaggatggccccggcgttcctcctccctctcccaggcggtcggttcccccatcaccaacctcccctagggccagcgaggagaatggcttgcctttgctggtccttcctccccctgcaccttccgtcgacgtcgaggacggtgagtttctattcgtcgagcctttgcctccacccctggaattcagcaactcatttgaaaaacctgagtcaccacttaccccgggtccacctcaccctttgccggacactcccgccccggccacacccctaccgcctgtcccaccacctgctgtcgccgcggccccgcctaccctggattcaactgcttcctctctgacctcttacgactcagaagttgcaacactgacacagggggcaagcgctgcgccgggagacccacaccctcctggcccaccagcaccagctgcgccagccccagctgcaccccagcccggacctgaccctcccccaggaaccgactcagggattgaggaggtggatagcaggtctagcagcgaccatcccctcgagactatctcatccgcgagtactttgagttcattatccgctgaagggggaggctccgcagggggcggaggcggcgccggggccggcgttgcctcgggtcctgaactcttggacacttacgtcgcctacctagacgggcaggcctttggtgggtcgagtactccaggacctccctaccctccccaactgatgacacccagtaagctgcgagggagggctctgggggcctcggggggtctgcgcccgggaccatcaggcggccttagggaccccgtaactccgacgtcgcctaccgtgtcggtgacaggagctggaactgacggattactggccctgagggcctgttctgggccaccgaccgccggggtggctgggggacccgtggccgtggaaccggaagtgcctccagttccactccctacagcttcttcattgccgaggaaactgttgccttgggaagaaggccctggaccccctcctcctcctttgcccggaccactggctcagcctcaggctagcgctctcgctactgtaaaagcctctatcatctccgagcttagtagcaagcttcaacagttcggcggaagcagcgctgcgggtggagcattaccttgggccaggggcggcagcggcggggggggcgactcacatcatggtggagcctcgtacgtgcctgagagaacatcaagcctgcagaggcagagactttctgacgactcgcaaagtagcctgttatcaaaacctgtctcttcccttttccaaaattggccaaaaccccccttaccccccctgccaacgggcaccggggtctctcctaccgcggcagctgctcctggcgcgaccagccccagcgccagctcaagttccactagtactagacatctgcagggcgttgaattcgaaatgagaccacctttgctgaggagagcacctagcccctcacttctgcccgcgtctgagcacaaagtaagtcccgccccccgtccttccagcctacccatcctcccctcaggcccactctatcccggactattcgacattagagggtcccctacgggcggagctggggggagcgcggaccccttcgcacccgtctttgtaccgccccacccagggattagcggaggactcggcggtgccctgtcaggtgctagtcggtcattgagtcctacacgccttctgagtctccctccagacaagccgtttggcgctaaacctctggggttttggaccaagttcgatgtcgcagactggctggaatggctgggactggccgaacatcgcgcccaatttctggaccacgagatagacgggtctcatctgcccgcccttacaaaagaagattacgtggaccttggcgttaccagggtaggtcatagaatgaatatcgatcgggccctgaagttctttcttgaaagatag

SEQ ID NO: 45952 - DNA, 2556 bp, Artificial Sequence
  Description of Artificial Sequence: Synthetic coding sequence
atgaccagccactacgtgatcgccatcttcgccctgatgagcagctgtctggccacagcagggccagagcctggcgcattatgcgaactctctcctgtctcagccagccaccctgttcaggcattaatggaaagttttaccgttttgtcaggatgtgcttcgcgcgggactactggcctgccccaggaggtgcacgtcttaaacctgagaaccgctggtcagggcccagggcaacttcagagagaagtcacactgcacctgaaccctatctcatctgtacacatccaccacaaatcggtcgtctttctcctaaattcaccccacccccttgtttggcatcttaaaactgaacgcctggccaccggcgttagcagactcttccttgttagtgaagggtccgtggtgcaatttagtagtgccaatttctcactgactgcagagactgaagaaagaaactttccccacggcaatgaacatctgctgaactgggctagaaaggaatacggagccgttaccagcttcacagagcttaagattgcccgaaacatttacatcaaggttggagaagaccaggtatttccaccaaaatgcaatataggcaagaatttcctttccttgaactatctcgcggaatatctccaacccaaggctgccgaaggatgcgtgatgtcaagccagccgcagaacgaggaggtgcacatcatcgagctaatcacaccaaattctaacccatatagtgcctttcaggtggatatcacgatcgacatccgaccctcccaggaagacctggaggtagttaagaatctaattctcatactgaagtgtaaaaagagcgtgaattgggttatcaaaagctttgacgtcaagggctccttaaagattatcgctccaaattctattggctttgggaaggagagcgaaaggtccatgacaatgaccaagtccattagggacgatataccttccacccagggcaacctcgtaaaatgggccctggataacggatattcccctatcaccagctatactatggctccagtggctaatcggttccacctcaggctggagaataatgcagaggaaatgggtgatgaagaagtgcatactatccctcccgaattgaggatcttattggaccccggagcgctgcccgccttgcagaatcccccaattcggggcggagagggccagaatgggggattaccattcccctttcccgatataagccggcgcgtgtggaacgaagagggggaagatggcctgcctcggcccaaggatccagtcataccttccatacaactgtttccaggactccgagagcctgaggaggtccaggggtccgtcgatattgctctgagcgtgaaatgtgataacgagaagatgatagtggctgtggagaaagattccttccaggcttctggctattctggaatggacgtgacactcctggatcctacatgtaaagcgaagatgaatggcactcattttgtgttggaaagccccttgaatggatgcggaacaagaccacggtggagcgccctggacggtgtggtgtattacaacagcattgttatacaggtgccagccttgggagattcgagcggatggccagacggatatgaagatctggaatccggggacaatggcttccctggagatatggacgaaggggacgccagcctttttactcggcccgagatcgtcgttttcaattgcagcctgcagcaagtacgcaacccatcatctttccaggagcaaccacacggcaacatcactttcaacatggaactgtacaataccgacctattccttgtgcccagtcagggagtcttttctgtgcccgagaacggtcatgtgtatgtggaagtaagtgtgacaaaggcggagcaggagctgggctttgcgattcagacctgttttattagcccgtactcgaatcctgaccgcatgtctcactatactataatcgagaacatctgccctaaggacgaaagcgtcaagttttactccccgaagagagtacatttccctatcccccaggcagatatggataaaaaaaggttcagcttcgttttcaaacctgtttttaacacatcactgctcttcctgcaatgcgagctgaccctgtgcaccaagatggaaaagcaccctcagaaactgcctaagtgtgtgcccccggatgaggcttgcacctccctcgatgcaagcatcatctgggccatgatgcagaacaagaaaacttttacgaagcctcttgccgttatccaccatgaggcagaatccaaggagaaagggcctagcatgaaggagcctaatccaatctctccgcctattttccacggcctcgataccctgaccgtgatgggcattgcgtttgccgcctttgtgatcggggccttgctaaccggggctctgtggtacatctattctcacactggagagaccgcgggaaggcagcaggtgcctacctcccctcctgcttccgagaattcaagtgcagcccattcaatcggctcaacacaaagtaccccttgctcttctagctctaccgcctag

SEQ ID NO: 45953 - DNA, 1161 bp, Artificial Sequence
  Description of Artificial Sequence: Synthetic coding sequence
atgaacatcatggacttcaacgtgaagaagctggccgccgacgccggcacattccttagtcgcgcagtccagtttaccgaggagaagctgggacaggcggagaaaactgagttggatgctcatctcgagaacttgctttccaaagccgaatgtacaaagatatggacagaaaagatcatgaaacagaccgaggtgttgctccagcctaaccctaatgccagaatcgaagagttcgtttacgaaaaattggaccggaaagccccatcgaggatcaacaatccggagctcctgggccagtacatgattgacgctgggaccgagttcggccctggcaccgcatatggtaatgctctgatcaaatgcggtgaaacccagaagcgcataggcaccgcagaccgggaactcatccaaacgagcgccctgaatttcctcacccctctgcgtaactttattgaaggcgattacaagaccatcgcaaaggaacgcaaactcctgcaaaacaaaagactcgatttggacgccgccaaaaccagactgaagaaggccaaggccgccgaaaccaggaacagccagctcaattctgcacgtcttgagggggacaatattatgatatgggccgaagaggtgactaaatccgagcaggagttaagaataactcagagcgaattcgaccgacaggccgagatcaccagattgctgttggaggggattagctctacacacgcccatcatttgaggtgtctcaatgacttcgtcgaggcgcagatgacctactatgctcagtgctaccagtacatgttagacctccagaaacagctcgggagtttccctagcaattacctcagtaataacaaccagacctccgtgaccccagtaccgagcgtcctgccaaatgctattggaagttccgccatggcatcaactagcggactcgtaatcacatctcctagcaacctctctgacctcaaggaatgttccggcagccgcaaggcaagagtcctctacgactacgatgctgccaattccactgaactttctctattagccgacgaggtaattacggtgttttcggtcgtgggcatggacagtgactggttaatgggcgagcgagggaaccagaaaggcaaagtccctattacctatctggaactgctaaattag

SEQ ID NO: 45954 - DNA, 798 bp, Artificial Sequence
  Description of Artificial Sequence: Synthetic coding sequence
atgatcgacgccggcaccgagttcggccccggcaccgcctacggcaatgcccttataaagtgcggggagacacaaaagaggatcggcaccgccgatcgcgagctgatacagacatccgctttgaattttctaactcctctgaggaattttatcgaaggtgactacaagacaatcgctaaggaacgcaaactcctgcagaacaaacgcctagatctggatgcagcgaagaccaggctgaagaaagctaaggcagccgagacaaggaacagcagtgagcaagaactcaggataactcagagtgagtttgatcggcaggcagaaatcactcgcctccttctagagggaatatcttctacccacgcccatcacctaaggtgtctgaacgactttgtggaagcccaaatgacctactacgcccaatgttatcagtacatgctggatttgcagaagcaactgggatcctttccatcaaactacttatcaaacaacaatcagacatctgtgactcccgtgccctctgtgctcccgaatgccatcggtagctctgctatggcctcgacaagcggcctcgttatcaccagtcctagcaatctgtccgaccttaaggaatgttctggttctcggaaggcaagagtgctttacgactatgatgccgccaacagtaccgaactctcactcttggctgacgaggttatcacagttttttcagtggtgggcatggactccgattggctgatgggtgaaagaggcaaccaaaaaggcaaagtacccatcacttacctggaactcctcaactag

SEQ ID NO: 45955 - DNA, 2124 bp, Artificial Sequence
  Description of Artificial Sequence: Synthetic coding sequence
atggccgccgccgccaccgccgccgagggcgtgcccagccggggccctccgggcgaagtgatacaccttaacgtgggtggtaagcgcttttcaaccagccgacaaactcttacatggattcccgattcctttttctctagcctgctcagcggccgaattagcacgctgaaggacgagaccggcgccatattcatcgaccgcgacccaacagtatttgctcccatcctcaatttcctacgtaccaaggagcttgacccgcgcggggtgcacggcagctccctgctccatgaagcacagttctacgggctgacccccctggtgagaaggctccagctcagggaagagctcgataggtcttcttgcggcaacgtcctgttcaacggttacctgccccctcctgtatttccagtgaagaggcggaaccggcatagcctggtcggccctcagcaactgggcggccggccagccccggtccgcagatcaaacactatgccccctaacctgggcaacgccggccttcttggtagaatgcttgacgagaagacacctcctagccctagcggtcagccagaggagcctggaatggtacgtttagtgtgcggccatcataattggatcgccgtagcctacacacagttcctcgtgtgttataggctcaaggaggcaagcggctggcagctcgtgttctcaagccctaggctggattggcccatagagcggttagccctcacagcccgggtgcacggcggagctttgggtgagcatgacaagatggtggcagcagccacgggtagcgagatattactttgggcattgcaagctgagggcggaggcagtgaaataggggtatttcatttgggcgtccccgtggaagcactctttttcgttggaaaccagttgatcgctaccagtcataccggtaggataggggtctggaatgcggtgaccaaacactggcaggtccaagaggtgcaacctatcacgtcctatgatgccgctgggagcttcctactgttaggttgtaacaatggctctatttactacgtggatgtgcagaagtttccacttagaatgaaggacaacgacttgttggtgtctgagctgtatcgggatccagcagaagatggcgtcacagcacttagtgtgtatctcaccccgaagacctctgattcagggaactggatagaaatagcatatggtacttcatcaggaggtgtgagggtgattgtgcagcacccagagaccgtgggctccggaccacagttgttccaaaccttcacagttcaccggagtcccgtgactaagatcatgctgtctgagaaacacctcataagcgtgtgcgctgataataatcatgtgaggacatggagtgtgaccagattccgaggaatgatctctacacagcccggctccacacccctggcctctttcaaaatcctggctttggagagtgccgacggacacggcggctgcagcgcaggaaacgatataggcccatatggagagcgggacgatcagcaggtctttattcaaaaagtggtgccctctgctagccagctgtttgtgagactctctagtacggggcagagggtgtgcagcgttcggagcgtggacggctcacctaccaccgcgtttacagtattggagtgtgaaggctcacgacgactcggctcaaggccccggaggtatctgttgactggtcaggccaacggttcgctggctatgtgggatctcaccacagccatggacggcctgggtcaggctcctgcgggggggttaacagagcaggagttgatggagcagctggaacattgcgagctggcgccccctgctccttctgcaccctcatggggctgtctcccatcaccttcccctagaatcagtctgacctctctccattcagctagctctaatacatccctttcagggcataggggttcccctagtcccccacaagccgaggcgcggcgacggggcgggggttcttttgttgaacgttgtcaggagctggtgcggtctgggccagaccttagaaggcctcccacccccgccccctggccttcatccggactgggaacgccactcacccccccaaagatgaaactaaacgaaactagcttttag

SEQ ID NO: 45956 - DNA, 1464 bp, Artificial Sequence
  Description of Artificial Sequence: Synthetic coding sequence
atgccccccaacctgggcaacgccggcctgctgggccggatgctggacgaaaagaccccacctagtccgtcagggcagccggaagagcctgggatggtgcggcttgtatgtggacaccataactggattgctgtcgcctacactcaattcctggtttgttacagattaaaggaagcctcgggatggcagctggtgttcagttctccaaggctggattggcccattgagcgtctggctctgactgccagagtgcatgggggcgctctgggggagcacgataaaatggtggccgcagccaccggcagcgagattttgttgtgggctctacaggcggaggggggagggtccgagattggagtgttccacctgggagtccctgtcgaggctttattttttgtggggaaccaactgatagcaactagccatacgggccggattggcgtctggaacgctgtgacgaagcactggcaggtccaggaggtacagccaataacaagctatgatgcagctgggtcattcctcttactgggctgtaacaatggctcaatatactacgtggacgtgcagaaatttcccctgcggatgaaggacaacgacctactggtgtcagagttgtaccgggacccagctgaggacggagtgaccgccttatccgtctatctcactcctaaaactatctgtgcagataacaaccacgtacggacatggagcgtgactcggtttcgaggaatgataagtacacagcccgggtccacacctttggctagcttcaagatcctggctctggaaagtgcagacgggcacggaggctgttcagctgggaatgatatagggccttacggggagcgcgatgaccagcaggtcttcattcagaaggtagtgccctcagctagccagctgtttgtgaggctgtcaagtactgggcagcgggtgtgttccgtcaggagcgtcgatggcagcccgactaccgcctttacagtcctggaatgcgagggttctcgccgactcggctctcggcccagaagatacctcctgaccggtcaggcaaatggatctcttgcaatgtgggacctgaccaccgcaatggatggcctcggccaagcccccgccggaggtctcaccgagcaggagcttatggagcagctcgagcactgcgagctggcccctcccgctccgtccgctccatcctggggatgtctcccatctccatctcctcggatttctctgaccagcctgcatagcgctagctcaaatacatccctttcaggccatcgcgggtccccctctcctccacaggccgaggcaaggcggcgagggggcgggtcattcgtggagcggtgccaggaacttgtgcgttcaggcccagatctccggcgcccacctacaccggccccctggccttcatccggtctgggtactcctctgacacctccaaagatgaaactgaatgaaactagtttctag

SEQ ID NO: 45957 - DNA, 1893 bp, Artificial Sequence
  Description of Artificial Sequence: Synthetic coding sequence
atgcgggagcggggccaggacagcctggccggcctggtgctgtacgtggggctgttcggtcatcccggaatgctgcacagggccaagtattcccggttcagaaacgagtccatcacctctttggatgaaggctcgagcggcgggtctgttggcaacaaaggttccccccagccaccacatcctgccctcgctccccacttaccaaccgaggatgcaaccctcccatcccaggaatcccccacccccttatgtaccctcattcctcgaatggccagcatgaagttagccaacccagccaccctgctgagcttgaaaaatttctgcctgggcactaaagaagtaccccggctcaagttacaggaaagcagggatcccggttcctctggtccgtccagtccagagacttcattgtcacgctcaggaacagccccaccccctcaacaggatctggttggtcaccgtgccaccgctctgacacccgattcttgcccattgccaggacccggcgaaccgacactccgatcaagacaggatagacatttcctgcagcacctgttgggcatgggcatgaactactgcgttcgctatatgggttgtgtcgaggttttacaatctatgcggtcccttgactttggaatgaggacccaagtgacgcgtgaggccatctcaaggttgtgcgaggcagtgcccggcgccaatggagccattaaaaagaggaagcccccagtaaagtttctgtcaaccgtccttggaaaaagcaatctgcagttttccggtatgaatattaagctcactatctcgacctgctcactaacattgatgaatctagataatcagcaaattattgccaatcaccacatgcagtccatttccttcgctagtggaggggacccggatactacagattatgtcgcttacgtagcgaaggaccctgtgaaccagcgggcttgtcatattctggagtgtcacaacggaatggcccaggacgtaatcagcaccatcgggcaggctttcgaactccgcttcaagcagtatctaaagaatcctagtctcaacacttcctgcgaatctgaagaggtccacattgattcccatgcggaagagcgggaggatcatgaatattataacgaaatccccggcaagcagcctccagtcggtggagtgagcgacatgaggatcaaagtgcaggcaacagagcagatggcctactgtccaatccaatgtgaaaaactgtgttacctccccggtaactctaagtgctccagtgtctatgaaaattgccttgagcagagtcgtgctattggtaacgttcaccccagaggagtccagtcccagcgggacaccagtctgctgaagcatacgtgtcgcgtggatttgttcgacgacccctgttatatcaacacgcaagctctccagagcacgcccggcagcgctgggaatcagcgttctgctcagcccctgggcagtccctggcactgtggaaaagcccccgagaccgtccagccaggagccacggctcagcccgcttcctcccattccttgcctcacattaaacagcagttgtggtccgaagaatgctaccacggaaagttgagtcgcaaggccgcggagagtctgcttgtcaaggacggggacttccttgtgagggagtccgctactagtcctgggcagtatgtactgtccggtctccaggggggacaggcaaaacacttgctcttagtggatcctgagggcaaggtcagaaccaaggaccacgtgtttgataatgtcgggcacctcattcgataccatatggacaacagccttcctatcatctccagcggtagcgaagtatctctgaaacagccagtgcgcaaggataacaaccccgctctcctacacagcaataagtag

SEQ ID NO: 45958 - DNA, 1164 bp, Artificial Sequence
  Description of Artificial Sequence: Synthetic coding sequence
atgctgcccgccctggagcactggatccccaagttcttcagcttcagaacaaggaccgggagtcccctgagcctcgcatgcagacagccaatcgttggtccatgcgaccatatcattgccaatcaccacatgcagtccatctctttcgcttcgggcggtgaccccgatacgacagactacgtggcctatgttgcgaaagacccagtgaatcagcgggcctgccacattctagaatgccataacggaatggcacaggatgtgatatctacgattggacaggcgttcgagttgaggtttaaacaatatctgaagaacccatctctgaatacttcatgcgagtctgaggaagtgcacatcgactcccatgcagaggaacgcgaagatcacgagtattacaacgagattccgggaaaacaaccgcctgtggggggcgtcagcgatatgcgtattaaggtccaggctaccgaacaaatggcatattgccctatacagtgcgaaaagctgtgctatttgcccggtaatagtaagtgtagtagtgtctatgaaaactgcctcgagcaatcccgggcaatcggaaacgtccaccctcgcggcgtacagtcccaaagagacacgtccctgctgaaacatacttgccgtgtggacctgttcgacgacccttgctacatcaacactcaggccctgcaatctacccctggaagcgctggaaatcagcggagtgctcagcctctgggcagtccttggcattgcgggaaggcccccgaaacggtccagcctggcgctacagcccaacccgctagcagtcactctctccctcacattaaacagcagctgtggtctgaggagtgttaccacggaaagctttcccggaaagccgctgagagcctgctggtcaaagatggcgattttctggtgcgggagtctgccaccagccctggacagtacgtattgtcaggactgcaaggtggccaggccaaacacctgctgcttgtggaccccgaggggaaggtaaggaccaaagatcacgtcttcgataatgtgggccatttaatccgataccacatggataactccctgcccattatctccagcggcagcgaggtcagcttgaaacagccagtgcgcaaggacaataaccccgccttactgcactcgaacaaatag

SEQ ID NO: 45959 - DNA, 888 bp, Artificial Sequence
  Description of Artificial Sequence: Synthetic coding sequence
atgtggggcgcccggcggagcagcgtgagcagcagctggaacgccgcctctctcctgcagcttctacttgcagcactgctggccgcaggagcccgagcctccggtgaatactgccacggttggttggacgcccagggggtttggagaatcgggtttcagtgtcctgagcgattcgatggcggcgacgccaccatttgctgcggatcatgcgctctacgctattgctgttcgtccgccgaggcccgcctggaccagggtgggtgcgacaacgatcgccagcagggtgcaggagagccggggagagctgataaagacggccctgacgggtccgctgtcccaatttacgttccgttccttatcgtgggaagcgtgtttgtggctttcatcatcctcggcagtctcgtcgccgcgtgttgctgccgttgccttcgcccaaaacaggatccacagcagagtagagcacctggaggcaaccgccttatggaaaccattcccatgataccttccgcctccacctctaggggtagctctagtagacagtcctccactgccgcgagcagctcgagctctgccaattcaggggcaagagccccccccaccagatcccagactaattgttgcctgcctgaggggactatgaacaatgtctacgttaacatgcccactaactttagcgtgttaaactgtcagcaagccacacaaattgtgccgcaccagggccaatatcttcatccaccttacgttgggtataccgtgcagcatgactctgtgcccatgaccgctgtgcctcccttcatggacggtttgcagcctgggtataggcagatccagtctcctttcccccatactaacagcgaacagaagatgtatcccgccgttaccgtgtag

SEQ ID NO: 45960 - DNA, 717 bp, Artificial Sequence
  Description of Artificial Sequence: Synthetic coding sequence
atgcgggccctgctggccctgtgcctgctgctgggctggctgcggtggggccctgccggcgcgcaacagtctggagagtactgccatgggtgggtggatgttcaggggaattaccatgagggattccagtgtcccgaggactttgatacgctcgacgcaacaatatgctgtggatcttgtgccttaagatactgttgcgccgcggccgatgcccggttggagcagggcggatgtaccaacgaccgtagagagctagagcacccaggtatcaccgcccagccagtctacgtccccttcctaatcgttgggtcaatattcatagctttcattatcctggggtcagtagttgccatatattgttgcacctgcctgagacccaaagagccttcccagcagcctataaggttttcacttaggagctaccagacggagactctgcctatgatcctgactagtacatcccccagggcgcctagccgccaatcttcaactgctacgtcctcctcttcaaccggaggcagcattagacggttttcctttgcacgcgcggagcccgggtgtctggtgccttcccctccacccccctataccacatcacactcgattcatctggcgcagccaagcggattccttgtctctccccagtactttgcctatcctctgcagcaggagccgccactccctgggaagagttgtccagacttctcttcaagttag

SEQ ID NO: 45961 - DNA, 594 bp, Artificial Sequence
  Description of Artificial Sequence: Synthetic coding sequence
atgccccccgccggcctgcggcgggccgcccccctgaccgccatcgcccttctggtgctgggcgcgcccttggtactcgctggggaggattgtctctggtacctggaccggaatggcagttggcaccctggcttcaactgcgaattcttcacgttttgctgtggtacgtgctatcatcgatactgttgccgtgacctgacactgctgatcacagagcggcaacagaagcattgtcttgcattcagtccaaaaactattgctggtatcgcctctgcagttatcctattcgtggcggtggttgccaccaccatttgttgttttttatgctcctgctgctacctgtaccggcggcgccagcagctccagtccccatttgagggccaagaaatcccaatgaccggtatcccagtgcagccggtatatccctacccacaagaccctaaagcaggcccggcccccccccagccaggctttatataccctcctagcgggccagccccgcagtatcctctgtaccctgcgggacctcccgtgtacaatcctgctgcaccccccccatatatgcccccccaaccgtcctatcccggcgcctag

SEQ ID NO: 45962 - DNA, 1503 bp, Artificial Sequence
  Description of Artificial Sequence: Synthetic coding sequence
atggccctgcggcggctgctgctgctgctgctgctgagcctggagtccctcgacttgctgccaagtgttcacggcgcaaggggccgggcggccaacagaaccctgtcagccggaggagccgccgtgggcgggagacgcgctggcggggcactggcccgcggcgggagggaactgaatggaacggccagggcccccgggattccagaggctggctctcggcgagggcaacccgctgccgcagtagcagcggctgcttccgccgcagtcacttacgaaacgtgttggggttactacgatgtgtctggccaatatgacaaagaattcgaatgcaataactcagagagcggttatctgtactgttgtggaacatgctattatcgattctgctgcaagaagcgccatgaaaaactcgaccagcgccaatgcaccaattatcagtccccagtgtgggttcagacaccttccacgaaggttgttagcccgggccctgaaaataaatacgacccagaaaaggacaagaccaacttcacggtatatattacttgcggcgttattgccttcgtcatcgttgctggagtgtttgcaaaagtgtcctacgataaagcccaccggcccccgcgggaaatgaatatccatcgcgccttagcagatattctccggcagcaggggcctattcctattgcccattgtgagcgcgaaaccatctccgctatagatacctctcctaaagaaaatactccagtgagaagttcaagcaagaatcactacactccagttcgaacagccaaacaaactccagagaagccccggatgaacaatatccttacctctgctacagagccatacgatctgagtttctcacgttccttccagaaccttgcccatctgcccccctcctacgaatccgctgtaaaaacgaatccaagcaagtatagttccttaaaacgtctcactgataaggaagctgatgagtactatatgaggcgccgccatctgccggacctggctgcaaggggcaccttgcccctgaatgtcattcagatgtcgcagcagaaacctttgccgcgggagaggcctcgcaggcctatccgagccatgtctcaagatagagtgctgagccccgaccgcggtttgcccgatgagttctctatgccctacgatcgcattctctcagacgaacagctgctgtccaccgaaagattgcactctcaagaccccctgctctcccctgagcggacggctttccccgagcagtctctgtcccgggcaatctctcacacggatgtctttgtgagcacccccgtcctcgacagatatcggatgtccaagatgcactcgcatccttcggccagcaataactcctacgctacactcggccaaagtcagactgccgcaaaaaggcacgccttcgccagccggaggcataatactgtcgaacagttgcactatatccctgggcatcacacctgctacacggcctctaagactgaggtgactgtttag

SEQ ID NO: 45963 - DNA, 1599 bp, Artificial Sequence
  Description of Artificial Sequence: Synthetic coding sequence
atggccctgcggcggctgctgctgctgctgctgctgagcctggagtcattagatctgttgccatcagtccatggcgcaagggggcgagcagctaataggactctgagcgctggcggggcagccgtcggaggacgtcgtgcggggggggccttagcccgaggtggcagggaacttaacggcaccgctcgtgctcctggaatccccgaggcgggctcaagaaggggccagccagctgctgccgtcgcagccgccgcttctgccgctgttacctacgagacttgctgggggtattatgatgtgagcgggcagtatgacaaagagtttgagtgcaacaactctgaatcggggtatctctactgctgtggaacttgctattatcggttctgctgtaagaaaaggcatgagaagcttgatcaacgtcagtgcacgaattatcagtcccccgtgtgggtgcagacaccaagcaccaaggtcgtgtctcctggccccgaaaataagtatgatccagagaaggataagacgaacttcaccgtttacataacatgcggcgtgattgcattcgtaatagtagccggcgtgtttgctaaggtgtcttacgacaaagcccataggcctccaagggagatgaacatacacagagctttggccgacatcctaagacagcaaggaccaattcccatcgctcactgcgaacgcgagactatttccgctatcgatacctcgcccaaagagaatacaccagtccggagctcttccaagaaccattatacccccgtcagaaccgctaaacagacacccggtcactacggcaaggacgcctacaggagcggtggtcctgatcttcataattttatctcttctggatttgtgaccttgggccggggccacaccaaggaaaaaccaagaatgaacaacattttaacctctgcaaccgagccctacgatctttccttctcacggtcctttcaaaacctggcccacctcccaccaagctacgaaagcgcggtgaaaactaatccttcaaaatattcttccctcaagcggctgacagataaggaagccgacgaatactacatgcgacgacggcacctcccggatcttgccgcaaggggtacactgcctctgaacgttattcagatgtcacagcaaaagccactgccccgtgaacgccctcgtcggcctatccgggcaatgtcccaggaccgggtgctgagccccgacagaggactcccagatgaattctctatgccttatgacagaatactgagtgacgaacaattattgtctacagaaagactccatagccaggaccccctactaagcccagaaagaaccgcattcccagaacaatctttgagcagagcaatttcccacaccgatgtattcgtgagtactccagtcttggaccgatatagaatgagcaaaatgcatagccacccatcagccagcaacaatagttatgctactctgggccaaagccaaactgcggctaagaggcacgccttcgcttcccgccgtcacaacacagttgagcagcttcactacatacctgggcatcacacatgctatacagccagcaagactgaagtcactgtctag

SEQ ID NO: 45964 - DNA, 1656 bp, Artificial Sequence
  Description of Artificial Sequence: Synthetic coding sequence
atggccctgcggcggctgctgctgctgctgctgctgagcctggagtccctggatctccttccatctgtacacggcgcgaggggccgtgcggccaaccggacgctgtcagctgggggcgcagctgttggggggaggagggcgggaggcgccttggctagaggcgggcgagagctgaacggaacagcaagagcccccggtattccagaggccggcagtagaaggggacagccagcagctgccgttgccgccgcggcctcagctgccgtcacatacgagacctgttggggatattacgacgtatcaggccagtatgataaggaatttgagtgtaataattcagaaagcggctacctgtattgctgcggaacatgctactacagattttgctgtaagaaaagacatgaaaagttggaccaacggcagtgcacaaattaccagagcccggtatgggtgcaaactccgagcacaaaggtggtgtcacctggcccagaaaataagtacgaccccgaaaaggacaagaccaactttactgtttacattacttgtggtgtgatcgcttttgtcatagtagctggtgtttttgccaaagtgagctatgataaagcacaccgccccccaagagagatgaatatccacagggcacttgccgatatcctgcggcagcagggaccaatcccaatagcccactgtgagcgggagaccatcagcgccatagatacctctcccaaggagaatactccggtcaggtcctcgagcaagaaccactacacgcccgttaggacagccaagcagacgcccggccactacgggaaagacgcatacagaagcggagggcccgacctccacaactttatctcttccggctttgtcacacttggcaggggacatactaagggtgatcatcaatacaaccatcctattctaagcagcgttactcaaatcccccctcatgaaaaaccaagaatgaacaacatcctgacatctgctactgagccttacgacctgtcattctccagaagttttcagaatctcgcacacctgccacccagttatgagagcgctgtcaagacaaacccatccaaatactcctcattaaagaggctcaccgataaggaggcagatgaatattatatgaggcggcggcacctccccgaccttgccgctcgcggaacgttaccgttgaacgtcattcaaatgagtcagcagaaacccctccccagagaacggccacgccggcccatcagagctatgagccaagaccgtgtgctgagccctgaccggggactcccagacgagttttctatgccatatgatcggatcttaagcgatgagcagttgctttccactgagaggttgcatagtcaagaccctcttctgtcccctgaaaggaccgcttttcctgagcagagcctgtcgcgggcaatctcacatacagatgtgtttgtatccacccccgtcctcgatagataccggatgtcgaaaatgcattcccacccgtctgcctccaacaactcttacgctaccctcgggcaatcccaaacagctgccaaacgacacgcctttgcaagccgacggcacaataccgttgaacagcttcactacattcctggacaccatacatgctatacagcctccaaaactgaggtaactgtctag

SEQ ID NO: 45965 - DNA, 930 bp, Artificial Sequence
  Description of Artificial Sequence: Synthetic coding sequence
atgagcttcaacctgcagagcagcaagaagctgttcatcttcctgggcaagagccttttttctttgctagaggccatgatattcgccttgctgccaaagccaagaaaaaacgtagcgggagagatcgtcctgattactggcgcgggatctggtctgggaaggttgcttgcactccagtttgctagactggggtccgtactggtgctctgggacatcaataaggaagggaacgaggagacctgcaagatggcaagggaggccggggcaacacgcgtccatgcttatacctgcgattgctctcaaaaagaaggcgtgtacagagttgctgaccaggtgaagaaagaagtgggcgacgtgagtatactgataaacaacgcaggaatcgtgaccggcaagaaattcctggattgcccagatgaactaatggagaagtcttttgacgtgaatttcaaggctcacctgtggacgtacaaagctttcctgccagccatgatagcgaatgaccacgggcacctcgtgtgcatatccagcagtgccgggctgagcggcgttaacgggttggctgattattgtgcctcaaagtttgccgccttcggctttgctgagtccgtgttcgtggaaacatttgtccagaagcaaaagggcatcaagaccacaatcgtgtgccccttcttcattaaaaccgggatgttcgagggctgtaccaccggatgccctagcctgcttccaattctggaaccgaaatacgccgtagaaaagattgtcgaggccatcctgcaggaaaagatgtacctgtacatgcccaagcttctgtacttcatgatgttcctcaagtcctttctccctttaaaaaccggcctacttatagccgattacctgggaatccttcatgctatggatggattcgttgaccagaaaaaaaaactttag

SEQ ID NO: 45966 - DNA, 798 bp, Artificial Sequence
  Description of Artificial Sequence: Synthetic coding sequence
atgagcttcaacctgcagagcagcaagaagctgttcatcttcctgggaaagtctctgtttagtctgctggaagctatgatttttgctctgctgccaaaacctagaaagaatgtcgcaggcgagatcgtgcttattactggcgcagggtcaggactgggacgcttactggccttacagttcgctcggcttggcagtgtgctggtcctgtgggacatcaacaaagaaggtaatgaggaaacctgtaaaatggccagggaggccggcgccacacgggttcatgcttacacatgtgattgctcccagaaggaaggagtgtaccgggtggcagatcagacttataaggccttcctcccggctatgattgctaatgaccatggccacctcgtatgcatcagtagtagcgctgggctctcaggtgtgaatgggctggccgactactgcgccagcaagttcgccgcctttgggttcgctgaaagtgtgtttgtcgagaccttcgtgcagaagcagaagggcattaagacgacaatcgtctgtccatttttcatcaagaccggaatgttcgaagggtgcaccaccgggtgcccgagcttgttgccaattctggaaccaaaatacgcggtggaaaagattgttgaggcgatcctgcaagagaagatgtacctgtatatgccaaagctcctgtactttatgatgttcctgaaaagcttcctgccactgaagactggcctgcttatagccgactacctgggcatcctgcatgctatggatggcttcgtggatcaaaagaaaaagctatag

SEQ ID NO: 45967 - DNA, 693 bp, Artificial Sequence
  Description of Artificial Sequence: Synthetic coding sequence
atgagcttcaacctgcagagcagcaagaagctgttcatcttcctgggaaagagcctttttagcctgctggaggctatgatttttgccctcctgcctaaacctcggaagaatgtggccggcgaaatcgtgctgatcacaggcgcgggtagcggacttgggagactgcttgctctacagtttgcgcgcttaggatcagtcctggtgctgtgggacataaacaaggagggaaacgaagaaacctgtaaaatggctagagaggctggtgctacacgggtgcacgcttacacctgcgactgctcacagaaagagggtgtataccgggtcgcagatcaagtgaagaaggaagttggggacgtgtcgatactgattaataatgcggggatcgttactggaaagaagtttttggattgtccagatgagcttatggagaagagttttgatgtgaatttcaaggcgcatttgtggacttataaggcttttctgcctgcaatgatcgccaacgaccacgggcacctggtgtgtattagctcctccgccggtctgtccggagtaaatggcctggctgattattgcgcaagcaagtttgccgcctttggcttcgccgagtcagtgttcgtggagaccttcgtccagaagcagaagggcattaagacaaccatcgtgtgtcctttttacaagaattggaatgtgtag

SEQ ID NO: 45968 - DNA, 1182 bp, Artificial Sequence
  Description of Artificial Sequence: Synthetic coding sequence
atggaccccaagcggagccagaaggagagcgtgctgatcaccggcggcagtggctatttcggttttcgtctaggatgcgcacttaatcaaaacggagtgcatgttatactcttcgatatcagttctcccgcgcaaacgatccccgaaggcataaaattcattcaaggggacatacgccatctctcggacgtggaaaaggcattccaggacgctgacgtcacttgcgttttccacatcgcctcttatggaatgtcgggcagagagcagctgaatagaaatctgattaaagaggttaatgttagggggacggataacatcctgcaagtctgccagcggcgacgggtccccaggttggtgtacacttccacattcaacgtaatcttcggcggacaggtcatccgcaatggagatgaaagcctgccgtatctccccctgcacttgcatccagaccactactcaagaaccaagtcaatagccgagcaaaaagtgttagaggccaacgcaaccccactcgaccgaggggacggggtgctccgcacttgtgccctgcgccctgctgggatatatggccctggagagcagcggcatcttccccggattgtgtcgtatattgaaaaaggcctctttaaatttgtgtacggtgacccacggtccctcgtggagtttgtccacgttgataatctggtccaagcgcacatcctggcctccgaggctcttcgcgcggacaaagggcatatagccagcggccagccatattttatctccgatggacgccctgtgaacaactttgagttctttagaccactagtggaggggctggggtatacatttccaagcacccgcctcccgctgacactggtctactgcttcgcgtttctgacagaaatggttcacttcattctgggtcgcctctacaatttccagccattcttgacaaggacggaggtgtacaaaactggtgttacgcattacttctctctggaaaaagccaagaaagagctcggctataaagcacagcccttcgacctgcaggaggctgtcgaatggtttaaagcacatggtcatggaaggagcagcggaagtagagattctgaatgcttcgtctgggacggcctactcgttttcttgctaatcattgctgtgttaatgtggcttccgtcatcggtgatcctgagcctgtag

SEQ ID NO: 45969 - DNA, 369 bp, Artificial Sequence
  Description of Artificial Sequence: Synthetic coding sequence
atggacggcagccggaaggaggaggaggaggacagcaccttcaccaacatttccctggcagatgacatagatcacagctctcgtattttgtatcccagacccaaatcattgctgcctaaaatgatgaacgccgatatggatgcggtggatgccgagaatcaggtagagctggaggagaaaacccgattgatcaaccaggtactcgaactgcaacacacacttgaggacctgtccgccagagttgacgccgtgaaggaagaaaacctaaagttgaaaagtgagaatcaagttcttggccagtacatcgaaaatctgatgtccgccagcagcgtcttccagactacggacaccaagtctaaaaggaagtag

SEQ ID NO: 45970 - DNA, 480 bp, Artificial Sequence
  Description of Artificial Sequence: Synthetic coding sequence
atgcggcggcgggtgttcagcagccaggactggcgggccagcggctgggacggtatgggattcttctctagacggaccttttgcgggaggtccggacggtcttgtcgggggcagctggtccaggttagtagaccagaggtgagtgcggggtccttattgcttcctgcgccccaggccgaagaccatagtagccggatcttgtaccccagaccgaaatccctgttgcctaaaatgatgaacgctgacatggatgcggttgatgcagaaaaccaagttgagttggaggagaaaacccggctgataaaccaggttcttgagctgcagcacacacttgaagacctgtcagcgagggtggacgctgttaaggaggagaacctaaagttgaaatccgagaatcaagtgctgggccagtacatcgagaacctgatgagcgccagttctgtgttccaaactaccgatacgaagtcgaagagaaaatag

SEQ ID NO: 45971 - DNA, 369 bp, Artificial Sequence
  Description of Artificial Sequence: Synthetic coding sequence
atggacggcagccggaaggaggaggaggaggacagcaccttcaccaacatcagcctggcagatgatattgatcatagcagccggatcctttatccccgtccaaagtcactattgcctaagatgatgaacgccgacatggacgccgttgatgccgagaatcaggtggaactggaagagaaaacgcgtctcatcaatcaggtgcttgagctgcaacacactctcgaggatctctcggcaagagtggacgctgtcaaagaagagaatttgaagttgaagagtgagaaccaggtgctcgggcagtacatcgaaaaccttatgagcgcctcgtcagtgttccagactaccgatacaaagagcaaacggaagtag

SEQ ID NO: 45972 - DNA, 369 bp, Artificial Sequence
  Description of Artificial Sequence: Synthetic coding sequence
atggacggcagccggaaggaggaggaggaggacagcaccttcaccaacatctccctggcggatgacattgaccattcatcccggattctgtaccctcgacctaagtccctcctccccaagatgatgaacgctgatatggatgccgtggatgccgaaaaccaggtcgagctcgaagaaaagaccaggctcataaatcaggtgctggagctgcaacacactttagaagatctttctgctcgagtggacgctgtgaaggaggagaatctcaaactaaagtcggaaaatcaggttctcggacaatatatcgagaacctcatgtcggctagcagcgtgtttcagactactgataccaagtccaaacggaaatag

SEQ ID NO: 45973 - DNA, 396 bp, Artificial Sequence
  Description of Artificial Sequence: Synthetic coding sequence
atgcggcggcgggtgttcagcagccaggactggcgggccagcggctgggacggtatggggtttttttctcggcgaaccttttgtggtaggtcaggaaggagctgcaggggccagcttgtgcaggtctctcgtcccgaggtgagcgccggcagtctgctattgccggccccacaagcagaagaccactcttcccggatcctctatcccagacctaagtctttgctgcccaagatgatgaatgccgacatggatgatctcagcgcaagggtagacgctgtcaaggaagagaacctgaaacttaaaagcgaaaaccaagttctggggcagtatattgagaatctgatgagtgcttcaagtgtgtttcagaccactgatactaagtccaaaaggaagtag

SEQ ID NO: 45974 - DNA, 1191 bp, Artificial Sequence
  Description of Artificial Sequence: Synthetic coding sequence
atgctgcccctgctgctgctgcccctgctgtggggcggcagcctgcaagagaagcctgtctacgaacttcaagtgcagaaaagtgtgactgtgcaagaaggtctgtgtgtgctggtcccatgctccttctcctacccatggaggagttggtatagcagtcctcctctctacgtgtactggttcagagatggcgaaattccatactacgctgaggtggtagccacaaataaccccgatagacgggtaaagcccgagacgcaaggaagatttcgactcctgggagatgtgcagaaaaaaaactgctcattatccataggggatgccaggatggaggatactggatcatacttctttagagtcgagagaggcagagatgtgaagtactcgtaccagcagaataaactgaacctagaggttactgcactcatcgaaaagcctgacatccactttctagagcctctggaaagtgggcgccccacaaggctgagttgttccttgcccggctcttgcgaggccggcccccccctgactttctcatggacaggaaacgctctgtcgccccttgatccagaaacgactagaagctccgagctcacattgactcctcgaccggaggaccacgggacaaacctgacttgtcaagttaagagacaaggcgcccaagtgaccacagagcgcacagtccagctcaatgtgtcctacgcaccccagaacctggctatcagtattttcttcagaaacggaaccggtaccgccctgcgaatcctgtccaatggcatgtccgttcctatacaggaggggcaaagtttgtttttggcttgcactgttgactcaaacccacctgcctctctcagctggtttagagagggcaaggccttgaacccttctcagacctctatgagtggtacattagagttacctaatatcggggccagagaggggggagagtttacttgtcgagttcagcaccctctggggagccagcacctgagctttatcctttccgttcaaagatcatcaagtagctgcatttgcgtaacagaaaaacagcaagggtcctggccactggtacttactctgatccgtggtgcactgatgggagctggctttctgctcacatatggactaacatggatttattatactagatgtggcggacctcagcagtcccgggcagaaagacctgggtag

SEQ ID NO: 45975 - DNA, 987 bp, Artificial Sequence
  Description of Artificial Sequence: Synthetic coding sequence
atggagaagagcatctggctgctggcctgcctggcctgggtgctgcctaccggatccttcgttagaacaaaaatcgacactacggaaaatttgctgaacaccgaggttcatagcagcccagctcagaggtggagtatgcaggtcccccccgaggtctccgccgaggctggggatgcagctgtgctgccgtgcacctttacgcatccccaccgtcactatgacggaccgctcacggctatatggcgggcgggcgaaccctacgctggaccccaggtgttcagatgcgcagctgcacgaggatctgagctctgccagacagccttgagcttacacgggcgctttcgcctgctaggaaaccctcggcgcaacgacctctctctgcgcgttgagcgcctggccctggccgatgataggcgatacttctgtcgcgtggaatttgctggggatgttcacgaccgctatgagtcgcgacacggcgtcaggcttcacgttaccgctgctcctcgaattgtgaacatttcagtactcccatctccggcgcacgccttccgagccctctgtacagccgaaggtgagcctccacccgccctggcctggtctggtcctgcacttggaaactccctggccgccgtgaggtctccccgggaggggcatgggcacctggtaaccgccgaactgcccgctctcacacatgatggacgatatacctgcacagcagccaactcactcggcagatccgaggcaagtgtgtatctgtttcgcttccacggagcatcgggagcttcgaccgtggcgcttttgttgggtgctttagggtttaaggctctgctgctgctaggggtgctggcagcccgagcagctcgaagacggcccgagcacttagacacacccgatactcctccaagatcgcaggcccaggagtcaaactacgagaaccttagccagatgaacccaagatccccccctgctactatgtgcagcccttag

SEQ ID NO: 45976 - DNA, 525 bp, Artificial Sequence
  Description of Artificial Sequence: Synthetic coding sequence
atgaccgccacccgggccgccaccgccagcggcagcgccccccggattgtgaacatcagcgtgctgccatcaccagcacatgccttccgggcgctctgcactgccgaaggagaaccgccacccgcactggcctggtccggtcctgccttgggcaactcccttgcagctgtgcggagtcctagagagggacacggacatcttgtgacggctgagctgccagcacttacgcacgacggaaggtatacttgtaccgctgccaacagcctgggccggtccgaggctagcgtatatctattccgcttccacggagccagcggggcttctacagtggcactgttactcggcgccctgggtttcaaggccctcctcttgctgggagtgctcgcagctagggccgcccgaagaagacccgaacatctcgatacccccgatacacctcccaggagccaagcccaggagagtaactatgagaatctctcgcagatgaatcctagaagcccgcccgccacaatgtgcagcccctag

SEQ ID NO: 45977 - DNA, 1494 bp, Artificial Sequence
  Description of Artificial Sequence: Synthetic coding sequence
atgatgagcagcgccgccttcccccggtggctgcagagcatgggcgttcctcgtacgccatctcggaccgtcctcttcgagcgcgagaggaccggtctgacatatagagttcccagcctgttgcctgtccctccaggcccaactctcctagctttcgtcgagcagcgtctctcaccagatgattcccatgcccaccgccttgtgctccgcaggggcacactcgctggcgggagtgttaggtggggagccctgcatgtgctcggcactgctgcccttgcagaacaccggagcatgaatccttgcccagtgcacgacgctggaacaggaaccgtgttcctttttttcattgccgtcctgggccatactcccgaggccgtgcagatcgctaccgggagaaatgctgcccgcctctgttgtgtcgccagtcgggacgctggtcttagctggggctccgctcgcgaccttacggaagaagccataggcggtgctgtgcaggactgggccacgttcgccgtcggaccagggcacggcgtgcaattgcccagtgggcgtctgctggtgcccgcctacacctaccgagtagatcgaagagagtgcttcggcaaaatttgtcgtacaagtccacactcatttgcattctattctgacgaccatggtcgtacttggcgctgtggtggtttggtccccaacctgcggagcggcgagtgccaactggcagcagtcgacggaggccaggcaggttccttcctctactgcaatgccagatcacccctaggcagtcgcgtgcaggcactgagtactgacgaaggtacttcctttctacccgccgaaagagtcgctagcctccctgagacggcctggggatgtcaggggtcaatcgtgggcttccccgccccagctcctaaccgccctcgggatgattcctggagtgttgggcccggttcacccctgcagccacccttgctcggcccaggagtgcacgagccccctgaagaagccgcggttgaccctcgcgggggccaggtgcctgggggtccttttagccgcttacagccacggggagacggtcctcggcagcccggaccccggccaggggtgagtggtgacgtaggcagctggacactcgccctgccgatgccctttgctgccccccctcagtcccctacatggcttctgtatagccatcccgtcggccgtcgggccagattgcacatgggaattaggctaagtcagagccctttggatccacgttcgtggaccgaaccctgggtgatatatgaaggcccctccggctactccgacttggccagcattggtcccgcccccgaaggtggcctcgtctttgcatgcctttacgagagtggcgcccgcaccagctatgatgagatttccttttgtaccttctcacttcgcgaagtactcgagaacgttcctgcctccccaaagccccctaatcttggagacaaaccccgtggatgctgttggccaagctag

SEQ ID NO: 45978 - DNA, 1455 bp, Artificial Sequence
  Description of Artificial Sequence: Synthetic coding sequence
atgggcgtgccccggacccccagccggaccgtgctgttcgagcgggagagaacgggactcacataccgggtcccctctctcttgcccgttccacctggaccgacccttctggccttcgtggagcaacggcttagccctgacgacagtcacgctcacaggctggtactcagaagggggacccttgcggggggatccgtacggtggggcgccctacacgtgttgggcaccgcagctctcgcagaacatagaagtatgaacccctgtccagtccatgatgccggcacaggcacagtctttctgttcttcatcgctgtccttggtcatacacctgaggccgtgcagatcgcaactggtagaaatgctgcccgtctgtgctgtgtggcatctagggacgcaggactgtcgtggggatcagcccgagatctgactgaggaggctattggaggggctgttcaggactgggccacgttcgctgtgggccccggacacggcgtacagctgccatctgggcggctcctggtgccagcctatacttatcgggttgaccgtcgggaatgcttcgggaagatttgcaggactagtccacatagctttgcattttattccgatgaccacggacgaacctggaggtgtggagggctggtgcccaatctgcggtctggcgagtgccagctggccgcagtggatgggggacaggcaggatcattcctgtattgtaatgctcgaagccccctgggtagtcgggtccaagcactcagcaccgatgagggaacatcgttcctgccagcagaaagagtggcaagcctcccagagactgcttgggggtgccagggctcaattgtgggcttcccggcccccgctccgaatagacccagggatgactcctggtccgtgggaccaggcagtccactgcaacctcctctgctggggcctggcgtgcacgagccacccgaagaggccgccgtcgatccacgggggggccaggtgccggggggtccattctctagactgcagccccgtggagacggacctcgccaacccggcccccgtcccggagtttcaggggacgtggggtcatggaccttggcattgcccatgccctttgctgcaccgccacagagtcccacatggctcctctattcacatccagttggcagacgggctcgtctccacatggggatccgactgtctcagagccctctagatcctcggtcttggactgagccgtgggtaatctatgaaggaccatccggttactccgatctagcatccatcggacccgcacctgagggaggcctggtatttgcctgtctttacgagtcgggtgcacggacaagctatgacgagatatctttttgcaccttttcactgagggaggtcttagaaaatgtccccgccagcccgaaacctcctaacttgggcgacaagcctcgagggtgttgctggccctcatag

SEQ ID NO: 45979 - DNA, 1491 bp, Artificial Sequence
  Description of Artificial Sequence: Synthetic coding sequence
atgatgagcagcgccgccttcccccggtggctgagcatgggcgtgccacggactcccagcagaaccgtgctctttgaacgggaacggaccgggctgacgtatagagttcccagcctgctccctgtgccgccagggccaaccctgctggctttcgtcgagcagagactgagccccgacgacagtcacgcccaccgtctggtcttgcgccgcggtacgttagccggcggttcagtgcgatggggcgcattgcacgtgctgggcaccgcggcactcgctgagcaccggagcatgaacccatgcccagtgcatgacgcagggactgggacggtttttctgttttttattgcggtgttggggcataccccagaggctgtgcaaatagcgactggccggaacgccgcacgactatgctgtgtggccagcagggatgctggcctgtcatgggggtcagcgcgggacctgaccgaagaagcaatcggaggggcagttcaggattgggcaacattcgctgtcggtcctggccacggcgtccagttgccctccggccgactcttggttccagcttatacctatcgggtggaccggcgtgaatgcttcggtaagatatgcagaactagtccgcattcttttgcattttatagtgacgatcacgggagaacatggaggtgcgggggtttggtcccaaacctcaggtccggcgagtgccaattagctgcggtggatggaggacaagccgggagtttcctgtactgtaatgcgagatctccattgggaagcagagttcaggcactgtccacagatgaggggacctccttcttgcccgcagagagagtcgcttcattgccagaaaccgcatggggttgtcagggctccatcgtgggctttcctgcaccagcacccaacagaccacgggacgactcatggagcgttggccccgggagcccactgcagccccctctgctcggccctggagtgcacgaaccccccgaggaagccgctgtggatccacgggggggccaagtacctgggggccctttcagcaggctgcagccgagaggggacggcccacggcaacccggtcccagaccaggcgtctctggcgatgtagggtcctggacattagcgctgccaatgcccttcgcggctccaccacagagcccgacatggttgctgtattcacacccggttggaaggcgggctcggttacacatgggcataagactgagccaatcacccctcgatccccgatcttggactgagccatgggtgatctacgagggccctagcggatacagcgatctcgcaagtatcgggccagctccagagggaggtcttgtgtttgcctgcctttatgagagcggtgcgcgcacatcatacgacgagatctccttctgcactttttcactccgggaggtgttggaaaacgtccctgcttcccctaagccacccaaccttggggacaaaccaagggggtgctgctggcctagctag

SEQ ID NO: 45980 - DNA, 1455 bp, Artificial Sequence
  Description of Artificial Sequence: Synthetic coding sequence
atgggcgtgccccggacccccagccggaccgtgctgttcgagcgggagaggaccggtctgacctatagggtcccatcccttctgccggtcccgccaggccccacactgctagcgtttgtagaacagcgcctgtctccagatgacagtcatgcacacagactcgtgttgcggcgagggaccctagccggcggttccgtaagatggggagctctgcacgtgctcggaacggctgcgttggccgagcaccggagcatgaacccctgccctgtccacgatgccggaacgggaaccgtgttcctgttctttatcgcagtgctggggcacactcctgaggcagtacagatcgccaccggtagaaacgcggccaggctgtgttgcgtagcctccagagacgctgggctctcatggggcagcgcacgggacttaaccgaggaagccatcgggggggcagtacaggattgggcgacttttgcggtgggccccgggcacggagtccaactcccctctggcagactgctggtgcccgcatatacctacagagtggatcggagagaatgtttcggcaaaatctgccgaacctccccccatagcttcgcattttatagtgatgatcatggtaggacctggcgctgtgggggactcgtgccgaacctcagaagtggtgagtgccagcttgccgctgtggatggtggccaagctggatcctttctctattgcaatgcccgttcacctttagggtcccgggttcaggccctgagtaccgatgaggggaccagtttcttgcctgcagagagagtggcaagcctccctgaaactgcttggggctgccaagggtccatcgtcgggttccccgcacctgcccctaatcggcctagagatgatagttggtccgttggcccaggttctcccctgcaaccaccactgctgggtcctggtgttcatgaacccccagaagaggcagcagtcgatccacgaggaggtcaagtgccaggcggtccttttagcagattgcagccacgtggcgatggccctcgacagccgggaccgagacctggtgtttctggggatgtgggctcttggacgctggccctccccatgccgttcgctgcccccccacagagtccaacctggttgctttactctcatcccgtgggtcgccgagctcgcctgcatatggggatacggctaagccaatctcccttagatcctaggagctggactgagccctgggtcatttacgagggtccatcgggttatagcgatctggcctccataggtcccgctccagaagggggactcgtctttgcgtgtctgtatgagtccggtgcccgcaccagctacgacgagatcagtttttgcacattcagcctcagggaggtgctggagaatgtgcctgcctcacctaaaccccccaatctgggagacaaacctaggggatgctgctggccgtcatag

SEQ ID NO: 45981 - DNA, 1455 bp, Artificial Sequence
  Description of Artificial Sequence: Synthetic coding sequence
atgggcgtgccccggacccccagccggaccgtgctgttcgagcgggagcgtaccggtctgacttatagagtgccctcactcttgcccgtgccacccggccccactctacttgcttttgtggagcagcgcctgtcaccagacgacagtcatgcccaccgcctagtgttaaggcgcgggaccctcgcagggggttctgtgcgatggggcgcgctgcatgtccttggtacagctgcactcgccgaacacaggtctatgaatccctgtccagtgcacgacgcagggacaggaacagtatttctcttctttatcgcggtcttgggccacacacctgaggcagttcagatcgccacaggtcggaacgcagcacgcctatgctgcgtcgcctctcgtgatgcaggactctcctggggctcagcacgggacctgaccgaagaggcaatcggcggcgccgttcaagactgggccactttcgccgttggaccaggtcatggcgtgcagctaccaagcggtagactgctggtacccgcatacacttaccgtgtcgatagacgagagtgcttcgggaaaatctgcagaacgtccccccactcattcgccttttacagcgatgatcacgggcgcacatggagatgcggaggtcttgtgcccaacttgaggagtggcgaatgccaactggcggccgtcgatggcggacaggccggtagtttcctctactgcaacgcacggtcccctctggggagccgggtgcaagctttgtccacagacgaaggcacttctttcttgcccgcagaacgcgtggcgtccctgcctgagacggcctggggatgccaaggctcaattgtcgggtttcccgcccctgctcctaataggcctagggacgatagttggagcgtcgggcctggttctccgctgcagcccccgcttctcgggcctggagtgcatgaaccgccagaagaggcggccgtcgatcccaggggagggcaggtgcctggcggaccctttagtcgattgcagcctcgcggtgatggtccacgacaaccgggtccacgacccggggtgtccggtgacgtgggttcctggacgctggcgctgcctatgcccttcgcagcacctccccaatcaccaacatggctgttgtattcccacccggtgggacggagagctaggctccacatggggatcagactttcccagtcccctctggacccgcgaagctggacagagccatgggttatctacgaagggccgtccgggtatagcgacctcgcctccatcggaccagcacccgagggaggactggtattcgcttgcctgtatgaatctggggcaaggacgtcctacgatgaaatctcgttttgcacattcagcctgcgagaggtgctcgagaatgtgccagcatcaccaaaaccgcccaacctgggagataagccccgggggtgctgttggcccagttag

SEQ ID NO: 45982 - DNA, 783 bp, Artificial Sequence
  Description of Artificial Sequence: Synthetic coding sequence
atgggcgtgccccggacccccagccggaccgtgctgttcgagcgggaaaggactggacttacttatcgggtcccaagtctcctgcctgttcctcctggaccaacacttctggcgttcgtggagcaacgcttgagcccagatgattcacatgcgcacaggttggttctgaggagagggacgcttgctggggggtctgtccggtggggtgctttgcacgtgctgggaaccgccgctctggctgaacatcgttctatgaatccatgccccgtgcatgacgcgggcacagggacagtttttcttttcttcattgcggtgctgggccacacccccgaggcagtgcagatcgccactggcaggaatgccgcaaggctctgctgcgtggctagcagagatgcgggattatcttggggaagtgcgagggatctgacagaggaggccataggcggggctgttcaagactgggcaacctttgccgtggggcccggacatggcgtacagttgccctccggacggctcctcgttcccgcatatacataccgcgtcgacagacgagaatgtttcggtaaaatatgccggacaagccctcactctttcgctttctactctgacgaccacgggcggacatggaggtgtgggggactggtccctaatctgcgttcgggggaatgccagctggccgccgtcgacgggggccaggcgggatcttttctatactgcaacgcaagaagccccttgggatctcgagtccaggcgctaagcaccgacgaaggcacctctttttag

SEQ ID NO: 45983 - DNA, 567 bp, Artificial Sequence
  Description of Artificial Sequence: Synthetic coding sequence
atgggcgtgccccggacccccagccggaccgtgctgttcgagcgggagcgtactgggctcacctatcgagtgccaagtctactgcctgtgccaccaggaccgacccttctcgccttcgttgagcaaagactgagcccggacgattctcacgcccatcgactcgtattgcggagagggacactagctggaggctccgtgcggtggggtgcactgcacgtcttaggaacggctgctcttgcagagcaccggagtatgaacccttgccctgtgcacgacgccggtacagggacggtgttcctgtttttcattgctgtgttgggccatacaccggaggctgttcaaattgccactggtaggaacgcagcaagattgtgttgcgtggccagcagggatgccggcctgtcgtggggcagtgctagagatctgaccgaggaagctataggcggggctgtccaagactgggcgacttttgccgtaggacccggtcatggcgtacagctgccgagtggccgactcttagtgcctgcgtacacataccgggtggaccggcgggagtgttttggctag

SEQ ID NO: 45984 - DNA, 1485 bp, Artificial Sequence
  Description of Artificial Sequence: Synthetic coding sequence
atgaagctgcaggagggccacaccgtgctgctgagcctgcccctgagactggcagggaccgagactgaacatggaggaccatcctatccatttacagactcggccctgagagctggtgaggacgggcccgatctgccaagagcactagccgctccacgggctcccccagatgatagccacgcgcatcggttggttctgcggcggggcactctggcgggcggaagtgtgaggtggggagccctacatgtcctggggacggccgccttggctgaacatcgttctatgaacccatgccccgtgcacgatgccgggactggcaccgtctttttgttcttcattgcagtgttaggacacactcctgaggccgttcagatcgcgactggccggaacgccgctcgactgtgttgcgtggcatctcgggatgcggggctcagctggggtagcgccagggacttaacagaagaggccattggcggcgcagtccaagactgggccacttttgccgtcgggccagggcatggcgttcagctgccatctggacggttactcgtgcccgcctacacctatcgtgtggatcgccgtgaatgcttcggcaaaatttgtcggaccagcccccattcttttgccttctactcagatgatcatggtcgcacctggcgttgtggaggcctcgtgccaaatttgcgttctggggagtgccaattggccgcagtggacggtggacaggcggggagcttcctgtattgtaatgctaggtccccgttgggatcccgagtgcaggcgctgtcaaccgatgagggtaccagctttctcccggccgagcgggtcgcaagcctgcctgagaccgcttgggggtgtcagggtagtatcgtaggcttcccagctccagccccaaaccggcctagggacgacagctggtctgtggggcctggtagtcccctccagccaccccttctcggacctggcgtccacgagccgcctgaggaggcagccgttgatccaagggggggacaggttccgggaggtccatttagtcgactgcagccacggggagacggtccacgtcagcccggcccgcgcccgggtgtatctggtgatgtgggcagttggactcttgccctgccaatgcccttcgcagccccacctcagagccctacctggctgctgtattcacatcccgtggggcgaagggctcggctgcacatgggtatccgcctcagtcagagtcccttggatccccggtcgtggaccgagccgtgggtgatatacgagggtccgtcgggctacagcgacctggcctctattgggcctgcccccgaaggtgggctggtatttgcttgcctatatgaatcaggcgcccgcaccagctacgatgagatctccttctgtactttctctctccgagaagttttggagaacgtacctgcctcacctaagccacccaacctcggcgataagccccgagggtgctgttggccctcctag

SEQ ID NO: 45985 - DNA, 2484 bp, Artificial Sequence
  Description of Artificial Sequence: Synthetic coding sequence
atgcggggctgcctgcggctggccctgctgtgcgccctgccctggctcctactggcagcaagcccaggccaccctgccaagagccccagacagcctcccgccccacggcgcgacccattcgatgccgcccggggcgctgacttcgaccacgtatacagcggagtggtaaacttgagcacagaaaacatctattcatttaattacactagtcagcccgatcaggtcactgccgtacgcgtgtacgtcaattcctcatctgaaaacctcaactatcctgtgctggtcgtagtgcgtcagcaaaaggaggtcctgtcttggcaggtacctctactctttcagggattatatcagcgttcatataactaccaggaagtgtctcgaactctgtgcccctccgaggcaaccaatgagacaggacctctccagcaattgattttcgtggatgtagcatccatggcgccgctgggggcccagtacaagctcctcgtgactaaactgaaacacttccagctgcggaccaatgtcgcgtttcactttaccgcatcaccaagtcagcctcaatactttttatataagtttcccaaggatgtcgactccgtgatcattaaagtggtgtccgagatggcttacccatgcagtgtggtatcagtacagaatattatgtgtcccgtctatgacttggaccataatgtggagtttaatggcgtataccaatccatgaccaagaaggccgctatcacattacagaaaaaagacttcccaggcgagcaattttttgtggtgtttgttatcaagcctgaagattacgcttgtgggggcagttttttcatccaggagaaggagaatcaaacctggaatttgcagcggaaaaaaaatctggaggtcacgattgtcccgagcatcaaagagtcggtgtacgtcaagagcagcctcttctccgtgtttatctttctctccttttacttgggatgcctgctggtcggcttcgttcactatctgagattccagagaaagtccattgatggctcttttggcagtaacgatggtagcggcaatatggtagcctctcacccaatcgccgcctccaccccagaaggatcgaactacggtaccatcgacgagagttcatcgtcacctgggcggcaaatgagtagctcagacggagggccccccggccaatcagatacagactcttcagtggaagagagcgatttcgataccatgcccgatatcgaaagtgataagaatattattcgcactaaaatgtttctgtacctttctgacctgtctaggaaggaccgtagaattgtttctaagaagtataagatatatttttggaacatcattactatagccgtcttctatgctctgcccgtgatccagttggtcatcacctaccagactgttgtcaacgtgaccggtaatcaggacatctgttactataactttctctgtgcccatcccctgggcgtgctctccgcattcaataacattctgtcaaatcttggacacgttcttctggggtttctgttcctcctgatcgttctcagacgagatatcttgcacaggagggccctggaagcgaaggatattttcgcagtggagtacggtatccccaaacacttcggcctcttctacgcaatggggatagcactaatgatggagggagtgctaagcgcatgttaccatgtctgtcccaattatagcaactttcaattcgatacttctttcatgtatatgatagccggcctgtgcatgctgaaactgtatcaaactagacatccagacattaacgcttcagcctactctgcctacgccagcttcgcagtggtaatcatggtgactgtcctgggagtcgtcttcggcaaaaacgacgtgtggttctgggtgattttttcggctattcatgtgctggcgtcccttgcattaagtacccagatctactacatgggaaggttcaagattgaccttggaatttttcggcgagcggcaatggtgttctatactgactgcatccagcagtgtagccggcccctgtacatggatcggatggtcctcttggtggttggcaacctcgtcaattggtccttcgccctcttcggtttaatttataggccccgggattttgcctcctacatgctggggatctttatctgcaacttactgctttacctcgccttctacattattatgaagctccgatcctccgagaaagttttgccagtgcccttattttgcatcgttgccacagcagtaatgtgggccgctgcactttattttttcttccaaaatctcagctcctgggaagggactccagccgagtccagggagaaaaaccgcgaatgcatcctgctcgactttttcgacgatcacgacatatggcactttctttctgctacagccctgttctttagctttcttgtcctgctgaccctggacgatgatctggatgtggtccggagggatcagattccagtattttag

SEQ ID NO: 45986 - DNA, 2499 bp, Artificial Sequence
  Description of Artificial Sequence: Synthetic coding sequence
atgcggggctgcctgcggctggccctgctgtgcgccctgccctggttgttgctggcggcaagcccaggccacccagctaagagccccagacagccgcccgcccccaggagggacccctttgacgccgcccgcggtgctgatttcgatcatgtgtatagcggagtggtgaacctctccactgaaaacatctacagcttcaattataccagccagccagaccaagtcactgcagtcagggtgtacgtgaactctagtagcgaaaacctaaactacccggtcctagtggtcgtgagacagcagaaggaagtgttgagctggcaggtaccactcttgttccaaggcttgtaccagcgatcatacaactaccaggaagtttcacgtacactgtgccctagcgaagccacgaacgagaccggccctttgcaacagctgatctttgtagatgttgcgtcgatggccccactcggggctcagtacaagttgctcgtgaccaaacttaagcactttcaactccgtactaacgtggctttccactttacggcaagcccgagccaaccccagtattttctgtataagtttccaaaagacgtggactctgttatcataaaggtagttagcgagatggcctatccttgctctgttgtgtcagtgcagaatattatgtgtcctgtgtacgacttagaccacaacgtggagttcaatggagtctaccagagtatgaccaaaaaggccgctatcacattgcagaagaaggattttccaggggaacagttctttgtcgtctttgtgataaagcctgaagactacgcatgcgggggctccttttttatccaagagaaggaaaaccagacctggaacctgcagaggaagaaaaacttagaggtcacaatcgtaccaagcatcaaggagagcgtgtacgtaaaaagctctctgttctcagtctttatattcttgagcttctatttaggatgtcttctcgtagggtttgtacattatcttaggttccaacgtaagtcgattgatggatctttcggttctaacgacggcagcggaaacatggtcgcctcacaccccattgcagccagcacacctgaaggcagtaattatggaaccatagatgagagcagttcgtctcccggtcggcagatgtcaagcagcgacggcgggccaccaggccagtccgatacagactcctctgtcgaagagtcagacttcgacacaatgcctgacattgaatccgacaagaatataattcgaacaaagatgtttctttacctgtcggacttgtcccgcaaagaccggcgtattgtatcaaaaaaatacaagatctacttttggaatattatcaccatagctgtattctacgcattgccggttattcaactcgtgatcacttaccagactgtggttaatgtgacagggaatcaggacatctgttattacaactttttatgtgcgcacccactcggtgtcctctctgcttttaacaacatcctctctaacctggggcatgtgcttcttgggtttctcttcctccttatcgtcctcagaagggatatactccataggcgcgcattagaggccaaggacatttttgcagtggaatatggtatccccaagcacttcggcctgttttatgccatgggtattgctctgatgatggaaggagtgctatcagcctgttaccatgtttgtccaaattattctaattttcagttcgacacatcattcatgtacatgatagccggcctgtgtatgctcaaactgtaccaaacacgccaccctgatatcaacgctagcgcatattccgcttatgcttcttttgctgttgtgattatggtgaccgtcctgggagtcgtgtttggaaagaacgatgtctggttctgggtcattttctccgctatccacgtccttgcgtcactggccctctcaacgcagatttattacatgggccgtttcaaaatcgccattacacccactgatctggggattttcagaagagccgcaatggtattctacacagattgtatacagcaatgctcacgtccactgtacatggaccggatggttcttctcgtcgttggaaatctggtcaactggagtttcgctctatttggtttgatttaccgcccaagagactttgctagctacatgctcgggatcttcatctgtaatctgctgctgtacctagcgttttatatcattatgaagctgcgcagctcagagaaggtactgcctgtgcccctgttctgtattgtcgcgaccgccgtgatgtgggccgccgccctttacttttttttccagaacctttcctcttgggagggcacccccgcagaatccagagaaaaaaatcgggagtgtatccttttggacttttttgacgaccacgatatttggcattttctttcggccacagcactgttttttagtttcctcgtactactgacactggatgacgatctggatgtggtccggagagatcaaattccagtgttttag

SEQ ID NO: 45987 - DNA, 2568 bp, Artificial Sequence
  Description of Artificial Sequence: Synthetic coding sequence
atgttcgccctgggcctgcccttcctggtgctgctggtggccagcgtggaaagtcatctgggggtcctgggtcccaagaatgtatcacagaaagacgctgagttcgaacgcacttacgttgatgaggtgaatagcgagctggtaaacatatataccttcaatcacacagtcacacgaaataggactgagggcgttcgggttagcgttaacgtactgaataaacagaaaggagcacccttgctattcgtggtcaggcagaaagaagccgtggtcagctttcaggtgccactgatccttaggggaatgtttcagagaaagtacttatatcagaaagtggagcgaaccctgtgccagcccccaacaaagaatgaaagcgaaatccagtttttctacgttgatgtcagcaccctttctcctgtgaatacgacttaccagttacgcgtttctagaatggatgattttgtcctccggacaggagagcagttctcgtttaacacaaccgcggctcagccacagtacttcaagtacgagtttccggagggtgtcgactctgtgatcgtcaaggtgacaagcaacaaagcatttccttgtagcgtgatctccatccaagatgtgctgtgcccggtatatgatctggataacaacgtagccttcattgggatgtatcagaccatgacaaagaaagcggcgatcaccgtacagaggaaggatttcccctcaaactccttctatgtcgttgttgtcgtgaagaccgaggatcaagcatgcggcgggagtttgcccttctatccctttgcggaagatgaacccgtggaccagggacacaggcagaaaacactgtccgtgctggtctcacaggctgtgacctctgaggcctatgtatctggcatgttgttttgtctgggaatctttctatctttctacttgttaacagttttactggcctgctgggagaattggcgccagaaaaaaaagacattgttagtcgctatagatcgcgcgtgccccgagtccggtcacccccgggttttagcagattcttttccaggcagctccccctatgagggctacaactacgggtcttttgagaacgtgtctgggtctactgacggcctggtcgacagcgcaggtactggggatcttagctacggctatcaaggccacgatcaattcaagagacggctaccttcagggcagatgagacaactgtgtattgcaatgggccgcagctttgaaccagtgggcacgcgcccaagagttgactccatgagttctgtggaggaggatgactatgacactctcactgacattgactccgacaaaaacgtgatacgaactaagcagtacctgtatgtggccgacctggcccggaaagacaaacgcgtcctgcgtaagaagtatcagatttatttctggaacatcgccactatagcagttttttacgctctgccggtcgtgcagctggtcattacctatcagaccgtggtaaacgtcactggaaaccaggatatctgttactacaacttcttgtgtgcccatccattggggaacctgtcagctttcaataacatcctctctaatttgggatacatcctgctgggcctcctgttcctattgataatactgcagagggagattaatcacaacagggcccttctcaggaacgatttatgcgctctggagtgcggaattcctaaacactttggtctcttttacgccatgggcacagcactgatgatggaaggacttctgtccgcttgctaccacgtatgtccgaactacacaaattttcagtttgacacatccttcatgtacatgatcgctggcctgtgtatgctcaagctttaccagaagcgacaccccgatattaacgcgagtgcctatagcgcctatgcttgcctggccattgtgattttcttctccgtcttgggcgttgtgtttggaaaaggcaacacagctttttggatagtattctctattatccacatcatcgctactcttcttctgtctacacagctgtattatatggggaggtggaaattggactctggaatcttccgtaggatacttcacgtcctgtacaccgattgtatcaggcagtgttctggacccctgtatgttgatcggatggtactgctggtgatgggcaacgtgatcaattggtctttggccgcatatgggctgattatgcggcccaacgacttcgcctcgtacctattagcgataggaatctgcaacctgctgctgtactttgcgttttatatcatcatgaagttgagatccggagagcgcatcaaattgatacccctgttgtgcattgtgtgtacttcggttgtctggggtttcgccttgttctttttcttccaaggcttgtctacgtggcagaaaacccccgccgagagtagagaacataatagggattgtattttattagatttcttcgacgaccatgacatttggcatttcctgtcatctatcgcgatgtttggttccttcctcgtgtctggccccccaggccgggccggctgggtcagggaaggatccagctgtcttctgctgtgcgggtag

SEQ ID NO: 45988 - DNA, 2499 bp, Artificial Sequence
  Description of Artificial Sequence: Synthetic coding sequence
atgttcgccctgggcctgcccttcctggtgctgctggtggccagcgtggaaagccatttgggggtactcggacctaaaaatgtgagccagaaagacgccgagttcgagcgcacgtatgtggatgaggtgaactctgagctggtcaatatctatactttcaatcacactgtgacccgtaatcgcacagagggggtccgcgtgagcgtgaatgttctgaataaacagaaaggagcgcccctgttgttcgttgtgcgtcaaaaggaggctgtggtgtcattccaggttcccctgatcctaaggggaatgttccagagaaaatatctgtaccagaaggttgagcggaccctctgtcagcccccaactaagaacgagtccgaaatccagttcttctacgtggatgttagtacactttcacccgtgaacacaacttaccagctcagagtgtcaaggatggacgacttcgtgttgcgcaccggagagcagtttagttttaacacaactgccgcccaaccacagtactttaagtacgaattccccgagggggtggattctgtgatcgtgaaagtgactagcaacaaggcttttccttgttcggtcatctcaatacaggacgtgttgtgccctgtgtatgatcttgacaacaatgttgcctttatcgggatgtaccagactatgactaaaaaagccgcaatcacagtgcaacggaaggactttccatccaactcattctacgttgtcgtggtggtgaagacagaggatcaagcatgcggagggtccctccccttctatcccttcgcggaagatgagcctgtagaccagggtcaccgacagaagaccctgtccgtacttgtttctcaagctgtcacatccgaggcctacgtaagcggcatgttattctgtcttgggatctttctgtctttttaccttctaacagttctgctcgcatgttgggaaaactggcggcagaaaaaaaaaacgttgctggttgcaattgaccgcgcctgtcccgagtccggccacccgcgagtgctcgcggattcttttccaggaagcagcccctatgagggttacaactacggtagctttgaaaacgtttccggaagcaccgacgggttagttgatagtgcaggcacaggcgacctcagttatggctaccagggaagatcctttgagcctgtcggcacacggcctagggtggactccatgtcatctgtggaagaggacgactatgataccctgactgatatagactctgacaagaatgttatacgaaccaagcagtacctttatgttgcagatttagctcgcaaggacaagcgggtgctccgcaagaaatatcaaatctatttctggaacatcgcaaccatcgcagtcttctacgccctgcctgtggtgcagttagtgatcacctatcaaacagtcgtgaacgtgacggggaatcaagacatctgctactataattttctgtgtgcacaccctcttggaaacctctctgcttttaataacatcttgtcaaacctgggctacattctcctcggtctccttttcctgttgattatccttcagagagagatcaatcacaaccgagcactgctgcggaatgatctttgtgccctggaatgcggtatcccgaagcattttggcctgttctacgctatgggcacggctctgatgatggagggattgctctccgcttgctaccacgtttgtcctaattacaccaatttccaatttgatacttccttcatgtatatgatcgcaggtttatgcatgttgaaactttatcagaaacgccacccggatattaacgctagcgcctattcagcttacgcttgcctcgcgattgtgattttcttctccgtgctaggggtggtctttgggaaaggcaatactgcattttggatcgttttctctataattcacatcatcgccacactcctgttgagcactcagctgtactatatggggcgctggaagttagacagcggaatctttcggaggatacttcatgtgctttacacagactgcatccggcagtgctctggccctttatatgtcgatagaatggtgctcctggtaatgggcaacgttattaattggtccctagcagcttacggtctcatcatgcggcctaacgacttcgccagctatcttttggctatcgggatttgcaatcttctgctgtacttcgctttttacatcatcatgaaactgcgctcaggggaacggataaaattgattcctctgctgtgcatcgtctgtactagcgtagtgtggggcttcgcacttttcttcttcttccagggcctcagcacgtggcaaaaaacccctgcagagagcagggaacataacagggactgtatcttacttgactttttcgacgaccacgatatttggcatttcctatctagtatagctatgttcgggagctttctagtgctgcttactttggacgacgacctggacactgtgcaaagagacaaaatctacgtattctag

SEQ ID NO: 45989 - DNA, 561 bp, Artificial Sequence
  Description of Artificial Sequence: Synthetic coding sequence
atgttcgccctgggcctgcccttcctggtgctgctggtggccagcgtggaatctcacctcggggtcctgggaccaaagaatgtttctcaaaaggacgcagagtttgagcggacttacgtcgacagaatggtattgctagttatgggaaacgttattaactggtctctggccgcgtacggactgatcatgcgtcctaatgattttgcgtcatatcttttggccatcgggatttgcaacctcctcctctattttgcattttacatcattatgaagctgaggtcaggcgagcgtataaaattgattcctctgctgtgcatagtgtgcacctcagtggtttggggattcgctctgtttttcttcttccagggtctaagtacttggcagaagactcctgctgagagtcgagaacacaacagagattgcattctgctggacttctttgacgaccatgatatttggcattttctgtccagcattgctatgttcggcagctttctcgtgctcctcactctggatgatgacctggacacagtgcagcgggacaagatttacgtcttttag

SEQ ID NO: 45990 - DNA, 2490 bp, Artificial Sequence
  Description of Artificial Sequence: Synthetic coding sequence
atgttcgccctgggcctgcccttcctggtgctgctggtggccagcgtggagtcacacttgggagtcctgggccctaagaatgtatctcagaaggatgcagaattcgaacgcacatatgtggacgaggtcaacagtgaattagttaacatttacaccttcaatcacactgttacacgaaacaggaccgagggcgtgagagtgtctgttaacgtcctgaacaagcagaagggcgcaccacttttgttcgtcgtgaggcagaaagaggctgtcgtgtcctttcaggtgccattgatactgcgcggaatgttccaaagaaagtacctctaccaaaaggtggagagaacactgtgtcagcctcctaccaagaatgagagtgagattcagttcttttacgtggacgtgtccaccttgtcaccagtcaataccacttatcaacttagagtctccagaatggacgactttgtgttgcgtacaggcgagcagttctcgtttaacacaacagccgcgcagccgcagtacttcaaatacgaattccctgagggggtggatagcgtgatcgtcaaagtcacatcaaataaggcctttccatgtagcgttattagcatccaggacgttctgtgcccagtctacgatttggacaacaatgtagcctttatcggaatgtaccagactatgactaaaaaggccgcaattacggtgcagcgcaaggatttcccgtccaacagcttctacgtcgtggttgtggtcaagacagaagaccaagcgtgtgggggaagtctgccgttttatccattcgctgaggacgaaccagttgaccagggccacaggcaaaaaacgctctcagtgctggtctcccaagctgtgacctcagaggcatacgtgagcggaatgctgttttgcctgggcatctttctctccttctatctgttgaccgtgctcctcgcctgctgggaaaactggaggcagaagaagaagaccctgctggttgccatcgaccgtgcttgcccggagagcgcctctctattaggacaccccagggtgctggcggactcttttccggggtcaagcccgtatgaggggtacaattatgggtcgtttgagaacgtgtctggatccaccgatggcctagtggacagcgcgggcacaggagacttaagctatgggtatcaaggtaccagaccgcgggtggatagcatgagctcagttgaagaggacgactatgacaccctgaccgatatagactctgataaaaatgtgattcgtacaaaacaatacctctatgtcgccgatcttgctaggaaagataagcgtgtgctgaggaagaaataccagatctatttttggaacatcgccaccattgcagtgttttacgcgttaccagttgttcaacttgtgatcacgtatcagacggtagtgaacgtaaccggcaatcaggacatttgctattacaatttcctgtgcgcgcaccctcttgggaatctatctgcttttaataacatactgagcaacctgggatacatcctgcttggtttgctcttcttgctgatcattctgcagagggagattaaccacaatagggccctgttacggaacgacctatgtgccctcgagtgcgggattcccaaacacttcggccttttctatgcaatgggaactgcactgatgatggaaggcctacttagcgcatgctatcacgtgtgcccaaactacaccaacttccagttcgatacctcatttatgtatatgatcgccgggctctgcatgttgaaactctaccagaaaaggcatcctgacataaatgcatctgcctactccgcttacgcctgtctggccatagtaatattttttagcgttctcggggtcgtgttcggtaaagggaatactgcattttggatcgtgttctcaatcatccacataatcgctaccctgttactcagcacacagttgtattatatgggcaggtggaagcttgactccggcattttccgacggattctgcatgttctgtatacggattgcattcgacaatgctcgggcccattgtacgttgataggatggtgctcctcgtcatggggaacgtgatcaactggtctctggccgcttatggccttatcatgaggcccaacgatttcgctagttatttacttgcgattggtatctgtaacttgttgctctattttgctttctacatcatcatgaagttacggtccggcgaaagaatcaagctgattccgctgttgtgtatcgtgtgcacaagtgtagtctggggatttgctcttttcttcttttttcagggtctgtcaacctggcagaaaacccccgccgagagccgtgaacacaatagggactgtatcttactagatttcttcgacgatcacgacatatggcatttccttagctctatcgcaatgttcgggagtttcttggtactcttaacgctggacgatgatttagacactgtgcagcgggacaaaatctatgtattttag

SEQ ID NO: 45991 - DNA, 330 bp, Artificial Sequence
  Description of Artificial Sequence: Synthetic coding sequence
atgttcgccctgggcctgcccttcctggtgctgctggtggccagcgtcgaatcccacctgggggtcctcggacccaagaatgtatcccaaaaggatgcagaattcgagcggacgtatgtggacgaggtgaattctgaactggtgaacatatatacattcaaccacaccgtgactcgcaatcgcacggagggcgtgcgggtttccgtcaatgtgctgaacaagcagaagggggctccacttctcttcgttgttagacaaaaggaagctgtggtcagtttccaggtccccctaattctgcggggcatgtttcagcgtaagtacctttattag

SEQ ID NO: 45992 - DNA, 333 bp, Artificial Sequence
  Description of Artificial Sequence: Synthetic coding sequence
atgttcgccctgggcctgcccttcctggtgctgctggtggccagcgtagagtcacatctcggggtgctcggcccaaagaacgtcagtcagaaggatgccgagttcgagagaacatacgtcgatgaggtgaactctgagctggtgaatatctacacctttaatcacactgtcacccgaaataggacagagggtgtgcgagtgtccgtgaatgttttgaacaagcaaaaaggggctcctttactgtttgtggtcaggcagaaggaggccgtggtctccttccaggtgccactgatccttaggggaatgttccagcggaagtacttatatcagtag

SEQ ID NO: 45993 - DNA, 6642 bp, Artificial Sequence
  Description of Artificial Sequence: Synthetic coding sequence
atggcccggggcgcccggcccagcgccgccggcggcggcggcggcggcgccgaaccaccagaacgcgcaggccccggtcgaccacgaggcagccctcctggacgggccagaccctctctggcacctcgacctggacccgaacccagccgcccacgggctgcacccgagacttccggaggagacacagctggtgccggccgatgcggaggcaggcgcgccgccaaacttggacccggcaggaggggatggtgggctcttctggcactccagctgcatctgcttcgggctctggcccaggacgacgtggccccatacttcaaaaccgagccgggactacctcagatacacctggaaggtaacaggttagttctgacgtgtctggccgaaggcagttggccactggaatttaagtggatgcgtgacgatagtgaactgactacatacagctccgagtataaatatattattccctcactgcagaagctagatgccggattctacaggtgcgtggtgcggaacagaatgggcgcactgcttcagcggaaatctgaggttcaggtggcgtacatgggcagttttatggatacggatcagcgcaagactgtttcacaagggcgcgccgccatcttaaatttgctgcccattacttcctacccccgccctcaagtgacttggttccgggaaggacacaagataatcccgtccaaccgcattgccataaccctcgaaaatcagttggtgatcctcgccactactaccagcgacgccggcgcttattatgtccaggcggtgaatgagaaaaatggggaaaacaagacttcacctttcatacacttgtctatcgcaagggacgtgggtacccccgagacaatggccccaaccatcgtggtaccgccggggaacaggtcggtggtagccggtagctctgagactaccctggaatgcattgcatctgctcgcccggttgaagacctttccgtgacctggaaaagaaacggggttcggatcacatctggtctgcacagctttggtagacgcctcacaatcagcaatccaacttctgcagacacagggccatatgtctgtgaagccgcgcttccaggttcagccttcgaaccagctcgagcgaccgctttcctctttatcattgaaccaccttactttacagctgagccagaatctagaatctcagccgaggtcgaagagaccgttgacattgggtgccaggcaatgggagtcccgttacctaccctccaatggtacaaggatgcaatcagcatctccaggcttcagaaccctcggtataaggttctcgcaagcgggggccttagaatacaaaaactccggcccgaagacagcggtatcttccagtgcttcgccagtaatgagggtggcgagattcagacccacacatatttggatgtgactaatattgccccggttttcacccagagacccgtagataccactgtgacagacggaatgactgccattttgaggtgcgaagtgtcaggggctcctaaaccggccattacttggaagcgcgagaaccatatcctggctagtggatccgtgcggatacctaggttcatgctcctcgaatctggcgggctccaaatagcacccgtattcattcaggatgccggaaattatacctgctacgcagctaacactgagggtagtctcaatgcttctgcgactctcaccgtctggaaccgcactagcattgttcatccacccgaagaccatgtcgtgatcaagggtaccacagccacattacactgtggagccacccatgaccctagggtgagtctgcgttatgtgtggaagaaagataacgtggcattaactccctccagtacatcgcgaattgtggttgaaaaggacgggtcgctactcatttcacaaacctggagtggcgacatcggagattatagctgtgagatagtgagcgagggcgggaatgattcacgtatggccaggctcgaggtcatagagctgcctcattccccccagaacttactcgtgtcccctaactccagccacagccacgcagtggtgctgtcttgggtcaggcctttcgacggcaacagtccaattctttactacattgtggagctgtctgagaataactcaccatggaaagtccaccttagtaacgtcggaccggagatgacaggcgtcactgtctctgggctcacacctgcccgcacgtatcagttccgagtgtgcgcggttaatgaggtgggccggggccagtactccgctgaaacatctcggctgatgctacccgaggaacctcccagcgctccccccaagaacatcgttgcctccgggcgcaccaaccagtccattatggtccaatggcaaccacccccagaaacagagcataatggggtgctgcggggatatatcctcagataccggcttgctggtcttcctggggagtaccagcagcgaaatattacaagccccgaagttaactactgcctggtgaccgacctgatcatatggacacaatacgagattcaggttgccgcctacaatggggctggcctcggagttttctcaagggcagtgactgaatacaccttacaaggggttcccaccgctcccccacagaacgttcagaccgaggctgtcaatagcaccactattcagttcctgtggaacccacctccccagcagtttatcaacgggataaaccaagggtataagctgctcgcctggcctgccgacgcccctgaggctgtcactgtggtgactattgcacctgactttcatggcgtgcaccacggacacatcactaacctgaagaagtttaccgcttacttcacatctgtactttgttttacaactccaggggatgggcccccctcaacccctcaactggtgtggacccaagaggataagcccggagcagtcggacaccttagcttcacagaaatcctcgacacaagtcttaaagtatcttggcaggaaccgttggaaaagaacggcataatcacagggtatcagatctcttgggaagtgtacgggcggaacgatagccgactcacccatactttgaacagtactacccacgagtacaagatccagggtctctcttctctcaccacctatactattgacgtcgcggcagtaacagccgtcggtaccgggctggttacgtcttccactatttctagtggagtaccccccgacctccctggtgcaccatccaatctggtcatcagtaatattagccccaggagcgcgaccctgcaattccgtcccggatatgatggcaaaacatccatctcaaggtggatcgtggaaggtcaagtcggggccattggggacgaggaggaatgggtcaccctctatgaggaggagaacgagccagatgcccagatgttagaaatcccaaatttaaccccttacacacactatcgctttcgcatgaagcaagtgaacattgtcggaccctcaccgtacagcccttcatcaagagtaatacaaacacttcaggcacccccagacgtagcaccaacgtctgtgaccgtacgaaccgccagcgagacctctttgagactccggtgggtcccactcccagatagccaatacaacgggaaccctgaatccgtgggatatcgcattaagtactggagaagcgacctacagtcgtctgctgtggcccaggtggtcagcgaccggctggagcgggaattcaccattgaagaactcgaagaatggatggagtacgaattgcagatgcaggcgtttaatgctgttggggccggcccctggtccgaagtggtccgtgggcgcacccgtgaaagcgtgccgagcgcagctccagaaaatgtgtcagctgaagcagtctcatctacccagatattactgacctggacgagcgtgcctgaacaggaccagaacgggctgatactgggatacaagattctatttagagctaaggatcttgatccagaaccaaggtctcacattgtgcgcggcaatcatacacagtctgccctccttgccgggcttcgcaaatttgtgctgtatgagctccaggtgctcgccttcacccggatcggcaacggcgttcctagcacccccctgatcctagaacgcaccaaggatgatgccccaggccctccggtgagactggtcttcccagaggttcgactaacctctgtacgcatagtgtggcagcctcctgaggaacccaatggcattatactgggttatcagatagcctacaggctagccagcagctctcctcacactttcactactgtggaggtgggcgcaaccgtccggcaatttacagctactgacttggctcccgaaagtgcatatatttttcgattaagcgctaaaacccgccaaggctggggggagcccctcgaagcaaccgttatcacaacagaaaagagagagcgccctgctcctcctagggagctgctcgtgccccaggctgaagtgactgcccgctccctgcgcctgcagtgggtgccaggttcagatggcgcatcaccaatcagatactttaccatgcaggtgagagagttgccaagaggtgaatggcagacttatagttcctctatttcacacgaagccactgcttgcgtcgtggatcgtctgcgcccctttacctcctacaaactacggctgaaggcaaccaacgatataggcgactccgattttagcagtgagactgaggccgtcaccaccctgcaggacgtcccaggggagcccccaggcagcgtgtcggctacgccacacacaacctcatccgtgctcatacagtggcagccacccagggacgagtccctcaatggccttttacagggatataggatctactaccgggagctggaatacgaggcagggtccgggactgaggcgaaaaccttgaagaatccgatcgccttgcacgctgagcttactgcccagagctcattcaagactgtcaattcaagttcaacctctaccatgtgtgagctcacccatctgaaaaaataccgccggtatgaggtgattatgaccgcctataatatcatcggggaatcacccgcatcagcaccggtcgaggtattcgttggggaggcagctccagcaatggccccacagaacgtgcaggtaacccctttaactgccagccagttggaagtgacctgggaccccccgcctccagaatcccagaatgggaacatccagggttacaagatctattactgggaggcggatagccaaaacgagacggaaaaaatgaaagtgctcttcctcccagagccggtagtcagactgaagaacctgacatctcataccaagtatctggtaagcatatccgcgttcaacgccgcgggagacggacccaagtcagacccccaacaggggaggacccaccaggccgctccaggtgcgccttcatttcttgccttcagcgagatcacatcaacgaccttaaacgtgagttggggggaacccgccgccgctaacggcatcctacaggggtatagggttgtgtatgagcccttagctccggtgcaaggggtgagcaaagttgtcactgttgaggtcagggggaattggcagagatggctcaaggtcagggatcttactaaaggggtgacatacttttttagagtgcaagcccgtactatcacatacggtcctgagctgcaagccaacatcacagccggaccagccgaggggtcacctggcagcccacgcgatgttctagtcacaaagagcgcatccgagttaactctgcagtggacagaaggacactctggagacacccctaccacaggatacgtgatcgaggcaagacctagtgacgaggggctgtgggacatgttcgtgaaggacatccctcggtcagccacaagctacaccctctcactggacaagctaagacagggagtcacctatgaattcagggtcgtggctgtcaatgaggctggatatggcgagccaagtaacccctccactgccgtctctgcccaggtcgaagctcccttttatgaggagtggtggttcctgctcgttatggcccttagttcattgatagtcatcttgctggttgtctttgccctggtgctccatggtcagaacaaaaagtacaagaattgcagtaccggtaagggaatttctactatggaagaatccgtcactctggataacggcggtttcgccgcactcgagctcagtagtcgccacttgaatgtgaaaagcacgttctcaaagaagaatggcaccaggagcccaccacgacccagcccaggggggctgcattattctgatgaggatatatgcaataaatacaacggcgccgtgcttacagaatctgtgtctctgaaggagaagtctgctgacgcatcagaatcagaggctactgatagcgactatgaggatgcactgcctaagcatagcttcgtgaatcattacatgtccgaccctacctattacaactcctggaagcgtcgggcgcaaggccgtgctcctgccccccatagatacgaagctgtggcaggcagcgaagcaggcgcccagctgcaccctgtcataacgactcagtcagcggggggagtttacactcccgctggaccgggagcgagaactcctcttactggcttctcatctttcgtgtag

SEQ ID NO: 45994 - DNA, 1386 bp, Artificial Sequence
  Description of Artificial Sequence: Synthetic coding sequence
atgaaggtgctgttcctgcccgagcccgtggtgcggctgaagaacttaacatcccatacaaagtacctggttagcatatccgctttcaacgccgctggagacggtccaaagtccgacccccaacagggtaggacacaccaagccgctccgggagctccaagcttcctggcattctctgagatcacttcaacaacccttaacgtctcatggggcgaaccggccgccgctaacggcatactgcagggttatagagttgtctatgagccacttgcgcccgtgcagggcgtgtcaaaggttgttacagtggaggtacgaggaaactggcagcgttggctgaaggttcgggacctgaccaaaggcgtgacttattttttccgtgttcaggcccgcaccattacttacggcccagagctccaggcaaacattacagcaggacccgctgagggtagcccgggttcgccgagggatgtgctggtgactaagagtgcctctgaattaaccctccagtggactgagggacactctggggacacgccgacgacgggctacgtcatcgaggcaagaccctcagatgagggcctttgggatatgttcgtaaaagacatcccacgctctgctacaagctacaccctcagtttagacaagctgcgccagggtgtcacctacgagtttagggtggtagccgtgaatgaagcagggtacggtgagccttcaaacccttccactgcagtctcagctcaagtcgaggcaccattctatgaggagtggtggtttctccttgtgatggctctgagctcgttgatcgtcatcctcctagtggtgtttgcgctggtcttgcacggtcagaataaaaagtacaaaaattgcagtacgggcaagggcattagtactatggaggaatcggtcactctggataacggcgggtttgccgccctagagttgagcagtcggcacctgaacgtgaaatcaactttctccaagaagaacgggacccggtcaccaccccgcccaagccccggcggcctgcattactcggacgaggacatctgcaacaaatacaacggtgctgtcctcaccgagagtgtctccctgaaagagaagagcgcggacgcctccgagagcgaagcaaccgactctgattacgaagacgccctaccgaaacacagttttgtcaaccattatatgtccgaccctacctattacaatagctggaaaaggcgggctcaggggcgggcccctgctccacatcggtatgaagccgtggcggggtccgaggcaggcgcccagttgcaccccgttataaccactcagtcagcaggtggagtatacacaccggccggtcctggtgcgcggaccccccttacggggtttagtagctttgtatag

SEQ ID NO: 45995 - DNA, 6651 bp, Artificial Sequence
  Description of Artificial Sequence: Synthetic coding sequence
atgtggggcctgctgatctggaccctgctggccctgcaccagatcagagccgccagagctcaggatgacgtgtcaccctatttcaaaaccgagcccgttcggacacaagtgcacctggagggcaatagattagtcctcacatgtatggccgaagggagctggcctctcgagtttaagtggctccacaataatcgcgagctcacaaaattctccctggaatataggtacatgatcacaagtttggaccggacgcacgccggcttttaccgatgcattgtcaggaacagaatgggagccctgctccaaaggcagacagaggtccaggttgcttacatgggctccttcgaggagggtgaaaagcaccagagtgtaagtcacggagaggctgcagtgattagggctcccagaatcgcttccttcccccagccccaagtaacgtggttccgcgacgggaggaagatccctccatcctccaggatagctattactctagagaatacactggtgatcctgtctacggtggcacctgacgccggtaggtactacgtgcaggccgttaatgacaagaatggcgacaataaaacctcccagccaattaccctaacagtggagaatgttggagggcccgccgacccaatagcacccactatcattattccccctaagaacacgagtgtggtagccggcacctcagaggtgacactggaatgcgtggccaacgcccggcctttgatcaaactgcacattatctggaaaaaggatggagtgctgcttagtggggggattagcgaccataacagaaggctgacaatccctaatccgaccggatccgacgcagggtattatgagtgcgaagccgtcctccgatcctctagtgtgccgagtgtggtgaggggagcttacctatctgtccttgaaccccctcaatttgtcaaggagccagaaagacacatcaccgccgagatggaaaaagtggtagatatcccctgccaggccaagggagtcccacccccctccatcacttggtataaggatgccgcagtagtggaggtggagaagttgacacgtttcaggcagcgcaatgatgggggattgcagatcagcgggcttgttcctgacgataccggtatgtttcagtgttttgctcgaaacgccgccggggaggttcaaaccagcacatatctggccgtaaccagcatcgcaccgaatattaccaggggccccctggactccactgtcatagacggcatgagcgtggtgcttgcttgcgagacctctggcgcccctaggcccgcaataacttggcagaagggtgaacgtatcttggcatcgggcagtgtgcagctacctagatttacgccgctggaatccgggagtctgctgatctctccaacccacatctctgatgccggaacatatacctgcctggccaccaacagccgcggggtcgatgaagcttctgcggacctggtggtatgggcgcgcacgcgtatcaccaagccgccccaggaccagagcgttataaagggtacacaggcttccatggtctgtggagttactcatgacccacgcgtgacgatccgatacatctgggaaaaggacggagccacattaggtaccgaatctcaccctaggattcgcctggataggaacggctctctgcatatttctcaaacctggagtggggatataggaacatacacatgtcgggttatcagcgccggtggaaatgactcaaggagtgcacatctacgcgtccggcagttaccccatgcgccggaacaccctgtggcgaccctgtcaaccgtagagaggcgggctatcaacctgacttggactaagccctttgacgggaactctcctctgatccgctacatccttgagatgtctgaaaacaacgcaccatggactgtgctcctggcctcagtggacccaaaagccaccagtgtgacggtgaaaggcttggtacccgctagatcttaccagttccgtttgtgcgctgtgaacgacgtgggcaaagggcagttttctaaagataccgagcgggtgtctctgcctgaagagcctccaaccgctccaccccagaacgtgattgctagcggacggactaatcaatcaatcatgatacagtggcagccaccgccagaatctcatcaaaacggcattctgaaaggttacatcatccgctattgtctggcaggattacccgtgggataccaattcaagaatattacagatgccgatgtcaacaacctgcttctcgaagatctcattatctggaccaactacgaaatagaggtggcagcctataattctgcgggcctgggtgtctactcatctaaagttactgaatggacgttgcaaggggttccaacagtaccccctgggaacgtacacgcggaggcaacaaattccaccactatcagattcacatggaatgctccttcacctcaattcatcaacggcatcaaccagggctacaagctcatcgcatgggaaccagagcaggaggaggaagtgactatggtgaccgcccggcccaatttccaggactcaatccacgtcggattcgtctctgggctcaagaagttcaccgagtactttacatctgtcctatgtttcaccacgcctggcgacggtccacggagcacaccccaattggtgcggacccacgaggatgtccctggtccagtcggccatttgagcttttcagagatcctggatacctcccttaaagtatcttggcaggagcccggcgaaaagaacgggatcctcacggggtaccgaatttcctgggaagagtataaccgaactaacaccagggtgacccactatttacccaatgtaaccctcgagtatcgcgtgactggactgaccgcgctgacaacctatacaatcgaggtcgcagccatgacatctaaggggcaggggcaggttagtgcatctacaatctccagcggggtcccgccagagctgcctggccccccaaccaacctggggattagcaatatcgggccgcgatctgtgacgttgcaattcagacctggctatgacggcaagacatccatttcgagatggctggtcgaggcccaagtgggagtcgtaggtgagggggaggagtggctgctcattcaccaattgagtaacgaaccagacgcccgctccatggaggtgcccgacctcaatccatttacgtgctattccttcagaatgcgacaggtgaacattgtgggaacgtctcccccatcacagccaagccggaagattcaaacccttcaggccccacctgatatggcccctgccaatgtgtcacttcggaccgccagtgaaacttccctgtggcttcgatggatgccactccccgagatggagtataacggcaaccctgagagcgtgggctacaagatcaagtatagccgcagcgatggtcacgggaaaacactatctcatgtggtccaggaccgggtggagcgcgattacacaatcgaggatcttgaagagtggacagagtacagagttcaggtccaggcctttaatgctattggttcagggccctggtctcaaacagtggtggggaggacgcgtgagagcgtcccaagctcagggcccacaaatgtaagcgcgctggctaccacctcttctagcatgctagtaagatggagcgaggtgccggaagcagaccgcaatggcctcgtgttgggctacaaggtaatgtacaaagaaaaggacagcgacactcaaccgagattctggttggtcgagggcaatagctcacggtctgcacagttaacgggcctcggcaaatacgtgctctacgaagtacaggtactggcattcaccagaatcggcgacggttcacccagccatccacctattctggagaggactctagacgatgttcctgggccccccatgggaatcttgtttcccgaggttaggacgacctctgtgagactcatctggcagccccctgcagcaccgaatggtatcatcctagcctatcagatcacccaccgactgaacacaactaccgctaacactgccaccgtggaggtgctggcccccagcgccagacagtacactgcaaccgggctcaaacctgagtctgtgtacctgttccggatcacagctcaaactcgaaaaggctggggggaagctgccgaagctctggtcgttactaccgagaagagggatagaccgcagccacctagcagacctatggtccagcaggaggatgtgagagcaagaagtgtcctgctgtcttgggaacccggatcagacggcctgtctcctgttcggtattacactatccagacacgagaactgcctagtggcagatgggccctgcacagtgcctcagtgtctcacaatgcgtcaagctttatcgttgatcggctgaagcctttcacatcctacaagttcagggtcaaggccactaacgatataggtgacagcgaatttagcgaggagtccgaatcactaaccacgttacaggcagcccccgacgaagcccctaccatcctgtcagtaaccccacatacaacaacctcagtcctgatcagatggcagccaccagctgaggacaagatcaacggaatcttactcgggttccggatcagatatcgggagctcctatacgaagggctccgggggtttacccttcggggcattaacaatcctggtgccacatgggccgagctcactagtatgtacagcatgcgaaatctgtctagaccatctctgacgcaatatgagctggataacctaaacaaacacagacggtatgagatacggatgtccgtctataacgccgtgggggagggcccaagttctcctcctcaagaggttttcgtcggagaggcagtgccaacggccgcccctcgcaacgtggtggtccacggtgctacagccacacagttagatgttacatgggaaccccctcctctcgactcccagaatggcgatatccaggggtacaaaatatatttttgggaggcccagcggggaaatctgaccgagagagttaagacactgttcctcgccgaaaattctgtcaagcttaaaaatcttacagggtacacagcctacatggtgagtgtggctgcatttaacgccgcaggggacggccctcgatccacccccactcagggacagacccagcaggccgctccttctgcgccatccagcgtcaaatttagcgaactgaccacgaccagcgtcaatgtcagctgggaggccccgcaattccccaacgggattttggaggggtatcggctcgtttatgagccatgctctcctgtggacggcgtttcaaagattgtcactgtggatgttaaggggaactctccactctggctcaaggtaaaggaccttgcagagggggtgacttatagattccgaatccgcgccaagacatttacttacggacctgaaattgaggctaatgtgaccacaggtccaggagagggagctcccgggccccctggggtgcccatcattgtgcggtacagttctgccatcgcaatccactggagcagcggtgatcccgggaaaggcccgatcacaagatatgttatagaggcccgaccatccgatgagggattatgggacattttaattaaggacatcccaaaggaagtatcctcttacacattcagcatggacatcctgaaacctggtgtgagctacgactttcgcgtaattgcggtcaatgactacggctttggcactcccagctcaccgagccagagtgtccccgcccagaaagccaatccattttacgaggaatggtggtttctcgtcgtcattgcgctcgtgggactgatctttattctgctgctggtgttcgtcctgatcattcgagggcagagcaaaaaatacgccaagaagaccgatagcggtaatagcgcaaagtccggagccctggggcactctgaaatgatgtcactagatgagtcttcatttcccgctctggaactgaataacagacgtctgtccgtgaagaactccttctgtcgcaaaaacggactgtatacaagatctccgcccagaccatcacccgggagtctccattattcagatgaggatgtgacaaaatacaatgacttaatccctgcggagtcctctagtcttaccgagaagccatcagagatctctgactcgcaagggtctgattccgagtatgaagtggactctaaccaccagaaggcccactccttcgtgaatcactacatttcagaccctacctattacaactcttggagaagacagcaaaaaggaatttcccgagcccaagcgtattcctatacggagtccgatagcggcgaaccagatcacacaacagtaacaaattccacgagtacccagcaggggagcctgttccgccctaaagcctctcggacacctacaccacagaacccaccaaaccccccgagtcagcagtctacactgtaccgcccccctagcaaggctggcgtgcagaaagagggcgagaaccgagaacgcatgtgcgtagcatcttccagtagcgccctgagatggtgggggagtctactgccctgggagctgcacggcgccggcgaagtggcggtgtctctgctctggaccaggtctggcgctggaatatggcgcgaacgtggatcgggggggtag

SEQ ID NO: 45996 - DNA, 6462 bp, Artificial Sequence
  Description of Artificial Sequence: Synthetic coding sequence
atgtggggcctgctgatctggaccctgctggccctgcaccagatcagggccgctcgggcccaggacgatgttagtccatattttaaaaccgaaccggtaagaactcaggtgcatctagaggggaacagactggtgcttacttgtatggctgaaggcagttggcctttggagttcaagtggcttcacaacaatagggaactgaccaaattctccctggagtacagatacatgatcacatctctggatagaacccatgccggcttctatcgatgcatcgttagaaatagaatgggtgctctccttcagcggcaaaccgaggtgcaggtggcctatatgggctcatttgaggagggagaaaagcaccagtctgtctctcatggagaggccgctgtgatccgtgctcccaggatcgcaagctttccgcagccccaggtcacatggtttagagatggacgtaaaatccctcctagcagcaggatagcaatcacactggagaacaccttagtgattctgagcacagtggcacccgatgctggacggtattatgtgcaggccgtcaatgataagaatggggacaacaaaacttctcagccgataactctcactgtggagaacgttggaggccccgccgacccaatagcaccaacaattataattccacccaaaaatacctccgtcgtggctggcaccagcgaagtcactctagagtgcgtggctaatgcccggcccctcataaaactgcacataatatggaagaaagatggtgtgttactgtccggaggtatctcggaccataatcgccgactcaccatcccaaatcccaccggcagtgatgccggttattatgaatgcgaggccgttctccgttctagctctgtgccttccgtagtacgcggagcctacctgtcagttttggagccacctcagttcgtgaaggagccagagagacacattacagcagagatggagaaagtggtggacattccgtgccaggcaaaaggtgtgccgccgccaagtatcacatggtataaagacgctgccgtggtggaggtcgaaaagcttacacgtttccgccagaggaatgacgggggattacaaattagcggactcgtgcccgatgacaccggcatgtttcagtgtttcgccagaaatgctgctggcgaggtccagacgtccacctacctggctgtcaccagcattgcccccaacattaccaggggacccttagactcaactgtgatcgacggcatgagtgtggttctcgcctgcgaaacaagcggcgccccgagacccgccatcacctggcagaagggagagagaattttggcgtctggtagcgtccaactgccaagattcacccctttggaatccggttctctgctgatcagccccacccatataagcgatgcagggacctatacgtgcctggctactaattctcgaggagtggatgaagcctcagccgacctggtggtgtgggccaggactcggataactaaacccccacaggatcagagcgtaatcaaggggactcaggcaagcatggtgtgcggtgtcacacacgatccaagggtaaccataaggtatatttgggagaaggacggcgccaccctcggtacagagtcccaccctagaattcggctcgatcggaatggcagccttcacattagccagacatggtccggggacatcgggacttatacttgtcgtgtgatctccgcaggggggaatgacagtagatccgctcaccttcgggtgcgtcagttgcctcacgcccccgagcacccggtcgcgacgttaagcacagtagaacggagagccattaacctgacctggacaaaaccctttgatggtaatagccccttaataagatacatccttgaaatgtccgagaacaacgccccctggactgttctgctcgctagcgtcgacccgaaggcaacctcagtgacggtcaaggggctcgttccagcaagatcttaccaattccggctgtgcgccgtgaacgatgtcgggaaaggccagttcagtaaggatacagaacgcgtcagcctgccagaggagccccccacggcaccaccacagaatgtcatagcctctggccggacaaaccagagcataatgatccagtggcagcctccaccagagagccaccaaaatgggatattgaaaggctatataatacgatactgcctggccgggctccccgtgggctaccaatttaagaacattaccgacgctgacgtcaataacctactattagaggatctgataatttggacaaattatgaaatcgaggtggcggcatacaactctgcagggctgggggtttactccagcaaggtgactgaatggacattgcagggagtgccgaccgttcctccaggcaatgtgcacgctgaggcaacaaactcaaccaccattcggttcacatggaatgccccttccccccaatttatcaatgggataaaccagggatacaagttgattgcctgggaacctgaacaggaggaggaggttactatggtgactgcgcggccgaacttccaagatagcattcacgttggttttgtcagcggcctgaagaaattcactgaatacttcacaagcgtactctgtttcaccactccaggtgatggcccccgatccactcctcaactcgttaggacccatgaagatgtaccaggtcccgtggggcatttgtctttcagcgaaatcctggatacttcgctgaaggtttcttggcaagagccaggagaaaagaatggtatcctgaccggatataggatttcttgggaagagtataatcgaacgaatactcgcgtcacccattacttgccaaatgtcactctcgagtatcgggtcaccggtcttactgccctgaccacttatactatagaggtcgctgcaatgacttctaagggccagggacaggtctccgcctctacaataagttctggcgtgcccccggaattgcctgggcccccaaccaatctcgggattagtaacatcggtccccgctcggtaacactgcagtttcgtcctggctacgacggcaaaacttcgatttcaagatggctagtcgaggctcaggtgggtgtagtaggcgagggagaggaatggttattgattcatcagctgagcaatgaacctgacgcccgatctatggaagtcccagatttgaacccgtttacgtgctattcctttagaatgaggcaagtgaacatcgtcggaacgagccctccaagtcaacctagtcggaaaattcagaccctgcaggcgcctcccgatatggctccagccaacgttagcctgaggactgccagcgaaacatcgctctggctgcggtggatgccgctccctgaaatggagtacaatggtaatccggagagcgtgggctacaaaattaaatatagccgatctgacggccatggcaaaaccctatcgcatgtggttcaggatagggtggaacgcgactataccatagaggatctcgaggagtggactgagtaccgggttcaggtgcaggccttcaatgccattggatctggcccttggagccaaaccgtggtcggccgcactagggaatccgtccctagctctgggccgaccaacgttagcgctctggcgaccacatcttcttcaatgctcgtcagatggagcgaggtgcctgaggcagacaggaatggactggttctgggctacaaggtgatgtacaaggaaaaggattccgatactcaacctcgattttggctggtggaaggaaactcttctagaagcgcacagctgaccggtctaggcaagtacgtgctctacgaggttcaagtgctggccttcactagaataggcgatggctcaccatcgcacccacccatcctggagagaactctcgacgatgttcctggacctcctatgggaattcttttccctgaggtgcggactactagcgtgcggctgatttggcagccacctgccgctccaaatggcatcattctcgcataccagattacccacaggctgaacacaactactgccaatactgccaccgtcgaggtgctcgccccctcagcccggcaatacactgcaacggggcttaaaccagagtctgtctacctgttccgaatcaccgcccaaaccagaaagggctggggggaggctgccgaggctctggtagtgactactgagaaacgtgaccgacctcagcccccctctcggccaatggtgcaacaggaggacgttagggcaagatccgtcctgctatcttgggagcccgggtcagacggcctgagccccgtccgctattacaccatccagactcgggaactccctagcgggcgatgggccttgcacagcgccagtgttagccataatgcctctagcttcatcgtggacaggttgaaacctttcacatcttacaaatttagagtgaaggctactaacgacatcggagacagcgaatttagcgaagaatctgaatcgcttacaactctgcaggctgcacctgatgaggcacctacaatcctcagcgtgacaccacacactaccacaagtgtgttgattagatggcagcctcccgctgaggataagattaacggaatcctactcggatttcgaatcagatacagggaactgttgtatgagggcttaagaggatttaccctgcgtggtataaacaaccccggcgcaacatgggcggaacttacctaccttaataaacaccgcaggtatgaaatacggatgagtgtttataacgcagttggtgaaggccccagcagccctccccaggaggtgtttgtgggagaggctgtccccacggccgcacctaggaatgtggtggtacacggcgcaacagctacacaacttgatgtgacatgggagccacctccactggactcccagaacggggacatacaggggtataaaatctatttttgggaagcgcaacggggcaaccttacagagagggttaaaacactgttcctggccgagaactccgtcaaactcaagaatctaacaggttatactgcttacatggtgtccgtggccgctttcaacgcagccggtgatgggcctcggtcgaccccaacccaagggcaaacacagcaggccgccccttcggccccttccagtgtgaagttttccgagcttaccactacgagcgtgaatgttagttgggaggccccacagttccctaacggaattctggagggctacagactcgtgtatgaaccatgctcacctgtcgatggagtgtctaagatcgtcaccgtcgatgtcaaagggaattctcccctctggctcaaagtgaaggatctggccgaaggggtcacctaccgcttccgtatccgagcaaaaacattcacctatggaccagaaattgaggcgaatgtgaccacaggccccggagagggcgctcccgggccccccggcgtccctataatcgtgcggtattccagtgccatagccattcattggtcaagcggggaccctggtaagggccctattacccggtatgttattgaagcaaggccctccgacgaagggctttgggacattctgataaaagatatcccaaaggaggtttcatcctatacgtttagcatggatatactaaaacccggtgtttcctatgactttcgcgtgatcgcagttaacgattatggcttcggaacaccaagttcacccagccagtctgtgccggcacagaaggctaaccccttctacgaagaatggtggttccttgtggtaatcgctctggtaggactgatcttcatccttctgttagtattcgtcctgatcatccggggacaaagcaaaaaatatgcaaagaagactgatagtggcaattcagctaaaagtggggcgttaggccatagcgagatgatgtcactcgatgagagcagcttccccgccttggaacttaacaaccgacgactcagtgtaaaaaattcgttctgtaggaaaaatggtctttacactcggagcccccctcggcctagtccggggagtctacattattccgatgaggatgttaccaaatacaacgacttgattcccgctgaaagctcttcgttaaccgagaaaccttcagaaatctctgactcccaaggatctgactccgagtacgaggttgatagcaatcatcagaaagcacatagcttcgtgaatcactacatcagtgaccccacatattacaacagctggcgccgccagcagaaagggatctcacgagctcaggcctattcatacaccgagtctgactccggcgaacctgaccatactactgtgaccaattccacttcaacacagcaggggagcctttttcgccctaaggccagtcgaacacctacccctcagaacccaccgaatcccccctctcaacagagtaccctctaccgcccaccctcatcattggcacctggcagccgtgcccctatcgccgggttttcatcattcgtttag

SEQ ID NO: 45997 - DNA, 6519 bp, Artificial Sequence
  Description of Artificial Sequence: Synthetic coding sequence
atgtggggcctgctgatctggaccctgctggccctgcaccagatcagagccgctagggcccaggatgacgtatcgccgtacttcaaaacggagccagtacgcacacaggtgcacctggaaggaaatcggcttgtgttgacatgcatggcggagggaagctggcctctcgaattcaaatggctgcacaataatagggagctgaccaaatttagcctcgagtacaggtatatgatcacttcactagatcgaacccacgccgggttctaccgatgcatcgtgcggaaccgcatgggcgccctcctacagcggcagacagaggttcaagtggcctacatgggcagtttcgaagagggcgaaaaacaccagtcagttagccacggcgaggcagcggtgattcgcgcaccccgcattgcatcgttcccccagccccaggtgacctggttcagggacggtcgtaaaatacctccgtcctctaggatcgctatcaccctggagaacacgctggttatactctctacggtagctcctgacgccggcaggtattatgtccaggcagtgaatgacaagaacggagataacaagaccagtcaaccgattaccctgactgtcgaaaacgtgggaggccctgctgaccctatagcacccaccatcatcatacctcccaagaacacctctgtggtggccggaacctccgaggtgactttggaatgcgtcgccaacgcccggccacttattaagctgcatatcatctggaagaaagatggggtgctgctgtcaggaggtatatccgaccataatagacggctgactatccccaaccccacaggcagtgatgctggatattatgagtgtgaggccgtacttcgctcgtcttctgtcccttctgttgtcagaggggcctacctgagcgtattggagccaccacagtttgtgaaagaacccgaacggcatatcactgccgaaatggagaaggtggtcgacattccatgccaggccaagggagtgcccccaccaagtattacctggtacaaggatgcggctgtcgtcgaagtcgaaaaattaacacgattcaggcagaggaacgacgggggtctgcagatctctggcctcgtgccagacgataccgggatgtttcagtgcttcgccagaaatgctgccggtgaggtgcagaccagcacctacctggcggtgacctcaatcgcacctaatatcacaaggggacccttggacagcaccgtgatcgacgggatgagcgtggtactagcatgtgagacaagcggcgcccctaggcccgctattacatggcagaagggggagcgcatcttggcaagtggatcagttcaactgcctcgattcactcctctcgagagtgggtcactgctgattagtcccacacacatctcagacgccggaacctacacttgcctggctactaatagtcgcggcgtggatgaggcgtcggcagacctggtggtgtgggctaggactcgtatcacaaagcccccacaagaccagtccgtgattaaagggactcaggcctcaatggtgtgcggagtcacccatgacccgagggttactattagatacatttgggagaaagatggcgccacattagggaccgaatctcacccccggatcagactggatcgtaacggaagtctgcatatcagccagacctggtccggggatattggcacatacacttgtagggtcatcagcgccggcggcaatgactcacggagcgcacatttaagggttcgccagctgcctcacgctcccgaacatcccgtggcaactcttagtacggtggaacggcgggcaataaacctgacttggacgaaaccctttgatggaaacagtcccctcattcgctatattcttgaaatgagcgagaacaatgcaccgtggacagtgctgttggcatccgtggatccaaaggccacctccgttacagtgaagggattggttcccgccagatcatatcaatttcgactctgtgcagtgaacgatgtggggaagggacaattctccaaagatacagagcgggtcagcctgccggaagaaccgcccacagccccccctcagaacgtgattgcttcgggacggacaaaccagtcaattatgattcagtggcagccccctccagaatcgcaccagaatggtatcctgaagggctacattattcggtattgcctggccggattaccagtggggtatcaattcaaaaacattaccgacgcggacgtcaacaatctactgctggaggacctgattatctggaccaattatgagatcgaagtggccgcgtataacagtgccggtctaggggtctactcatctaaagtaacagagtggacccttcaaggggtaccaacggtgccccctggcaatgtccacgctgaagcgaccaactcaaccaccatccgctttacctggaatgctcccagcccgcagttcatcaacgggattaatcagggctataaactgatcgcttgggagcccgagcaagaggaagaagtgaccatggtcactgcacggcctaacttccaggacagcatccatgtgggctttgtatcaggccttaagaagtttaccgagtatttcacttcagtcctgtgtttcaccacgcccggagatggccctcgatctactccccagctggtgagaacccacgaagacgtgccagggccggtcgggcacctaagcttcagcgagattttggataccagtcttaaggtgtcctggcaagagcccggggagaagaatggcattctgaccggataccgaatcagctgggaggaatataatcgtacgaacactagagtgactcactatttacctaatgtcaccctggagtatagggtcaccgggctgacggccctcacgacttacaccattgaggttgctgctatgacctcaaaagggcagggacaggtttcagcatcaaccataagttcgggagtgcctccagagctgcctgggcctccgactaatctgggcatctctaatatcggaccgcgttctgtcacattgcagtttcggccaggctacgatggaaagacatcaatctcacggtggttggtggaggcccaggtgggagtcgtaggagaaggggaggaatggctgctgattcatcagctcagcaacgagcctgacgcccgtagcatggaagtgccggatctcaatccattcacctgttactcctttagaatgcgacaagtgaacattgttggtacctctcctccgtcgcagccttctcgtaagattcagaccctgcaagccccgcccgacatggccccggctaatgtctctctgcgcacagctagcgaaactagcttatggctaagatggatgccgctgccagaaatggaatacaacgggaatcctgaatctgtaggttataagataaagtactcacggagcgatggccatggcaagaccctctctcacgtcgtccaggaccgggtggaacgcgattataccatagaggacctggaagagtggactgagtaccgagtgcaggttcaggcctttaatgccatcggatcgggtccctggtcccagactgtcgtggggcgtacccgggaaagcgttcccagctccggtccaacaaatgtgtcagcgcttgcaacaacaagctctagcatgcttgttcgctggtctgaggtcccggaggccgatcggaacggtttagtgctcggttacaaagtcatgtacaaagagaaggatagtgatacccaacctaggttttggctggtggaggggaattcttcacgctcggcccagctgacaggactggggaaatacgtcctgtacgaagtgcaggtcctggccttcactagaataggtgatggaagcccatcccatcctccaatcttggaacggacgttagatgacgtgccaggacctcctatgggtattctgtttcccgaggtacgaaccacatccgtgcgcttaatctggcagccacccgctgcaccgaatgggataatcttggcttatcagataacccaccgccttaacaccactaccgctaacaccgcgacggtggaagtgctcgctccgtctgcccgccagtatacggccaccggtctcaagcctgaatccgtatacctgttccgtataaccgctcaaacacggaagggatggggggaggctgcagaggccctagtcgtgaccaccgaaaagagagataggccccaaccacctagtagacctatggtgcagcaggaagatgtgcgggcccggtccgttctgctgtcctgggaacccggctccgatgggctctctcccgtgcgatactatactattcagacccgcgaactgccatctgggagatgggctctgcactctgcctctgtttcccacaatgcctcaagttttatcgttgatcggctcaagccattcacttcgtacaagttcagagttaaagccactaacgatattggagatagcgaattctcagaagaaagcgagtctctgaccacactccaagccgcgcccgacgaggcgccaaccattctgagcgtgaccccccatactacaacttctgtcctgatccggtggcaaccaccagctgaggacaagatcaatggaatcttactgggatttcggatcaggtatcgcgaactgctctatgaagggcttcgcggattcaccctgcgcggcatcaataatccaggtgccacatgggctgagctcacctccatgtatagcatgcggaacctttcacgcccgtctctaacacagtacgagctggacaacttaaacaagcaccgcagatatgagataaggatgagcgtgtataacgctgtgggtgaaggcccatcaagccctccccaggaggtctttgtgggcgaggctgtgccaactgcggctccccgaaatgtggtagtgcatggagccactgcgacacagctggacgtcacctgggaacctcccccacttgatagccaaaacggcgacatccaggggtacaaaatttacttctgggaggctcagagggggaatcttacggagcgcgtgaaaaccctatttcttgcggagaactccgtgaagctgaagaatctcacaggctacacagcttatatggtttccgtcgcagctttcaacgcggctggggacggacctcgctcgaccccaacccaaggacaaacccagcaagctgccccgtcagcaccctcatctgttaaattctccgaacttacgacaacctctgttaatgtctcatgggaagcgccccagtttccgaacggaatactggaggggtatagactggtttatgagccttgctccccagtcgatggcgtgagcaaaattgtgaccgtagacgtcaagggcaattctccactgtggttgaaggtgaaggaccttgcggaaggcgttacctataggtttagaatacgtgccaagacatttacatatggaccagaaatagaggctaacgtgactactggacctggcgaaggggcccctgggccacctggagttcccatcatcgtcaggtatagttcggcgattgccatccactggtcttctggggaccccggcaaggggccgattacccggtatgttatcgaagcaagaccgtctgacgagggactgtgggacattctcatcaaggatatccctaaggaggtgtccagctacaccttctccatggacatcctgaaaccgggcgtgagttatgattttcgggtgattgctgtcaatgattacggattcggcactccttcatccccctcgcagagcgtccccgcacagaaggcaaaccccttctatgaagagtggtggttccttgtagttattgccctggtgggtttgatcttcatcctcctgctcgtgtttgtgcttataatccgggggcagagcaagaaatatgctaagaaaactgactcaggcaatagtgccaaatcaggtgctttagggcactccgagatgatgtccctagatgagtcatcctttcccgccctggaattgaataataggcgtctgagtgtgaaaaattcattttgcagaaagaatggtctttatacaaggtccccaccacgcccctctcccggcagcctccactactccgacgaggacgttaccaaatataatgacctaatacccgcagagtcttctagcctcacagaaaaaccctctgagatctccgattctcagggatccgattctgagtacgaggtggactccaatcaccagaaggctcactccttcgtgaatcattacatctcagatcctacctactacaatagctggcgccgccagcaaaagggtatctctcgggcacaggcttatagttacacagagagcgactccggagaaccggatcacactaccgtaacaaacagcacgtccactcagcagggtagcctctttcgaccaaaagcatcacgaacccctaccccacagaacccgcccaatccgcctagccagcagtcaaccctgtatcggccgccttctagcctcgcacccggatcaagagcgcctatcgccgggttttcctccttcgtctag

SEQ ID NO: 45998 - DNA, 969 bp, Artificial Sequence
  Description of Artificial Sequence: Synthetic coding sequence
atgagcggcgagctgccccccaacatcaacatcaaggagccccggtgggatcagtccactttcatcgggcgagccaaccactttttcaccgtgaccgatccgagaaatattctactgaccaacgagcaactggaaagtgctcggaagatcgtccacgattatcggcaggggattgttcccccgggccttacggaaaacgaactgtggagagccaagtatatttatgacagcgccttccatcctgatactggcgaaaagatgattctaataggacggatgagcgcacaagtgccaatgaacatgaccataacaggatgtatgatgactttttataggaccacgccggctgtgctattctggcagtggataaatcagtcctttaacgccgttgtgaactacaccaatcgcagtggagatgcaccactcacagtaaacgaattaggcacggcctatgtctctgccaccaccggggccgtggctaccgcgctagggctcaatgccctgaccaaacatgtttcccccctcatcgggcggtttgtgccttttgcagccgtggctgcggcgaactgtattaacatacccctcatgaggcagcgggagctgaaggtagggatccctgtaaccgatgaaaacggaaacagactgggggaaagtgcaaacgccgccaaacaggcgatcacgcaggtagtggtgagtcgtatcctcatggcagcacctggaatggccataccacccttcataatgaacacactcgagaagaaggcttttctaaaacgcttcccatggatgtccgcaccaatccaggttgggctggtggggttctgtctcgtgtttgcgactcccctatgctgcgccctcttcccacagaaatcctcaatgtctgtcaccagccttgaagcggaactccaggccaaaatacaggagagccacccagagttgcgaagagtctacttcaacaaagggctctag

SEQ ID NO: 45999 - DNA, 585 bp, Artificial Sequence
  Description of Artificial Sequence: Synthetic coding sequence
atgagcggcgagctgccccccaacatcaacatcaaggagccccggtgggaccagtccacttttataggtagagcaaatcattttttcactgttacagatccaagaaatattctcttgaccaatgagcagttggagtctgcgcgaaaaatcgtgcatgattatagacagggcatagtgccacctggtctgactgaaaacgagctatggagagctaagtacatatatgattcagcattccacccggatactggggaaaagatgatcctgatcggccgaatgagtgcgcaggtgcccatgaacatgaccattactggatgcatgatgaccttttataggactaccccggcggtgttattctggcaatggatcaaccagagctttaacgcggtcgtcaactatacgaacagaagtggggacgcacccctgacggttaacgagctgggaacagcatacgtgtccgcaacaactggcgcggtagctacagctttgggtctgaacgctcttacgaaacacgtgagccccctgattgggaggttcgttccattcgcagcggtggcggcagccaactgcattaacatcccctag

SEQ ID NO: 46000 - DNA, 435 bp, Artificial Sequence
  Description of Artificial Sequence: Synthetic coding sequence
atgagcggcgagctgccccccaacatcaacatcaaggagccccggtgggaccaaagcacctttatagggcgagcaaaccatttctttacagttacagatccacggaacatcctccttacgaacgagcagttggagtctgcccggaagatcgtacatgactatcgtcaggggatagtgccccctggcctgacagagaacgagttatggagagccaaatacatctacgacagcgccttccaccccgataccggggaaaagatgatcctgatcggaagaatgtcagcccaggttcctatgaacatgactatcaccggctgcatgatgaccttttaccgcactactcccgctgtcctgttctggcagtggatcaaccagagttttaatgccgttgtgaactacactaacaggagcggcgacgctcctctgactgtgtag

SEQ ID NO: 46001 - DNA, 969 bp, Artificial Sequence
  Description of Artificial Sequence: Synthetic coding sequence
atggaggccgacctgagcggcttcaacatcgacgccccccggtgggaccagcgtacattcttagggagagtcaagcattttttaaacattaccgatcccaggaccgtgttcgtatcggaacgagagctcgactgggctaaagtgatggttgagaaatcccgaatgggtgtggttcctcctgggactcaagtggagcagctgctctacgcaaagaagctttatgatagcgccttccaccccgacacaggagagaagatgaacgtgatcgggcggatgagtttccagcttcccggtggtatgattatcaccggcttcatgttgcagttctatagaaccatgcctgctgtgattttctggcagtgggtgaatcagagcttcaacgccctggttaattacactaaccgaaatgctgcctcccccacatccgtgcggcagatggcccttagttacttcaccgcgaccaccaccgccgtcgccacggccgtgggcatgaacatgctcaccaagaaggcaccgcctctggttggaagatgggtaccctttgccgcggttgccgcagctaactgcgtgaacattcctatgatgagacagcaagagttgataaagggaatttgtgttaaggacagaaatgagaacgagatcggccactcccgccgcgccgcagccatcgggatcacccaggtcgttatcagtcgtatcaccatgtcagctccaggcatgatcctactgccagtgattatggagagattggagaaattacatttcatgcagaaggtcaaggtccttcacgcccccctccaagttatgctatcaggatgttttcttatattcatggttccagtggcatgcggcctatttcctcagaaatgcgagctccctgtttcctatctcgagccaaaattgcaggacaccattaaagccaagtacggcgaacttgaaccctacgtttatttcaacaagggactatag

SEQ ID NO: 46002 - DNA, 1134 bp, Artificial Sequence
  Description of Artificial Sequence: Synthetic coding sequence
atgtgcgaggaggaggacagcaccgccctggtgtgcgacaacggctccggactatgtaaagctggttttgccggtgatgacgccccccgggccgttttcccctcaatagtcggaagacctcggcatcagggcgtcatggtggggatggggcagaaagattcttacgtaggcgatgaggcacaaagcaagcgggggatattgacactgaaataccccatcgaacacggcatcattaccaactgggatgatatggagaaaatatggcatcactcattttacaacgagctgcgcgtggccccagaggaacatcccaccctcctcaccgaggcgccccttaacccaaaggctaaccgcgagaagatgactcaaatcatgttcgaaacatttaatgtgcctgccatgtatgtagccatccaggcggtcctttccctgtatgcatcagggagaaccaccggaattgtgctggacagcggggacggtgttacacacaacgtgcctatctatgaggggtatgctttaccccatgccataatgcgcctggacctcgctggtagagacctgaccgactacttaatgaaaattttgactgagcgcgggtactcattcgtgaccactgccgaacgggagattgtgcgcgatatcaaagagaagttgtgctatgtcgcattggatttcgagaacgagatggcaactgcagcaagtagcagcagtcttgagaaatcatacgagcttcctgacgggcaggttatcaccatcggaaacgaacggtttagatgcccagagaccctgttccaaccatcctttattgggatggaatctgctggtatccacgaaaccacttataacagtatcatgaagtgcgatatcgacattagaaaggacctgtatgccaacaatgtgttatcagggggcactactatgtatccgggtatagcagataggatgcaaaaagagattaccgctctagcgccttctactatgaaaattaagataatcgccccaccagaacgaaagtacagcgtctggatcggcgggagcatcctggccagtctctctacttttcaacagatgtggatctccaaacaggagtacgatgaagcaggcccctccatcgtccatcgcaagtgcttctag

SEQ ID NO: 46003 - DNA, 966 bp, Artificial Sequence
  Description of Artificial Sequence: Synthetic coding sequence
atgggcgagctgcccctggacatcaacatccaggagccccggtgggaccagtcaaccttccttgggagagctcggcacttttttaccgttacagatccgcggaatctactgttatctggcgcacagctcgaagcgtcccggaatatagtccagaattatcgcgccggggtggtcacaccaggtattactgaggatcaactgtggcgcgcaaagtacgtctacgactcagcattccacccagacactggagaaaaagtcgtgctgataggtagaatgagcgctcaggttccaatgaacatgaccataacagggtgtatgttgaccttttaccggaagacaccgactgtggtattctggcagtgggtgaaccagagttttaatgcaatcgtgaattattctaatcgaagtggagatacaccgattactgttcggcagcttgggaccgcatatgtttcggcaacaaccggagcagtcgccactgccctggggttaaaatccctgaccaagcatcttcctccacttgtgggccgatttgtcccgttcgcagctgtggcggccgctaactgcattaatattccactgatgcgacaacgcgaactacaggttggcatacccgtcgctgacgaggctgggcagaggttgggatactcagtcactgctgccaagcaaggtatattccaagttgtgataagccgtatctgtatggctatccccgcgatggctatcccaccgctgatcatggacaccttggaaaagaaggacttcttgaagagacgcccctggttaggggccccgcttcaggtgggcctggtggggttctgtctagtctttgctactcccctttgctgcgcactgttcccccagaagtcaagcatacacatctctaacctcgagccagagctgcgcgctcagatacatgaacagaacccaagcgtggaggtggtatactataataaagggttgtag

SEQ ID NO: 46004 - DNA, 987 bp, Artificial Sequence
  Description of Artificial Sequence: Synthetic coding sequence
atgagcctggagcaggaggaggagacccagcccggccggctgctggggcgtcgcgatgcggtccccgcgtttatagaacctaatgtgagattttggatcaccgagcgacaatctttcatccggaggttccttcagtggacagagctcttagacccaaccaacgttttcatttctgtggaatcgatcgagaacagtcggcagctgttatgtactaacgaagacgtctcatccccagccagcgccgatcagcgggccactgtgcaccccgactcttcaaatctcattcccaagctttttaggcccgccgcatttcttcccttcatggctcccacagtattcctgtctatgaccccgctaaaagggattaaaagcgtgatccttccacaggtgtttctctgcgcctatatggctgcttttaacagtatcaacggaaaccggtcatatacatgcaagccactggagaggtccctgctaatggcaggcgctgtggcgtcatccaccttcctcggcgttatcccacaattcgtgcaaatgaaatatggactgaccggtccctggataaagagactcttgcccgtgatcttcttggtccaggcttcagggatgaacgtgtacatgagcaggtctctggagtccattaagggcattgccgtcatggataaagaagggaatgtacttgggcactctaggatcgcaggtacaaaagctgtgagggaaacgttggctagtcggatcgtcctgtttggcaccagtgctctcatccctgaagtctttacttatttctttaagaggactcagtattttagaaagaacccaggctctttgtggatcctgaaactctcctgtactgttctggccatggggctcatggtccccttttcttttagcattttcccgcaaatcgggcagattcagtactgctcacttgaagagaagatccagtctcctactgaggagaccgagatcttttaccataggggcgtttag

SEQ ID NO: 46005 - DNA, 1014 bp, Artificial Sequence
  Description of Artificial Sequence: Synthetic coding sequence
atgagcctggagcaggaggaggagacccagcccggccggctgctgggaaggcgagatgcagtcccagcgtttatcgagccgaatgtgaggttctggattacggagcggcagtccttcattcggcgctttctccaatggactgagctgctcgacccaaccaatgtcttcattagtgtcgaaagcatagagaatagcaggcagctactgtgcaccaatgaggatgtcagttctccagcttctgcggatcagcgcattcaagaagcctggaaaagatctctggcgacagtgcatccagactcgtcaaatttgatacccaagctgttccgaccagcggcctttctcccttttatggcgccaactgtgtttctgagtatgactcctctgaagggtattaaatcagttattctcccacaagttttcctttgcgcgtacatggctgcctttaacagcatcaacggtaaccggagctacacatgtaagcccctcgagagaagcctactgatggccggcgctgtggcttcaagtacgtttctgggcgtgattccacagttcgtgcaaatgaagtatgggctgacgggaccatggatcaagcgtctgctcccggtgatattcctggtgcaagcttccggtatgaacgtgtacatgtcccggagtctggagagcataaagggaattgccgtgatggacaaagaggggaacgtgctggggcatagccggattgcaggaacaaaggcggtacgggagaccttggcttcacgaatcgtgctctttggtacctcggccttaattcctgaagtgttcacctatttctttaagagaactcagtattttaggaagaatccaggctcactctggattctgaaactcagttgcacagtgttggccatgggattaatggttcctttcagtttcagtattttcccacaaatcggccaaattcagtattgctctcttgaagagaagatccagtccccaacggaggagaccgaaatcttttaccaccgaggtgtctag

SEQ ID NO: 46006 - DNA, 537 bp, Artificial Sequence
  Description of Artificial Sequence: Synthetic coding sequence
atggcccccaccgtgttcctgagcatgacccccctgaagggcatcaaaagcgtgatcctgcctcaggtgttcctgtgcgcttatatggctgccttcaacagtatcaatgggaaccggtcctatacttgtaaaccgcttgaacggtcattgctgatggcgggcgcggtggcatcctccacctttctaggggtgatcccccagttcgttcagatgaaatacggtctaactggcccctggatcaagcggctccttcctgttatttttctggtccaagcttctggtatgaacgtttacatgtcgcgcagcttagagtccattaaggggatcgccgtgatggataaagaagggaacgtccttggccactcgcgcattgccggcactaaggctgttcgtgagaccctggcttcccgaattgttctgtttggaactagtgccctgatcccagaggtctttacttatttctttaagagaactcagtattttagaaaaaaccccggcagtctgtggattcttaagttatcatgcacagtactgtag

SEQ ID NO: 46007 - DNA, 663 bp, Artificial Sequence
  Description of Artificial Sequence: Synthetic coding sequence
agccccctggtgttcctgagcatgacccccctgaagggcatcaagagcgtgatactgccacaagtgttcctgtgtgcttacatggcagcgtttaactctattaatggcaacaggtcatatacctgcaagccgctggagaggtctctgctgatggcaggcgctgtcgcctcctctaccttcttaggggtgataccgcagttcgtacagatgaagtatgggctcaccgggccatggatcaagagactgctgcctgtcatttttttagtgcaggccagcggtatgaacgtgtacatgtccaggtcactggaatcaatcaaaggtatagcggtgatggacaaagagggaaacgtcctgggacattcccgcatagccggcactaaggctgtgagggaaactcttgccagcaggatcgtgcttttcgggacttccgctctgattcccgaagtcttcacctacttttttaaaaggactcagtattttcgcaagaatcctgggtccctgtggatcctcaagctgtcttgtacagttctcgcgatgggcctgatggttcctttttccttcagcatttttcctcaaatcgggcagattcagtactgctcactggaggaaaagatacagtcccctaccgaagagacggaaatcttctatcaccgaggagtgtag

SEQ ID NO: 46008 - DNA, 192 bp, Artificial Sequence
  Description of Artificial Sequence: Synthetic coding sequence
atggcccccaccgtgttcctgagcatgacccccctgaagggcatcaaaagcgtgatccttccccaagtctttctttgtgcttatatggccgccttcaacagtatcaacggcaacagaagctacacctgcaagcccctcgagaggtctctgttaatggccggggctgtagcgtcttccacattccttggctag

SEQ ID NO: 46009 - DNA, 1023 bp, Artificial Sequence
  Description of Artificial Sequence: Synthetic coding sequence
atggccgacaccgccaccaccgccagcgccgccgccgccagcgccgcgtctgcctcttctgatgcgcctcctttccaattaggaaaacctcgattccaacagactagtttctatgggcgcttccgacactttctggatataatagacccacggactttattcgtgactgaacgcaggctgcgtgaggctgtgcagctcctggaggattacaagcatgggacactcaggcctggagtaaccaatgaacagctatggtcagctcagaagataaagcaagccatactacatcctgatactaacgagaagatcttcatgccctttaggatgtcaggatatataccctttgggacaccgatcgtcgtgggactcctgttgcccaatcagactctcgcttctacggtgttctggcagtggctgaatcagagccataatgcctgcgtaaactatgcaaacagaaacgccactaaaccttcccctgctagcaaatttatccagggctatctcggcgctgtgatttcggctgtcagcattgcagtggggcttaacgtgctggttcaaaaagccaacaagttcacacccgccacacggttactgatacagaggtttgttccattccctgccgtggcaagtgcaaatatttgcaacgtcgtgctgatgagatacggtgaactggaagagggcatcgatgtgcttgattcagacgggaacctggtcggctctagtaagatagcagctaggcacgctcttctcgagaccgcattaactcgcgtggtgctcccaatgccaatcctggttctaccacctatagtgatgtctatgcttgaaaaaaccgctctgctacaggcaaggcccagattgctactccccgtgcagagcttagtctgcctggcagccttcggactcgcactccctctggcaattagtctttttccacaaatgtcggagatagagacgtcccaattggaacccgaaatcgcccaagctacttcttccagaacagtggtctataataaagggctctag

SEQ ID NO: 46010 - DNA, 4389 bp, Artificial Sequence
  Description of Artificial Sequence: Synthetic coding sequence
atgggcgcccaggaccggccccagtgccacttcgacatcgagatcaaccgcgagcccgtcggaagaataatgtttcagttgttttcagacatctgccctaagacatgtaagaacttcctgtgcctctgtagcggagaaaaggggttgggaaagactacggggaagaagctgtgctataaaggctccacctttcaccgagtggtgaaaaatttcatgatccaggggggggatttttcagaggggaacggtaaggggggtgaatcaatctatggcggatactttaaagacgagaatttcatcctaaagcacgatcgcgcttttttattgagtatggcaaacaggggtaaacacaccaacggcagtcaattcttcataaccacgaaaccagcacctcatctagatggcgtgcacgtggtgtttgggctggtcatttctggctttgaggtcattgagcaaattgagaacctcaagacagatgccgcaagccgaccatacgccgacgtaagagttatcgattgcggcgtgttagccaccaaaagtatcaaagacgtctttgaaaaaaaacgcaaaaagccaacccactcggagggaagcgattcttcatcaaactctagctcatcttccgagagctcatctgagtctgagctggagcacgagaggagtcgtcgtagaaagcacaaacgacggcccaaagtgaagagatccaaaaagcgtcgcaaagaggcatccagtagtgaggagcccagaaataaacacgcgatgaacccaaagggccatagtgaacggtcggacacaaatgagaagcggagcgtagacagcagtgccaaacgtgaaaaacccgtcgtgaggcccgaagagattccaccggtccctgagaaccgatttcttctgaggcgagacatgccagtggtgacagccgagcccgaacctaaaatccccgacgtcgcacctatcgtgtccgaccagaaaccgtccgtgtccaagagtgggcggaaaatcaagggccgggggactatccggtatcatactccaccacgcagcagaagctgcagcgaaagtgacgacgacgattctagcgaaactccccctcattggaaggaagagatgcagcgtctgcgggcttacagaccaccctcgggagaaaaatggtcaaagggggataagctctcagatccgtgtagcagccggtgggacgagcggtccctctcacagaggagccgcagttggtcttataacgggtactattcagatctatctactgctagacactcggggcatcacaaaaagaggagaaaggagaaaaaggtgaaacacaaaaagaagggaaagaagcaaaaacattgccgtcgtcacaagcagactaagaagagacgcattcttataccctccgacatagagtctagcaagtctagtaccagaaggatgaagagcagttgcgatcgagagcgctcatcacgctcctcatcccttagctcccatcactcatctaagagggactggtccaagagtgataaagacgtgcagtctagcctgacgcattcgagcagggattcctataggtcaaaatctcactcccagagttattccagaggaagctctcgtagcagaaccgcctccaagtcttcatcacacagcagaagccgctccaagtcacgttcatcaagtaagagcggacatcgaaaaagggcctccaaatcccccagaaagacagcttcccaactttccgaaaacaagccagttaagaccgaaccactgagagccactatggctcaaaatgagaatgtagttgtccaacctgtcgtggccgaaaacatcccggttatcccactgagcgactcccccccacctagtcgctggaagcctgggcaaaagccctggaagccctcgtacgagcgaatccaagagatgaaagcaaagactacccatctgctgcccatccagtccacatattctctcgctaatattaaagagacgggctccagcagtagttaccataaacgagaaaagaattccgagagtgaccagtcgacgtattctaaatattcagacagatctagcgagagcagccctcgtagtcgatccaggagtagtagaagccgctcatactcccgttcttacacgcgcagtcggtctttggcctcttctcacagccggtccaggagcccttcctccagatcacactctcgcaataaatacagtgaccatagtcagtgtagccgaagtagctcctacacaagcattagctctgatgacggcagacgagctaagagaagactccggagtagcggcaagaaaaactcggtctcccataagaagcattcctcaagctccgagaaaacgttgcactccaagtacgttaagggacgtgatcggtcttcctgtgtcagaaagtatagtgagtcaaggagtagccttgactatagttctgattccgaacaatcaagcgtgcaggccacacagagcgctcaggaaaaggagaaacaaggccagatggaacgcacccacaacaagcaggagaaaaatcgcggtgaagagaagagtaagtctgagagagagtgcccccattcaaaaaaacgaaccctgaaagaaaatctctctgaccacctaaggaacggttctaagccaaagagaaaaaactatgcggggagcaagtgggattcagaaagcaactccgaaagagatgttaccaaaaactcaaaaaacgactcccacccctcttcagacaaagaggagggggaggccacaagcgactccgagtccgaagtttcggagatccatattaaagttaagcccactactaagtctagtacaaatacaagtctgccagacgacaacggggcttggaaatcatcaaagcaaaggacaagcacctcggactcagagggctcctgctccaactctgagaacaaccgggggaagccgcagaaacacaagcacgggtctaaggagaatttaaagcgcgaacatactaagaaggtgaaggaaaagctaaaagggaaaaaggacaaaaaacacaaggcccccaaaagaaaacaggcattccattggcagccccctctggaatttggggaggaggaagaggaagagatcgatgacaagcaggttactcaagaaagtaaggagaagaaagttagcgagaacaatgaaaccataaaggacaacattctcaaaactgagaagagttcggaagaagacctgtctggaaaacacgacacggtaaccgtctcctctgatcttgaccagttcacaaaagatgacagtaagctcagcatcagtccaactgcattgaataccgaagagaacgtggcatgtcttcagaatattcaacacgtggaagaaagcgttccaaacggagtggaagacgtgctccagactgatgataatatggagatttgtacacctgataggtcttcacctgctaaggtggaagagacttctcccctggggaatgcaagattagacacaccagacattaatatcgtgctcaaacaagatatggcaactgaacatccccaggcagaggtggtgaagcaggagtctagcatgtccgaaagcaaagtgctgggagaagtgggcaaacaggactcttcttctgcctctctagcctcagctggtgagtccactgggaaaaaagaagtggccgagaaaagccaaatcaaccttattgataaaaagtggaagcctctgcaaggcgttgggaacctcgcggctccaaacgccgcaactagctctgctgtagaggtgaaagtgctcacaaccgttccggagatgaagcctcaggggctgaggatcgagataaaaagtaaaaataaggtgcggcctggaagccttttcgatgaggtgagaaagactgccagattaaacagaaggccaaggaaccaagaatcttcgtccgacgaacagacacccagccgcgacgatgacagccagagccggtccccctcgaggtcccgttctaagagcgagacaaagtccagacaccggacccgctccgtgtcatactcacattcccgctcaagaagccgatcatccacctcctcttaccggagccggagttactcgcgcagtcggtcccgggggtggtatagtcgagggcggaccaggtcccgttcttcttcctataggtcctacaaatctcatcgcacttcttcccgcagtcggagccgatcctcatcatacgacccgcatagtaggtctaggtcgtatacctacgactcatattactcccgtagccgaagtcgcagtcggagtcagaggtcagactcctaccatcggggccggagttataataggcggagccgttcttgcagaagctatgggagtgactccgaatccgacaggagttattcccatcaccgctccccctctgaaagcagtcggtattcatag

SEQ ID NO: 46011 - DNA, 681 bp, Artificial Sequence
  Description of Artificial Sequence: Synthetic coding sequence
atggccgccgccgccgtgcagggcggccggagcggcggcagcggcggttgctctggcgctggtggagcctcaaactgtggcaccgggtccggtagatcaggcctcctcgataagtggaaaattgacgataagccagtaaaaattgacaaatgggatggcagtgccgtgaaaaactctttagacgacagtgctaaaaaagtgctgctggaaaagtataagtatgttgaaaatttcgggctgattgacggcaggctgaccatttgtacgatttcctgtttcttcgccatagtagctctcatctgggactacatgcaccctttccccgagtctaaacctgtcttggctctctgcgttatctcctactttgtaatgatgggtatcttaacaatctacacgtcatataaagagaagtctatatttctggtcgcccaccggaaagaccccaccggcatggacccggatgatatttggcagttgagctccagtctgaagcggttcgatgacaagtatactctaaaactgaccttcatcagtggtcgtacaaagcagcagcgcgaagcagagttcactaaatccatcgccaagtttttcgaccattccggtacactcgtgatggacgcttatgaacccgagatcagcagacttcacgactcccttgcgattgaaaggaaaatcaagtag

SEQ ID NO: 46012 - DNA, 543 bp, Artificial Sequence
  Description of Artificial Sequence: Synthetic coding sequence
atgaacaccgtgctgagccgggccaacagcctgttcgccttcagcctgtcggtcatggcggccctcacattcggatgcttcatcaccaccgctttcaaagaccggagcgtgccagttaggcttcacgtctcaaggatcatgctcaagaacgtggaggatttcactggccccagagaaaggtcggaccttggctttatcacatttgatatcacagccgacctggagaacatatttgattggaatgttaagcagctgtttctgtacttatcggctgaatacagcacaaaaaataacgccctaaatcaagtggtgctctgggacaagatcgttctaaggggcgataacccgaaactcctgctgaaggacatgaaaacaaagtactttttcttcgacgatggaaacgggcttaaggggaaccgcaatgtaaccctgaccctctcttggaacgtcgtgcctaacgccggcattttgcctctggtgacaggcagcggtcatgtcagcgtgccctttccagatacctacgaaatcacaaagtcctactag

SEQ ID NO: 46013 - DNA, 1563 bp, Artificial Sequence
  Description of Artificial Sequence: Synthetic coding sequence
atgggcccccagcggcggctgagccccgccggcgccgccctgctgtggggcttcctcctacagctgacagctgctcaggaggcgattttgcacgcatctggtaatgggaccactaaagattactgtatgctgtacaacccatattggaccgcactgcccagcacccttgagaatgctacaagcatttcactcatgaatcttactagcacaccgctatgtaacttgagcgacatccctcctgtaggaataaaatctaaggctgtggtcgttccatggggctcttgtcattttctcgaaaaggctcgtattgcacagaagggtggggcggaggccatgctggtagtaaacaactccgtgctgttccccccctcaggcaatcgttctgagtttcctgatgtgaaaattttgattgcatttatttcatataaagactttagagacatgaaccagacactgggagataacatcacagtaaaaatgtactcaccatcctggcccaattttgattatacgatggtcgtgatttttgtgattgccgtgttcaccgtcgcccttggcggctattggagtggcctagtggagctggagaatctcaaggcagtcacaacagaagacagggaaatgaggaagaaaaaggaagagtacttgaccttttcgcctctgactgtggtgatcttcgtggtaatttgttgcgtgatgatggtattgctctacttcttctacaaatggctagtgtacgttatgatcgccatcttttgtattgctagcgccatgagcctgtacaactgtttagcggccctaatccacaagataccatacggccagtgcaccattgcatgccgcgggaagaacatggaggtacgactgatcttcctgagtggcctgtgcatcgccgtcgccgtggtttgggccgtcttccggaacgaggaccgctgggcttggattctgcaggacatactgggcatagccttctgcctaaacctgattaaaacattgaaactgcccaattttaagtcctgcgtgattctcttaggcctcctcttgttgtatgatgtgttcttcgtatttattactccttttataacaaaaaatggcgaatcgattatggtagagctcgcagcaggacctttcggtaataatgagaagctgcccgtggttatccgggtgccaaaacttatctatttttctgttatgtccgtatgcctgatgcccgtctcaattctggggtttggagacataatcgttcccggcctgttgattgcctactgtaggagatttgatgtccagacgggtagttcctatatatactacgtgtcctccacagttgcttatgccatcgggatgatattgacgtttgtcgtgctggtcctgatgaagaaagggcaacccgctcttctgtatttggttccatgtactctgattaccgcctctgtggtcgcctggcgcagaaaggagatgaaaaaattctggaagggcaacagctaccagatgatggaccatctggactgcgctaccaatgaggagaatccagtcatttccggtgaacagatagtacaacagtag

SEQ ID NO: 46014 - DNA, 2055 bp, Artificial Sequence
  Description of Artificial Sequence: Synthetic coding sequence
atggcctgcctgggcttcctgctgcccgtgggcttcctgctgctgataagtaccgtggctggcggaaagtatggagttgcccatgtggtctccgaaaactggtctaaggactactgtattttattttcatcagactatatcactctgcccagggacctgcaccacgcaccacttctgccgctttacgacggaactaaggcaccatggtgcccaggggaggacagccctcaccaagcgcagctgagatcccccagtcagagacccctgagacaaactactgctatggtgatgcgcggaaactgttccttccacacaaagggctggctcgcccagggtcagggcgctcatgggttgctaatcgtgtctcgtgtctcagaccagcagtgcagtgacacaaccctggcacctcaggacccaagacaacccttggcagatttaaccattccagtggccatgctgcactatgcagatatgctggacatcctctcccatacacggggagaggctgtagtgcgcgtcgctatgtacgctcctccagaacccatcattgattacaatatgctggttatttttattctggcagtcggaacagtagccgcaggaggttactgggccgggttaactgaagccaataggctacaacgccgccgtgcccgtcggggcggaggctctggggggcatcaccagctgcaggaagccgccgccgccgagggagcccagaaagaagataatgaggacattccagtcgactttacacccgctatgactggcgtggttgtcaccctgtcctgctcccttatgctgctgttgtatttcttctacgaccatttcgtgtacgtcactatcgggatcttcgggctaggtgcaggtattggactgtacagttgcctgagtcccctggtttgcaggctgtctcttaggcaataccaaaggcccccacatagcctgtgggcctcccttcctctaccgcttctgcttttggcttccttgtgcgctacggttatcattttctgggtggcctacagaaatgaagatcgatgggcatggcttctgcaggacacactcgggatatcttactgcctcttcgtgttgcaccgagtccggcttcccacgctcaagaactgctctagcttcctgctggcacttttggcattcgatgtgttcttcgtcttcgtgacaccattttttacaaaaacgggtgagtccatcatggcacaggtggcactagggcctgctgagtcttccagtcacgaacgtctacctatggtccttaaggtgcctagactgcgggtgtcggcgctgaccctgtgttcgcagcctttttcaatcctcggattcggagatatagtcgtccccggcttcctggtcgcgtattgttgcagattcgatgttcaggtgtgcagtcgacagatttacttcgtcgcctgtactgtcgcatatgctgttgggctactcgtcacattcatggccatggtgttgatgcagatgggtcaacccgccctgctctacctggtgagcagcactctgttgacatcccttgctgtggccgcctgccgacaagaattgtccctgttctggactggacagggaagagccaaaatgtgtggccttggatgtgcaccatctgcggggtctcgccaaaagcaagagggtgccgccgatgcccacacagctagcacactcgagcgtggcacgtccaggggggccggcgatctagattccaatccgggagaagataccaccgagattgtcacaatatccgaaaatgaggccaccaaccccgaggacagatctgactcttcagaagggtggagcgacgctcacctcgaccccaatgaactcccttttatccctcctggagcaagtgaagaactcatgcccctcatgcctatggctatgcttattcctcttatgccactgatgcctccccctagcgaactggggcatgtccatgctcaggctcaggcccacgaaacagggctgccttgggctggcctccacaagaggaaaggacttaaagtgcgaaaatccatgagcacccaagcaccactttag

SEQ ID NO: 46015 - DNA, 1155 bp, Artificial Sequence
  Description of Artificial Sequence: Synthetic coding sequence
atggccgagcagacctacagctgggcctacagcctggtggacagcagccaagtgtccacttttctgatctctattttgctcattgtgtatggatccttcagatccctgaacatggactttgaaaaccaggataaggagaaagactctaattctagttctggcagtttcaacggcaattccacaaataattcaatacagaccatagattccacacaggcactgtttctgcctatcggggcgtccgtgtcgctcctggtgatgttcttttttttcgactcagtacaagtcgtgtttacaatttgcaccgccgtcctggcaaccattgccttcgccttcctgttgctccccatgtgtcagtacctgactaggccctgcagcccacagaataagatctcctttggctgctgcgggcgattcaccgccgccgagctcctgagtttttcgctttctgtgatgttggtgttgatatgggtgctcaccggccattggctcttgatggatgcactggctatgggcctgtgtgtcgctatgatcgcctttgtgcgactgccctctctgaaagtctcttgtctcctgctgtccggtcttctgatctatgatgttttctgggtgttcttctctgcttacatctttaactctaatgtcatggtcaaggtggccactcagccagcggataaccctctggatgtgctgagccggaagctccacctcggacccaacgtcggtcgggatgtgccccggttgagtctgccaggaaaactggtattcccgagttcaacaggctcccatttctccatgctgggcattggagatatcgtaatgccggggttactactctgcttcgtgctcaggtatgataactacaagaagcaggcttcgggggattcttgcggggcacctggtccagcaaacatcagcggccggatgcagaaagtctcgtatttccactgtacccttattggatactttgtgggtctactcacggcaaccgtggcatccagaatacatcgtgctgcccaaccggctctactgtacttggtgcctttcacccttttgcctctgctgactatggcttatctgaagggggatcttcgtcgaatgtggagtgaacctttccattccaaatcttctagctccaggttcctggaggtttag

SEQ ID NO: 46016 - DNA, 1152 bp, Artificial Sequence
  Description of Artificial Sequence: Synthetic coding sequence
agcatccggacccactgcatggcctacagcctggtggacagcagccaggtgagcacgtttttaatctccatcttgcttatcgtctatggctcgttccggtccctcaatatggactttgaaaaccaggacaaagagaaggactcaaattcaagcagcggttctttcaacgggaactccccaattatcggtatacaaaccatcgactctacccaagcactttttcttcccataggggcttctgtctccctgctggtgatgttctttttctttgattctgtacaggtcgtgttcacaatttgtacagccgtgcttgctacaatcgccttcgccttcctacttcttccgatgtgccagtatttaactaggccttgtagtcctcaaaataagatctccttcgggtgctgtgggagattcacagccgccgagctgctttcattctcgttatctgtgatgttagtcctcatctgggtcctgacaggtcactggctgctcatggatgccttagctatggggctttgcgtggctatgattgcattcgtgaggctgccttccctcaaggtttcatgcctgcttctctccgggctcctgatttacgacgtcttttgggtgttttttagtgcctacatcttcaattcaaatgtgatggtcaaagtggccacacaacccgccgataacccactagacgtgttgtcccgcaagttacacttgggccctaatgtgggtagagatgttccaagactgtctctcccgggcaaacttgttttcccttcgtcaactggatctcatttctcaatgttgggcatcggggatatcgtgatgcctggcctgctcctgtgttttgtgctgcgctatgacaattataaaaaacaagcaagtggcgattcttgtggagcccctggccccgccaacatctctggacggatgcagaaagtgtcatacttccactgcacactaatcggatatttcgtgggattgttgaccgctacagtggcctcgcgcatacatagggccgcacaaccagctctcttgtaccttgtacctttcaccctcctgcccttactgaccatggcctacttaaaaggggacctgcgacggatgtggtcagaacccttccactctaagtcctccagttcacggtttctggaagtatag

SEQ ID NO: 46017 - DNA, 816 bp, Artificial Sequence
  Description of Artificial Sequence: Synthetic coding sequence
atggccagcgccgacagccggcgggtggccgacggcggcggcgccggtggcacattccagccttacttggatactctgaggcaggagctccagcagactgacccaaccctactgtccgtggtcgtggccgtactcgcagtgctcttgacgctcgtattctggaaactgatacgttctagacgcagttcacagcgtgcagtcttgcttgtggggttatgcgatagtggaaaaacattgcttttcgtgcgactgctcactgggctctatcgcgacacgcagaccagcatcaccgacagctgtgcagtttacagggtaaacaacaatcggggcaatagccttacgctcattgatctgcccggccacgaatcacttagactgcaatttctggaacggttcaagtctagtgcacgggccatcgtgttcgtagtggattctgccgcttttcaacgcgaagtcaaagacgttgccgagttcctgtaccaagtattgatagattcaatgggtttaaagaacactcctagctttttaatcgcttgcaacaagcaggatatcgcaatggcaaagagtgcaaagttgatccagcagcaattagagaaagagctgaatacacttcgggtgactaggagcgccgccccatcaacactggactcctcttctacggccccagcccaactcggcaaaaagggcaaggagtttgagtttagccagctccctctcaaggtggagttcctggagtgcagtgccaagggaggccgcggggatgttggctcagcggacatccaggatttggaaaagtggctggcgaagatcgcctag

SEQ ID NO: 46018 - DNA, 279 bp, Artificial Sequence
  Description of Artificial Sequence: Synthetic coding sequence
atggccagcgccgacagccggcgggtggccgacggcggcggcgccggcggcacattccagccatatctcgatactctgaggcaggaattgcagcagactgatccaactctgctgagtgtggtcgttgctgtgctggcagtgttgctcacccttgttttttggaaattgatcagatctagaagaagcagccagagggccgtcttactagtgggtctgtgtgactctgggaagacccttctctttgtcagactgctcactggactttacagagacacttag

SEQ ID NO: 46019 - DNA, 861 bp, Artificial Sequence
  Description of Artificial Sequence: Synthetic coding sequence
atgcggctgctgccccggctgctgctgctgctgctgctggtgttcccggccactgttctgttcaggggaggcccccggggcctcctcgccgttgcccaggacctgacagaggacgaagaaacggttgaagactctatcatcgaggacgaggacgacgaggctgaagtcgaggaggacgagcctactgatctggtcgaagacaaagaggaagaagacgtgagtggcgagcctgaggctagtccatctgccgacacaacaatactatttgtcaaaggcgaggatttccccgctaataacatcgtcaaatttctggtaggcttcacaaataagggaacagaagattttattgtagaatctttggacgcaagtttccggtatccccaggactatcagttctatattcaaaatttcaccgcgctcccactgaacaccgtggtgccaccccagcggcaagcaacctttgagtactcatttatcccagccgaacctatgggcgggagaccttttggtctggttatcaatctcaattacaaggatcttaacggaaacgtattccaggatgccgtgttcaatcagacagtcacggtcattgagcgcgaagatggcttagacggagaaactatctttatgtacatgtttttggcaggcctcgggctgctggttatcgtgggattgcaccagcttctcgagtcccgaaaacgcaagcgccccattcaaaaggttgaaatgggaacttcatctcaaaacgatgtcgacatgagttggataccccaggaaacactgaaccagataaataaagctagccccaggagactgcctcgcaaacgggcacaaaagcggagcgtaggctctgacgagtag

SEQ ID NO: 46020 - DNA, 780 bp, Artificial Sequence
  Description of Artificial Sequence: Synthetic coding sequence
atgcggctgctgccccggctgctgctgctgctgctgctggtgttcccagctactgtgctatttcgggggggcccacggggccttctagcagtcgcccaggaccttaccgaagacgaagaaaccgtagaggatagcatcatagaagacgaagacgacgaggctgaagtcgaagaagacgaacccaccgatttggtcaagtatttccccgctaacaacattgtcaagttcctcgtgggctttacaaataagggtactgaagacttcattgtggagtccttggatgcctcctttcgttatccacaggattatcagttttacatacaaaacttcaccgcactcccccttaatactgtcgtcccgccacagcgacaggccacctttgagtactcgttcataccggcagaaccgatggggggtagaccatttggtttggtaatcaatctgaactacaaagacctcaacggcaacgtgttccaggacgccgtcttcaatcagactgtaaccgtgatcgagagggaggacggattggacggcgaaactattttcatgtacatgttccttgccgggctgggattactggtgattgtgggactccaccaactgctcgagtctaggaaaagaaaacgccctattcagaaggtggagatgggcacctcttcccagaatgatgttgatatgtcatggattccccaggaaactcttaaccagatcaacaaagctagcccacgaaggctgccacgcaagagagcgcagaagcgcagcgtcgggtcagatgagtag

SEQ ID NO: 46021 - DNA, 558 bp, Artificial Sequence
  Description of Artificial Sequence: Synthetic coding sequence
atggcccccaagggcagcagcaagcagcagagcgaggaggacctgctactgcaggacttttctagaaacttgagcgccaaaagtagcgccctgttcttcggcaatgccttcatagtgtccgctattcccatctggctttactggaggatttggcatatggatctgattcagagtgcagtactgtattccgttatgactttagtgtctacctacctggtcgcattcgcatacaaaaatgtgaagtttgttcttaagcataaggtggcgcagaagcgagaagatgccgtgtcaaaggaagtaactcgaaaactgagtgaggcagacaataggaagatgtcaaggaaagaaaaggatgagagaatattgtggaaaaagaacgaggtggccgactatgaagcgaccacattttctatcttctacaataacacattgttcctggtggtagtcatagttgcatcctttttcatcctgaagaattttaaccccactgtgaattacatcctgtcaatctccgcgagctctggattgatcgcgctcctcagcacggggagtaagtag

SEQ ID NO: 46022 - DNA, 597 bp, Artificial Sequence
  Description of Artificial Sequence: Synthetic coding sequence
atggcccccaagggcagcagcaagcagcagagcgaggaggacctgctcctgcaagacttctcccgtaacctgtccgccaaatccagcgcactgttttttggcaacgcctttatcgtgagtgccatccccatctggctgtattggaggatatggcacatggatctcatccaaagcgccgtcctgtatagcgtgatgaccctggtgtctacatacttagtggctttcgcctataagaatgtcaagtttgtgctaaagcacaaggtggcacagaagcgggaagacgcagtgtctaaggaagtaaccagaaagctctctgaagctgacaatcggaagatgtcacggaaagaaaaggacgaaaggttcgactcatgtctgaagtatggccatcacaagcggggcatactctggaaaaagaacgaagtggccgactacgaggccaccacattcagcattttctacaataatacattgttcctagttgttgtcatcgtggcctctttctttatcctgaagaacttcaaccctacagtgaactatatcctgagcatctctgcaagcagtgggctgatagcccttctttccacaggcagcaaatag

SEQ ID NO: 46023 - DNA, 5352 bp, Artificial Sequence
  Description of Artificial Sequence: Synthetic coding sequence
atgaccagcctgaagcggagccagaccgagcggcccctggccaccgacagggccagtgtggttggcacagacggtacacctaaagttcatactgatgatttctacatgcggcgatttaggagccagaatggctcactaggaagtagtgttatggccccggtgggccccccaaggagtgaagggtcacatcatatcacatccacaccaggagtgcctaagatgggagtgagggccaggattgctgattggcctcctcgcaaggaaaacatcaaggagagctctaggagcagccaggaaatcgagacctcttcctgtttggactcactttcatccaagtctagccccgtcagccaggggtcttccgtaagcctcaatagtaatgactctgccatgctgaagtctatccagaacacactgaagaataaaactaggccgagtgaaaacatggatagcagatttctcatgcccgaagcatatccctcaagtccccgcaaggctctgcgccgtattcgacagcgttccaactccgatatcaccatctctgaacttgatgtcgactcattcgacgaatgcatctcacccacttataaaactggcccatccctgcacagagaatatggtagcacttcatcgattgacaagcaggggacaagtggcgagtccttcttcgacctgctgaagggctacaaggacgataagagtgaccgaggcccgactccaacgaaattgtctgacttcctgattactggcggaggcaagggctccggcttcagtctggatgttatcgacggtccaatatctcagcgcgaaaacctccggctgtttaaggagcgcgaaaagcctctgaagcgacgaagcaagtctgaaacgggggattcttccatctttcgaaaattgcgtaacgcgaaaggcgaagagttagggaaaagctctgacctggaggataatcggagcgaagattcggtgaggccctggacttgtcctaaatgctttgctcactacgatgtccaaagcatactgttcgatctgaatgaggcgattatgaataggcataatgttatcaaacggagaaatacgaccactggggctagcgcagccgccgtcgcatctttggtctctggaccgctgagccactctgcatcgttttcatctccaatgggaagtaccgaagatctgaattccaagggatcattgagcatggatcagggcgacgacaaaagcaatgagcttgttatgagttgcccatatttccggaatgagattggaggggagggtgagcggaaaataagtctttccaagagtaactccggatcattctcaggttgtgagtcggccagcttcgaaagcacgctgtctagtcattgcacaaacgccggtgtagctgtgctggaggtgcccaaagagaacctagtcttgcacctggacagagtgaagaggtacatagtggaacacgtcgatctcggagcttactactataggaagtttttctaccagaaggaacattggaactatttcggggccgacgagaacctgggaccagtggcagtctccatacgacgggaaaagcccgacgagatgaaagagaatggatctccgtacaattacaggatcatttttcgcacatctgaattaatgacactcagaggttcggtgctggaagacgccataccatccaccgcgaaacattctacagcaagaggcttacctctgaaggaggttctggagcatgttgtgccagaactgaatgtccagtgcctgcgactcgcttttaatactcctaaggtgaccgagcaattaatgaagcttgatgagcaagggctgaactatcagcagaaggttggcatcatgtactgtaaagcagggcagagtacggaggaagaaatgtacaacaacgaatctgccgggccggctttcgaagagtttttacaattgctcggcgagcgagtacgcctaaaaggcttcgaaaagtatagggcccagttggacacaaagactgatagcactggtacgcattctctgtatactacatacaaagattacgagatcatgttccatgtaagcaccatgctaccatatactcccaataacaagcagcaactgctgcgcaaaagacatattggcaatgatatagtaacgatcgtttttcaagagccaggcgcgcagccatttagcccaaagaacattcgctcccacttccagcacgttttcgttatcgttagagtgcacaacccatgtagtgattctgtgtgctattccgtcgctgtgactcggagtcgggacgtcccttctttcggtccgccgattcccaagggtgtgacatttccgaaaagcaatgtgttccgtgactttttactggcaaaagtcatcaacgctgaaaatgcagcccacaagagtgagaagttcagagccatggcaactcggaccagacaggagtatcttaaggacctggccgagaagaatgttacgaacacgccaattgacccctccggcaaattcccttttattagtctggcctctaagaagaaagaaaaaagcaagccgtaccccggggccgagttgtcttcaatgggcgccattgtctgggccgtccgcgcggaagattacaacaaagctatggagctggactgccttctcggtatcagcaatgagtttattgtgttgatagaacaggagaccaaatccgttgtattcaactgtagttgcagggacgtgattggttggacttctacggacacctccctaaagattttctatgagaggggcgagtgcgtgagcgtcggaagctttattaatatcgaggaaatcaaagagatcgtgaaaaggttgcagttcgtgagcaaaggctgcgaatcggttgagatgaccctgagacgcaacgggctgggccagctgggctttcatgtgaattacgaaggtatcgtcgccgacgtggaaccatatggatacgcctggcaggcaggcctgcgacagggaagtaggctggttgaaatttgtaaagtagcggtagctaccctatcacacgaacagatgatagaccttctgaggacatctgttacagttaaagtagtcatcattccaccccatgacgactgtacacctcggaggagttgtagcgagacataccggatgcctgtcatggaatacaagatgaatgagggcgtcagttacgagtttaaatttcctttccgtaataacaacaaatggcagcgaaatgcctcaaagggaccgcattcaccacaagtgccctcacaggtccagagtcccatgacttcacgcctgaatgcagggaaaggcgatggcaaaatgcctccgccagaacgcgcagccaacatcccccgttcgatctcatctgatggcagaccgctggagcggaggctctcgcccggaagtgacatctacgtcaccgtctcttctatggctctcgcaagatctcaatgtcgcaattctccatccaacttaagcagctcaagcgacacaggaagcgtcggcgggacttaccggcagaagagcatgccagagggtttcggcgtctcacgacgctcgcctgctagtattgatcgccagaatacccagagcgacatagggggctccgggaagagcacaccctcttggcagcggagcgaagattccatcgccgaccagatggaaccaacctgccaccttccggcggtgtcgaaggttctgcctgcctttcgggaaagtccctccgggaggttgatgcgtcaggatccagttgtccacctatcacccaacaagcaggggcactccgattcccactattctagccattcctcttccaacacactatcatctaacgcctctagtgcacattcagacgaaaaatggtatgacggggaccgcaccgagtccgaattgaatagctacaactatttgcaaggtacttccgctgactctggaattgacacgacgagttacgggccttcacatggcagtacagcttccctgggggccgctacttcgtctcctcgaagcggtcctggcaaagaaaaggtggcgccactctggcattcgtccagcgaggtaattagcatggcagatcgtactctggagacggaatcgcacggcctggacagaaaaaccgagtcttccctctcattggacattcacagtaaatctcaggctggttccactcccctaacaagagaaaacagtactttttctattaatgacgccgcttcacacacaagtaccatgagcagccgacacagtgcctcccctgtagttttcaccagcgcccgatcatcccccaaggaagaactgcatcctgcagcgccctcccagctcgccccatccttcagcagcagctcatctagctcaagcggtccgcggtccttctaccctcgccaaggcgccacatctaagtacctgattggttggaaaaagcccgaaggaaccatcaactccgtcggctttatggacacaagaaagcgtcatcagtctgatggaaacgagattgcccacacacgcctgagggcttctacccgggacctgcgggcctccccaaaaccgactagtaagtcgaccatcgaggaagatctcaaaaagctgatcgatctcgaaagcccaactcctgagtctcagaagtcctttaagttccatgcactttcttcaccacagagcccctttccaagtacccccacgtctcgcagagccctgcacaggaccttaagtgatgaatcgatttacaatagccagcgcgagcacttcttcacttcaagagccagcctgctggatcaagcactccccaatgacgtgctgttctccagcacttacccgtctctgccaaaatctctccccctgcgaagaccatcatacaccctcgggatgaagtccctgcatggtgagtttagtgccagcgactccagtttaaccgacatccaggaaaccaggcgccagccgatgcctgatccagggttaatgcctctgccagacaccgctgcagatttggattggtcaaatctagtcgatgccgcaaaagcctatgaagtgcaaagagcttcatttttcgcagcctccgacgagaaccaccggcccctttctgcagcctccaattcagaccagctcgaggaccaggctcttgctcaaatgaagccctacagctcttccaaggattccagccccactctggcttcaaaggtggatcagctagagggaatgttgaagatgctgagggaagaccttaaaaaagagaaagaagataaagctcatctacaagcagaggtccagcatcttcgtgaggataacttgagactgcaggaggaatcgcagaatgcatccgacaaactcaagaagttcactgaatgggtgtttaacacgatagacatgtcatag

SEQ ID NO: 46024 - DNA, 3774 bp, Artificial Sequence
  Description of Artificial Sequence: Synthetic coding sequence
atgaaggagaacggcagcccctacaactaccggatcatcttccggacttcagagctgatgaccctgcgaggctccgtgttagaagatgccatccctagcaccgccaaacacagcactgctcgcggcctccccctcaaagaggttctcgaacacgtcgtccccgagctgaatgttcagtgcttgaggcttgcttttaatacacctaaagtaactgagcagctaatgaaattagacgagcagggcctgaactatcagcaaaaagtcggtattatgtattgtaaggccgggcagtcaaccgaagaggagatgtataacaacgaatcagctgggcctgcctttgaagaattcttgcaactgctgggggaacgtgtgagactgaaaggattcgaaaagtatcgcgcacagttagacaccaagactgacagcaccggcacgcattctctgtatactacctataaggactacgaaataatgtttcatgtctctacaatgctgccctacacccccaacaacaagcaacaactgctacggaaacggcatatcggaaacgatatcgtcaccatcgtgtttcaagagcccggagcacagcccttttctcccaagaatatcaggtctcattttcagcatgtctttgtaattgtccgggttcacaatccgtgctcagactccgtctgctattctgttgctgtgacccgttcaagagatgtgccttcgttcggtcctcccattccgaagggagtgacattccccaaatcaaacgtgttccgtgatttcttgctggcgaaagtcattaatgccgaaaacgctgctcataaatccgagaaattccgcgctatggcaacccgaacacgacaggaatacctgaaggaccttgccgaaaaaaacgtgacaaataccccgatcgacccgagcggaaagttccccttcatttcactggcctccaaaaagaaagaaaagtccaagccctaccctggcgctgaactttccagcatgggtgccatagtttgggcagttagggcggaagactacaacaaggcgatggagctcgactgcctcctgggcatctcaaacgaatttatcgtgctgatcgaacaggagaccaaatccgttgtatttaactgcagctgccgggacgtcattgggtggactagcactgatacttcactgaagattttttatgagagaggagaatgtgtgagcgtgggctcctttatcaacatagaagaaatcaaagagattgtcaagaggttacagttcgtgtctaaaggttgtgagtccgttgagatgacattgagacgcaatgggctgggccaactcggctttcacgtgaattacgaaggtattgtggctgatgtggaaccctacggctatgcttggcaggctgggttgaggcagggttcgaggctggtggagatttgcaaagtggccgtggcaacattatcacacgaacaaatgatcgacctcttgcggacgtccgtgacggtgaaagtcgtaattattccccctcacgacgactgtacccctcgacgctcctgcagtgagacttaccggatgcccgtgatggaatataagatgaacgaaggggtctcttatgaatttaaatttccattcagaaataataataaatggcagcgcaacgcgtctaaagggccacattccccacaagtgcctagccaagtccaatccccaatgacctccagactaaacgctggaaagggagacgggaagatgccaccacctgagcgggcagccaatatccctcggagcatctcctcggacggaagaccccttgaacgaaggctttctcctggcagcgatatttatgtgacagtgtcctctatggccctggcccgtagccagtgccggaattcccccagcaacctgagtagcagtagtgatactggctcagtcggcggaacttaccgccagaaaagcatgcctgaaggatttggggtgtcaagacgctcccccgcatcaatcgaccggcagaacactcagagtgatatcggtggttcagggaagtctactccctcctggcagcgaagtgaggactccattgctgaccagatggaacctacttgtcatcttcctgcagtgagtaaggttcttccggcctttagagagtccccaagtgggcggctgatgcgccaggatccagtagtgcatctgtctcccaacaaacaggggcactctgatagccattactccagtcattcctcctccaacacactcagctcaaacgcttcctctgcccacagcgatgagaaatggtatgacggagataggacggagtccgagctgaactcctataattacctgcagggcaccagcgccgattcaggcattgacactactagctatgggcctagtcacggaagtactgcatccttgggcgccgccacatcaagccctagaagtggccctgggaaggagaaggtagcccctctgtggcattccagcagtgaggtaatcagcatggccgatcggaccctggagaccgaatctcacggccttgacaggaagacagaatcgagtctgagccttgatatccactcaaaatcccaagctggcagcaccccgctcacccgtgagaactcaacattttctatcaacgacgctgcctctcatacctcaaccatgagcagcagacatagtgcatctccagttgtgttcacgtccgcgcgctcatcgccaaaggaggagctgcaccctgccgcgccctcccagctggccccctctttttctagcagctcctcatcctcttcgggcccacgttctttttatccaaggcagggagccacctcaaaatatctgatcggatggaagaaacccgagggcacaatcaactccgtcggtttcatggacacacgcaagagacaccagagtgacggaaacgaaatcgcacacactagactgcgcgcttctactcgggacctgagggcctcccctaagccgacatctaagagcactattgaagaagatctgaaaaagctgattgacttggaaagtccaactccagagtcccaaaaaagtttcaaattccatgcactgtcaagcccccagagcccattcccttctactccaacaagtagacgggcactgcaccgcaccctgtcggatgaatcgatctataactctcaacgggagcatttctttaccagtcgggcctctctcctggaccaagcgctcccgaacgacgtgttattctctagcacctacccctcactgccaaaatctctgcccttgcgacgtccctcttacaccctggggatgaagtccctccatggcgagtttagcgcctcggattcgtcgttaaccgacatccaagaaacccggcgccagccaatgccggatcctggcctgatgcccctgcctgacacagccgctgatctcgattggtctaacctggttgacgctgccaaagcctacgaggtgcaaagggcatcctttttcgccgcatcggacgagaatcacaggccactcagcgccgcaagcaactctgatcagctggaggaccaggccctcgcgcaaatgaagccctactcctctaaggacagctcccctactttggcctccaaagtggatcagctggaagggatgttgaaaatgctgcgagaggacctcaagaaagagaaggaggacaaagcacacctgcaggccgaggtgcagcacctacgggaggataacttaaggctgcaggaagagtctcagaacgcgtctgacaaactgaaaaagttcacagaatgggtcttcaataccattgacatgtcgtag

SEQ ID NO: 46025 - DNA, 5415 bp, Artificial Sequence
  Description of Artificial Sequence: Synthetic coding sequence
atgaccagcctgaagcggagccagaccgagcggcccctggccaccgatcgcgcttcggtggtcgggactgacgggacccctaaggtgcacacagacgacttttatatgcgcagattccggtcacaaaatggctctctgggatcttctgtcatggcccccgtaggaccgccccgttccgaaggcagccaccacatcacctcaacacccggcgtccccaagatgggcgtccgagccagaattgccgactggcctccaaggaaagaaaacatcaaggaatcctctcgcagttctcaggagatcgagactagtagttgcctggactctctttcttcaaagtcatcacctgtgagtcagggctcttctgtttcactgaacagcaatgatagtgcgatgctcaaaagcatccagaacactttaaaaaacaaaacacggccatcagagaacatggatagccgcttcctcatgcccgaggcctacccgagtagcccaaggaaggcccttagaagaatccgccagcgcagtaatagcgacatcactatctctgaactggacgtggacagctttgacgaatgcatctcgcctacctacaagaccggccccagcctgcatagggagtacggctcaactagctcaatcgataagcagggaacaagcggtgaaagcttcttcgatcttttgaagggctacaaagacgacaagtccgataggggacccacacctaccaaattaagcgattttttgattaccggtggggggaaaggtagcggattttctctggacgttattgacgggcccattagtcagcgggagaatcttagactgtttaaggagcgggaaaagcccctcaaacgtaggtcaaagagcgagactggagacagcagcatcttccgcaagttaagaaacgcgaaaggtgaagagctaggcaaaagctccgacctcgaggataatcggagcgaggacagtgtcaggccttggacctgtccgaagtgtttcgcgcactatgacgttcaaagcatcctgttcgaccttaacgaggccattatgaaccgacacaatgtgattaagcgtcgaaacactaccacaggcgcttcggccgccgccgtagccagccttgtctcaggacctctgagccattccgcatccttctctagccccatggggagcaccgaagatctaaattctaagggctctctgtcaatggatcaaggcgatgataagtccaacgaactggttatgagctgcccatacttcagaaatgagattgggggggagggcgagagaaagatctccttatccaagtctaattcagggagtttctccgggtgtgagtctgccagctttgaatctaccctgtcatctcattgtactaatgctggcgttgctgttctggaggtgcccaaagaaaacctggttttgcacctggacagggtcaaaaggtacatcgtggagcacgttgacctgggtgcctattactacagaaagttcttttatcaaaaagagcactggaattattttggcgcagacgaaaaccttgggcctgtggcggtgtcaattaggagagagaagcctgatgagatgaaggagaatggcagcccttataactatcggataattttccggacctcagagctcatgacgctgaggggctctgttctggaggacgccattccatccacagccaagcacagtacagctagagggctgcctttaaaggaagttttggagcacgtggtccctgagcttaacgtgcaatgccttcggcttgccttcaatacaccaaaagtcacggagcaattgatgaagttggatgaacaagggcttaattaccagcagaaagtaggaattatgtactgcaaagccggccaaagtaccgaagaagagatgtataacaatgagagcgctggacctgcatttgaggagttcttgcagcttctgggcgaaagggtgagactgaaaggcttcgaaaagtaccgggcgcaactagatacaaagaccgacagcactggcacacactccttatatactacttacaaggattacgaaatcatgttccacgtgtcaacaatgctgccttatacgcccaacaataagcaacagcttctcaggaaaagacatataggaaatgatatcgtcacgattgtgttccaggagcccggtgcacagccctttagccccaagaacatacggtcccactttcaacacgtttttgtgattgtccgcgtccataatccctgctctgatagtgtgtgctacagcgtcgcagtgactcgcagcagggacgtcccgtccttcggtccaccaattcccaagggggtgaccttcccgaaatcaaatgttttccgggattttctgctcgcaaaggtgataaatgcggaaaacgcggctcacaaaagcgagaagtttagggcaatggcaactagaacaagacaggagtaccttaaggatttagctgagaagaacgtcacaaacacaccgatcgacccatccgggaaatttccctttataagtttggctagtaaaaagaaggaaaaatcaaaaccatatccgggtgccgagcttagttcaatgggggctattgtctgggccgtcagagccgaagattacaataaggccatggagctcgattgcctgttgggcataagcaatgagttcatagtcctaatcgagcaggaaaccaagagtgtagtcttcaactgcagctgtcgggacgtcatcggatggactagcaccgacacttccctaaagatcttctatgagagaggcgagtgtgtatctgtgggaagtttcatcaacattgaggagattaaggagattgtaaagagattgcagttcgtgtccaaaggttgtgagtcagtggagatgacattgcggagaaacgggctggggcagctcgggttccacgtcaactatgagggaatagtcgccgacgtcgaaccttatggctatgcatggcaggccggcctgagacagggcagccggcttgtggaaatttgtaaagtagccgtagcgacactgtctcatgagcagatgatcgacctgctgcggacaagcgtgacagtaaaggtcgtaatcattcctccccacgatgattgcacgcctcgtcgctcctgctcagaaacctaccgcatgccagttatggagtataagatgaacgagggtgtatcttacgagttcaagtttcctttcaggaacaataataaatggcagcgaaatgcctcaaaaggcccacattccccgcaggtgccgtcccaagttcagtctccgatgacctcacgcctcaatgcaggcaagggcgacggaaaaatgccacctcctgaaagagcagccaatatcccccgctctatctcatcagacggccgtcccctggaaagacgcttaagtccaggctcagatatctacgtgacagtctcctcaatggccctggcccggtcccagtgccggaactcaccctcaaatctcagcagctcttccgatacgggatcagtgggaggcacataccggcaaaagtccatgcctgagggcttcggagtctcccggcgtagcccggcctcaatagatcgccagaacactcaaagcgacataggcggaagtggtaaaagcacaccaagttggcagagatccgaggactctattgcagaccagatggcctactcttaccgaggcccgcaggattttaattccttcgtactggaacagcacgagtataccgaacctacctgccaccttccggccgtctctaaggtactgccggcttttcgtgagtcgccatcaggaagactgatgcggcaagaccccgttgtgcacctgagccctaacaagcaggggcatagtgactcccactactccagccactcttcatcaaatactctgtctagcaacgccagtagcgcacactccgatgaaaaatggtatgatggagatagaaccgaaagcgagctgaactcatataactatttacagggcaccagtgcggactcgggcatcgatactacatcctatggcccgtcccatggtagcacggcatctctgggagccgctacctcttcccctcgatcaggacctgggaaggaaaaggtagcccccctatggcactcatcttctgaagtgatatctatggccgaccgcaccctcgaaacggagtctcatggacttgaccgaaagaccgagtctagcttgtccttggatattcattcgaaaagccaggctgggtccactccgctgacaagggagaactctacattttccatcaacgacgccgctagccacacttccaccatgtctagcagacacagcgcaagtcctgtggtgtttacttccgctaggtcaagcccaaaagaagagctgcacccggctgcgccctcccagctggcgccatccttcagctcatcatcttcaagctcttccggccctagaagtttctatcccaggcaaggggcaaccagcaaatacctgattggatggaagaagccagagggaacaattaattcggtgggctttatggatacaagaaaacgacatcagagcgacggaaacgaaattgctcacacaagattgagagcttctacacgggacctccgagcctcacccaaaccaacctcaaaatctactattgaagaggacctgaaaaagctcatcgacctggaaagtccaacaccagaaagccagaagagctttaaattccacgccttatcctctccacaatctccatttcccagtacgcctacctccagaagggcgctgcaccggaccctcagcgacgagagcatttacaacagtcaacgcgagcacttttttacatcccgggcctccctgctcgatcaggctctgcctaacgacgtgctcttcagcagcacctatccatctcttcccaaatccctgcctttacggcgaccaagttatacgctggggatgaaaagcctgcacggagaattctcagcatccgatagctcgttgaccgacattcaggagaccagaaggcagcccatgcccgaccctggtctgatgccactgccagacactgcagcggatcttgattggtccaacctggtggatgccgccaaggcctacgaggtgcaacgcgccagctttttcgcggcaagtgacgaaaaccataggcctctgtctgccgcctctaacagtgaccaactcgaagaccaggctctcgcccagatgaagccttatagcagctccaaagattccagccctactctggccagcaaagtggaccagttggagggaatgcttaaaatgctgagagaggacctcaagaaggaaaaagaggataaagctcatttgcaggccgaagttcagcacctgcgggaagataatcttaggttgcaggaagagtcccagaacgccagcgataaactgaagaagttcacagagtgggtcttcaataccattgacatgagctag

SEQ ID NO: 46026 - DNA, 591 bp, Artificial Sequence
  Description of Artificial Sequence: Synthetic coding sequence
atgaaccaggccgacccccggctgcgggccgtgtgcctgtggaccctgaccagtgctgcaatgtctcggggcgataactgcaccgatctccttgcactgggtatcccttctattacacaggcatggggactgtgggtactccttggcgccgtgacactccttttcctgatctccctagcagcccatcttagtcaatggacccgtggacgctcacgctcccatccgggccagggtaggtcaggtgaatccgtcgaggaagttccactgtatggcaatttgcattacctccagactgggcgcctgagtcaagatccggagcctgatcaacaggatccgactttaggaggtcccgcccgggcagccgaggaagtgatgtgttatacctccctccagctgcgaccccctcagggccggatccctggacccgggacccctgtcaagtacagcgaggtggtgctcgactccgagcccaaatctcaagctagtgggccagagcctgaactgtacgcatcggtctgtgcacagactaggcgtgcacgagcttcatttcccgatcaggcctatgcgaattcccagccagccgcctcgtag

SEQ ID NO: 46027 - DNA, 1515 bp, Artificial Sequence
  Description of Artificial Sequence: Synthetic coding sequence
atggagcccgccggccccgcccccggccggctgggccccctgctgtgtctcctgctcgccgcatcatgtgcttggagcggcgtagcaggcgaggaggagctgcaggtgatccagccagataagtctgtactcgtggcagccggtgagactgctactctacggtgtacagcaacatcacttatcccagttggtcccatacagtggttccggggtgcagggcccggccgcgagttgatttataatcaaaaggagggccatttccctcgcgtcacaacagtcagtgacctgaccaagagaaataacatggacttctccatccgaatcggtaatatcacccctgccgacgccggcacttactattgcgtgaagttcagaaaaggcagccccgatgacgtggagtttaagagtggcgccggcactgagctgagcgtccgggcaaaaccttccgcccctgtggttagcggacccgccgctagagctactccacagcatacagtgtctttcacctgtgagtcacacggcttttccccacgggatatcacactgaagtggtttaaaaacggcaatgaactctctgactttcagactaatgtggaccccgtgggagagagtgtgtcatactccatccatagcacagcgaaggtcgtattgactagggaagatgtgcattcccaggtaatttgcgaggtggcgcacgtgacgctccagggagaccctctgcgagggactgccaatctgtcagagactattcgcgtccccccaacccttgaagtgacccagcagcctgtccgcgccgaaaaccaggtgaacgtaacttgccaggtgcgaaaattctatccacagcgtctacagttgacctggcttgagaacggtaatgtgagtaggacggagacggcatctacagtgactgagaacaaggatggaacctataattggatgtcctggctcttggttaacgtgtctgctcaccgggatgatgtgaaactgacttgtcaggtagagcacgacggccaacccgccgtctctaaatcccacgatcttaaggtcagcgcacacccgaaggagcagggcagcaacactgctgcggaaaacactggctccaacgaaaggaacatttatattgtcgttggtgtggtgtgcacactgctggtagcccttcttatggcagcactgtatctggtcagaatccggcagaagaaggcgcagggcagcactagtagcacgcgactgcatgagccagagaaaaacgccagggagattacgcaggataccaatgacatcacttatgccgacctgaatctcccgaagggaaagaagcccgctccacaggccgcagaacctaataatcatacggaatacgccagcatacagacgtctcctcagcctgcctccgaggacaccctgacatatgcagacctagatatggtgcacctaaacagaacgcctaagcaaccagcccctaagccagagccttctttcagcgagtacgcttctgtgcaagtaccccggaaatag

SEQ ID NO: 46028 - DNA, 1515 bp, Artificial Sequence
  Description of Artificial Sequence: Synthetic coding sequence
atggagcccgccggccccgcccccggccggctgggccccctgctgtgtcttctcctggctgcctcctgtgcgtggtcaggagtggccggtgaggaagaactgcaggtgatccagccagataaatccgttctcgtcgctgctggcgaaactgcaacgttacgctgcacggcaaccagtctgatcccggtggggcctattcagtggttcagaggcgcaggtcccggcagagagctgatctacaatcagaaagaggggcactttccgcgagttacaaccgtgagtgacctgacaaagcgtaacaatatggactttagcatcaggatcggcaacattacacccgccgatgccggaacttactactgtgtgaaattccgcaaggggagcccagacgatgtggagttcaagtcaggggctggaaccgagctctccgtacgcgcgaaaccttctgcaccagttgtgtcagggcctgcagctcgagccacaccacagcatactgtgtcctttacatgcgaatcacacggattcagcccaagagacatcactctaaaatggttcaaaaatggaaatgaactgagcgatttccagacaaatgtcgatcccgttggagagagcgtgtcttactctattcatagtaccgctaaggtggtgctgacacgcgaagacgtgcattcacaggtgatatgtgaagtcgcacacgtcacccttcaaggcgatccgctccggggaaccgctaacctgtcagagactatcagggtaccgcccacccttgaagtgacgcagcaaccggtgagggccgaaaaccaagtcaatgtcacttgccaggtgcggaaattctatccacagcgtctacaactcacatggttggagaatggcaatgtttctcgcacggagacagccagcaccgtgacggagaacaaggacgggacctacaattggatgtcatggcttctcgtgaatgtgtctgcacatagagacgacgttaaactgacatgtcaggtggaacatgatggccagcctgctgtgtcgaagtcacatgaccttaaggtcagcgcccatcctaaggagcagggcagtaacaccgcagccgagaacaccggatccaacgagagaaatatctatatcgtcgtcggagttgtgtgtaccttattagtggccttgttaatggccgccctttatctggtgcgaattcggcaaaaaaaggcacaggggagcactagctccacgagattgcacgagccggagaagaatgcgagagagattactcaggacaccaacgatataacatacgcagatctcaatttgccgaagggaaagaagcctgcaccccaggccgccgagccgaacaaccatacagagtatgcttcaatccagacgtctcctcagccggccagcgaggacaccctcacatatgctgacttggatatggtgcacctcaatcggacacccaagcagccagcgcctaagccggaaccgagtttttcagagtacgccagcgtccaggtaccacgaaaatag

SEQ ID NO: 46029 - DNA, 1527 bp, Artificial Sequence
  Description of Artificial Sequence: Synthetic coding sequence
atggagcccgccggccccgcccccggccggctgggccccctgctgtgtcttctgctggccgcctcttgtgcctggtcaggggtcgccggggaggaggagctccaagtcattcagccggacaagagtgtgctggttgcagcaggtgagaccgctacgctccgctgcaccgccacttcactgatacccgtagggcccatccagtggtttcgcggagcaggacccggtcgagaattgatttacaatcagaaagagggacacttcccaagagtcacaactgtctcagatctaaccaagagaaacaatatggatttctctataaggatcggcaacattacaccagccgacgccggaacatattactgcgtcaagttcaggaaggggtctccagatgacgttgaatttaaaagcggggccggaactgagctgtccgtgagggccaagccttcagcccctgttgtgtccggaccagctgcccgagccactccccagcatactgtgagtttcacatgtgagagccacggttttagcccaagggatataacactgaagtggttcaagaacggcaatgagttgtccgacttccagacaaacgtcgatcctgttggggagtccgtatcttatagcatacacagcaccgctaaagttgtgctgactagggaggacgtgcacagccaagtgatttgcgaagtggcgcacgtgacactacaaggtgatcccttgcgtggcacggcaaatctttctgaaacgattagggtcccccctaccttggaagtcactcagcagccagtccgcgcagagaatcaggtcaatgtgacatgtcaggtccggaagttttatcctcaacgattgcagctgacatggctcgagaatggcaatgtgagtcgtactgaaacagcctcaacggtcactgagaacaaagatggcacttataactggatgagctggttgcttgtgaatgtgtcagctcaccgcgacgacgtcaaacttacatgccaggtggagcatgatggccagcctgccgtctcaaagagtcacgacctcaaggtgagcgcccaccccaaggagcagggcagtaataccgcagctgaaaacactggctccaatgaaaggaacatctatattgtggttggcgttgtgtgtactctgcttgtcgcgctactcatggctgcgttgtatcttgtccgcattcggcagaagaaagcccagggtagtacatctagtacgcgtttgcatgaacccgagaaaaatgcccgtgagataacccaggtccagtcattggacacaaatgatataacatacgcggacctgaatttgcccaaggggaagaaaccggctccccaggctgccgagccaaataatcacacagagtatgcttccattcagacatcaccccaaccagcctccgaagatacactcacatacgccgaccttgatatggtgcacctgaacaggacacctaagcagccagccccaaagcccgaacctagtttctcagaatacgccagcgtgcaggtcccaaggaagtag

SEQ ID NO: 46030 - DNA, 543 bp, Artificial Sequence
  Description of Artificial Sequence: Synthetic coding sequence
atgcccgtgcccgccagctggccccaccccccctgccccttcctgctcctgacactgctgctgggcctgactggcgtggctggcgaagacgaattgcaggtgatccagccagaaaagagcgtatctgtggcagccggagagagtgctacactgcggtgtgcaatgacgtctctgattcctgtcggacctattatgtggtttcgaggcgccggcgccggtagagagctgatctacaaccagaaagagggccattttcctcgggtgacgacagttagtgaattgacgaaaaggaacaacctagatttctcaatttccatttccaacataacacccgccgacgccggcacttattactgtgtcaaattccgaaaaggatctcctgacgatgttgagtttaagagtggtgcaggcacggaacttagtgttcgtgaggccgccctagctcccaccgctccccttctagtggcactgttgttggggcctaaactcctgctagtagtaggagttagtgcaatttacatctgttggaagcagaaagcctag

SEQ ID NO: 46031 - DNA, 1197 bp, Artificial Sequence
  Description of Artificial Sequence: Synthetic coding sequence
atgcccgtgcccgccagctggccccacctgcccagccccttcctgctgatgactctgctgcttgggaggctgaccggcgtggccggggaggaggaactgcaagtgatacagccagacaaatcaatttcagtagctgccggagagagcgctaccctccactgcacagtgactagtctgatccctgtggggccgattcagtggttcaggggggcaggtccgggtcgcgagctcatctacaatcaaaaagaaggacacttcccaagagtgacaacagtgtcggacctgacaaaacgaaacaacatggacttctccattcggatcagtaacatcactcccgccgatgctgggacttattattgcgttaagttccgaaaaggctctccagaccatgtagagttcaagtctggtgcagggaccgaactgagcgtgagggcaaagccctctgctcctgttgtttccggccccgcagctcgcgccacgcctcaacataccgtcagcttcacctgtgagtctcacggcttttcccctcgcgatatcactctaaagtggttcaaaaatggaaatgagctgtctgatttccagacaaatgttgatcctgcaggcgactccgtctcatactctattcacagcactgccaaagtggttctaactagagaggacgtgcacagccaggtcatctgtgaagtggcacacgtcacgctgcaaggagatccacttagaggtacggcaaacctgagcgaaacgatccgcgttcccccaaccctggaggttacccagcagcctgtgagagctgagaaccaagtgaatgttacctgccaggtgagaaagttttacccccagaggctgcagctaacttggctggagaatggcaacgtaagcaggactgaaaccgcgagcaccctcacagagaataaggatgggacatataattggatgagctggttactagtgaacgtgtcggctcatcgcgacgatgtcaaactgacttgtcaggtcgagcacgatggccaacctgccgtgtccaaatcccacgatctgaaagtcagtgcccacccgaaagagcagggctccaacacagctcccgggcctgcgctggcttctgcggcgcccctcctcatcgcattcttgcttggccccaaggttctgctcgtagtgggggtcagcgttatatacgtgtactggaagcagaaggcttag

SEQ ID NO: 46032 - DNA, 519 bp, Artificial Sequence
  Description of Artificial Sequence: Synthetic coding sequence
atgcccgtgcccgccagctggccccacctgcccagccccttcctgctgatgactttattattagggcggctgacgggagtcgcaggcgaggaggagctgcaggtcatccaacctgacaagagtatctcagtcgccgcgggggagtccgctacactgcattgcactgtcacatccctgattccagtggggcccatacagtggttccggggcgcgggcccaggccgggagctgatctataaccagaaggagggtcattttcccagagtgactactgtgtccgatctgaccaagcgtaacaacatggactttagcatcaggattagtaatatcactcccgccgacgccgggacttattactgtgtgaaatttcgcaaagggtctcccgaccacgtagaattcaaaagtggcgcgggcaccgaactctcagtaagagtgctgcaagtgaaagagattaaaataccacggacactggcttccgtggtgattcaggtgtacctcctccaacatccagttgcttag

SEQ ID NO: 46033 - DNA, 546 bp, Artificial Sequence
  Description of Artificial Sequence: Synthetic coding sequence
atgcccgtgcccgccagctggccccacctgcccagccccttcctgttgatgactctgcttctcggacgcttgaccggagtagccggcgaagacgagcttcaggtgatccagccagaaaagtcggtctctgtagctgcaggcgagtcagccacactgagatgtgcaatgacaagcctcatcccagtaggtcccattatgtggtttcgcggggccggcgcaggaagggagctgatttacaatcagaaggagggccacttccctcgggtgactaccgtctctgaactgaccaaacggaacaatctcgatttttccatttctattagcaatatcacccccgccgacgccggcacgtattactgcgtcaagttcagaaaagggagcccagatgacgttgagtttaagtccggggccgggaccgagctatctgttagagaagcagctctggctcctactgcccccctgcttgtggcgctacttctcgggcctaagctgctgttggtcgtgggagtctccgcaatctatatctgctggaaacagaaggcttag

SEQ ID NO: 46034 - DNA, 1197 bp, Artificial Sequence
  Description of Artificial Sequence: Synthetic coding sequence
atgcccgtgcccgccagctggccccacctgcccagccccttcctgctgatgactcttctcttgggacgcttgaccggggttgccggagaagacgaactgcaggtcattcaacctgaaaaatcggtctccgtggcagcaggagagtctgcaaccctgagatgtgcaatgactagcttgattcccgtggggcctatcatgtggtttaggggcgctggggcaggccgagagctgatttataatcagaaagagggccactttccgagggtcactaccgtgtcggagctgaccaagcggaacaacttggatttttctatctctatttccaatataacccctgcggatgctggaacctactattgtgtcaagtttcgcaaaggttctcctgacgacgtggagttcaagtcaggcgcaggcacagaactgagcgtacgggctaagccaagtgcccccgtggtttctggaccagctgtcagggccacacctgagcacaccgtgagttttacatgtgagagccatggattcagcccccgtgatattaccctgaagtggtttaagaatggtaacgaattaagtgactttcagactaacgtggatcctgcaggcgattcagtttcatactctatccactcgacagcgcgcgttgtattgactcggggggatgtgcacagccaggtaatttgtgaaattgcgcatattacactccagggagatccactgcggggaaccgccaatcttagtgaggccatcagagtcccccctactttggaggtgacccagcagcctatgagggcagagaatcaggctaacgtgacctgccaagttagcaatttctatccgcggggtctacagttaacctggcttgagaatggcaacgtttcacgtacagaaacggcaagcacattgattgaaaacaaagacggcacctataactggatgtcttggctgttggtaaatacctgcgctcatcgcgacgatgtggtgctgacatgccaggtcgagcacgacggacagcaggcagtgagcaaatcctacgcccttgagatttctgcacaccagaaggagcacgggagcgacattacgcacgaagccgctctggcacccaccgcccctttgctggtggctctcctgcttgggcctaaactgctattggtcgtcggggtcagtgctatttacatctgctggaagcagaaagcatag

SEQ ID NO: 46035 - DNA, 519 bp, Artificial Sequence
  Description of Artificial Sequence: Synthetic coding sequence
atgctggccgccggcgtgggcggccagggcgagcggctggccggcaggcggagaaaaatggcagtagaatccagagtgacccaggaggaaatcaagaaggaaccggaaaaacccattgatagagaaaagacatgtcccctactgttacgggtgttcactacaaataatggcagacaccaccgaatggacgaattctctaggggcaacgtgcccagtagtgaattacagatttacacttggatggacgccaccctgaaggaactcactagcctagtgaaagaagtgtatcccgaagcccggaagaaaggcacacacttcaattttgcaattgtcttcacggacgttaagcgcccaggctaccgcgtgaaggagattggtagcacaatgtcaggacggaaaggcacggacgattctatgaccctccagagccaaaaattccaaatcggggactacctagatatcgccataaccccacccaatagagctccgccccccagcgggcgcatgcgaccctactag

SEQ ID NO: 46036 - DNA, 1020 bp, Artificial Sequence
  Description of Artificial Sequence: Synthetic coding sequence
atggagagccggaaggacatcaccaaccaggaggagctgtggaagatgaaacctaggcgcaacctggaggaggacgactacctgcataaagatactggtgaaacgtctatgctgaagagacctgtcctactgcacctccatcagacagctcatgccgacgagtttgattgccccagtgagctgcagcacacacaggagctgttccctcagtggcatctgcctatcaaaattgctgctattatcgcttctctgaccttcctctatacgctcctgcgggaggtcattcacccccttgccacctcacaccagcagtatttttacaagattccaattttggtaattaataaagtgctgcccatggtctcaattacattacttgctttggtgtacctccctggagtgattgcggctatcgtacagcttcacaatggcaccaagtacaagaaattcccacattggctagataaatggatgcttacccgcaaacagtttgggttactgtccttcttttttgcagtcctgcatgccatatacagcctgagttatccaatgcgcagatcataccgatacaagctgctgaattgggcttaccagcaggtccaacagaacaaggaggacgcctggatcgaacatgatgtgtggaggatggaaatctacgtgtcattggggatcgtgggactcgctatactagccctgctggctgtgacttctatcccaagcgtctctgatagcctgacctggcgggaattccactacatccagagcaagctgggaatcgtatctctgctacttggaaccatccacgctctcatatttgcctggaacaaatggattgatatcaaacagtttgtgtggtataccccacctacttttatgatcgccgtatttctgcctattgtggtcttaatatttaagagcatcctgtttctcccttgcctccggaaaaaaattttgaaaatccgtcacggatgggaagacgttacaaaaattaataagactgaaatctgctcccaactgtag

SEQ ID NO: 46037 - DNA, 597 bp, Artificial Sequence
  Description of Artificial Sequence: Synthetic coding sequence
atgtgcgccttcccctggctgctgctgctgctgctgctgcaggagggctcccaacgccggctgtggcgatggtgtggcagtgaagaggtcgttgctgtgttgcaggaaagtatctctcttccactggaaattccgcccgacgaggaggtggagaatatcatatggtcatctcacaaatctcttgccacggtggttcccggcaaggagggacatccagcaaccattatggtcaccaacccccattatcagggccaggtgagtttcctggacccttcctactccctccacatttccaacctgtcatgggaagatagtgggctctatcaggcccaagtgaatctccgaacgagccagatcagtacaatgcagcagtacaatatttgcgtatatcaccccaattatgcgtcggaaaagccaagcacagcattctgcctgcttgcaaaggggctgctgatcttcctacttctcgttattctcgccatgggactctgggtcatccgagtacaaaaaagacataagatgccgaggatgaagaaattgatgcggaaccgcatgaagctacgaaaggaggcaaagccaggcagctcccctgcatag

SEQ ID NO: 46038 - DNA, 870 bp, Artificial Sequence
  Description of Artificial Sequence: Synthetic coding sequence
atgtgcgccttcccctggctgctgctgctgctgctgctgcaggaggggagccagcggaggctctggcgctggtgtggatctgaagaagttgtcgccgtacttcaggagtctatctccctcccacttgagatccctcccgatgaggaggtagaaaacatcatatggtcttctcataaatcgttggccacagttgtccctggtaaggaagggcaccccgccactattatggtcacaaatcctcactaccaaggccaggtgtccttcctggatccaagttatagtctgcatatttccaacctgtcatgggaggacagtggcctgtaccaggcgcaggtgaacctgcggacctcccagatctccactatgcaacagtataacatttgcgtttatcgctggctgagtgagcctcaaattactgtcaatttcgagtcaagcggtgagggcgcttgctctatgagtctcgtgtgcagtgtggagaaggccgggatggacatgacctattcttggctgagtcggggtgatagcacctatactttccatgagggccccgtgctgtcaacttcctggaggccaggggatagcgcattatcctatacgtgccgagcgaacaacccgattagcaacgtctccagctgtcccattcccgatgggccattctacgccgacccaaattacgcgtccgagaaaccatccactgctttctgtcttctggccaagggattgctgatcttcctcttattagtgattcttgcaatgggcctgtgggttatccgagtacagaaaagacataaaatgcctaggatgaagaaactgatgcgaaatcggatgaaattgcgcaaggaggctaaacccggaagctcgcctgcatag

SEQ ID NO: 46039 - DNA, 519 bp, Artificial Sequence
  Description of Artificial Sequence: Synthetic coding sequence
atgaagatctggagcagcgagcacgtgttcggccacccctgggacaccgtaatccaagccgccatgcgcaagtacccgaatcccatgaacccaagtgtcctgggggtcgatgtcctgcagcggagagtcgacggcagaggtagactgcattccctgcgcctgttatcgaccgagtggggtcttccaagcttggtccgcgcaatcctcggtacgtcacgcaccctgacctatataagggagcacagcgtggtcgacccagtggagaagaaaatggagctgtgcagcactaacattacactcaccaatctagttagcgtgaacgagcgtttagtctacacgccacacccagaaaatcctgaaatgaccgtcctcacccaggaagcaataattacagtgaaaggcatctcccttggaagctacctggagtcactcatggccaacacaatctcctccaacgcgaagaagggatgggccgccattgagtggataattgagcactccgagtccgctgtcagttag

SEQ ID NO: 46040 - DNA, 519 bp, Artificial Sequence
  Description of Artificial Sequence: Synthetic coding sequence
atgaagatctggagcagcgagcacgtgttcggccacccctgggacacagtaatacaggccgcaatgcgcaaatatcccaaccccatgaatccctcagtgctcggcgtggatgttctccagaggagggtggacggccgcggtaggctccattcactccgactgctcagtaccgagtggggcctgccctcactggtccgggctattctagggacctctcggacattgacttatattcgtgagcattccgtggtggaccctgtagaaaagaaaatggaactgtgctccacaaacatcaccctgacaaaccttgtgtccgttaacgagaggctcgtttacacaccacatcctgagaatccagaaatgacagtgctgactcaagaggccattattactgtgaaggggattagcctcggatcttacttggagtccctgatggccaatacgattagctcaaatgcaaagaagggatgggcagccattgaatggatcatcgagcactcagaatctgccgtctcctag

SEQ ID NO: 46041 - DNA, 585 bp, Artificial Sequence
  Description of Artificial Sequence: Synthetic coding sequence
atgaagatctggaccagcgagcacgtgttcgaccacccctgggagacagtgaccactgccgctatgcagaagtaccctaaccctatgaacccttctgtagttggagtggacgtgctcgaccgccacatcgatcccagcggtaaactgcattctcacaggctgctgtccacagaatggggtctcccctctatcgtgaagtcattaattggtgcagcgcgcaccaaaacctatgttcaggagcattccgttgtggaccctgttgagaaaaccatggaactcaaatcgaccaacatttcattcactaacatggtgagcgtggatgaacggctaatctacaaaccccacccacaggatcccgagaaaaccgtacttacccaggaggccatcataactgtaaaaggcgtttcactgtcttcctatctggagggacttatggcaagcaccattagttcaaatgcctccaaaggtcgcgaagcgatggagtgggttatccacaagctgaacgctgagatcgaggaacttacggcttctgccaggggcactattcggactcctatggccgccgccgccttcgccgaaaagtag

SEQ ID NO: 46042 - DNA, 2247 bp, Artificial Sequence
  Description of Artificial Sequence: Synthetic coding sequence
atgagcaaccccggcggccggcggaacggccccgtgaagctgcggttaaccgtgctatgtgccaagaacctggtcaagaaagattttttcagactgcccgacccttttgctaaggtggtggtcgacggctcgggacaatgccactctaccgatacagttaagaatactctggacccgaagtggaatcaacactatgacctatacattggtaaatctgattccgtcaccatatcagtgtggaaccacaaaaaaatacacaaaaaacagggcgctgggttcttagggtgcgttagactgctgtccaacgctatcaataggctgaaagacaccggctaccagcggcttgacctatgtaaactgggacccaacgacaatgacaccgtgcggggccagatcgttgtttctctacagagcagggaccgcatcggaacagggggtcaagtcgtcgactgcagccgcctcttcgacaatgatcttcctgacggatgggaggagcgcagaacagcttcggggcgaatacagtacctcaatcatattacacgaaccacccagtgggaacgtccgacccgtcccgcttcagaatactcgagcccaggcaggcctctgtcgtgcttcgtggatgagaatacaccgattagtgggacaaatggagccacgtgtggtcaatcatctgacccccgcctagccgaacgaagagtgcgatcccagcgacacagaaactatatgagtcgaacccaccttcatacccccccagatctccctgaaggttatgaacaacgtacaacccagcagggtcaagtttacttcctgcatacacaaaccggcgttagtacatggcacgatccgcgtgtgccaagggacctgtcaaacatcaattgtgaggagctaggccccctgccgccggggtgggaaatacgaaatacagccacaggacgggtgtattttgtggatcataataacaggacaacccaatttaccgacccgcggctgtcagctaacctgcatcttgtcctgaacagacaaaaccagctcaaagatcagcagcaacaacaggtggtctcactctgtcctgatgacacagagtgcctgaccgtgccaaggtacaagcgggacttggtacagaaattgaagattcttcggcaggagctgagtcagcagcagcctcaggccggccattgtcgtattgaagtgtcccgagaggaaattttcgaagagagctaccggcaggtgatgaagatgaggccaaaagacctctggaagagactgatgatcaaatttagaggtgaagaaggccttgattacggcggcgtagcacgggagtggctgtacctgcttagccacgagatgcttaatccctattacggcctgtttcaatacagtcgcgacgacatctacacactgcagataaaccccgacagcgcggtgaacccagaacacttgtcgtactttcattttgtaggtcgaatcatgggcatggcggtcttccacggccattacattgacggcggctttacccttcctttctataagcagctattagggaagtccatcactctcgacgatatggaactggtggaccccgacctgcacaacagcctggtttggattctcgaaaacgatatcaccggcgtcctggaccacacattctgcgtggagcacaacgcctacggtgaaatcattcagcacgaactcaaaccaaacggcaaatccattcctgtgaatgaggaaaataagaaggagtatgtccgcctgtacgttaactggaggttccttagaggtatagaagcgcagtttttagccctacagaagggttttaacgaggtgattcctcaacacctgttgaagacatttgatgagaaagaattggagcttatcatctgtggactgggtaagattgacgtcaatgactggaaggtgaatacaagattaaaacattgcactccagattccaacatcgtgaaatggttttggaaggcagtggaattttttgatgaggagcgaagggctcgactcctgcaatttgtcaccggaagtagccgcgtgccactgcagggcttcaaggccctgcagggggccgccgggccaaggttgttcactatccaccagattgacgcttgtacaaacaacctccccaaggctcatacatgcttcaaccggatcgatattcccccatacgagtcttatgaaaaactttatgaaaaactacttactgccattgaggaaacctgtggatttgcagtcgagtag

SEQ ID NO: 46043 - DNA, 294 bp, Artificial Sequence
  Description of Artificial Sequence: Synthetic coding sequence
atgaccagcctgctgaccacccccagcccccgggaggagctgatgacgacacccatcctgcagcctaccgaagcgttgtctcccgaagacggagccagtacggcacttattgctgtcgtgataactgtggtattcctgaccctgctgagtgtcgtaatcctcatcttcttctacctttataaaaataaagggtcatacgtcacatacgagcccaccgagggggagccttcagccattgtgcaaatggagtccgatctggccaagggctccgaaaaagaggagtacttcatatag

SEQ ID NO: 46044 - DNA, 294 bp, Artificial Sequence
  Description of Artificial Sequence: Synthetic coding sequence
atgaccagcctgctgaccacccccagcccccgggaggagctgatgactaccccaatcctgcagccgacggaggcactgagccccgaggacggtgcaagcactgccctgattgccgtggtaattactgtggtcttccttaccctgctgagtgtcgtgattctgattttcttctacctgtacaagaacaagggcagctacgtcacttacgaacccaccgaaggggaaccgtcagcaatagttcagatggagtccgacctggctaagggatccgagaaggaggagtactttatatag

SEQ ID NO: 46045 - DNA, 3282 bp, Artificial Sequence
  Description of Artificial Sequence: Synthetic coding sequence
atggccagcgcccccgccgaggccgagacccggcagcggctgctgcggacagtgaaaaaagaggttaagcagattatggaggaagccgtgacaaggaagttcgtgcatgaagacagcagccacattatatcattctgtgctgccgtggaagcgtgcgtgctgcacgggctgcgtcgccgcgctgcagggttccttaggagcaataagatcgccgcgttgttcatgaaagttggcaagaattttcccccagcagaggatcttagcagaaaggtgcaggatctggagcagctgatcgaaagtgccaggaaccagattcagggtctgcaagaaaacgtccggaagctgcccaaactgcctaatctgagccctctcgccattaagcatctgtggatccggacagccctgttcgaaaaggtgctggacaagatcgtgcattacctagtcgagaatagctccaagtattacgagaaagaggctctgctcatggaccctgtggatgggcccatcctggccagccttcttgtcggtccctgcgcactcgaatacaccaagatgaaaaccgccgaccacttttggacagacccttctgctgatgagttggtgcagcgacataggattcattcttctcacgtgcggcaagactctccgactaaaagaccagctctatgcatccagaagaggcactccagcggatcgatggatgaccgaccatcactgtcggcccgggactacgttgagagcctgcatcagaacagtcgggctacgctgctgtatggcaagaataacgtgctggtccagcctcgggacgacatggaagcagtgcctggatacctttctctccaccagactgcagacgtgatgaccctgaagtggacaccaaatcagctcatgaacggaagcgttggtgatctggattatgagaaatcagtatattgggactacgccatgacaatccggctggaagagatagtgtatcttcattgccaccaacaggtggatagcggagggactgtggttctggtaagtcaggatggcatccagcggcctccctttcgttttcctaaaggagggcatttgctgcagtttctgtcatgcctggaaaatggtctgctgccacatggccagcttgaccctcccttgtggtcacagagggggaagggtaaggtgtttcccaaattacggaaacgatcaccacaggggagcgcagagtcaacaagttccgacaaggacgacgacgaagcaaccgactacgtgttccgcattatttatccgggaatgcagtcagaatttgtcccccaggacctcatggacgtttcagtatccaatctgccttctctgtggcagcccagtccgcgcaagagttcctgttcgtcatgctctcagagtggttctgccgacggatccagtaccaacgggtgcaatcacgagcgtgctccactaaaactgctgtgcgacaacatgaagtaccaaatattgagcagggcattttacggatggctggcctactgtcgccatctctccaccgtgcgtactcatctgagtgcactggtgaatcacatgatcgtgtctcctgatctgccctgtgacgctgggcagggactaaccgcaagaatatgggagcagtacctgcatgacagtacttcatatgaagaacaggaattgctccggctgatctactatggaggaatccagcccgagattaggaaggccgtgtggcccttcctcctgggccactaccaattcggcatgactgagacagaaaggaaggaagtagacgagcagatacacgcctgctacgctcagacgatggctgaatggttgggttgcgaagccattgtgaggcagcgagaaagagaatctcacgcagccgcccttgccaaatgctcatctggcgctagccttgactctcacttgcaccgaatgctacaccgggactctaccatatcgaatgaatcatcccagtcctgctcctccggccgccagaatattcggcttcactccgatagctccagctccactcaggtgtttgaatcggtggacgaagtggagcaggtggaggctgaaggcagactggaggagaagcagcctaagattcccaacggtaacctggtgaacggcacttgttcaccagattctgggcatccatcctcccacaacttttcaagcggactcagtgagcacagcgagcccagcctgagtactgaggacagtgtgctggatgctcaacggaacaccccgaccgtcctccgcccaagagatggcagcgtggatgaccgccagagctccgaagcgactacatcacaggatgaagctcctagagaggagctggccgttcaggacagtcttgaatcggatctactcgcgaatgaatcaatggatgagtttatgtccatcaccggctctctcgacatggccctgcccgagaaggacgatgtggttatggagggctggcgctcgtccgagacagaaaagcatggccaggctgactccgaggataatctgagtgaggaaccggaaatggaatctctgttccccgctcttgccagtcttgctgtcacaaccagcgcgaatgaagtgagtcccgtcagtagtagcggcgtaacgtacagtccagagctgctagatctgtacacggtgaatttgcaccggattgaaaaggacgtgcagcgatgcgaccggaattactggtatttcacacctgcaaacctggaaaaactgcgcaatattatgtgtagttatatttggcaacatatagagatcggctacgtccaaggaatgtgcgatctgctggcacccctgctggtcattctggatgatgaggccctagcgttttcgtgcttcaccgagcttatgaagcggatgaaccagaacttccctcacgggggtgcaatggatacccactttgccaacatgcggagcctgatccagatcctggactctgagttgtttgagcttatgcaccaaaacggagattacactcatttttacttctgctataggtggtttctactagattttaaacgcgaactggtgtatgacgatgtgttcttagtgtgggagactatttgggctgccaaacacgtctccagcgctcattatgtgcttttcatagcactcgccctggtggaagtataccgagatatcattttggaaaataatatggacttcacagacatcatcaaatttttcaacgaaatggccgagaggcacaacacaaagcaggtacttaaactggcccgcgaccttgtctataaggtccaaacgctgatcgagaataagtag

SEQ ID NO: 46046 - DNA, 3447 bp, Artificial Sequence
  Description of Artificial Sequence: Synthetic coding sequence
atggccagcgcccccgccgaggccgagacccggcagcggctgctgaggacagtcaagaaagaagtgaagcaaatcatggaggaagctgtgacaaggaagttcgtgcacgaagattccagtcacatcatctctttctgtgctgccgtcgaggcttgtgtattgcatgggttaagaaggcgcgctgcaggtttcctccgcagtaataaaatcgccgccttgttcatgaaggttggtaaaaactttcctcctgccgaggacctctccaggaaggttcaggacttggagcagctaatcgaatctgctcgaaatcagatccagggattacaggagaacgtgagaaagctcccaaaactgccaaatctgagccccctcgcaattaagcacctgtggattcgcactgcactgtttgagaaggtgttggacaaaattgtgcactatttggtggagaattcaagcaagtattacgagaaggaggctctgctcatggaccccgtggatggcccaatccttgcatctttattggtgggcccatgcgccctcgagtacaccaagatgaagactgccgaccacttctggacggacccctctgccgacgaattagtacagagacatcgtatccactcctctcacgtccgtcaggatagccccacaaagcggcctgcgctctgcatccagaaacgtcatagtagcggaagcatggacgaccggcctagcttgagtgctagggactacgttgaatcactgcaccagaacagcagggctactcttctgtacgggaaaaataatgtcttggtacagcctcgggacgatatggaagccgtccctggctacctctctcttcaccaaactgcagatgtgatgactctcaagtggacccccaaccaactgatgaatggcagtgtgggtgatctcgactacgagaagtccgtgtattgggactatgcgatgacgatccgactggaggagattgtctatctccactgccaccaacaggtagattctgggggcacagtcgttctagtttcacaggacggcatacagcggcctccatttaggtttccaaagggcgggcacctgctgcagtttctctcctgtctggaaaatggcctactacctcacggacagctcgaccctcctctttggtcccagcgagggaaaggcaaggtatttcctaagttgagaaaacgttcgcctcaggggtctgccgagagtaccagcagcgacaaggatgacgatgaggcaaccgactacgtgttccggattatctatccgggaatgcaatctgagttcgttgcccccgacttcctgggaagcacctcttccgtgtctgtcggacccgcctggatgatggtcccagctggccggtctatgttagtggttgcccgcggcagccaatgggagcctgctcgttgggacacaactctgcccacacctagcccaaaagagcagccaccaatgccacaggacttaatggacgtaagcgtttctaatctcccttccctgtggcagccttcgcctcgaaagtctagctgttcctcctgctcacaaagcggctctgccgacggttcctccactaatgggtgtaaccatgagcgggctcccttgaagttattatgcgacaacatgaaatatcaaattttatcacgggctttttatggctggcttgcctactgtcgccacctgagcaccgtgagaactcacctgagcgccctggtgaaccacatgattgtgagccccgatctcccttgtgatgccggccagggtctgactgcccggatttgggagcagtacttgcatgactccacgtcttacgaagaacaggaactcctgaggctcatctattacggaggcatacagccggagatccgcaaagcagtgtggcctttcttgctggggcactaccagttcggtatgacggaaaccgaacggaaggaagtcgatgagcagatccatgcttgttatgcacagacgatggccgaatggctgggatgcgaagccattgtaaggcaaagggagcgggaatcacacgcagctgctctggctaagtgttcctcaggggcttcactcgacagtcacctgcatcggatgcttcacagagattccacaatctcaaatgaatccagtcaatcctgctcttcaggtaggcagaatattcgcctgcattccgacagctcatcaagcactcaggttttcgagagtgttgacgaggtggagcaggtagaggcagaaggaagacttgaggagaagcaacccaagatcccaaatggaaacttggtgaacggcacctgttcaccagattccgggcatccttccagccacaatttcagcagtggcttatcagaacattctgaaccaagcttgagtactgaggactctgtgctggatgctcaaagaaataccccaactgttctgcggcctcgggacggatccgtggacgaccggcagagtagcgaggccactacctcccaagatgaagcaccgcgtgaggagctggctgtccaagacagtttagagtctgacctgttggctaatgagagtatggacgagttcatgtcaatcaccggttcactcgatatggccctgcccgagaaggatgatgtggttatggaaggctggcggagttccgagaccgagaagcacggccaggctgattctgaagacaacttgtctgaagagcctgaaatggaatctcttttcccggcactagcctctctggcggtgaccacctcagctaacgaggtgtctcctgtgtctagttcaggcgttacatatagtccagagctcttagacttatatacggtcaatctgcaccgaattgaaaaagacgtgcagcggtgtgaccgcaactattggtatttcacgcccgccaatttagagaaactcaggaacataatgtgttcgtacatctggcagcacatcgagataggctacgtacagggtatgtgcgacctgttggctccgctcctggttatccttgatgacgaagccctcgcttttagctgttttaccgagctgatgaagcgtatgaatcagaactttccccacggaggagcaatggacacccactttgccaacatgcggagtttgatacagatactggacagcgaactgtttgagctgatgcaccagaacggtgattatacccacttttacttttgttatcggtggttccttctcgatttcaagcgggagctcgtctacgacgacgtgttcctcgtctgggaaaccatttgggcagctaagcatgtgtcgtcggctcactacgtgctattcatcgctctcgctctcgttgaggtctatagggacattatccttgagaataacatggattttaccgacatcatcaagtttttcaatgaaatggccgagcggcataatactaaacaggttctaaagctcgctagagatttggtgtataaggtccaaactctgatcgagaataagtag

SEQ ID NO: 46047 - DNA, 3447 bp, Artificial Sequence
  Description of Artificial Sequence: Synthetic coding sequence
atggaggaggccgtgacccggaagttcgtgcacgaggacagcagccacattatcagcttttgcgccgctgtagaggcatgcgttcttcatggtctaaggaggagggctgcaggatttctccgttctaacaaaattgctgctctgtttatgaaagtgggaaagaatttccctccagccgaggatctcagccggaaggtacaggatctcgagcagcttatcgagagcgccagaaaccagatacaaggcctgcaggaaaacgtgcgcaagttgcctaagctgcccaacctgagccccctagccattaaacatttgtggatccgaaccgccctcttcgagaaagtcctggacaagatcgtgcactacctggtggagaactctagcaagtattacgaaaaggaggcccttctgatggatccagtggatggcccgattctggccagtctactcgttgggccctgtgctctggagtatacaaaaatgaaaactgccgaccacttctggactgacccaagcgcagatgaattggtacagcgacaccgcatccatagttctcacgtgcggcaggacagcccgaccaaacggccggctctgtgcatccagaagaggcattcatcgggctcgatggatgatcgaccgagtctctcggctagagactacgtggagagcctccatcagaacagccgggccacactcctgtacggcaagaataatgtgctcgtacaaccaggtctgacacccgggtacagaggaaaggggctatccgggtctagactcccgattcattccagcatctatgcactgacacatgcccacattcatccgccaaatactcacagcagcatacacctctatttgcacgctccaatcctgacttctattcatccaccaatcgtgattagcattcatcctcccattgtgacaacaatccatccgtcgacacacctctacatccatttgtccaaccatctttacatccatcctagcacccacctgtacatccatccaagtacacacctctatatctacccgtccatacacccctcaattcaccccagcatctacccctcaatccatttctctgattacgtgtttctgaaccagacaggacagacctatgtgcactcaaattcttctaccatggcacgccctgaagatgatatggaggctgtacctggatatttgtccctgcaccagaccgccgatgttatgacgctgaagtggacaccaaatcagctgatgaacgggtcggttggagacctggactatgaaaaatcagtctactgggactacgcaatgactatccggctggaggagatagtctatcttcactgtcaccaacaggttgactcaggcgggaccgtggtccttgtatcccaggatggaatccagcgaccgcccttccgcttccccaagggaggccaccttctccagtttctgtcatgtcttgaaaatggcctgttgccccacggacagctggatcctccattatggagccagcgcggcaaaggaaaagtttttcccaaactaaggaaacgtagtccccaaggaagcgcggaaagcacttcttcagataaggacgacgacgaggccaccgattacgtgttcaggatcatttaccccgggatgcagagcgagtttgtaccccaggacttgatggatgtctcagtcagtaaccttcccagtttgtggcagccttccccacgcaaatcttcatgctcttcgtgcagccaaagtggaagcgctgatggctcttcaactaatggatgtaaccatgaacgtgcacctttgaagttgctttgtgataacatgaagtaccagatactcagtcgcgccttctatggctggctcgcctattgccgccacctctctactgtacggactcacctatcagccttagttaatcacatgatcgttagccctgacctgccctgtgacgctggacaaggactgactgccaggatttgggagcagtatcttcatgactccacgagttatgaagagcaagaacttcttagactgatctattacggagggatacaaccggagatcagaaaggcagtgtggccgttcctgctcggccactaccagttcggcatgaccgagactgaacgcaaggagtcatctcagtcttgcagtagcggacgacagaatatcagattacattccgactcctcctcgagcacccaggtatttgagtctgtcgatgaggtggaacaggtggaagcagaggggcggctggaagaaaagcaacccaaaattcctaatggcaacctggtgaatgggacgtgctcacccgatagcggtcatcccagctcacacaatttctcctcaggcctaagcgaacactcagagccgagccttagtactgaagattccgtcctcgatgcccagcggaatacacctacagtgttgagacccagagacgggtccgtagatgatcgccagtcttccgaagctaccacgtcccaggatgaagccccccgggaggaactcgccgtgcaagatagtttagagtctgatctcctagcaaacgagtccatggacgaatttatgtcaatcaccggaagtcttgatatggctcttcctgaaaaagatgacgtggtgatggagggttggagaagctcagagacagagaaacatggccaggccgattctgaggacaatctctccgaggagcctgaaatggaaagtctcttcccagcattagcaagtctcgccgtcaccacctctgcgaatgaggtgagtccagtgagcagttctggtgtcacctactcaccggagcttctggacctgtacactgtcaatttgcatcggatcgagaaggacgtgcagagatgtgaccgcaactattggtacttcacccccgcaaacttggagaagctgaggaatataatgtgttcttacatttggcagcacatagagattggttatgttcaggggatgtgtgacctgttggccccgttgctggtgatactcgatgatgaagcactggcttttagctgcttcaccgaattgatgaagaggatgaatcaaaattttccgcacggcggcgccatggacactcattttgccaacatgcgcagcctgatccaaattttggacagcgagttgtttgaactgatgcatcaaaatggtgactacacacacttctacttctgctacagatggttcctgctcgacttcaaacgggagctggtatacgacgatgtgtttctggtgtgggagactatctgggcagcgaaacacgtgtccagcgctcattatgtccttttcatcgcactggctcttgtggaggtctaccgtgatataatcctagagaacaacatggattttaccgacattataaagttttttaatgagatggcagagagacataatacaaagcaagtgctcaagctcgccagggatctggtttacaaggttcaaactcttatcgagaacaaatag

SEQ ID NO: 46048 - DNA, 234 bp, Artificial Sequence
  Description of Artificial Sequence: Synthetic coding sequence
atgggcctgtgcttcccctgccccggcgagagcgccccccccacccccgacctggaggaaaagcgggctaaactagctgaggctgccgaacgaagacaaaaggaggctgctagccggggcattctggatgttcagtccgtacaggagaagcggaaaaagaaagagaagatcgaaaagcagatagccacctctggtcctcctcctgagggcgggctacgctggaccgtctcttag

SEQ ID NO: 46049 - DNA, 1365 bp, Artificial Sequence
  Description of Artificial Sequence: Synthetic coding sequence
atggccgagttcagccagaagcggggcaagcggcggagcgacgaggggctgggctccatggtggacttcctgctcgcgaatgcgaggctggtactgggtgtcggcggcgcagccgtgctcggcatagcaactcttgccgtaaaaagatttatcgatagagccacttcaccacgcgacgaagacgacacgaaagctgactcctggaaagaactctctctgctgaaggctactccacacctccagccccgtccacctcccgcagcgctgtctcagccagtcttgcccttggcaccttcttcgtcagcccccgagggccctgctgagactgatcccgaagtaactccacagctatcctcacctgctcccctgtgcctgactttgcaagaaagactgttggcatttgagagagacagagtaacgattcccgccgcccaggttgccttagcaaaacagttggccggggatattgctctggagttgcaagcttattttcgctctaaatttcctgagctaccttttggggcctttgtgccagggggccccctgtatgatggtctgcaggctggggctgcagaccatgtgagactgctagtgccgttggtgttagagccaggattgtggtccctggtcccaggggtggacacggttgcaagggacccccgatgctgggcagtgagaagaacacaactggaattttgtcccaggggcagcagcccctgggacaggtttctggttgggggctatctgagttcgcgcgtgttgcttgaactgctgagaaaggctttagcagcaagtgtgaactggcctgcaatcggtagtttgcttggttgtttgatcagaccatctatggcttcagaggagctgctgcttgaggtgcagcatgagcgcctcgagttaacagttgccgttctcgtagccgtaccaggggtcgacgccgacgataggttactgctggcttggcccctggagggcctggccggcaatttatggctgcaggatctctatcctgtggaagccgcacgtctcagagccctggacgaccacgacgccggaactcggcgcaggctgctgcttttgctctgtgccgtatgccgcggctgttctgcactcggccagctggggcgaggacaccttactcaagttgtgttacggctgggcgaggacaacgtcgattggacagaagaggccctgggtgagcggtttttgcaggcactagagcttttaattggtagtctggaacaagcgtcactcccttgccacttcaatccctcagtcaatctcttcagtagcttacgggaagaggaaatagacgacatcggctacgcgctctattcaggcctgcaagaacccgagggtctgctgtag

SEQ ID NO: 46050 - DNA, 492 bp, Artificial Sequence
  Description of Artificial Sequence: Synthetic coding sequence
atggccgagttcagccagaagcggggcaagcggcggagcgacgagggactgggatccatggtcgattttctgctggcgaacgctagattggttcttggggttgggggcgcagctgtcttaggaattgccaccctagcagtgaagcggtttatagatcgtgctactagcccaagagatgaggacgataccaaggccgattcttggaaggagttaagcttgctgaaagccacaccacacttgcagccaaggcctccgcccgctgccctgtctcaacccgtcttacctctggccccctcctccagtgcaccaggagagtggcactccttcccgtccttcggagtcactttcaagaggaggtcgcctggcttcgctctcacagattgcgtaactctgagagagagtctcctcctgtcaaggctatgggcgccccaaatctttaacggcggcggagttagcctaccttgttcttggtctaaagtggtggccctgtag

SEQ ID NO: 46051 - DNA, 618 bp, Artificial Sequence
  Description of Artificial Sequence: Synthetic coding sequence
atggccgagttcagccagaagcggggcaagcggcggagcgacgagggcctgggcagcatggtggactttctgctggccaatgcaaggctcgtgttgggtgtgggtggcgctgcagtgctgggcatcgcgaccctggctgttaagcggtttatcgaccgggccaccagccctcgagacgaggatgatactaaggccgattcatggaaggagctctccctgctgaaggcaacaccgcacctccagccccgcccaccacctgcagccctatctcagccagtgttaccattggcaccttcatcttctgcacccggcgaagctgccggcctgagggctggaccttgcgatcacccttcgagcccgggggggttcgggcaaaccgctggctggaggcacagacccggcgcagctggacttttatccgaacaagtccctggcacggccctttggggaatccgggcctggggtgcagcccttaggcgggcagccgggggagggtgtggcccatgcgcaagtcctggagctacaggcgcaggcgccggaccagtggaacctggcgcagggaggggtcactgtggagaaggaccatctctgttgggccgcgctcaagacgcagcgtag

SEQ ID NO: 46052 - DNA, 1398 bp, Artificial Sequence
  Description of Artificial Sequence: Synthetic coding sequence
atgggcctgagccccaacctggaccggcagaccatggccgagttcagccagaagaggggaaagcgaaggagtgatgaaggattgggctccatggtggacttccttctggccaatgccagactggtgcttggtgtgggaggggccgctgttctggggattgccactcttgccgtgaaacgtttcatagaccgggcaacgtcaccaagagacgaagatgatacaaaggctgatagttggaaggagttatctttgctcaaagcgacaccacatctgcagcccagacctcctcccgccgcgctctctcagccagtccttccgctcgctccatcttccagcgcgcccgaaggacccgcagaaaccgaccccgaggtcactccccagctctcgtcccccgcccctctgtgcttaacgctgcaggaaagactgttagctttcgaacgagaccgagtgaccatcccagccgctcaggtggctctggccaagcagctagcaggcgacattgccctcgagcttcaggcttacttccgcagtaaattccctgagctgccgttcggcgcattcgtccctggggggcctttatatgatggtctgcaggccggagcggccgatcatgtacggcttctggtgcccctggtcctggagcctggtctgtggtcgctggttcccggcgtcgataccgttgccagggaccctaggtgctgggctgtgcgcagaactcagctcgagttctgccccaggggctcttcgccctgggacagatttcttgttggcgggtacctctcgtctcgcgtgctgctggaactactgaggaaagccctggccgctagtgtgaactggccagctatcggctccctcctgggttgcctgattcggccctccatggcatccgaggagctgcttctggaggtgcagcatgaacggcttgaactcaccgtggcagtgctggtggcggttcccggtgtggatgccgatgacagactgttgctagcatggcctctggaaggacttgccggcaatctgtggcttcaggatctctaccctgtggaagctgcacggctacgggcgctcgacgatcatgatgcagggactagaaggaggctgctgctgctgctgtgcgccgtatgtcgcggctgctccgccctgggacaactgggccgcggacacctcacccaggtggtgctcagactaggcgaggataacgtagattggacagaagaggctctgggcgaaagattcctccaggccctggagctcttaattgggagcctagaacaggcgtctctgccgtgccattttaatccttccgtgaatctgtttagctctctgagggaagaggagattgacgacatagggtatgcactttattctgggttgcaagagccagaaggtttgctctag

SEQ ID NO: 46053 - DNA, 1392 bp, Artificial Sequence
  Description of Artificial Sequence: Synthetic coding sequence
atggccggcgccggcgagcggaagggcaagaaggacgacaacggcatagggacggcaatcgactttgtgctgagcaacgccaggttggtcctcggagtcggaggagctgccatgctcggtattgccaccctggccgttaaaaggatgtatgatcgggcaatctcagcccccactagcccaacccgcctgagccattcaggaaaaaggtcttgggaggaacctaattggatgggctccccaagactgctaaacagagatatgaagaccgggcttagcagatcccttcagaccctccctaccgacagttctaccttcgacacagataccttctgtccgccaagaccgaagcctgttgcacggaagggccaggtcgatctgaagaaatccaggctgagaatgagcctccaggagaaattattgacatactaccgtaatcgtgcagcaattcctgcaggcgaacaggcgagggccaagcaagcggcagtcgatatatgcgccgagttaaggtccttccttcgagccaagctcccagatatgcctctgagggatatgtatttgtcagggtctctttacgacgacctgcaggtggtgacagccgatcatattcagctgatcgtgcctctggttttagaacagaatctgtggagctgcatccctggtgaagatactattatgaatgtgcccggattctttctagtgcgtcgggagaaccccgagtacttcccgcgaggaagctcctactgggataggtgtgtcgtggggggctatctctcacccaagactgtagccgataccttcgagaaagtagtggccggcagtatcaattggccagccatcggctctctgctggattacgtgattcggccagccccaccgcctgaggcgttaactctggaagtgcagtatgaaagagacaaacacctattcatcgactttctgccatctgtgacgctcggagacacagtgctggtagccaagccccaccgcctggcccagtacgataacctgtggagacttagcctgcgccccgccgaaacagcaagactcagggccttagaccaagctgatagcgggtgccggtcattatgtctcaaaattctgaaggccatatgcaaatctacccccgccttaggccatctgaccgctagtcagttgaccaatgtgattcttcacctggcgcaggaagaggccgactggtcccccgacatgctagcagacagatttctgcaagcactgagaggcctgatttcatatctcgaagctggagtacttccaagcgctctgaaccctaaggtcaatttgtttgcagaactcacccctgaagaaatcgacgagctcggatacactctgtactgcagcctctctgagcccgaggtgctcctccaaacgtag

SEQ ID NO: 46054 - DNA, 1437 bp, Artificial Sequence
  Description of Artificial Sequence: Synthetic coding sequence
atggccggcgccggcgagcggaagggcaagaaggacgacaacggcatcggaacagccatcgactttgttctttccaacgctagattagtgctgggagtggggggcgcggcgatgctcggaatagccactctcgctgtgaagagaatgtacgaccgtgctatcagcgcccctacatcgcctacccgcttatcccacagcgggaagagatcttgggaagagcccaattggatggggtcccccaggctgctaaatagagatatgaagacaggattgagccggtctctgcagaccctcccaaccgatagctccacctttgacaccgataccttttgcccacctagaccaaaacctgtggcaagaaaaggccaggttgacttaaaaaagagtagattacgcatgagccttcaggagaagctactgacttattaccgcaatagggctgctattccagctggcgagcaagctcgcgccaagcaagctgctgttgacatctgcgctgagctgcgcagctttctgcgggccaaactccctgacatgccactgcgagatatgtacttgtctggctcattatacgacgatctgcaggtcgtgaccgcggaccatatccagctgattgtgcctctggtgttggaacagaatctctggtcctgcataccaggcgaagataccattatgaatgtgcccggcttcttccttgttcgcagggagaaccccgagtacttcccaagaggttcttcttactgggaccgatgtgtggtcgggggatatctgagcccgaaaacagttgccgatacatttgaaaaagtggtcgccggttctatcaactggccggcgatcggcagtttgcttgattacgttattcgccccgcaccaccccctgaagccctcacactggaggtgcagtacgagagggataaacatctgttcatcgattttctcccctccgtcacgctaggcgatactgtgctggtcgccaagcctcaccggctggcgcaatacgataatttgtggagactctctcttcggcccgcagaaacagctcgtctgcgcgcactcgaccaggccgattcgggctgccgctccctgtgtctcaaaatccttaaagccatctgcaagtcaacccccgcactgggacaccttaccgcctctcagctcaccaacgtcattttacacctggcacaggaagaggccgactggagtcccgacatgctggcagacaggttcctccaagccctccgtggactgatttcatatctcgaggctggagtgctcccttccgccttgaatcctaaggacaaagctttaaaggagagatctctgagacaccaggtgcggatgatggaagtggacagtcgtctcaatgtgagttggaagatccagtctctggtcggagtgtggtggccatgctttttgcctcggcaggcattattgttctag

SEQ ID NO: 46055 - DNA, 1392 bp, Artificial Sequence
  Description of Artificial Sequence: Synthetic coding sequence
atggccggcgccggcgagcggaagggcaagaaggacgacaacggcatagggactgctatcgactttgtgctgagtaacgcaagactggtcttaggtgtgggcggggccgccatgctaggcatagctactctcgctgtaaaacgcatgtatgaccgcgctatttctgcgcccacaagccctacacgactctcccactcagggaagaggtcttgggaagagccgaattggatgggatcccctagactattaaaccgtgatatgaagaccggtctctcgcgctctctgcagactctgcccacagatagctcaacattcgacacagatacattctgtcctccaagacccaaacccgtcgcccgcaagggccaggtggacctgaagaagtcacgtttgcgtatgtcactgcaggagaaactgctcacgtattataggaatagagcagccattcccgccggcgaacaggctagggccaaacaggccgccgtggatatttgcgcagagctccgatcctttctacgtgctaagctgccagatatgccccttagggacatgtacctgtctgggagcctttacgatgacctccaggttgtgaccgcggatcacatccagttaattgttccactggtgttggagcagaacctgtggagttgcatccccggtgaggacacgattatgaacgtgcctggcttctttcttgtgcgccgggagaatcccgaatactttccccggggcagttcttactgggatcggtgtgtcgtgggggggtacttgagcccaaagactgtggctgacacttttgaaaaagttgtcgctggttccattaactggcccgccattggcagtcttctggattatgtgattcgtcccgcccccccaccagaagctctgaccctcgaggtgcagtacgagcgggataagcatctgtttatagatttcctgccgtctgttactctcggcgatacggtgctggtcgcaaagccccacaggctcgctcagtacgacaatctctggagactaagtctgcgtcccgccgagacagccaggttacgggcactggatcaggcagatagcggatgcagatccctttgcttgaaaatcctgaaagctatctgcaaaagtaccccagcgcttggacacctaacagcttctcagctaactaatgtgatcctccatctggcccaggaggaagcagactggtcgccagacatgctggccgaccgtttcctgcaggcactgcgcggattgatctcctacctggaagcaggcgtactccccagtgcattaaatcccaaggtcaacctgtttgcggaactaacacctgaggagattgacgagttaggttacaccctttactgttctctcagcgagcccgaggtcctcctgcagacttag

SEQ ID NO: 46056 - DNA, 447 bp, Artificial Sequence
  Description of Artificial Sequence: Synthetic coding sequence
atggccggcgccggcgagcggaagggcaagaaggacgacaacggcattggtaccgcgatcgacttcgtcctaagtaacgccaggttggtgctgggagtggggggcgctgctatgctcggcatcgctacactcgccgtgaagcgtatgtacgatagggctattagtgctccaacctcccccacacgcctctcccatagcggcaagcgtagttgggaagaacccaactggatgggctctccgagactgctcaatcgggacatgaaaactgggctgagtagatccctccagaccctgccgacagattctagtacctttgataccggggagactagctatctgctgcccgaacctggaagccacccatgttggagagctggttccggccaggccagttgctgcggtcacatgtgccgcgctcccgaattaccagccggacaggtcgcatag

SEQ ID NO: 46057 - DNA, 447 bp, Artificial Sequence
  Description of Artificial Sequence: Synthetic coding sequence
atggccggcgccggcgagcggaagggcaagaaggacgacaacggcattggtaccgcgatcgatttcgttctgagtaacgctcgcctcgtgctcggagtcggaggagccgccatgcttggcatcgctactctggctgtaaagcgcatgtatgaccgcgccatttccgcacccacaagtcccacacggctgtctcacagtggtaagagaagctgggaagagcctaattggatgggatctcctcgactgttaaaccgggatatgaagactggcctctctaggtccctgcagaccctgcccaccgattcttcaacatttgatacaggagaaacttcttatttgctgcccgaaccaggaagccacccctgctggagagctgggagtgggcaagcttcctgctgcgggcacatgtgcagagccccagagctccctgccgggcaagtagcttag

SEQ ID NO: 46058 - DNA, 132 bp, Artificial Sequence
  Description of Artificial Sequence: Synthetic coding sequence
atggccggcgccggcgagcggaagggcaagaaggacgacaacggcattggcacggccatagattttgtactgtccaatgctcggctcgtgcttggagtaggaggtgcagccatgttgggaatcgccacctag

SEQ ID NO: 46059 - DNA, 2067 bp, Artificial Sequence
  Description of Artificial Sequence: Synthetic coding sequence
atggccgccgagatcgacttcctgcgggagcagaaccggcggctgaatgaagacttccgacgctatcagatggagtctttttcaaagtatagctccgtgcagaaggcagtgtgtcaaggggagggcgacgacactttcgagaaccttgtgtttgatcaatccttcctggcccccctggtgactgaatacgataagcatctcggggaactgaatgggcagctgaaatactaccagaaacaggtcggcgagatgaagttgcaacttgaaaacgtcattaaggaaaatgagagactccactctgagctgaaggacgctgttgagaagaaacttgaagccttcccactggggactgaagtcggcaccgatatctacgctgatgacgagactgtccggaaccttcaagaacagctccagttagccaatcaggagaaaacccaggcagtagagctttggcagaccgtgtcgcaggagctggatcgtctgcataagttatatcaggaacatatgaccgaggcccaaattcacgtgtttgaaagtcagaagcagaaggatcagctattcgactttcagcagttgacaaagcagctccacgtcactaacgaaaatatggaagtgacaaatcagcaattcctgaaaaccgttaccgagcagtcagtgattattgagcagttaagaaaaaagcttcgtcaggccaaactcgaactgcgcgtcgctgtcgctaaggtggaggagctgacaaatgttacagaggatctgcaaggtcagatgaagaagaaggaaaaagacgtggtgtccgcacacgggagagaggaagcaagcgaccgaaggctgcagcaactgcaatcctctatcaagcaactggaaatcaggctgtgtgtcaccatacaagaggccaatcaactacgaacagaaaatactcatctggaaaaacagacaagagagctgcaagctaaatgtaacgagctggaaaacgagaggtatgaagctatcgtcagggcccgtaacagtatgcaattattagaggaggcaaacctacagaaatcccaggccttattagaagaaaagcagaaggaagaggatattgaaaaaatgaaggagacagtctcaagattcgttcaggacgccacaatccgcacgaaaaaggaggtcgcgaacacgaagaagcaatgtaacatccaaatatcacggctgacggaagagctgtcagcgctgcagatggaatgcgctgagaagcagggccagattgagcgcgtaatcaaggagaaaaaggccgttgaagaggaactcgagaagatataccgtgaaggacgcggaaatgagtctgactataggaagctggaagagatgcaccaaaggtttttggttagcgaaaggtcaaaagatgacctgcagctcaggttaacacgggcggagaaccgaatcaagcagctagagaccgactctagcgaggagatatctcgatatcaggagatgatacagaagctccagaatgtactggagtccgagagagagaattgcgggctggtgtccgaacaacggctgaagctgcagcaggagaacaagcaactacgtaaggagaccgaaagcctgcgtaagatagccctggaagctcagaagaaggcaaaagttaagatttccaccatggagcacgaatttagcattaaggaacggggcttcgaggtccagctcagagagatggaagacagtaataggaactcgatcgtggaactgcgtcatttgctcgccactcagcagaaagccgccaaccggtggaaggaggaaacaaaaaagctgaccgaatccgccgaaattcgtattaataatctgaagagtgagttatctcggcagaaactgcacactcaggagctgttgagccagttagaaatggcgaacgaaaaggtggccgagaatgaaaagctgatccttgaacaccaggagaaggctaatcgcttgcagaggcgactgtcccaagctgaagagcgagcggccagcgccagccaacagctctcggttatcaccgttcagcggcgaaaggccgcctcgcttatgaacctcgagaacatttag

SEQ ID NO: 46060 - DNA, 924 bp, Artificial Sequence
  Description of Artificial Sequence: Synthetic coding sequence
atggccgccgagatcgacttcctgcgggagcagaaccggcggctgaatgaggactttcggagatatcagatggagtctttctctaaatattcttctgtgcaaaaagcagtgtgccagggcgaaggggacgatacttttgagaacctcgtcttcgaccagtcttttctggcaccactcgttacagagtatgataaacatctgggcgaattgaatggacagctgaagtattaccaaaaacaggtgggcgaaatgaagctgcagcttgaaaacgtgataaaggaaaatgagagactccattcagaactgaaggatgcggtggagaagaaattggaggcattcccactgggcaccgaagtggggactgacatctatgctgacgacgaaactgttcgtaaccttcaggaacaactgcagctggcgaatcaggagaagacgcaggccgtggagctgtggcagacagtgtcccaggagctcgatagactgcacaaactatatcaggagcacatgaccgaggctcagatccacgtgttcgagagccagaagcagaaagaccaactattcgactttcagcagcttaccaaacaactgcatgtgactaacgagaatatggaagttaccaatcagcagtttcttaagaccgtgacagaacagtctgtgattatcgaacaactgcggaagaagcttaggtccgagctcagccgacagaaactgcacacccaggaactgctgagtcaactcgagatggcgaatgagaaagtggctgaaaatgaaaagctgatcctggagcatcaggagaaggctaatcgcctgcagaggagactctcccaggccgaggagcgtgctgcttctgcctcacaacagctgagtgttatcacagtccagagaaggaaagctgcatccttaatgaaccttgaaaacatctag

SEQ ID NO: 46061 - DNA, 528 bp, Artificial Sequence
  Description of Artificial Sequence: Synthetic coding sequence
atggccgccgagatcgacttcctgcgggagcagaaccggcggctgaacgaggacttccggcgttaccagatggagagcttcagcaaatatagttcggtgcagaaggcagtttgccaaggggagggcgatgatacctttgaaaacctggtgtttgaccaatcctttctggcccccctggtgactgagtatgataagcacctgggagaattgaatggccagttaaagtactaccagaagcaggtcggtgaaatgaaattgcaactagaaaatgtgatcaaagaaaatgagcggtctgaattgtcacggcagaagctgcacacccaggagctgctgagtcagctggagatggccaacgagaaagtggccgagaacgagaagctaatactcgagcaccaggagaaagccaataggctgcagcgaaggctaagtcaggctgaggagcgcgctgcttcggcatcccagcagctctccgtgattacggtacagcggcggaaggccgcctcactgatgaatctggagaacatttag

SEQ ID NO: 46062 - DNA, 240 bp, Artificial Sequence
  Description of Artificial Sequence: Synthetic coding sequence
atggccgccgagatcgacttcctgcgggagcagaaccggcggctgaacgaggatttcagacgttatcaaatggaaagcttcagcaaatacagttccgtccagaaagctgtatgtcagggggagggagatgacacctttgagaatttagtgttcgatcagtcattcctcgctccattggtaactgagtacgataaacacctaggtgagctcaacggtcaacttaaatattatcaagcctag

SEQ ID NO: 46063 - DNA, 738 bp, Artificial Sequence
  Description of Artificial Sequence: Synthetic coding sequence
atggagggcaacaagctggaggagcaggacagcagccccccccagtcaactcctgggctgatgaaaggaaacaagcgggaagagcagggacttggtcccgagccagccgctccgcaacagccaacggcggaggaagaggcactcattgagttccaccgctcatatagggaactgttcgagtttttttgtaacaacaccaccatccacggagccatacgtcttgtgtgcagccaacataatcgcatgaagactgccttttgggccgttctttggctgtgtacctttgggatgatgtactggcagttcggcctcttattcggcgagtacttttcttatcccgtcagcctgaacataaatctaaattcggataaactggtctttcccgcagtgacgatatgcaccctgaacccatataggtatcctgagattaaggaggaactggaggaactcgatcgtataacggagcagaccctgttcgatttgtataagtatagcagctttaccacactcgtagctggctctagatcccgtagagacctgcgtggcaccctgccccatcctctccaacggttgcgcgtgcctcctccccctcacggtgcacggcgggccaggtctgtggcatcttcactacgggacaataatcctcaggtggattggaaagactggaagatcgggtttcagctggagttgctgagcttgcctcctcccgacgtctggaagttactgtattttcagtag

SEQ ID NO: 46064 - DNA, 2187 bp, Artificial Sequence
  Description of Artificial Sequence: Synthetic coding sequence
atgggcatggcccggggcagcctgacccgggtgcccggcgtgatgggggaggggacccagggtcctgagctaagcctggaccctgacccgtgttcgcctcagagcactcctggacttatgaaaggcaacaagctggaggaacaggatcctaggcctctgcagcctattcccgggttgatggagggtaacaaattagaagagcaggactcatctccaccacagtccacacccgggctgatgaaaggtaacaaacgagaggagcaaggcttaggtccagagccagccgctccgcagcagccaacagcagaggaagaggcccttattgagttccaccgctcttacagggaattatttgagttcttttgcaataataccactatacatggagcaataaggctcgtctgttcccaacacaatcggatgaagacagcattctgggccgtcctgtggctctgcaccttcggtatgatgtattggcagttcggcctcctgttcggagagtatttttcctatcctgtgagcttaaatattaatttgaatagcgataaactggtttttcccgccgtgacaatctgcaccctcaacccctataggtaccccgagatcaaagaagaactggaagaattggacaggatcaccgaacaaaccctcttcgacctctataaatattcttcctttacgactcttgtggcgggtagtcgctctaggcgggatctccgggggacgctgcctcatccactccagcgactgcgggtgccgcctcccccccatggtgctaggagagcacgctctgtggcgtccagtctgcgggacaacaacccacaggtcgattggaaggactggaagatcggatttcaactgtgcaaccaaaataagagtgattgcttctaccagacatactcttccggtgtcgatgccgtcagagagtggtacagattccactacatcaacattctgtctagattgcctgaaaccttgccaagcttggaagaagacaccttaggcaactttatctttgcatgtagatttaaccaagtcagttgcaaccaagccaattactcacactttcaccacccaatgtatggcaattgttacaccttcaacgacaaaaacaatagcaatctctggatgagcagcatgcccggaatcaataacggcctttccctcatgctacgcgctgaacagaacgacttcattccactcttatccacggtcaccggtgcacgtgtgatggtccacggacaggacgagcctgcatttatggacgatggcggttttaatttgcgacctggagtagagacatctataagcatgcgcaaggagacactggatcgcctgggtggagactatggtgattgcacgaagaacggatcagacgtgcctgtcgaaaatctgtatccatctaagtacacacagcaggtctgcatccactcctgtttccaggagagtatgataaaagaatgtggctgcgcatatatcttttacccacggccgcagaatgtagaatactgcgactaccgaaagcactcatcctggggatattgctactacaagttgcaagttgatttcagctctgatcatctgggctgtttcactaagtgccgcaagccatgttccgtgacaagctaccagctctccgccggctattctagatggccatcagtgaccagccaggaatgggtgtttcaaatgttatcacgacagaacaactacacagtgaataacaagcgaaatggagttgccaaggtcaacatttttttcaaggaattaaactacaaaactaattccgaatccccgtctgtgaccatggttaccctgctgtccaatttgggctcacagtggagcctctggttcggttctagcgtgctgtccgtcgtagagatggccgaactcgtttttgacctgctggttatcatgtttctgatgcttttacgaaggtttcgcagtaggtactggagccctggtaggggtggccggggcgcccaggaggttgcctctacgctggcaagttcccctccatcgcacttctgccctcacccaatgagtctctccctcagccagcctgggccagcgccttctcctgcgctgacagcacctcctcccgcctatgcaaccctggggccaaggccatctccaggtggcagcgctggggcgtcaagtagcacctgccccctgggcggcccctag

SEQ ID NO: 46065 - DNA, 2079 bp, Artificial Sequence
  Description of Artificial Sequence: Synthetic coding sequence
atgagcagcatcaagggcaacaagctggaggagcaggacccccggcccctgcagcctatcccaggcctgatggagggaaataaattagaggaacaggactcgagcccccctcaatccactccagggctcatgaagggcaataaaagagaagagcagggccttgggcccgagccagccgccccgcaacaacccacggccgaggaggaggcgttgattgaattccatcgctcatatcgtgaattattcgaattcttctgcaacaacaccacaatccacggcgcaatcaggctggtgtgctcacaacacaatcgcatgaagaccgccttttgggctgtattgtggctctgtactttcggcatgatgtattggcaattcgggctcctgttcggcgagtacttcagttaccctgtgtccttaaacataaatctaaactcggacaaactggtttttccggccgttactatttgcacactgaatccataccgatatcccgagatcaaggaagaactggaagagctggataggatcaccgaacaaaccctgttcgacctctacaagtactcttcctttacaacattagtggctggttcccggagcaggcgagatcttaggggcaccctgccgcaccctcttcagcgcttacgcgtgccgccaccaccccacggagcccgcagagctaggagcgtggcctcgtcattgagagataacaacccacaggttgattggaaagattggaagatcggctttcagttatgtaaccaaaataaatccgattgcttttaccaaacgtacagcagtggcgtggacgccgtgagggaatggtaccggtttcactacataaatattctctccagactgcccgagacgttgccatccctagaagaagatactctggggaatttcatttttgcttgcaggtttaaccaggtcagctgcaaccaggccaactattcgcacttccaccacccaatgtacggcaattgttacaccttcaatgataagaacaatagcaacctgtggatgtccagcatgcctgggatcaacaacggtttatccctgatgttgcgagcagaacaaaacgattttatcccccttctgtccaccgtcaccggcgccagagtgatggtgcacggccaggatgagcccgcgttcatggatgacggaggattcaatctgcgacccggcgtggaaacctcaatttcaatgcgaaaagaaacactcgatcggctggggggagactacggggactgcaccaaaaacggatctgacgtgcccgtggagaatctgtacccatctaagtatacccagcaagtctgcatccactcttgtttccaggagagcatgatcaaagagtgtgggtgcgcatacattttttacccgaggcctcagaatgtggagtattgcgattaccggaaacatagctcttggggctactgctactacaagctgcaggtcgatttttcaagtgaccacctggggtgttttacgaagtgtcgcaaaccttgcagtgtgacaagttaccagctctccgccgggtactctaggtggccaagcgtgactagtcaggaatgggtgttccagatgctttctagacagaacaattatactgttaataataagcggaacggagtggccaaggtgaatatttttttcaaggaactgaattataaaacaaattccgagagccccagcgtcacaatggtcactctccttagcaacttggggagtcagtggtctctgtggtttggtagctcagtgttgtctgtggtcgagatggcagaactcgtgtttgacctcctggttattatgtttcttatgttactgaggagatttcgctcacgctattggtcccctgggcgcggtggccgcggagcccaggaggtggcctccacactcgcatccagcccaccttcccatttttgcccgcaccccatgtcccttagtctaagccaacccggtcccgcaccaagtcctgccctgacagctcctccccctgcgtacgcaacactggggcctagaccgtcccctggcggcagcgccggcgcgtcaagttccacctgccctctgggagggccctag

SEQ ID NO: 46066 - DNA, 477 bp, Artificial Sequence
  Description of Artificial Sequence: Synthetic coding sequence
atggtgccccacgccatcctggcccggggccgggacgtgtgccggcgtaatgggctgctgattctgtccgttctgtccgtgattgtcggctgcttgctcgggttctttcttagaactcggagactgagcccccaagagatatcttacttccagttccccggtgagttgcttatgaggatgttgaagatgatgattctgcctctggttgtatccagcctcatgtcgggtctcgcatctctggatgctaaaacttccagcaggctgggggtcctgaccgtggcatactatctgtggacgacttttatggcagtcattgttggaatcttcatggtttccatcatccatcctgggtcagcagcccaaaaggagacaacggagcagtcggggaagccgatcatgtcctccgccgacgcgttgctggatctcatcaggcagaaagaggaatcttggcggaatgggccaaagggcccgggatag

SEQ ID NO: 46067 - DNA, 1683 bp, Artificial Sequence
  Description of Artificial Sequence: Synthetic coding sequence
atggtgccccacgccatcctggcccggggccgggacgtgtgccggcgcaatggtctgctgatcctctctgtgctgagcgtaatagtcggatgtctcctgggattctttttacgaactaggcggctgtccccacaagagatttcttactttcagttccccggtgaactacttatgcgtatgctgaagatgatgatcctgcccctggtggtgagctccctaatgtccggattagccagtttggacgctaaaacatcgtcacgattaggagtcctaaccgtcgcttattacctctggacaacatttatggcagttatcgtaggaatctttatggtgtctatcatccaccctggatctgccgcccagaaagaaacgacggagcaaagcggaaagcctattatgagttctgccgatgcattattagatttaataaggaacatgttccctgccaatctggtggaagcgacctttaaacaataccggaccaaaacaactcccgtggttaagtctcctaaggtagcccccgaagaagccccccccagaagaattctcatttacggcgtccaggaggaaaatggctcccacgtacagaacttcgccctggatctgaccccacctcctgaagtggtgtacaaaagcgaacctggcacctctgacgggatgaacgttctcggcatcgtgttcttctccgcaacgatgggcataatgctaggaaggatgggcgattcaggcgctccactcgtgagcttctgccagtgcttgaatgaaagcgttatgaaaatagtagcggttgccgtgtggtatttccctttcggaatcgtgttcctgattgcaggcaagatcctggagatggacgacccacgagcagtgggaaagaagctgggattctactctgtcacagtggtatgtggacttgttttgcacggcctgttcatcctgcccctgctgtactttttcataacaaaaaaaaatcccatcgtctttattagaggaatcctgcaggccttacttattgcattagcaacctcctcctcctccgccactctgcccattacttttaagtgtctcctagagaacaatcacatagacaggcgaatcgccaggtttgtgctaccagtgggagccacaatcaatatggacggcactgcactgtatgaggccgtggctgcaatcttcatagctcaggtgaataattacgagttagacttcggtcagatcattactatatctataactgccacagccgcttctatcggagccgcaggaatacctcaggctggattagtcacaatggtcattgttttgacatccgtcggcctgccaaccgatgacatcactctcataattgccgtcgattgggctctcgataggttcaggactatgataaatgtccttggtgacgccttggcagctggtatcatggcccacatctgtcggaaggatttcgcgcgcgacacaggaacggaaaagctgctgccctgcgaaaccaaacccgtgagcctccaagagatcgttgccgcccagcagaacggctgtgtgaagagcgttgccgaagctagtgagcttactttgggacccacatgcccgcatcacgtgcccgtccaagtggaacaggacgaagaactgcctgctgcctcactaaatcattgtactatccagatctctgaactggaaacgaacgtgtag

SEQ ID NO: 46068 - DNA, 729 bp, Artificial Sequence
  Description of Artificial Sequence: Synthetic coding sequence
atgagcaacccccggagcctggaggaggagaagtacgacatgagcggggcaaggttagccctcattttgtgcgtgaccaaggcacgtgagggaagcgaagaggatctggacgccttagagcacatgttcaggcagttaaggttcgagagtactatgaaaagagatcccacagcagagcagttccaagaggaactggagaagtttcagcaggctattgattcacgggaggaccccgtgtcctgtgcctttgttgttctgatggctcatgggcgagaagggtttctgaaaggcgaggatggagagatggtgaagctcgaaaacctatttgaagccctgaacaataagaattgtcaggccctgagagctaagcccaaagtctacattattcaggcatgcagaggagaacagagagatcccggagaaacagtgggcggcgacgagatcgtgatggtgattaaagactcccctcagaccatccctacatataccgacgcactgcacgtgtactccaccgtggagggatacattgcctacagacacgaccaaaagggcagctgcttcatccagaccctggtcgatgtgtttactaaacgcaagggacacattctggagctcctgacggaagtgacacgtaggatggctgaggcagagctggtgcaagaggggaaagctcgtaagactaaccctgagatccagagtaccttgcgcaagaggctgtacctccaatag

SEQ ID NO: 46069 - DNA, 1503 bp, Artificial Sequence
  Description of Artificial Sequence: Synthetic coding sequence
atgagcatcgaccacgagcagccctggcagcagcccgtgcccgccggcgagcgcccagctgcagggcctggggggttggccgcagccgcagcgggcaagcccgctgccgagagcaccgctcacgcccctgcccccgcagatcacgaccctcgtgccagagccgcactgccagcccccaagaggctacacagcgcggacggccagcggagaggccattgggggcagccaggtctgtgtccagcccccattagtgcgcaccttccacccgatcaggttctacttttcagttggagagcatccgatgaggatgccgccgatgccggggtcacatcccattgcctccaacccggccatcggaatatgtttcctcccaaccttgtagaagcctgctttaaacagttcaaaacgcagtactctacacgtgtggtcaccaggacgatggtgcgcactgaaaacggcagcgagccaggggcttcaatgcccccacctttcagcgtggagaacggaaccagctttctggaaaacgtcacccgcgctctcggtactttgcaggagatgctgtccttcgaggaaacagtgcccgttcccggaagcgccaacggtattaacgcccttggactggtagtgtttagcgtggcttttggtctagtcataggcggcatgaagcataaaggcagggtcctacgtgactttttcgactctctgaatgaggccatcatgaggctggtgggcattattatttggtatgccccagttggcatccttttcctaatagccggcaagatacttgagatggaggatatggctgttctgggtggacagcttgggatgtatacactgactgttattgtgggtctttttctgcacgccggaatcgtgctccccttaatctacttcttggttacccacagaaatccgtttcccttcattggtggtatgctccaggcattaatcactgccatggggacgagtagtagttctgcaactctgcccataaccttccggtgtttagaagaaggcttaggagtggatcgcaggataacaagatttgtcctccccgtgggagcaaccgtgaacatggacggcactgcactgtacgaggccctggccgccattttcatagcccaggttaataattacgaattaaatctgggtcagattacgacaatttctatcactgccaccgctgccagtgtcggagcagccggtattcctcaggccggactagtgaccatggtgattgtgctgacctccgtcggtctcccaacagaagatattaccttaatcatagcagtggactggtttctggacagacttcggactatgaccaacgtgctcggagattccatcggagctgcagtgatcgaacacttgtcccaaagagagctggaattgcaggaggcagagcttacgctgccctccctgggtaagccttacaaatccctgatggcgcaggaaaagggggcatcacggggtcgggggggcaacgaatcagccatgtag

SEQ ID NO: 46070 - DNA, 618 bp, Artificial Sequence
  Description of Artificial Sequence: Synthetic coding sequence
accatgagcagccacggcaacagcctgttcctgcgggagagcggccagagactggggagagtgggctggctgcaacgactgcaggaaagtctgcaacaaagagcacttcggaccagactgagattgcagaccatgaccctggaacatgtgctgagattcctgcgccgaaatgcctttattctgctgaccgtgtctgccgtggtgataggcgtcagcctggccttcgccttgcgcccataccagctgacgtaccgtcagattaaatacttctctttccctggcgagcttctcatgcgtatgctacaaatgctggttctgccattgatcgtcagtagtctggtgacaggaatggcaagccttgacaacaaagcaaccggccgcatgggaatgcgggcagcagtgtactatatggtcaccactatcattgctgtcttcatagggatactcatggtcacgattatccaccccggaaagggtagtaaggaggggctgcatagagaaggtcggatcgaaactatcccgacggctgatgccttcatggacctcatcaggaacatgtttccaccaaacctggtcgaagcttgcttcaagcaagtgcggggtaagtataccgtatag

SEQ ID NO: 46071 - DNA, 939 bp, Artificial Sequence
  Description of Artificial Sequence: Synthetic coding sequence
atgagcagccacggcaacagcctgttcctgcgggagagcggccagcgcctaggccgtgtggggtggttgcagagactgcaggaatccctccagcagcgcgctctgcgaacccgactgaggctgcagaccatgaccctcgaacacgttcttagatttctcagaagaaacgccttcatcttgctcacggtctccgccgttgtcatcggtgtgagcctcgccttcgcactgcgaccttatcaactgacctaccggcagattaaatacttttccttccctggcgagctgttgatgcggatgttgcagatgctcgtgctaccactgatagtctcctccctggtgacagggatggcatccttagacaacaaagccaccggccgcatgggaatgcgggctgccgtttactatatggttacaactatcattgcagttttcattggaatactgatggtgaccatcatccacccaggcaagggcagtaaagagggcctgcatcgggagggacggattgagactatcccaaccgctgatgctttcatggatctgatcagaaacatgtttcctcctaacctcgtagaagcctgtttcaagcaatttaaaactcaatactcaactagggttgtgacccggaccatggtccggaccgaaaatggctccgaaccgggagcttctatgccacctcctttcagcgtggagaacggtacctctttccttgagaatgtcaccagagctcttggaactttgcaggagatgctttcttttgaggaaactgttcctgtgcccggtagtgcgaatgggatcaatgctctcggtctcgtcgtgttcagcgtggcattcggactggtcattggcggcatgaaacacaagggtcgagtgttgagagatttctttgactcactgaatgaagccattatgaggcttgttggcattatcatttggtag

SEQ ID NO: 46072 - DNA, 1317 bp, Artificial Sequence
  Description of Artificial Sequence: Synthetic coding sequence
atgatccggaagctgttcatcgtgctgctgctgctgctggtgaccatagaagaggcaagaatgtcctctctcagctttctgaatattgaaaagactgagatcctgtttttcaccaaaactgaagaaaccatcctggttagcagttcctatgagaacaagaggccaaattcttctcacttattcgttaagattgaggatcccaaaattttgcaaatggtgaacgtggcaaagaagattagttccgacgccacgaatttcaccataaacctcgttaccgatgaagaaggggagaccaacgtgacaatccagttatgggacagtgaaggccgacaagagcgcttgatcgaggaaataaagaacgtgaaggtgaaggtattaaagcagaaagatagcctcctgcaggctcccatgcacattgacaggaacatcctgatgttgatcctcccactgattcttctgaataagtgtgccttcggctgtaaaattgagctccaactgtttcagactgtgtggaaacgcccactgccagttatattaggcgctgtgacccagttcttcctaatgccattctgcggattcctgctaagtcagattgtggcactacctgaagcgcaagcatttggtgtagtgatgacctgcacctgccccggtggaggagggggatatctatttgcccttttgctcgacggggattttaccctcgctatcctgatgacttgtacttctacattgctggcccttatcatgatgcctgttaattcttatatctactccagaatactgggcctctcaggaacgttccacatccccgtttcaaagattgttagcacgctgttattcattctggtccctgtaagcatcggcatagtcattaaacacagaattcctgagaaagcgagcttcctggagagaatcatccgccccctgtctttcatccttatgtttgtaggtatttacctgactttcacggtcgggttggtctttctgaaaacagacaacttggaggtcattctcttgggcctcctggtgcccgctttggggctcctattcgggtacagcttcgcaaaggtctgtaccctgccacttcctgtgtgcaaaaccgtggccatcgaaagtggcatgttgaattccttccttgcactggcagtgatccaactgtctttcccacagagtaaagcaaatttggcatcagtggctccattcaccgtggctatgtgctcaggctgcgagatgctgctcattatactggtgtacaaagccaaaaagagatgcatctttttcttgcaggacaagaggaagcggaacttcctgatctag

SEQ ID NO: 46073 - DNA, 258 bp, Artificial Sequence
  Description of Artificial Sequence: Synthetic coding sequence
atgcggctgctggagcggatgcggaaggactggttcatggtgggcattgtgctggcaattgcaggggccaaactggagccatcgatcggagtaaacggaggacccttgaagcctgagatcaccgttagctacattgctgtggcaacaattttcttcaactccggcttgagtctgaaaaccgagttcgctgacagccggttgcacgcttccgcctgtgtcttttgctcggactttaaccaagggtcgtggtggaagtag

SEQ ID NO: 46074 - DNA, 1023 bp, Artificial Sequence
  Description of Artificial Sequence: Synthetic coding sequence
atgcggctgctggagcggatgcggaaggactggttcatggtgggcattgtgctggccatcgccggggcaaagttagaaccaagcattggcgtgaatgggggacctctgaagcccgagataactgtctcctacatcgccgtggctaccatcttttttaatagtgggctgtccctcaagaccgaagaactgacctctgccctcgtccacctgaagttacacctcttcatccagatctttactctggccttttttcccgctacaatttggctgttcctgcagctgttgtccataacccctatcaacgagtggctcttgaaaggactgcagacagtcggttgtatgcctccaccagtttctagcgccgtcatcctgaccaaggcagtaggtggcaacgaggctgccgccatttttaacagtgcttttggaagtttccttggtatcgtgatcacccccctccttttgttgctgtttctcggctccagctccagcgtaccttttacatctatttttagtcagctgtttatgaccgtagtggttcccttaatcatcggacagatcgttcgacggtacataaaggactggcttgaacgcaagaaaccgcccttcggtgctattagtagctccgtcctactgatgatcatctacaccaccttctgcgatactttctcgaatccaaacatcgacctggataagttcagtctagtcctgattctatttataatcttcagcatccagctctcctttatgttgcttacttttatattcagtacaaggaataacagtggcttcaccccggccgacacagtggctattattttttgctcaactcacaaatccctcacgctgggaattcccatgctaaaaatcgtttttgcaggccacgagcacttgtccctgattagcgtcccacttctgatttatcacccagctcagatactcctggggtcagtgttggtccctacaatcaagagctggatggtcagtaggcagaagggggttaagcttactaggcctactgtttag

SEQ ID NO: 46075 - DNA, 480 bp, Artificial Sequence
  Description of Artificial Sequence: Synthetic coding sequence
atgcggctgctggagcggatgcggaaggactggttcatggtgggcattgtgctcgcaatcgctggggctaagcttgaaccctccatcggcgttaatggcggccctcttaagcccgaaataacagtgagttatatcgccgtggcaaccatcttttttaactccgggttgagtctcaaaactgaggaactaactagcgcgttagttcacctaaagttgcacctcttcattcagatcttcaccctggcctttttccctgccaccatttggttgtttctacaactactgagtattaccccgattaacgaatggctgctgaagggcctccagaccgtcggctgcatgccgccccctgtgtcgagtgctgtaattttgacgaaggcagtgggtgggaatgaggccgccgccattttcaactcggcgttcggatcctttctggtttccaagcacagcttgacctgcctactgcaattgctgctgtag

SEQ ID NO: 46076 - DNA, 1077 bp, Artificial Sequence
  Description of Artificial Sequence: Synthetic coding sequence
atgcggctgctggagcggatgcggaaggactggttcatggtgggcatcgtgctcgcaatcgccggggcgaagctggagccctccattggggtgaatggaggcccgcttaaacctgagataactgtaagttacattgccgtggctactatattttttaactccggcctttccttaaagacagaggagttaaccagcgccctggtgcacctgaaattgcacctgttcatccagatcttcaccctggccttcttccccgccacaatttggctctttttgcaactcctcagtattaccccgatcaacgagtggctactgaaaggacttcagacagtgggatgcatgcctccaccggtgtcaagtgcagtgatacttacaaaagcagttggcggcaacgaggccgcagctatcttcaattccgccttcggaagtttcctcggaattgtcatcactccattgctcctcctcctgttcttggggagttcctcttccgttccttttacaagtattttcagccagttgttcatgaccgtggtagttcctctaataatcggacaaatcgtgaggcggtatattaaggattggcttgagagaaagaagccacccttcggagccataagcagtagtgtgctgctgatgattatatacaccaccttttgcgatacattttcaaatccaaatatcgacttagacaaattctccttggtcctgattctctttattatattctcgattcagctgagcttcatgctcctgacctttattttttcaactaggaataattccggctttacccccgccgacactgtcgcaataatcttctgtagcacccataaaagcctgacgctgggaatcccaatgctgaaaattgtctttgcgggacacgagcatcttagcctgatctctgtccccctactgatatatcacccggctcagatcctactggggtcggtcctggtccctacaatcaagtcctggatggtgtctagacagaaaaaactcctgcagactcggggaccactagccaatttaaataacccggaaggactcgaatacctgtctatcaagtttgggcattag

SEQ ID NO: 46077 - DNA, 984 bp, Artificial Sequence
  Description of Artificial Sequence: Synthetic coding sequence
atgcggctgctggagcggatgcggaaggactggttcatggtgggcattgtgctggccatcgccggtgcaaaattagagcccagtatcggagttaacggtggtcctcttaagccagaaatcacagtttcctacattgcagtcgccacaatttttttcaacagcggactgtcactgaagacggaagagctgacctcagcactcgtacacctgaagctgcacctgtttatacagatttttaccctcgcctttttccctgcaaccatttggctgttcttgcaactccttagcatcactcccataaatgagtggttgttaaagggattgcagactgtgggatgcatgccacccccagtgtcaagcgcagttatcctcacaaaagctgttggggggaatgaaggaattgtgatcacaccgcttcttctgctgctgtttctgggcagcagttcttctgtccctttcacctccatcttcagtcagctgtttatgacagtagtcgtgcccctcattatagggcaaattgtgaggcgatacataaaagattggttggagcggaagaagcccccctttggcgccatatcttcctctgtgctgcttatgatcatctacaccactttttgtgatacattttccaacccaaacattgatctggataagttctccttggtgctgatcctgttcataatattttctattcagttgtccttcatgctcttaaccttcatattcagcacaaggaataattcagggtttacccctgccgacacggtagctatcatattttgctcaactcacaagtccctgaccctcggaatccccatgttgaagatcgtgttcgctggacatgaacacctgtcccttatttctgtgccactgctgatttaccacccggcccagatcttgctgggtagcgtattggttcctactatcaagtcctggatggtgagcaggcaaaagggtgtgaagctaacccgccccactgtgtag

SEQ ID NO: 46078 - DNA, 195 bp, Artificial Sequence
  Description of Artificial Sequence: Synthetic coding sequence
atgcggctgctggagcggatgcggaaggactggttcatggtgggcatcgtcctggcaattgcaggcgcgaaactggagccatcgattggagtgaatggtggccctctgaagcctgaaattacagtatcttacatcgcggtagcaacaatctttttcaacagcgggctctcgctcaagaccgagctgttgacctag

SEQ ID NO: 46079 - DNA, 1077 bp, Artificial Sequence
  Description of Artificial Sequence: Synthetic coding sequence
atgcggctgctggagcggatgcggaaggactggttcatggtgggcatcgtgttggcaatcgccggagctaaattggaaccaagcatcggagtgaatggtgggcccctgaaaccggagatcaccgtatcatacatagccgtggccactattttcttcaatagcgggctgagcctaaagaccgaggaacttacatccgcactcgtccacctgaagctccatctgtttatacagattttcactctggctttctttccagcaacgatctggttgtttctccagcttctctccatcacccccatcaacgagtggctccttaaagggctccagacggtgggctgcatgcctccccctgtgtcatcagcggtgattctgacaaaagcggttggtggtaatgaagccgccgcaatattcaatagcgcatttggatctttcctgggaatcgtcattacccctctgctcctgttactctttctgggatcctcttcctcagtgcctttcacctccatcttctcccaactctttatgaccgtggtcgtccctctgataatcggtcagattgtgaggcgctacattaaggattggttggagaggaaaaaaccacctttcggcgcaatatctagttccgtcctccttatgatcatctacactactttctgtgacaccttttctaacccaaatatcgacttagacaagtttagcctagtcctgatcctgtttatcatcttttctatacagctcagttttatgctgctaacctttatctttagtacaagaaataatagcggcttcactcccgcagacactgtcgccatcatattctgttccacccataagtctctcacattgggtattccaatgctcaaaattgtgtttgcagggcatgagcatctttcgctgatctctgtacctttgctcatctatcatcccgcacagatattgttaggaagtgtgctcgtgccaacaattaagtcctggatggtgagtaggcagaaaaagctgctgcagacccgcggacctctcgcgaacctgaacaatccggaggggttggaatatctctcgatcaagtttgggcattag

SEQ ID NO: 46080 - DNA, 1707 bp, Artificial Sequence
  Description of Artificial Sequence: Synthetic coding sequence
atggtgctgggccccgagcagaagatgagcgacgacagcgtgagcggtgatcacggtgaatcagccagcttgggaaacattaatccagcatactcaaacccttctctgagccagagccccggagattctgaggagtattttgcgacatacttcaatgagaagatatccattcccgaagaggagtattcctgcttttccttcaggaagttatgggccttcactggtccaggctttctgatgtccatagcttatctcgacccaggcaatatcgaaagtgatctccagtcaggcgcggtagcaggctttaaactgctgtggattttgctcctcgctacactcgtgggcctgctgctccagaggctggccgcccgcctcggcgtcgtaactggcctacacctagctgaggtttgtcatagacagtaccccaaggtgccccgcgtgatactgtggctcatggtggagcttgcgattatcggatccgatatgcaggaggtcataggaagtgcaattgctatcaacctcctttcagtcggccggattcccctgtggggtggggtcttgatcacaatagccgacaccttcgtgtttttgtttcttgacaaatatggcctaaggaaactggaggctttctttggtttcctgatcacaatcatggctctgacattcggctacgaatacgtgaccgtcaagccatctcagtcccaggttctaaagggaatgtttgtgccctcgtgtagtgggtgccggacaccccagatcgagcaagcagtagggattgttggggcagttataatgccacataatatgtaccttcactctgctctggtaaagagccgtcaagtcaaccgtaataacaagcaggaggtccgcgaggcaaacaaatactttttcatcgagtcctgcattgctctcttcgtttcttttatcattaatgtgtttgttgtgtcagtcttcgccgaggccttctttgggaaaaccaatgaacaggtggtcgaggtgtgcacaaacacctcttcccctcacgcaggtctgtttcccaaggacaatagtaccttagcggtcgacatttataaaggcggagttgtgctgggatgctacttcggacctgccgccctgtacatttgggccgtcggcatcctggccgctgggcagtctagcactatgacaggaacttattcggggcagttcgtgatggagggtttcctgaacctcaagtggtccaggtttgccagggtggtcctcaccaggtccattgccattataccaacactgcttgtagctgtgttccaagacgtagagcacctgaccggcatgaatgactttctgaatgtcttgcagtcactccagttacccttcgccctcatacctattctaaccttcaccagcctccgccccgttatgtccgactttgcaaatgggctcggatggcgaatagccggaggcatcctagtattgatcatctgttcaatcaacatgtatttcgttgttgtgtatgtaagagatctcgggcatgtagccttgtatgtggtggccgctgttgtgagcgtggcatacttgggctttgtgttttatctaggatggcaatgccttatagctctcggtatgtctttcttggattgcggacatacttgccacctgggtctcaccgcacaacctgaactctacttactaaacaccatggacgcagactcccttgttagccgttag

SEQ ID NO: 46081 - DNA, 1686 bp, Artificial Sequence
  Description of Artificial Sequence: Synthetic coding sequence
atggtgctgggccccgagcagaagatgagcgacgacagcgtgagcggtgaccacggagaaagcgcttcattgggaaatattaacccggcctactctaatccctcgctgtcacaatcccctggcgacagcgaggagtactttgcaacatactttaatgaaaagatttctatccccgaggaagagtactcatgcttctccttccgaaagctgtgggcttttacaggccctggattcctgatgagcattgcctatctggatcctggaaacatcgaaagtgatcttcagagcggcgccgtcgctggctttaaactgctgtggatactgctgcttgctaccctggtgggactgctcttacagcggctggctgccaggcttggggtggtgacgggactccacctcgcagaggtgtgccatcgtcaatatcccaaagtacccagagttattctctggctgatggtggagctcgcgattatcgggagtgacatgcaggaggtaatcggaagcgctatcgctattaacttgctctccgtcggacgcatccctctgtggggcggagtgcttataaccatagcagacacgtttgtgttcctgttcttggacaagtacggtcttcggaagctggaagccttcttcggctttcttattactattatggccttgacctttggatacgagtacgttactgtaaaaccttcccagtctcaagttttgaagggtatgttcgtgccatcatgctcaggctgtcgcacaccccagatcgaacaggcggtggggatcgtgggcgccgttattatgccacacaatatgtatctgcattctgcattggtcaagtcacgccaagtgaacaggaataacaagcaggaggttcgcgaggccaacaaatactttttcatcgagagttgcatagcgctgtttgtaagcttcatcatcaacgtctttgttgtgtctgttttcgcggaggctttcttcggaaagacaaatgaacaggtcgttgaggtgtgcacaaacaccagctctccgcacgccggtttgtttcccaaagacaactcgaccttagccgtggacatctacaagggtggggtagtcctggggtgctacttcggtccggccgcactgtacatctgggccgtcggtatccttgccgcaggacagagctcaacgatgacaggaacgtacagtggccaattcgtaatggagggattcctgaatctgaagtggagccgatttgcccgcgtggtcttaactcggtctatcgcaatcatccctactcttctggtggctgtctttcaagatgtagaacacttaacggggatgaacgatttcctgaatgttctgcagtcattgcaattgcccttcgccttgatcccaattctaactttcacaagcctacgaccagttatgagtgacttcgccaacgggttgggatggaggattgccggagggatcctcgtgctaatcatctgctccatcaatatgtacttcgtggtagtgtacgtcagagaccttgggcacgttgcactctatgtagtggccgcagttgtttctgtcgcctatttaggttttgttttctacctcggctggcagtgtctgatcgctcttggaatgtccttcctcgactgtggccatactgtctccatttcaaagggattgcttaccgaagaagccacaagaggctacgtaaagtag

SEQ ID NO: 46082 - DNA, 1773 bp, Artificial Sequence
  Description of Artificial Sequence: Synthetic coding sequence
atgcggaagaagcagctgaagaccgaggccgccccccactgcgagctgaagtcttactctaagaacagtgctactcaagtcagcaccatggtgttagggcctgagcaaaaaatgtctgacgactccgtttccggagaccatggcgaaagcgccagcctggggaacattaaccccgcatatagcaacccttccttgtcacaaagtcctggagatagtgaagagtatttcgccacgtacttcaacgaaaagatttccatacccgaggaagaatacagctgtttcagttttaggaagttgtgggccttcaccggacccggcttccttatgtccatcgcgtacttggaccccgggaacattgagagtgatctgcagtcgggtgctgtggccggttttaagcttctgtggattctgctgttagctaccctggtaggattactgcttcagcgactggccgcccgtctgggagtagtgaccggtctgcacctggccgaggtgtgccaccggcaatacccaaaggtcccaagagtgatcctgtggcttatggtggaactggccattatcggaagcgacatgcaggaggtgattgggagcgctattgccattaatctgttgtcagtgggaaggattcccctgtggggcggcgtgttaatcacaattgctgacactttcgtattcctattcctggacaaatatgggctccgcaaacttgaagcattctttggattcttgatcaccataatggccctgacgtttgggtacgagtacgttacggttaagccatctcagtcgcaggtcctgaagggcatgttcgtgccctcgtgttcaggatgccgtactcctcaaatcgagcaggctgtgggaatcgtgggggccgtgatcatgccccacaatatgtatttgcacagcgccttggtgaagagtcggcaagtgaatcgaaacaataagcaggaggttagagaggccaataaatacttctttattgagtcttgtattgcactgtttgtctccttcatcattaacgtgtttgtcgtctcagtctttgcagaggctttttttggtaaaacaaacgagcaagttgtggaagtgtgcacaaatacaagcagcccacatgctgggctgttccctaaggataacagtactcttgccgttgacatttataagggtggggtggtgctcggatgttatttcggtcctgcagctctgtacatctgggccgtgggcatccttgcggccgggcagtcatccaccatgaccggcacctattcgggacagttcgttatggagggatttctgaatctgaagtggagtagattcgctcgagtagtactcacgagatcgattgccatcatacctactctcctggtcgccgtcttccaggacgtggagcacctgaccggcatgaacgattttctcaatgtgctgcagtccctccagttgccattcgccttgatccctattctgaccttcacctccctgcgccccgtcatgtctgatttcgcaaacggcctggggtggcggatcgctggagggattctggtcctcatcatctgttctattaatatgtacttcgtggtggtgtatgtgcgagatttaggccacgtggcactgtacgtagtggccgccgttgtttcagtggcatacttggggtttgtcttttacctgggttggcagtgtctgatagctctgggcatgtcatttctagactgcgggcacacagtttccataagcaaaggtctgctaaccgaggaagccaccagaggctatgtgaagtag

SEQ ID NO: 46083 - DNA, 1686 bp, Artificial Sequence
  Description of Artificial Sequence: Synthetic coding sequence
atggtgctgggccccgagcagaagatgagcgacgacagcgtgagcggcgatcacggagagtcagcttctctcggcaacatcaaccccgcctattccaacccctccctgtctcagtctcctggcgattcagaagagtacttcgctacatatttcaacgaaaagattagcataccagaagaggaatacagctgcttctcttttcgcaagctatgggctttcaccggccctggatttctgatgtctattgcatacctggatcctggcaacattgagtcagacttgcagtcaggtgcagttgctggatttaagcttttatggatccttttgctggcaactctggttggacttctactgcagaggctcgccgctcggctgggcgtggtgaccggcctccatcttgccgaagtctgccacagacagtacccgaaagttccgagggtgatcctgtggctgatggtcgagctggcaatcatcggttcagacatgcaagaagtgataggatcagctatcgccatcaatcttttgagtgtgggtagaatccctctttggggcggggtgctgattaccattgcagacacttttgtgttcctgttcctcgataagtacggactgaggaaactagaagccttttttggattcctcatcactatcatggcactgacgttcggatatgagtatgtgaccgtaaaacccagccagtcccaggtgctcaaggggatgttcgtcccctcctgtagcggctgtcggactccacagatcgagcaagccgtcggtatcgttggagccgtaatcatgcctcataacatgtacctgcattccgcccttgtcaagtctagacaagtcaatagaaacaacaagcaggaagtcagggaagcaaacaagtactttttcatcgagagttgcatagcactgttcgtttctttcatcatcaatgtgtttgtggtgtctgtcttcgctgaggcatttttcggcaagacaaatgaacaggtagtggaagtgtgcaccaatactagttctccacatgctggactatttcctaaagacaacagcactcttgccgtggatatctacaaagggggagtggtgctcgggtgctactttggaccggcggctctgtatatttgggctgtgggaatcctggccgccggccagagctctaccatgaccggcacatacagcggtcagtttgtgatggagggatttctgaacctgaagtggagtaggttcgctcgggttgtgctgactagatcaattgctattatccccacattgctggttgccgtttttcaagatgtggaacaccttactgggatgaatgatttcctcaacgtactgcaatccttacagctcccatttgcacttatccccatcctgaccttcacctccctgcgaccagtaatgtctgattttgccaatggcctgggctggcgcattgctggcgggattctggtccttattatttgcagcattaatatgtatttcgtagtggtgtacgtgagagatcttggacacgttgcactttacgtggtggccgcagttgtcagcgtggcttacctcgggttcgttttttacctggggtggcaatgtcttatcgctctgggaatgtcttttttagattgcggccatactgtttcaatcagcaaggggctgctcacggaagaggctaccaggggttatgtcaaatag

SEQ ID NO: 46084 - DNA, 1674 bp, Artificial Sequence
  Description of Artificial Sequence: Synthetic coding sequence
atgagcaccgtggactacctgaacagcgtgagcggcgaccacggcgagtctgcctcattgggaaacattaacccggcatactctaacccaagtttgtcccagagtcccggagactctgaggagtattttgcgacatatttcaatgaaaagattagcataccagaggaagagtactcatgcttttcatttagaaaattatgggcatttactggccctggttttctcatgagcatcgcgtacctggaccctgggaacatcgaatctgatctacagtccggggcggtagccggcttcaagctgctctggatccttctcctcgccacactcgtgggcctcctcctgcagcgcctggcagcacggctgggggttgtgacagggttgcatttggcagaggtgtgccatcgccagtaccccaaggtgcctcgtgtcatcttatggctcatggtcgagcttgccatcatcggtagtgacatgcaagaagtgataggctccgccatagctatcaatttgctttcagtggggcgaatacccttatgggggggtgtcttaattacaatcgcagacacctttgtattccttttcctggacaagtatggcctgagaaaattagaagccttctttggcttcctcattacaattatggctttaacctttggctacgaatacgtgaccgtgaagccaagccaaagccaggtgctaaagggtatgtttgtaccctcttgcagcggctgccgcaccccccagatagagcaggcagtgggaatagtaggagccgtgatcatgccgcacaacatgtacttgcattctgcattagttaaatcacgtcaggtcaaccggaataacaagcaagaggtccgcgaagctaataagtatttttttattgagagctgcatagccctatttgtttctttcatcatcaatgtatttgttgtgtccgtgttcgccgaagccttcttcggcaagacaaatgagcaggttgtcgaagtctgcactaacacatcctcaccccatgccggcctgtttcctaaggacaactcgacactcgcagtggatatctataaaggaggagtagttcttggctgctactttggcccagctgccctgtacatctgggccgttggcatactggcagctgggcagagcagcactatgactgggacttactctggccagttcgtgatggagggtttcctgaacctcaaatggtctcgctttgccagagtcgttcttaccagatcaattgccataatcccgacattgctcgtcgcagtgtttcaggatgtggaacacctaacagggatgaacgattttctgaatgtgctgcagagcctccagctgccattcgcactgatacccatccttacattcacttctctgagacctgttatgtcagactttgctaatggcctagggtggcgcattgctggagggatactggtgctgattatatgtagcataaacatgtattttgtggttgtctacgtgcgagacttgggccatgtggctctatatgtcgtggcggctgttgtgtctgtggcttatctggggttcgtcttctatctgggatggcagtgtctgattgccctaggcatgtctttcttggattgcggccatacagtgagcatctctaaagggctgctgaccgaggaggccacacgtggatacgtgaagtag

SEQ ID NO: 46085 - DNA, 1707 bp, Artificial Sequence
  Description of Artificial Sequence: Synthetic coding sequence
atggtgctgggccccgagcagaagatgagcgacgacagcgtgagcggagatcacggtgagtcagcatctcttggcaacataaatcctgcttattccaatccaagcctctctcagtcaccaggcgacagcgaggagtacttcgctacatatttcaatgagaaaattagcatccctgaagaagaatactcttgcttttccttcagaaaattatgggccttcactggccctgggtttttaatgtccatcgcctatttggatcctgggaacattgagtctgacttgcagtccggtgccgtggctgggttcaaactgctgtggattctgctcttagcaacactcgtcggcttgctgctgcagaggctggcagcccggctaggcgtagttactgggctccacctagctgaggtgtgtcaccgccagtatccaaaagtgccacgagtgatactgtggctgatggtggagttagccataattgggagtgatatgcaggaggtaataggcagtgccattgcaataaacctgctgtccgttgggagaattcctctgtggggaggggtcctgataactatcgcggacacctttgtatttctctttctcgataaatatggcctccgcaagttagaggcattcttcggattccttatcaccatcatggcattgaccttcggctatgaatacgtgaccgtgaaaccaagccagtctcaagttctgaaaggcatgtttgtcccctcctgctcaggctgtcgcactcctcaaatcgagcaagctgtcggcattgtcggcgctgtcatcatgcctcacaacatgtacctgcattccgcgctggtgaagtcccggcaggtgaatcggaataacaaacaagaggtgagggaagcaaacaaatactttttcattgaaagctgtattgctctgttcgtctcctttataatcaacgtctttgtagtgtcagtgttcgcagaggcattcttcgggaaaacgaacgaacaggtggtcgaggtgtgcacaaacacttcctctcctcacgccggtctgtttcccaaggataactcgacgcttgccgttgacatttacaagggcggagtggtgttaggatgttactttgggccagctgccctgtatatatgggcggttggcatccttgctgccggtcagagttccacaatgacgggcacttactcgggtcagttcgttatggaaggatttctcaatctgaaatggtcccggttcgcccgtgtggtactcactcgatctatagctattattcctaccctgctcgtggctgtgttccaggacgtggagcatctgactgggatgaatgacttcctcaatgtcctacagtccctccagttaccttttgcactgataccgatcctcacattcaccagcttgagacctgtgatgagtgattttgctaacggcctgggatggagaatcgccggcggcatattggtgctgatcatctgttctatcaacatgtacttcgtcgttgtgtacgtgagagatttgggccacgttgcgctgtatgtggtggccgcagtagtgtctgtggcgtacctgggcttcgtgttttatcttggctggcagtgtctcatcgcccttggaatgtcatttctggactgtgggcatacttgtcaccttggtctcactgctcaacccgagctctatctgctgaacacaatggacgccgattccttggtttcccggtag

SEQ ID NO: 46086 - DNA, 1449 bp, Artificial Sequence
  Description of Artificial Sequence: Synthetic coding sequence
atgagcatcgcctacctggaccccggcaacatcgagagcgacctgcaatcgggggctgtggccggcttcaagttgttatggattctactgttagcgacgcttgtggggctcctcctgcagcggttggcagccagactcggcgttgtgactgggttacacctggctgaagtgtgtcacagacagtaccctaaggtgcccagagtaatactgtggctcatggttgagctggctatcattggatctgacatgcaagaagttattggatcagctattgcaataaatttgctgagcgtgggccggatccctctgtgggggggggttttgatcacgattgctgacacattcgtctttctcttcttagacaaatacggcctgcgcaaactggaagccttttttggctttctgataacaataatggctcttacatttggctacgaatacgtcactgtaaagccttctcagtctcaagttctaaagggcatgtttgtgccatcatgctctgggtgcagaacgcctcaaatagagcaggcagtgggcatcgtcggagccgtcatcatgccccataacatgtacctccactccgctctcgtgaaatcgcgccaggtgaaccgtaacaataagcaagaggtgagggaggccaataaatacttcttcattgaatcgtgtatcgcattgtttgtgtcgtttattatcaatgtctttgtggtaagcgtcttcgccgaggccttctttggtaagactaatgagcaggtcgtagaggtttgcacaaataccagttccccccatgccggtctgtttcccaaggacaactccaccctggccgtggatatctacaagggtggagtggtcttgggatgctacttcggccctgccgctctctatatctgggcggtgggaatcctggctgccggacagagctccactatgacagggacatattctggacaatttgtgatggagggttttttaaacctgaaatggtctaggtttgccagggtagtactgacgagaagcattgccatcatacccaccttactggtggccgtatttcaggatgtggaacatctaactgggatgaatgacttcttaaatgtgctgcagtcccttcagctgcccttcgcgctaattcctattcttactttcacgagtctccgaccagtcatgtccgattttgccaacggcttgggatggagaatagccggaggcatccttgttttgattatctgcagcattaacatgtatttcgtcgtggtgtatgttagggacctggggcatgtggccctatatgtggtggctgctgttgtaagtgtggcctatctgggctttgtattctacctcggatggcaatgcctgatcgccctgggaatgagcttcctggactgtggccacaccgtgagtatatccaaggggctactgacagaggaggccacacgaggatacgtgaaatag

SEQ ID NO: 46087 - DNA, 1707 bp, Artificial Sequence
  Description of Artificial Sequence: Synthetic coding sequence
atggtgctgggccccgagcagaagatgagcgacgacagcgtgagcggggatcatggcgaaagcgccagcctgggaaatattaacccagcatacagcaaccctagcctctctcagtcccctggcgacagtgaggagtatttcgccacctatttcaacgaaaaaatcagtatacccgaggaagagtatagttgcttctctttcaggaagctctgggcattcactgggcccggttttcttatgtcgatcgcatatcttgaccctggtaatatcgagtcagatcttcagtcgggagccgtcgccggctttaaactgctgtggatactgctgctcgccacgttggtcgggctcctcctccagagattggccgctcgcctaggagtggtaaccggccttcacctagcagaagtttgccacagacaataccctaaggtacccagggttattttgtggctaatggtcgagctagccatcatcggtagcgacatgcaggaagtgatcgggtctgccattgctatcaacctcttgtccgtaggccgtatccctctgtggggcggggtgttgatcacaatcgctgatacgttcgtttttctatttctggacaagtacgggctacgaaagctggaggctttctttggattcctgattaccattatggcgctcacatttggctacgaatatgtgactgtgaaacccagccagagtcaggtgttgaaaggaatgtttgtcccaagctgtagcggttgcagaactccacagatcgagcaggcagtcggcatcgtaggggctgtcattatgcctcataatatgtatttgcactctgcccttgtcaaatctcggcaggtgaatcgaaacaataaacaagaggtgcgagaagcaaacaagtacttctttatcgagtcatgcattgctctgtttgtcagtttcataatcaatgtttttgtggtaagtgtcttcgctgaggccttctttggaaaaaccaatgagcaggtagtagaggtttgtaccaacacctctagtccacatgccggactgtttccaaaggataatagtacactcgcggtggacatatacaagggtggggtggtgcttggatgctactttggtcccgcagcgctctatatttgggccgtgggcattttagccgccgggcagtccagcaccatgactggtacctactccggtcagttcgtgatggaaggctttctcaatctgaaatggagccgcttcgcccgcgttgtcttgactcgttcgatcgcaattatccccactctcttggtcgctgtattccaggatgtggagcacctcaccggaatgaatgacttcctcaatgtgctacagagtctacaacttccctttgctctcattcctatactgacattcactagcttgcggccagtcatgagcgattttgccaatggcttaggctggcgaatcgcaggcgggattctcgtgctaatcatctgctccatcaacatgtactttgtggttgtgtatgtgagggatctgggccacgtcgccctctatgtggttgccgccgtcgtgagcgttgcttatcttgggttcgtcttctacctgggctggcaatgtctcatcgccttgggcatgagctttttggattgcggccacacatgtcatctaggcctcactgcgcaacccgagctgtatctcctgaataccatggatgctgattcactggtatcccggtag

SEQ ID NO: 46088 - DNA, 1773 bp, Artificial Sequence
  Description of Artificial Sequence: Synthetic coding sequence
atgcggaagaagcagctgaagaccgaggccgccccccactgcgagctcaaatcttattccaagaactcagctacccaggtctctaccatggttctaggtcctgagcagaagatgagcgacgacagcgtctctggggatcacggcgaaagcgcctcactgggcaacattaatcctgcctattccaatccttctctttctcagtcacctggcgacagcgaggaatacttcgctacttatttcaacgagaaaattagcatcccagaggaggagtactcttgcttttcatttcgcaagttgtgggccttcacaggcccagggttccttatgagcatcgcctaccttgaccctggtaacatcgagtcagatttacagagcggagctgtcgctggatttaagctcctctggatactgcttctggcaaccctcgtgggactgctgctgcagcgcttagcagctcgtcttggtgtggtcaccggcctccacttggcagaagtatgtcacaggcagtaccctaaggttccgagagttatcctctggctgatggtcgaactggctatcattggttccgacatgcaagaggtcataggcagcgcgatcgcaattaatcttcttagcgttggaagaattcccctgtggggaggcgttttaatcaccatcgctgacactttcgtgttcctgtttctagacaaatatgggcttcgtaaactagaggccttttttggctttctgattactattatggccctgacgtttgggtatgagtatgtcacagttaagccgagtcagtctcaggtgctgaaaggtatgttcgtgccatcctgctccggatgtagaacgcctcagattgagcaagctgtcggcatcgttggagcggtaatcatgccccataatatgtacctccactccgcgctggttaaaagccgacaggtgaatagaaacaacaagcaggaggtaagggaagctaataagtatttcttcattgaatcctgcatcgcactgttcgtcagctttatcatcaacgtcttcgtcgtctccgtgtttgcagaggccttctttgggaaaactaatgagcaagttgtcgaggtgtgcacaaacacctcctcccctcatgccgggttatttccaaaagataacagcacactcgcagtcgacatttacaaaggcggtgtcgtgctcgggtgttattttggcccagcagctttatacatatgggctgtgggtatattggctgccggtcagtcatccactatgaccgggacatattctggccagtttgttatggaggggtttcttaatctcaagtggagcaggtttgcccgagtggtcctgactagatcaattgctataataccgaccctgctcgtggctgtgtttcaggatgtggagcacctcaccggaatgaatgatttcttaaacgtgttacagagtctccagctgcccttcgcactcattcctatccttacatttacatcactccgccccgtgatgagcgacttcgccaatggcctggggtggcgaatcgcagggggcatcctcgttttaatcatctgcagtatcaatatgtacttcgttgtcgtttatgttcgggacttgggacatgtggcgctgtatgtcgtggcagcggtcgtgtctgtcgcctatttaggttttgtattctatctggggtggcagtgcttgattgccctgggcatgtctttcctggactgcggccacacagtgagcataagcaagggcctgttaaccgaggaagccaccagagggtacgtgaagtag

SEQ ID NO: 46089 - DNA, 12 bp, Artificial Sequence
  Description of Artificial Sequence: Synthetic coding sequence
atggtgctgtag

SEQ ID NO: 46090 - DNA, 450 bp, Artificial Sequence
  Description of Artificial Sequence: Synthetic coding sequence
atggtgctgggccccgagcagaagatgagcgacgacagcgtgagcggggatcacggagaatccgccagcctcggcaacataaaccccgcatattccaacccaagcctatcgcagtctcctggtgactcagaggaatatttcgcaacctatttcaacgagaagatatccattcccgaggaggagtacagctgttttagcttcagaaaactgtgggcttttacggggcccggtttcctgatgtccatagcctaccttgacccaggcaatatagaaagtgacctgcaatcgggtgccgtcgccggattcaagctgctgtggattctcttacttgcaacactagtggggctgctactccagagactcgccgccagactgggagtagtgactggcctgcacctggctgaggtctgccaccggcagtatcccaaggttcctcgggtgattttatag

SEQ ID NO: 46091 - DNA, 2145 bp, Artificial Sequence
  Description of Artificial Sequence: Synthetic coding sequence
atgacccagatgagccaggtgcaggagctgttccacgaggccgcccagcaagacgccctggcccagccacagccttggtggaagactcagttatttatgtgggaacctgtgttatttggtacatgggacggagtttttacaagttgtatgatcaacatctttggggtggtattatttctacggacaggctggctggtaggcaacacgggtgtgctgctaggaatgtttctagtatccttcgtgatccttgtagctctggtaaccgttttatcaggcatcggcgtgggtgagaggagtagtattgggagtggtggcgtatactccatgatctcatctgtgttgggaggtcaaactgggggcactatcggacttctctatgtgttcgggcagtgtgtagccggcgccatgtacatcaccggcttcgcagaatccatctctgaccttttaggccttgggaacatctgggcagtgagaggcatcagcgtcgccgtcctgttggcgctgctcggaatcaacctggcgggcgtgaaatggattatccgcctacagctactgctacttttcttgctcgccgtgagcacacttgactttgttgttggtagcttcactcacctggaccctgaacacggcttcattggatatagccccgaactgcttcagaacaataccctgccagactattctcctggggaaagcttcttcactgtgtttggagttttcttccctgcagctacgggcgtcatggcaggatttaatatgggcggcgatctcagagaaccagccgcgtccattccacccggtagtctcgccgcggtggggatttcctggtttttgtacattatatttgtgtttcttcttggggccatttgcacccgtgaagctctccgatacgactttctgatcgccgagaaggtgtctctgatgggattcctttttctgttggggttatatatctcaagcctggccagttgtatgggaggcctgtacggcgccccccgaatcctccagtgtatcgcccaagagaaagtgattccggcactggcctgcttgggccagggaaaaggcccaaataaaacgcctgtggccgccatatgtctcacgtccctggtgaccatggcattcgttttcgttgggcaggtcaacgtgctcgctcctatagtcactattaacttcatgttgacatatgtggccgtcgattacagctacttcagcttatccatgtgcagctgtagtctcacaccagtgccagagcccgtcctgagggaaggtgcagagggcctgcattgctccgagcatctgctgctggagaaagctccttcctacggatcagagggtccagcccagcgggttctcgagggtaccctgttggagttcacaaaagacatggaccaacttctgcagctgacgcgaaagctggagtccagtcagcctaggcagggggaagggaatcgaactccggaatcgcaaaagcgcaagtccaaaaaagccaccaagcagacgctgcaggactcgtttctgctcgatctgaaatcaccgccatcattcccagttgaaatctcagacagactgcccgcagcttcgtgggaaggccaagaatcatgttggaataagcaaacttccaagagcgagggcactcagccagaaggcacctatggcgagcaattggtgccagaactgtgcaatcaatctgagtcatccggcgaggatttctttcttaagagcaggctacaggaacaagacgtatggcggaggtccaccagtttttacacacatatgtgcaacccctgggtcagcctgctcggcgccgtggggagtctcctcattatgtttgtaatccagtgggtctatacactagttaacatgggggtagccgctatagtttacttctatatcggccgggctagcccaggcctgcacctgggatccgctagcaatttctctttctttcgatggatgcgcagtctcttactcccgagctgccggagcctgcgctcgcctcaggagcaaataattctcgcaccctcacttgccaaggtcgatatggaaatgactcaattgacacaggagaatgccgactttgccacaagggacaggtaccatcacagcagtcttgtgaatagggaacagctgatgccacattactag

SEQ ID NO: 46092 - DNA, 2145 bp, Artificial Sequence
  Description of Artificial Sequence: Synthetic coding sequence
atgacccagatgagccaggtgcaggagctgttccacgaggccgcccaacaggacgctcttgctcagcctcagccatggtggaagacccagctgtttatgtgggagccagtgctgttcgggacttgggatggagtgtttaccagctgtatgattaacattttcggggtcgtgctgttcctgcggactggatggctggttggcaataccggcgttctcctcggcatgtttctggtttcttttgtaatacttgtagccttagtgaccgtgctgtctggcatcggagttggtgaacggtccagtattgggtctggaggggtgtactccatgattagtagcgtgttgggcggacagacaggagggacaatcggattgttgtacgtcttcggccagtgcgttgctggcgccatgtacattaccggctttgctgagagcatctctgatctcctcggtctcggaaacatctgggcagtgagaggaatcagtgtggcagtcctactggcgctgttggggattaatttggcaggagtcaaatggataatcagactccagttgcttcttcttttcttactggcagtgtcaaccctggactttgttgtgggcagttttacccacctggacccagaacacggcttcattgggtacagccccgagttacttcagaataacaccctccctgattactctcctggcgagtcatttttcacggtgtttggcgtgttcttccccgcagctaccggggttatggcagggttcaacatgggcggtgacctgcgtgagccggcggcctcaattcctccagggtccctggcagcagtagggatctcatggtttctttatattatttttgttttcctccttggggctatatgcactcgcgaggcgctgagatatgactttttgatagctgagaaggttagcctaatggggtttctctttctgttggggttatatatatctagcctcgccagttgtatgggcggcctgtatggagcaccacgaattttacagtgcattgcacaggagaaggtcattcccgcactcgcctgcctcggccaagggaaaggcccaaacaagacccccgttgcagccatctgcctcaccagtctcgtcaccatggctttcgtatttgtggggcaagtgaatgtgctggcacccatcgtgacgatcaacttcatgctgacttatgtcgcagttgactacagttatttctcactgagcatgtgttcttgcagccttactccagttcctgagcctgtcctgcgggaaggcgccgagggattgcactgctctgaacacctgctgctcgagaaggccccctcctatggctcggaaggccctgctcaacgcgttctggaaggcacactattggaattcaccaaggacatggaccagctgctgcagttaactcgcaagctggagagtagccaaccaaggcagggcgaaggaaaccggacccccgagtcccagaaaaggaaatccaagaaggccacaaagcaaacgctccaggacagcttcctgctcgacttgaaatcacccccctcattccctgtggagatttctgatcgcctgccagcagcatcttgggagggccaggagagctgttggaataagcaaacttctaagtctgaaggtacacagcctgaaggcacctatggtgaacagctagtccccgaactgtgcaaccagagcgagtcatcaggggaagactttttcttgaagagtcgcctccaggaacaagacgtgtggcgaagatcaacctccttttacacacatatgtgtaatccctgggttagcctcctgggcgctgtggggtccctcttgattatgttcgtcatccaatgggtctatacacttgttaatatgggtgtcgccgctatcgtctatttttatatcgggagagcatcaccaggactccacctggggtctgccagcaatttctccttctttaggtggatgagatctctgctcctccctagctgcaggagtctccgttctccccaggagcagataattctggccccctccttagccaaggtggatatggagatgacacaattaacacaggagaatgcagatttcgccactcgtgacaggtaccaccattcctcccttgtgaaccgagaacagctgatgcctcattattag

SEQ ID NO: 46093 - DNA, 1617 bp, Artificial Sequence
  Description of Artificial Sequence: Synthetic coding sequence
atggccagcgagagcagccccctgctggcctaccggctgctgggcgaggaaggagtcgcactgccagcgaatggggctggggggcctgggggcgcttccgccaggaaactgtcaacatttctgggggttgtggtccctacagtgttatccatgttttctatagttgtgttcctacgcatcgacgcaaccggcccttctggccttcgggtgttgcctcagggctacggatggaacttgctctatggatcgctcttgttaggcttagtcgggggtgtgtgtacgttgggcgcaggcctgtacgcgcgggcgagcttcctcacattcttgttagtctctggaagtctcgcaagcgtgttgattagcttcgtcgctgtcggccctagggatattaggctaacgccacggcctgggccaaatggctcctccttacctcctagatttggccacttcacaggtttcaactccagtacactgaaagacaatctcggcgccggctacgccgaggactacaccaccggcgccgttatgaatttcgcatctgtgtttgccgtgctttttaacggatgtacaggcatcatggcgggggcgaacatgagcggtgaactgaaggatccatcccgggctattcctctgggaactatagtagcagtggcgtacacatttttcgtttatgtgctgctattcttcctgtcctctttcacatgcgacaggaccttgctgcaggaggattacggtttcttcagagctatttccttatggccccccctggtcttgatcggaatctatgccaccgccctctccgcttccatgtcgtctctcataggggcctcccgtatcctgcacgccctggctcgggacgacttatttggtgtgatcctggctccagctaaggtggtcagtcgagggggcaatccttgggccgctgtcctttattcatggggcctcgtgcagttggtgctcctggcagggaagctcaacacacttgccgcagtagttaccgtgttttatctggttgcctacgccgcagtagatctctcatgcctttccttggagtgggcctccgcacccaacttccgaccgacattctcgttgttctcgtggcatacatgcctcctgggcgtcgcaagttgcctgcttatgatgttccttatcagtcccggagcagctggcggttcactgctgttgatgggtctactggccgctttgctcactgcgaggggcggaccaagctcttgggggtacgtttcgcaggcgctactcttccaccaggtgcgaaagtatcttttgagactggatgtgaggaaagaccatgttaaattttggaggccccagctgctgctgctcgtaggaaatcccaggggtgcactgccattgctgaggctggctaaccagctgaaaaaaggagggttgtacgtgctgggccacgttacattgggcgacttagatagcctgccttcagaccccgtccagccacagtacggcgcttggctttcccttgtcgatagagcgcaggttaaagcctttgtcgatctgaccctgagcccctccgtcagacagggtgctcagcacctgttgcgcatatcaggcctcgagtcaaattcacatcccctgccctag

SEQ ID NO: 46094 - DNA, 2745 bp, Artificial Sequence
  Description of Artificial Sequence: Synthetic coding sequence
atggccagcgagagcagccccctgctggcctaccggctgctgggcgaggagggggtggcattgcccgctaacggggccgggggacccggaggcgccagcgctcgaaagttgtctactttccttggcgtggtggtgcctacagtcctgtcaatgttctccatcgtggtgtttttgagaatcggcttcgtggtaggccacgccggactcctccaagcactggctatgctgctggtcgcttacttcattctcgccctgactgtactgagcgtgtgcgcaatagcaacgaatggcgccgtgcaaggcggcggagcctatttcatgatttccagaacattagggcccgaggtgggtggctcaatcggtctgatgttttatcttgctaacgtttgcgggtgcgctgtgagtttgctgggcctcgtagagtcagtcctcgacgtatttggcgccgacgcgactggccctagcggtctgcgagtcctgccccagggctatggatggaatctgctttacgggtcgctgcttttggggctggttggtggggtgtgcaccttgggagcgggtctctacgctcgcgctagctttctgacatttctccttgtctccggctccctggcaagtgtgctcatctctttcgtggccgtgggtcctcgcgacattcggctgaccccaaggcccgggccaaacggttcttcgttgcctccacgctttggccactttactggattcaatagctccactcttaaagataacctgggagctgggtacgccgaagactatactacgggcgctgttatgaatttcgcatctgtcttcgccgttctgttcaacggatgcacgggaattatggctggcgcgaatatgtctggcgagttgaaggacccatcccgcgctatccctctcggaacaatagtggccgtggcttatacttttttcgtgtacgtactgctatttttcttatcctcgttcacgtgtgatcgcaccctcttacaagaggactatggttttttccgcgccattagtctctggcctcctcttgtgctgatcggcatttacgctactgccttaagcgcatcgatgtctagtttgattggagcaagtcgaatcctgcatgcactggcccgagatgacttattcggcgtaattctggctccggctaaggtggtatcacgcggtggcaatccttgggctgctgtactctactcttggggactggtgcaactggttttgcttgctggaaaactgaataccctcgcggcagtggtcaccgtgttctacttggttgcctatgccgccgtggacctgagctgtctgtccctggagtgggcaagtgctccaaattttagacccaccttcagcctgttcagttggcacacctgcctgctgggtgttgcctcatgtctgcttatgatgttcctcatctccccaggcgccgctggcggatccctgctgttgatggggcttctcgcggccctcctgacagccagggggggtccttcttcctgggggtatgtatctcaggcactcctgttccatcaggtgagaaaatatctattaaggcttgacgtcagaaaagatcatgtgaagttttggcgcccacagctgttgctgctggtggggaatccgcgcggcgcactcccattacttcgacttgccaaccaactgaaaaaaggggggttgtatgtactcggacacgtcacactgggagacctcgattcgcttccctcagacccagtgcagccgcaatatggcgcatggttgtcattagtggatcgcgctcaggtgaaggcgttcgtggacctgacactgtcgcccagcgtaagacaaggagctcagcacctcttgagaattagcgggctgggcgggatgaaacctaacaccctcgtcctgggattttacgacgacgcgcctccgcaagatcatttccttacagacccagcattctccgagcccgcagactcaaccagagagggatcttctccagcactctcaacgctgttcccccctccaagagctccagggtcaccacgcgctctcaaccctcaggactatgttgcgactgtggcagatgccctgaagatgaacaagaatgtggtccttgccagagcctccggtgccctgccaccggaaaggcttagcagaggatctggtggcacaagccagttgcatcatgtggatgtgtggcccctgaatctcctccggccccgcggcgggccaggatatgtcgacgtgtgcggtctgtttctgctccaaatggctaccattcttgggatggtgcctgcctggcattctgccagactacgcattttcctctgtctgggcccacgggaggctcccggagctgccgaaggaaggttgagagccttactaagccagctgagaatacgagccgaggtccaggaggttgtatggggcgagggggccggtgctggcgaaccagaggccgaggaagaaggcgattttgtcaactcaggacgtggcgacgcggaggcagaggccctcgcgcgctcagccaatgcattggttagggctcaacagggtaggggaactggggggggccctgggggaccagaaggcggagacgctgaaggacctatcaccgcgcttactttcttgtatttaccgaggccccctgccgatcccgcccggtacccccgctacctggccctccttgaaaccctgacaagagacttgggaccgaccctccttgtgcatggcgtgaccccagtgacttgtactgacctgtag

SEQ ID NO: 46095 - DNA, 1617 bp, Artificial Sequence
  Description of Artificial Sequence: Synthetic coding sequence
atggccagcgagagcagccccctgctggcctaccggctgctgggcgaagagggagtcgctttgcctgctaatggagccgggggccctggcggagcctccgcgcggaagctctccaccttcctcggggttgtggtgcccacggtgctgtcaatgttttctattgtcgtgtttttgcgcattgatgcaactgggccttccggtctgcgagtcctgccacaaggatatggctggaacctgctgtacgggtcacttctactaggattggtgggaggcgtgtgtacgttgggggcagggctttatgcacgtgccagcttcctaacatttttgctggtgtccgggtctttggcctctgtactaattagcttcgtggccgtcggacccagagatattaggcttaccccacgcccagggcccaatgggagctctttacctccccggttcgggcatttcactggattcaatagcagtacactcaaagacaatttgggggccgggtatgcggaagactacaccacaggcgctgttatgaatttcgcaagcgtttttgcagtgctgtttaatggttgtaccggtatcatggctggtgccaatatgagcggcgaactcaaggacccctccagagccatccccctggggactatcgtcgccgtggcatatacattcttcgtttacgtgctcttattcttcttaagtagctttacatgtgataggacgttgctccaggaggactacggattttttagagctatcagcttatggcctcccttggtgctgattggcatctatgccaccgccttgtctgcatccatgagttccttgattggggcatctcgcatactccatgcactggcacgagatgatttatttggggtaatcctcgcgcccgctaaagttgtctctcggggcggtaacccctgggcagcggttctgtattcttggggcctggtccagctcgtgctgttagccggcaagttaaacactctcgccgccgtcgtgactgtgttttacctggtggcctacgccgccgttgacctgtcatgcttatctctcgagtgggcaagtgcgccgaactttcgccctacattcagtctgttctcatggcacacttgtctacttggggtggccagctgcttgttgatgatgtttttgatatctccgggcgctgcaggcggctcattgctgctgatggggttactagccgctctcttaaccgccaggggaggaccctcttcctgggggtacgtatctcaggcattgctgttccaccaagtgagaaagtacctcttaaggcttgatgtgcgcaaggaccatgttaaattttggcgcccgcagctattgttattggtggggaaccctcgcggcgcacttcccctactgcgactcgccaatcagctgaaaaaaggcggtctatacgtgctggggcacgttacacttggcgacctggatagccttccttccgaccctgtgcaaccccagtacggggcctggctctccctggtggatcgtgcccaagtgaaggcttttgtcgaccttactctgtcccccagcgtacggcagggggcccaacacctgttgcggatttctggactggagagcaattcgcatcccctgccttag

SEQ ID NO: 46096 - DNA, 1884 bp, Artificial Sequence
  Description of Artificial Sequence: Synthetic coding sequence
atggccagcgagagcagccccctgctggcctaccggctgctgggcgaggaaggcgtggctctccctgcgaatggtgcaggcggccctggcggagcttctgccagaaagctatcaacgttcctgggcgttgttgttcctaccgtgctcagcatgttctcaattgttgtttttctgcggatcggcttcgttgtgggtcatgccggactactccaggcactggcaatgctgcttgtggcttattttatattagctttaactgtattgtcagtatgcgccattgctaccaacggagcagttcagggtgggggcgcttactttatgatcagtaggacactgggccctgaggtcggcgggtctattgggttgatgttttaccttgcaaacgtttgcggatgtgccgttagcctgctgggcctcgtcgagtctgttctggacgttttcggagccgatgcaactggccccagcggactccgcgtgctgcctcaaggatatggctggaatctactgtacgggagtctgctgctcggcctggtgggtggtgtgtgtactcttggcgccggcctctacgcacgagcatccttcctcacgttcttgcttgtcagcggttcactcgcaagcgtgctaatctcttttgtggcagtgggtccacgggacatccggttgacccccaggccagggcccaacggctcttctttaccgcctcggtttggacatttcacagggtttaactcttctacactcaaggataacctgggagctggctacgccgaggactacacaaccggcgccgtcatgaatttcgcctccgtgtttgctgtgctctttaatggatgcacagggatcatggctggggctaacatgtccggcgaactcaaagacccatctcgcgcgatccctttagggacaatcgtggctgttgcatacacattcttcgtgtatgtcctcctgttttttctctcgtcttttacatgtgatcggactttgctccaagaagactacggattcttccgcgcgatcagcttgtggccccccttagtgctcatcggcatctacgctacagcactttccgcatctatgagcagcctgatcggcgcatccagaattctgcatgcgctagcccgggatgacctctttggcgtaatcctggcaccagccaaagtggtgagtcggggagggaatccttgggcagcagtgctgtattcctggggactggttcaattagtacttctggcaggaaagttaaatacactggccgcagtggtgacagttttctatctcgtcgcatatgctgcagttgatttgtcatgtctatccctggagtgggcttcagctccaaacttccgccccactttcagtcttttcagctggcatacctgtctgttgggagtggctagctgcttgctgatgatgttcctcatctccccaggcgctgcaggcggaagccttctgctcatgggcctactggccgccctgctgaccgccaggggaggaccttcgagctggggctatgtgagccaagctctgcttttccatcaagtaagaaagtacctcctgcggctggatgttcggaaagaccacgtgaagttctggcgccctcagcttctgctactcgtcggaaaccctaggggcgcgctgcctttactacgccttgctaatcaactgaaaaagggtgggttgtacgtcctcggccatgtgaccctgggtgacctagattcgctgccctccgatccagtacagcctcagtatggagcatggctgagcctcgtcgatagagctcaggtcaaggcctttgtggatctgacattaagcccgtcagttcgacaaggcgctcaacacctgttgcggatctcaggactggaatcaaatagccatcccttgccatag

SEQ ID NO: 46097 - DNA, 390 bp, Artificial Sequence
  Description of Artificial Sequence: Synthetic coding sequence
atggccagcgagagcagccccctgctggcctaccggctgctgggcgaggaaggggtggctctcccagccaacggtgcaggtggtccgggcggtgcaagcgcgcgaaaactatcgacgttcctgggcgttgttgttccaacggtgctttccatgttctccattgtggtgtttcttaggatcggtttcgttgttggtcacgcgggactgctccaggcccttgccatgcttctcgtggcctattttattcttgccctcacggtgctctctgtgtgcgccatcgccacaaacggcgcagtgcaaggaggcggggcctacttcatgatttccagaaccttaggccccgaggtggggggctctatcggtctaatgttttatctggcaaatgtgtag

SEQ ID NO: 46098 - DNA, 1461 bp, Artificial Sequence
  Description of Artificial Sequence: Synthetic coding sequence
cacttcggcgtgcactggcacagcctggtgttcaccggcatcctgggcgtgcattggcacttcggaaccacagcgcgtctactggccctggcacaactggtgcttctcgcggggaagctcaatacactggctgcggttgtcacagtgttctacttggtggcttacgctgctgtggacttatcctgcctttccctcgaatgggcctccgccccaaactttcgccccaccttctccctgttttcatggcacacatgcttgctgggcgtcgccagttgtttactgatgatgttcctgattagtcctggagctgccgggggttcattactcctcatgggcctcttggcagccctgcttacagctaggggaggaccaagttcatgggggtacgtttcgcaggccctccttttccatcaggtacgcaagtatttacttcgtctcgacgtcaggaaagatcatgtcaaattctggcggcctcagctgctgctactggtgggaaatcctagaggagcgttgcccctcctgagattagctaaccagctgaagaaaggaggactctacgtcctgggacacgtcaccctcggcgaccttgactctctgccctctgacccagttcagcctcagtacggcgcgtggctcagcctggtggaccgggcccaggttaaggcatttgtggaccttaccctctcaccctctgtgagacagggcgctcaacatcttctacgtatctcaggtctgggaggaatgaagccgaacactctggtcctcggtttctacgatgatgcccccccccaggatcattttcttaccgatcctgccttttccgaaccggccgattccactcgtgaaggtagctcacctgcattatcaacgctgttcccccctccaagggccccaggctcgccacgcgcactgaatccccaggattatgtggctaccgtggctgacgccctgaaaatgaataagaacgtggtgctggcacgcgcctccggagcgctgcctcctgaacgcctaagcagaggatctgggggtaccagccaactacatcacgtcgatgtgtggcccctgaatctgctaaggccacggggcggacctggctatgtggacgtgtgcggacttttcctgcttcagatggccaccatcttgggaatggtaccagcatggcactccgctcggctacgcattttcctttgcctcggtccccgggaagctcccggagccgctgagggtcggctccgtgcgcttcttagtcagctgcgtataagagctgaagtccaagaagtagtttggggtgagggggccggggccggtgaaccagaagccgaagaggagggggactttgttaattcagggagaggtgacgctgaggcggaggccctcgccaggtccgctaatgcactggtacgcgcccagcaagggagacacagacgcagggctggatgggccggcggctggggctgttag

SEQ ID NO: 46099 - DNA, 1896 bp, Artificial Sequence
  Description of Artificial Sequence: Synthetic coding sequence
atggccagcgagagcagccccctgctggcctaccggctgctgggcgaagaaggcgtagccttacctgcaaacggagctggaggacctggcggggctagcgccagaaaactgagtaccttcctgggggtcgtagttcccaccgttttgtctatgttttccatcgtcgttttcctcaggatcgggtttgttgtgggccatgcaggtcttctgcaggccctagctatgctcttggttgcctacttcattctggcgctaaccgttctgtcagtgtgcgccatcgcaaccaatggcgcagttcagggcggcggagcttatttcatgatcagccggactctgggcccggaagtcgggggatcaatcggcctgatgttttacctggcaaacgtctgcggatgtgccgtgtccctgttagggcttgtggagagcgtgcttgatgtcttcggcgctgatgcgactgggccttctggtttgagggttttaccacaggggtatggttggaacctgctctatggctctcttttgctgggcctcgttggcggggtgtgcactctcggggccggcctgtacgctcgtgcttcattcctgacttttttgttggtgtccggctctctcgcttctgtactgatcagcttcgttgcagtcggaccacgcgatatcaggttgactccacgtcccgggccaaatgggagttctctgcctcctaggttcgggcacttcactggcttcaattcctcaaccttgaaggacaatctcggggcgggctatgccgaagactataccacaggggccgtgatgaactttgcttctgttttcgccgtactgttcaacggctgcacgggcatcatggcaggtgccaatatgtcaggcgaactcaaggacccatctcgagcaattcccctgggtaccatcgtcgccgtggcgtacactttcttcgtgtacgtgcttctctttttcctcagtagttttacatgcgataggacactgcttcaagaagactacggcttcttccgcgccatctcgctgtggcctcctctggtcctaatcgggatttacgctactgcactcagcgcatcgatgagcagcttgattggcgcgagtagaattttacatgctctggcacgggacgacctttttggggttatcctggcccctgctaaggtggtgagcaggggcggcaacccatgggctgccgtgctctactcttggggcctggtacagctggtcctgttggccggaaagctaaacacattagccgcagtggtcaccgtcttctatttagtcgcttatgctgccgtggacctgagctgcctctccctagagtgggcctctgcaccaaacttccgccctacattctctctgttttcttggcatacgtgtctgctgggcgtcgcctcttgtctgctcatgatgttcttgatctcgcccggtgcggctgggggatccctactactgatgggtttgttggcagccctactgactgccagagggggacctagctcttggggatatgtaagtcaggccttgttgttccatcaagtgcgaaagtatctgcttcggcttgatgtgaggaaggaccacgtcaaattctggaggccccaactgttattattggtggggaaccctaggggcgccttgcccctcctgaggttggcgaaccagctcaagaaaggtggactctacgtcctgggccacgtcacccttggcgacctggacagtctaccttccgatccggtgcagccacagtacggggcatggctctctctcgtcgaccgcgcacaggtgaaggccttcgtggatctcacgttgtcccccagtgtgaggcaaggcgctcaacacctgctccgcataagtgggctggaaagtggcaccttactcccatggggctttcgctcctag

SEQ ID NO: 46100 - DNA, 2097 bp, Artificial Sequence
  Description of Artificial Sequence: Synthetic coding sequence
atgaaccccttccagaagaacgagagcaaggagaccctgttcagccccgtctcaatcgaagaagtgcctccccgccccccgtccccacctaaaaagccatctcctacgatctgtgggagcaattatccgctctctatcgcattcatagtggttaatgagttttgcgaaaggttttcttactacggcatgaaagccgtcttgatactgtacttcctgtatttcctgcactggaacgaggacacttctacctctatctatcacgcttttagctccctctgctatttcacgcctattctgggcgccgcgatcgctgacagttggttaggcaaattcaaagtcttgtctttgatagggctctctctgatcgcattgggaaccggtggcattaaaccctgcgtcgccgcattcgggggggatcagtttgaagagaagcatgcggaggagagaacacgttacttttcagtattctatctcagcatcaatgcgggctcactcatctcaactttcattaccccaatgctgcgaggagatgtgcaatgcttcggagaggactgctatgctctcgccttcggggtgcctggcctgctgatggttatagccctcgtggttttcgcaatggggtcaaagatctataacaaacccccccctgagggcaatattgtggcccaagtgtttaagtgtatttggtttgcaataagtaacaggttcaagaacagaagcggagacattccaaagagacagcattggcttgattgggcagctgagaagtaccctaagcaactgataatggatgtgaaggccctgacacgagtcctctttctctacatccctctgccaatgttttgggccttgctagatcagcaaggcagcaggtggacactccaggcaattcgaatgaatcgcaacctggggtttttcgtgctccagcccgatcagatgcaggtgctcaatccacttcttgtgctgatctttatccccctgttcgatttcgttatctatcgccttgtgtccaaatgtggaatcaacttctcaagcctgcgcaagatggctgtgggcatgatactggcttgcctcgcattcgcggtggcggctgccgtggaaatcaagattaacgaaatggctccggcacagccagggccccaggaggtcttcctacaggttctcaatctggctgatgatgaagtgaaggtcaccgtggtggggaacgagaacaacagtctcctaattgaatcaattaagtcatttcagaaaaccccccactatagcaagctgcatctcaaaaccaagagccaggactttcattttcacctcaagtaccacaacctgtctttgtataccgaacactcagtgcaggagaaaaattggtactccctcgtgatcagagaagacggaaatagcatttcgagtatgatggtaaaagacactgaaagtaggaccaccaacggtatgaccacagttaggttcgtaaacaccctccacaaggacgtgaatatttccctgagtaccgacacctcactgaatgtcggagaagattacggagtctccgcctatcgcaccgtgcagaggggggagtaccctgctgtgcattgtcggacagaagataaaaacttttcactgaacctggggctgcttgactttggagcagcctacctgttcgtaataaccaataatacgaaccagggactgcaagcatggaagatcgaggacatcccagcaaacaaaatgagtattgcctggcagcttccccagtatgctctggtcaccgctggcgaagtgatgttttccgttacaggtcttgaattcagttacagtcaggcacccagttccatgaagtccgtccttcaggccgcatggctgttgactatcgctgttgggaacataatcgtgttagtggtggcgcagttctccggacttgtacagtgggccgaattcatcctctttagctgtctgctcctggtgatatgtctgatcttctccatcatggggtattactatgtcccagtgaaaactgaggacatgcgaggccccgctgataaacatatacctcatatccagggcaatatgattaagctcgaaacgaaaaagaccaagttatag

SEQ ID NO: 46101 - DNA, 2190 bp, Artificial Sequence
  Description of Artificial Sequence: Synthetic coding sequence
atgaaccccttccagaagaacgagagcaaggagaccctgttcagcccagtgtctatagaagaggttcctccaaggccaccgagtccaccgaaaaaaccgtcacctactatttgcggatctaattatcctctgagcatagccttcatagtggttaacgaattctgtgagcgtttcagctattacggcatgaaggccgttctaatactttatttcctctactttctgcattggaatgaagacacctccacttccatttatcacgcctttagctcactgtgctacttcacccccattctgggggccgcgattgccgacagctggttaggcaaatttaaaaccatcatctatctgtcactcgtttacgttctgggtcacgtgatcaagagtctgggcgcattgcctatcctcggcggccaggtggtgcacacggtgctttccttaattgggctctctttgatagccctcggcaccggtggtatcaagccctgtgtggctgcctttggtggggatcagttcgaagagaaacacgccgaggaacgaacacgttactttagcgtgttttacctcagcattaacgcaggatcgctgatctccacatttatcaccccgatgctccgcggagatgttcaatgcttcggcgaggactgctacgctcttgcattcggcgtgcctgggttgctcatggtgatcgcccttgtcgtctttgcaatgggaagtaaaatctataataagcccccccctgagggaaacattgtcgcacaggtttttaagtgcatctggttcgccatttcaaatcgattcaaaaaccggtctggtgacatacccaagagacagcactggctcgactgggctgcagaaaaatacccgaagcagctgattatggatgtgaaagcccttactcgggtgcttttcttgtatatccccctgcccatgttctgggccctccttgaccagcagggatcacgatggacactgcaggcgatccgcatgaatcggaacctcggattcttcgttctccaacctgatcagatgcaagtgttgaatccgctcttagtgcttattttcattcctctttttgacttcgtcatttaccgtttggtatcaaagtgtggtataaacttttcctctctgaggaaaatggccgtgggcatgattttagcatgcctggccttcgccgtggcagccgccgttgaaataaaaatcaacgaaatggcacctgcacagccaggacctcaggaagtctttctgcaagtgctcaatctagctgacgacgaggtcaaagtgacagtggttggcaacgagaacaactccctcctgattgagagtatcaagtcatttcagaaaaccccccactattctaaattacatctcaaaacaaagagccaggattttcattttcatcttaagtaccataatctcagtctgtataccgagcactcagtgcaggaaaaaaactggtactccctggtgattagggaggacggcaatagcatcagtagcatgatggtgaaagacaccgagagccgaactactaacgggatgacaactgtgaggttcgtgaatacactccacaaggacgttaatatctctctctctacagatacttcgcttaatgtaggcgaggattatggcgtttcagcctaccgtaccgtacagaggggcgagtaccccgccgtgcattgtaggaccgaagataaaaacttctcccttaacttggggctattagactttggagcagcctatttgttcgtgattacgaataacacgaatcaagggctgcaggcttggaagatagaagatattccagctaacaaaatgtccatcgcgtggcagcttccgcagtacgcgcttgttacagctggcgaggtaatgttcagcgtgactgggctggagttctcatactcccaggccccaagcagtatgaagagtgtgctgcaggctgcctggttgctcacgattgctgtagggaacataattgtgttggttgtagcacagtttagcgggctggtgcagtgggccgaatttatcttgttttcgtgcctgctgctagtgatttgtctgatcttcagcatcatgggttactattacgtgccggttaaaacggaagatatgaggggaccggcggacaaacatattccccacatccagggaaacatgatcaaactcgaaacgaagaagaccaagctctag

SEQ ID NO: 46102 - DNA, 2076 bp, Artificial Sequence
  Description of Artificial Sequence: Synthetic coding sequence
atgagcccccggaagctgttcttccccgtgagcatcgaggaggtgcccccacgtccaccttccccaccgaaaaaaccgagccccacgatttgcggctcgaactacccattaagtattgctttcattgtcgtcaatgagttctgcgagcgcttcagttactatgggatgaaagccgtattgatcctgtacttcttatatttcctgcattggaacgaggatacttcgactagtatttatcatgccttctccagtttatgttactttacacccatccttggtgcagctattgctgattcgtggctcggcaaatttaaggtgcttagcttgatcggcctgtccttaatcgcactgggtacagggggaatcaaaccttgcgtcgcagcattcggcggcgaccaattcgaggaaaaacatgctgaagaaaggacacgttactttagcgtgttttatctcagcattaacgcaggaagtctgatcagcaccttcattacccctatgctgcggggcgatgtacagtgttttggtgaggactgttacgctcttgcctttggtgtacccggcttactaatggtcattgccttggtggtgttcgctatgggaagcaagatttataacaaacctcctcccgagggtaacatcgtggcccaagtgtttaagtgtatctggttcgcaatctccaatcgcttcaaaaacaggagcggagatataccaaaaaggcaacactggctagactgggcagccgaaaaatatccgaagcaactgattatggatgtcaaggcattgacacgcgtgctgtttttatacatccccttaccaatgttttgggctctcttggaccaacaggggagccggtggacattgcaggcaatcagaatgaaccggaatctcgggttctttgtccttcaacctgatcagatgcaggttctaaacccgttactggtgctcatcttcatcccactattcgacttcgtaatttaccgtctggttagcaagtgtggcattaatttcagttctctcagaaagatggcagtcggaatgatcttagcctgcctcgccttcgccgtcgccgccgctgtcgagatcaagatcaatgagatggccccagcgcagccgggtccgcaggaggtattcctccaggtgttgaatttggcggatgatgaagtgaaggtgaccgtggtaggaaacgagaacaacagcttgttgatcgagagtatcaagagcttccagaaaacaccccactactctaagctccacctaaagactaaatctcaggactttcacttccaccttaaataccacaacctgagtctctatactgagcatagtgtccaagagaagaactggtattcactggttatacgagaggacggaaactcaatctccagcatgatggtgaaagacaccgaatcacggaccaccaacgggatgaccaccgtgcgctttgtgaacactctacacaaagacgtcaacattagcctgtctactgacactagtttaaacgtcggggaggattatggggtgagtgcgtacagaactgtgcagcggggtgagtatccagctgtacattgcagaaccgaggacaagaacttcagcctgaacctaggactccttgactttggggccgcctacctcttcgtcataactaataacaccaaccaaggactgcaagcgtggaagatcgaggacattccagccaataaaatgagtattgcgtggcaactgccgcagtatgcactcgtaacggcaggagaagtgatgttttctgttactggattagagttttcatactcacaagctccttcctctatgaagtccgttctgcaagccgcatggttactaactatcgccgttggcaacattatagtgttggtggtagcccagtttagcggtctcgtgcagtgggcggagttcatcctgttctcgtgcctcctgctcgttatctgtttgatcttcagcataatgggttattattatgtaccagtgaagacggaagacatgaggggtccagccgacaagcacattccccatatccagggcaatatgataaaattggagactaaaaaaacaaagctgtag

SEQ ID NO: 46103 - DNA, 1506 bp, Artificial Sequence
  Description of Artificial Sequence: Synthetic coding sequence
atggccgccagctggcggctgggctgcgacccccggctgctgcggtacctggtgggttttcctgggagacgatcagtgggactggtgaagggggcgctgggatggtcggtgagccgcggggccaattggcgttggtttcatagtactcagtggctgcgcggggatccaatcaaaatcttaatgcctagtctgtctcccactatggaggagggaaatattgtcaaatggctcaagaaggaaggagaggccgtgtctgcaggggatgcgctgtgcgagatcgaaaccgacaaagccgtggtaaccttagacgcctccgatgacgggatactggcaaagatagtggtcgaagaaggttcgaagaatatccgcttaggaagtttaatcggactaatcgtcgaagagggcgaggactggaagcatgtcgagatacctaaggacgtaggacccccgcctccagtctctaaaccatcggagcctcgcccgagccctgaaccccagattagtatccctgttaagaaggagcatatacccggaacattaaggttccggctgagtccagccgcaagaaacattctcgaaaagcattcattggatgctagccaggggaccgcaacaggaccaaggggcatctttaccaaagaggacgcactcaagctcgtccaactcaagcaaactggtaaaatcacggagagccgccccactcccgctccaaccgccacacccacagccccctcccctctgcaggcaacagctgggccttcctaccctaggccagttatccctcccgttagcacgcccggacagcctaacgcagtcggtactttcaccgagatcccagccagtaatattcgcagggtgatagccaagcgactgaccgaatcaaaaagcaccgtcccacatgcctacgctacggctgattgcgacctcggcgccgtgttgaaggtgagacaggacctggtcaaagatgatatcaaagtctccgttaacgacttcattataaaggctgccgcagtgacactgaaacaaatgcccgatgtgaatgtgagctgggacggagaggggccaaaacaacttcccttcatcgacatatcagtggctgtggcaacggacaaagggctcctgacaccaatcatcaaagacgctgcagctaaaggcatccaggaaattgccgattctgtaaaggcattgtccaagaaggcacgggacggtaagctccttcccgaggagtaccagggcggatccttttccatatcaaacctgggcatgtttggcatcgacgaatttacagccgtcatcaatccaccgcaggcatgcatcctcgctgtgggcagattccgccccgtactgaagctgaccgaggatgaggagggcaatgcgaagctccagcagagacaactgattactgtcaccatgtccagcgacagcagggtcgtggacgacgaactcgccacacgattcctcaaatccttcaaggctaacctggaaaaccccatccggctcgcttag

SEQ ID NO: 46104 - DNA, 942 bp, Artificial Sequence
  Description of Artificial Sequence: Synthetic coding sequence
atgcccgccccccgggcccgggagcagccccgggtgcccggcgagcgccaacctctgctgccgagaggcgcaaggggtcccagacgatggagaagggccgccggagctgccgtgctgctggtggaaatgttagaaagggccgcgttctttggagtaactgctaacctcgtgttatacctgaacagcaccaattttaactggaccggggaacaggccactagagccgcattggtgttcctgggcgctagttatctcctggccccagtgggcggctggctggcggatgtgtacttgggtcgctatcgggcagtggccctgtccttgttactgtacctggcagctagtggcctcttaccagctacagcgttccctgatgggaggtcttccttctgtggtgagatgcccgcctccccactgggcccggcctgtccatccgcagggtgcccccgctcctctccatctccctactgtgctccggttctgtacgctggtctgctgctgttgggactggcagcttcctctgtccggagcaacctgacgagctttggagcagatcaagtgatggacctggggagggatgccacgcgccggttttttaattggttcacgggggcctctacatgggtgctgtgctgtagatgttggtggtggcggctcttctcccgcacatcagcgtcctgctgggccacagcctccctgtgggccgtatgggcatggcacttttcctccagctcattgccccccccctcctcctcccctagcccgcgctgggctgccaagtgccccctctgcttatcaagtctgtcaaaaaccgcggcccccagttgcggaaatgatacccggcccgagaccgtgaatgttcccgcatgctggccgacaaggggcctgccatctcaggggctccccagaaaacggacaagtccaaccagtagatgctggtag

SEQ ID NO: 46105 - DNA, 1734 bp, Artificial Sequence
  Description of Artificial Sequence: Synthetic coding sequence
atggagggcagcggcggcggcgccggcgagcgggcccccctgctgggcgctcggagggccgctgcggccgctgctgcagctggagctttcgcagggcgaagagccgcctgcggggcggtgctcttaaccgaattgttagagagggctgcattttacggtataacctccaacctagtcctatttttaaatggggctccgttctgctgggagggtgcccaggcttcagaagcgcttctcttatttatgggcctgacataccttggaagcccatttggcggatggctcgctgacgcgaggctcggtcgggcacgtgccattttgctgtccctggctttgtacctgcttggcatgctggcattccccctcctggccgcacccgcaacacgtgccgccttgtgtggcagcgccaggctgctgaattgtaccgcccctggtcctgacgctgccgccaggtgctgcagcccagcgactttcgccgggctggtacttgtgggtctcggcgttgctacagtgaaggctaacattacaccctttggagcagatcaagttaaggacaggggaccagaggctacccgtagattctttaactggttttactggtccatcaaccttggagccatcctgtctctggggggcattgcctatatccagcaaaatgttagttttgtcaccggctatgctattcctactgtgtgcgtcggtctagcttttgtcgtgtttttgtgcggccagagtgtattcatcactaaaccccccgacggttctgccttcacagatatgttcaagattctgacgtactcatgctgctcccaaaaacggagtggcgagaggcagagcaatggagaaggaattggggtgtttcaacaaagttctaaacagtcactcttcgatagctgtaagatgtctcatggcggtccgtttacggaagagaaagtggaggacgtgaaggctcttgtgaagatcgttcccgttttcctggccctcatcccctactggactgtttacttccagatgcagaccacgtatgtgttacaatcgctccacctacggattcccgagatcagcaacataacaacaactccacacaccctcccggctgcttggctcaccatgtttgacgcagttctaattctgctgctgattccgctcaaagataagctcgtggatcccatccttagacgtcatgggctgctccctagcagcttaaaacggattgctgtgggaatgttttttgtgatgtgctcagccttcgccgctggcatactggaatccaaacgcctgaatttagtgaaggaaaagacgattaaccagacaatcggcaacgttgtgtatcacgctgctgacctttcgctctggtggcaagtgcctcaataccttctgatcggtatctcagaaatcttcgctagcatagccggactggagttcgcctactccgccgcacccaaatcgatgcagtctgccatcatggggttatttttttttttctccggcgtcggatcgttcgtaggaagtggtctgctggcgctcgtgtccataaaagctattggatggatgtcttctcatacagactttggcaacattaacggttgctaccttaactactatttcttcctgctcgctgccattcaaggagccacactgctgttatttttgataatatctgtgaaatacgaccatcatcgcgatcatcagaggtcacgcgccaacggcgtcccaaccagcagacgtgcctag

SEQ ID NO: 46106 - DNA, 1320 bp, Artificial Sequence
  Description of Artificial Sequence: Synthetic coding sequence
atgctgaagcgggagggcaaggtgcagccctacaccaagaccctggacgggggctgggggtggatgatagttatacacttttttctggtcaacgtatttgtaatgggaatgaccaaaacatttgccatcttttttgttgtgtttcaggaggaatttgaggggacctccgaacagattggctggattgggtccatcatgtcaagcctgaggttttgtgcgggcttgggctccgcgtttttgtatcaggtggcggcagtggtgacaaccaaatactttaagaaacgcctcgccctttccactgcgattgcaaggtccgggatgggcctcactttcctactagcgccattcacgaaattccttattgacctgtacgactggacaggagccctgatactgttcggggctatcgccttgaatttggttccctctagcatgctcttgcggcctattcacattaagtccgaaaacaacagcggtatcaaggataaagggtccagcctgagtgcgcacggccctgaggctcatgccactgagacccactgtcacgaaacggaggaaagcacaatcaaagatagcacaactcaaaaagctggactgccatccaaaaatctcacagtgagtcagaaccagtctgaggagttttacaatgggcctaacaggaaccgtctgctgctcaagagcgatgaggaatccgacaaggtgatttcctggagctgcaaacagctattcgacatttctttgtttcggaacccatttttctatattttcacatggtcctttctgctttctcagctagcatatttcatcccaacgtttcacttggtggctcgcgccaagacactcggtatcgatatcatggatgcgtcttacctcgtcagcgtcgcagggattctggaaacggtaagtcaaattatcagcggttgggtagctgaccagaactggatcaaaaaatatcactaccacaaaagttacctcatcctgtgtggcatcaccaatctgctcgccccattagcaactaccttcccccttctgatgacatatacaatttgcttcgcaatcttcgcggggggctacctcgcactaatactgcctgtgctcgtcgatttgtgtcgaaacagcactgtcaacagattcttaggtttggcatctttcttcgctgggatggctgtgctatctggaccaccaattgccgggtggctctatgattacacccagacctacaatggttctttctatttctcggggatctgctacctgttgagcagtgtgtcattttttttcgtgccactggctgaacgctggaagaattccctgacttag

SEQ ID NO: 46107 - DNA, 1416 bp, Artificial Sequence
  Description of Artificial Sequence: Synthetic coding sequence
atgcccgccccccagcggaagcaccggcggggcggcttcagccacagatgctttcctacccctcaaactgctatgaccccgcaaccagctgggcctccagatggggggtggggttgggtggttgccgcagccgccttcgccatcaacggactgagctacggcctgctgaggagcctgggacttgccttccctgacctggcggaacattttgacaggagcgcacaagataccgcctggatctctgctctggctctggctgtgcagcaggctgccagtcctgtggggagcgcattatccacgagatggggggccagacctgtggtgatggttgggggtgtactggcctccctggggttcgtattctcggccttcgcttcagaccttctgcatctgtacctggggttggggctcctggctgggttcggatgggctctagtgtttgccccagctctggggaccctgtcgaggtatttttccaggaggagagttctcgctgttgggctggcattgacaggaaatggggctagtagcctactactagcccccgccctacagctgctgttagatacgttcggatggcggggagcactgttgctgctcggcgcaatcaccctgcaccttacaccttgcggcgccttgctgttgcctttagtgcttcccggggacccgccagctcctccacgcagcccactggctgcgctggggttgtctctgtttactaggagagcttttagcatattcgctctgggcaccgccctcgtcggcggtggatattttgtcccctacgtgcacctggctccccacgctcttgataggggccttggggggtatggcgctgccctagtagttgctgtagccgccatgggagacgcgggagcccggctcgtgtgcggctggcttgccgaccagggatgggttccactcccaagactgctcgccgtgttcggggcactgaccggactgggcctctgggtggtcggactggtgcctgtagttggcggtgaggagtcctggggcggccccctgctcgcggcagctgtcgcctatggacttagcgctggtagttacgccccgcttgtgtttggtgttctaccagggctcgtcggtgtgggtggcgtggtccaggccaccggactcgttatgatgctgatgagtctgggcggacttttgggccccccattatcagggttcctgagggatgagaccggtgactttacagccagcttcctattgtccggttcactcatcctgagcggaagctttatttatatcggtctgccaagagcactgccatcttgtggccccgcgtcaccccctgccacacctcctccagagactggggagttgctgcccgccccccaggcagtgctgctatctcccggaggccctggctcgacgttggacaccacctgttag

SEQ ID NO: 46108 - DNA, 1320 bp, Artificial Sequence
  Description of Artificial Sequence: Synthetic coding sequence
atgaccccccagcccgccggcccccccgacggcggctggggctgggtggtggccgctgccgcatttgcaattaacggcttatcttatggactgctgcggtcactgggcttggcttttccagacctcgccgaacactttgaccggagcgctcaggatacagcttggatttccgcgctcgccctagctgtgcagcaagctgcgtccccggtgggatctgcccttagcactcgctggggagctcgccccgtggtcatggtggggggggtgctcgcatcactgggttttgtattctcagcctttgccagcgatttgttacacttgtacctcgggttagggcttcttgccggatttggttgggccctggtctttgcccctgccctgggcacactaagcagatactttagcagacggagagtactggcggtcgggttggcgctgactggcaatggcgcttcatcactactcctcgccccagcactacaactgctgttggatacttttggatggcggggggcattgctcttattaggcgccatcaccttacacctgacaccctgtggcgccctgctgttacccttggtcctgcccggagatccccctgcaccccctagaagccctctggccgcactgggactgtctctgtttactcggcgggcctttagcatcttcgccctgggtaccgcactagtgggcggaggctactttgtaccttatgttcatcttgccccacacgccttggatagaggattaggtgggtatggagcagcgcttgttgtcgccgtagccgccatgggcgatgccggtgcacgtcttgtgtgtgggtggttagcggaccagggctgggtaccccttcccaggctactggctgtctttggagctctcacggggctggggctgtgggtagtgggtctttcttggggtggccctctcttagcggccgccgtggcctatggcctgagtgccggatcttacgctcctcttgtctttggcgtattgccaggactagtgggagttgggggagtcgtgcaagcaacaggcttggttatgatgctcatgagtctgggtggactgctgggcccccctctttcaggatttttgcgggacgaaacgggcgacttcactgctagctttctgttatccggctcactcatcttaagcggcagcttcatctacattggactacctcgggcactacccagttgcggccctgcttcacctcccgccacacctcctcccgagaccggggagctcctgcctgccccccaggcagtgttgctttcgccaggcggtcctgggtcgactcttgatacaacatgctag

SEQ ID NO: 46109 - DNA, 1281 bp, Artificial Sequence
  Description of Artificial Sequence: Synthetic coding sequence
atggcccggcggaccgagccccccgacggcggctggggctgggtggttgtgctgagtgccttctttcagagcgcactggttttcggggtgcttaggagctttggggtgtttttcgtagagtttgtcgctgcctttgaagagcaggcggccagggtctcttggattgcttccatcggcatcgctgtccagcagtttggcagccctgttgggagcgccctctctactaaatttggacctaggccagtggtcatgacaggcggcatcttagccgccctgggtatgctgctagccagctttgcaacatccttgactcacctctatctctccatcggcctcctaagtggcagtggctgggcattgacttttgctcctactctggcttgtctgtcttgctacttttctagacgtcgctccctcgccacagggctggcactgactggagtgggcctgagcagtttcacatttgcaccattcttccagtggctgttatcccactacgcatggagaggatcacttcttcttgtgagtgcactcagcttgcacctcgtggcgtgcggagctttgctccgcccaccttctcttgccgaggaccctgctgttggtgggcccagggcacagctgaccagtctgcttcaccatggccctttcctgcggtatacagtggccctcacgctcattaacaccggttactttatcccctatctgcacctggtagcccatctacaggacttggattgggacccactgccagctgcattcctactatccgtagtggcaatctcagatctcgtgggccgagtggtatccgggtggctgggagacgctgttcccgggcccgtgacacgccttctgatgctgtggacaacactgactggcgtttctctcgcgctatttccagtcgcgcaggccccgacagccttagtggccctggctgtcgcctacggctttacaagcggagctttggctcctttggcattctctgtcctaccagaacttatcgggacccggcggatctattgcggtttgggcctcctccagatgatagagagcatcggcggacttctgggtccaccgttgagcgggtacctcagggacgtgaccggtaactatactgcctctttcgtggtggctggtgcattcctgctcagtggtagcggtatcctactgacgttgccgcacttcttctgcttttccacgacaactagcgggccccaggatttagtcaccgaagcactcgacaccaaagtgcctctcccaaaggaggggcttgaggaggattag

SEQ ID NO: 46110 - DNA, 1533 bp, Artificial Sequence
  Description of Artificial Sequence: Synthetic coding sequence
atgtacaccagccacgaggacatcggctacgacttcgaggacggccctaaggataagaagaccttaaagccccaccccaacattgatggaggctgggcctggatgatggtcctgagctcattctttgtgcatatcttaataatgggaagtcagatggcattaggtgttttgaatgtggaatggctcgaggagttccaccaatctaggggtttgactgcatgggtgagttctttgagcatgggaataacactaatcgtgggcccttttatcggtctgtttataaatacatgtggatgtagacagactgccatcattggtggactggtaaattccctgggttgggtgcttagtgcctacgcagccaatgtgcattatctctttattacctttggagtggcggccggcctaggctccggaatggcttatctgcccgccgtcgtgatggtgggtagatacttccaaaagagaagggccctggcccaggggctcagtaccactggcaccggttttggcactttccttatgactgttctcctgaagtatctttgtgcagaatacggatggcgtaacgcgatgctgattcagggtgctgttagtctgaatttatgcgtgtgcggcgccctaatgcgcccactctcccctggcaagaacccaaacgatcccggcgagaaggacgtgcgcggacttcccgcacattctactgaaagtgtcaagagcactggacagcagggaagaaccgaagaaaaggatggagggctggggaatgaggaaactctatgtgaccttcaggcgcaagaatgcccagaccaggccggtcacaggaaaaacatgtgtgctttgcggatcctaaagacggtgagctggttaactatgagggtcagaaagggttttgaggattggtattctggctattttgggacagcttccctgtttaccaaccgaatgttcgtggcctttatcttttgggctctctttgcctactcttcctttgtcataccttttatccacctgcccgagatcgtcaatttgtacaacctgtccgaacagaatgacgtctttcctttgacatctataatcgctatagtgcatatcttcggcaaagtgatcctcggggttatcgctgatctcccatgtatatccgtgtggaatgtgttcctgctggccaacttcacattggttctatctatctttatcctgccattaatgcacacctacgccgggttggctgttatttgcgcattgattggctttagcagcggatactttagccttatgcccgtggtgactgaagacctggtagggatcgagcacttggcaaacgcatacgggattataatttgtgccaatggtatttcggcgctgctcggcccaccatttgcaggctggatttacgacattacccagaaatatgacttcagtttctacatttgcggtctcctctacatgataggaattctgttcctcctcatccaaccttgcattaggattattgagcaatctcgtcgcaagtacatggatggcgcccatgtatag

SEQ ID NO: 46111 - DNA, 1458 bp, Artificial Sequence
  Description of Artificial Sequence: Synthetic coding sequence
atgtacaccagccacgaggacatcggctacgacttcgaggacggccccaaagataagaaaaccctcaaacctcaccctaatattgatggtggatgggcttggatgatggttctctcttccttttttgtgcacattttaataatgggttcccagatggccctaggtgtgctaaacgtcgagtggctggaggaattccatcaatctagaggcttaaccgcctgggtgagttccctgtcaatggggatcaccctgatagttggaccattcatcggcctctttattaacacctgcggatgtcgccagacagctattataggtgggctcgtgaatagcctcggttgggtgctcagtgcttatgctgccaacgtacactatctttttataaccttcggagttgcagctgggctggggagtggtatggcttatctacctgcagttgtgatggttggaaggtacttccagaaaaggcgggcgcttgctcaaggcctctccactactggtactggatttggaacttttctgatgaccgtattactaaaatatttatgcgccgagtatggttggcgcaacgcgatgctgatacagggagccgtttcgttgaacctgtgcgtgtgtggagcccttatgcggcccctcagcccaggaaagaacccaaacgaccctggagagaaggatgtaagagggctccccgcccatagcaccgaaagcgttaagtcgaccggacagcaaggccgcaccgaggaaaaagatggggggctgggcaatgaagagaccctctgtgacttgcaagcccaagaatgtcccgatcaggctgggcaccgaaagaatatgtgcgccctgcgcattctaaagaccgtgtcttggctaactatgagagtgagaaagggattcgaagattggtattcagggtacttcggtactgcttcattattcactaataggatgtttgttgccttcatcttctgggctctcttcgcttattcgtctttcgtaatacctttcatacacctgccagaaatagtcaacttgtacaacctttccgagcagaatgacgtctttcctcttacaagcattatcgctatcgtgcacatatttgggaaggtgatccttggagtgatcgcagacctcccgtgtatctccgtatggaatgtgttcctgctggctaacttcacattggtcctgagcatcttcattctgcccctgatgcatacctacgccggactcgctgtcatttgcgccctgatcggattctctagcggttatttcagcctcatgcctgttgtgaccgaggaccttgttggaatcgaacatctggcaaatgcctacggaatcattatttgtgccaacggaatcagtgccctgctcggccctccgtttgccggcaagctgtctgaagtgctaagggcccaaagcgcatgcacatacggtgcgctctgctataaagtccccgataagtag

SEQ ID NO: 46112 - DNA, 129 bp, Artificial Sequence
  Description of Artificial Sequence: Synthetic coding sequence
atgtacaccagccacgaggacatcggctacgacttcgaggacggccccaaggataagaaaacactcaaaccccaccctaacatagacgggggctgggcatggatgatggtgctgagtagctttttctag

SEQ ID NO: 46113 - DNA, 57 bp, Artificial Sequence
  Description of Artificial Sequence: Synthetic coding sequence
atgtacaccagccacgaggacatcggctacgacttcgaggacggccctaaggactag

SEQ ID NO: 46114 - DNA, 1470 bp, Artificial Sequence
  Description of Artificial Sequence: Synthetic coding sequence
atgtacaccagccacgaggacatcggctacgacttcgaggacggcccaaaggataagaagaccctaaagcctcaccctaatattgacggcggctgggcgtggatgatggtgctttcttcattttttgtccatatacttatcatgggttctcagatggctttgggtgttcttaatgtggagtggctcgaggaatttcaccagtcccgcgggctcactgcttgggtgtcaagcttatcaatgggcatcacattgatcgtcggaccttttataggacttttcatcaatacctgtgggtgtcgtcaaaccgccattattgggggcctggtcaacagccttgggtgggtgctctccgcctacgctgctaatgtccactacttgttcatcacattcggggttgcggccggcctcggctccggcatggcataccttccagcggtagtaatggtgggaagatactttcaaaaaagacgcgccctggcacaggggttgagcacaacaggcacaggcttcggcactttcttaatgacagttctgctgaaatatctctgtgccgaatatggttggcggaacgccatgctgattcaaggcgccgtatcccttaacctctgcgtgtgcggcgctctgatgcggcccctgagcccaggaaagaacccgaacgatcccggagaaaaggatgtccggggcctgccagctcactcaacggaatcagtgaaatccactggccagcagggccggactgaagaaaaagatggaggcctcggcaatgaggaaaccctctgcgatctccaggcccaggagtgccctgatcaggcaggccacaggaaaaatatgtgcgcactgcgtatactgaaaactgtgagttggctcaccatgcgtgtgaggaaggggtttgaggattggtatagcggatactttggaaccgcctcactattcaccaatcggatgtttgttgcttttatcttttgggcccttttcgcctatagctccttcgtcatcccatttatccacctccctgagattgtgaacctctataatctgtccgagcagaacgatgttttccccttgacaagcatcattgcgatagttcatatctttggcaaagtgattctgggcgtcatcgccgatttaccgtgcatctccgtctggaatgtcttcctgctcgctaacttcacactcgtgctatccatctttatattgccactgatgcacacttatgccgggctggccgtaatatgcgccttgattggattttcctctggctacttcagcttgatgcctgtagttaccgaagacttggtgggaattgagcacctggcaaacgcgtacggaatcattatctgcgccaacggcatttctgccctcctcggtccacctttcgccgggaagttgtcagaggtgctgcgagcacagtctgcatgcacctatggcgccctgtgctataaagtgcctgacaaggaagaaggattctag

SEQ ID NO: 46115 - DNA, 1464 bp, Artificial Sequence
  Description of Artificial Sequence: Synthetic coding sequence
atgctgaagcgggagggcaaggtgcagccctacaccaagaccctggatggtggttgggggtggatgatcgtgattcactttttcctggtgaatgttttcgtcatgggtatgactaagaccttcgccattttctttgtcgtatttcaggaagagtttgagggtacaagtgagcaaatcggatggattggctccataatgagttcactgcgcttctgtgccggccctctggttgcgatcatctgtgacatcctgggcgagaagacaacatccattctaggcgcgtttgtcgtcactggtgggtacttgatctcgtcttgggctaccagtattccatttctatgcgttacaatgggcctgctgcccggcttgggatcagcatttctctaccaagtcgcagccgtggtgaccaccaaatatttcaagaagcgacttgccttgagtaccgcgatagccaggagtggcatgggcctcacctttctgcttgctccgttcactaaatttctgatcgatctttatgattggaccggtgccttgatcctgttcggcgccattgctttgaatctggtcccaagcagcatgctgctgcgacccatccatattaagtccgaaaataactccggaataaaggacaaaggatcctcactcagcgcgcacggacccgaggcgcatgccaccgagacccattgccacgagaccgaggagtctacaataaaagactctactacacaaaaggcgggcttgccttccaaaaatcttaccgtgtcccagaaccagtccgaggagttctacaacggtcccaatcgaaacagactgttactgaagagtgacgaagaatcagacaaggtcattagttggagctgcaagcagctgtttgacatttcgctgttcaggaatccatttttctatatttttacctggtctttcctgctgtctcaacttgcctatttcatacctacgtttcacctggttgctcgtgcaaaaacgctaggaattgacataatggatgcgagctatctcgtatctgttgcaggcatattggaaacagtcagccagattatatcgggttgggttgctgatcagaattggatcaaaaaatatcactaccacaagtcatatctcatcttgtgcggtattaccaatttactcgcacctctggccacaaccttcccccttctgatgacctacactatatgttttgcaatcttcgcggggggttatctggccctgatcctgcccgtcctcgttgatctttgcagaaattccaccgtcaatagattcctaggactcgcttctttttttgccggaatggcagtgttgtccggcccgcccatcgcaggttggctctacgactatacccaaacttataacgggagcttttatttttcaggcatatgctacttgctgagcagcgtgtctttcttctttgtcccattggcagagcgttggaagaattccttaacatag

SEQ ID NO: 46116 - DNA, 960 bp, Artificial Sequence
  Description of Artificial Sequence: Synthetic coding sequence
atgctgaagcgggagggcaaggtgcagccctacaccaagaccctggatggaggctggggttggatgatagtcatacatttctttttggtgaacgtattcgtgatgggcatgaccaaaacctttgccatattcttcgtcgtcttccaggaggagtttgaggggaccagcgaacagatcggctggattggttcaattatgagttcactgaggttctgtgcgggccctctggtggctattatttgtgatattcttggggagaagacaacctctattctaggcgcctttgtggtcaccggtggctatctcatcagttcatgggccaccagcatcccctttctttgtgttacgatgggactgttgcctggacttggatctgctttcctctatcaggtggctgctgttgttaccacaaaatacttcaagaagcggctcgcactgagtaccgccatagcacggtccggtatggggcttactttcctcctcgctccttttaccaaatttctcatcgacttatacgattggacgggcattttggaaacagttagccagatcatcagtgggtgggttgccgaccagaactggattaagaaataccattaccataaaagctatctcattctctgtggtattaccaacttgttggcccctctggccacgacattccccttgttgatgacctacaccatttgcttcgctatatttgccggcgggtacctggcgctcatcctaccagttcttgtggacctgtgtagaaattctactgtgaataggtttctggggttggcctcgttctttgccgggatggcagttttgagcggaccacctattgccggttggctgtatgactacacccagacttacaatggctctttttacttttccgggatatgctacttgttgtcgtccgttagtttctttttcgtaccactcgccgagcgctggaagaatagcctcacctag

SEQ ID NO: 46117 - DNA, 1149 bp, Artificial Sequence
  Description of Artificial Sequence: Synthetic coding sequence
atgggcatggacgactgcgacagcttcttccccggcctgggcagcgcatttctttaccaggtagccgcagtcgtgacaaccaagtactttaagaagcggctagcacttagcacggccattgcccgcagcggaatgggcttgacgttcctgctagccccttttactaagtttttgattgatctgtacgactggactggcgcattaatcttgtttggagcaatcgcactgaacctggtccctagttccatgctcctgagacccatacacatcaagagtgaaaacaacagtggcatcaaagacaagggctccagcctcagtgctcacggccctgaagcccacgctaccgagacccactgtcacgaaaccgaggaatccacaattaaagattcgacaactcagaaggctggcctaccatctaagaatctcaccgtaagtcaaaatcagtcagaggaattctacaatggtccgaatagaaatcggttactcctcaagtcagacgaggagtctgacaaagtcatatcttggtcttgtaaacagctgttcgatatctccttatttcggaaccctttcttctacatttttacttggtcctttctcctgtctcagcttgcatatttcatccctacattccacctggtggcacgggccaagaccttgggtattgatatcatggatgcatcatatttagtctcagtggctgggatcctggagacagtgtctcaaattatcagcggctgggtggctgatcagaactggataaagaaataccactaccacaaaagttatttaatactgtgtggcatcactaacttacttgcgcctctggcaaccacgttcccactactaatgacttacacgatatgtttcgcaatcttcgcaggagggtaccttgcactcattctgcctgttttggtagatctctgcagaaacagtacagtcaacagattcttaggtttggcatcatttttcgcgggaatggctgttctgtctggcccgccaatcgcagaaataattcccagtttccaggcaggctacatgatcattcctcgacacacaatggcccttagcacctcattggcttacgccatctcaagcttacagtttcccttcttcctttaccattggcctaaggacgggaagaccgtctag

SEQ ID NO: 46118 - DNA, 1278 bp, Artificial Sequence
  Description of Artificial Sequence: Synthetic coding sequence
atgggcatggacgactgcgacagcttcttccccggccccctggtggctatcatttgcgacattctgggagagaagactacctctatcctcggggcttttgtggttaccgggggttatcttatcagtagttgggctacttccatacccttcctctgtgtaaccatgggcctgcttcctggactgggtagcgccttcttgtaccaggtggctgccgtcgtgaccactaagtactttaaaaaacggctcgccctttcaactgctatcgcccgctccgggatggggctcaccttcctcctggctccctttacaaagttcctcatcgatctctacgattggacgggcgccttgatcctgttcggcgctattgcccttaatctagtgccctccagcatgctactgcggccaatccacatcaagtcagagaataattcaggaatcaaagacaaaggctccagcttatcagcacatggccctgaggctcacgcgaccgaaacccattgccatgaaaccgaggaaagtaccataaaagattccactacacagaaagctgggctgcctagcaaaaatctgaccgtttcccagaaccagtctgaggaattctacaatggccctaataggaataggttactcctgaaatcagacgaggagagcgataaagtgatttcctggagctgcaagcaactttttgacatctcactctttcgaaatccgtttttttatatcttcacgtggagcttcctcttgagccaactggcctatttcattcccacgtttcatctggttgctcgggctaagaccctaggtatcgacatcatggacgctagctacctcgtgagcgtggccggcatcttggaaacggtctctcaaatcattagcggctgggtggcagaccaaaattggattaaaaagtatcactatcacaaatcgtatcttatcctttgtggtataactaaccttctggctccgctggccaccacattccccttgttgatgacctatacaatttgttttgcaatattcgccggaggatacctggctctcatccttccagtgttagtagatttgtgccgtaatagtacagtcaaccgatttctgggattggctagttttttcgcaggcatggccgtcctgtcaggccccccaattgcaggatggctgtacgattatactcaaacttacaatggatccttttacttcagtggcatttgttacctcctaagttcggtgtccttttttttcgttccactagcagagagatggaagaattcccttacctag

SEQ ID NO: 46119 - DNA, 1518 bp, Artificial Sequence
  Description of Artificial Sequence: Synthetic coding sequence
atgccccaggccctggagcgggccgacggcagctgggcctgggtggtcctgcttgccactatggtcacccaaggactgacccttggtttccctacctgcataggtattttctttacagagctccagtgggaattccaggccagtaatagtgaaacctcgtggttcccgtccatcctgacagcagtgttgcatatggctggtcctctctgttccatcctcgtgggccgattcgggtgtcgggtgaccgtgatgctaggcggagtcctggcttctttaggtatggttgcatccagttttagtcacaacttgagccagctgtattttacagcgggctttattacaggccttgggatgtgctttagctttcagtcttccataaccgtgttgggattttattttgtccgtagaagggtgctcgctaacgcactggcgtctatgggggtgagcctggggatcactctttggccactgctatctcgctatcttctggagaacctgggctggcgaggtacatttttggtcttcggtggcatatttctgcactgctgcatttgcggcgcgataatccgccctgtggcaacctcggtggctcctgaaacaaaagaatgcccgccaccaccccctgagactcccgcccttggctgtttagcagcctgcgggcggaccatccaacgccacttggcctttgatatccttagacataacaccggatactgcgtgtatatcttgggagttatgtggtcggtcctgggcttccccctgcctcaagtgttcctcgtcccgtatgctatgtggcattcggtggacgaacagcaggccgccctactgatttctatcatcggcttttcgaatattttcctcaggcctctagcaggcttgatggcagggcgacctgcattcgctagccatcgcaagtacctgttttccctcgccctgctcctgaacggacttaccaaccttgtgtgcgcagcttccggtgacttttgggttctggtcggctactgcctggcctacagtgtgtcaatgtccgggatcggggccctcatttttcaggtgctaatggatattgtgcctatggatcagtttccacgggctctcggcctgttcactgtgctggacggccttgcatttttaatttctcctcctttagccggcctgctcctcgatgcaacaaacaactttagttacgtcttctacatgtcctcctttttccttatctcggccgctctgtttatgggaggctccttttacgctctgcaaaaaaaagagcagggcaaacaggccgtcgcagcggacgctctcgaaagagatctctttctcgaggcaaaggacgggcccgggaagcaacgcagtcccgaaatcatgtgccaatctagtagacaacctcgtcctgccggagttaacaagcacttatggggctgccccgcctccagcaggacctcgcacgaatggttgctttggccaaaggctgttctgcaggccaaacagacggcactgggttggaacagtcctacgtag

SEQ ID NO: 46120 - DNA, 1518 bp, Artificial Sequence
  Description of Artificial Sequence: Synthetic coding sequence
atgccccaggccctggagcgggccgacggcagctgggcctgggtggtcctgttggcgaccatggttactcagggtctgacattgggcttccccacttgtattgggatctttttcaccgagctgcagtgggagttccaggcgtctaattcagagacctcgtggttcccgagcattctgactgctgtcctccatatggctggcccactctgctccatactggtgggacggtttgggtgccgggtgactgtcatgttggggggcgtcctcgcttcactgggcatggttgcttcctcgttttcccacaacctctctcaactttactttaccgccggctttatcaccggactgggcatgtgtttttcttttcagtcaagcatcacagtgctgggattctactttgtgagaaggagggtcctagccaacgcactggcttctatgggcgtgagtttgggcattactctgtggccgctgctctctaggtatctactggagaatttgggatggaggggaacgtttttggtttttggcggcatctttctgcattgctgcatctgcggcgctataatcagaccggtggctacaagcgtcgcaccggagacgaaagagtgccctccaccgccacctgagacacctgctctgggatgtctcgctgcctgcggtcggactattcagcggcatctcgcctttgacattctgaggcataatacagggtactgcgtgtatatcctaggggtaatgtggtccgtgctgggatttcccttaccacaagttttcctggtgccctatgccatgtggcactcagttgatgagcagcaggccgcgcttctgatcagtattattgggttcagcaacatcttccttagacccctcgcgggcctgatggccggcaggcctgccttcgcatcacaccggaaatacctgttttccctcgccctgctgctgaatggactaaccaatctggtgtgcgccgcctccggcgacttttgggtgctagtgggatactgcctcgcttatagcgtgagcatgagcgggattggcgccctaattttccaggtgcttatggacatcgttcccatggaccaattcccacgcgccttgggtctcttcaccgtgctggatgggcttgcgtttctaatttcccctcccttagccggactgctccttgacgccactaataacttttcctacgtattctacatgtcctcgttctttctgatttctgcggccttattcatgggtggctccttttacgctttgcagaagaaggaacaagggaagcaggctgtcgctgccgatgccctggagagagacctgtttctcgaggccaaggacgggcccggcaaacagcggagccccgagatcatgtgtcagtcctccagacagccccgtcctgccggggtcaataaacacttgtggggctgtcccgcatccagcagaaccagtcatgaatggctcctctggcctaaagctgtgctccaggcaaaacagactgccctcggctggaactctcctacatag

SEQ ID NO: 46121 - DNA, 1503 bp, Artificial Sequence
  Description of Artificial Sequence: Synthetic coding sequence
atgccccggcccacccggggccccctggccaccagccagggctggtgtccttctgtcactcctgggacttgggcggctgccaccctcgcggttagaccctggcagagacggcagcagcggatgccccaagcacttgagagagccgacggctcatgggcctgggtggtactgctggcaactatggtgactcagggtctaacactgggattccctacgtgcatcgggatattttttacagagctgcagtgggagttccaggcgagcaatagcgagaccagttggttccccagcatcctgactgcggtcttgcacatggctggccccctgtgtagcatactcgttggcagatttggatgtcgtgtcacagtcatgctggggggcgtcttagcatcactggggatggtggctagctctttctcacataatctaagccagttgtactttacggctggatttatcaccggactgggcatgtgcttcagttttcagagttccatcaccgtgctgggcttttacttcgttcgaagacgggttctcgcaaatgccctggccagcatgggggtgtccctcggcatcactctatggccacttctgtccaggtatctcctcgaaaacttgggctggagagggacctttctggtttttggtggaatctttctgcactgctgtatttgtggcgctattatccggccagtcgccaccagcgttgctccagagactaaggaatgcccccctcctccccccgagacgccagcgttaggctgcctggccgcttgcggcaggactatccagaggcacctcgccttcgacatcctgaggcacaacacaggctattgcgtttacatcttaggggtgatgtggtccgtactggggttcccattacctcaggttttccttgttccctatgctatgtggcattcggtcgacgaacaacaggcggccctgctgataagcatcataggcttttctaacatcttcttgcgccccctggctggcctcatggcaggcaggcccgctttcgctagccacaggaagtaccttttcagtttagcgcttctactaaatggactgaccaacctggtgtgtgccgcaagcggcgacttctgggtactagtggggtactgcctggcgtactctgtgagtatgtccggcattggagcccttatcttccaggtcctcatggatatcgtgcctatggaccagttcccaagggccctgggactctttactgttctggacggactggcttttcttatctcacctccactcgccggacttctgctggacgctactaataacttctcatacgtcttctacatgagctcatttttccttattagtgcagccctatttatgggcgggagtttttatgcgctccagaaaaaggaacagggtaaacaagcagttgctgcagatgccctcgaacgagacctgtttttggaagcaaaggacggccctggaaaacagcggtctcctgagataatgtacgtcacgtctgtatag

SEQ ID NO: 46122 - DNA, 1572 bp, Artificial Sequence
  Description of Artificial Sequence: Synthetic coding sequence
atgacccagaacaagctgaagctgtgcagcaaggccaacgtgtacaccgaggtgcctgatggcggatggggctgggctgtagctgtgtcttttttcttcgttgaggttttcacttatggcatcattaagacctttggcgtcttttttaacgatctcatggatagtttcaacgagagtaacagtagaatttcatggattatatcgatttgtgtgtttgtactaacatttagcgctcctctggctaccgttttatccaatcgctttggacaccggctggtggtgatgttgggcggtctcctggtctctaccgggatggtagctgcctccttttcccaggaggtgagccatatgtatgttgccatcggtataatttcaggattggggtattgcttttcctttctgccaacagttacaatcctctcacaatacttcggtaaaagaagaagcatcgtgaccgcggtggcctctacaggtgaatgttttgcagtgttcgcctttgcccctgctattatggccctgaaagagcgaatcgggtggcgctactcgttgctgtttgtggggctactccaattgaatatcgtgattttcggagccctactgcggcccatttttattcgagggccggcttcccctaaaatcgtgattcaggagaaccgcaaggaggcacagtacatgctggagaacgagaaaaccagaacgtcaatagactcgatcgatagtggcgtagagctaacaacctctccaaagaacgttcctacacatacgaatctggagctggaacccaaagccgacatgcagcaggtgttagttaagacctcccctcggccttccgagaaaaaagcccccctgctggatttttccattctcaaagagaagtccttcatatgctacgcattatttggtttgttcgccacactgggtttcttcgccccttcactttacatcatccccttgggaatcagtctcggaattgatcaggatagggccgccttcctgctgagtacaatggctatcgccgaggtgtttgggcggattggggctggtttcgtgctcaaccgggaacccattaggaagatctacatagaactaatttgcgttatcctcctgactgtgagccttttcgcgtttaccttcgctaccgaattctggggactgatgtcatgcagcattttctttgggtttatggtgggcaccatcggcggcacacatataccgctgctggcagaggatgacgtggtggggatcgagaagatgtctagcgccgccggagtttacatttttatccagtctatcgcgggcttagccgggccccccctggcagggttgctggttgaccagtcaaaaatctattctcgggccttttatagctgcgccgccgggatggccctggccgcggtgtgtctggcactggtgaggccttgcaagatggggttatgtcagcatcatcattcaggcgagacaaaggtggtgagtcataggggaaagaccctccaagatattcctgaggatttcctggagatggaccttgccaagaatgaacacagagtgcacgtccaaatggaaccggtgtag

SEQ ID NO: 46123 - DNA, 1515 bp, Artificial Sequence
  Description of Artificial Sequence: Synthetic coding sequence
atgggcgccggcggcccccggcggggcgagggcccccccgacggcggatggggttgggtggtactcggcgcttgcttcgtggtgaccggtttcgcatatgggttccctaaagctgttagtgtgttttttcgcgcactcatgagagattttgacgctggctatagcgatacggcctgggtttcatccatcatgctggctatgctatatggaacaggcccggtgtcatctatcctagtcacacgcttcggatgtcggcctgtgatgctcgctggggggctattggctagcgcaggaatgatcttggctagtttcgctacccgtctgctggagctgtacctcaccgccggagtactgactggcctggggctggctctcaattttcagcccagtctgatcatgttagggttgtacttcgaacgtcgccgaccacttgcaaatggcttagccgctgcaggatctcccgtctttctctccgcgctgtctccgctgggacagcaactgctagagcgttttggatggcgaggtgggttcttgttgctaggaggtcttctgctccactgctgcgcatgcggggcagtcatgcggcccccaccaggtccgggacctcggccacggagggattctgccggagatagggcgggggacgcaccaggagaggccgaggctgatggggccggattgcagctgagggaggcctcccccagagtgagaccaagacggagactgctggacctagccgtttgcacagatagggccttcgccgtttatgctgtgaccaagtttctgatggccttagggctgtttgtgcccgctattcttctcgtcaactatgccaaggatgcgggggtccccgacactgatgccgcctttttgttatcgatcgtcgggttcgttgacatcgtggcacggccggcctgcggggcgttagcaggtctggcgagattgcgccctcacgttccttacctattctcacttgctttactagctaatggtctcacggacctcagtagtgcccgagctcggtcatatggagccctggtagccttttgcgtggcctttggtctgagctatggcatggtgggcgccttgcagtttgaggttctgatggcagcggtcggcgcaccacggttcccatcagccttgggcctagtgctgcttgtagaagccgcggcagtcctcatcggtcccccaagtgcaggccgtttagtagacgtgctcaagaattacgagattatcttctacctcgctggatccgaagttgcattggctggcgtcttcatggctgttgccacaaactgctgcctgagatgcgctaaagccgccccctcaggccctggcaccgagggaggtgcaagtgataccgaggatgccgaggccgaaggagactcggagccccttccagtggtggccgaagagcccggaaatttagaggctcttgaagtgctgagcgcacgaggcgagccaactgaacccgaaattgaggcccggccccgtttggctgcagagtctgtatag

SEQ ID NO: 46124 - DNA, 294 bp, Artificial Sequence
  Description of Artificial Sequence: Synthetic coding sequence
atgggcgccggcggcccccggcggggcgagggcccccccgacggcggttggggctgggttgtcctgggcgcatgtttcgtggtcacaggttttgcctacggttttccaaaagctgtatccgtgttcttcagagcgctgatgcgagatttcgacgcaggttattcggataccgcatgggtgtctagcattatgctcgccatgctgtacgggactgggcctgtctcttccatcctcgttacaaggttcggctgccgaccagtcatgctcgcgggcggtctgttggcgtctgcctag

SEQ ID NO: 46125 - DNA, 1500 bp, Artificial Sequence
  Description of Artificial Sequence: Synthetic coding sequence
atgctgcacgccctgctgcggagccggatgatccagggccggatcctacttttgaccatctgtgccgccgggataggagggactttccaattcgggtataacctgtccatcattaacgcgcccaccctccatattcaagaattcacaaatgagacctggcaggcccgcactggggaaccactccccgatcacctggtgctccttatgtggtccttaattgtgagtctttaccccttgggggggctctttggggcgctgttagccggtccattggctattacgctcggacgcaaaaaaagtctgcttgttaataatattttcgtcgtttctgcggccattctttttggattcagccggaaggccgggagtttcgagatgatcatgcttggcagattgcttgtgggggtcaatgccggggtgtctatgaatattcagcctatgtaccttggggagtctgccccaaaggagttaagaggcgcagtcgcaatgtcctctgccatcttcacagcattggggattgtgatgggccaggtggttggccttcgagagctgcttgggggcccgcaggcgtggcctctgctgttagcatcatgcctcgtccccggggcgctccaactcgcatcattgcccctgctccccgagagtcctcgctatctcctaatagattgtggagatactgaggcgtgtctcgccgcccttaggcggcttcgagggtcgggggacttggctggggaactcgaggagcttgaggaagaacgcgccgcttgccagggatgtagggcacgcaggccttgggaattgtttcagcatagagcacttagaaggcaagtcacgagcttagtcgtgctggggagcgcaatggagctgtgcggaaatgactctgtgtatgcctatgcctccagcgtgttcaggaaagcgggcgtcccggaggcaaaaatacagtacgcaattatcggcaccggctcatgcgagctcttgactgcggtggtgagctgcgtggtgattgaacgagtcggaagacgcgttctgctgatcggcggctattcacttatgacctgttggggttccatcttcacggtggccctgtgcttgcaaagctcgttcccatggactctctacctggcaatggcatgcatcttcgccttcatactgtccttcggaataggtcccgcgggcgtgacaggaattctggccacagaactcttcgatcagatggcacgccctgcagcttgtatggtatgtggggcgctgatgtggatcatgctgattctggtgggtctgggcttccctttcatcatggaggctttgtctcactttttgtacgtacctttccttggagtctgcgtgtgtggagccatctataccggcctgttcctgcctgagaccaaaggtaagacatttcaagagatttctaaggaactgcatcggttgaactttccccgccgcgctcagggaccgacgtggcgcagcctcgaggtgattcagagcaccgagctttag

SEQ ID NO: 46126 - DNA, 1491 bp, Artificial Sequence
  Description of Artificial Sequence: Synthetic coding sequence
atgcgggccctgcggcggctgatccagggccggatcctgctgctgacaatatgtgccgcaggcattggaggtacctttcagtttgggtacaacctatccatcatcaacgcacccacgctacatatccaggagtttacgaatgaaacgtggcaggctaggaccggtgaaccattacctgatcaccttgtcctgcttatgtggagcttgatcgtgagtctatatccactggggggcctgttcggagcactcctggctggccctcttgctattaccctgggccggaaaaaaagccttttggtgaataatatctttgttgtttctgcagctatcttgttcgggttctctcgcaaagcaggttcttttgagatgatcatgctcggccgtctgctggtgggggttaacgccggcgtgagtatgaacatccagcccatgtacctcggcgaatctgcccctaaagagctgcgcggggctgttgcgatgtcaagcgcgattttcacagccctcggaatagtgatgggccaggtggttgggctaagggagctcctgggcggaccccaggcttggcccttactgctggcctcctgcctggtgcccggcgccctgcagttggctagtcttcctcttttgcctgaatcaccacgctacctgctaatcgattgcggagacactgaagcttgcttggccgccttacggcggctgagagggtcaggcgatttagcgggcgaacttgaggaattggaagaggaaagagcggcttgccaggggtgtagggccagacggccgtgggagctgtttcagcacagggccctgaggcgtcaggttacaagtttggtagtgcttggaagtgccatggaactctgcggaaacgattctgtgtacgcctacgcatcttccgtgttccggaaagccggagttcctgaggccaaaattcagtatgcgattatcggcactggcagctgcgaactcctgacagctgtcgtgtcttgcgtggttattgaacgcgtgggccggagggttctgctgattggcggctactcactgatgacctgctggggcagcatttttactgtagccctttgtttacagagcagcttcccatggacactttatctagctatggcctgtatattcgcctttatcctatcctttggaattggtcccgctggcgtcacaggcatcctggccacagagttgtttgatcagatggctaggcctgccgcctgcatggtctgcggcgcactgatgtggattatgcttattctcgtggggctgggattcccctttatcatggaggccctttcccacttcctgtatgtgcccttcctgggcgtgtgtgtgtgcggagccatctacacgggcctctttctcccagaaacgaaggggaagacctttcaggagatcagcaaggagctgcatcgactgaatttcccccgacgggcccagggaccaacatggcggtctctggaggtgatccaatccaccgaattgtag

SEQ ID NO: 46127 - DNA, 1512 bp, Artificial Sequence
  Description of Artificial Sequence: Synthetic coding sequence
atggaggacgagctggagcccagcctgcggccccggacccagatccagggaagaatcctgctcctgactatttgtgccgccggaatcgggggcactttccagtttggatacaacttatctatcatcaatgcacctactctccacatccaggaattcacaaatgagacgtggcaggctcgcactggggagccactaccagaccacctcgtgctcctgatgtggagcctcatcgtctccttataccccctcggtggccttttcggcgccctgctggctggacctttggctatcactctgggccggaagaaatcactgctggttaacaatatatttgtggtgtctgccgctattttatttggcttttcacgaaaggctggttcatttgagatgattatgctgggaaggttactggtaggcgtcaatgccggagtaagcatgaacatccaacctatgtacttgggtgagtcagccccaaaggagctaagaggagctgttgcgatgagtagcgcaatttttactgcactcggtattgtgatgggccaggtagtgggcctgagagaattactgggaggacctcaggcttggcctctgttgctcgcatcatgcctggtacccggcgccttacagctggcctccctgcctttactcccggagtcccctaggtacttgctgatcgactgcggagacacggaagcctgtctggcagcgctgcgacgcctgcggggctctggcgaccttgcaggcgaattggaagagctggaggaggagagggcagcctgccaaggttgccgggcccgcagaccctgggaattatttcagcatcgcgcactgcgcagacaagtgactagcctcgttgttctcggaagcgcaatggaactgtgcggaaatgacagtgtgtacgcctatgctagttccgtgtttagaaaggctggcgtgccggaagcaaaaattcagtatgcgataattggtactggatcatgtgaattgctgacggcagtggtgagctgtgtagtaattgaacgcgttggcaggagggtgctgcttatcggtggatattccctgatgacgtgttgggggagtatatttactgtcgctctgtgtctgcaatcgtcctttccgtggaccctctacttagcaatggcatgcattttcgcctttatcctaagtttcggtatcgggcccgcaggcgtgaccggaatcctggccactgaactctttgatcagatggcacgtcctgccgcgtgcatggtgtgtggagcattgatgtggatcatgctaattctcgtcggacttggattccctttcattatggaggctctgtcacacttcctgtacgttcccttcttgggcgtttgcgtgtgtggagcgatatacaccgggctattcctgccagagaccaagggcaagaccttccaggagatcagcaaggaacttcataggttgaattttccacggagagcacagggcccaacatggcgcagcctggaagtcattcagtccacagagctgtag

SEQ ID NO: 46128 - DNA, 1104 bp, Artificial Sequence
  Description of Artificial Sequence: Synthetic coding sequence
atggaggacgagctggagcccagcctgcggccccggacccagatccagggacggatcctcctgttgactatttgcgccgctggcatcggcggaacctttcagttcggatacaatctctcgatcatcaatgccccgaccctgcatattcaggaattcaccaatgagacctggcaggcacgcacaggcgaaccgctgcctgaccacctcgttctcctcatgtggtccttgattgtgagcctgtatcccctgggggggctgttcggcgcactcctggctggtccactcgctatcactctgggacggaaaaagagtctcctggtgaacaacatctttgtcgtgagtgccgcaattctgttcggcttctctcggaaggcgggctctttcgagatgatcatgcttggaagattgctggtgggagtgaacgcaggcgtgagcatgaatattcagcctatgtacctgggggaatcagcgcctaaggagctaaggggagctgtcgctatgagttcagctatcttcacagctctgggtatagtaatggggcaggtagtggggctgcgagaattgctgggaggcccgcaggcatggccgttgctgcttgcctcatgccttgtaccaggagccttgcagctggcctctctgccactgctccccgagagtccaagatatctgctcattgattgcggcgataccgaagcttgtctcgcagccctgaggcggctgagaggcagcggcgacctcgccggagagctggaggaattggaagaagagcgcgccgcttgtcaaggatgtagagctagacggccatgggaactcttccagcaccgggctctgagacgccaagtgacaagcctagtggtattaggaagtgccatggagctctgtgggaacgattcagtttacgcctatgcaagctctgtatttcgcaaagcgggagtgcctgaagccaagatccagtacgcaatcatcgggaccggttcttgcgaacttctgacggcggtggtatcggtgtctctggaaggcgctctgccaccgcctgctttatgggggggcactccccggtcatccgcattaaaccaatttacactccaaaagaaaaaaaagtag

SEQ ID NO: 46129 - DNA, 1104 bp, Artificial Sequence
  Description of Artificial Sequence: Synthetic coding sequence
atgcgggccctgcggcggctgatccagggccggatcctgctgctgactatttgcgcagcaggtattggcggtacttttcaattcgggtataacttgtctatcataaacgccccaactctgcatattcaggagttcaccaacgaaacctggcaggcacggactggagagcctctgccagaccatctggttctcttgatgtggtccctgatcgtatctctgtatccacttggaggtctgtttggcgctctattagccggaccccttgccataaccctgggtagaaagaagagtctgctggtgaacaatatcttcgtggtttcagctgcaatcctctttggtttttccaggaaggccggatcattcgagatgatcatgctagggagactcttagtcggcgtgaacgccggcgtaagcatgaatattcagcctatgtatctcggggagagcgctcccaaagaactgcgtggggccgtggcaatgagtagcgcaatctttaccgccctaggcatcgtaatggggcaggtggtgggactgtctaccacagcagcccctggtttaaggggactcggccgtggagcaggaggagccggtggaggagctaggtgtctccccggactgccgtgccggccatgggagttgttccagcaccgcgccctgcgtaggcaagtcacgtcgctggtcgtgctcggatctgccatggaactgtgtggaaatgactccgtatacgcgtatgcttcaagcgtcttccggaaagcaggcgtgcctgaagctaaaatccagtatgctattatagggactggaagttgtgaattactgaccgcagtggtgtctgtgagcctggagggggcattgccacctcctgcactctggggcggaacaccgagaagctccgctcttaaccagtttacactgcagctcatggttctgaagtgttctgaaggccctggggccgttgcacatgcatgcaagcccagtaccctgggcgggagagggggatggatcaccaggtctggggtgcgtgaccagcccggacagcacagcgagactccagtgtcgacaaaaaagtataaaaaactttcacgcagagggggaggcaggctttag

SEQ ID NO: 46130 - DNA, 1392 bp, Artificial Sequence
  Description of Artificial Sequence: Synthetic coding sequence
atggaggacgagctggagcccagcctgcggccccggacccagatccagggacggatattactgctgaccatttgcgccgctggaatcggaggcacattccaatttggatataaccttagcataatcaatgcacccactttacatattcaggagtttacaaacgaaacttggcaagcacgaaccggcgagcccctgccagatcacctggtacttctgatgtggagcctgatcgtatcactttatcccctgggtggactcttcggggcgttactagctggcccccttgctattaccctaggaaggaaaaagagccttctcgtaaataatattttcgtcgtctctgccgctatacttttcggtttcagccggaaggccggatccttcgagatgataatgctcgggcggctgctggtgggtgtcaatgccggcgtctcaatgaatatccagcccatgtacctcggcgaatctgccccaaaggaactgaggggagccgttgccatgtcctccgcaatcttcacagccctgggcatcgtcatgggacaggtggtaggattgagagaactgctcggaggcccacaggcttggccattgcttctggcatcctgcctagttccgggcgcactccagctggcaagtctgcccttactccccgaaagtccacgctatctgctgattgattgcggcgatacagaagcgtgtctggctgccctgcgaagactgcgcggatctggtgatctggccggagagctcgaagaactagaagaggaaagagccgcctgccaggggtgccgagccagacgtccttgggagctgtttcagcaccgtgcactgcgccgccaggtcacctctctggttgtgttgggaagcgcgatggagctgtgcggcaacgacagtgtttatgcgtatgcctcctccgtgttccgcaaagcaggcgtgcctgaagcaaaaattcagtacgcgataatcggcacgggcagttgtgaactgctgacagcagtcgtcagtgttgccggtgtggatgagggatggggggttcaagcgggcctgactagcacatctcctcccccacggccccggcaatcgagctttccctggacattgtaccttgccatggcgtgcatcttcgcctttatattgtcatttggcatcggcccagccggcgttactgggatcttggcaaccgaactattcgatcagatggctcgccccgctgcctgcatggtatgtggagcactcatgtggatcatgctcatactcgttggattaggcttcccatttattatggtcttaggaagttttttgatcgctggcggactggttcccctaccactatgcccgttcccatggtgtctgtgcctctggggccacttgcactggccggtcccaagctag

SEQ ID NO: 46131 - DNA, 1854 bp, Artificial Sequence
  Description of Artificial Sequence: Synthetic coding sequence
atggtgcccgtggagaacaccgagggccccagcctgctgaaccagaagggcaccgccgtggaaacagaagggtcaggatcacgccatcccccatgggccagaggctgcggtatgttcacattcttgtcctccgttaccgctgccgtgtctgggcttttggttggctacgagctgggcatcatttcaggcgctctcctgcagattaagaccttactcgccctgtcctgccacgaacaggagatggttgtctcaagcctggtgataggcgccctcctggcgtcactgaccggcggggtcctcatcgatagatacggcaggagaacagccattatcctcagttcatgtttgctcggcttgggatcattagtgttaatactgtccctcagttataccgtgctcatcgtaggccggatcgccataggagtgtctatatctttgagcagcatcgcaacctgcgtctatattgccgagattgctcctcagcatcgtcgaggccttctggtgagtctgaacgagctgatgatcgttattgggatcctgtctgcttatatctcaaattatgcattcgccaacgtatttcatggttggaagtatatgttcggtttggtaattcctctgggagtcctccaggccatcgctatgtactttttgcccccctccccaaggttcctagtgatgaaaggccaggagggagccgcaagcaaagtgttaggtaggctaagggcactcagcgataccaccgaggaactcaccgttatcaaatcttccctaaaggacgagtaccagtatagtttttgggatctttttcggagcaaagataacatgcgcactcgcatcatgatcggtttgacacttgttttcttcgttcagatcaccgggcaacctaacattctgttttatgccagcaccgttctgaagagtgtgggattccagagtaacgaagcagctagcctggctagcaccggagttggcgtggtcaaagttatatccacgattccagcaacattactggtggatcatgtaggatccaagaccttcctgtgtattggatcttccgtgatggcagcatcactagtcactatgggcattgtgaacttgaatattcacatgaacttcacccacatttgccgaagccataattctatcaaccaaagcctagacgagtctgtgatctacggcccagggaacctgtcgactaacaataataccctgcgcgatcacttcaagggaatcagttctcactcgcgctcatccctgatgcctctcaggaacgacgtggacaagcggggtgaaacaacctccgccagcctgctgaacgcaggactgagccacaccgagtaccagattgtaaccgatccaggagacgttcccgcattccttaagtggcttagtttggcaagcctgcttgtgtacgtcgcagcattcagcatcggactagggcctatgccatggctcgtcctgtctgagatatttccgggaggtattagaggtagggccatggccctcacgagctcaatgaattggggaatcaatctcctgatttcgctcactttcctgactgtgacggatctaatagggttgccttgggtctgtttcatctataccataatgtcccttgctagtcttctgtttgttgtgatgtttatccccgagacgaagggctgttccttagagcagattagtatggaactcgcaaaggtgaattatgtgaaaaacaatatatgtttcatgagccatcaccaggaggagctcgtcccaaagcaaccacagaagcggaaaccacaggaacagctgctggaatgcaacaaactgtgtgggcgcggacagagtcggcagctctctcccgagacctag

SEQ ID NO: 46132 - DNA, 1656 bp, Artificial Sequence
  Description of Artificial Sequence: Synthetic coding sequence
atggcccagttcgtgcaggtgctggccgagatcggcgacttcggcaggtttcagatacagctcttaatcctcctttgtgtccttaatttcttatctcctttctactttttcgcgcatgtatttatggtgctggacgaaccacaccactgtgccgtggcatgggtcaaaaaccataccttcaatctctcggctgcagaacagctggttctaagcgtgcccctggatactgcaggtcacccagagccgtgcctgatgtttagaccgcctccggctaatgcctccttacaggatattctgagtcaccgcttcaatgagacgcaaccttgtgatatgggttgggagtatccagaaaacaggttgcctagtttgaagaacgagtttaatctggtatgtgacaggaagcatctcaaggataccactcagagcgtgtttatggctgggctcctcgtgggcaccctgatgtttggccctctgtgtgatcgcattggccgtaaggcgactattttagcccaactcctgttgtttacgttaattgggttagccaccgctttcgttcccagctttgaattatacatggccctacggtttgccgtcgctaccgcggttgcaggactgtctttttctaatgtgaccctgttgaccgagtgggtcgggccttcttggcgcacacaggccgttgtgctagcccaatgtaacttttcacttggccagatggtgttggcgggcctggcctatggattcaggaactggcggctcctgcaaattaccggcaccgcgcccgggttgctgctgttcttttatttctgggcactgcccgagtccgcccgctggctgctgaccaggggcagaatggacgaagcaattcaactgatacagaaagctgctagcgttaacagaagaaagctttcaccagagttgatgaatcagctggtccccgagaagactggtcctagcggtaacgcactggacctgtttagacacccacagttgcgcaaagttaccttgatcattttttgcgtgtggtttgtggattcactcggatattatggtctgagtctacaggtgggcgattttggattggacgtttaccttacacaactcatttttggagcagtggaggttccggccagatgcagctccatattcatgatgcaacggtttgggcgcaaatggagtcaactgggtactctggtcctcggcgggctcatgtgcatcatcattatatttattccagcagaccttcctgttgtagtaactatgttagccgtggtaggaaaaatggccacggccgcagccttcacgatcagctacgtgtattcggcggaactgtttccgacaattctgaggcagaccgggatgggattggtgggaatattctccagaatcggtggcatactgaccccactggtgattctgctgggagagtaccacgcagccctgccgatgctgatctatggctccttacccattgtggccggcttgctgtgtacgctccttccggagacccacggccagggcttgaaggatacactgcaggatctcgaactgggcccgcatccccgttcccccaaatccgtgccttctgagaaagagacagaggctaaaggccgaacctcaagccccggggtggcctttgtttcctcaacctacttctag

SEQ ID NO: 46133 - DNA, 618 bp, Artificial Sequence
  Description of Artificial Sequence: Synthetic coding sequence
atggtgctggacgagccccaccactgcgccgtggcctgggtgaagaaccacacattcaatctgtctgccgccgaacagctcgtgctttctgttccgctggacaccgctggtcatcccgaaccttgccttatgttccgccctccccctgctaacgcttcgctccaggatatattatcccaccgctttaacgaaacgcaaccttgtgacatgggttgggagtacccagaaaatcgtctgcctagcctcaaaaacgagtttaatcttgtctgtgatcggaagcacctgaaggacacaacacaaagcgtatttatggcaggactgctcgttgggaccctaatgttcggtcccctgtgcgacagagacaggatggggggtgcccttatggaagacgcggggaggggcccaggaccagtgcagctgctaccccgtgccgatggcgcatgcggtacccggctgcgattcccccagcttgaggctccgtctgaccaccgtcactgtgcctggttgaccgctctgctgctcctactgggcagcgcgaggatctgtactctcgctcccgatccttgggaagatggccggggtgataccaccgatccagaaggcgggctgggccagtag

SEQ ID NO: 46134 - DNA, 1662 bp, Artificial Sequence
  Description of Artificial Sequence: Synthetic coding sequence
atggccttccaggacctgctgggccacgccggcgacctgtggcggtttcaaatcttacagactgtctttctctccatctttgccgttgcgacgtacctccacttcatgctcgaaaactttactgccttcatccccggtcatcggtgctgggttcacatcttggacaatgacaccgtaagcgacaacgataccggagctctctctcaagacgctctgcttcgcattagcattccactggacagcaacatgcggcctgagaaatgccgtcgcttcgttcatccacagtggcagctactccacctaaatggaaccttccctaatacatccgacgctgacatggagccctgtgtagatggatgggtctatgaccgaattagcttcagttctactattgtcaccgagtgggaccttgtctgtgattcacagtccctaacgtcagttgctaagttcgttttcatggctgggatgatggttgggggtatcctcggcggacatttaagcgatcgcttcgggaggaggtttgtgcttcgatggtgttatctacaggtggccattgtcggaacctgcgccgccctggcacccacattcctgatctactgttcactgcgttttctctctgggatcgctgctatgtccttgatcaccaacactattatgttgatagctgaatgggccacacatcggttccaagcaatgggaattactctggggatgtgccccagtggaattgccttcatgaccctcgccggcctcgcatttgccattcgcgattggcatattctgcagcttgtggtctctgtgccgtacttcgtcatcttcctgaccagttcctggctgctggaaagcgccagatggctgatcatcaataacaaaccagaagagggcctgaaggaattacgaaaggccgctcacagatccgggatgaagaatgcgcgtgatactctgacactggagattttgaaatccaccatgaaaaaagagctggaggcagctcagaaaaagaaaccatcgctgtgtgaaatgctgcatatgccaaacatttgcaagaggatcagcctgctctcatttactcgctttgcgaacttcatggcgtatttcggactcaacttacacgtgcagcacttaggaaataatgtatttcttttacagaccttgttcggcgccgtgatactcttggccaactgtgtggccccctgggcacttaagtacatgaatcggagagcctctcaaatgctgctcatgttcctgttagcaatttgcttactggccattatttttgtgccacaggaaatgcaaaccctgagggaggtcctggctactctggggctaggagcttccgctcttgccaacactttggcattcgctcacggaaatgaggtgatccctactattatcagggctagggcaatggggattaacgcaacattcgccaatatagcaggggccttggcacccctcatgatgatcctgtctgtttatagcccccctctgccatggatcatctacggcgtgtttcccttcatcagtggcttcgccttcctgctgctgcccgagacccgcaacaaacccctcttcgacacaatccaagacgagaagaacgagcggaaggaccctcgggagccaaagcaagaagaccctcgtgtggaagttacccaattctag

SEQ ID NO: 46135 - DNA, 717 bp, Artificial Sequence
  Description of Artificial Sequence: Synthetic coding sequence
atggccttccaggacctgctgggccacgccggcgacctgtggcggttccaaatcctgcagacagtcttcttgagcatttttgctgttgctacctacctgcacttcatgctggaaaactttactgctttcattcctggccaccgctgctgggtgcatatactggataatgacaccgttagcgacaacgacacaggggcattgagccaggacgccttgctccgtatcagcattcctctggactccaacatgcgacctgaaaagtgccgacggttcgtccacccacagtggcagctgctgcacctcaatggaaccttccccaatacttccgacgctgacatggagccatgcgtcgacggctgggtgtatgatagaatctctttcagctccaccattgttacagaatgggatctcgtctgcgacagccaaagccttacttctgtagctaagtttgtcttcatggccggcatgatggtggggggcattctcgggggtcacttgagcgattcatcacgcgtcggcaacacgcagatccctggacacgggaactatataggaaatgtacccttctggtactgcatttatgaccctggaagaccaggcttttgccactcaagactggcttatccccccgcgggtggggtctgcaccatcctatgtgatttgtccgatcttaagctggcggcgagagtctgttctgtcgctcactaccagcagtag

SEQ ID NO: 46136 - DNA, 1626 bp, Artificial Sequence
  Description of Artificial Sequence: Synthetic coding sequence
atggccttcgaggagctgctgagccaggtgggcggcctgggccggttccagatgctgcacttggtttttattttgccctccttaatgttgctgattccacacatactgctcgaaaactttgccgctgccattcccggccacagatgctgggtgcatatgctcgataataacaccggatccgggaatgagacaggcatattatctgaagacgcactgttgcggatcagcatccccctggactcaaacctccggcctgagaagtgtaggaggttcgtgcaccctcagtggcagctgctccacctcaacgggactatccatagcacatccgaggccgacacagaaccatgcgtggatggctgggtctatgatcagtcatattttccctctaccattgtaaccaaatgggacctcgtttgtgactaccagtcattgaagtcagttgttcagtttttgctcttgacaggcatgttagtaggaggcatcatcggcggtcatgtgtcggatagatttgggcggaggtttatcctcaggtggtgcctcctccaacttgcaataaccgatacatgcgcggctttcgcccctacctttcccgtctattgcgtgttgaggttcttggccgggttctcgagcatgataataatctcaaacaacagcctacccattacagaatggatccgcccaaacagcaaagctctggtcgttatcctgtcctccggagcactctcgataggccagatcatcctaggtggactcgcttacgtgttccgagattggcaaactttacacgtagtcgcctcagtccccttcttcgtgtttttccttctgtcccgttggctggtggagtctgcgcggtggctaataatcactaacaagctggacgaagggttgaaggctctccgcaaggtggctcggaccaatggtataaagaacgccgaggagacgcttaatattgaggttgtgcgtagtaccatgcaggaagagctggatgccgctcaaacaaaaaccactgtgtgcgacctgttcaggaatcccagcatgcgaaagaggatctgtatcctagtcttcctccgctttgccaacacaattcccttttacggaactatggtcaacctccagcatgtcggctccaacatatttcttctccaagtcctatacggggctgttgcactgattgttcgctgtctcgctttactcaccctgaaccatatgggccgcagaataagtcagatcttatttatgttcctggtggggctgagtattctcgccaacacatttgtgcctaaggagatgcagaccctgcgagtggctcttgcatgcttaggcattggatgctccgcagccacctttagctccgttgcagttcacttcatcgagttaatccctaccgtgctgcgcgctcgggcttctggcatcgacctcaccgcctccagaattggggcggctctggcccccctactgatgactctcacagtcttttttaccaccttgccttggattatctacgggatattccctattatcggtggcctcatcgtgttcctattgccagaaacaaaaaacctccctcttcctgacactatcaaagatgtggagaatcagaagaaaaacttaaaagagaaggcctag

SEQ ID NO: 46137 - DNA, 1119 bp, Artificial Sequence
  Description of Artificial Sequence: Synthetic coding sequence
atgctggacaacaacaccggcagcggcaacgagaccggcatcctgtcagaagacgccctgttgcgtattagcatcccactggactccaatctgcggcccgagaagtgccggcgatttgttcacccacagtggcaactcctgcaccttaacgggaccatccacagtactagcgaggccgacaccgagccatgcgtggacggctgggtgtatgaccagagctacttcccgtctaccatcgtcacaaagtgggacctagtgtgtgactaccagagtctgaagtcggtcgtgcagtttctccttctgaccggtatgctagtcggtggtattatcggcggacatgttagcgatcgatttggccgacggtttatcctccgctggtgccttctgcagctggccattacagatacttgtgccgccttcgcccctacgttccccgtgtattgtgtgttacgtttcttagccggcttctccagtatgatcattataagtaataactctctgcctattaccgaatggattcggccaaacagcaaagcccttgtagtcatcctgtcttccggagccctgtcaatcggtcagataatactgggaggcctggcttatgtgtttcgcgactggcagacgctgcacgtggtggctagtgtccccttcttcgtctttttcttgctttctcggtggttagtggagtcggcaaggtggttgatcattacaaataaactcgacgaaggattgaaggccctgaggaaagtggcgagaacgaacggtattaaaaatgccgaggaaacccttaacatcgaggtcgttcggagtacaatgcaggaagaacttgatgccgcccagaccaagaccaccgtatgcgatttgttccgcaacccctccatgcgcaagcggatctgcatcctggtcttcctgcgctttgccaacaccatccccttttacggaacaatggttaatctgcagcacgtgggttccaacatttttctgcttcagaaatgccgaccctgtgtgtggctgtggcatgtctgggagagcgcagttcttctgcttctcttccccgtcctgctgtttaccagcttaaactcctcaccattgttctccggtcaggaactgcaggagtag

SEQ ID NO: 46138 - DNA, 444 bp, Artificial Sequence
  Description of Artificial Sequence: Synthetic coding sequence
atgatcatcatcagcaacaacagcctgcccatcaccgagtggatccgacctaacagcaaggccctggtcgttattctgagcagtggagccctttctattggccagatcatcttgggcggccttgcctacgtattccgggactggcagacactgcatgtcgttgcttccgtgcctttttttgtctttttcctcctgagtcggtggctcgtcgaatctgcacgatggctcattattactaacaaactggatgaaggtttaaaagccctgaggaaggtagccaggacgaacggcattaagaatgccgaggagacccttaacatagaggtcgtccgtagtacaatgcaggaggagctcgacgcagcgcagaccaaaacgaccgtgtgcgacctatttcgtaaccctagcatgagaaagcgcatctgtatccttgtttttctgaggtag

SEQ ID NO: 46139 - DNA, 810 bp, Artificial Sequence
  Description of Artificial Sequence: Synthetic coding sequence
atgctggtgggcggcatcatcggcggccacgtgagcgaccggttcggacgtcgctttattctgcgctggtgcctcttacagttggccattacggacacgtgtgccgcatttgcacccacctttccggtgtactgtgtgctccgctttcttgcgggtttctctagcatgatcatcatctctaataattctttgcccatcacagaatggatccggcccaactccaaggcattggttgtcatcttgtcctcaggggcactgtcaattggccagatcatattgggaggtcttgcctacgttttccgagactggcagaccctccatgtggtcgccagcgtcccgttctttgtcttctttttgctgtccagatggctggtggagagcgccagatggctgatcatcaccaacaaattagacgagggcctgaaggcattgcggaaggtcgcgcgcacaaatggtatcaaaaacgcggaagaaacactgaatatcgaagtggtacggtctaccatgcaggaggagctggacgcagcccagacgaagaccactgtgtgcgaccttttccgtaacccctccatgagaaagaggatctgtatcctcgtttttctgaggttcgccaatacaatccctttttatggtaccatggtcaacttacagcacgtgggatctaatatcttccttctacaaaaatgcaggccatgcgtgtggctgtggcatgtttgggagagcgcagtgctcctgctgttgttccctgtcctgctctttacgtccttgaactcctcccccttgttcagcgggcaggagctccaggaatag

SEQ ID NO: 46140 - DNA, 1785 bp, Artificial Sequence
  Description of Artificial Sequence: Synthetic coding sequence
atggccggcgaggagaacttcaaggaggagctgcggagccaggacgccagtagaaacctcaaccagcacgaagtggctggccaccctcatagctggtctttagagatgctgctgcgtcgcctgcgcgcagtgcacacaaaacaggacgacaagtttgctaatttactggatgctgtgggcgaattcggaacctttcaacagcgacttgtcgctctgacctttatcccttccattatgtccgccttctttatgttcgctgaccacttcgtgttcaccgctcagaaaccatattgtaacacgtcttggatcctcgcagttggcccacacttgtctaaagccgaacagctcaatctgaccattccacaggccccaaacggctctttcctcacttgcttcatgtacctgccagttccttggaacctggacagcataatccagttcgggctgaacgataccgacacctgtcaggatggatggatctaccccgatgccaagaagagatccctgattaatgaatttgatctggtgtgcggcatggaaacaaagaaagacacagcccaaattatgtttatggctgggttacctattggtagcctcatctttagactcattaccgacaaaatgggtagatacccggcaatacttctgagcctactaggtctcatcatcttcgggttcggaactgcctttatgaacagctttcacttatacctgtttttccgctttggaattagccagtccgtggtgggctacgccatctcttctatcagcctggccacagaatggcttgtaggagaacatagagctcacgcaattatactgggccattgctttttcgccgttggcgcagtcctcctgacaggtatcgcatactccctaccacattggcaactcctttttcttgttggtggcatcctggtgatccctttcatctcttacatctggattctgccagagtcacctagatggctcatgatgaaaggaaaggtcaaggaagccaagcaggtgctctgctatgccgcgtctgtgaataaaaaaacaattcctagcaatctgctggatgagcttcagctgcctagaaagaaggtcacgcgggcgtctgtgctcgacttttgtaagaataggcagctttgtaaggtgactctggtcatgtcatgtgtctggttcaccgtgtcctacacatattttacactctctcttcggatgcgcgagctcggggttagcgtgcacttcagacatgtggtgccttcgataatggaggtgccggctcggctctgttgcatctttcttctacagcagataggtcgcaagtggagcttggccgtgaccctgctgcaggccatcatctggtgtctccttctcctattcttgccagagggggaggacggattaaggctgaagtggcctcggtgtcccgcaacggaattgaagagcatgacaatactcgttctgatgcttcgagaattctccctcgccgccaccgtgacagttttttttctgtatacggccgaactgttgccgactgtcctgcgtgccaccggtctcggccttgtttcactggcatccgtggctggtgccatcctctctctgacgattatcagtcagactccctcgttacttcctatattcctgtgctgcgtgctcgccatagtggcattttcattgtcttcccttcttcctgagacacgagaccagcctctcagcgagtcgttgaaccattcctcacagattaggaacaaagtgaaagacatgaaaaccaaggagacctcttccgacgatgtatag

SEQ ID NO: 46141 - DNA, 1785 bp, Artificial Sequence
  Description of Artificial Sequence: Synthetic coding sequence
atggccggcgaggagaacttcaaggaggagctgcggagccaggacgcttcgagaaatctgaaccagcatgaggtagccggacacccgcatagttggtcactcgagatgctgctccgccggttgcgcgctgtccacaccaagcaggacgacaagttcgcgaacctcctcgatgcggttggagagtttggcaccttccagcagcgcctggtggccctgaccttcattccttccatcatgtccgccttttttatgttcgccgaccactttgtttttacagcacagaagccctattgcaatacctcatggattctcgcagtcgggccacatttgtccaaagccgaacaactgaatctgactatccctcaggcccctaatggcagttttctaacctgtttcatgtatctgccggtcccctggaatctggatagcataatccagttcgggcttaatgacacagatacttgccaggatgggtggatttatcccgatgccaagaaaaggagtctgattaatgaatttgatcttgtgtgtggtatggagactaagaaggacactgctcaaattatgttcatggcgggtcttcccataggctccctcatcttccgtctgataaccgataaaatgggtaggtaccccgcaattctgctgagcctccttggactgattatctttgggttcggcactgctttcatgaactccttccatctgtatctcttcttcaggttcgggataagccaatctgtggtggggtatgcaatcagttccatcagtctggctaccgagtggctagtgggagagcaccgtgcccacgctattatactcggccattgctttttcgctgtcggggccgttttgctcactggtattgcttatagcctcccacattggcaactgttgtttctggtgggcggcatactggtgatccctttcattagctatatctggatcctgccagagagtcctaggtggctgatgatgaaggggaaagtgaaggaagcgaagcaagtcctgtgctacgctgcgtccgtgaataagaaaacgattcccagtaacctgctcgacgagctgcagttgccacgcaagaaggtgacacgcgcttccgtactcgatttttgtaagaataggcaactgtgcaaggtgactctggtgatgtcctgtgtctggtttaccgtctcctacacttactttacactatctcttcgtatgcgggaacttggcgtgagcgttcattttagacacgtggtgccttctatcatggaagtccccgcgcggctgtgttgtattttcctattgcaacagattggccggaagtggagtctagctgtcaccctgctgcaggccatcatatggtgcttgcttttactgtttctgcccgagggggaagatggactgcgcctgaaatggccgaggtgtcccgccacagaactaaaaagcatgaccatcctggtattaatgctccgtgagttctcactcgctgcaactgtaactgtcttctttctttacaccgccgagctcctgccaacagtcctgagggccaccggcttggggcttgtaagtttagcttctgtggctggagccatacttagcttgacaataatttcacagacacctagcctgctccccatttttctgtgctgcgttctggcgatcgtggccttttccctcagttctttgctcccagagactagagatcagccactgagcgagagcttaaaccacagttcccagattagaaacaaagtcaaggacatgaaaaccaaagagacctcaagcgacgatgtgtag

SEQ ID NO: 46142 - DNA, 1275 bp, Artificial Sequence
  Description of Artificial Sequence: Synthetic coding sequence
atgcagggcgcccgggccccccgggaccagggccggagccccggcagaatgtctgctctgggtaggtcctccgtgatcctgctgacctacgtgctcgccgcaaccgagctgacctgcttgtttatgcaattttctatagtgccgtacctgagccgcaaattggggctggactcaatcgcttttggttatctccagactacattcggcgtactgcaactgttgggtggacccgtttttgggcgcttcgccgatcagcgcggagcgcgggctgctctgaccttgtctttcttagccgcactggctctgtacctgcttctcgccgcagcatccagtccggctctgccaggcgtctatctgctttttgcgagtagactacccggggcgctgatgcatacactgccagcggcccaaatggttattaccgacctgtctgctcctgaggagagacccgcggcactgggccggctcggcctttgttttggagtgggcgttattctgggcagtttgctcggcggcaccttggtgtctgcctatgggattcagtgtcccgccatccttgccgccctggccaccctgctaggagccgtcctctctttcacctgcatcccggcttcgaccaagggcgccaagacggatgcccaagccccactccctggcgggcccagagcgtcagtctttgacttgaaggcaatcgcgtctctgctgagattgccagatgtgcctcgcatttttcttgtgaaggttgcttctaactgccctacgggactctttatggtcatgttttccattatctcgatggacttcttccagctggaggccgctcaagccgggtacttgatgtctttttttggccttctacagatggtcacacaagggttggttattggccagctcagctcccactttagcgaggaggtcctgctccgcgcatcagtgcttgtgtttattgtcgtgggtttggctatggcttggatgtccagcgtgtttcatttttgtctactggtcccaggcctagtgttctccctgtgtacccttaatgtggtaaccgattctatgctcattaaagccgtcagcacttctgatactggcaccatgctcggcctgtgcgcttcggttcagcctctgctgaggactctggggcctacagtaggtggtctgctctacagatccttcggcgtgcccgtgtttggacacgtacaggttgcaattaatactctggtcctgctggtactgtggcgcaaaccaatgcctcagcgtaaggataaagtgcgatag

SEQ ID NO: 46143 - DNA, 1275 bp, Artificial Sequence
  Description of Artificial Sequence: Synthetic coding sequence
atgcagggcgcccgggccccccgggaccagggccggagccccggccggatgtccgcactgggtcgttcatctgtgatcttattgacctacgtcctggcagcaacagagttgacctgcctgtttatgcagtttagcatcgtaccttacttgagccgcaagcttggtctggacagtattgcctttggctatctgcagacaacctttggagtgctacagcttctgggtggccccgttttcgggcgctttgcggatcagagaggggcacgcgctgctcttaccttgtcttttctggctgcccttgctctttatttgctgcttgccgcggcctcaagccccgcattgccaggcgtgtacctgctgttcgccagtagattgccaggtgccctaatgcacactcttccagcagctcaaatggtcattactgatctgtctgcccctgaggaaaggcctgccgccctgggaaggctggggctgtgttttggcgtcggtgtgattctgggcagtcttcttggcggcaccctggtgagcgcgtatggcattcagtgtcccgccatccttgccgcactcgcaacattactgggagcagtgcttagttttacttgcatacctgccagcacaaaaggagctaaaacagacgctcaggcccctctccctggaggtccccgagcgagcgtttttgacctgaaggccatcgccagcctgctgcggctcccagatgttcctagaatcttcttagttaaagtagcttctaattgcccgactggactgttcatggttatgttcagtattatctcaatggattttttccagttggaagctgcacaggcggggtaccttatgtctttcttcggcctgcttcagatggttacacaaggcttggtgatcgggcagctctctagtcatttttcagaagaagtgttgttgagagcttcagtgctcgtgttcatcgtggttggcttagccatggcctggatgtcctctgtgttccacttctgtctcctcgtgcccggcctggtgtttagcttgtgcaccctgaacgtggttaccgactctatgcttattaaggctgtgagtacctccgatacgggcacaatgctcgggctatgcgcatccgtgcagcccctgcttaggaccctcggccctactgtcgggggtctgctgtaccgtagttttggggtccctgtgtttggccatgtccaagttgccattaacaccctggtccttctagttttgtggcgaaagcccatgccccaacggaaggataaagtcaggtag

SEQ ID NO: 46144 - DNA, 1275 bp, Artificial Sequence
  Description of Artificial Sequence: Synthetic coding sequence
atgcagggcgcccgggccccccgggaccagggccggagccccggcagaatgagtgcgttaggcaggtcctctgtgatcctgctgacatatgtgctggcagccactgagctgacttgtttgtttatgcaattctcaatcgtgccctacttatcccgcaagctggggttggacagtattgctttcggatatctgcagactacattcggcgtgctgcagctgctcggcggccctgtgttcggccggttcgccgatcagcggggggcccgagcggcactcaccctttcatttttggcagccctcgctctgtatttactcctcgctgctgcaagttctcccgcacttccgggggtctatctgctctttgcaagtcggctgcccggagctctcatgcacacactcccagcagcacaaatggtgattactgacctgagtgcacctgaagaaaggccggctgccttaggtagattgggcttgtgcttcggtgtcggagttatcttaggctcgcttctcggcgggacgctcgtctccgcttatggcatccaatgtccggcgatcctcgctgccctggctacattactgggcgctgtactgagctttacctgtatccccgcatcgactaagggagcaaagaccgatgcacaggccccactgcctggcggtcccagggcatccgtatttgatctcaaggctatagcctccctgctgcgactgccagacgtgcctcggatttttctcgtcaaggtggcctcaaactgtcctacaggtctcttcatggtgatgttcagcattatctccatggacttcttccagctggaagccgcccaagccggctatctgatgagtttctttggtctgctgcagatggtgacacaaggattagtgatcggccaattgtcgtcccatttctctgaggaagtcttacttagagcatcagttctggtatttatcgtcgtcgggctggctatggcgtggatgtccagcgtgtttcacttttgtctgctggtgccagggttggttttctcgttgtgtacattgaatgtcgtgaccgattccatgctgattaaggccgtgtctaccagtgacactggtacaatgctcggattgtgcgcttcagttcagcccttgctgagaactctcggcccaacggtcggggggctcctatatcggtcattcggagtccccgtttttggacacgtccaggtggcaatcaatactctggttctcctcgtactgtggaggaaaccgatgcctcagcgaaaggataaagtcagatag

SEQ ID NO: 46145 - DNA, 981 bp, Artificial Sequence
  Description of Artificial Sequence: Synthetic coding sequence
atgcagggcgcccgggccccccgggaccagggccggagccccggccggatgagcgcattgggacgaagctccgtgattctgctcacctacgtgttagcagccaccgagctgacgtgcctgttcatgcagttcagtatcgttccctatttgtcacgtaagctgggtctcgactcgatcgcgtttgggtacttgcaaactaccttcggagttctgcagcttctgggcggccctgtttttgggaggatccagtgcccagcgatcttagcagccctcgctaccctgctgggtgcagtcctgtcctttacttgtatccccgcaagcactaagggggccaagaccgatgcccaggctcccttacccgggggacctcgggcgagcgtattcgacttgaaagccattgcgagcctgttgcgactgccagacgtgccacgcatctttctggtcaaagtggcatccaactgtccaactggtctttttatggtgatgtttagcatcatctccatggattttttccaactggaggctgctcaggcagggtatctgatgtcgttctttggcctgctccagatggtgacacagggcctcgttatcggacagctcagtagccacttttcagaagaggtgctactgcgcgcttcagtactagtcttcatcgtggtgggccttgcaatggcgtggatgagctccgtatttcacttttgcctgttagtgcctggactggttttctccctgtgtaccctaaacgttgtcacagacagtatgcttattaaggccgtgtctacttccgatacagggacaatgctcggcctgtgcgcctcagtgcagccactcctgcgtacactgggacctaccgttggtggacttttgtatcggtcttttggggtgcccgtttttgggcatgtgcaggtggctataaatacccttgtactgctagtactgtggagaaagcctatgcctcaacgcaaggataaagtgcgatag

SEQ ID NO: 46146 - DNA, 405 bp, Artificial Sequence
  Description of Artificial Sequence: Synthetic coding sequence
atgcagggcgcccgggccccccgggaccagggccggagccccggcaggatgagtgctctggggaggtcaagcgtaatcctgctgacatacgtgctagccgcaacagagctgacttgcctgtttatgcagttttctatcgtcccttatcttagtcgtaaactggggctggacagcattgcgtttggctacctgcagacaactttcggagtcctacagctcctaggggggcctgtctttggtcgatttgccgaccagcgcggtgccagggctgctctgaccctttcctttcttgccgcccttgccctttaccttttgttggcagccgcaagctccccggccttacctggagtgtatctgctgttcgcaagtagattacctggcgctcttatgcacacactcccttag

SEQ ID NO: 46147 - DNA, 1644 bp, Artificial Sequence
  Description of Artificial Sequence: Synthetic coding sequence
atggccttccaggacctgctggaccaggtgggcggcctgggccggttccagattttgcagatggtgttccttattatgtttaacgtcattgtttaccaccagactcagctggaaaacttcgcagcattcatactcgatcaccggtgttgggtgcatatcctcgacaatgacaccatccctgataatgaccccggtaccctgagccaggacgcactactcaggatatccattccttttgacagcaatctgaggccagagaagtgccgtcgatttgtgcacccccagtggaagttgatccacctgaacggcacttttccaaatacgagcgagcctgacaccgagccctgcgtggacggatgggtatacgatcaaagctccttccccagtactattgtgactaaatgggacctggtctgtgaaagccagcctctcaattctgtggctaaatttttgttcatggccggaatgatggtgggcggaaacctctacggccatctctctgatagatttggcaggaaatttgtgttgcgatggtcctaccttcagttagcgatcgtcggcacatgtgcagcctttgctcccacaatcctggtgtattgttcccttcggttccttgcaggagcagccactttctccatcatcgtgaatactgtcttattaatagtcgagtggatcactcaccagttctgcgcaatggctctgactctaacactgtgtgccgctagcattggccacatcacactcggcagcctggccttcgtgattagagaccaatgtattctgcagctggtgatgtccgcaccctgctttgtcttcttcctgttttctagatggctggcggagagcgcccgttggttgatcataaacaataagccagaagagggattgaaggagctgagaaaagccgcccacagaaatggaatgaagaacgccgaagacatacttacaatggaagtactcaaaagtacaatgaaacaggagcttgaggcagcccagaagaaacatagcctgtgtgagcttctccggatccccaatatctgcaagagaatctgtttcctgtcttttgttagatttgcttcgactatccctttctggggcttgactctgcacctgcagcatttaggaaataacgtgtttctgctccagactctgtttggcgctgttaccctgctcgctaactgcgtggctccctgggcactcaaccacatgtctcgccgcctgagccagatgttacttatgtttttgctggcaacatgtttacttgctatcatttttgtgccccaggaaatgcagactctgagagttgtgctggccactcttggtgtgggagcagcttccctcgggatcacttgctcaactgcccaggagaatgaattgattccttctataatccgggggcgtgctacaggaatcacaggaaacttcgccaatattggaggtgccctggcgtccctcatgatgatcctttccatctactctaggcccctcccttggattatttacggggtgttcgcaattctaagcggcctggtcgtcctgctgctgcctgaaacccgcaatcagccactgctggattccatccaagacgtggaaaatgaaggggtaaacagcttagcggctcctcaaagatcttctgtgctatag

SEQ ID NO: 46148 - DNA, 705 bp, Artificial Sequence
  Description of Artificial Sequence: Synthetic coding sequence
atgaacatgttcggccggaagttcgtgctgcggtggagctacctgcagctagctatcgtgggaacttgtgcagcctttgcccctactatcctggtatactgtagtctgaggtttctggcaggcgccgctacgttctccattattgttaacaccgttctgctgatcgtggagtggatcacacatcagttctgcgccatggcattgactctgacattgtgcgccgcaagtatcgggcacatcactctcgggagcctggcattcgtgatccgcgaccagtgtatcttgcagctcgtgatgagtgccccctgctttgtgttttttctctttagcaggtggctcgccgagtcagctagatggttgattattaacaataagcccgaggagggtcttaaagaattgaggaaggccgctcaccgtaatggcatgaaaaacgcagaggatatactgacaatggaggtcctgaagagtacaatgaaacaggaactagaagccgcacagaagaaacacagcctttgtgaacttcttaggatacctaatatttgtaaacgcatctgcttcctgagtttcgtcagaagcgccggggtctgttggcgcagcacaccagatccagtctgtctgggtattaccagtggcggctgcagaacagcaaagatcccagcttgctcctttctgtggaaactccacttcagaggggcacctgcgtag

SEQ ID NO: 46149 - DNA, 609 bp, Artificial Sequence
  Description of Artificial Sequence: Synthetic coding sequence
atggccttccaggacctgctggaccaggtgggcggcctgggccggtttcagatcctgcagatggtgttcttaatcatgttcaatgtgatagtttatcaccagacacagctggaaaacttcgccgcatttatcttggaccacagatgctgggtccacatcctggataacgacaccatacccgataatgatcccggtactttgagccaggacgcattgttaagaatatctataccattcgattctaatttacgccccgaaaagtgccggcgattcgtccacccccagtggaagctgattcatctgaacggcacttttcccaataccagtgagcccgatactgagccgtgtgtggacggttgggtgtatgaccagtcaagcttcccgtctaccatagtgacgaaatgggatctggtctgcgaaagccagcctctcaattcagtagctaagttcttattcatggcaggcatgatggttggtggaaatttgtacggtcatctctctgatagaaaacccctgtcatccccgaaccacgtgagcactgactgtgacgagggtctcgaggtgcctatcgctatccaccagcaccacgtgttctggtacttgtcgtag

SEQ ID NO: 46150 - DNA, 1200 bp, Artificial Sequence
  Description of Artificial Sequence: Synthetic coding sequence
tgattccaggacctgctggaccaggtgggcggcctgggccggttccagattctacagatggtgtttctgataatgtttaacgttatagtgtaccaccagactcagttggagaatttcgcagcttttattttagaccacaggtgctgggttcacattctggataacgatacaattcctgacaatgacccagggactctttctcaggacgcgctgctgagaatttcaatcccatttgatagtaatctccgccccgagaaatgcaggcggtttgtgcaccctcagtggaaactcattcacctcaatggcaccttccccaataccagcgagccggatactgagccttgtgtcgatggctgggtgtacgaccaatcatcctttccaagcactattgttaccaagtgggacctggtgtgtgaatcacagcccttaaacagtgttgctaagtttcttttcatggctggaatgatggtcggcggcaacttgtacgggcatttgtccgatagatttgggaggaagttcgtcctgcggtggtcttacttgcagctggccatcgtggggacgtgcgccgcttttgcccctaccattcttgtgtactgttccttgcgctttctggccggggccgcgaccttctccatcattgtgaacacagtcctgctcatcgtggaatggataacccatcagttttgtgcaatggccctgaccttaacactgtgcgcagcctcaattggacatatcacactgggttcgctggctttcgtgataagggatcagtgtattcttcagctcgtcatgtcggccccctgtttcgtgttctttctcttcagtcgttggttggccgagagcgcacgttggctgatcattaacaacaagcccgaagagggcctcaaggagcttcgcaaagcggcacacaggaatggcatgaaaaatgccgaggatatcctgactatggaagtgctcaaatctacgatgaaacaagaacttgaagctgcccagaaaaaacacagcctgtgtgaactgctgagaattcctaacatctgcaaaagaatctgcttcctgtctttcgtgaggtctgccggggtgtgttggagatctacaccagaccctgtttgtctgggcattacatccggcggatgccgcacagcaaagatcccagcatgcagttttttatggaaactacacttcagaggagctcccgcgtag

SEQ ID NO: 46151 - DNA, 1482 bp, Artificial Sequence
  Description of Artificial Sequence: Synthetic coding sequence
atgagccggagccccctgaaccccagccagctgcggagcgtgggctctcaggacgccctagcgcccttacctccaccagccccccagaacccatccacccactcgtgggaccccctatgcggttccctgccatgggggctgagttgcctcttggcattgcaacacgttctggttatggcgagtcttctctgtgtttcccatttacttctcctttgctcactcagtcctgggggtctgtcgtactctccctcacagctccttgcttctagtttcttttcttgcggcatgagcactatattacagacctggatgggtagcagactcccgctggtgcaggcccccagcctggaattcctcattcctgcccttgtccttacctcgcagaaattacctagggccattcagacacccgggaattcttctctcatgctgcatttatgtcggggaccatcctgtcacggcctagggcactggaatacatccctgcaggaagtgtccggcgctgtcgtggtctctggcctcctgcaggggatgatgggattgctggggtctccaggacatgtcttccctcattgcggacctctggtgctggccccttcccttgtcgtcgccgggttgtccgctcatcgcgaagttgctcagttttgttttacacactggggtctggctctcctgacatgggcgcctgctagctttatgtgtgcgcccggcggcgagctgcagaggcaccaacttactctgctgagcctgtccagtgggtctttccggaattgcctcccgccgcctaggcaccatggattcggatgcctgactcaggccggatcccaacaggtggctcacctggtgggacttctctgcgttgggctggggcttagccctcgcttagctcagctgctgaccacgatacccctccccgtagtgggcggggtgctaggcgtcacgcaggctgtagtgttgagtgccggcttctcctctttttacctcgccgatatcgacagcggtaggaatatttttattgtggggttcagtatttttatggccctattgctccctagatggtttagagaggcaccggtactgttttctaccggctggtcccccctggacgttctgctgcactccctgctcacccagccaatcttccttgctgggctgagtggattcctgctggagaatactatcccgggcacacaactcgagcgtggcctcgggcagggactaccatccccgttcacagctcaggaggcccgaatgccccagaagcctagggaaaaggcagcacaggtgtatagactgccgtttcctatacagaacctctgcccctgcatcccccagccactccactgtctgtgcccactgcctgaagaccctggcgacgaagaaggcgggtccagcgagcccgaagaaatggccgatctgctacctggctccggagaaccgtgtccggaatcaagccgcgaaggctttcgctcgcaaaaatag

SEQ ID NO: 46152 - DNA, 585 bp, Artificial Sequence
  Description of Artificial Sequence: Synthetic coding sequence
atggccagcctgctgtgcgtgagccacctgctgctgctgtgcagccttagcccggggggactatcctactcaccctctcagctcctggcctctagcttcttcagctgtggtatgtccacgatcttgcaaacctggatgggttcacgtctcccactggttcaggcaccctcccttgagtttcttatacccgccctggtgctcacatcccagaaactgcccagggcaatccagactcccgggaattcctcactgatgcttcacctgtgccgcggcccctcttgtcacgggctcggacattggaatacatctctgcaggaaggatatcccgcacacggcggactgttttccgccccgggtctattgccagtgtcctgcgtgcctctggaggcatcctttaatgtgatcaattcacactcttcaccctgcctgccagccccattcggagcggatccctcaggcctctgcgtcgactgtttctgcctgtgcgggattcagtgttacccaccgggtaccgtgtgcccgcatcagggcactatggatctcgctgcctctccaaggttggacctgagcaaatggctgacttag

SEQ ID NO: 46153 - DNA, 1833 bp, Artificial Sequence
  Description of Artificial Sequence: Synthetic coding sequence
atgagccggagccccctgaaccccagccagctgcggagcgtgggctcacaggatgcactcgccccgctgccgccccctgccccccagaacccgtctactcattcctgggaccccctctgcgggagcttgccttgggggctgagttgtctattagctttacagcatgtgctcgtgatggcatcgttactgtgcgtgagccatctgcttctcctatgctcgctgtcccccggtgggctgtcttatagccctagccagctgttagcgagttcttttttttcttgcggcatgagtactattctgcagacttggatgggaagtcgactgcccctggtgcaagcacccagcctggagttcctcattccagcactggtgctcaccagccagaaacttccccgggctattcagactcccggtaattcatctctcatgcttcacctatgtcgaggcccgtcatgccacgggttaggccattggaacacctccttacaagaggtgtcgggagctgtggtggtgtcagggctcttacaagggatgatggggttactcggatccccaggccacgtgttccctcattgtggaccgctagtgctggcacctagcctggtggttgccggactgtcagcgcatcgagaggtggcgcagttctgttttacacactggggcctggctctgcttgtaatcctgttgatggtggtgtgttctcagcacctcggcagttgccagtttcacgtgtgcccatggcgccgggcatctacttccagcacacacaccccactgccggtgtttcgactgctgtccgtgctaatacctgtggcttgtgtctggattgtgagcgcctttgtcggcttttcggtgatccctcaggagctttcagctccaactaaagccccctggatttggcttccccacccaggagaatggaattggcctcttctcactccccgcgccctggctgccggaatctcaatggccctggccgcaagcaccagttctctggggtgctatgcgctgtgtgggagactcctccacttgccccccccgcctcctcacgcttgctcgcgcggcctttccctagaagggttgggatcagtgcttgctggattgcttggcagccccatgggtactgcatcttcctttccgaacgtgggaaaagtgggtttaatccaggccggcagtcagcaagtggctcacttggtaggactgttgtgcgtggggctgggtttgtctcccaggcttgcacagttactcaccactatacctctaccggtggtcggtggagtgttaggcgtgacacaggctgtcgtgctgtcagctggattttcctccttctatctggcagacatcgatagcggcagaaatatattcattgtaggtttcagtatattcatggccctgctgcttccaaggtggtttagggaggccccagtccttttttccaccggctggtcgccactagatgtgttgctgcattccctcttgacacaacctatctttctggctggactttctgggttcctgctcgagaacacgatccctggaacccagctggagcgcggcctcgggcaggggctaccatcccccttcacagcacaggaggcgaggatgccgcagaaacctcgcgagaaggcagcccaggtttaccgccttcccttcccgatacagaacctctgcccctgtataccacagccgctgcactgtttatgtccacttcccgaagacccaggtgatgaggaaggtgggagttctgagcctgaggaaatggcagatctgctgcctgggtccggcgagccatgtcccgagtcaagtagggagggattccggtcacagaaatag

SEQ ID NO: 46154 - DNA, 1857 bp, Artificial Sequence
  Description of Artificial Sequence: Synthetic coding sequence
atgagccggagccccctgaaccccagccagctgcggagcgtgggctcgcaggatgcactggccccattgccgccccccgcgccgcagaatccaagcacacactcctgggacccactttgcggtagccttccctggggactctcctgtctcttagccctacagcacgtactggtgatggcctccctgctgtgtgtctcccacttacttcttctgtgttccctgagtcctggtggactgtcatatagcccaagtcaactcctggccagttccttcttttcttgtggtatgtccacaattctccaaacctggatgggcagccgactccctttggtgcaggcaccctctctcgagttcttgattcccgctttggtactgacttcacagaagttgccacgagcgattcaaacacccgggaattgtgagcacagagcacgcgcaagagcgagcctgatgttacacctgtgccgaggccctagctgtcatggcctggggcattggaacaccagtctgcaggaggtgtctggcgcagtcgtcgtgtctgggctgttacagggcatgatgggcttgctgggaagtcctggtcacgtcttccctcactgcggacccctggtgttggcgcctagtctcgtcgtggccgggctctcggcacatcgcgaggttgctcaattctgttttactcactggggcctagcgctgttggtgatcctgcttatggtcgtgtgctcacaacacttagggagctgccaattccacgtatgtccctggcggcgcgcatctacaagctccactcacacaccccttcccgtgttcagactcctgagcgtactgatccccgtggcatgcgtgtggattgtctcagcatttgtcggctttagtgtcattccacaagaacttagcgctcctaccaaggccccgtggatctggctgcctcaccctggcgagtggaattggcccctgctgacaccgcgggccctggctgccggcatcagtatggcccttgccgccagcacatcttctttgggatgttacgcactgtgcgggcgcttgctgcatctgccaccccccccccctcacgcgtgctccagagggctttctttggagggcctcggatccgtgctggctgggttactgggatcccccatggggacagctagtagctttcccaacgtgggcaaggtgggtcttattcaagcagggagtcaacaggtcgcacatcttgtggggttgctctgcgtcggtcttggactctcgccaaggctggcccagctgctgactaccatccctctacctgtggtgggcggtgtccttggcgtcacacaggccgtggtgctgagcgctggtttcagtagtttctacctcgccgacatagacagcgggcgcaatatctttatcgtcgggttttccattttcatggcccttctgctccccagatggttcagggaggcacctgtactttttagcactggctggagccccctggatgtcttgctacactcactgctgactcaacccatttttctagccgggctgtctgggttccttctggagaacacaattcctgggacccaattggagaggggattggggcaggggctgccttccccattcacagcccaagaggcacgcatgcctcagaagccaagggaaaaagcggcacaggtataccgcctgccttttccaatccagaatctctgtccctgtattccgcagcccctgcactgcctgtgtccactgccagaagaccctggcgacgaggagggcggatcctccgagcctgaagaaatggcagacctcctgcctggctctggagaaccatgcccggagagctctagggaaggctttcggtcacagaaatag

SEQ ID NO: 46155 - DNA, 1434 bp, Artificial Sequence
  Description of Artificial Sequence: Synthetic coding sequence
atgctgcggtggctgcgggacttcgtgctgcccaccgccgcctgccaagacgccgaacagcccactcggtacgaaacactgttccaggctctggacaggaacggtgatggggtggtagacatcggggagcttcaggaagggctgcgaaatctgggcattcccctggggcaggacgcagaggagaagattttcaccacaggggacgtcaacaaggacggcaagctggatttcgaggaatttatgaagtatctgaaagaccatgagaaaaaaatgaaactggcatttaaatcactggataaaaacaacgacggcaaaattgaggccagtgagatcgtccagagtctgcagacactgggattgaccatttcggagcagcaagcagagcttatattgcagagcattgatgttgacggaactatgaccgtggactggaacgaatggcgagattacttcctgtttaaccccgtaacagatatcgaggagattattcgtttttggaagcacagcactggcatagacatcggcgattcattgacaatccctgacgagttcacagaagatgagaaaaagtctggacagtggtggcgccagctccttgcgggcggcattgccggggccgtctcccgcacctcaactgccccactagacagactaaagatcatgatgcaagtgcatgggagcaagtccgataaaatgaatattttcggcggatttcgccagatggtcaaagagggtggcattagatctttatggcgcggcaacggaaccaatgtgattaaaattgccccggagaccgccgtcaagttttgggcatatgagcagtataagaaattgctcactgaagaggggcagaaaattggtaccttcgagcgcttcatcagcgggtccatggcaggcgccacggcccagaccttcatctaccccatggaggttatgaaaacacgtctggcagtggggaagacaggccagtatagcgggatctatgattgcgcaaagaagatcctgaaacatgaaggtctgggcgcattttataaaggctatgtgcctaatctactggggatcatcccctacgccggtattgacttggctgtttacgagctcctcaagtcctattggctggataactttgccaaggactccgtcaaccctggagtgatggttcttctgggatgcggggccctatcgtccacctgtggccagcttgcttcctatcccttagctctggtccgcacccggatgcaggcccaggctatgctggaaggctcccctcaattgaacatggtggggttgtttcggcgcatcatctcaaaggaggggattccgggcctctataggggaataacacctaacttcatgaaggtgctgcctgcggtcgggatttcctacgtcgtatatgaaaacatgaagcagactctcggggtaacccagaagtag

SEQ ID NO: 46156 - DNA, 1449 bp, Artificial Sequence
  Description of Artificial Sequence: Synthetic coding sequence
atgcggggcagccccggcgacgccgagcggcggcagcggtggggcagactgtttgaagaactggattcaaataaagatggtagggtagatgtccatgagctgaggcagggcctggccaggctggggggaggaaacccagatcccggtgcccagcagggaatttcatcagagggggacgctgacccggacggcggcctggatctggaagagttctctagatacctccaggagcgcgaacagagactgttgctgatgttccactccttggacaggaatcaggatggccatatcgatgtatcagagattcaacagagctttcgggcgctaggaatctcgatctcccttgaacaggccgagaaaatcctccatagcatggatagggatggcaccatgacaatagactggcaggaatggcgggatcacttcctcctccatagcctggagaatgtggaggatgtgctatacttctggaagcacagcactctttccagcgctggcttctctgcctggatcaaggatagcaccgcagaacagaatcgctccaaaacaaccgtacttgccaggagaagcggttcccacctcaagagtcagcatttcggaaggcctaagtgggccgatcacgaggtgctggatatcggggagtgtctcaccgttcccgatgagttcagcaaacaggaaaagctcacaggcatgtggtggaagcagttggtggccggagccgtggcgggagcggtcagcaggacgggtactgcacccctggatcgcctcaaagttttcatgcaagtgcacgcgagcaaaactaatcgacttaacatccttggaggactcagaagcatggtacttgagggcggcatccgttccctgtggcgcggcaatgggattaacgtgttgaaaatagcaccggagtcagctatcaagtttatggcttatgagcaaattaagagagccatactcggccaacaggaaaccctccatgtgcaggagcgatttgtggctgggagtttggcgggcgccacagctcagacaattatctaccccatggaagtgctgaaaacacgtcttacccttcggaggaccgggcagtataaaggcctgctggactgcgcccgacgtattctggagcgcgagggtcccagggctttctatcggggataccttcccaacgtcttaggcatcatcccctatgccggcatcgacctcgcagtgtatgagactctgaagaactggtggctgcagcagtacagtcacgacagtgcggatccgggcattttggttttgctggcatgcggcactattagcagcacctgtgggcagattgcgtcatatcccctcgccctggttcgtacacgaatgcaagcccagggttggagtaccgtagccaggttccaaatcaccgccacttccgccttccaagtacaggccattctgctccctcagcctcctgaatag

SEQ ID NO: 46157 - DNA, 1407 bp, Artificial Sequence
  Description of Artificial Sequence: Synthetic coding sequence
atgcggggcagccccggcgacgccgagcggcggcagcggtggggccgcctttttgaggagctggacagcaataaggatggcagagtcgacgtccacgagctcaggcagggcctggcgcggctcggcggcggaaatccggatcccggcgctcagcagggcatctctagcgaaggcgatgccgatcctgacggcggcctggacttggaggaattctctcgctatttacaggaacgagaacagagactgctgctgatgttccatagcctggaccgcaaccaggacggccacatagacgtgagcgaaatccaacaatcattccgggctctgggcataagtattagcttagaacaggctgagaagattttacacagcatggacagagacggaactatgaccattgactggcaagaatggagagatcatttcttactgcactccctggaaaacgtggaggacgtgctgtacttttggaagcactccacggtcttggacataggcgaatgcctcacagtgcctgatgagttctctaagcaagaaaagttgacaggcatgtggtggaaacagctggtcgctggtgctgttgccggggcagtgtcaaggacaggcacagctcctctcgacaggcttaaagtgtttatgcaggtgcatgcctccaaaacaaacaggctgaacatactgggggggttgcgatcaatggttctggaaggcggaatacggtccctctggaggggtaacggaatcaacgtcctcaaaattgccccagaaagcgcaattaagtttatggcctatgaacagattaaacgagccatcctgggccaacaggagaccttacatgtccaggaaagatttgtggcaggatcattagcaggagctaccgcccagactatcatttatcccatggaagtcctcaagacacgacttaccctcaggagaacgggacagtacaaggggctgctcgattgcgcacgtcgtattctggagcgcgaagggcccagggccttctatcgaggatacctgccaaatgtgctgggaataatcccatatgccgggatcgatctggcagtgtacgagactttgaagaactggtggttgcagcagtactctcacgattcagccgatcccgggatcttggttctcctggcgtgcggtactatcagctcaacctgtggtcaaattgccagctatcctctggctttggtgcgtaccaggatgcaggcccaggctagtattgagggcggtcctcagctgtctatgctaggactcctacgccacatcctgagtcaggaaggtatgcgcgggctgtacaggggaatcgctcctaacttcatgaaagtaatccccgccgtatctatttcctatgtggtctatgagaacatgaaacaagccctcggtgttacatcccggtag

SEQ ID NO: 46158 - DNA, 1317 bp, Artificial Sequence
  Description of Artificial Sequence: Synthetic coding sequence
atgcggggcagccccggcgacgccgagcggcggcagcggtggggccgccttttcgaagaattggattcaaataaagacggccgcgttgatgtgcatgagctccgccagggtctggctcgattaggtggagggaaccctgatccgggcgcacaacaagggatttcctcggagggggatgccgacccggacggaggtctggatttagaggagttttctaggtacctccaggagcgtgagcaacgcctgctgttgatgttccactccttggatcgcaaccaggacggtcatattgacgtttccgagatccagcagtctttccgagcactcgggatcagtattagcctggaacaagccgagaaaatcctgcactctatggacagggatggtacaatgaccatagattggcaggaatggagggaccacttcctgttacatagtctcgagaacgtggaggatgttctctatttctggaagcacagcaccgtgcttgacattggggaatgcctgactgtgccagacgaatttagcaagcaggaaaaattgacgggaatgtggtggaaacagctcgttgccggcgctgtggctggcgcagtatccagaaccgggacagctccactcgacagactcaaagtcttcatgcaggtgcatgcctccaagactaatcggctcaatatcctaggcggattacgatcaatggtgctggagggcgggatacgcagcttatggcggggcaatgggattaatgtgctgaaaattgctcccgaatctgctattaaattcatggcgtacgagcagattaaaagggcaatcctgggacagcaggaaacgcttcacgtccaggaacggttcgtggccgggtcgcttgctggggccaccgcacaaaccatcatctatcctatggaggtgttgaagactaggctgacactgcgcaggaccggccagtacaaaggacttctcgactgtgcacgccggatcctggagcgagaaggtcctcgcgccttctatcgggggtacctgccaaacgtactgggaatcatcccatacgcaggtatcgatcttgccgtgtacgagacactgaagaactggtggctgcagcagtatagtcatgatagtgctgaccctggcattctcgtgctgctggcttgtggcactatatcctcaacatgcggccaaattgcaagttatccattggctcttgttaggaccaggatgcaggcccaggatgtgtcagtgtacaaaaccgacaccgtgcctacgttgatcgagctaacaggacggcgcggcaggaaaatgctcaacaagtcattctggaactag

SEQ ID NO: 46159 - DNA, 690 bp, Artificial Sequence
  Description of Artificial Sequence: Synthetic coding sequence
atgtggtggaagcagctggtggccggcgccgtggccggcgccgtgagtagaacgggtacggctccgctcgatagattaaaggtgtttatgcaggttcacgcttcgaagaccaatcgtcttaacatccttggagggctccgttcaatggtattggaaggagggattagatcactgtggcgtgggaatggcattaacgtgctgaaaatcgcccccgaatcggctatcaaattcatggcctatgagcaaatcaagcgcgctatccttggccagcaggagactctccatgtgcaagagcggttcgtcgcaggtagtctagctggcgctaccgctcagaccattatctacccaatggagactttgaagaactggtggttgcagcagtattcacatgattctgccgatccagggattttggtgttgctggcttgtgggaccattagttctacatgtggccagattgcttcctatccactggctctggtgcgcactcggatgcaggcccaggcatcaatcgagggtggtccgcagttatcaatgctcggactgctacgccacatccttagccaagaagggatgagggggctttaccgcggcatcgctcctaactttatgaaagtgataccagccgtgtcaattagttatgtggtgtatgagaatatgaagcaggcgttaggggtgacatcccggtag

SEQ ID NO: 46160 - DNA, 372 bp, Artificial Sequence
  Description of Artificial Sequence: Synthetic coding sequence
atggaggtgctgaagacccggctgaccctgcggcggaccggccagtacaagggccttctcgactgtgcccggaggatcttagaacgagagggtcccagagccttctatcggggatacctccccaacgttctggggatcattccatacgccggcatagacctggcagtctacgaaaccctgaagaactggtggttacaacagtactctcacgactccgccgaccctgggatcctggtcctgttggcttgtgggacaattagctctacatgcggacaaatagcgagttaccctcttgccctggtacggactagaatgcaagcccaggccggggggcacgccatgtcctctctgatggagaggactatgtggtag

SEQ ID NO: 46161 - DNA, 1434 bp, Artificial Sequence
  Description of Artificial Sequence: Synthetic coding sequence
atgctgcggtggctgcgggacttcgtgctgcccaccgccgcctgccaggatgccgaacagcctacccggtacgagacactgttccaagctctcgatcgtaatggggacggcgtcgtggatataggcgaactgcaggaaggccttagaaacctaggcataccacttgggcaagatgcggaggaaaaaatctttaccacaggagacgtaaataaagatggcaagttggatttcgaagagtttatgaaatacctgaaggatcatgagaaaaaaatgaagctcgctttcaagagtctggacaagaacaacgatggcaagattgaggcctcagagatagtgcagagtctgcagacactggggctgacgatcagcgaacaacaagccgagctcatcctccagtcaatcgacgtggacggaaccatgactgttgactggaatgagtggcgcgactactttttgtttaatcccgtaactgacatcgaagaaatcattcgtttttggaaacatagcactggaatcgatatcggggacagcctgacaattcctgacgagttcaccgaggacgaaaagaaatccggacaatggtggcgccagcttttggctggtgggatcgctggagccgtgagcaggacctcgacagctccgctggatcgacttaaaatcatgatgcaggtccatggctctaagagcgacaaaatgaatatctttgggggcttcagacagatggtcaaggaagggggtatacgctcactgtggcgaggcaatggcacaaacgtaatcaaaattgccccggaaacagcagtgaaattttgggcttatgagcaatacaagaagttgctgacagaagaaggacaaaagatcgggacattcgaacggttcattagcgggagcatggctggcgccactgcacagaccttcatttaccctatggaggtgatgaagacacggctggctgtggggaagacgggacagtattctgggatatacgactgcgccaaaaagatattgaaacacgagggtctgggcgcgttctacaagggttacgttcccaacctcttgggaatcatcccctacgcaggcatcgatctggcagtctacgaactattgaagagctactggctggacaactttgccaaggactccgtcaatccaggcgttatggtgctgctggggtgtggcgccctgtcctccacatgcgggcagttagcttcttatccgctcgccttagtgcgtactaggatgcaggcacaggcaatgctggaggggtcaccccaactgaatatggttgggctgttccgcaggattattagtaaggagggaatcccagggctttatcgtggcataactccaaacttcatgaaggtgctgccagctgtgggaatctcatatgtcgtctacgagaatatgaaacagaccctgggtgtaacccaaaagtag

SEQ ID NO: 46162 - DNA, 1377 bp, Artificial Sequence
  Description of Artificial Sequence: Synthetic coding sequence
atggacagcctgtacggcgacctgttctggtacctggactacaacaaggatggcacccttgacatcttcgagctgcaggagggcctcgaggacgtgggcgccatccagtcactggaggaagccaaaaaaatattcactactggcgacgtcaataaggatggtaagctagacttcgaagagtttatgaagtacctgaaagaccacgagaagaaaatgaagttggccttcaaaagtctagacaagaataacgatggtaaaattgaggcctctgaaatcgtgcagagcctgcaaaccttggggcttactattagtgaacagcaggccgagctgatcctgcagtccatcgatgttgacggcacaatgacggtagattggaacgaatggagagattattttctgtttaacccagtgacagacatcgaagaaattattcgcttctggaaacattctacggggattgatatcggggattcccttaccattcccgacgaatttacggaggatgagaagaagagtggacagtggtggaggcaactcctggccggcggcatcgccggggccgtcagtcgcactagcaccgcgccgctggatagactgaaaatcatgatgcaggtgcacggcagcaaatctgacaagatgaacatttttggcggcttccgccagatggtgaaggaaggcggtatccggtcattgtggagggggaacgggaccaacgtgataaaaatcgccccggaaaccgcggtgaaattctgggcatatgaacagtacaaaaaactgttaactgaggagggacagaagattggtacatttgaaaggttcatctcaggcagcatggctggcgccacagcccaaactttcatctaccctatggaagtgatgaaaaccaggctagctgtgggcaagactggacagtacagtggtatttacgattgcgccaagaaaatcctgaaacatgaggggctgggtgccttctacaaaggttatgttcctaacctactgggcatcatcccatacgccggtattgaccttgccgtgtatgaattactgaagtcttactggctggacaactttgctaaggattccgtgaatccaggagtaatggtcttgctgggctgcggagctctcagctcaacttgtggccagttggcttcatatcccttggctctggtacggaccagaatgcaggcccaagctatgttagagggcagtccacagctgaacatggtgggcctgtttcgccgcattatctcaaaagaagggatcccaggcctgtatcgcggtatcacccccaacttcatgaaggtgctgcccgccgtcggcataagctacgttgtgtatgagaacatgaagcaaacccttggcgtcacccagaagtag

SEQ ID NO: 46163 - DNA, 1410 bp, Artificial Sequence
  Description of Artificial Sequence: Synthetic coding sequence
atgctgtgcctgtgcctgtacgtgcccgtgatcggcgaggcccagacagaattccagtatttcgagtctaaaggactgccggccgagcttaagtctattttcaaactgagcgtcttcatacccagtcaggagtttagtacctatcggcagtggaagcagaagattgtccaggccggcgacaaagacctggatggccaattagacttcgaagagttcgtccactatctgcaggaccacgagaagaagctcaggctcgtattcaaatctctggataagaaaaacgatggcaggatcgatgcccaggagatcatgcagtcactcagagatctgggggtcaaaataagcgaacagcaggcggaaaagattctcaaatctatggacaagaacggaactatgacaatcgactggaatgagtggagggactaccacctgctccatcccgtggagaacataccagagatcatcctatattggaaacattctaccatcttcgatgtgggtgagaatctcaccgtcccagacgaattcactgtggaggagagacagacgggtatgtggtggcgacacctcgtcgccggcggaggagctggggctgtttccaggacgtgtacggctcctttggacaggctaaaggtcttgatgcaggttcacgcttctcgctccaacaacatgggcatcgtgggtggtttcacccagatgattagagagggcggggcacgaagtttgtggagggggaatggcattaacgtgctgaaaatagcccccgagtctgccatcaagttcatggcctacgagcaaatcaagaggctggtcggatccgatcaggagactctgcgtatccatgaaagacttgttgctggtagtctggccggggctatcgcgcagtcctctatataccctatggaagtgctcaaaacccggatggcacttcggaaaacaggtcagtactctggcatgctagactgcgctcgtagaatcctggcccgagagggtgttgctgcattctacaaaggatatgtgcctaacatgttgggaataatcccatacgccggcatcgacctcgctgtttatgagactctcaagaacgcttggttacagcattatgcagtgaactccgccgaccctggcgtatttgtacttctggcgtgcggtaccatgagtagcacctgcggacagctggcctcatatcctctagctctggtgagaacgcggatgcaagcccaggcctcgatcgagggggccccagaggtcactatgtctagcctcttcaaacacattctccgcaccgagggggccttcggcttatataggggtctggcgcctaatttcatgaaagtcatccctgcagtgtctattagctacgttgtctatgaaaatctgaaaattactctcggggtccagagccgttag

SEQ ID NO: 46164 - DNA, 1506 bp, Artificial Sequence
  Description of Artificial Sequence: Synthetic coding sequence
atgctgcagatgctgtggcacttcctggccagcttcttcccccgggcaggctgccacggttctagagaaggggacgaccgcgaggtgcggggaaccccagccccagcttggagagaccagatggcatcttttctcgggaagcaggacgggcgggccgaggccaccgagaagagaccaacaatccttcttgtggtgggtccagctgaacagtttccgaagaagattgtacaggctggagacaaggacctggatggccagcttgactttgaggagttcgtccactatcttcaggatcacgagaaaaagctgcggcttgtgtttaagagcctagataagaaaaatgacgggcgcatagacgctcaagagattatgcagtcactaagagatctgggcgtgaagatcagtgagcagcaggcagaaaaaattctgaaacggatccggaccggacacttctggggtcccgttacttatatggacaagaatggaacaatgaccatcgactggaacgaatggcgagactaccacctgcttcatcctgtggagaatattcctgaaatcattctgtattggaaacattctactatcttcgacgtgggcgagaatctgacggtcccagacgagttcacggtcgaagaacggcagacaggaatgtggtggcgccatctggtagccggcggcggagccggcgccgtgtcccggacctgcaccgcccctctagatcggctcaaggttctcatgcaggtacacgccagtcgctctaacaacatgggaattgttggcggatttacgcagatgattcgtgaggggggcgctcgtagcctgtggagaggtaacgggattaacgtgctgaagatcgcccccgaatccgccataaaatttatggcatatgagcagattaagaggttagtgggtagtgatcaggagacacttcgtatccatgagcggctggtagctggttcacttgccggcgccatcgcccaaagttctatataccccatggaggtgctcaaaacaagaatggccttgcgtaaaacgggacagtacagcggtatgttggattgcgcacgccgtatcctggcccgagaaggcgtggcagccttctataagggatatgtgcccaatatgttgggcattattccatatgccgggattgatttagcagtctacgaaactttaaaaaacgcctggctccaacactacgctgttaactctgctgacccaggggtatttgtgcttctggcttgtgggaccatgagttctacttgtggtcaacttgcttcttacccgttggccctggtgcgaacgcggatgcaagcgcaggcttccatagaaggtgctcctgaggtaaccatgagcagtctgtttaagcacatcctgagaacagagggggcctttgggctctatcgcggtttggcacctaacttcatgaaggtcatccctgctgtcagtatttcatatgtggtgtatgaaaacctgaaaattaccctgggggtccagagtcgttag

SEQ ID NO: 46165 - DNA, 1512 bp, Artificial Sequence
  Description of Artificial Sequence: Synthetic coding sequence
atggtgagcagcgtgctgtgccggtgcgtggccagccccccccccgacgccgctgcgacggcggccagctccagcgccagctctccagcctctgtgggtgacccctgtgggggggcaatctgcggcgggcccgatcataggctgcggttgtggcgcctattccaaacattagatgttaatagggacgggggcctctgcgtgaacgacttagctgtggggcttcgaaggttgggcctccaccgcacagagggagaacttcagaagattgtacaagctggcgacaaagacttagatggccaactcgatttcgaagagtttgtgcactacctgcaggatcacgaaaaaaaactaaggctggtattcaagtccctagacaaaaaaaacgatgggaggatcgacgctcaggagatcatgcagtcacttagggacctgggtgtgaaaatctcagagcaacaggccgagaagatcctgaagtcaatggataagaatggaaccatgacgattgactggaatgagtggagggattaccacctgctccaccccgtggagaatatcccagaaatcatcttatactggaaacatagcactatctttgacgttggcgaaaacctcactgtgccagatgaattcactgtggaagagcgtcagaccggtatgtggtggcggcacctggtggcaggaggcggggctggggcggttagtaggacatgcaccgccccgctagaccggttgaaagtgttgatgcaagtccacgcgagccgctccaataacatgggaattgtggggggctttacccaaatgattcgggaagggggggctcgcagtctgtggcggggtaatggaatcaatgtgctgaaaatcgccccagagagtgcgatcaagtttatggcttatgagcagattaagcggctggtaggttctgatcaagagaccctccggattcatgagaggctggttgcaggcagtttggctggagcgatagctcagtcatctatctaccctatggaggttctgaaaacacgcatggcactacgcaagactggccagtacagcggcatgctcgattgtgcaagaagaatactggccagagaaggcgtggccgccttttataaaggctatgtgccaaatatgcttggaataataccttatgctggcatcgaccttgccgtctatgagactttgaaaaatgcatggctgcagcattatgccgttaatagtgccgacccaggcgtgttcgttctccttgcctgtggtacaatgagttctacctgcggacagttagctagctacccgctggcgttagtgcggacccgaatgcaggcccaggcctcaatagaaggcgcccccgaagtgaccatgagcagtctgttcaagcacattcttcgcacagagggtgcctttggcttataccggggcctggcccccaattttatgaaggtaatacctgcggtgagtatctcatacgttgtatatgagaatctaaagataactctcggagtacagtcaaggtag

SEQ ID NO: 46166 - DNA, 1548 bp, Artificial Sequence
  Description of Artificial Sequence: Synthetic coding sequence
atggtgagcagcgtgctgtgccggtgcgtggccagccccccccccgacgccgcagcgacagcggcctcctcatcagcatctagtcccgcaagcgtcggagatccttgtggcggggctatctgcgggggccctgatcatagattgagattgtggaggctgttccagactctggacgtgaacagggacggcggcctctgtgtgaatgatctagctgtaggtttaagacggctgggactgcaccgaaccgaaggcgagcttcaaaagatcgttcaggcaggtgacaaggacctggacgggcaattggatttcgaggagttcgtgcattatctgcaggatcacgagaaaaagctgagattggtttttaagagcctcgataaaaaaaatgacggacgcatcgacgcccaagaaatcatgcaaagtctgcgcgacctgggagtgaagattagtgaacaacaggcagaaaagatactgaaaagaattagaactggccacttttggggacccgtcacttacatggacaaaaacggcactatgaccatagattggaacgagtggcgagattatcatctgttgcaccccgtggagaacattccagagattatcctctattggaaacactccaccatttttgatgttggggagaacctgactgtaccagacgagtttacagtggaagagcgtcaaaccggtatgtggtggagacacctagtcgctgggggaggcgcaggcgccgtatcccgcacatgtaccgcacccctcgatcgcctgaaggttctcatgcaggttcatgcctctcggagcaataatatggggatcgttggcggctttacccaaatgattcgcgagggaggtgcgcgctctctgtggaggggcaatggtataaatgtccttaagatagcccctgagagcgcaatcaagttcatggcttatgagcagatcaagagactggtgggatctgatcaggaaactctgagaattcatgagagactggtggctggatcgcttgcgggagctatcgctcagagcagtatatatccgatggaggtcctcaaaacgagaatggctctaagaaaaactgggcagtactctggaatgctggattgcgccaggcggatcttggctcgagagggtgtggcagcgttttacaaaggatatgtccctaatatgctgggcataatcccctatgctgggatcgatctggcagtgtatgagacgctgaagaacgcttggctgcaacactacgcagtcaactcggccgaccccggcgttttcgtgcttttggcctgtggaacaatgtcatccacatgcggtcagctcgctagctacccgttggccttagtgagaactaggatgcaggcacaggcttcaatcgagggcgctcctgaggtaacaatgtcatcattatttaagcacattctccggactgagggagcctttgggctctatcgcggactggcacccaactttatgaaagtgatccccgcagttagcatttcatacgtggtatacgagaatctcaaaatcactctgggagtccaaagtagatag

SEQ ID NO: 46167 - DNA, 1470 bp, Artificial Sequence
  Description of Artificial Sequence: Synthetic coding sequence
atgctgcagatgctgtggcacttcctggccagcttcttcccccgggccggttgtcatgggtcccgggagggagacgatagggaagtgcgcgggacacccgctccggcttggcgggaccagatggcttcctttttggggaaacaggatggccgcgctgaggccaccgagaagagaccaactattttattggtcgtcggccctgcagagcagttcccgaagaagatcgtgcaggccggggacaaggatcttgacggacagctggatttcgaagagttcgtgcattacctgcaggatcacgagaaaaaactgaggctcgtctttaaatctctggacaaaaagaatgatggcagaatcgacgctcaggagatcatgcagtccctgcgcgacttgggtgtcaaaataagcgaacagcaggccgagaagatcctgaagagcatggataaaaatggcactatgaccatagactggaacgagtggcgagattatcatctgctccacccagtggagaatatccccgaaattattctgtattggaaacatagcacaattttcgatgtgggtgagaatttaaccgttcccgacgaattcaccgttgaggagcgccaaaccggcatgtggtggcggcacctggtagctggcggcggtgcaggagccgtatcacgaacctgcactgcccctctggatagactgaaagtgctgatgcaggttcatgcgtcccgctctaacaatatggggatcgtggggggcttcacgcaaatgatcagggagggcggggcacgcagtctctggcgagggaatggaattaacgtgctgaaaatagctcctgagagcgcaatcaaatttatggcatatgagcagattaaaaggctagtgggaagtgaccaggaaaccctccgtattcacgagcgcctggtcgccggttcattggctggcgccatagcgcagagcagcatctatcctatggaggtgttgaaaacacgcatggcccttaggaaaacaggtcagtatagcggtatgctcgactgcgcccgcagaattctggcacgcgagggggtagcagccttctacaaaggatatgtgcccaatatgctgggcataattccgtatgctggtatcgacctggcggtgtacgagactcttaagaatgcttggctccaacattatgccgtgaactcagctgaccccggggtcttcgtgctcctcgcctgcggcactatgagcagtacctgcggtcagctcgccagttatcctctggcattggttaggactcgcatgcaggcccaagctagtattgaaggtgcccccgaagtcaccatgagctccctgttcaaacatatactgcgcaccgagggagccttcggcctctaccgggggttggctcctaattttatgaaggtgatcccagccgtatccatcagctacgtggtgtatgaaaacctgaaaatcactctaggagtccagtcacggtag

SEQ ID NO: 46168 - DNA, 1101 bp, Artificial Sequence
  Description of Artificial Sequence: Synthetic coding sequence
atgcagagcctgcgggacctgggcgtgaagatcagcgagcagcaggccgagaaaatcttgaagtcaatggataagaacggaacaatgacaatcgattggaatgagtggcgcgattatcacctgctccaccccgtggaaaacatcccagaaattattttgtattggaagcatagtacaatcttcgacgttggcgagaacttgaccgtcccggatgagtttacagtggaggagaggcagacgggcatgtggtggcgccatcttgtagctggagggggggcaggggccgttagtcgaacatgcactgccccacttgatagactgaaggttctcatgcaagtgcacgcttctagatcaaataatatgggcattgttgggggctttactcagatgatccgtgagggcggcgccaggtcattgtggaggggcaatggtattaatgtcttgaagattgccccggaatcagcgattaagtttatggcatacgaacagatcaagcggttagtcggatccgatcaggaaactctacgcatccatgagcggctggtggctggaagtcttgcaggcgctatcgcacagtcgagcatttaccccatggaagtactgaaaacaagaatggctctgaggaagactggccagtattcgggcatgcttgattgtgccaggaggatcctagcccgggaaggagtcgccgctttctacaagggctacgtcccgaacatgctgggcatcataccgtatgctggcattgacctggctgtctatgaaacgctgaagaatgcctggctccaacactatgccgtaaactctgctgatcccggcgtatttgttctgctcgcgtgcgggaccatgagctcaacatgcgggcagctcgcatcctacccactggcccttgttaggaccagaatgcaggcgcaggcctcaatcgagggcgcccccgaagtaacaatgtcttctcttttcaagcacattctgaggacagaaggggccttcggcctgtacagaggccttgcacccaacttcatgaaagtaattcctgccgtctcaatcagctacgtggtctatgagaatcttaagattacattaggtgtgcaatcacgatag

SEQ ID NO: 46169 - DNA, 894 bp, Artificial Sequence
  Description of Artificial Sequence: Synthetic coding sequence
atgatcgacagcgaggcccacgagaagcggccccccatcctgacctcttccaagcaggatattagtccacatattaccaacgtcggagaaatgaaacactatctgtgcggatgctgcgccgcttttaacaatgtagccatcacttaccccattcagaaggttttgtttcgccaacagctttacgggattaaaacacgtgacgctgtcctgcagctgcgcagggacgggtttcgaaatttgtacagagggatccttccgccgctgatgcaaaaaaccaccaccctggcacttatgttcggcctctatgaggatttatcatgtctgcttaggaagcacgtgcgcgcacccgagttcgccacccatggggtggctgcagtactggccgggactgccgaggccatcttcacccccttagagagagtccagaccttgctgcagaatcataagcatcatgacaagttcactaatacctatcaagccttcaaggccctgaagtgtcacggaatcggggaatactatagaggtctcgtgcccatcctatttcgtaatggattgtcaaatgtcctgttctttggtctcagagggcctattaaagagcatctgccaaccgcaaccacccatagcgcacacctggtgaacgactttatcggtggcggactgctgggcgctatgctcggcttcttgtgctttcctatcaacgtcgttaagacgcgcttgcaaagccagatcggcggagaattccagtcttttccaaaagtctttcaaaagatttggctggagcgggaccgcaaactcatcaatcttttcaggggcgcccacctcaactaccatcgcagcctcatcagttgggggattatcaacgctacctatgagtttctactcaagtttatctag

SEQ ID NO: 46170 - DNA, 912 bp, Artificial Sequence
  Description of Artificial Sequence: Synthetic coding sequence
atggccctggacttcctggccggctgcgccggcggcgtggccggcgttctggtcggtcatcccttcgacaccgtcaaggttagactgcaggtgcagtcagtggagaagcctcagtacagaggcactctgcactgttttaaatccatcatcaagcaggagtcagtgctcggtctttataaaggtctgggttccccgctgatgggactgacatttattaatgccctggtgttcggagtccagggcaacacactgagggccctcggtcacgattcccctcttaatcagtttctggccggcgcagccgcgggtgccattcaatgtgtcatctgttgtccgatggagctggccaagacaagacttcaacttcaggatgcggggccagccagaacatataagggctcccttgactgcctggcacagatatatgggcatgagggcctgcggggggtcaacaggggaatggttagcaccctcctccgggagacgccgtctttcggtgtttacttcctgacttatgacgcgttgacacgagccctggggtgcgagccaggagaccggctcttggttccaaagctactgctggccgggggaacaagcggtatagtatcttggcttagcacctatcctgtggatgtggttaaaagcaggctccaagcggacggccttcgaggtgcacctcgctatagaggcatcctggactgtgtgcatcagtcttatagagcagagggctggagagtgttcaccagagggctcgcctccaccttactcagggcattccccgtcaacgctgccacattcgcaactgtcacggtcgttctgacttacgcgagaggggaagaggccgggcccgagggagaagcagtgcccgcagccccagctggccctgcgctggcccagccctcctccctgtag

SEQ ID NO: 46171 - DNA, 714 bp, Artificial Sequence
  Description of Artificial Sequence: Synthetic coding sequence
atgggcctgaccttcatcaacgccctggtgttcggcgtgcagggcaatacgctccgcgcactgggccatgattcccccctgaaccagttcttggccggtgcagctgccggagcaattcagtgcgtcatatgctgccccatggagctggccaagacccgtttgcagctgcaagacgccgggccggcccggacttacaagggatccctggattgtctagctcaaatctatggacatgagggactgagaggcgttaatcggggcatggtctctactttgctcagagagactcctagctttggggtctactttctgacttacgacgcattgacaagggcgctaggttgtgaacccggtgaccgcttgcttgtccccaagctgctgctcgcaggcggaacatcagggatagtgtcctggctctcaacctacccagtggatgttgtgaagtccaggctgcaggccgatggacttcggggagctcctcgatatagaggcatcttagactgtgtacaccagagttatagagctgaggggtggcgcgtgttcacgcgcggtcttgcttctacactccttagagcgttcccagtgaatgcggctacctttgcgactgtgacagtagtcttaacctacgcccgcggtgaggaggccgggcccgaaggggaagccgttcccgcagctcccgcgggaccagcactcgcacagccttcatccctgtag

SEQ ID NO: 46172 - DNA, 714 bp, Artificial Sequence
  Description of Artificial Sequence: Synthetic coding sequence
atgggcctgaccttcatcaacgccctggtgttcggcgtgcagggcaacactttacgggccctaggtcacgattctcccctgaatcaattcttggccggcgccgccgcgggggcaatacaatgcgtgatctgttgcccaatggaacttgccaaaactcggctacagctgcaggacgctggtcctgctcggacatacaagggcagccttgactgcctcgctcagatatacggtcacgaagggctaaggggcgttaatcggggcatggtctcaactctgcttagagaaacaccctcctttggagtgtattttctaacctacgacgcactcaccagagctctcgggtgcgagcctggcgaccggctgctggtgccgaaactgctgttggcgggtggcactagtgggatcgtgtcttggcttagtacatatcctgtcgatgtggttaaatcccggctccaagcggacgggctgaggggtgcgccaaggtataggggcattctggattgcgtgcaccagagttatcgggccgagggctggcgcgtttttacgcggggattagcttcaactctgctcagggcctttcctgtcaacgccgccaccttcgctacagtgactgtcgtccttacctacgccagaggcgaagaagctggccccgagggagaggccgtcccggccgcgccagcaggtccagccttagctcaacctagtagtctgtag

SEQ ID NO: 46173 - DNA, 714 bp, Artificial Sequence
  Description of Artificial Sequence: Synthetic coding sequence
atgggcctgaccttcatcaacgccctggtgttcggcgtgcagggcaacaccctgagggcactgggccacgacagccctctgaatcaatttctggctggtgctgccgctggcgctatccagtgcgtgatttgctgtcccatggagctcgccaagacccggttacagctccaagatgcagggccagccagaacttacaagggtagccttgattgcctggcccaaatatacgggcatgagggactgaggggagtcaaccggggaatggtgtctacattactccgcgagacaccctcttttggggtgtatttcctcacctacgatgccctgacccgagccctcggctgcgaaccaggagatcggttgctcgttcccaaactgctgttagccggcggaacatcaggcatagtgagttggctctcaacctaccccgtggatgtggtcaagtccagactccaggccgacggtctaagaggcgccccaaggtacaggggaatcttagattgcgtacaccagtcctacagggcggagggttggcgtgtttttacccgcggtctcgccagcacgctgctgagagcgttccctgtaaatgcagccacctttgctacagtaacagtggtactgacatatgcacggggcgaggaggcaggtccagagggtgaggccgtgcctgcagcacctgcaggacctgctctggcccaaccgtccagcctgtag

SEQ ID NO: 46174 - DNA, 714 bp, Artificial Sequence
  Description of Artificial Sequence: Synthetic coding sequence
atgggcctgaccttcatcaacgccctggtgttcggcgtgcagggcaataccttgcgcgccctgggccacgactcaccattgaatcagttcctcgccggagcagcggcaggggcgatacagtgtgtgatctgctgccctatggagctggccaagacccgattgcaacttcaggacgccgggcctgccaggacgtataaagggtctctggattgtttagcccagatctacggacacgaaggtttaaggggcgttaacagaggtatggtgagcacacttttgagggaaacgccttcgtttggggtgtacttcctgacttacgacgctctgactcgcgcccttggatgcgagcccggggaccgcctgctggtacccaagctgctgttggcaggaggcacgagcggaatcgtcagctggctatcgacctatcccgtggacgtggtcaagtctcgcctgcaggctgatgggctgcgaggcgcccccagatacaggggcatccttgattgtgttcatcagtcgtacagggctgagggctggagagtgttcaccagaggcctggcaagcactctgttgagagccttcccagtgaacgctgcgacgttcgccactgtgactgtggttttgacgtacgccaggggcgaggaagcagggcccgaaggagaggccgtccctgcggccccggcgggacccgccctagcccagccatcctcactctag

SEQ ID NO: 46175 - DNA, 936 bp, Artificial Sequence
  Description of Artificial Sequence: Synthetic coding sequence
atgagccagcgggacaccctggtgcacctgttcgccggcggctgcggtggaaccgtgggcgctatactgacgtgtccattggaagtggtcaagacccggctccagtcgagttcagttaccctttacatcagcgaggtgcagctgaatactatggccggggccagtgtgaatcgggtggttagccctggtccgctccactgcttaaaagtaattttagagaaggaggggcctcgcagccttttcaggggtctgggtcccaatcttgtgggcgtcgcaccaagccgagcaatctacttcgccgcctattccaattgcaaagaaaaactgaatgacgttttcgatccagacagtacacaggtgcacatgattagcgccgctatggccggttttactgcgatcaccgccaccaaccctatttggctgatcaagacacgtcttcagctggacgccaggaaccgcggggagaggcgcatgggagcttttgaatgtgtgcgaaaagtataccaaaccgacggtctcaaaggtttctataggggaatgagcgcatcatacgctggcataagcgaaactgtgatccactttgttatatacgagtcaatcaagcagaaacttctggaatacaaaacagcttccacaatggagaatgacgaagaatccgtcaaagaggccagcgattttgttggaatgatgcttgccgccgcaacttctaagacatgcgcaaccaccattgcctaccctcatgaggtggttcgcacacgactcagagaagaaggaaccaagtacaggagcttttttcaaaccctctctctcttggtccaggaggaggggtatgggtctctgtacagggggttgacgactcatctggtgagacagatcccgaacacagctataatgatggccacctatgagctagttgtatacctcctgaatgggtag

SEQ ID NO: 46176 - DNA, 933 bp, Artificial Sequence
  Description of Artificial Sequence: Synthetic coding sequence
atgagccagcgggacaccctggtgcacctgttcgccggcggctgcgggggcaccgttggtgctattcttacatgtccattggaggtggtcaagactcgtctgcagagctcatctgtgaccctttacatatctgaggtgcagttaaataccatggctggagccagtgtcaaccgtgtggtgagtcccgggcctttacattgcctgaaagtgatactagaaaaagagggtccacgctccctgttccgcggtctcggacccaatctggtgggagtagctccctccagagctatttacttcgccgcttacagtaactgcaaggaaaagctgaatgacgttttcgaccctgacagtacacaggttcacatgatctctgccgccatggctggtttcaccgcaataacagccaccaaccccatttggctgatcaagacacggctacagctggacgctcgtaaccgaggcgaaagacgcatgggagcttttgaatgcgtgagaaaagtgtaccagaccgatggcctgaaggggttctaccgcggaatgagcgcatcttatgcagggatctccgagactgtgatccacttcgtgatttacgaatctattaaacagaagttgctcgagtacaaaaccgcgtcgactatggagaatgatgaggagagtgtgaaggaggcctccgattttgtcgggatgatgctggctgctgcgacctctaagacatgcgcgaccaccattgcctacccacatgtagtacgaaccagactccgggaagaggggaccaaatatcggtccttcttccagaccttgtctctgctggtccaagaggagggctacgggtcactgtatagggggttgaccacacaccttgtgcggcagattcctaacactgcgatcatgatggctacttacgagctggtcgtgtatctgttgaacggctag

SEQ ID NO: 46177 - DNA, 927 bp, Artificial Sequence
  Description of Artificial Sequence: Synthetic coding sequence
atggacttcgtggccggcgccatcggcggcgtgtgcggcgtggccgtcggataccctctggatactgtgaaagttagaattcagaccgagcccaaatatactggaatctggcactgcgtgcgtgatacctaccatagggaacgggtctggggattctatcgggggttgtcactaccagtctgtactgtctcgctcgttagctcagtgtcttttggcacttacagacattgtctcgctcacatctgcagactcaggtatggaaacccagacgctaagcccactaaggctgatattaccttgtcaggctgcgcatccggccttgtgcgcgtgtttctcacctcccctacggaggtggccaaagtccggctgcagactcaaactcaggcccagaagcagcaaagacgactgagcgcgagcggccctctggcggtgccccccatgtgccccgtgcctcctgcgtgcccagaacccaaatacaggggacccttgcactgtcttgcaacagtggctcgggaggaggggttgtgtgggctgtacaagggaagctcagccctcgttctgagagatgggcacagctttgcaacttacttcctgtcctacgcagtgctgtgcgagtggctgtccccagccgggcactcacgaccagatgttcccggtgtgctggtagctggaggttgcgccggagtgcttgcttgggccgtggctacccctatggatgtaattaaatcaagactgcaggcggacggccaaggtcagagacgttatagaggcttgcttcactgcatggtgacctccgtgagagaggaagggccccgagtactgttcaaagggctggtgctcaattgctgccgagctttccctgttaacatggttgtgttcgtcgcctatgaagccgtcttgcgtttagcgcgcggcctgctgacttag

SEQ ID NO: 46178 - DNA, 876 bp, Artificial Sequence
  Description of Artificial Sequence: Synthetic coding sequence
atgggcagcttccagctggaggacttcgccgccggctggatcggcggagcagccagtgtaatcgtgggacaccctctcgacacagtcaaaacccggctccaggccggcgtgggatatggaaacacacttagctgcataagagtagtgtatcgtcgggagtccatgttcggttttttcaaaggcatgtccttccccctcgcgtcaattgccgtgtataacagcgtcgtgtttggggtcttttcaaatacgcagcggtttctgtctcagcatcgatgcggcgagcccgaggcctctccaccaaggacactcagcgacttgttgctggcatctatggtggcgggcgtcgtgtctgtggggctgggcgggccagtcgacctcatcaaaataagactacagatgcagacccaaccattcagagacgccaacctgggactgaagtctagggccgtggccccagctgaacagccagcttatcaaggtccggtacattgtattaccaccatcgtacggaacgaagggctggctgggctctaccgcggtgccagcgccatgctcttaagggatgtgccaggatattgcctttacttcattccctatgtgttcctctctgaatggatcacacctgaggcatgtacaggcccctccccctgcgccgtctggctcgccggagggatggccggaaagggctcatcaagctggtctcgaacgcccgtgcaggctaccgctgtgggtcagcttggcaattgtcacgctcttttatcaccaggggggggccaagacacattccgatattcccctaacaacagtcttctcggaacttatagcgtccccggcccactaccgcctcaatcgcaccccttcccgatgcagctttag

SEQ ID NO: 46179 - DNA, 474 bp, Artificial Sequence
  Description of Artificial Sequence: Synthetic coding sequence
atgggcagcttccagctggaggacttcgccgccggctggatcggcggggctgcaagcgtcattgtggggcacccacttgacaccgtaaaaaccagattgcaggccggcgtgggatacggtaacaccttgtcttgcatcagagtggtgtatcgccgagaatctatgttcggcttttttaaaggcatgtctttccccttagcttcgattgccgtgtataattcagtcgtgttcggtgtcttttccaacacccagagattcctgagtcaacacaggtgcggagagcccgaggcctcacctcctaggacactgagtgatctgcttcttgccagtatggttgctggagtcgttagcgtgggactgggcggtcctgtggatcttattaagatcaggctgcagatgcagactcaaccgtttcgcgacggaggagagcatcgtatgacaaccgtctttcccggcccgcacctgtgcatgtag

SEQ ID NO: 46180 - DNA, 936 bp, Artificial Sequence
  Description of Artificial Sequence: Synthetic coding sequence
atgggcagcttccagctggaggacttcgccgccggctggatcggcggagccgcatcagtgatagttggccatcccctcgacaccgtgaaaacccgattgcaggccggagtgggctatggcaacactctgtcctgcatcagagtcgtgtacaggagggagtccatgtttggcttctttaaaggaatgagcttccccctggctagcatcgccgtgtacaattcagttgtgtttggggtctttagcaacacacagcggttcttaagtcaacacagatgcggtgaacccgaagcctccccgcctcgcactttgagcgatctgctcttggcatccatggtggccggggtcgttagtgtaggcttgggcgggccagtcgatctcataaagatcaggctccagatgcagacccaaccttttagggatgctaatctgggactaaaatctagggctgtggctcccgctgagcagcctgcttaccaggggcctgtgcactgcattacaaccatcgtccgcaacgaaggtctcgcaggtctgtaccggggggcctctgccatgctgctgagagacgtgcccggttactgcctttacttcattccttacgtctttctttctgagtggatcactcccgaggcttgcacaggaccctctccctgtgcagtgtggctcgccggaggcatggcaggtgcgattagttggggaaccgccacccccatggatgtcgtcaaaagtcgcttgcaggccgatggtgtttatctgaataagtacaaaggcgtgttggactgcatctcccagtcctatcagaaagagggactgaaggtcttctttaggggaatcaccgtgaacgccgtacggggtttccctatgtcggcggctatgttcctcgggtacgagttgagccttcaggccattcggggtgatcacgccgtgaccagtccttag

SEQ ID NO: 46181 - DNA, 774 bp, Artificial Sequence
  Description of Artificial Sequence: Synthetic coding sequence
atgttcggcttcttcaagggcatgagcttccccctggccagcatcgcagtgtacaactccgttgtgttcggggtgttttcgaacactcagagattcctgagccagcacaggtgtggagagcctgaggcaagtcccccccgcacactgagcgatctgcttcttgctagtatggtggcgggcgtcgtatcagtggggctaggaggacccgttgatctgatcaagattagactccagatgcagacacagcctttccgggatgccaatctggggctgaaatcaagagcagttgctcccgccgagcaacccgcataccagggcccagtgcactgcattaccacaatcgtcaggaacgaaggacttgcaggactgtataggggtgctagcgccatgcttttaagagacgttccaggctactgtctgtactttatcccctacgtcttcttaagcgaatggataacacccgaagcctgcacagggccttctccctgtgctgtttggcttgcgggggggatggctggagccatttcttggggtacagctacccccatggacgtggtcaaaagccggctgcaggcagacggggtttatttgaataagtacaaaggcgtcttggactgcatcagccaaagctatcagaaagagggtctcaaggttttttttcgtggaattacggtgaacgcagtaagaggatttcccatgtctgcggcaatgtttttagggtacgagctgagccttcaggcaattcggggggatcatgccgtaacatcaccgtag

SEQ ID NO: 46182 - DNA, 2106 bp, Artificial Sequence
  Description of Artificial Sequence: Synthetic coding sequence
atggacgagagccccgagcccctgcagcagggccggggccccgtgcccgtgcgccgccagcggcccgcaccccgcggtctcagagaaatgctgaaggcaaggctgtggtgttcctgctcttgctctgttctctgtgtgagagcactggtgcaagatttactccccgcaacaagatggctgcgtcagtatcgtccccgggagtacctcgccggtgatgtaatgtcagggcttgtcataggaatcatacttgtcccacaggcgatcgcatacagcctgcttgctggtctgcagcctatttattccctgtacacatcttttttcgccaatctgatctacttcctgatgggtacctctagacacgtgtccgtcggaatcttctccctactctgccttatggttgggcaggttgtggacagagaactacagctggccgggtttgatcctagccaagacgggctgcagcctggcgccaatagctcgacccttaacggaagcgccgctatgctcgactgtggccgcgactgttacgccatccgtgtggctactgcactcacactgatgacgggcctgtatcaggtgctcatgggagtgctgcgcttgggcttcgtgtcagcctacttgtctcaacctcttcttgatggctttgccatgggcgcctcagtaactatcctcacatctcagcttaagcacctcctgggggtgcgcatcccacgtcaccagggacctgggatggttgtgcttacctggctgtctctcctcagaggcgccgggcaggcgaatgtctgtgacgtagttaccagtaccgtgtgtcttgctgtacttttggccgcaaaagagctgtcggaccggtacaggcatcgcttgcgggtccccctgcctaccgaactgctggtgatcgtggtggctaccttggtgtcacattttggtcagctgcacaagagatttggctctagtgttgcgggcgatatccccacgggcttcatgccacctcaggtcccagagcctaggcttatgcagagagtagcactggatgcggtggcgcttgctctggtcgccgccgccttttctatctctctggccgaaatgttcgcacggtcccatggatactcggtgcgggctaatcaggagttgctggcagtgggctgctgtaatgtgctgccagcatttctacactgttttgctacatccgcggcgctggcgaaaagtctcgttaaaactgccaccggctgtcgcactcaactttcctcagtcgtctccgccacagttgttcttctggtgttgctggcattagcccccctgttccacgacttgcagcgctctgtcctcgcttgtgttattgtggtctctctgcgtggcgccctgaggaaggtttgggatttgccccggctttggaggatgtcccccgccgatgcactggtctgggccggcacagccgccacttgcatgctggtatcaactgaggccggtttactcgctggggttatcctaagtctgctatcactggcaggccgcacccagagaccaaggaccgcgcttttggctcggatcggcgacacggcattctatgaggacgccactgaattcgaagggctcgtccccgagcctggggttagggtgtttcgctttggcggtcctctgtattatgccaacaaagacttctttctgcagtcattgtattctctgaccgggctggatgctggttgcatggctgctcgccggaaagaaggtggatccgagacaggagtcggcgaaggaggtccagcccaaggtgaggacctgggcccagtgtcaacacgagctgcgttggtgcccgctgcagccggctttcatactgtggtcatcgattgcgcacctctgctcttccttgatgctgctggtgttagtacccttcaggacctgcgacgcgattatggggccttgggaatctcactactgctcgcctgttgttccccacccgtgcgcgacattctgagtcgaggcggcttcctgggggagggacccggcgatacagctgaggaagagcagctgttcttatccgtgcacgacgctgtccagactgcccgggcccggcaccgggagctcgaggctactgacgcccacctgtag

SEQ ID NO: 46183 - DNA, 2106 bp, Artificial Sequence
  Description of Artificial Sequence: Synthetic coding sequence
atggacgagagccccgagcccctgcagcagggccggggccccgtgcccgtgcgacgccagcggccagcacctcgaggtctgagagaaatgctgaaggcacgtctatggtgctcctgctcgtgctctgtcctgtgcgtcagggccctggtgcaggatctactgcccgcaaccaggtggcttcgccagtaccgtccaagggagtatctggctggggacgttatgtcgggacttgtcataggcattatattagttccgcaggctatcgcctactccttgttggctggcctgcagcccatttattccctgtatacctcgttctttgccaatctcatttactttctcatgggcacatcccgccatgtgtcagtagggatcttttctttgttatgtctgatggttggacaggtggtggatcgagagctgcagctcgccgggtttgatccaagccaggacggactccagcccggagctaacagcagtaccctgaacgggtccgcagctatgctcgactgcgggcgggactgctacgcaattagagtcgcaacagccctgaccctgatgacgggactgtaccaggtgctcatgggtgtccttaggttaggcttcgtgtctgcctacctctctcagcctctcttggacggatttgctatgggcgccagcgtgaccatcctaaccagtcagctgaaacacctgctgggggtgcgcatacctagacaccagggacccgggatggttgtacttacatggctcagcttgttgaggggtgcgggccaggccaatgtatgtgatgtcgtgacaagcaccgtgtgccttgcagtgctactcgccgccaaggaactatccgatagataccgccaccggctgcgcgtgccccttcctacagaattgctggtgatcgtcgtcgctacactcgtgtcccacttcgggcaactccataagcgatttgggagctctgtcgccggcgacattcccaccggcttcatgccaccacaggtgccggagcctcggctgatgcagcgcgtggccctggacgcagtggccctagcactggtggctgcagctttcagcatcagcctcgccgaaatgtttgctagaagtcacggttattcagtgagggctaaccaggaattgttggcagtgggctgttgtaatgtcttgccagctttcctgcactgttttgccacatccgctgccctggctaagtccctcgttaaaacggcaaccgggtgccggacgcagttgtcctctgtagtgtccgcaactgtggtactcctcgtcctgctcgcccttgccccactgttccacgacctgcagagaagcgtgctggcttgcgtgatagtggtatccctaaggggggcactacgcaaggtctgggacctccctagactgtggcggatgagccccgccgacgccctggtgtgggcaggaacagctgccacttgcatgctggtctcaaccgaggctgggttattagccggggtgatcctctctctgttgagcctcgcaggcagaacccagaggccacgcacagcgctcctggccagaatcggagacacagcgttctacgaagatgcaacagaattcgaaggactggtgccagaaccgggggtgcgggtctttaggttcggtgggccactgtactacgcaaacaaggatttcttcctccagagcctctatagcctgactggacttgacgcaggctgtatggctgcaaggcgaaaagagggtgggagcgagactggggttggcgaaggcggcccagctcagggcgaagatctgggtcctgtgagcacccgagctgccctggtgcctgccgccgccggattccacacggtggttatcgattgcgcacctttactgtttctcgacgcagctggcgtgtcaaccctgcaggatctgcgacgtgactatggggcattgggaatctctcttcttttggcctgctgctcgccccccgtgcgggatatcctatccagaggtggttttctgggcgagggacccggagacacagctgaggaggagcaactgttcctatctgtccacgatgccgtgcagaccgcaagagccagacatagggaactcgaggccactgacgcgcacctttag

SEQ ID NO: 46184 - DNA, 675 bp, Artificial Sequence
  Description of Artificial Sequence: Synthetic coding sequence
atggacgagagccccgagcccctgcagcagggccggggccccgtgcctgtgcgccgccagagacctgccccgcgtggcctgagagaaatgctcaaggctcgcctctggtgctcttgtagctgttcagtgttgtgtgtgcgagccctggtgcaggacttgctgcccgccactcgttggctccgccagtatcgtcccagggagtacctggccggtgacgtgatgtctgggctggtgatcgggataatattggtccctcaagccatcgcctacagcctgcttgcgggactgcagcccatctattctctttatacaagcttctttgccaaccttatctattttctaatgggaacaagcagacatgtgtctgtgggcatcttctctcttttgtgtttgatggtcggtcaggtcgtggaccgggaactacagcttgccgggtttgacccctcccaggatggactccagccaggagccaactcttccacgctcaatggttctgctgcaatgctcgactgcggcagggactgttatgcgattagagtggctactgccctcacattaatgactggactttatcagacgtcgtggggcagaaacagcttccagcagcatccgtggcagctcactcaaaggagcgattcccaggagctgctcgaggaggaggagaggtcgtgctag

SEQ ID NO: 46185 - DNA, 1365 bp, Artificial Sequence
  Description of Artificial Sequence: Synthetic coding sequence
atgcggctggacctggccagcctgatgagcgcccccaagagcctggggagtgccttcaagagctggcgtctcgacaaagccccaagcccacagcatacatttccttccactagcatcccaggcatggcttttgccctgctggcatccgtgccacctgtgtttggcctgtacacaagctttttccctgtattaatctatagtctcttaggaacaggcaggcacctgtccactggtactttcgctatactttccctgatgacaggctccgctgtcgaaaggctggttcccgagcccctggtcggcaacctgtccggtatcgagaaggagcagctagacgcccagagagtgggcgtggccgcagctgtggcatttggcagcggggctctaatgctgggtatgtttgttctacaattgggcgttctctcaacgtttctgagtgaacccgtcgtcaaggctctgacatcgggcgctgctcttcacgtgcttttatctcagctcccttccttgctcgggctctcattaccccgccagataggatgtttcagtcttttcaaaaccctggcctctttattgaccgcacttccgcggagttccccagccgagctcaccattagcgccttgtccctagccttgctcgtccctgtaaaggaacttaatgtgcgctttcgagaccgtttgcctacccctattcccggggaagtggtcctggtgctcttggcgtccgtgttgtgtttcacatcaagcgtcgacaccaggtatcaggttcagatcgtcgggttactgcctgggggatttccacaaccacttttgcctaacctggccgagctcccccgaattctagctgattcccttcccatagccctggttagctttgctgtcagcgcatccttggcttcaatccacgcagacaaatacagttacacgattgactccaaccaggagttcttggctcacggcgctagcaatttgatctcctctctattttcatgcttcccgaacagcgcaacccttgccactactaacttgttggtggacgcaggcggaaaaacacagctcgcaggattattcagttgtacagtggtgctcagtgtgcttttatggttagggcctttcttttattaccttcccaaagctgttctggcctgcataaatatcagttccatgcggcaagtgttctgtcagatgcaggaactcccccagctctggcatatatctcgagtcgatttcgcagtgtggatggtgacctgggttgccgtcgtaaccctttcagtcgacctcggactggccgtgggggtcgtgttttcgatgatgactgtcgtttgcagaacaaggagcagcagtcgatccagagggtccgctagttag

SEQ ID NO: 46186 - DNA, 1821 bp, Artificial Sequence
  Description of Artificial Sequence: Synthetic coding sequence
atgcccagcagcgtgaccgccctgggccaggcccggagcagcggcccaggcatggctccctcggcatgctgttgcagtcccgccgctctgcagcgccgattgcccatcttggcctggctgccctcgtattcactgcaatggctcaagatggatttcgtggctggactgtcagtcgggctgacagccattcctcaggcattggcatatgccgaggtggccggactccctcctcagtacgggctctatagtgctttcatgggatgctttgtctacttcttcctggggaccagccgagacgttactctgggaccaactgccatcatgagcctgctcgtgagtttttatacattccacgaaccggcttacgcagtactcctggcattcctgtcaggatgtatccagctggccatgggtgttctgaggttaggctttctgctggacttcatatcctaccccgtgataaaaggatttacaagtgccgcagccgtcacaattggcttcgggcagatcaagaacttattggggctgcagaatatcccacgaccattctttttgcaagtgtaccatacatttctgaggatcgctgagaccagggtcggggacgcagtgttgggcttggtttgtatgctgttgctgctggtcctgaagctgatgcgggatcacgtgccccctgtccatccagaaatgcccccgggagtgcggctgtctagaggattggtctgggcagccaccaccgcgagaaatgccctagttgtctcatttgcagccctcgtggcatactcctttgaggttacaggttaccagccatttatcttgacaggcgaaaccgcagaagggttacctcctgtgagaatccctcccttctccgtgactacggccaatggcacaatatccttcaccgagatggtccaggatatgggggccggcttggctgtggttcccctgatgggactcctggagagcattgcagtggcgaaggccttcgcttctcagaataattatcgcattgacgccaaccaggaattgctagccatcggcttgacgaatatgctcggatcattagtgagctcctacccggtgaccggcagctttggacgaacagccgttaacgcccagtctggagtgtgtactccagctggcggcctcgtaacaggcgtgctggtgctgctgtcattggactatctgactagcctgttctattatataccaaagagtgctctggccgcggtgatcattatggccgtggctccccttttcgacactaagatcttccggacattgtggagggttaagagattagacctgcttcctctgtgcgtcactttcctcctttgtttttgggaagtccagtatggaatattggccggagcacttgtctctcttctgatgctcttgcatagcgccgcccggcccgaaacaaaagtgtctgagggccccgtcctggttctgcagccggcatcaggcctgtctttccctgctatggaggctctgcgcgaggaaattctgtcccgcgcactcgaggtgagtcctccaaggtgtctcgtgctggaatgcacccatgtatgctctattgactataccgtagtcttgggcttgggggagctgttgcaggatttccaaaagcagggggtagctctggcctttgttggactccaggtacccgtacttcgcgttctcctgagcgccgatttaaaaggctttcagtacttctctaccctcgaggaggcagagaagcacctccgccaggagccaggtacacagccctacaacatcagggaggatagtatcctggatcagaaagtggccttgctcaaggcctag

SEQ ID NO: 46187 - DNA, 1821 bp, Artificial Sequence
  Description of Artificial Sequence: Synthetic coding sequence
atgcccagcagcgtgaccgccctgggccaggcccggagcagcggcccagggatggcccccagcgcatgttgctgttcgcctgccgctctgcagagaagattgccaatactggcatggctcccaagctactccctgcaatggcttaagatggatttcgtggccgggctctcagtggggcttaccgctatccctcaggccctagcgtacgctgaagtggcaggcttaccccctcaatatggcctgtattcagctttcatggggtgtttcgtttacttcttcttaggtacgtcgcgagacgtgacccttggccccaccgctataatgtcgcttctggtcagcttctacactttccacgaaccagcctacgctgtattgctggcatttctgagtggttgtatccaactagccatgggggtgctgagactgggctttctcctggactttatctcttaccccgtgataaaggggtttaccagtgccgcagccgtgaccataggcttcggtcaaataaaaaacttgctgggtctccagaacatcccccgaccgttttttctgcaagtttaccacaccttcctcaggattgccgagacaagagtcggggacgctgtgctgggtctggtatgcatgctgctcctgctggtgctgaaattgatgcgggaccatgtccctccagtccatccagaaatgcctcctggcgttcgactcagcagaggtctcgtgtgggccgccacgactgctcggaatgccttagtggtgagctttgcagctcttgtggcctactcgtttgaagtgacaggttatcagccattcatcctaacaggagagacagcagaaggactccctcccgtgcgcatcccaccattttcagtcacaacagccaatggcactattagcttcaccgaaatggtacaggatatgggtgctggactcgcggtagtgccgttaatgggactcctggaaagcatcgcggttgccaaagccttcgcgtcacagaacaattaccgcattgacgccaatcaggaactgctggcgattggcctcactaatatgctgggctccctcgtaagttcctaccctgtaaccgggagttttgggcggactgctgtgaacgctcagtccggcgtgtgcacacctgctggtggcctggtgacaggggtattggttctattgagtctggactacctgacaagcctcttttattatatacctaaatctgccctggcggcggtcatcataatggctgttgctcccctatttgatactaaaatcttcagaaccctgtggagagtcaagcggttggatcttctgcccctgtgtgtaacctttctattatgcttttgggaagtacagtatggcattctcgctggggcattggtgagcctgctgatgctgttgcattccgcggccagacccgagacaaaggtctccgaaggacctgttctggtgcttcagccagcatctggtttgtcgttcccagccatggaggcgctccgggaagagattctcagccgggccctggaggtatcccccccacgctgtttggtcctggagtgcacccacgtgtgctctatcgactataccgtggtccttggcctgggggagttgctccaggatttccagaagcagggcgtcgcgcttgctttcgttggcctccaggtccctgtcctcagggtccttctctctgcagacctaaagggatttcagtacttttcaaccctggaagaggcagagaagcacttacgacaggagccaggcacccagccctataacattcgggaagactccatccttgaccagaaggtggccctcctgaaggcctag

SEQ ID NO: 46188 - DNA, 1821 bp, Artificial Sequence
  Description of Artificial Sequence: Synthetic coding sequence
atgcccagcagcgtgaccgccctgggccaggcccggagcagcggcccaggaatggcccctagcgcttgttgttgttctccggctgcccttcagcgccggttacccatcctcgcgtggctgccatcttacagcctgcagtggctaaagatggactttgtggcaggtctgagcgtgggactcaccgccataccccaggccctcgcctacgcagaagttgctgggctgcccccacagtacgggttatacagcgcctttatgggttgctttgtttacttctttcttggcacttcaagagacgtgactttaggtcctaccgcgattatgtcccttttagtcagcttttatactttccatgaaccagcttatgctgtcctgctggcgttccttagtggctgcattcaactggctatgggtgttctaaggctcggtttcctgctggattttatctcttacccggtgattaaagggtttactagtgcagccgccgtgaccattggatttggccagatcaaaaacctcctgggactccagaatattccccgtcctttctttctgcaagtttaccacacctttttgagaattgccgaaacgcgggtgggtgatgccgtgctgggtctggtgtgcatgctgcttctacttgtgctcaaacttatgcgagaccacgttcctccagtgcaccctgagatgcctcccggagtcaggcttagtcgtggcctcgtgtgggccgcaaccaccgcccgtaatgcccttgttgtcagctttgctgcacttgtggcctacagttttgaggtaacaggttatcaaccatttatcctgaccggggagacagccgaaggcctccctcccgtgaggatcccccccttctctgtaacaactgccaacggaaccatctcctttaccgagatggttcaggacatgggcgccggactcgcagtggtccccttgatggggctcctggagtctatagcggttgccaaggcctttgctagtcagaacaactatcgtattgacgctaaccaggaacttctggcaatcggactcaccaacatgctgggaagcctcgtcagctcttaccccgtaacggggagctttgggcgaacagccgtcaacgctcagtcaggggtgtgcacacccgcaggggggctggtcactggcgtcctggtcctgctgagtctggactatctcacctccttattctactatatccccaaatccgcccttgccgcagtcattatcatggcagtcgctcccctttttgacacaaagatctttagaaccctatggcgcgtcaaacggctcgatcttcttccactgtgtgtgacctttcttctgtgcttctgggaggtgcagtacggtatcctagctggagcgcttgtttctttactgatgctgctccattctgctgcccgcccggaaactaaggtatcagagggcccagtgttggtgctgcagcccgccagcggactctcctttcctgccatggaggctctgagagaagagatcctttccagggccctggaagtatctcctcctcgatgtttagtgttggaatgcacccacgtttgtagcatcgactacaccgtggtcctcggcctgggggaactcttgcaagactttcagaagcaaggagtcgcgttagcgtttgtgggcctgcaggtgcccgtgcttcgcgtgctccttagtgccgatctgaaggggtttcagtacttcagtaccctggaagaagcggaaaaacatctgcgacaggaacctggtacacagccatataatatccgcgaggattctatcctcgatcagaaggtggccctcctgaaagcctag

SEQ ID NO: 46189 - DNA, 1971 bp, Artificial Sequence
  Description of Artificial Sequence: Synthetic coding sequence
atgaccggcgccaagcggaagaagaagagcatgctgtggagcaagatgcacacgccccagtgtgaggacattatacagtggtgtcggagacgccttcccatcctcgactgggccccccactataacctcaaagagaacctgcttcccgacactgtgtctggcattatgctagccgtccagcaagtcacccagggtttagcattcgccgtcctaagctccgtccatccggtatttggcctctacggatccctgtttcctgctatcatttatgctatcttcgggatgggacaccatgtggctacagggacctttgccttaacttctcttatctccgcgaatgccgtggaacggattgttccgcagaacatgcagaatcttaccacacagtcaaatacttcagtcctgggactttcggacttcgaaatgcagagaattcacgtggcggctgccgtgtcctttctgggaggggtaatccaggtagccatgttcgtcctacaacttgggtctgcgactttcgttgttacagagcccgtgatatctgccatgaccactggcgccgctacacacgtggtaacctctcaggtgaagtatttgctgggcatgaaaatgccttacatttcaggcccacttggattcttttacatttacgcttacgtttttgaaaacattaagtcggtccggctggaggcgctgctcctgtcactattgtctatcgtagtactggtcctcgtgaaggagctaaatgaacagttcaagcgcaagataaaagtggtgttgcctgtggatttggtgctgatcatcgccgcttcattcgcttgttactgcactaatatggagaacacctacggattagaagttgttggccatattccccagggcataccctccccacgtgccccacctatgaacattctctccgcagtcattaccgaagcattcggggtggcactggtcgggtacgttgcctctcttgccctggcgcaaggcagcgcaaaaaagttcaagtactccattgatgataaccaagagttcctcgctcatgggctgagtaatatcgtcagcagtttcttcttttgtatccctagtgctgccgcaatgggtagaaccgccggtttgtattctaccggggcaaaaacccaggttgcatgcttaatcagttgcatctttgtgctaatagttatctatgctattgggccgttattatattggctaccaatgtgcgtcctagctagcatcatcgtcgtgggacttaaggggatgctgatccagtttagggacctgaaaaaatactggaatgtcgataagatcgattggggcatatgggtgagcacttatgtcttcaccatttgtttcgctgctaatgtggggctcctgttcggcgtggtgtgcacaatcgcaatagtaatcgggagattcccacgcgccatgaccgtcagcattaaaaacatgaaggagatggaattcaaagtgaaaactgaaatggactcagagactttacagcaagtgaagattatctctatcaataatccactggtgtttctgaacgctaagaaattctataccgacctgatgaatatgatccagaaggagaatgcatgcaaccagcccctggacgacatctccaaatgcgagcagaatacactcctgaattccctgagcaacggtaactgtaatgaggaagcaagccaaagctgcccaaatgagaagtgctacctaatattggactgttccggattcaccttcttcgactactccggagtgtcaatgctggtagaagtctatatggactgcaagggccgaagcgttgacgtcctcctcgcacattgcaccgcatctctcattaaagctatgacctactatggcaatctcgattcggagaagccgattttcttcgagagcgtttcagccgccattagccatatccacagtaataagaacctctctaagctgtctgatcactctgaggtgtag

SEQ ID NO: 46190 - DNA, 1992 bp, Artificial Sequence
  Description of Artificial Sequence: Synthetic coding sequence
atgaccggcgccaagcggaagaagaagagcatgctgtggagcaagatgcacacacctcaatgcgaagacattatacagtggtgtagacgtaggctcccaatactggattgggccccacattataatctgaaagagaacctcctccccgacacagttagcggcatcatgcttgctgttcaacaggtgactcaaggcttggctttcgccgttttgagctctgtgcatccagtgtttggattatatggcagcctgttccccgccatcatctacgccatcttcggcatgggacatcatgtcgccacagggacatttgccctcacatcactgatcagtgccaacgctgttgagaggatcgttcctcagaacatgcagaacctgaccacccaaagtaatacctccgtgctcggcctttcagatttcgagatgcagagaatccacgtcgcggctgcggtctctttcctgggcggcgtcatccaggtcgcaatgtttgtgctgcaacttggctccgcaacgtttgttgtgacggaaccagtaatttcagctatgactacaggtgctgctacccacgtggtcacttcacaagtcaaatacctgttgggcatgaagatgccctacatctccgggccactgggattcttctacatttatgcttacgtgttcgagaatattaagtctgtgcggctggaggcgctactcctcagcttgctttcaatcgttgtgctggtactcgttaaggaactgaatgagcagtttaagaggaagattaaggtcgtgctgccggttgacctggtcttgatcattgctgcgagcttcgcctgctattgcaccaacatggagaatacgtacggattagaggtggttgggcacattcctcagggaatcccaagcccacgtgccccacccatgaacatcctgtctgcagtcatcacagaggcattcggtgtcgccttggtgggttatgtggcttcactggcactcgcccaggggtctgctaagaagttcaaatatagtattgatgataatcaggagttcctggcccacgggctctcaaacatagttagtagtttttttttctgtattcccagcgccgccgcgatgggcaggaccgcagggttgtacagcacaggcgccaaaacccaggtcgcctgcctaattagctgcatcttcgtgcttattgtaatatatgccatcgggcccctgctgtactggctacctatgtgcgtgctagcttcaataattgtggtgggtctgaaggggatgttaattcaattccgtgatctgaagaagtactggaatgtcgataaaatcgactggggaatctgggtgagcacctatgtctttactatttgctttgccgcgaatgtgggtctgttattcggggtggtgtgcacgattgcgatagttatcgggagattccctcgagctatgaccgtttctatcaaaaacatgaaggaaatggaattcaaggtcaaaactgaaatggattcggaaactcttcagcaggtgaagataatatcaattaataatccgttggtattcctcaacgcaaagaagttttacacagatcttatgaacatgattcaaaaggagaatgcctgcaatcaaccccttgatgacatctcaaagtgcgagcagaacactctcctaaattcactctctaatggcaactgtaacgaggaggcgtcacaaagttgtcccaacgagaagtgttaccttatcctggattgttctggctttacattcttcgactatagtggggtgagcatgctggtggaggtgtacatggactgtaagggccgctcagtcgatgtcctgctggctcattgcactgccagcctcattaaggccatgacctattacggaaatctggattccgagaaacctatcttttttgagtcagtatccgcagccatcagccacattcactctaacaaagcctcatacaagctcttgttcgataatctggacctgccaacaatgcccccgctgtag

SEQ ID NO: 46191 - DNA, 624 bp, Artificial Sequence
  Description of Artificial Sequence: Synthetic coding sequence
atgaccggcgccaagcggaagaagaagagcatgctgtggagcaagatgcacaccccccagtgcgaagacatcattcagtggtgtcgtagacgacttccaatcctggattgggctcctcactacaacttaaaagagaatttgctaccagatactgtctcaggtatcatgctggctgtacagcaagttacacagggtctagcattcgccgttctgagctctgtgcatccagtattcggcctgtatgggtctctgttcccggctataatatatgcgatattcggtatgggtcaccacgtggcgactggcacatttgctttgacttccctgatcagtgccaatgccgttgaaagaatcgtcccgcagaacatgcaaaaccttaccacccagtccaacacttccgtgctgggactgtccgatttcgaaatgcagcggatccacgtggccgcggccgtgtcctttttggggggcgtcatccaggtggctatgtttgtcctgcagttggggtcggctactttcgtggtaactgaacctgtcatatcagctatgacaactggcgctgcaactcatgttgtgaccagtcaggtgaaatatctattggggatgaagatgccgtacatttcttag

SEQ ID NO: 46192 - DNA, 1971 bp, Artificial Sequence
  Description of Artificial Sequence: Synthetic coding sequence
atgaccggcgccaagcggaagaagaagagcatgctgtggagcaagatgcacactccacagtgcgaggatattatccagtggtgtcgcagacgactacctatcttggactgggccccccactacaacctcaaagaaaatctgctgcctgatacagttagcggcattatgctggccgtgcagcaggtcacccaaggacttgcctttgcagtgctgagcagcgtgcatccagtgttcggcctctatggcagcctgttccccgccattatctacgcaattttcggtatgggacaccacgttgccactggcacattcgcactcacgagcctgattagcgcaaacgccgtggagcggatcgtcccacagaatatgcaaaatttgacaacacaatccaacactagtgtcttgggtctgtccgacttcgagatgcagcggatccatgtcgctgcagccgtgagcttcttgggcggagtcatccaggtggcaatgtttgtcttacagcttggatccgccaccttcgtggtgaccgaaccggttatatctgctatgaccacgggggctgccactcacgtcgtgacctcgcaggttaagtatcttctgggcatgaaaatgccctacatttcgggccctctgggtttcttctacatctatgcttacgtgtttgagaacattaagtctgtgaggctggaggccttgctgctgagtctgctgagtatcgtagtgttggttcttgttaaggagctgaacgagcaatttaaacggaagataaaagtggtgttacctgtcgacctagtgttgattattgcggcctcctttgcctgttactgtactaatatggagaacacttacggtcttgaggtggtgggccatatcccacagggtatcccctctccgcgcgcacccccaatgaacattctgtctgccgtgattaccgaggcattcggggttgcattagtcgggtacgtcgcaagcctagctctcgcccagggctcggccaagaaatttaagtatagcattgacgataaccaggaattcctggcgcatgggctgtccaacatcgtgtcaagcttcttcttttgcatcccgagtgccgccgcaatgggcagaaccgccgggctctacagtacaggcgccaagacacaggtggcatgcctcattagttgcatcttcgtgctgatcgtcatttacgctatcggaccactgctctactggctgcccatgtgtgtcttagcttctatcattgtagtgggcttaaaagggatgttgattcaattcagagacttgaagaagtactggaatgtggacaaaatcgattggggaatttgggtctccacttacgtgttcactatctgctttgctgccaatgtcggactgctgtttggcgtggtctgtacaattgccatcgtcatagggcggtttcctcgtgcaatgacagtcagtattaaaaacatgaaagagatggaattcaaggtgaagacagaaatggacagtgaaaccctccaacaggttaagatcatcagcataaacaaccccctcgtgtttctgaatgctaagaaattctatacagatttaatgaacatgattcagaaggaaaacgcttgcaatcagccacttgacgatatctcaaaatgtgagcaaaacacactactcaatagcctgtccaatggtaattgcaacgaagaagcttcacagtcctgtccgaatgagaagtgttacttaattttggactgtagcggttttacattttttgattacagtggagtgagcatgttagttgaagtctatatggactgtaaggggagatccgtcgatgtgttactggctcactgcaccgcctcactcatcaaagccatgacatattatgggaaccttgattcagagaagcctatatttttcgagtccgtctcagccgctattagccatatccatagcaacaaaaatttgagcaagctttcagaccattctgaggtgtag

SEQ ID NO: 46193 - DNA, 2913 bp, Artificial Sequence
  Description of Artificial Sequence: Synthetic coding sequence
atggcccagctggagcggagcgccatcagcggcttcagcagcaagtcacgacggaactcctttgcttatgatgtgaaacgggaggtttacaatgaggagacatttcaacaagaacacaaaaggaaggcatcttcgagcgggaacatgaacataaacattaccacttttcggcaccacgtccagtgccggtgtagctggcatagatttctccgatgcgtgctgactatatttccattcctcgagtggatgtgcatgtatcggctgaaggactggctcctaggtgatctgctggctgggatttccgtggggctggtgcaggttccacagggtttgaccctgagcctcctggccagacaactcattcccccattgaatatcgcgtatgccgctttttgttcctcagtgatttatgtcatattcggttcatgtcatcagatgtctatcggctccttttttttagtgtcagctctcctgatcaatgtgctgaaggtgagtccctttaataacggacagctggtcatgggaagttttgtgaagaacgagttcagtgcaccatcttacttaatgggctacaacaaatctctgtccgtggtggccaccacgacatttctgacaggcattattcagctgataatgggagtgttgggcctgggtttcattgcaacatacctccccgaaagtgctatgagcgcctacctggcagcggtggcattgcacataatgctgtcacaactgacctttatctttgggattatgatctcctttcacgctggccctattagtttcttctatgacatcatcaattactgcgtggccctgcctaaggccaattctacttctatcctcgtgttcctgacagttgtggttgctctccgtataaacaaatgcatcagaatttcctttaatcaatacccaatcgaatttccaatggagctttttttgatcatcggcttcaccgtcatcgcgaacaagattagcatggctaccgagacctcgcagaccctcatcgatatgattccttacagctttttattaccggtaactccggactttagcctcctgccgaagattatcttacaagcattctccctctctctggtaagctccttcctgctcatttttctcggaaaaaagatcgcctcactccataactatagtgtgaactccaaccaggatctgattgcaattggtctgtgcaatgtggtttcttctttcttccggagctgtgtgtttacaggggccattgccagaaccattattcaggacaaatccggcggaaggcagcagtttgcgtctctggtcggagccggcgtgatgttgctactgatggtgaaaatgggccatttcttttacaccctgcccaacgcagtgttagccgggatcattttgtcaaatgttatcccctacctggaaacaatctccaacctcccttcattgtggcgccaggaccagtatgattgcgcattatggatgatgactttttctagtagcatcttcctgggccttgatattgggttgatcatctcggtggtaagtgcctttttcatcaccaccgtgcgttcccaccgggctaaaattctattgcttggacagatcccaaacaccaatatttataggagtatcaacgactatagggagatcattacaattcccggggtgaagatcttccagtgttgttcctcaatcacgtttgtgaacgtgtattacctcaaacacaaacttctgaaggaggtggacatggtaaaagttccactgaaagaagaggagattttcagcctgttcaacagcagtgatacaaatctgcaagggggcaaaatttgtcgctgtttctgtaattgcgatgatttagaaccactcccaaggatactgtataccgagaggtttgagaataaactcgatccagaagcttcctcaattaacttaatacactgtagtcacttcgaatcgatgaatacgtctcagaccgccagcgaggatcaggtgccttacaccgtgtcaagcgtttctcagaagaaccagggccagcaatacgaggaggtggaggaagtgtggctgccgaataacagctcccgcaacagtagccctgggctcccggatgttgctgaaagccagggacgcaggagcctcattccttactccgatgcgtccctgctcccttcggtgcacacgatcattttagacttcagtatggtgcactacgttgactcccgcggccttgtcgtcctgcggcaaatctgtaacgcgtttcaaaatgccaatatacttattttgattgccggttgccattctagcatcgtccgtgctttcgaacgcaatgattttttcgatgccggtattaccaaaacccagctattcttgagcgttcacgatgcagtgttattcgcgcttagccgcaaggttatcggctcctctgaactttcaattgacgagtccgagactgtgatccgggagacatactcggaaactgacaaaaatgataattcccggtataagatgagttccagtttcttgggatctcagaaaaacgtaagccccgggtttataaaaatccagcagccagttgaagaggagagcgagcttgatcttgagttagagtccgagcaagaggcaggattggggctcgatctcgatcttgatcgggaactcgaacctgaaatggagcctaaggccgaaaccgaaactaaaacacagacagagatggagccccagcccgaaactgaacccgagatggagccaaaccctaagtcgcgaccccgtgctcatacatttccccagcagcgatactggcctatgtatcacccgagcatggcctcgacccaaagtcagacccagacacgcacatggtcggtcgagaggcggcgacatcctatggattcctatagcccagagggtaatagtaatgaggatgtatag

SEQ ID NO: 46194 - DNA, 2598 bp, Artificial Sequence
  Description of Artificial Sequence: Synthetic coding sequence
atggcccagctggagcggagcgccatcagcggcttcagcagcaagtcccgccgaaactcgttcgcatacgacgtgaagagggaagtttacaatgaagaaacatttcaacaggagcacaaaaggaaggctagcagcagtggtaatatgaatattaatattaccacttttcggcatcatgtgcagtgcaggtgcagttggcataggttcctccgatgcgtgctcaccatcttcccatttttggaatggatgtgcatgtatcggctgaaggattggcttctcggggacttactcgccggcatcagtgtgggcctcgtccaggtgccccagggcctcaccctgtctcttctggcaaggcagttaatccctccactgaatattgcctacgccgcattctgtagttccgttatctacgtgattttcggaagttgtcatcagatgtcaatcgggagctttttcctcgtgtcagcactgctaatcaacgttctcaaggtttcaccgtttaataatggtcaattagtgatgggatcattcgtgaagaacgagttcagtgcgccttcctacttgatggggtacaataaatcactcagcgtggtagccacaactaccttcctgaccggcatcatccagattatcggttttactgtaattgccaacaaaataagcatggctaccgaaacttcccagactttgattgatatgatcccatattccttcctcttgccagtgactccggacttttctctcctgccaaagatcatactccaggccttctcactgagcctcgtcagtagttttctccttatctttctggggaagaaaattgcatcccttcacaattactctgttaatagcaatcaagacctaattgccattggtctgtgtaatgtggtgagttctttctttcgttcatgtgtattcactggagctattgcccggaccatcatccaggataagagtggagggcggcagcagtttgcaagcttggttggagcaggagtgatgctcttacttatggtgaagatgggacattttttttataccctacctaacgcggtgttagccggaatcattctttcgaatgtcataccataccttgagacaatcagcaacctcccttccctgtggcggcaagaccaatatgactgtgccctgtggatgatgaccttttcttcaagtatctttctaggtttagacattggcctaattatctccgttgtgagcgcttttttcattactaccgtgagatctcacagagctaagatcttgctgctggggcagatccccaatactaacatctaccggtctatcaacgactaccgcgaaataatcaccattcccggcgttaagattttccagtgttgcagctccatcactttcgtgaatgtgtattatctgaaacacaagctcctcaaagaagtggatatggtgaaggtgccactcaaggaagaagaaatttttagtttgttcaattcaagcgatactaatttgcagggtggaaaaatttgcaggtgcttctgtaactgcgacgatctggaacctctgccccggatactgtacacggagaggttcgagaacaaactggacccagaagcctcttcgattaatctcatacattgtagccactttgaatctatgaacacgagccagacagcttccgaggaccaggtcccctatacggtatccagcgtctcccaaaaaaaccagggccagcagtacgaggaagtggaagaagtgtggctgcccaataattctagccgaaatagctctccaggacttcccgacgttgcggagagccaggggcggagaagtctaatcccatatagtgatgcatccctgctcccaagcgtccacaccataatcttagatttctcgatggtgcactatgtcgacagccgcgggcttgtcgttctcaggcaaatttgcaacgcttttcagaacgctaacattctgatcctgattgcgggttgtcattccagcatcgtgagagcctttgagcggaatgactttttcgacgcagggatcactaagacccagctctttctgtctgtgcacgacgccgtgctgttcgccttgtcaaggaaggtgatcggatcaagcgagcttagtatagatgaatctgaaacggtcatacgggagacctacagcgagacagacaagaatgataactcccggtacaagatgtcctccagctttctgggaagtcagaaaaacgtttccccaggtttcataaaaattcaacagcccgtcgaagaggaaagcgagcttgacctagagcttgagtccgagcaggaggcgggactgggccttgatctggacttggaccgtgaacttgagccagagatggagccgaaagccgagaccgaaacaaaaacgcagaccgagatggaaccccagcctgagacggaacctgagatggagcctaaccctaaatcccgcccccgcgcccacaccttcccacaacagcgctattggccaatgtaccatccgtccatggcttcaacccagagccagactcagacccgcacctggtctgtggaaagaagacggcaccccatggacagctattcacccgaggggaacagcaacgaagatgtgtag

SEQ ID NO: 46195 - DNA, 2913 bp, Artificial Sequence
  Description of Artificial Sequence: Synthetic coding sequence
atggcccagctggagcggagcgccatcagcggcttcagcagcaagtcacgaagaaattcttttgcctacgacgtgaagagagaggtttacaacgaggagacgttccagcaggagcataagaggaaggcgtcgagcagcgggaatatgaacatcaacattaccacctttcggcaccacgtgcaatgccggtgctcttggcaccggtttctcaggtgcgtgttgaccatttttccttttctggaatggatgtgtatgtatagactaaaggattggttactgggcgacctcctggccggaatatccgttggcctggtacaggtgcctcagggccttacactgagcctgcttgcacgccagctgattcctcctctcaacatcgcctacgcagctttttgcagcagcgtcatctacgtgatctttgggagctgccatcaaatgtcaatcggaagcttctttctggtcagcgccctgcttataaatgttttgaaggtatccccttttaacaacgggcagctggttatgggcagctttgtgaagaatgaattttcagcaccaagttacctaatgggttataacaagtccctgagcgtggtcgctaccacaacatttcttaccgggatcattcagctgatcatgggtgtgttggggctggggtttatcgcaacttacctaccagagtctgcgatgtccgcttaccttgccgccgtggccctgcacatcatgttgtctcagctgaccttcatcttcgggatcatgatctctttccatgcggggcctatttctttcttttacgacatcattaactactgcgtcgcacttcctaaggctaatagcaccagcatcctcgttttcttgacggtggttgtggctctgcgcatcaacaagtgtattcgtatctctttcaatcagtatccaatagagttcccaatggagcttttcttaatcatcggttttacggtcatcgcaaacaagatttctatggcaactgagacctcacagaccctgatcgacatgattccatacagctttctactgccagtcaccccagactttagcctgttgcctaagataatcctacaagctttcagtctctctctcgtcagttcatttctcttaatatttttgggcaaaaagatcgcctcactgcataattactcagttaactccaatcaagacctaatagctatcgggctctgtaatgtcgtgagtagcttcttccggagctgcgtcttcacaggcgccatagcacggacgattatccaggataagtctgggggccggcaacaattcgcctcacttgtcggtgcgggagtgatgctcctgttgatggtcaaaatgggacattttttctatacactacctaatgcagtcctagccggtatcattctttccaacgtcattccatacttagaaacaattagtaacctgcctagcctgtggaggcaagaccaatatgattgcgctctgtggatgatgacattttcctcttcaatttttctgggattggatatcggcctgatcattagtgtggtgagcgcattcttcatcacaacagtcagatcacatagggctaagattctactactgggacagatccctaatactaacatttacagatccatcaacgactatcgggagatcatcacgatccctggggttaaaatatttcagtgttgctctagtatcaccttcgttaacgtgtattaccttaagcataagctcctgaaggaggtggatatggtaaaagtgcctctgaaggaagaggagattttttcactttttaacagttctgatacgaatttgcagggaggcaaaatatgccgatgcttctgtaattgcgatgacctcgagccacttcctaggatcctgtatacagagcggtttgagaacaagctggatcccgaagccagttccataaacctgattcattgctcccattttgaaagtatgaacacgtctcaaacggcaagcgaggaccaagttccatatacagtttcatctgtgagccaaaaaaaccagggccagcagtacgaggaggtagaggaagtatggctgcctaataatagcagccgcaattcaagcccaggcctgccagacgttgcagagtcacagggacgcaggtccttaattccatattccgacgccagcctgctgccttcagtccatactatcatcttggattttagcatggtgcactatgtcgatagcaggggcttggtggtgttgagacaaatctgtaatgcattccagaacgcaaatattctaatccttattgctggctgccattcttctatcgtaagggccttcgagcgaaatgacttttttgacgcagggataacaaagacccaattatttctctccgtccacgatgctgtcctttttgcattatcgcgtaaagtgatcggatcctcagagctgtctatcgacgagagcgaaacggttatccgagaaacctacagcgagactgataagaatgacaatagcaggtataaaatgtcgagctcattcctgggatcacagaagaacgtttctcctggattcatcaaaatccagcagcctgtagaggaggagtctgaactggatttggagttggaaagcgagcaggaagccggcctcggcctggacttggatttggatcgcgaactggagccagagatggaacccaaggcagagacggagaccaaaacacaaacagagatggaaccacagccagaaaccgagcccgaaatggaacctaatccgaagtcacggcctcgagcccacaccttcccccaacagaggtactggcctatgtaccacccgagcatggcctctactcaatcccagacccaaacccggacatggagtgtcgaacgcaggcggcaccctatggactcttattcccctgaggggaactcgaacgaggatgtgtag

SEQ ID NO: 46196 - DNA, 2664 bp, Artificial Sequence
  Description of Artificial Sequence: Synthetic coding sequence
atgagccagccccggccccggtacgtggtggaccgggccgcctacagtcttactctcttcgatgatgagtttgaaaagaaagaccgtacatatcctgtaggcgagaagttaagaaatgcctttaggtgctcttcagccaagattaaagcagtggtttttggcctgcttcccgtgctcagttggctgcctaagtacaagatcaaagactatatcattccagatttactgggcgggctgtcaggtggatctatacaggttccacaggggatggcctttgctttgctggccaatctcccagccgtgaatggtctgtactcttcctttttcccccttcttacttatttcttcctcggcggtgtccatcaaatggtgcccggtacttttgcagttatttccatcttggtgggaaatatatgtcttcagttggcgcccgagagcaagttccaagttttcaacaatgcaaccaacgaatcatacgtcgacaccgccgcgatggaggccgaaagactccatgtaagtgcaaccctggcttgtctgaccgccattattcagatggggctcggatttatgcaattcgggttcgtcgctatctatctgtcagaatctttcatccggggtttcatgaccgctgcaggattgcagatattaatcagcgtactgaagtatatatttggactgaccataccaagctacacagggcctggcagcattgtcttcacattcattgacatctgtaagaacctgccccatacaaacattgccagcctcatcttcgccctgatctcgggcgccttcctcgtattggtgaaggagctgaacgctcggtatatgcataaaattcggtttcccataccaacagaaatgatcgtggttgtggttgccacagctataagtgggggctgtaaaatgcctaagaaatatcatatgcaaatagtcggtgagatccaacgcgggttccctacacctgtcagtccggtggtttcccagtggaaggatatgatcggaacagcttttagtttggcaatcgtgtcttacgtgatcaatctggctatggggcgcacccttgctaataagcacggttatgatgtcgactctaatcaggagatgatcgcgctcggctgcagcaacttttttggttcattcttcaaaatccatgtgatctgttgtgcactgtctgtcaccttagctgtggatggggccggcggtaaatcacaagtcgccagtctgtgtgtgagcctggttgtgatgatcacaatgctagttctgggcatttatctttatccactgccaaaatcggtgttgggtgccctgatcgcagtgaacctaaagaatagtcttaagcagcttaccgatccatactacttatggaggaaatccaaactggactgctgtatatgggtagtgtcattcctctctagcttcttcctatccctcccgtacggtgtggccgtgggagtggcttttagtgtgcttgttgtggtgtttcaaacccagttccgtaatggatacgccctggcccaggtcatggatacggacatttatgtgaatcccaagacctacaatcgggcccaggatattcagggtattaaaatcataacttactgcagtcctctgtattttgccaacagtgaaatatttcgtcagaaggttatagctaaaactggtatggacccacaaaaggtcctgctggctaaacagaaataccttaagaagcaagaaaagagacgcatgaggcccacccagcagaggcggagcctattcatgaagactaagactgtctccctccaagaacttcagcaagattttgagaatgcaccccccaccgaccccaataataaccagacccccgccaatgggacatcggtgtcgtatatcactttcagtcccgactcaagctcaccagctcagtctgaacccccggcttctgccgaggccccaggcgagccctctgacatgctggcctctgtgccgccattcgtaactttccacacactcatccttgatatgagcggcgtttccttcgtggacctgatgggcatcaaggccctagctaagctaagtagcacctacgggaaaatcggggtaaaggtgttcctcgtcaatatccatgctcaagtctataatgacattagccatggcggagtctttgaggatggatcgctggaatgcaagcatgtcttcccatcaattcacgatgcagtgctctttgctcaagccaatgcccgtgatgtcacaccaggccataacttccagggagctcccggcgacgccgaattaagcctttacgactctgaagaggacatcagaagttactgggacttggagcaggagatgttcggctctatgtttcacgctgaaaccctcaccgcgttagagtcactgtcggctgccgggggttgctacccttatcgttcggagtcattagtgagcccattgttcactaggcaggccctagcagcgatggataaacccccagctcatagcacgcctcctacctccgcgctcagcctggctgctgagggtcacctcgatttccagctgttgcgcgtaagccaaaagcagaaagataaatacaattgtgccggcctgctgtacaagcttcagaaggtctctcaaagccctcatggcagcgtcagcgacggtgtgcgcctgagtaggacatag

SEQ ID NO: 46197 - DNA, 2664 bp, Artificial Sequence
  Description of Artificial Sequence: Synthetic coding sequence
atgagccagccccggccccggtacgtggtggaccgggccgcctactctctgacgctttttgacgacgagtttgaaaagaaggacagaacttatcctgtaggggagaaactgcggaacgcttttagatgctctagcgctaagattaaagctgtggtcttcggcctcctgccagtgctgagttggctccccaagtataaaattaaggactatattattccagatcttcttggaggcctttccggcggctcaattcaggttccccagggcatggcattcgcgctcctggccaacctgcctgctgtgaacgggctgtactcatcctttttccccctactaacatatttcttcttgggcggagtgcaccagatggtgcctggaacttttgctgtgatctctatcctcgtaggcaacatttgcctccagctggcgcctgagtctaagtttcaagtgtttaacaatgcaaccaacgagtcctacgtcgacacagcggccatggaggccgagcgcctccatgtgagcgctactctggcatgtctcacagccatcattcagatgggcttaggtttcatgcagttcggcttcgtcgccatctaccttagcgagagcttcatcaggggcttcatgacagccgccgggcttcagatcctgataagcgtccttaagtatatcttcggcctgactattccttcctatacgggtcccgggtccattgtctttacctttatcgacatttgcaagaatttaccccacaccaatattgcttccttgatcttcgctctgatttcaggcgctttcctcgtcctggtgaaggagttaaacgcccgttatatgcataaaatccggtttcctataccaactgaaatgatagtcgtcgttgtcgctacagccatcagcggagggtgtaaaatgcctaagaaataccacatgcaaatcgttggcgaaatccagcgagggttccctaccccagtcagccctgtcgtctcgcagtggaaagacatgattggtacagcattctctctggctatcgtgtcgtatgtgattaacttggccatggggaggacattggccaataagcatggctacgatgtggactctaaccaggaaatgatcgctctcggatgcagcaatttctttggatccttttttaagatccatgttatctgctgcgccttgtcagtcacactggccgttgacggagcagggggtaagtcccaggttgcttccctgtgtgtgtctctggtagtgatgattaccatgctggtgcttggaatctacctataccctctcccgaagtcagttcttggagcccttatcgctgttaatctgaaaaacagcctgaagcagttaacagatccttattatctgtggaggaagagtaagctggactgttgtatatgggtcgtttcattcctgtctagtttctttctgtccctgccttatggtgtcgccgtaggcgtagcgttctctgtccttgttgttgtgttccaaacacaatttagaaatggatacgctttggcccaagtgatggacactgacatttacgtgaaccccaagacgtacaatagggcccaggatatccaggggatcaagattatcacttactgttcacccttgtactttgcaaatagtgagatatttagacagaaagtgattgccaagactggcatggatccacaaaaggtgctcttggctaaacagaagtacctgaaaaaacaggaaaaaagacgaatgagaccgacgcagcagcggaggagcctctttatgaagaccaagacggtgagtctgcaagaactgcagcaggactttgagaacgcacctcctaccgaccctaataataaccaaacgcccgctaatgggacctcggtgtcatacattacattttcaccggatagctccagtcctgcgcaatctgagcctccggctagcgcagaggcccccggcgagccaagtgacatgctcgcctctgtgcctcccttcgtgacctttcacacactgatccttgatatgtctggagtatcgtttgtcgatctgatgggaatcaaagcgctggccaagctttcaagcacctatggcaagattggcgttaaggtttttctcgtgaatattcacgcacaggtgtataacgatattagccacggtggagtgtttgaggacggcagtctagagtgcaagcacgtcttcccttccatccacgacgctgttctgttcgcccaagcaaacgcacgcgatgtaacccctggccacaacttccagggggctcccggggacgccgagttgagtctttacgactctgaggaggacatccgctcttactgggacttagaacaggagatgtttggtagcatgttccacgccgagactctcactgctcttgagtccctctctgcagcaggagggtgttatccttatcgcagcgaaagcctggttagtcctcttttcacaagacaagccctcgccgctatggacaaaccacccgcccacagtactcctcctaccagcgccctttcactggccgccgaaggccacctggacttccagcttctgcgagtgtcccagaagcaaaaggataaatataactgcgccggcctcctgtacaaactgcagaaagtcagtcaaagtccccatggctccgtgtccgacggagttcgcctttctcgtacatag

SEQ ID NO: 46198 - DNA, 2376 bp, Artificial Sequence
  Description of Artificial Sequence: Synthetic coding sequence
atgagccagccccggccccggtacgtggtggaccgggccgcctactccttgaccttattcgatgatgagtttgaaaagaaagatcggacctaccccgtcggagagaagctgcgaaatgcatttagatgttcttccgccaagatcaaagccgttgtatttggccttcttcctgttctgtcctggcttcccaaatacaaaatcaaggactacatcataccagaccttctcggcggactgtccgggggctccatccaagtgccccagggaatggcctttgccttgctggcaaatttacctgccgtaaacggactttactcctctttctttccactcttaacgtacttctttttgggaggggtacatcaaatggtgcctgggacattcgcggtgatttcaatcttggtgggcaacatttgtctccagctcgcgcccgagtccaaattccaagtgtttaataacgccaccaacgagagctatgtggatactgcagcaatggaggccgaacggctgcacgtgagcgctacattggcatgtctgactgccatcatccagatgggcctgggcttcatgcagtttggattcgtggcaatctatctgagcgaatcctttattcgtggcttcatgacagccgcgggcctccagattcttatttccgttctcaaatatatcttcgggctgactatcccaagctatacaggaccaggctctattgtttttaccttcatcgatatctgcaagaacttacctcatacaaatattgctagcttgatatttgcgctgatctctggcgcattccttgttcttgtaaaggagctcaatgcccgctatatgcataaaatacggtttcctatcccaaccgagatgatagtggtagtggttgcaactgctattagcggtggatgcaagatgcctaaaaaataccacatgcagattgtaggcgagatccagagggggttccctacacctgtatcaccagttgtgtcccagtggaaagatatgattggtacagcatttagcctcgcgatcgtgagctatgtgattaacctcgccatgggtaggacactcgccaataagcatggctacgacgtcgactctaatcaggaaatgatcgcactggggtgtagtaatttcttcgggtctttcttcaagatccatgtgatctgttgtgcactctcagtgaccctggccgttgatggcgcggggggcaagtctcaggtggcttccctgtgtgtgagcttagtggtcatgatcactatgttagtcttagggatctacctctacccacttcctaagtcggtacttggggcattgatcgcggtgaacctgaagaactccttaaagcaactcacagatccctattatttatggagaaaatcaaagcttgattgctgcatttgggtggttagctttctttcatcttttttcctctcattaccttacggggtggcagtgggagtcgctttttctgtgctggtggtcgtgttccagacccaatttaggaacggctacgctctcgcacaagtgatggataccgacatctacgtgaaccctaagacctacaaccgagcccaggatatacagggcatcaaaatcatcacttactgcagtcctctttacttcgcaaatagtgaaatctttaggcagaaagtgattgctaagacaggcatggatccccagaaagtgctattagcgaagcagaaatacttgaaaaaacaggagaaacggaggatgaggccaacacagcagcgcaggtctctttttatgaagacgaaaactgttagtctccaagagctgcaacaggactttgagaacgccccccccacggatccaaataacaaccagaccccagccaacggcacctcggtttcttatattaccttttctccggattcttcttctccagctcaatccgagcccccagcatccgccgaagctccaggcgaacccagcgatatgctggccagcgttccacccttcgtcacttttcataccttgatcctggacatgtctggcgtcagttttgtcgatctgatgggaataaaagctctggctaaactctcgagcacttatggaaaaatcggggtgaaggtttttctagtgaacattcacgcacaagtttacaacgacataagccacggcggagtctttgaggacggctctctggagtgtaaacatgtgtttccatccatccatgatgcagtgctcttcgcgcaggcaaatgcacgtgatgtaacaccagggcataactttcagggcgcaccaggagatgccgaactgtctctgtatgactcagaagaggatattcggagttactgggatcttgagcaggagatgttcggatccatgttccacgcagaaaccctgacagctctctag

SEQ ID NO: 46199 - DNA, 1860 bp, Artificial Sequence
  Description of Artificial Sequence: Synthetic coding sequence
atgctgctgagctggctgaccgtgctgggcgccggcatggtggtgcttcacttcctgcagaagctgttattcccttacttctgggacgacttttggttcgtgctgaaagtcgttttgattatcatacgactcaaaaagtacgagaagcggggtgagctggtgactgtgctcgataaatttctttcccacgccaagcggcaaccacggaagcccttcattatttacgagggcgacatctatacctaccaggatgtggataagaggtcgtccagagtcgctcacgtgttcctcaatcattctagcctgaagaagggcgacacagttgccctgctaatgagcaacgaacctgacttcgtccatgtgtggttcggactcgccaagctgggctgcgtggttgctttcttgaatactaacattcgaagtaacagtctgcttaattgtattcgagcatgcggaccccgggccctggtggtaggcgcagatctcctggggacagtggaagaaatactgccgtccctaagtgagaatatctcagtgtggggaatgaaggattccgtccctcaaggggtgataagcctcaaagagaaactaagtactagtccagacgagccggtgccacgctcccatcatgtcgtctccctgttaaaatccacatgcctctatatattcaccagcggaacaactggactgcctaaggccgccgtgatctcccagttgcaggttctgagaggctccgcggttctctgggcgttcgggtgcactgcgcatgatatcgtctatatcaccttgcccttatatcattcttctgctgccatactggggataagcgggtgcgtcgagctcggcgccacctgcgttctgaagaagaagttctcagcctcacagttttggtccgactgtaagaagtacgatgtcacagtatttcagtacattggggaattgtgtaggtacctctgtaagcagtctaaaagagagggggaaaaagaccacaaagttagactggcaattggcaacgggattcgctcagatgtgtggcgtgagtttctcgaccggtttgggaatatcaaggtgtgcgaactctacgcggcaacagagagcagcatctcttttatgaattataccgggagaataggagctatcggaaggaccaatttgttctataagctcctgtcgaccttcgatctgattaaatacgatttccagaaggatgaaccgatgcgaaacgagcaggggtggtgtattcatgtgaaaaagggcgaaccaggactcctgatctctcgagtgaacgccaaaaatccattttttggatatgctgggccttataagcacaccaaagataagctgctctgcgatgtgttcaagaagggcgacgtgtacctgaacaccggtgatctgattgtgcaggaccaggacaatttcctctacttttgggaccggacgggcgacacctttcggtggaagggcgagaatgtcgccaccaccgaggttgcagacgtcatcggcatgttggactttatacaggaggccaacgtgtatggtgtcgccattagcggctacgaaggcagggccgggatggcttccatcatcctgaagcccaatacttccctagacctggagaaagtgtatgaacaagtggtgactttcctgccagcttacgcatgccctcgcttcctgcggattcaggagaaaatggaggcgacagggacgttcaaactcctgaagcatcagctggttgaggacggtttcaacccactgaaaatctctgagcccctgtactttatggacaatctgaagaagtcctacgtgctcttgacacgagaactgtatgaccagatcatgctgggcgagatcaagctgtag

SEQ ID NO: 46200 - DNA, 1860 bp, Artificial Sequence
  Description of Artificial Sequence: Synthetic coding sequence
atgctgctgagctggctgaccgtgctgggcgccggcatggtggtgttgcactttttgcagaaattactctttccttatttttgggacgatttctggtttgtgttaaaggtagtgcttatcatcattagattgaagaaatacgagaaaagaggagagctggttacagtactggacaagtttctgtcacacgcaaaacggcagcccaggaaaccttttattatatatgaaggcgatatttatacatatcaggatgtggataagcggagctctagagtggctcatgtgttccttaatcacagctcgctcaaaaagggagacacagtggctcttctgatgtctaatgagcccgacttcgttcacgtatggtttggcctggcgaagttaggctgtgtggtagcctttctgaataccaatattaggagcaatagtttgttgaactgcataagggcatgtgggccacgagcccttgtagttggtgccgacctgctgggtaccgtggaggagattctgccgagcttgagcgaaaatatttctgtctggggaatgaaagatagcgtgccccagggagtgattagtttgaaggagaagctcagcaccagccctgatgaaccagtgccacgcagccatcatgtggtgagccttctgaaaagcacttgtttatatattttcacctcagggacaactgggcttcccaaggccgctgtgatatcccagcttcaggtgctcaggggctctgccgtgctctgggcctttggctgtaccgcccatgacatcgtctatatcactttgcctctgtaccactcttccgccgctatcctgggcatatctggctgtgtagagctgggcgcaacctgtgttctcaagaaaaagttttccgcgagccagttctggtcggactgcaaaaagtatgatgtgaccgtgtttcagtatatcggtgagctgtgtagatacctatgcaaacagtcgaagcgtgagggagagaaggaccacaaagtgcgacttgccataggcaacggaattagatcagatgtctggcgagagttcctcgatagatttggaaatatcaaggtgtgcgaattatatgcggctacagaaagcagtatttctttcatgaactataccggtcgaatcggtgcaataggcaggacaaatcttttttataagctcttgtccacgtttgatctgatcaagtacgattttcagaaagatgaaccgatgcgtaacgaacaaggatggtgtatccatgtgaagaagggggagcctggtctgctgatctccagggtgaacgccaaaaacccattttttgggtacgcgggaccctataaacacactaaggataaacttctgtgtgatgtttttaaaaaaggtgatgtttacctcaacaccggcgacctcatcgtgcaagatcaggacaattttttgtatttttgggatcgcactggagacacattccggtggaaaggtgagaatgtggcaacaactgaggtcgctgatgtgattgggatgcttgattttatccaagaggcgaatgtctacggagtcgccatttcaggttatgagggacgtgccggaatggcttctataatattaaagccaaacacatctctagacctggagaaggtttatgaacaagtcgtgaccttccttccagcatatgcttgtccgaggtttctgcgcatccaggagaagatggaagcaactgggactttcaagctactaaaacaccaattagtggaagacggtttcaaccctctgaaaatttctgagcccttatactttatggataacttgaaaaaaagttatgtgttacttacccgcgaactctatgaccagatcatgttgggagaaattaaactgtag

SEQ ID NO: 46201 - DNA, 1860 bp, Artificial Sequence
  Description of Artificial Sequence: Synthetic coding sequence
atgctgctgagctggctgaccgtgctgggcgccggcatggtggtgctacacttcttgcagaaactgctctttccatacttctgggatgatttttggtttgttctgaaggtggtactgataatcattcgcctgaagaaatatgaaaaacggggggagcttgtgacggtcctcgacaaatttcttagtcatgctaagagacagcctcggaagcctttcatcatttacgagggggacatttatacataccaggatgtcgacaagagatcttcccgcgtggcccatgtgtttttaaatcactcctccttaaaaaagggcgacacagtggctcttctgatgtctaatgaacccgattttgtgcacgtgtggtttggacttgccaaattgggttgcgtggttgccttcctcaacacaaacattcgatccaattctcttctcaactgcattcgagcgtgtgggccaagagccctagtggtcggtgccgacctgctgggaaccgttgaggagattctcccctctctctccgagaacatctccgtttggggcatgaaagattctgtgccacagggtgtaatcagcctgaaggagaagctcagcacttctccagacgagcctgtccccaggtctcaccacgtcgtttctctgctgaaaagtacctgtctgtacatcttcaccagcggcacaactggtctgccgaaagcagccgttattagccagctgcaggtccttcgtggctctgcagtattgtgggctttcggatgcacagcgcacgatattgtgtatattacccttcccctttaccactcttcagcggctatcctggggataagcggatgtgtggagctgggggcaacttgcgttctgaagaaaaaatttagcgctagtcagttctggagcgactgtaagaaatacgatgtaacagtgtttcagtatatcggagagttgtgtcgatacctctgtaagcaatccaagagagaaggggagaaggaccacaaagttcgcttagctataggaaacggtattagatcagacgtatggagagagttccttgataggttcggaaacataaaagtatgcgagctctatgccgcaacggagtcctctatctcctttatgaactatactggtagaatcggcgcaattggcaggacaaatctcttctacaagctgctgagtacgtttgaccttattaaatacgattttcagaaagatgagcccatgcgcaacgaacagggctggtgcatccacgtgaagaagggtgagcccggcttgttgatatcccgagtgaatgctaagaatcctttttttgggtatgctggtccatacaaacacaccaaggacaaactgctgtgcgacgtgttcaagaagggagatgtgtacttgaatacgggagaccttattgtgcaggaccaggacaacttcctgtacttctgggataggacaggagacacctttcggtggaaaggagaaaacgtggccaccacagaggtagccgatgtaataggcatgcttgactttatacaggaagctaatgtgtacggcgtcgcaatttctgggtacgaggggcgcgccggaatggcatcaattattctcaagcccaatacaagcctcgatctggaaaaagtctatgagcaggtggtaacctttctgcctgcctatgcatgtcccagattcctgcgaatacaggaaaaaatggaggccacaggcacttttaaactgctcaaacatcagttagtggaggacggatttaaccccttgaagatttctgagccgctatacttcatggacaacctgaagaaatcgtatgttcttcttacccgtgaactttatgaccagatcatgttgggcgagattaagttatag

SEQ ID NO: 46202 - DNA, 1593 bp, Artificial Sequence
  Description of Artificial Sequence: Synthetic coding sequence
atgggcagcgtgggcagccagcggctggaggagcccagcgtggccggcacccccgaccccggcgtggtaatgagctttacctttgactcccaccagcttgaggaggctgcagaagcggcgcagggacagggcttgagagcgcggggcgtaccggcattcacagataccaccctcgatgagcctgtacccgatgatagataccatgctatctacttcgccatgttgctggctggcgttggcttcctgttgccctacaactctttcattacggatgtcgattacctccaccataagtaccctgggacatccatcgttttcgacatgtcactaacctacatcctggtcgccctagccgccgttctgctcaacaacgttttggtggaacggctcaccctgcacacaagaatcaccgcaggctatctgctggcgctggggccattgctgtttatttccatttgcgacgtctggctgcagctattttcccgcgaccaggcctacgcgataaaccttgctgctgtgggcacagtcgcattcgggtgcacagtgcaacagtccagcttttacggctacacaggaatgctccctaagagatacactcagggcgtgatgaccggggaaagcacagcgggtgtgatgatcagcctctcccgcattctgacaaagctgttgctccctgacgaaagagcctcaacgctgattttctttctggtgtcagtcgcccttgaactcctgtgtttcttgctgcacctgctggtgagacgcagccgcttcgttttgttttacacgacgcgccctcgcgactcacaccgcggccggcccggactgggtcgaggatacgggtaccgcgtccaccatgacgtggtggccggcgacgtacacttcgagcacccagctccagcgctcgctccaaacgagtctcctaaggatagcccagcacacgaggtcacaggaagtggcggcgcatacatgcgcttcgatgtccccaggccccgcgtacaacgctcgtggcctacttttagggccctactcctacaccggtatgtggtggcccgcgttatctgggccgatatgctaagtattgccgtaacttactttattaccctttgtctcttccccgggcttgagagcgagatcaggcactgcatcctcggagagtggctgcctatccttataatggcggtttttaacctgtctgacttcgtaggaaagatccttgccgccctcccagtcgattggagaggcacacacctcctggcctgttcatgcctgcgcgtcgtgtttatccctcttttcattctgtgtgtgtacccaagcggaatgcccgcccttagacacccagcatggccttgtatcttctctcttctgatgggaatctccaatggatactttggttctgtgcccatgattcttgccgccgggaaggtgtcaccaaaacaacgcgaattggccggaaatactatgacagttagctacatgtcaggcctgacacttggtagtgccgttgcttactgcacgtattcactcacgagagacgctcacgggagctgtttgcacgcatccacggcaaatgggtccatcttagccggcctgtag

SEQ ID NO: 46203 - DNA, 1593 bp, Artificial Sequence
  Description of Artificial Sequence: Synthetic coding sequence
atgggcagcgtgggcagccagcggctggaggagcccagcgtggccggaacacctgatcccggggttgtgatgagtttcacctttgactcacaccagttggaggaagccgccgaggctgcccaaggtcagggcctgagagcgcggggggtcccagcgtttacagacacaacactggatgaaccagtgccggacgaccggtaccacgcgatttattttgcaatgctgttggccggtgtcgggttcctattgccctataactccttcatcaccgatgtcgattacctccaccataaataccccggcaccagtatagtgtttgatatgagtttaacctatatcctcgtggccctggctgcagtgctcttgaataacgtcttagtagaacggctgactttgcatacaaggatcacggccggctatcttttggctctgggtccgctgttatttatatcaatctgtgacgtatggttacagttgttcagcagggatcaggcatatgctatcaatctcgccgctgtggggactgtcgcttttggctgcacggtccagcaatcatccttctacgggtacacagggatgttacctaaaagatacacacaaggcgtgatgaccggagaatcaaccgcaggcgtaatgatatcccttagccggattctgaccaagctcctcctccctgacgagagggcttctactctgatcttcttcctagtgagtgtggctctcgagctgctctgctttctgcttcacctcttggttcggaggtctcgatttgtgctattttacaccacaaggccgcgggactcacaccgcggccgccccggattaggcagaggatacggatacagagtgcaccacgatgtagttgccggcgatgtgcacttcgaacatcctgcgcccgcactcgcccccaatgagtccccaaaagacagccccgctcatgaggtaaccgggagtggcggagcatacatgcggtttgatgttcccagaccacgcgtacagagatcatggccaacattcagagccctcctcctgcaccgttacgtggtggcccgggttatctgggctgatatgctaagcatcgccgtcacctacttcatcaccctgtgtctttttccaggcctggaatccgagatccgccattgtatactgggggaatggctgcccattctgatcatggctgtgtttaacctatccgactttgtgggtaagatcctggcagcgctgcccgtggattggcgcggaactcatctgttggcctgttcatgcctcagggtcgtcttcataccgctgttcatcttgtgcgtctacccctcgggtatgcctgctctgcgacaccctgcctggccctgtattttcagtcttctgatgggcattagtaatgggtacttcggatcagtgcccatgatcctggcggctggcaaagtcagccccaagcagagagagctagctggtaacacaatgaccgtttcctacatgtccgggctcacactcggcagcgccgtggcctactgcacctactctttaacgagagatgcacatggcagttgtcttcacgcatccaccgccaacgggtctatactggcgggattatag

SEQ ID NO: 46204 - DNA, 492 bp, Artificial Sequence
  Description of Artificial Sequence: Synthetic coding sequence
atgggcagcgtgggcagccagcggctggaggagcccagcgtggccggaacccctgacccaggagtagtcatgagcttcaccttcgactcacatcagctggaggaagccgctgaggccgcccagggtcaggggctgcgggcccgaggggttcccgcattcacggataccactctcgacgagccggttccagacgacaggtatcatgctatctacttcgccatgctgttagccggcgtgggtttcctcctgccctacaattccttcatcactgacgtggactacctccaccacaaatatcccggaacgagtatcgttttcgatatgtcactgacttatatattggtcgccctggcagcagtactgctgaataatgttttagtcgaacgcctgaccctacatactcgcattaccgcgggttaccttctcgcgctcggccccttgctctttatctccatatgcgacgtttggttacagctgttttctcgggattag

SEQ ID NO: 46205 - DNA, 1707 bp, Artificial Sequence
  Description of Artificial Sequence: Synthetic coding sequence
atgctgcccggcctggccgccgccgccgcccaccggtgcagctggagcagtctctgcagattaagactccgttgtagggccgccgcatgtaatccgtcagatcgtcaggagtggcagaaccttgtgactttcggatcatttagcaacatggtgccttgcagtcacccctatattgggactctctctcaggtgaagttatactccacgaacgtgcagaaagagggacaagggtctcaaaccctacgcgtagaaaaagtgccaagcttcgagaccgccgagggcattggcactgagctcaaggcccctctcaaacaggagccccttcaggtgagggtgaaggcagttctaaaaaagcgggagtacggtagcaaatacacccaaaacaacttcattaccggagtacgcgctattaatgagttttgtttgaaatcctccgatctggaacaactacgcaagattcgccggcgttccccacatgaagataccgaaagctttaccgtttacctcaggagcgatgtcgaagcaaagtccctagaggtctggggtagtccagaagccctggcaagagaaaagaaactgcggaaagaagctgaaatagaatatcgtgaaaggctatttaggaatcaaaaaatcctcagggaataccgagactttctgggaaacaccaaaccccgctcacgcacagccagcgtattcttcaaaggacccggaaaggtagtgatggtggccatttgtattaatggcttgaactgcttcttcaaatttcttgcttggatatacaccggaagtgccagcatgtttagtgaggctatacactctctgtcagacacgtgcaatcaggggctgctcgccctggggatctccaaatccgtgcaaaccccagaccctagtcatccgtatggctttagtaatatgaggtacatatcttcactgatctccggggttggaatcttcatgatgggtgccggactttcctggtatcatggagttatgggcctgctgcacccacagccaattgagtcactcctgtgggcatactgcattctcgccggaagtttagtgagcgagggagcgacactgctggtggccgttaatgagctccggcggaatgccagagccaaggggatgagcttttacaagtatgtgatggaatctagagacccaagcaccaatgtcatcctcctcgaggacaccgccgctgtccttggcgtgatcatagccgccacctgcatgggtctaacctctatcactggtaaccccctgtatgattcactcgggagcctgggcgttggcacactgctggggatggtctcagcctttctaatttacactaataccgaggccttacttggacgcagtatccagcctgagcaggtacagcgcctcactgaactactcgagaacgatcctagcgttcgtgcgattcacgatgtgaaggcaactgacctggggctgggcaaggtacgtttcaaagccgaagtggacttcgacggacgtgtggtcactagaagttatctcgagaaacaggattttgaccagatgcttcaggagatccaggaagtcaaaaccccagaagagttagagacttttatgctgaagcacggggagaacattattgatacactcggcgccgaggttgaccgactcgagaaggagttaaagaagagaaaccctgaagtaagacatgtcgatctagaaattttatag

SEQ ID NO: 46206 - DNA, 1191 bp, Artificial Sequence
  Description of Artificial Sequence: Synthetic coding sequence
atgtggaagcagaacctgtggaagttcggcgaggccctgaagctgctgcctgagaagaaactccggaaggaagctgaaatagagtacagggagcggctgttcaggaaccagaagattcttagagaatacagggattttctgggtaataccaagccccggtccaggacagcctcagtgtttttcaagggtccaggaaaggtggtcatggtcgccatctgtattaacggccttaactgtttcttcaagttccttgcttggatttataccggcagcgcctccatgtttagtgaggcgattcattcactctcagacacctgtaaccaggggctacttgctctcggaatttccaaatccgtgcagacgccggacccctcacatccttatggcttctcgaatatgaggtacatctctagtctgattagcggcgtggggatttttatgatgggtgcaggcttgagttggtaccatggcgtgatggggcttctgcacccccaacctattgagagtctgctgtgggcttactgtattttggctggaagcttagtgagtgagggcgccactttgctcgtggctgtcaatgaactcagaagaaatgcaagggcaaaaggaatgtctttttacaagtatgtgatggagtctcgtgatccctctaccaacgtaatattgctggaggacactgccgcagtcctaggcgtcatcattgctgccacatgcatgggtctgacttccattacgggcaatccgctttacgatagcttaggcagtctcggagtcggcacgctgctcggaatggtcagcgcctttcttatttataccaacactgaagctcttcttggtcggtccatccagccagagcaggttcagcgtctcactgagttgctggaaaatgaccccagtgttagggccatacatgacgttaaggcaacagacctggggctcggcaaggtgaggtttaaggccgaagtggatttcgacggacgggtcgtcactcggagctatttggagaaacaagactttgatcagatgctgcaggagatccaggaagtgaagactccagaggagctggagacttttatgctgaagcatggcgaaaacataatagacaccctcggtgccgaagtcgatcgcttggagaaagagctgaaaaagaggaaccctgaggtgagacatgtggacctcgagatcctctag

SEQ ID NO: 46207 - DNA, 1446 bp, Artificial Sequence
  Description of Artificial Sequence: Synthetic coding sequence
atgggcgccctggcccgggccctgcccagcatcctgctggccctgcttctgacgagcacgcccgaagccctcggtgcaaaccctggtctggtcgctaggatcaccgacaaaggtttgcagtacgctgcgcaggaggggctgctggcactgcagtctgagctgctgagaattaccctgcccgactttactggagacctgcggattccacacgtggggagaggcaggtatgaatttcatagcctgaacattcactcctgcgagctgctccattccgcattgcggccagtccccggtcaggggctatcccttagcatatctgacagctccattcgtgtccagggaaggtggaaagtgcggaaatccttcttcaaactgcagggctcttttgacgtatcggtgaagggcatctctattagtgttaacctccttttgggctccgaatctagcggacggcccaccgttaccgccagctcctgttcttccgacatagccgacgttgaggtcgatatgtctggcgacctgggctggttgctgaacctgttccataatcagatagaatccaaattccagaaggtattagagagccggatttgtgagatgattcagaaaagtgtctccagcgacctccagccttacctccagacacttcccgttaccactgaaatcgactcttttgcggacatcgactatagtctggtcgaagcgccacgcgcaacagcgcagatgttggaagtcatgttcaagggggagatctttcatagaaatcacagaagcccagtgacgctgttggcggctgtcatgagtctcccagaggagcacaacaaaatggtgtactttgctatcagcgactacgtcttcaacaccgcttcattagtttatcatgaggagggctacctgaattttagcatcacagacgatatgatccccccagatagtaatatcagacttactaccaagtcttttcggccgttcgtccctagattagcacggctgtaccccaatatgaacctggaactgcaaggatccgtgccctccgcgccactgctgaatttttcccccgggaacctttctgtcgacccctatatggagatcgatgcctttgtgttactgccttcaagttccaaagagcccgtgtttcggctgtcggtagctaccaatgttagcgcaaccctgaccttcaatacctctaagattaccggcttcctcaaacctgggaaggtgaaggtggagttgaaggaatccaaagtgggcctgttcaatgccgagttacttgaagctctgctcaattattatattctaaacaccttctaccccaaattcaatgacaaactggcggaagggttcccgttgcctctactcaagagagtccagttgtacgatctgggtttgcagatccacaaagacttcctctttctcggggccaatgtgcaatacatgcgggtgtag

SEQ ID NO: 46208 - DNA, 1233 bp, Artificial Sequence
  Description of Artificial Sequence: Synthetic coding sequence
atggccgccgccgccgtgggcgccggccacggcgccggcggccccggggcggcaagcagctcaggaggagcccgcgaaggagcccgcgttgccgcgttgtgcttactgtggtatgccttgtccgctggtggcaacgtggtgaataaggtgattctctccgcctttccgttccccgtaacagtctccctgtgccacatcctcgcactgtgcgctgggttacctcccctcctgcgcgcatggagagtgcctcccgcccctccagtgagtggtcctgggccatcgcctcacccttcttccgggccgctcttgccccctcggttctatcctaggtacgtgctgccactagccttcggaaagtacttcgccagtgtttctgctcatgtgtcaatctggaaggtaccagtgagctacgcccacaccgtgaaagcgacaatgcccatctgggttgttcttctctcgaggatcattatgaaagagaaacagtccactaaggtttatctctcattaatcccaatcatcagcggggtcctcctggccacagtcacagagttaagctttgatatgtggggcctcgtcagcgctctcgcagcgacactgtgtttttcgttgcagaacattttctccaaaaaagtgcttagggattctcgaattcatcacctaagactgctgaacatcttaggctgtcacgccgtcttctttatgatccctacttgggttttggtcgatctgagcgcttttctcgtgtccagcgatcttacttacgtgtaccagtggccctggaccctcttgttgttggccgtgagtggtttctgcaacttcgcacaaaatgtaatcgccttttcgatcctgaatctggtctcaccactgtcttactcagtggcaaatgccactaaacggattatggtgattacagttagtcttataatgttgagaaatcccgtcacctccacgaacgtgctggggatgatgaccgccattctgggggttttcctgtataataagacaaagtatgacgccaaccagcaggctcgtaagcatctactgcccgtgacaaccgcggaccttagcagcaaggagaggcaccggtcccccctcgagaaaccccacaacggcctcttgtttccacaacacggtgactatcagtacggccggaataacattttgaccgatcattttcagtacagtcgccaatcgtaccccaattcttacagccttaataggtatgatgtgtag

SEQ ID NO: 46209 - DNA, 1458 bp, Artificial Sequence
  Description of Artificial Sequence: Synthetic coding sequence
atggacgtgaaggccgcccccaacggcgtggccaccatcgaggaccgaattttaagaattacggggtactacggctactatccgggatacagcagccagaagtcaacttcgaggagctccgtcacacggtgcaaaccaggagctaactgcccatcaagccacagcggcattagtagacagttatccccccttagcgttactgaagacagcagtgccccgatcctggagctccaaaatcaaggcagtagtggagtgtgcggccatagggttgagcgtcagaaccgctctgcggatgatggcacacagacccactctgaaaatagtagtcaggagaaccggatcaaggccaggtgtctaagctgtacaagtatggttctcaaggggatctggggactcctgatcatcctgtctgtgtcgagcagttgggttggcacaactcaaatcgttaaaattacttacaagaatttttattgccctttctttatgacatggttttccactaactggaatattatgttcttccccgtttactacagtgggcacctggcaacagcgcaggagaaacagtctccaatgaaaaaatttcgcgagtgttctcgcatattcggggaggacgggctgactctgaagctgtttctcaagcgcacagcgccttttagcattctctggactttgacaaattacctgtacctcctcgcattgaagaaactaacagcaaccgatgtttccgctctgttctgctgcaacaaggctttcgtatttctcttaagttggattgttctgaaagaccgatttatgggcgttcgcatcgtcgctgccatcatggcaatcaccggcatagttatgatggcgtacgcagataatttccatgccgattccatcatcggcgtggccttcgccgtgggttccgctagcaccagcgccctctacaaggtgctctttaagatgttcctagggtcggcaaattttggtgaggctgctcattttgtcagcacactcggattttttaacttgatcttcatctcatttacaccagtgattttgtatttcactaaggtcgagcactggtcttcatttgcagccttaccatggggctgcctgtgtggaatggctggcctgtggctggcttttaacatattggtaaatgtgggcgtggttttgacataccccatcctgatctccattggaaccgtcctgtccgtgccaggcaatgcagctgtggatcttttgaaacaagaggtgatttttaacgttgtgcgcctcgcggcgaccatcataatttgtattggcttcctgctcatgctgctgcctgaggaatgggacgaaatcaccttgcggttcataaattcacttaaggaaaagaaatccgaagaacacgtcgacgacgtgaccgatccctcaattcatcttcgcggacgcggccgggccaacggcacagtatctatccctctggcctag

SEQ ID NO: 46210 - DNA, 975 bp, Artificial Sequence
  Description of Artificial Sequence: Synthetic coding sequence
atgagcgtggaggacggcggcatgcccggcctgggccggccccggcaggcccgttggaccctaatgttgttactcagcacagcgatgtacggtgcccatgccccactactcgctctctgccacgtggacggccgtgtccctttccgtccaagtagtgccgtcctgctgactgaacttaccaaactccttctctgcgccttttccttgctggtggggtggcaggcttggcctcagggcccaccaccatggcgccaagctgccccatttgcactgtccgccctgctatatggtgccaataataaccttgtgatctatttgcagcgttatatggatccctccacatatcaagtcctctctaatctgaagattgggagtactgcggtactgtattgtttgtgtctgcggcaccggctctctgttaggcagggccttgcactacttcttctaatggcggccggagcgtgctatgccgcgggcgggctccaggtgccgggcaataccctgccctcccctccgcccgcagcggcagcctctcctatgccgctgcacatcacccctcttggcctgctgttactgatcttgtactgccttataagcggtctctcttcagtctatacagaacttctgatgaaacgccaacgcctccccctcgctctgcagaatctctttctgtatacattcggcgtcttgttgaaccttggtttgcacgcaggtggtggaagtggtccggggctcctagagggatttagcggctgggcagctctagtggtgctgtcgcaggcgctgaatgggctcctgatgagcgccgtcatgaaacacggcagctccatcacccgactgtttgtggtgtcttgtagcctcgtagtaaatgcagttctcagcgcggtgctcctgagactgcagttgaccgccgcattcttccttgccacattgctgatcggtctggcaatgaggctctattatggaagcagatag

SEQ ID NO: 46211 - DNA, 537 bp, Artificial Sequence
  Description of Artificial Sequence: Synthetic coding sequence
atgcccctgatcctgagcatcctgagcggcaacgtgccccggctgctattaccgggctcctggctccacaatttaatcttccccaagcgggtggccattccagccgcaccaggcaccagtgagcctctcccacttcacttctggtgtgcatccgaaagccgatctgcgtgttggaggcggctctggccacgaccgccaggaagatttttaagaatgggcagcacacgcggcgccgagccaggtacaaagtggacagcacacgtatgttgtcatgaggcatggcagcagcatcatacacccctttgtggcgtgctgctggccggaggacagcgccgagccctcagttcccctgctacagccgcagctcattccaggctacttcctggccacattgcgcactggccaggccacgctcccgtcttgtggcagcctctcgtgcccgataatttccaccctgactctggaccctgtcggcttggcgccacaactcgcagtcccagtcaggcttttctgccactgccgagtgctgctctctag

SEQ ID NO: 46212 - DNA, 975 bp, Artificial Sequence
  Description of Artificial Sequence: Synthetic coding sequence
atgagcgtggaggacggcggcatgcccggcctgggccggccccggcaggcaaggtggaccctcatgctcctgttgtcgaccgccatgtacggagctcacgcccctttgctggccctttgtcacgttgacggccgtgtgccgttcaggccatctagcgccgtgctgctcacggagctgacaaaacttctgctgtgcgcctttagtctcctcgtgggttggcaggcatggccgcagggtcctcctccgtggaggcaggccgccccgttcgctctctccgccttactctatggcgcgaataataacctcgtaatctatcttcagaggtacatggaccccagcacatatcaggtactgtccaacctgaaaatcggaagtaccgctgtcctctattgtctctgcctgagacatcgactgagtgtgcgccaagggctagctcttctcctgctgatggcagcaggcgcgtgctatgctgccggaggactccaggttccggggaacacactccctagcccacctccagctgccgctgcttctcctatgcccctacatatcactcctttgggcctgctcttactgatactatattgtctgatctctgggctcagcagcgtgtataccgaactgctcatgaaaagacaaagactccccctcgccctccagaatctgttcctttataccttcggcgtgctgctgaatctcggactccacgctggaggcggcagtggcccgggcctgctggagggcttttccggatgggccgcccttgtggtgctcagccaggccctcaatgggctgctgatgtcagccgtgatgaaacacggtagctccatcactcgactatttgtggtgtcctgtagtctcgttgtgaatgccgtcttgagcgctgtcctgcttcgcctccagctgaccgctgcgttttttcttgccactctcctgatcgggttggctatgagactctattatggaagtaggtag

SEQ ID NO: 46213 - DNA, 267 bp, Artificial Sequence
  Description of Artificial Sequence: Synthetic coding sequence
atggagaagcagtgctgcagccaccccgtgatctgcagcctgagcaccatgtacacgttccttctgggggctatctttatcgccttgtcaagctcacgaattctcctcgttaagtactccgcaaatgaggaaaacaagtatgattatctgcctacgactgtcaatgtgtgttccgagctggtaaagctagtattttgtgtgctagttagcttttgcgtgatcaagaaagaccatcagtctaggaatttgaaatatgctagttggtag

SEQ ID NO: 46214 - DNA, 444 bp, Artificial Sequence
  Description of Artificial Sequence: Synthetic coding sequence
atggagaagcagtgctgcagccaccccgtgatctgcagcctgagcacaatgtacaccttccttttgggcgccatctttattgcgttaagctcctcccgcatcctcctggtcaagtacagtgcgaacgaagaaaacaaatatgactatctgcctaccaccgttaatgtttgctccgaattagtgaaattagtcttttgcgtactcgtgtctttctgcgtgatcaaaaaggatcaccagtcacgcaatttgaagtacgcctcatggaaagagttttccgattttatgaagtggagcattccggccttcctctacttccttgacaatcttatcgttttctatgtactatcctacttgcagcccgccatggccgttattttcagcaattttagcattatcacaactgccctgctgtttagaattgtgctgaaaaggaggttgaattag

SEQ ID NO: 46215 - DNA, 1275 bp, Artificial Sequence
  Description of Artificial Sequence: Synthetic coding sequence
atggagaagcagtgctgcagccaccccgtgatctgcagcctgagcaccatgtacacatttctgctgggggctattttcattgctctttctagctccagaatcttactggtcaagtactcagctaatgaagagaataagtatgactacctgcctaccacagtgaacgtgtgctccgaattggtcaagctcgttttctgtgttctggtgtctttctgcgtcattaagaaggatcatcagagtagaaatctgaaatacgctagctggaaggagttctccgatttcatgaagtggtcaatacctgcatttttatattttctggataatctgattgtcttctatgtgctctcgtatctgcagcccgccatggccgtcatcttttcgaatttcagtatcattactactgcccttctgtttaggatcgttctgaagaggcgcctgaactggatccagtgggcatccctcttgaccctgtttctgtctatcgtcgccctgaccgctggcactaagaccctgcagcataatttggcaggtagaggattccatcatgacgccttcttcagcccgtcgaactcatgcctgttgtttcgatcagagtgccccagaaaagacaactgcaccgcaaaggagtggacctttccagaggccaagtggaacaccactgcaagggtcttctctcatatccggctgggaatgggccacgtgctcatcatagttcagtgcttcatcagctctatggccaacatctacaacgaaaagattctcaaggagggcaaccagttaacggagtccatctttatccaaaattccaaactctacttcttcgggatcctcttcaatggcttaaccctggggctccaaagatcaaaccgagatcagattaagaattgtggctttttctatggccatagcgctttttctgttgccctaatctttgtgaccgcctttcagggactcagtgtagcctttattctgaaatttttagacaacatgtttcatgttttgatggctcaagttaccaccgtcattatcaccacggtgagtgtcttagtgtttgatttcaggccctctctggaattcttcctggaggcaccttcagttctcctgtccatctttatttacaatgctagcaaaccacaagtgccggagtatgcaccacggcaggaacgcattagagatttatctggcaacctatgggaacgttcctctggagacggagaggagctcgaacgcctcactaagccgaagtccgatgagtcagacgaagacaccttctag

SEQ ID NO: 46216 - DNA, 1098 bp, Artificial Sequence
  Description of Artificial Sequence: Synthetic coding sequence
atgggccggtgggccctggacgtggccttcctgtggaaggccgtgctgacactggggctggtactgctgtactattgtttttccatagggataaccttttacaacaaatggctcacgaaatccttccacttccctctctttatgacaatgctgcacctggccgtgattttcttgttctccgctttaagcagagccctcgtgcaatgttcaagccacagagccagggtggtccttagttgggctgactatctgcgccgggttgccccgacggccctggccacggcgctggatgtcgggctatctaattggagctttctatacgtgacagtttcactctatactatgaccaagagctcagccgtattgtttatcctgatcttctcactgatcttcaaactggaggaactgcgcgcagcgctagtgctagtcgtgctcctgatagctggtggtttgttcatgttcacgtataaaagcactcagtttaatgtggaaggttttgcgctggtgcttggagccagtttcatcggaggcatcagatggacgttaacccagatgctgctccagaaggctgaattgggcttgcaaaaccccattgatactatgttccatcttcaacctcttatgttcctcgggctgtttcccctgttcgcagtcttcgaaggcttgcacctgtccacctcagagaaaatttttagattccaggacactggactgctcctgcgggtactcggtagcttattcctgggcgggattttagccttcggcctcggcttcagtgaatttcttttggtcagtcgcacatctagtctgaccctgtccatcgccggcatttttaaagaggtgtgtacgttgctgttagctgcccaccttctcggagaccagatatctcttctgaattggctgggcttcgctctctgcttgagcgggattagcctccacgttgcactgaaggccctacattcccggggagacggcgggccaaaagctcttaaggggctcggttctagtcccgacctggagttgctcctcaggtcatcgcagcgtgaagagggcgacaacgaggaggaggagtactttgtggcccaggggcagcaatag

SEQ ID NO: 46217 - DNA, 1035 bp, Artificial Sequence
  Description of Artificial Sequence: Synthetic coding sequence
atgggccggtgggccctggacgtggccttcctgtggaaggccgtgctgacgttaggactggtactgctctactactgtttttctatcgggataacgttctataataaatggttgactaagtctttccacttcccgctttttatgacaatgctgcatctcgctgtaatcttcctgttctccgcgctttcgagagctcttgttcagtgttcctcccacagggcacgcgtcgtgctgagctgggccgactatttgcgaagggtcgcccctactgcactcgctaccgccctcgatgtcggactttcaaattggagcttcctctatgtaaccgtgagcctgtacaccatgaccaagagcagcgcggtcttgttcatacttattttcagcctgatctttaaactggaagagctgagcacacagtttaatgtcgaggggttcgctctggtcttgggcgcctccttcatcggtggcattaggtggactcttactcaaatgctgcttcagaaggccgagttaggactccaaaatccgatcgatacgatgttccatttgcagccgctgatgttcctgggtttgttccccctgtttgccgtttttgagggtctccacctgtctactagcgaaaagatctttaggttccaagacactgggcttctgcttcgggtgttgggtagcctgttcctgggcggaattttggccttcgggctgggcttctcagagtttttgctcgtctcacggacttctagtctgactttaagcattgctggcatattcaaggaagtgtgtactctcttgttagccgctcatttacttggtgatcagatctccctgcttaactggctcggatttgccctctgcctgagcgggatctccctgcacgtagccctcaaggctctgcatagtcgcggagacggaggcccaaaggcccttaaggggctgggctcctctcccgatctggaacttttgctgcgtagcagtcagcgcgaggaaggagacaacgaggaggaggaatactttgtggcacaggggcagcagtag

SEQ ID NO: 46218 - DNA, 477 bp, Artificial Sequence
  Description of Artificial Sequence: Synthetic coding sequence
atgggccggtgggccctggacgtggccttcctgtggaaggccgtgctgaccctcggcctggtgctgctgtattactgtttctcgatcggaattactttttacaataaatggttgaccaagagttttcacttcccactgtttatgactatgttgcatctggctgttatctttctctttagtgccttgtcaagagcattggtacagtgcagctcacaccgagcgagggtcgtactaagctgggcagattatctccggcgggtcgcccccaccgctctggccactgcgctcgatgtcggcctatccaattggtcttttctgtacgttaccgtctctctcgctcgccactggtcatggtggtctagcagttccccaggcgtctccagttgctcacctacttccccacattcctctacctggcgggccagcccctggtgttggggccccagaagttcggttgcattcgctggcccttcatag

SEQ ID NO: 46219 - DNA, 702 bp, Artificial Sequence
  Description of Artificial Sequence: Synthetic coding sequence
atggagctgaagcgggccgccctggtgctggtggtgctgctgatcgctggcggactattcatgttcacatacaagtccactcagttcaacgttgaaggtttcgccctggtccttggggccagcttcattggcggcatcagatggaccctcacgcagatgctgcttcagaaggcagagttgggactccagaatccaatcgacactatgttccatctccagcctctgatgtttttaggactgtttcccctttttgccgtcttcgaggggctgcatctctctacttcagagaagatcttcagattccaggacactggcctcctcctgagggtgctcggctctttgttccttggaggaattttggcgttcggcttgggcttctcggaattcctgctagtctcaaggactagcagtttgacactgtccatagccggcatattcaaggaggtatgcactctgctgctggctgcgcacctgcttggtgatcagatttcgctgcttaactggttaggctttgctctgtgcctgtccgggattagcctgcacgtagccctgaaagcccttcattcaaggggggacggcggccctaaggccctaaagggacttgggagctcgcccgacctcgaactgctcctccggagctcacagcgcgaggagggcgacaatgaggaggaggagtatttcgtcgctcagggacaacagtag

SEQ ID NO: 46220 - DNA, 1098 bp, Artificial Sequence
  Description of Artificial Sequence: Synthetic coding sequence
atgggccggtgggccctggacgtggccttcctgtggaaggccgtgcttaccctgggactggttttattgtactactgtttttccatcgggattacattttataataagtggcttacaaaatccttccattttcctctgttcatgactatgctgcacctggctgtcatctttctgtttagcgctctgagccgggctctggtgcaatgctcaagtcatagagcccgcgtggtcctttcctgggccgactatcttagacgggtcgccccgaccgcactcgcgacagccctggacgtgggactttctaattggagttttctatacgtgactgtgtcactgtacaccatgacgaagtcgtccgccgttctgttcatcctgatattttcccttatctttaagttggaagaactgcgggcagccttggtgttggtggtgcttcttatagccggtggcctgttcatgttcacctacaagagtacgcagtttaatgttgaaggattcgctctggtattgggagcttctttcatcggcggtatcagatggacgcttacgcagatgttactgcaaaaagccgaactcggtctgcagaacccaattgatactatgtttcacctgcagcccctcatgtttcttgggttgttcccacttttcgccgtgttcgagggcctgcacctttccacatctgagaagatttttcgttttcaggacactggcttgctcctccgtgtcctgggatcactgttcctggggggaatactcgcattcggactgggcttcagcgagttccttctggtaagcaggacttcttctctgacactctctatcgccggaatttttaaggaggtatgtaccctgctgttagcagcgcatctgctcggggatcagatatctctgttgaactggctcgggtttgcactctgcctgtcaggcatcagtttgcacgtggctctcaaagccctccacagtagaggcgatggaggacccaaagcacttaaagggctggggtcttcacctgatctagagctactgctgcggtcgagtcagagggaagagggagacaatgaagaggaggagtatttcgtggctcaagggcagcagtag

SEQ ID NO: 46221 - DNA, 699 bp, Artificial Sequence
  Description of Artificial Sequence: Synthetic coding sequence
atggagctgcgggccgccctggtgctggtggtgctgctgatcgccggcggcctgtttatgttcacctataaatctacccagttcaatgttgaggggtttgctttggtgctgggagccagttttattggcggcattaggtggacccttacacagatgttactacagaaagcagaacttgggttacagaaccccatcgacactatgttccatctacagcctctcatgttcctgggcttgttccccctgtttgccgtgttcgaggggctgcacttgtctaccagtgagaagatctttaggttccaggatactggacttctcctgcgtgtgctggggtccctttttttggggggcatactcgcttttggcctgggtttcagcgagtttctgctggtatctcggacctcgtcgctgacgctgtcaatcgccgggatttttaaggaggtctgtacacttctgctcgctgcccacctgttgggagatcaaatttccctcttaaattggctgggctttgccctgtgcctctccggcatctcattacacgtcgcgcttaaagccctgcacagcaggggagacggagggcctaaagcccttaagggcttggggtccagcccagacttagagcttttacttcgcagctctcagagggaagagggggataatgaggaagaggagtatttcgtcgcgcagggacagcagtag

SEQ ID NO: 46222 - DNA, 1098 bp, Artificial Sequence
  Description of Artificial Sequence: Synthetic coding sequence
atgggccggtgggccctggacgtggccttcctgtggaaggccgtgctgactttgggcctagtgcttctctactactgtttttcaatcggtattaccttctacaacaagtggctcaccaaatctttccactttcctctctttatgaccatgctgcacctcgccgtgatattcctattcagtgcactctctagagccctggtgcagtgtagttcgcaccgggcccgggtcgtgcttagctgggccgactacctgcggagagtggccccaactgcactcgccaccgccttggacgtggggctttctaattggtcgttcttgtacgtgacggtgagtctttatacgatgaccaagtcctctgcagttttattcatcctgatattttcattgattttcaagttagaggaactgagggctgctctggtcctcgtggtgttacttattgctggagggctgttcatgtttacgtataaaagtactcagttcaatgtggaggggttcgcccttgtgctcggcgccagctttatcggcggcatccgctggacactcacacagatgctattacagaaggctgagcttggcttgcagaaccctatcgatactatgttccacctgcaaccactgatgttcctggggctcttcccactcttcgcagtctttgaaggcttgcatttgtcaacgtcagagaagatctttaggtttcaggacactggcctactgctgcgcgttttggggtctctttttctcggggggattctcgcgttcggcctcggcttttccgagtttctgctggtgtcacgaacctcttcgctgaccctgtctattgctggcatttttaaggaggtgtgcactctgctactagccgctcatttgctgggggaccagatttcattgttgaactggctgggcttcgcgctgtgcctgtctggcatctccctgcatgtggctttgaaggccctgcactcccggggggatggaggtccaaaagcactcaaagggcttgggtcaagtcccgatctcgagttgctgctccggtcaagccagagagaagaaggcgacaacgaggaggaggaatatttcgtggcacaaggacagcaatag

SEQ ID NO: 46223 - DNA, 591 bp, Artificial Sequence
  Description of Artificial Sequence: Synthetic coding sequence
atgggccggtgggccctggacgtggccttcctgtggaaggccgtgctaacgctggggctggtgctactgtactattgcttcagcatcggcatcaccttctataacaagtggcttacgaaaagttttcacttccccctgtttatgaccatgctgcacctggccgttatctttcttttctcagcactaagccgggcattggttcaatgctcctcccaccgtgctagagtggtgctcagttgggcagattatttgagacgtgtggccccaaccgctctggctacagcccttgacgtgggtctttcaaattggtcttttctgtatgtgacagtcagtttgccccacagcagtacttggagagcttctccgtggtgctggggtcctaggagctcagttgccttcgccggtccatctcctagatgtagctgcaggcgcttgaactctgctagtcgaatcccaagtacaccttgttcaacatgctcccactcctgctcctggggctctagtctctctctgctgtatctcaaggtgtcaatttgtcctcacctgagaaagtccagtgtgagccggacacagggatgttcgtgcggatag

SEQ ID NO: 46224 - DNA, 477 bp, Artificial Sequence
  Description of Artificial Sequence: Synthetic coding sequence
atgggccggtgggccctggacgtggccttcctgtggaaggccgtgctgacactggggctggtgctgctttattactgcttctcaatcggcataaccttctataacaagtggctgactaaaagctttcatttccccctgtttatgaccatgctgcatttagctgtgattttcctgttctctgcactgtccagagctctagtgcagtgcagctcacatcgcgcccgcgtcgtactctcttgggccgactaccttcgcagagtggccccaaccgcacttgcgactgccttagacgtgggcttgagtaattggtcttttctctacgtaacggttagcctcgcaagacattggtcttggtggtcgagctcttcacccggggtctcctcctgttccccaacatcccctcattcctctacttggagagcaagcccatggtgttggggccctagatcctcagtggcgttcgctggtccctcttag

SEQ ID NO: 46225 - DNA, 1185 bp, Artificial Sequence
  Description of Artificial Sequence: Synthetic coding sequence
atgggccgggtgagcaccagccaccagcccctgcggggcgtgcccgctcctgccgactcaggcgcgcctgtgctgcagcctcccagaatgggacgttgggcactcgacgtagcttttctgtggaaggcagtgctgaccctgggcctggtgctcctctactattgtttttcaattggcatcaccttctacaacaaatggctcactaagtctttccatttccctttattcatgaccatgttacatctggcagtaatcttcctctttagcgctttgtctcgggctcttgttcagtgctcttctcatagagccagagtggtcctgtcatgggcggattacctgcggagagtcgctcctactgctctagccacagctcttgatgttggattgtccaattggtcttttctatatgtaaccgtgagtctatatactatgaccaagagttcagccgtgctgttcatcttgattttttcgttaattttcaagctggaggagctccgggccgcgctcgtgctggtggtgttacttatagccggtggcctgttcatgtttacctataagagcactcagttcaatgtagagggatttgcattggttctgggcgcatctttcattggaggcatcagatggacactaacgcagatgcttctgcagaaggcagaactaggacttcaaaacccaatagatacaatgttccacctccagcctcttatgttcttaggcctgtttccactgtttgctgtgttcgagggcctacatctgtccacttccgaaaagattttccgctttcaggacaccgggctgttgctacgggtccttggcagcctgttcctggggggtattttggcttttggtctgggtttctccgaattcctgctggtgtctcgaacttcttctttgacccttagcatcgcaggaatatttaaggaggtgtgcacgttgcttttggctgcccacctgctcggcgaccagatctccctcctcaattggctggggtttgctctgtgcttgtcaggtatctctcttcatgtggcccttaaagcactgcattcccgaggtgatggcggcccaaaagcactgaagggcctgggttcctcaccggatctggagctcctgttgcgctcatctcagcgagaagagggagataacgaagaagaggaatacttcgtcgcacagggtcagcaatag

SEQ ID NO: 46226 - DNA, 1233 bp, Artificial Sequence
  Description of Artificial Sequence: Synthetic coding sequence
atggccgccgccgccgtgggcgccggccacggcgccggcggccccggagccgctagcagttccggtggcgctagagaaggggctagagttgcagctctatgcctgctgtggtacgctctaagtgcaggaggcaatgtggtgaacaaggtgatattgagtgcattcccatttcccgtaacggtgagtctgtgccacatcctggctctctgtgctggcttaccccctctactgagggcatggagagtgccccctgcgccacccgtgtcaggacccggtccaagccctcacccgagttccggccccttgctcccaccgagattttatccgaggtatgtgctcccactggctttcggcaagtactttgcatccgtttcagcccacgtgtcaatttggaaggtgccagtgagctacgcccatacggtgaaagcaaccatgccgatatgggtcgtcctcttatcccggattatcatgaaggaaaagcagtctaccaaggtgtacctgtcactaatcccgattatctcgggggtgctgctggccaccgtcacagagctaagcttcgatatgtggggcctggtgagcgctctggccgcaaccctgtgttttagtctgcaaaacatcttcagtaagaaagtgctacgggattcccggattcatcaccttcgcctattgaatattttaggttgtcatgcagtgtttttcatgatacccacatgggtgcttgtcgacttgtctgcctttctggtttcctctgacctcacatacgtgtaccagtggccttggacactcctgcttttagctgttagtggcttctgcaacttcgcgcagaatgtcattgcgttttcaatcttgaaccttgtttcacctctttcctactctgtggccaacgctactaagcgcataatggtgattacagttagccttatcatgctgcggaatccggttactagcaccaacgtgctgggaatgatgacggcaatattgggggtgtttctgtataacaagacaaaatatgatgcaaatcagcaggcacggaaacacctgctccctgttactactgcagatctttcctcaaaggaaaggcacaggagccccctggagaaaccccataatggcctactttttccgcaacatggtgattaccagtacggaagaaacaacatcttgacggaccactttcaatattcacggcaaagctaccccaattcttatagtctcaaccggtacgacgtctag

SEQ ID NO: 46227 - DNA, 315 bp, Artificial Sequence
  Description of Artificial Sequence: Synthetic coding sequence
atgaaggagaagcagagcaccaaggtgtacctgagcctgatccccattatatctggcgtgctgctcgccacagtgaccgaactctcattcgatatgtggggactcgttagtgcacttgctgccaccctttgcttttctcttcagaatatattttctaagaaagtgctgcgcgactcaaggatccatcacctcaggctccttaacatcctcggatgccatgctgtgttcttcatgattcctacttgggtcctggtggacctgtccgctttcctggtgtcaagcgatctcggcctgccctctgagaacgttctctag

SEQ ID NO: 46228 - DNA, 801 bp, Artificial Sequence
  Description of Artificial Sequence: Synthetic coding sequence
atgagcagcagcgtgaagacccccgccctggaggagctggtgcccggctccgaagagaaaccaaaaggacgatcacctttgagctggggatctcttttcgggcacaggtccgagaaaattgtctttgccaaatccgatggcggaactgatgagaatgtattgactgtgacgatcacggagacgacagtgattgagtctgacctgggcgtgtggagcagccgcgcactcttatacctgaccctgtggtttttcttttccttctgtacattgtttctgaataaatacatcctgtctctgctggggggagagccttcgatgttaggcgctgtccagatgctgtcaacaactgtgataggatgcgtgaagacacttgtgccttgctgtctgtaccaacacaaggcgagactgagctatcctcccaactttctgatgactatgttgttcgtcggattgatgcgattcgccacagtcgtgctgggtttagtgtcactcaagaacgtcgccgtgagttttgctgagactgttaagtcctccgccccaatctttacagtcattatgtccaggatgatcctgggcgagtacaccggtaggccctcagatcgggaagagagggaggagttacagctccagcccggacgaggggccgctgccagtgacaggagatcacctgtgcctcctagcgagcgccacggcgtcaggccacacggcgagaacctcccaggggatttccaggttccgcaagcgctgcacagagtcgctctttctatggcccttccctgccctatgcttccagcaagctag

SEQ ID NO: 46229 - DNA, 741 bp, Artificial Sequence
  Description of Artificial Sequence: Synthetic coding sequence
atgagcagcagcgtgaagacccccgccctggaggagctggtgcccggaagcgaagagaaacccaagggccggtcccctctttcttggggatccctattcggccatcgcagcgaaaaaatcgtattcgccaagagcgacggtggcaccgatgaaaatgtcctcacagtcactataacagaaactaccgttattgaaagtgacctaggggtgtggtcgtctcgcgcactcctttacctgacgctgtggttttttttctccttctgcacgctgttcctcaataagtacatccttagccttctcggaggagaaccctctatgctcggcgcggttcagatgctgtctaccacggttattggttgtgtgaaaacacttgtgccgtgttgtctctatcagcacaaggccagactaagctaccctccaaacttcctgatgacaatgctgtttgtgggattgatgagattcgccactgtggtccttggacttgtcagtctcaagaatgtcgcagtgagctttgctgagactgtgaaatcgtccgcccccattttcaccgtaatcatgtcgcgcatgatcctcggagaatacacaggcaggccctccgatcgcgaagaacgggaggagctgcagctgcaacctggccgtggcgccgcggcttccgaccggaggtctcctgtacctccttctgagagacatggggtgcgccctcatggtgaaaacttacccggtgacttccaagcccagtag

SEQ ID NO: 46230 - DNA, 741 bp, Artificial Sequence
  Description of Artificial Sequence: Synthetic coding sequence
atgagcagcagcgtgaagacccccgccctggaggagctggtgcccggctcagaggagaagccaaaagggaggtcccccctaagttgggggagccttttcggccacaggagcgagaagatcgtattcgccaagtctgacgggggcacagacgaaaatgtgctgaccgtcactatcaccgaaacaaccgttattgagagtgacctgggtgtctggtcttctagggctctgctctatctgacattgtggttttttttcagcttttgtaccctctttctgaacaagtacattcttagtttacttggcggcgagccaagtatgttgggagccgtgcagatgcttagtacaaccgtgatcggttgcgtgaagaccctggtcccatgttgtctctaccagcataaggcacgccttagctaccctccaaacttcctcatgacaatgctgttcgttggcctgatgaggttcgccaccgtcgtgttgggattagtctccctaaaaaatgttgcagtgtcatttgccgaaacagtaaagtccagtgcccctatctttaccgtgatcatgtcacgaatgatcctgggtgagtataccgggcgccctagcgatagggaggaacgagaggaactccagctgcagccagggaggggggctgccgcatccgatcgtcgatcaccagtgccaccttcggagcgacacggcgtccgaccacacggcgagaacttaccaggtgatttccaggcacagtag

SEQ ID NO: 46231 - DNA, 966 bp, Artificial Sequence
  Description of Artificial Sequence: Synthetic coding sequence
atggccctgggcgcctgcggcctgctgctgctgctggccgtgcccggtgtcagcctcagaacgcttcagcccggctgcggacggccgcaagtgtcagacgccggaggacgaatcgttggtgggcatgcggctcccgccggcgcctggccttggcaagcctccctccggttaagacgggtccacgtctgcggtggatcccttttgagcccgcagtgggtgttaacggctgcccactgtttctctggatcactcaactccagcgattatcaggtacacctaggcgaactggaaatcaccctcagccctcatttctcaaccgtgaggcaaatcatcttgcacagttcgccaagtgggcagccaggaacctccggagacattgctcttgtggagctgtcagtgccggtgaccctcagttcaagaatcttgcccgtgtgcttacccgaggcttcagacgatttctgcccaggcatacgctgttgggtgaccggatggggttatacccgggaaggagagcccttaccacccccttattcccttcgagaggttaaggtgtccgtcgtggatacagagacctgccggagggattaccctggtcccggaggcagtatattgcagccagatatgctgtgtgcccgagggccaggcgatgcctgccaggacgatagtggtgggcctcttgtttgccaggttaatggggcttgggtgcaagccgggaccgtctcctggggggagggctgcgggaggcctaacagacccggtgtctatacccgtgtgcctgcatacgttaactggattcgcaggcacatcaccgcctctggcggctcggagtccggataccccaggctcccgttactcgcgggcttttttctccccggactttttttgttgttggtttcatgcgtgctgctggcgaagtgcctcctgcacccttcagcggacggaaccccttttcccgctcctgactag

SEQ ID NO: 46232 - DNA, 1218 bp, Artificial Sequence
  Description of Artificial Sequence: Synthetic coding sequence
atgagcagcagcgtgaagacccccgccctggaggagctggtgcccggatccgaagagaaacctaaaggcagatctccgctgagttggggatccctgtttgggcatcggagtgagaaaattgtgtttgctaagtcagacggtgggaccgacgaaaacgttcttacggtgacaataaccgaaactacagtcattgagtcagacctaggcgtgtggtcttccagggccctcttataccttacactgtggtttttcttttccttctgtacactgtttctgaacaaatatattctgtccttactgggcggggaaccaagtatgctcggagccgtgcaaatgctctccacaacagtcatcggatgcgtgaagaccttggttccatgctgtttgtatcagcataaagcaaggctgtcttaccctccaaactttctgatgacaatgttgtttgtgggactgatgcgatttgccaccgttgtcctgggcctggtatctctgaagaatgtcgcagtcagtttcgctgagacggtgaagagctctgcccctatctttaccgtaataatgagcagaatgattctcggagagtacacaggtctcctggtgaacctgtcactgatacctgttatggggggcctggctctctgtacggccaccgagataagctttaatgtcctgggcttctccgcagccttgagcacaaatattatggattgtcttcagaacgtcttctccaagaaattgttatcgggagataaataccgattctcagccccggagctccagttttacacctcagcagctgccgtggccatgcttgttcctgctagagtcttctttaccgacgttcccgtgatcggccgctcgggcaagtcattctcctacaatcaagatgttgtcctcttgctcctcacagacggggtcctgttccacctccagagtgtgactgcttacgcgctgatgggtaagatttcacccgtgaccttcagtgtggcatccacagtgaagcacgccctgtctatctggttaagcgtgatagtgttcggcaataaaatcacgtccctgagcgcggtgggtacagcccttgtgacagtcggtgtgctcctgtataataaagcaagacagcatcaacaggaagccttgcagtctctcgccgccgctaccgggagggcacccgacgacactgtcgaacccctgctaccccaagatccaagacagcacccctag

SEQ ID NO: 46233 - DNA, 942 bp, Artificial Sequence
  Description of Artificial Sequence: Synthetic coding sequence
atggccctgctggtggaccgggtgcggggccactggcggatcgccgctggcctgctctttaaccttttggtttctatctgcatagtgtttctgaacaaatggatctacgtgtaccacggatttcccaatatgagtctcaccctcgtccacttcgtggtcacatggctgggactgtacatctgccagaagcttgacatttttgcgcctaagtctctgcctcctagccgccttcttcttctcgcccttagcttctgcgggtttgtcgtattcaccaatttgtctctccaaaacaataccattgggacctaccagctggcaaaagctatgaccacacccgttataatagccatccagacattctgttatcagaaaactttttctacgcggatccagctgactctgattccaataaccctgggggtcattttgaactcttattatgacgtgaaattcaactttctggggatggtctttgccgccctgggcgtcttggtaacctccctgtaccaggtctgggtgggcgctaaacagcatgagctgcaagttaacagtatgcagctgctctactaccaagcgccgatgtccagtgccatgctgctggtcgctgtgcccttctttgaacccgtttttggtgaaggggggattttcggtccctggtctgtgtctgccttgctcatggtcctgctcagcggggtgatcgctttcatggtgaacctttccatctactggatcatcgggaacaccagtccggtgacctataacatgttcgggcattttaagttttgcataaccctgttcggaggctacgtcctctttaaggatccactgtccattaatcaggctctagggatcttatgtacactttttggaatccttgcctacacccactttaagctgagtgagcaggagggctctcgcagcaagcttgcccagcggccgtag

SEQ ID NO: 46234 - DNA, 705 bp, Artificial Sequence
  Description of Artificial Sequence: Synthetic coding sequence
atgtgccggtgcccccccgagcaccacgacggccggatgaccagcgctgaagtgggcgctgctgctgggggcgcccaagcagcggggcctcccgagtggcccccagggtcaccccaagcgttaaggcaacctggtcgtgctcgggtggcaatggccgcactcgtgtggctcctagcaggggcaagcatgtcttcccttaataaatggatctttacagtgcatggtttcgggaggccacttttgctttccgccctacatatgctagtggccgccctggcttgccataggggggcccgaagacccatgcccggcggtacgagatgccgcgtgctcctgctgtctcttacctttggaaccagtatggcctgcgggaacgttggcctgcgcgccgtgccacttgatttggctcagctcgttaccacgacgacccctttgttcacactggccttgtctgcccttctgctgggcaggagacatcatccactgcagcttgctgccatgggacccctctgcctgggcgcggcttgttcgttggctggtgagtttcgaacccccccaacaggctgtgggtttttgctggccgctacatgcctgcgtgggctcaaaagcgtgcagcaatccctatcgttccagatctgtaagatggagctcatgatccccatggaacgtgtccgcatgaggtccgcaggtcaggggcaagaatag

SEQ ID NO: 46235 - DNA, 1053 bp, Artificial Sequence
  Description of Artificial Sequence: Synthetic coding sequence
atgtgccggtgcccccccgagcaccacgacggccggatgaccagcgccgaggttggggccgctgctggtggggcacaggcggccgggccgcccgaatggccacccggctcaccacaggctctgcgacagccgggcagagccagagtggccatggccgcgctggtgtggcttttggcaggggcgtcgatgtcatctctcaataaatggatcttcacagtacacggttttggtcggcctttactgctgtccgctttgcatatgctcgtggctgctctcgcctgccatcgcggggccagaagaccaatgccagggggcacccggtgccgagttctactgctttcactgacttttggtacctccatggcctgcggaaatgtcgggttgagagcagtgcccctcgacctggcccagctggtgactacaaccacaccgctattcaccctcgcactgagtgccttgctcctggggcggcggcatcatccactgcaactcgcagccatggggcctctgtgcttgggcgcggcctgcagtctggcaggggagttccgtaccccgccgactggttgcggttttcttctggccgcgacctgcctacgaggtctgaaatcagtccagcagtccgctcttttacaggaagaaagactggacgcggtaaccctgctgtacgccacgtcgttgccgtccttttgcctgcttgctggggcggctctcgtgcttgaggcaggcgttgcaccacctcccacagcgggggacagcaggctgtgggcatgcatcctcctgtcttgtctgctgtcagtcctgtataatctggccagcttcagcttgctggcactgacgagtgccctgacagtgcatgtgctgggcaatctcaccgtggtgggcaacctgattctatctcgattactgttcggcagtcggctcagcgcactatcttatgtggggattgccctcacgctaagcggaatgttcctctatcacaattgtgaattcgttgccagctgggccgcgcgcagggggttatggcggcgggaccaaccgtccaaaggactgtag

SEQ ID NO: 46236 - DNA, 705 bp, Artificial Sequence
  Description of Artificial Sequence: Synthetic coding sequence
atgtgccggtgcccccccgagcaccacgacggccggatgaccagcgcagaggtaggagcggccgccggcggggctcaggctgcaggcccaccggaatggccgccaggctcaccgcaggcgctcagacagcctggtcgggcgcgcgttgccatggcagctctggtctggctcttggcaggagcctcaatgtcctctctcaataaatggatttttaccgttcatggttttggcaggcctttactgctttccgcactccatatgctagttgcagccttggcctgtcatcgaggtgcccgtcggcccatgccaggaggtacacgttgtagggtattgcttttaagtcttacttttgggactagcatggcttgcggaaacgtgggactgcgagccgtgccccttgatttggcccagctcgtgactacaaccaccccgcttttcactttagctctttctgctctgctgctcggccgtaggcatcatccactccagctcgcggcaatgggaccactctgtctaggtgctgcatgctccctcgccggggaattccgaaccccaccaactggatgtggatttctgctggccgccacatgcttgagaggacttaagtctgtccaacagtcactgtctttccagatctgtaagatggaactgatgatccccatggagagggttcgtatgaggtctgccggccagggtcaagagtag

SEQ ID NO: 46237 - DNA, 1227 bp, Artificial Sequence
  Description of Artificial Sequence: Synthetic coding sequence
atgatcccccccgagcagccccagcagcagctgcagccccccagccccgctccaccaaaccatgtggttacaacaatcgaaaacctcccagccgagggtagcgggggcggcggctcactgagcgccagcagtagagccggggtcaggcagcggatcaggaaggtactcaatagggaaatgctcatatctgtcgctctggggcaagtcttatccctgctcatctgcgggatcggtctgacatcgaagtatctcagcgaagacttccatgcaaacactccggtgttccaatcttttctcaactacatcctcctgtttttggtatataccactaccctcgccgtgagacaaggcgaagagaacctgcttgcaatcctgagacgccgctggtggaaatacatgatccttggcctaatcgacctcgaagctaactatctggtggtgaaagcctatcagtatacaactctcacatcaattcagctgctcgactgtttcgtaatcccagtagtgatcctcctcagctggtttttcctgcttattagatacaaagctgtacattttataggaattgttgtttgtattttgggaatgggatgcatggttggtgccgacgttctcgtgggccgccaccaaggcgccggagagaacaagctggtaggcgatctgttagttcttgggggcgccactctctatggaatatcaaacgtttgggaagaatacatcatcagaaccttgtcccgtgtcgaattcctaggtatgatcggtctgtttggggccttctttagcgggatacagctggctattatggaacacaaggaactgctgaaggtgccgtgggactggcaaatcggcctcctatatgtcggcttctcggcctgtatgtttggcctttattcattcatgcctgttgtcatcaagaaaacttctgccacatccgtgaacctgtccttgctgaccgctgatctgtattccctcttttgcggactattcctttttcactacaagttctccggtttgtacctgttaagctttttcaccattctgatcggtctggtgctatattcctctacttctacttacattgctcaggaccctagggtttacaagcaattccggaatccctccggtcccgttgttgaccttcccacgactgcacaggtcgagccatccgtcacgtacactagcttgggccaggagaccgaagaagagcctcacgttcgagtggcctag

SEQ ID NO: 46238 - DNA, 681 bp, Artificial Sequence
  Description of Artificial Sequence: Synthetic coding sequence
atggccctgagctggttcatcctgcacgcccggtaccgggtgatccactttattgctgtagccgtctgcttgctgggagtaggtactatggtgggcgcggacatattagcgggccgcgaagataattcaggcagcgacgtgttgatcggggatattctggtgctgttaggggcctccttatatgccatctctaatgtgtgcgaggaatacattgtcaagaagctgtcgcgacaagaatttctgggcatggttgggctgttcggcacaatcatcagcgggatccagctcctgattgtagagtacaaggacatagcctcaattcactgggactggaagatcgctcttttatttgtcgcattcgctctgtgtatgttctgcttgtattcctttatgccgctggtgattaaggttaccagtgccacatcagttaatctgggaatactgaccgccgatctgtattcactgttcgtcggcctcttcctttttggctataaattttccggcctctacatcctgtctttcactgtcatcatggtggggtttatactgtattgcagcactcccacccggacagccgaaccagctgaatcttccgtccctccagtaacctccattggcatcgacaacctcggactgaagctagaggagaatttgcaagagacacattcggccgttctgtag

SEQ ID NO: 46239 - DNA, 984 bp, Artificial Sequence
  Description of Artificial Sequence: Synthetic coding sequence
atgctgagcctgtgcatctgcggcaccgccatcaccagccagtacctcgctgaacgctacaaggtgaacaccccaatgttgcagtcctttatcaactactgcctgctgttcctgatttatacggtgatgctcgccttccgctcgggatctgacaacttattggtcatacttaagcgaaagtggtggaaatatatcctgctagggttggccgacgtcgaggccaactatgtgatcgttagggcctatcaatatactactctgaccagtgtgcaactccttgactgcttcggaatacctgtgcttatggcacttagttggttcatactgcatgcccgatacagggtgatacacttcatcgccgtagctgtctgtctgctgggagttgggaccatggtgggcgccgacattctcgccggaagggaggataattccggctcagatgtacttatcggagatatcctcgtgctgttgggtgcctccctgtatgccatttcaaacgtttgtgaagagtacatagtgaagaaactttcacgccaggaattccttggaatggttggtctattcggtactattatttccggaattcaactcctgattgtggaatataaggacatagctagcattcattgggactggaagattgccctgctctttgttgcattcgccctgtgcatgttttgtctgtatagtttcatgcccctcgtgataaaagtcacgagcgcaacctcggtaaatttgggcatactcacagctgatctctactcactgtttgtcggtcttttcctctttgggtacaaatttagcgggctatatattttgtcattcacagtgataatggtaggattcattctttactgttccactcctactcggacggctgagccagccgaatctagtgtcccgcccgttacgagtatcggaattgacaacctcgggctgaaactggaggaaaatctgcaggagacacattcagccgtgctgtag

SEQ ID NO: 46240 - DNA, 1125 bp, Artificial Sequence
  Description of Artificial Sequence: Synthetic coding sequence
atggaggccgacagccccgccggccccggcgcccccgagcccctggctgaaggggccgcggctgagttttcctctctgttgagacgcatcaagggcaaactgttcacatggaatattctcaaaactatcgccctggggcagatgctctcactatgcatttgtgggaccgcgataactagtcaatacctggcggaaagatacaaggttaacactccaatgctgcagtccttcattaactattgcctcctcttcctgatttacacagtgatgctggcatttcgctccggcagcgacaacctgctggtgatacttaagagaaagtggtggaagtacatactcctgggacttgccgatgtggaggcaaattacgttattgtgagagcttaccagtataccaccctcaccagcgtgcagctcctggattgttttggaataccagtgctgatggctctcagctggttcattcttcatgctaggtaccgagtcattcacttcatagctgtagccgtttgtcttctgggcgttggtaccatggtaggagctgacattcttgctggccgagaggataattctggatccgacgtcttgattggcgacattctcgttcttctgggcgcttcgttgtacgcaatctccaacgtctgtgaggaatatatcgtaaaaaaactttccaggcaagagtttcttgggatggtgggcctgtttgggactataattagcgggatccagctcctcatagtggaatacaaggacatcgcatccatccactgggattggaaaattgctttactgtttgttgctttcgcactctgtatgttttgcctgtactcgttcatgcctttggtgataaaggtgacttccgctacctcagtcaatcttggtatcttgaccgctgatctatactccctcttcgtcggattgtttctcttcggatataagtttagcggactatacattctgtccttcacggtgataatggtgggatttatcctgtactgttcaacccctacccgaactgctgaacccgctgagagcagcgtcccccccgtgaccagcatcgggattgacaatctgggactgaaactggaggaaaacttgcaagagactcactctgccgttctgtag

SEQ ID NO: 46241 - DNA, 1074 bp, Artificial Sequence
  Description of Artificial Sequence: Synthetic coding sequence
atggaggccgacagccccgccggccccggcgcccccgagcccctggcggagggtgcagctgctgagttctcctctctgctgaggcgtattaaaggaaagctgtttacttggaatatccttaaaaccattgctctcggccaaatgttatccctttgcatctgcgggaccgccattacctcacagtacttggcggaaagatacaaggtgaatacccccatgctccaatcatttatcaactactgcctgctgtttctgatttatacagtaatgctcgctttccggagcggatctgacaatctattagtcattctgaagaggaagtggtggaaatacatattgctgggcctcgcagacgtggaggcaaactacgtgatagtccgagcctatcagtacaccaccttaaccagcgttcagctcctggactgcttcgggatccccgtactgatggctctttcctggtttatcctccatgctagatatcgtgtcattcacttcatagcggtagctgtgtgcctgctcggggtaggcacaatggtgggggcagacatcctcgcggggcgggaagacaactccggcagtgatgtgctgattggcgacattttggtgctcctcggtgcaagtttatatgcgatctctaacgtttgcgaggagtacatagtcaagaaactgtctcgtcaggagtttctagggatggtgggacttttcggaacgattatcagtggtatacagttgctgattgtcgagtataaagacatagcctcaattcattgggattggaagattgctctcttattcgttgcctttgccctatgcatgttctgcctctattcctttatgcccctggtcataaaagtgacaagcgccaccagtgtgaatcttggaattctgaccgccgatctgtacagtctcttcgtgggtttgtttctgtttggatacaaggactccacctcctgcccatctctgtcctcctggtggggcctgagttgtaccgctcctcctttacttgcccgtcccagtagactcaaggcagcttgtttgcagtctccagccttgggacttacaacctggggctag

SEQ ID NO: 46242 - DNA, 1125 bp, Artificial Sequence
  Description of Artificial Sequence: Synthetic coding sequence
atggaggccgacagccccgccggccccggcgcccccgagcccctggccgaaggcgccgccgctgagttctcatccttgcttaggcgtattaagggaaaactgtttacgtggaacatccttaagacaatcgcccttggacagatgttatccctttgtatctgcggcaccgcaataacctctcaatatctggcagaaaggtataaagtgaatacaccaatgctgcaatcatttatcaactattgcctattattcctgatttacactgttatgttggctttcagaagcggatccgataatctcttagtgatactcaaaaggaagtggtggaagtatatactgctcggactcgcggatgtcgaggccaactatgtaattgtaagagcctatcagtataccactttgacgtctgtgcaactactggattgtttcggaatccctgttttaatggccctcagttggttcatcctacacgccaggtaccgtgtgatccattttattgcggtggctgtgtgtcttctgggcgtgggtacaatggtgggcgcggatatccttgccggacgggaggacaattccggatccgatgtgctgattggtgatattctagtcctgctcggggcctccttgtatgccatttccaatgtctgtgaagaatacatcgtcaagaagcttagcagacaagaattcctcggcatggtcggcctgttcggaactattatcagcggcatccaactcctaatcgttgagtataaagatatcgccagtatccactgggattggaagatcgccttgctgttcgtggcttttgccctgtgcatgttctgcctttacagcttcatgcctttagtgatcaaagtaacttctgccacgtcggtcaatctcggaattctcaccgctgatctctactccctctttgtggggctgtttttgtttgggtataagttcagcggattgtacatcctaagctttactgtcataatggtgggcttcatactctactgtagcacccccactagaacagcagaaccagccgagagtagcgtcccgcctgtcactagcatcggaatagataacttaggcttaaagttggaggagaacctccaagaaacgcattcggccgtgttatag

SEQ ID NO: 46243 - DNA, 1266 bp, Artificial Sequence
  Description of Artificial Sequence: Synthetic coding sequence
atgaagaagcacagcgcccgggtggcccccctgagcgcctgcaactcgccagtgttaactctgactaaagtggagggggaggaacgcccacgcgactcgccgggtccggccgaagcccaggcccccgcaggggtcgaggccggaggacgcgctagccgcaggtgctggacctgttctagagcacagctgaaaaagattttctggggcgttgcggttgtgctttgtgtgtgttcatcctgggctggctctacacagctggccaagctgacatttcggaaatttgacgcgccttttacgttaacctggttcgccactaactggaacttcctgttctttcctctgtattatgtgggccacgtgtgcaagagcacggaaaagcagagcgtaaaacaacgctaccgggagtgttgtcggtttttcggcgataatggcctgactctcaaagttttttttactaaagcggcacccttcggtgtgctctggacacttacaaactacctgtacctgcatgccatcaaaaaaataaacacgacggacgtgagtgtgctgttttgctgtaataaggcctttgttttcttgctgtcatggatcgtgctcagagacagatttatgggggtccgcattgtggcagccattctcgcaatcgccggaattgttatgatgacgtatgcggacggcttccatagtcactccgtgatcggaatcgccctcgtggtcgccagcgcaagcatgagcgccctgtacaaagtgctgtttaaacttctgttgggttctgcaaaattcggagaagcagctttgtttttgtctatcctgggggtgttcaatattttgttcatcacttgcatccctatcattttgtactttaccaaggtcgagtactggagctcatttgacgacatcccctggggtaacctttgcggattctctgtgctgttgctaaccttcaacattgttctgaactttggaatcgcagtgacctacccaaccctgatgtccctgggcattgtgctctctatccctgtgaatgcagtgatcgaccattatacgagccagatcgtctttaatggtgtccgcgtcatagcgatcattattatcggtcttggatttctgctgctgcttttaccggaggagtgggacgtgtggctgattaaactgctgacccggctgaaagtgcggaagaaagaggaacccgcagagggtgcagctgacttaagtagcggaccgcaatccaaaaaccgccgggccagaccctcttttgcccgctag

SEQ ID NO: 46244 - DNA, 1473 bp, Artificial Sequence
  Description of Artificial Sequence: Synthetic coding sequence
atgggcatccgggagttccccagcggcgccccccggggcaagagcatcgctgttggtatgaggcgaagcccagatgtgtccccgaggcgccttagcgacataagcccccaacttcgccagctaaagtatttagtggtggatgaagccatcaaggaggatctgaagtggtcacgcagtgttgaagacctcacttcagggcccgttgggttaacgtccatcgaggaaaggatcctgaggatcaccgggtactatgggtatcagccgtgggctgccagttgtaagcgcgaggaaagaccccgggattcccccgggccagccgaggctcaggcccccgctggggtagaggctggggggagggccagtcgccgttgttggacctgttcacgcgcacaacttaagaagattttttggggcgtcgccgttgtgctttgtgtttgttcgtcatgggctggttccacccaattggccaagctgacattccgcaaattcgatgccccattcacactgacatggtttgctaccaattggaatttccttttttttccactatactacgtagggcatgtgtgcaagtctaccgaaaaacagtctgtcaagcagcgctaccgtgagtgctgtcgctttttcggggataacggcctaactctgaaggtattctttactaaagccgcccccttcggagtgctatggacactgacgaactatttgtacctacacgccatcaaaaagattaacaccacggacgtgagcgtgctgttctgctgcaataaggcgttcgtgttcttgttgtcctggatcgtgctgcgcgacaggtttatgggagtacgtatcgtggcggccatcctggctattgctggcattgtaatgatgacatacgccgacgggtttcactctcactcggtcatcgggatcgcattggttgtggccagcgctagcatgtcagccttatacaaggtcctttttaaactcttactgggcagcgcaaaatttggtgaagccgctctcttcctctctatcctgggcgtgttcaacattctcttcattacatgtattcctatcatcctttatttcactaaggtagagtattggtcttcttttgacgatatcccatgggggaacctctgtggattctctgtcttgctgcttactttcaatatagtcctgaatttcggtattgccgtcacatacccaactttgatgagcctggggattgtgctgtctattcccgtgaatgctgttatcgatcactacacttctcagatcgtattcaatggggtcagggtcattgctatcatcattatcggactcggctttctgttgctgctgctgcctgaagagtgggatgtgtggcttataaagctgctcacgcgcctgaaggtgaggaaaaaggaggaacccgctgagggcgccgccgatctgtctagcggtccacagtcaaaaaaccggcgcgcccgccctagctttgcccggtag

SEQ ID NO: 46245 - DNA, 1566 bp, Artificial Sequence
  Description of Artificial Sequence: Synthetic coding sequence
atggacgagctgctgctggacctgttccacaagctgaccagcggcaggcagcttgccgccggaaacggtctttgtggaattagtcataaggagcaggaagtgtggaagcctggtcacaatatcctggtgaagatgaggaaagaagacaaaagcctggtgtggctaatacattccacactcgcacggtatacacaggtgaccaactttctgggaacatccagatccagcgtgactcgatgtaagccaggtgccaactgtccatctagccacagtggcattagtcgccaactctccccactgtcagtgacggaggattcgtccgcacctatcttggagctacaaaaccagggctcctctggcgtctgtggtcacagggtcgaacggcaaaaccggtctgccgatgatggcactcagacccactcagaaaattcgagtcaggagaacagaatcaaagctcgatgcctatcttgcacctccatggtactgaaggggatctgggggcttctgatcatcctgtcagtgtccagcagctgggttggtactacacaaatagttaagattacttacaaaaacttttactgccccttcttcatgacttggttctcgacaaattggaatattatgttttttccagtgtactactctggccatctggctactgcccaggagaagcaatcccctatgaagaagttccgggagtgttctaggatattcggagaggatggcctgactctaaaactgtttcttaaacggacagcaccgttttctatactgtggacactgactaattacctctaccttctggctcttaaaaagctgacggccacggatgtgagcgccctcttctgttgcaacaaagcgtttgtcttcctgttgtcctggattgttctcaaagacagatttatgggtgtccgcattgttgctgcaataatggcaattactgggattgtaatgatggcatatgcagataactttcacgccgattccataattggagtcgcatttgccgtggggtcggccagcacgagcgccttatacaaagtgctgtttaaaatgttcctgggatccgcgaattttggagaagccgcacactttgtgagtacactgggattttttaacctaattttcatcagctttacacccgtcatcctgtatttcacaaaagtggagcattggagctcatttgccgctctgccatggggctgtttgtgcggaatggccggcctctggctcgcctttaacattttggtcaacgtgggcgtggtgctcacctaccccattctcatctctattggcactgtgctgagtgtgcctgggaacgctgccgttgacttgttgaagcaagaagttatctttaatgttgtgcgcctggctgctacgatcattatttgtatcggtttcctgttgatgctcctgcctgaagagtgggatgagataacgctacgttttattaattccctgaaggagaagaaatccgaggagcacgtagacgatgtgaccgatccatccatccacctccggggtagaggcagggctaacggaactgtttccattcctctggcctag

SEQ ID NO: 46246 - DNA, 1572 bp, Artificial Sequence
  Description of Artificial Sequence: Synthetic coding sequence
atggtgcccccccggcggcaccggggcgccggccggcccggcgtgctgtctagctccccaccgtttcggctgcggtctgctaagttcagtggcattgctttggaggacctgagaagggctctcaagactaggcttcagatggtatgcgtgtttgtcatgaaccgtatgaatagccagaacagcggtttcacccagagacggcgaatggcccttggaatagtcatactgctacttgtggatgttatatgggtcgcttcttccgagctaacttcatatgtatttacacagtacaataaaccctttttctccaccttcgctaagacatcaatgttcgtactgtaccttttgggcttcattatctggaaaccctggcgccaacagtgtacgcgcgggctccgaggaaagcacgctgccttttttgcagatgctgaggggtattttgctgcttgtacaaccgacactactatgaatagtagcctctctgaacccctctacgtgcccgtgaagttccatgatctgccaagtgaaaaaccggagagtacaaacatcgatactgagaagacccctaagaaatcccgcgtccgtttctcaaatatcatggagatccgacagctgccatccagccatgccctggaagcaaagctgtccagaatgtcctatccagtcaaggaacaggagtccatactgaagaccgttggaaaactcactgccacacaggttgccaagatctcatttttcttttgttttgtgtggtttctcgcgaacttaagctaccaagaggccttgtctgatacacaagtggcgattgtgaacatattatccagtacaagtggcctattcaccctgatcctggccgcagttttcccgtcaaactctggcgatagatttactctgtccaagctgctcgccgtgatcctgagtatcggtggcgtcgtgctggtgaacctggccgggtctgaaaagccagccggacgcgacacggtgggttccatctggtctttagcaggagccatgctgtatgccgtttatatcgtcatgatcaagagaaaagtagatcgcgaggataagctcgacatccctatgttctttggcttcgtcggactgtttaatctgcttctcttgtggcctgggtttttccttctccactatactgggttcgaggactttgagtttccgaacaaggtcgtccttatgtgtatcataatcaatggcttgatcggtacagtcttgagtgagttcctgtggctgtggggatgctttttaaccagtagcctgatcggcactcttgccttaagcttgacaatcccactcagtatcatagccgacatgtgcatgcagaaggtgcaattctcatggctcttcttcgctggtgcaattcccgtatttttctcttttttcatagtgacactgttgtgccactataataactgggacccagtgatggtaggtatacggagaatttttgctttcatatgccggaagcataggatccagagggtgcctgaggacagcgaacagtgcgagagcttgatctctatgcactccgtaagccaggaggacggagccagctag

SEQ ID NO: 46247 - DNA, 1554 bp, Artificial Sequence
  Description of Artificial Sequence: Synthetic coding sequence
atggacagcagcggctggcggggcgtgctgagcagcagcccccccttccgcctccggagcgccaagtttagcggcatagccctggaggacctacgcagggcgctcaagacccgactacagatggtgtgcgtgttcgtcatgaatcgaatgaacagccaaaacagtggcttcacacaaaggaggagaatggctctcggcatagtgattttgctcctcgttgatgtcatttgggtggcctcaagcgaactaacatcatatgtgttcacacagtacaacaagcctttctttagcacttttgctaagacatcaatgtttgtgctgtacttgctcggatttatcatttggaaaccctggagacagcagtgcacacgcggcctcagaggtaaacacgcggcattttttgccgacgctgaaggatacttcgctgcatgtacgacagatactactatgaatagtagcctgagtgaaccactttacgttcctgtcaagttccatgacctgccctcagagaaacccgagtccactaacatcgacaccgaaaagacaccgaaaaagtctagagtgaggttttctaacataatggagattagacaacttcccagtagtcacgcgctggaagccaagctctctcggatgagctaccctgtgaaggaacaggagtccattctcaagaccgtgggcaagctgacagcgacccaggtggctaaaatcagtttctttttctgttttgtgtggtttctcgccaatctaagctaccaagaagccctctctgatacccaggttgctatcgtgaacatcctctccagcacatctggcctgttcaccctcatacttgccgcggtgttcccatctaattctggtgatcgcttcaccttgagcaagcttctcgccgtaatactctcgatcggaggtgtagtgctcgtgaaccttgcaggctccgagaagcctgccggccgcgatactgtgggttccatttggtccctggccggcgctatgctgtatgccgtgtatatcgtgatgattaagcgaaaagtagatagggaggacaagctggacattccgatgttctttggtttcgttggcctattcaaccttctcctactttggcctgggtttttcctcctgcactacacgggctttgaagatttcgagtttcctaataaagtggttctaatgtgtatcattattaatggtctgatcggcactgtgctctccgagtttctttggttgtggggatgcttcctgactagctctttgattggaacactcgccctctctctcactatacctctatccataattgccgacatgtgcatgcaaaaggttcaattctcttggctcttttttgctggcgccatccctgtcttcttttctttttttatagtcacactattatgccattacaacaactgggatccagtgatggtgggtataaggcggatcttcgctttcatctgtaggaaacacagaattcaaagggtgcccgaagatagtgagcagtgtgaatctctgatttctatgcactccgtgagccaggaagacggagcctcctag

SEQ ID NO: 46248 - DNA, 1095 bp, Artificial Sequence
  Description of Artificial Sequence: Synthetic coding sequence
atgcggccccaggacagcaccggcgtggccgagctgcaggagcccgggctgccgttgactgatgatgctcctcccggtgctaccgaagagccagccgctgccgaagccgctggcgccccagaccgaggtcgctgctggctgtgtctatctagcccttgttgttcgagaacagagcccgcgaaaaagaaggccccctgcccgggactaggcctcttctatacgctactctccgctttcctattctcagtaggcagtctgttcgttaagaaggtgcaagatgtgcatgccgtcgagatttctgctttcaggtgtgtgttccagatgctagtggtgatcccatgcctaatttatagaaaaacagggtttatcggacccaaaggccagcggatcttcctgattctccgaggcgttctgggctccacggcaatgatgctgatttactacgcttaccagacaatgagcttggccgatgctacagtgataaccttttcctcaccggtctttacttcaatctttgcttggatctgccttaaagagaagtattcgccgtgggatgcactgttcaccgtcttcactatcaccggcgttatccttattgtgaggccacctttcctgttcggttcagatacgtcaggaatggaagagtcatactcgggacatctgaagggcacttttgccgctattgggtccgccgtcttcgctgcctcaaccttggtcatccttcgtaagatgggaaaaagcgttgactacttcttgtccatctggtattatgtggtgttaggactagtggaatctgtgatcattctctccgtgttgggggagtggagcctaccatattgtgggctcgatcgcctcttcttgattttcatcggattgttcggcttagggggacagatcttcattaccaaagctctccagatcgaaaaggcagggcccgtggctataatgaaaacgatggatgtggtgttcgcattcatctttcagatcatattttttaataatgtcccaacatggtggacagtgggaggggctctttgcgtggtggcgtccaatgtgggagcggccattagaaaatggtatcagagctccaagtag

SEQ ID NO: 46249 - DNA, 1098 bp, Artificial Sequence
  Description of Artificial Sequence: Synthetic coding sequence
atgcggccccaggacagcaccggcgtggccgagctgcaggagcccgggcttccattaactgatgacgctccgcctggcgcaactgaggaaccagccgccgccgaagctgcaggggctccggacagaggacgctgctggctttgtctgtcgagtccgtgctgttcacggaccgaaccagaggcaaagaaaaaggcaccctgccccggtctgggtctgttctatactctcctgtctgccttcttattctccgtggggtccctctttgtgaaaaaagttcaggacgtgcacgcagttgagatttctgccttcaggtgcgtctttcagatgctcgtggtgattccttgtctgatctacaggaagacgggcttcattggacccaaagggcagagaatcttcctcatccttcgaggcgtacttggcagcacagcaatgatgttgatatactatgcgtaccagactatgtccctggctgatgccactgtgattaccttctcctctcctgtatttacgtccatttttgcctggatttgccttaaagagaaatactctccttgggacgcactgttcacagtcttcacaatcacaggggtaattctcattgtgaggccccctttccttttcggtagcgacaccagtggaatggaagaatcctatagcggacacctgaagggaacgtttgcggctattggtagcgcggtctttgccgcctcaactttggtcatactccgaaaaatgggtaaatccgtagattacttcctgtcaatatggtattacgtcgttctggggctggtggaatcggtgatcattctgtctgttttaggggaatggtccctgccatactgcggactggataggttatttcttatcttcattgggctgtttggactgggaggccaaatttttattacaaaagccctccagattgagaaagccggccccgtggccattatgaagacaatggacgtggttttcgcatttattttccagatcatctttttcaataacgtccctacatggtggacggtgggcggtgctctttgcgtggtcgcctccaatgtcggtgctgccattagaaaatggtaccaaagcagcaaatag

SEQ ID NO: 46250 - DNA, 1017 bp, Artificial Sequence
  Description of Artificial Sequence: Synthetic coding sequence
atggccggcagccacccctacttcaaccagcccgacagcacccacccatcccccccatcagcacctccatccctgagatggtatcaaaggtgccagccttccgacgctaccagcggcctcctggtagctttactgggaggaggtcttcccgcagggtttgtagggccactctcccgcatggcctatcaggcatccaatctgccttctctggaacttttgatttggaggtgtctgttccacctgccgatcgcgctactcctaaaacttcgaggcgaccccctcttaggcaccccggacatcaggtctcgtgcattcttctgtgcactgcttaacattttgagtatcggctgtgcgtactcagcagttcaggtcgtccctgcgggtaacgctgcaacagtgcggaaaggctcctccacagtctgttcagccgtactgaccctctgcctcgaaagccagggtctgagcggatacgactggtgcggcttattgggatgtattctcgggcttatcatcatcgtgggacccggcctgtggaccttgcaggaaggaaccactggcgtgtacactgcactcggctacgtggaggcgttcctgggcggactggcactgagcttacggctgctagtttaccgctcgctgcacttccccccctgtctgcccaccgtggccttcctgtctgggctcgtgggattgctcgggtccgtccctgggctgtttgttctgcaggctccagtattgccttctgatctgctgtcctggtcttgtgtgggtgccgtcgggatacttgccctggtgtctttcacatgcgtgggctacgccgtgaccaaggcgcatccggcgctcgtatgcgctgtgctgcattctgaagtggtcgtggcacttatcctccagtactatatgctccatgagacagtggcaccttccgacatcgtagccgcgggggtggttttggggtcgattgccatcattaccgcccagaatctttcatgcgagcggaccggaagggtggaggagtag

SEQ ID NO: 46251 - DNA, 1017 bp, Artificial Sequence
  Description of Artificial Sequence: Synthetic coding sequence
atggccggcagccacccctacttcaacctgcccgacagcacccacccgagtcccccaagcgccccaccaagcctccgctggcaccaaagatgtcagccctcaggtgcgaccaacggacttctcgtggctttgttgggcggcggtctgccggccggatttgtaggaccgctatctcgcatggcgtaccaggggtccaatctgccaagccttgagctccttatttgccgatgtctgttccacctccccattgccctcctgctcaaacttaggggcgatccacttctgggacctcccgacatccggggctgggcatgcttctgtgctttgctgaacgtcctgagtattggttgcgcgtatagcgccgtgcaggtggtgccggcaggcaatgctgctacggtgcggaagggaagctccacggtgtgctcagccgtactgactctgtgcttggaatcacaggggctgggtggctacgagtggtgcggcctgttgggatccatacttgggttgattattattctgggcccgggactgtggacactgcaggaggggacaaccggggtgtataccacattggggtacgtgcaagccttcctgggtggtcttgccctttccctcgggttgcttgtttacagatccctgcactttcccagttgcctcccaacagttgccttcctgtctggtcttgttggcctcctggggtgcgtgccaggtctcttcgtccttcagaccccagtgctgccctctgacctgctgtcttggagctgtgttggcgctgaaggtatattggcccttgtttctttcacatgtgtggggtatgccgtgactaaagctcatccagccctagtctgcgccgttctgcactccgaagtcgtggtcgcgttgatcctgcagtactacatgctgcatgagacagtggcgctgtcagacatcatgggcgctggcgtcgtgctcggcagcattgccatcatcacggcacgcaacctcagctgcgagcggacaggaaaggtggaagagtag

SEQ ID NO: 46252 - DNA, 1158 bp, Artificial Sequence
  Description of Artificial Sequence: Synthetic coding sequence
atgcggagcagcctggcccccggcgtgtggttcttccgggccttctcaagagatagttggttcaggggcctaatactcctcctcaccttcctcatttacgcttgctatcacatgagtcgtaagccaatatccatcgttaaaagccgtctccatcaaaactgtagcgagcagattaaacctatcaacgacactcactccttgaatgatacaatgtggtgctcttgggctccattcgataaagacaattacaaggagctgctgggaggtgtggataatgcgtttctaatcgcgtacgctattgggatgtttatttccggggtattcggagaacggctccccctgcggtactatttaagcgcagggatgctgctttctgggctctttacttccctgttcggacttgggtacttctggaacatacacgagttatggtactttgttgtcatccaggtgtgcaacggtctcgtacagaccacgggatggcccagcgtcgtgacttgtgtgggaaattggtttggcaagggtaaacgcggtttcatcatgggtatttggaactcccatacctctgtggggaatatactcggaagtctcatagccgggatctgggtgaatggtcaatggggactaagcttcattgtcccaggcataataaccgcagttatgggagtcataacattcctctttcttatcgagcacccggaggacgtcgactgtgcgcctccacaacaccacggtgaaccagctgagaatcaggacaacccagaggatccaggaaacagtccatgcagcattagggagagtggccttgagacagtagctaaatgcagtaagggcccatgcgaagagcccgccgccatttcgttttttggagctctgcggatccccggtgtcgtggagtttagcctgtgcttactgtttgcaaaactggtatcctatacctttctgtactggctgcctctttatatcgctaacgtggcgcatttttctgcgaaagaggccggagacctcagtacactttttgacgtaggcggcattatcgatgttcctgttcagttgcactggcctggccgtgattgtcagctccatagcgacgcagaccatctgtggggcccaggacagtggcctatcagggcccaccaccactgctgcctttgttag

SEQ ID NO: 46253 - DNA, 1518 bp, Artificial Sequence
  Description of Artificial Sequence: Synthetic coding sequence
atgcggagcagcctggcccccggcgtgtggttcttccgggccttcagcagggactcatggttccgcggacttatcttgctgctgactttcctcatctatgcttgctatcacatgagtagaaaaccaattagtatcgtaaagtctaggctgcatcaaaactgcagcgaacaaattaagcccatcaacgatacccactcactgaacgataccatgtggtgctcgtgggccccttttgacaaggataactataaggagcttctgggcggagtcgataacgcattcctgatcgcttacgctataggaatgttcataagtggcgtgttcggagagcgcttacctctaaggtactatctgtcagccgggatgttactctccggactgttcacctccctcttcggacttggttacttctggaatatccacgagctctggtactttgtcgtgattcaagtgtgcaacggactggtacagacgacaggctggccctccgtagtgacttgtgttgggaactggttcggcaagggcaagcgcggctttatcatgggtatctggaacagccatacctccgtggggaacatcttagggagcctaattgctgggatctgggtgaacgggcagtggggtctcagctttatcgtaccaggaatcatcacggctgtcatgggcgtgataacatttctctttctcatcgagcatccggaagacgtggactgcgcccctccacagcaccacggtgagcctgccgagaaccaggataacccagaggatcctgggaactccccgtgctccattagagagtctggactcgagaccgtagctaagtgttccaagggaccttgcgaagagcccgccgcaatttcgttttttggagctttgagaatacccggagtggtcgagtttagcctgtgtctcttgttcgccaagcttgtgagttacacctttctgtattggctccccctgtacatcgccaatgtcgcgcacttttctgcaaaagaggcaggagacctgagcacccttttcgatgtgggaggcataattggtggaatagtcgccggcctcgtcagtgattatacaaacggacgcgccacaacatgttgcgtcatgcttattctggcagctcctatgatgttcctgtataactatataggccaggatggaatcgcctccagcatcgttatgcttattatttgtggtggccttgtgaacggcccatacgctcttattaccacggctgtgtcagctgacctgggcacccataaatccctcaagggtaatgccaaggccctgtcaacagtcacggctataatagatgggactggatcaataggcgccgcccttgggcccctgttggcggggttgatttctccaacgggctggaacaatgttttttatatgctgataagtgctgatgtcctggcatgcttgctactatgtcgtctggtatacaaagagatcctggcctggaaagtctccctgagcaggggatccggatcgagtatggtgttgactcaccagtag

SEQ ID NO: 46254 - DNA, 1506 bp, Artificial Sequence
  Description of Artificial Sequence: Synthetic coding sequence
atgcggagcagcctggcccccggcgtgtggttcttccgggccttctcaagagacagttggtttagaggcctgatccttctattgacgtttttgatttatgcctgttatcacatgtcccggaaaccgatttccattgtgaaatccaggcttcaccagaactgttcagagcaaattaaaccaataaacgatacgcactcacttaatgataccatgtggtgtagttgggccccattcgataaagacaactataaggagctccttggcggtgtcgacaatgctttccttatagcctatgccatcgggatgtttatctctggagttttcggggagcgtctgccccttagatactacctctctgctgggatgctactcagcggtctgtttacaagcctcttcgggctgggctacttctggaacatccacgaactgtggtattttgtcgtcatccaggtgtgtaacggcctcgttcagacaacaggctggccctcagtcgtcacatgcgtaggcaactggtttgggaaagggaagcggggattcatcatgggaatctggaactcacacaccagcgtgggcaacattctagggtcactgattgctggcatctgggtaaacggacagtgggggctgagcttcatcgtgcccgggattatcaccgccgtgatgggagtgatcacttttcttttcctcatcgagcaccccgaggacgttgactgtgccccaccacagcaccacggggaaccggccgagaatcaagacaaccccgaggatccagggaactccccctgttctattcgggagtccggcctcgaaacagtcgcaaaatgctcgaagggcccatgtgaagagccagccgccatcagcttcttcggcgctctccggatcccaggtgtcgtggagttctccctgtgtcttctctttgctaaattggtgtcctacactttcctgtattggttgcctctttacattgctaatgtggcccacttcagcgccaaagaagcgggtgatctgtccaccctgttcgacgtaggcggcattatcggaggcattgttgccggacttgtgtcagactacacgaacgggcgcgctactacttgctgtgttatgctcatactggccgcaccgatgatgtttctttacaattacataggccaagacggaattgccagcagcatagtcatgctgatcatctgtggcggacttgtaaacgggccttatgcactcattaccacagctgtcagcgccgatctggggacacacaaatcactgaaggggaatgccaaggcactttccactgtgactgccattattgatggcacaggcagtatcggggccgccctcggtcctttgctagcaggcctcatctcacccaccggatggaataatgtgttttacatgctaatctccgctgatgtgctggcctgtttgctgctgtgtagactcgtgtacaaggaaatccttgcatggaaggtctcgcttagccgggggtctggttataaggaaatttag

SEQ ID NO: 46255 - DNA, 1518 bp, Artificial Sequence
  Description of Artificial Sequence: Synthetic coding sequence
atgcggagcagcctggcccccggcgtgtggttcttccgggccttctcgcgcgatagttggttccgcggcttgatcctcctgctgactttccttatatatgcctgctaccacatgagtagaaagcccatttctattgtcaagtctcggttacatcagaactgcagcgaacagattaaaccaattaacgatacacattctctgaacgacactatgtggtgttcctgggcaccctttgacaaagataactataaggagttactcggtggggttgataatgcttttttgattgcttatgccattgggatgttcatttccggggtgtttggagagaggctcccactgcggtactacctgagcgccggtatgctcctgtctggtttgttcacctccctattcgggttgggctatttttggaatatccatgagctttggtatttcgtcgttattcaagtctgcaacggtttggtgcagaccacaggatggccgagcgtggtgacttgcgtcggcaactggtttgggaagggtaagcggggtttcattatggggatctggaactctcacacctccgtggggaacattctcgggtctcttatcgccggtatttgggtgaacggccaatggggcttgtcgttcattgtgcctggtattatcactgccgttatgggcgtgattacgtttctctttctgatagagcatccagaagacgtagattgtgcacctccccagcatcacggcgaaccagccgagaaccaagacaatccggaggatccgggcaactcgccgtgctctatccgcgaatccggcctcgagacagttgcgaaatgctcaaaaggaccctgtgaggaacctgctgccatttcattctttggcgcactccgaatcccaggggtcgtggagttttcactgtgtctcttgtttgcaaaactggtgagctacacctttctctattggcttccattgtacattgccaacgttgcccacttttccgccaaggaggccggagatctgagcaccctgttcgacgtaggaggaatcataggggggatcgtggccgggctcgtttctgactatacaaacggacgggcaacgacgtgttgcgtgatgctgatcctcgccgccccaatgatgtttctatataactacatcggtcaggatggcattgcatcttctatcgtcatgttgattatttgcggagggttggtgaatgggccctacgctctgattaccacagcagtgtccgctgatcttggaactcataagtccttgaaggggaatgcaaaagctctttccactgttaccgcgatcatagacggtacagggtccatcggggcagccctcggccccttgttagccggcctaattagcccaaccgggtggaataacgtgttctatatgttgatctctgccgacgtgttggcctgcctgttgctgtgccgcctggtatacaaggagattcttgcctggaaagtgagtctatccaggggatccgggagtagcatggtgcttacccaccagtag

SEQ ID NO: 46256 - DNA, 1485 bp, Artificial Sequence
  Description of Artificial Sequence: Synthetic coding sequence
atggcctggcccaacgtgttccagcggggcagcctgctgagccagttctctcaccatcacgtggtcgtcttcctgctcacatttttttcatatagcttacttcacgcttcccgaaagaccttctcgaacgttaaagtgagcatttccgagcagtggacaccatccgctttcaatacgtccgtggaactgccggttgagatctggagttcaaatcacctcttcccgagcgccgagaaagccaccctctttttggggaccttggatactattttcctgtttagttatgcagtgggtttatttataagcgggatcgtgggagaccgtctgaacttacgctgggtattgtcctttggtatgtgctctagcgccctcgtagtgttcgtctttggagccctcaccgagtggctccgcttttacaacaaatggctgtactgttgcctttggattgttaacggactccttcagagtaccggctggccctgcgtagtcgctgttatgggaaattggttcggaaaggctgggcgtggtgtcgtattcggcctgtggtccgcctgcgcctccgtgggaaacatcctcggtgcgtgcctggcctcttccgtactgcagtacggatatgagtacgcgttcctggtgacggcttctgtgcagttcgccggaggaattgtgatttttttcggccttctggtgtcacccgaagagattgggctgtccggtatagaagccgaagagaacttcgaagaggactcccaccggcctctgattaatggtggagaaaatgaagatgagtatgagccaaattattcaatacaggacgactcaagtgtggctcaagttaaagcgatttcattttaccaggcatgctgtctcccaggagtgataccatactccctcgcttacgcatgtctgaagctggtgaactattcttttttcttctggctcccgttctacctttccaacaacttcggatggaaggaagccgaagctgataaacttagcatctggtacgacgtgggtggcattattggaggcacactgcagggatttatcagtgacgtgctgcagaaacgggcccccgtgctggcactctccctactgttggccgttggaagccttattgggtactctcggtctcctaatgacaagagcattaacgctttgctgatgacagtcacaggattctttatcggagggccaagtaatatgatcagctccgctatctcggctgacctgggtagacaggaattgattcaaagatcatccgaagctttagccaccgttacaggcattgtggacggttccggctctattggtgcggccgtgggccagtaccttgtgagtcttatccgtgacaaattaggctggatgtgggtgttctattttttcattctaatgacctcttgcacaatcgtgttcatcagccccctcatcgtcagggagatttttagcttggttctccggcggcaggctcacatcctgcgcgagtag

SEQ ID NO: 46257 - DNA, 1332 bp, Artificial Sequence
  Description of Artificial Sequence: Synthetic coding sequence
atggcctggcccaacgtgttccagcggggcagcctgctgagccagttcagccaccaccatgtagttgtgtttctgcttaccttttttagttacagtctgcttcatgcttctcgcaagaccttttcgaatgtgaaggtgtctatttctgagcagtggactccaagcgcattcaatacttctgtggagctaccagttgaaatctggtcaagtaaccatctgtttcccagcgctgagaaagctacattgttcctggggacactggataccatattcctcttctcttatgccgtcgggctttttatttctggaatcgtgggcgatcgtttgaacctgcgatgggttctaagtttcggcatgtgtagctccgctctcgtggttttcgtgttcggtgctctgaccgagtggcttagattctacaataaatggctgtattgttgtctgtggatcgtaaatggtctgttgcagagcactggatggccttgcgtggttgctgtgatgggaaattggttcggcaaagcggggcggggagtcgtgttcggattgtggagcgcctgcgcctcggtcggcaacatcttaggagcctgccttgcctcatctgtgcttcagtacggttacgaatacgcttttttggtcactgcaagcgtacagttcgcaggagggattgtgatcttcttcggtttgctcgtgtctccagaggagatcggacttagtggaatcgaggccgaggaaaatttcgaggaggattcacatagaccactcatcaacggaggagagaatgaagatgagtatgaacccaattatagcatacaagatgacagctccgttgctcaggtgaaggcaatctctttttaccaagcgtgctgcctccctggtgtgattccttacagcctagcttatgcctgcttgaaattagtgaattacagcttcttcttttggctgcccttctatctaagcaacaatttcggatggaaggaagctgaggcagacaaattaagtatttggtatgacgtcggtggcattatcgtttttagtgtcagcgacccaggccaagcgcgtatggacgtaggctttttactatttcatagccatgataagctgtataattgtgtgtaccttgctattaacagtgagggcaatatcctttctagggccaaagagacaggcagccatattgaaggcgtgacaggcgcacgtgagaccgagaggactatgtccgcgacatccggccccttagggctacgggtctgcccaaatcttggcctgtcccgatccagctcgctaatccttgattgccaagcttcccttaacaccgcatcccatttgaggtgctag

SEQ ID NO: 46258 - DNA, 471 bp, Artificial Sequence
  Description of Artificial Sequence: Synthetic coding sequence
atggcctggcccaacgtgttccagcggggcagcctgctgagccagttctcacaccatcacgtggtcgtgtttttgctcaccttcttttcatatagcttgcttcatgcgtcccgcaaaactttttctaacgtgaaagtgagcatcagcgagcaatggacccctagcgcttttaacacgtcggtcgagttgccagtcgagatctggtcgagcaaccatttgttcccgtctgccgaaaaagcaaccctctttttaggcactctggatacaattttcctgttctcatatgcggtgggcctttttatcagtggcattgtgggtgacaggctcaacctgcggtgggtgctcagctttgggatgtgctccagcgcgctggtcaccagatcttgcttctggtcgcttgagtgtctgtgttttggaggccaacattttggctccgtgcccagcttcttctgtagcagcgtgtggctgtag

SEQ ID NO: 46259 - DNA, 1437 bp, Artificial Sequence
  Description of Artificial Sequence: Synthetic coding sequence
atggcctggcccaacgtgttccagcggggcagcctgctgagccagttttcacatcatcatgttgtggtatttttgctaaccttcttctcttattccctgctgcacgcttccaggaagacctttagcaatgttaaggtgagcatatccgagcaatggacccctagcgccttcaacacctcggtggagctcccggtggagatatggagcagcaaccatctgtttcccagcgccgagaaagccactctgttcctgggaactctggataccattttcttgtttagctacgcagtcggactctttatctcgggaatagtcggggacaggctgaacctccgttgggtgctttccttcgggatgtgttcctctgccctcgtagtgttcgtgtttggtgcactgaccgaatggctcaggttttataacaagtggctctattgctgtctgtggatcgtgaacgggctcctgcagtcaacaggatggccatgtgtcgttgcagtgatgggcaactggttcggaaaggccggccgtggggtcgtttttggactctggagtgcgtgtgcttcagtgggtaatatactcggagcttgcttagcatccagtgttcttcagtacggttacgagtacgcgttcctggtgactgcctccgtccaattcgccggaggaattgtcatctttttcggtctgctagtgagcccagaggagattgggctctccggcatagaggccgaggaaaactttgaagaggacagccaccgacctctcatcaacggcggtgagaacgaggatgagtacgagccaaactacagtattcaggatgattcatcagtggcccaggttaaggctattagtttttaccaggcctgttgcctgcccggggttattccgtattctctggcatatgcttgtctgaagttagttaactacagcttctttttttggctgccattttacctgagcaacaacttcgggtggaaagaggcagaagcagacaagctctcaatctggtacgatgtgggtggcattatcgggggaaccttacaggggtttatcagcgacgtgctgcaaaagagagcaccggttctggcgctgagcctgctattagctgtgggatcattgatcggctacagtcggttcttcatcgggggcccatctaatatgatttcaagcgctatttccgccgacctgggcaggcaagagcttattcagcgcagcagcgaggccctggcgacggtaacagggattgtggatggctccggcagtatcggcgctgcagtcgggcagtatctagttagtttgatccgagacaagttgggatggatgtgggttttctatttttttattttaatgacatcatgtacaatcgtgttcataagcccactcatagtaagggagatctttagcttagtgctgcggagacaggctcacattctgagggaatag

SEQ ID NO: 46260 - DNA, 45 bp, Artificial Sequence
  Description of Artificial Sequence: Synthetic coding sequence
atggcctggcccaacgtgttccagcggggcagcctgctgagctag

SEQ ID NO: 46261 - DNA, 714 bp, Artificial Sequence
  Description of Artificial Sequence: Synthetic coding sequence
atggcctggcccaacgtgttccagcggggcagcctgctgagccagttttcacatcatcacgtagttgttttcctacttactttttttagctacagtctcctgcatgcatcaaggaagacatttagcaatgttaaggtttcaattagtgaacagtggacaccgtccgctttcaatacctctgttgagctacccgtggaaatttggtcttcgaaccacctgtttccaagtgcggagaaagctaccctctttcttgggaccctggatacaatcttccttttctcatacgcagtcggcctgttcatctccgggattgtgggggatcgccttaatctcaggtgggtgctatccttcggtatgtgcagttctgcgctggtggtctttgtgttcggagcgctgactgagtggttgagattctataataaatggctgtattgctgtctgtggatcgtgaatgggctgctgcagtcaacaggatggccatgtgtggttgcggtgatgggcaactggtttggaaaagccggccggggggtcgttttcggcctgtggtctgcatgcgcctccgttgggaatattttgggggcctgcctggcaagttccgtgcttcagtatggctacgagtacgctttcctagtgacagccagtgtgcagtttgcagggggaattgtcattttcttcggcctcctcgtgtcccccgaagaaattggaaaactgtag

SEQ ID NO: 46262 - DNA, 2343 bp, Artificial Sequence
  Description of Artificial Sequence: Synthetic coding sequence
atgaccgccgccgccgccagcaactggggcctgatcaccaacatcgtcaattccatcgttggcgtgtccgtattaactatgccattctgcttcaagcaatgtggaattgtgctgggggccctgctgctggtcttctgtagttggatgacacatcaaagctgtatgtttctcgtgaaatcggctagcctttccaaaagacgcacgtacgcgggcctcgcctttcacgcctacggcaaagcgggcaagatgctggtggaaacgagcatgatcggactgatgcttggcacatgcatagcattctatgttgttatcggcgatctgggatccaatttcttcgcacgactctttggatttcaagtcgggggtaccttcagaatgttcctgcttttcgctgtttccctctgtatcgtgctgcccctgagtttgcagagaaatatgatggccagcattcagtccttttccgctatggcactcctgttctataccgtttttatgtttgttattgtgctcagctctctgaaacatgggcttttttccggtcaatggttaagacgagtctcgtacgtcagatgggagggggtttttcgatgcatccccattttcggcatgagcttcgcttgtcagagtcaagtcttacctacctacgacagcctggatgaaccgtcggtgaagaccatgtcctctatcttcgctagcagtctgaatgtggtgacaactttttacgtgatggtgggcttcttcggctacgtctctttcaccgaggccactgccggcaatgtgttaatgcattttcccagtaacttggtgaccgaaatgttgagggtgggttttatgatgtctgtcgctgtcgggttccctatgatgatcctgccatgtcggcaggccctctctacgcttctttgcgagcagcagcaaaaagacggcacttttgcagccggaggctatatgccacctctgcgcttcaaggcattgacccttagcgtggtattcggtacaatggtgggtggcatcctgatccccaatgtagaaactattcttgggctcactggggccaccatgggctctctgatatgcttcatatgccctgcacttatctataagaagatccacaagaatgccctgagttcacaggttgtgttatgggttggtctgggtgttctggtcgtaagtaccgtgaccacgctgtcagtttctgaagaggtccctgaggacctggccgaagaggcccccggcggaagactgggggaggccgaaggtcttatgaaagtggaagctgcaaggctgtcagctcaagacccggttgttgcagtggcggaagacggcagggaaaagcctaaacttccaaaggagcgggaggagctggaacaagctcaaattaaggggccagtggatgtccccggacgtgaggatggtaaagaagcgcctgaggaagctcagcttgacagacccgggcaaggcatagccgtccctgtgggcgaggctcatcgccatgaaccaccagttccccacgacaaggtggttgttgacgaaggacaggatagggaggtgccagaggaaaataagcccccttcaagacacgctggtgggaaagccccgggtgtgcagggtcagatggcaccaccactgccggattccgaaagagagaaacaagaaccagagcagggagaggttggaaaacgccctggtcaggcccaggcgttagaggaggccggggatctgcctgaggatcctcagaaagttccagaggctgatggccagccagctgtgcagccagccaaagaggaccttggacctggcgatcgcggactccaccctaggccccaggcggttctcagcgagcagcagaatggactggccgtggggggcggcgaaaaggccaagggcggccctcctccagggaacgctgcgggagataccgggcagccggccgaggactccgaccatggtggaaagccaccactaccagcagaaaagccagctccaggtccggggctgcctcccgagccaagagaacagagggatgtggaacgagccggcggaaatcaggcagcttcacagcttgagggcaaagcttccgccctgcagcccccggcgtccggtccagggagtggctcgccactgccccagccatggggagacgcccaggtaatcctggggtcccctgcccggcctcccttctctttccagcctcctgcagaacaaaccccgagacgcgcattttgcagtctcccgatctcttctctgcttagcggaaatctcctgagtgcgctgctcccttttaagcaccttcgtcaccgtcatatggcttgtgactatagatttatttctctggcccccttgtag

SEQ ID NO: 46263 - DNA, 3360 bp, Artificial Sequence
  Description of Artificial Sequence: Synthetic coding sequence
atgaccgccgccgccgccagcaactggggcctgatcaccaacatcgtgaacagcatcgtgggcgtgtccgttctgactatgcctttttgtttcaagcaatgcggtattgttttaggcgctctgcttttagtcttctgctcatggatgacacatcaatcatgcatgtttctcgtgaagagtgcttctttatctaagcgaaggacctacgcaggtttggcatttcacgcctacggaaaggcaggaaagatgttggttgaaacttctatgataggcctcatgctcgggacttgtatcgccttctatgtggtgataggggatttgggctccaacttttttgcccgacttttcggttttcaggtgggcggaacgtttaggatgtttctgctgtttgcagttagcctttgtatcgtgctgcccctgtcactccagagaaatatgatggctagcatccagagtttttccgctatggcactgcttttctataccgttttcatgtttgttattgtgctctcttctctgaaacacggcctgttcagcggccagtggcttcgacgcgtgtcatacgtgagatgggaaggagtctttcgatgcatccccatctttgggatgagctttgcttgtcagtcccaggttctccccacatacgacagcctcgatgagccttcggttaagactatgagctcgatattcgcctccagcctgaacgtggttaccaccttctatgttatggtcggtttttttggttacgtaagcttcaccgaggccactgccggtaacgtgctgatgcactttccatccaatctggttaccgagatgctgcgggtagggttcatgatgtcggttgcagtgggctttcctatgatgatactcccctgtcgccaagcactgtcaaccctgttgtgtgaacagcaacagaaagacggcacattcgccgccggtgggtacatgcctcccctgcggtttaaggccctgactcttagcgtcgtgtttggcactatggtcgggggaatactgatccctaacgtggagaccatattgggccttactggtgccaccatggggagtctgatctgctttatatgcccagcgctgatatacaaaaaaatccacaagaacgcactgagttcccaggtggtgttatgggtgggattaggtgttctggtagtgtctactgttacaacactttctgtaagcgaagaagttcccgaagacctggcggaggaagctccaggcggaagactgggcgaggccgagggactgatgaaggtggaggcagcccggctgtccgcacaagaccccgttgttgctgttgcagaagacggacgggaaaaaccaaagttgccgaaggagcgtgaagagcttgagcaagcccagattaaggggcccgtagacgtgccaggccgcgaggatggaaaagaggctccagaggaggcgcagctagaccgaccagggcagggtattgctgtgccagtaggtgaggcgcatcgccacgagccacccgtgcctcacgataaagttgttgttgacgagggccaagaccgggaggtccctgaagagaataagccacccagtaggcacgccggcggcaaggcacctggagttcaaggccagatggctcccccacttccagattcagagagagagaaacaggagcccgagcaaggagaggtcggcaagcgccccgggcaggcacaggccctggaggaggcaggtgatcttccagaagatcctcagaaagtaccagaagccgatggccagcctgctgtgcagcctgctaaggaggacctcggaccaggcgatcggggcctgcacccgagaccacaggcggtgctgtctgagcagcagaacggtcttgctgtgggcggaggcgaaaaagcaaagggcggaccaccaccaggcaatgccgctggcgacaccggccagccagcagaagattctgatcacggtgggaagcctcccctccctgccgagaaacccgctccaggcccaggcttacctccagagcctagggaacaacgtgatgtggaacgagccggagggaaccaggctgcaagccaactggaggaggccggtagggccgaaatgttggatcatgccgtcctgctgcaggtgataaaagaacagcaggtacagcagaagaggctgctggaccagcaggagaagcttttagccgtcatcgaagaacagcataaagaaatccatcagcaaaggcaagaggatgaagaggataaacctcgacaggtcgaagtacaccaagagcccggagcggctgtacctcggggacaggaggcccctgaggggaaggcacgagagaccgtcgaaaacttgccaccacttcctctcgatccagttcttcgagctcccggcggccggcccgctccgtcacaagacctaaaccagcgcagcttggaacactcagaaggcccagtcggtcgggatccagctggacctcctgatggaggtcccgacacagaaccccgggcggctcaggctaagctgcgtgacggccagaaagacgcggctcctagagcagcggggaccgtaaaagaacttccgaaaggccccgagcaggtgccagtgcctgacccagcaagggaggcaggaggtcccgaggagaggctcgcggaagagtttcctggtcagagccaggatgtgaccggcggatcacaggaccggaaaaagcccgggaaggaagtcgccgctactggaacctccatcctgaaggaagcaaattggctagtggccgggcctggagccgagactggggaccctaggatgaagccgaaacaagtttctagggacctgggactcgcagctgacctgcctggcggtgctgaaggggcagccgcacagccgcaagccgtactcaggcagccggagcttagggtaatctctgatggtgaacagggcggacagcagggacatcggcttgatcacggcggccatctggaaatgcgcaaggcgcgagggggcgaccacgtgcctgtgtcacatgagcaacccagagggggcgaagacgcagccgtccaggaacctagacaacgacctgagcccgaactggggctgaaaagggccgtcccgggaggacagaggccagacaacgcaaagcccaaccgggatttgaagctgcaggctggttccgaccttagacgtcgtaggcgcgatttaggacctcatgccgagggtcagctcgccccaagggacggggtgatcatcgggctgaatccattgcccgacgtgcaggttaacgatctgcgtggagcgctggacgcacagctacggcaggccgcaggcggagccctacaggtggtccattctcggcagctgcggcaggctccaggcccacctgaggagtcctag

SEQ ID NO: 46264 - DNA, 1155 bp, Artificial Sequence
  Description of Artificial Sequence: Synthetic coding sequence
atgaagcaggccggcttccccctgggcatcctgctgctgttctgggtgagttacgtgactgacttttctctggttctgttgatcaaaggtggggcgctttccggaacggatacctatcaatccctggtcaacaaaaccttcggatttcctgggtatctcctgttatccgtgctgcagtttctgtaccccttcatagtagaccccgaaaatgtcttcattggcagacacttcatcatcggattgtcaaccgtcacttttaccctcccactgtctctgtatcgcaatatcgctaagctcgggaaggttagccttatttctaccgggctgacaacactgatcctcggaattgtgatggcacgcgcaatcagcctcgggccccacatacctaaaactgaagatgcatgggtctttgccaagccgaatgccattcaggccgtcggtgtgatgtcctttgcctttatctgccaccacaactccttcctggtctacagttccttagaggaaccaactgtggctaaatggtcccgacttattcacatgagtatcgtgatttctgtctttatctgtattttttttgctacctgtggttacctcaccttcacgggatttacccagggagatctctttgaaaattactgtcggaatgatgacctagtcacgttcggccggttttgttacggcgtgacagttattctgacgtaccctatggaatgcttcgtgactcgtgaagtgatcgccaacgtcttcttcggaggcaacctgagctcagttttccatatcgtggtgaccgtgatggtgatcaccgtggcgacgttggtgtccctgctgatcgactgtctgggcatagtactcgagttgaatggggtgctgtgtgccacccccctgatctttatcatcccgtcagcttgttacctgaaactaagtgaggaaccccggactcactccgataagatcatgtcctgcgtaatgctgccaattggggccgttgtgatggtgtttggattcgttatggccattactaacacccaagactgtacccatggccaggaaatgttttactgctttcctgacaacttctcactgacaaatacttccgaaagtcacgtccaacaaacaacacagctgtcaactcttaacatcagcatatttcaatag

SEQ ID NO: 46265 - DNA, 1221 bp, Artificial Sequence
  Description of Artificial Sequence: Synthetic coding sequence
atgaagcaggccggcttccccctgggcatcctgctgctgttctgggtttcttacgtgacagacttttccttggttttgcttataaaggggggagctctgtcagggactgatacatatcagagccttgtcaataagacattcggcttcccggggtatctgctgctctccgtgctccagttcctgtatccttttatcgccatgatcagttacaacatcattgccggggataccctgtcaaaggtgttccagaggattccaggggtggaccccgaaaacgtgttcattgggcgccattttatcatcggactgtccacagtgacattcacattgcccctgtcattgtaccgcaacattgcgaagctggggaaagtaagcctaatcagcactggactgactaccctgattttggggattgtcatggccagggcaatctccctgggcccacacatacctaaaaccgaagacgcatgggtgttcgccaaaccaaatgccattcaagcagtgggagtcatgtctttcgcatttatatgccaccataattcatttttggtatactcctcgctcgaagagcccacagtagctaagtggagccgactgattcacatgagtattgtcatttcagtgttcatttgtatttttttcgctacgtgtggatacctgacctttacaggcttcactcagggagacctcttcgagaactactgccgaaacgacgatctggtgacatttggcagattctgttatggagtgaccgttattctcacatacccgatggagtgttttgtgacgcgggaggtgattgccaatgttttttttggtggcaacctctcatcggttttccatatagtggtcacggtcatggtgataaccgtggctaccctggtgtctctgctcattgactgcctgggaatcgtgctggagctgaacggagtcctctgtgcaactccacttatttttattataccatcagcctgttatcttaaactgagcgaggagcctcgtacccactcagacaaaattatgtcctgcgttatgctgcctatcggcgcagtagtgatggtcttcggctttgttatggcaataaccaatactcaggattgtacacatggccaagaaatgttttactgcttcccagacaacttttctctcacaaatacatctgaatctcatgtccagcagactactcaactcagtacccttaacatcagtattttccagtag

SEQ ID NO: 46266 - DNA, 1221 bp, Artificial Sequence
  Description of Artificial Sequence: Synthetic coding sequence
atgaagcaggccggcttccccctgggcatcctgctgctgttctgggttagctacgtgaccgatttttctctagtgctcttgattaagggtggcgccctcagcgggacagatacctaccagtccttggtaaataaaaccttcggctttccaggctatttgctcctctccgtcttgcagtttttgtatccctttatcgcaatgataagctacaacataatagctggggatacactgtcgaaagtttttcagcggattcctggtgtggatccagagaatgtcttcatcgggcgccatttcattattggactgagcacagtgacctttacgctgccactgtcgttgtaccggaacatagcaaaacttggaaaggtgagcttgataagtacaggactcaccactttaattctcggtattgttatggctcgggccatttctttgggccctcacatccctaaaaccgaggacgcctgggttttcgctaaaccaaatgccatccaagcggtcggcgtcatgagctttgcgttcatctgccaccataatagctttctggtctacagctccctcgaggaacctactgtggccaaatggtcccggctgatccacatgtccattgtaataagtgtgtttatatgtattttttttgccacttgcggctacctcacatttactgggtttactcaaggggacctgttcgagaactactgcagaaacgatgatctggtgacctttggacggttttgctacggcgtcacggtcatcttaacctacccaatggagtgctttgtgacgcgggaggtgatcgccaatgtgttctttggtggcaatctatcatctgttttccatattgtcgtaacagtgatggtgatcactgtggccaccctggtgtctctattaatcgactgtctcgggattgtgttagaactgaacggcgtcttgtgtgccacaccactcatctttatcatcccctcagcttgttatctcaaactgtcagaggagcctagaactcacagcgacaaaattatgtcttgtgttatgctgcccattggcgccgtggtgatggtgtttgggtttgtaatggcaataacaaacactcaggattgcacccatgggcaagaaatgttctactgctttcccgataacttctctctcacgaatacttcggaaagccatgttcaacaaactacacagctctctactcttaacatctccatcttccagtag

SEQ ID NO: 46267 - DNA, 1371 bp, Artificial Sequence
  Description of Artificial Sequence: Synthetic coding sequence
atggaggccagctggggcagcttcaacgccgagcggggctggtacgtcagcgtgcagcagcctgaagaggcagaggcagaagagctgagtcccttacttagcaacgagctacacagacagcgaagccccggcgtgagctttggactgagcgtgttcaaccttatgaatgcaattatggggtccggtatccttgggttggcgtacgtgctggccaacacaggtgttttcggctttagtttcttattgctgacggtggctcttttggcttcttattccgtgcacctcttgttaagcatgtgcattcagactgccgtgacgagctacgaggacctggggctgtttgcgttcggtctgcctggaaagttggtggtggccggcactatcatcatacagaatatcggcgctatgagcagttatctgctaattataaaaaccgaactaccggctgcaatcgcggagtttctgaccggggattactctcgctactggtatctggacggacagacactactcattattatctgtgtagggatcgtgtttccacttgcattactcccgaaaataggttttctggggtatacaagtagcctgtccttcttttttatgatgttcttcgccttggtggtcatcatcaaaaagtggtccatcccttgtcccctcacgctgaactatgtggaaaagggcttccagatatccaatgtgacagatgattgtaagcccaaactgtttcacttcagtaaagaaagcgcttacgccctacccacgatggccttcagctttctttgtcatacctcaatcctgcccatctactgcgagctgcagtccccttcaaaaaagaggatgcaaaatgtcaccaatactgctatcgccctgagcttcctgatttacttcataagcgcacttttcgggtatctgacattttacgataaagtggagagcgaactcctgaagggttactcaaagtacctatctcatgatgtagtggtgatgactgtgaaactttgtattttgtttgcagtgttgctgaccgtgcctttaattcactttccggctagaaaggcagtcacaatgatgtttttcagcaattttcctttttcttggatccggcattttctgataactcttgcactcaacattatcattgtgctgcttgccatctacgtcccagatatccgcaacgtgtttggagtagttggcgcttcaacatctacctgcctcatcttcatttttccgggactgttttaccttaagttgtctcgcgaagattttctgtcctggaaaaaattaggggcatttgtcttgctgattttcggcatcttggtaggaaacttttcgttggcactcattattttcgattggataaacaagtag

SEQ ID NO: 46268 - DNA, 1566 bp, Artificial Sequence
  Description of Artificial Sequence: Synthetic coding sequence
atggaggccagctggggcagcttcaacgccgagcggggctggtacgtcagcgttcagcagcctgaagaggcggaagccgaagaactttcacccttactgagcaatgagctgcataggcaacggagccccggcgtcagctttggcctgtctgtgtttaacctgatgaatgccataatggggtctggaattctgggcctcgcctacgttctggccaatactggtgtcttcggattctcgttcctgttgctcactgtggccttactcgcttcttattccgtgcacttgctgttgagcatgtgtattcaaacggccgtcacaagctatgaagacctcgggttatttgcttttggccttccagggaaattggtggttgccggcactattatcatccagaatatcggcgccatgtcttcatacctgctgataatcaaaactgaactccctgcggctatcgcggaatttttaacaggagactattcgaggtattggtacctggacggccagaccttgctgattatcatctgtgtggggatcgtgtttccgttagctttgctccctaagattggttttttgggttacacttcctctttgtccttttttttcatgatgttttttgccctagtggtgatcattaaaaagtggagcatcccttgtcctctgaccctgaattacgtcgaaaagggcttccagatctccaacgttacagacgattgtaagcccaaacttttccatttctctaaggaaagcgcctatgccttaccaactatggcgtttagtttcttatgtcacaccagcatactgcctatctattgcgaattacaatccccctctaaaaagaggatgcagaatgtgaccaataccgctatcgctttgtctttcctgatttactttatttcagccttgttcggttacctcaccttttacgacaaagtcgagtcagaactgctgaaaggttactccaagtatctctcacacgacgtcgtggtgatgaccgtgaaactctgcatattatttgccgttttactcaccgtccctctgattcacttccctgcacgcaaagccgtcacaatgatgttcttctcaaattttcctttttcttggatccggcactttttgataacgcttgcgttgaacatcattatcgtgctcttagccatctatgtgcctgacattcgaaacgtgttcggagtggtgggggcctccacctccacctgtttaatctttatctttcccggcctgttttaccttaagctatctcgagaagacttcctgagttggaagaaattgggggggctcattttgtcccataggctcgcatgctccggcgtgatttctgcgcactgcaacttgtgtctgcccgactcctcaaatccccccacctccgcttccagggtggcagaaactaccgggcgcgatactatggaaatgtgcactcagcgcaaggggcacgcacggacccagcaggagggcaactgcctgcaggctaagggccgaggcctgaggagaaccaaacgggtgcacacattaattctgcatttccccacaagcaggaccgtcagcaagtag

SEQ ID NO: 46269 - DNA, 1551 bp, Artificial Sequence
  Description of Artificial Sequence: Synthetic coding sequence
ggcagcttcaacgccgagcggggctggtacgtgagcgtgcagcagccagaggaggcagaagctgaagagctgtcccccctgctcagtaacgagctccaccgccagagatcaccaggtgtgtcattcgggctaagtgtcttcaatctgatgaatgctattatggggtccggtattctgggcctcgcctacgtgttagctaacactggagtgttcggcttctctttcttacttttgaccgtagccctgttagcctcatactcagtccatcttcttttaagcatgtgcatccagacagccgttacatcctatgaggaccttggcttatttgccttcgggctgcccgggaagctggtggtggccggcaccattattatccagaatataggagcaatgagttcatatctgctaatcatcaaaaccgagcttcccgcagccattgcagaatttctgaccggtgattattctaggtattggtatttagacggtcaaaccctgttgattatcatttgcgttggaatagtattcccactcgctcttctgcctaaaattgggtttctgggatacacctcatccctgagcttcttctttatgatgtttttcgccttggttgtgatcattaaaaagtggagcataccttgtccgctgacactcaattacgtggagaaaggctttcagattagcaacgtgaccgacgactgtaagcctaagctctttcatttcagtaaagaaagcgcctacgcattgcctactatggcattcagctttttatgtcataccagcatcctgcccatctactgtgaactgcagagtccctctaagaaaaggatgcaaaacgtaaccaatactgctatcgcactctcgtttctgatatatttcatcagcgcactgttcgggtatctgacattctatgacaaggtggaaagcgaattgctgaagggatactcaaagtacctgagccatgacgtagttgtgatgaccgtgaaactatgcatcttatttgccgttctgttgaccgtgcctcttattcatttccccgcacgcaaggccgtgacaatgatgtttttctcaaacttcccattttcatggattagacatttccttattacactggccttgaatattattatcgttttgcttgccatctatgtaccggatattagaaacgtcttcggcgtggtaggagcctctacatcgacttgcctgatcttcatcttccccgggctcttttacctcaaattgtcgagggaggattttttgtcctggaaaaagctagggggcctcatcttaagccaccgtttagcatgctccggggtgatttccgctcattgtaatctgtgtctcccggactcgtcgaaccctcctacttccgcctctagagtcgctgaaactactgggagggacaccatggaaatgtgcacacagcggaagggccatgccagaacgcagcaagaaggaaattgcctacaagctaagggtcggggactccgtcgaaccaaaagagtgcacaccctgatcctccacttccctactagtaggactgtgtccaagtag

SEQ ID NO: 46270 - DNA, 1464 bp, Artificial Sequence
  Description of Artificial Sequence: Synthetic coding sequence
atgagcggcccccggatcatgtacagcctgctgctggagctgcaccggcagcggagccccggtgtctcctttggattatccgtgttcaatctcatgaatgctatcatgggctctgggattttaggcctcgcttatgtacttgctaacaccggagtattcgggttctcttttctcctgcttacggtagccctccttgccagctatagtgtacacttacttctttccatgtgcattcagacagctgtaacctcgtacgaggacctgggcctgttcgccttcggcctgccaggaaagcttgtggttgcaggaacaattatcatccagaacataggggcaatgtcctcttatttgcttatcatcaagactgaactacccgctgctatcgctgaatttctgaccggcgactattcccgctactggtacctggacggacagacgttactgattattatatgcgtcggcattgtgtttccgttggcccttttacctaagataggctttctcggctacacctcatctctcagttttttctttatgatgttcttcgccctggtggtgatcatcaagaaatggagcatcccatgcccgctgacactgaactacgtcgagaagggttttcagatatcaaatgttacagacgactgcaaacccaaactcttccatttctctaaagaaagtgcctacgccctccctaccatggctttcagcttcctctgccatacttccattctccccatctactgtgagcttcaatccccttcaaagaaacgaatgcagaatgtcacaaataccgccattgccctgtcattcttaatttactttatatcggctctgtttgggtacctgacgttttacgacaaagtggagtccgagctgttgaaaggatacagtaagtacctgtctcacgacgttgtcgtaatgaccgttaaactgtgtattctgttcgctgtcttacttacagtacccctgatacatttccctgctaggaaggcagtgaccatgatgttcttctctaattttccattcagctggattcgccacttcctaatcaccctggcactgaacatcataattgtgctgttagccatttatgtgcctgatatacgcaacgtgtttggagttgtgggggcctcaacctcaacatgtcttattttcatctttccggggctgttctatctgaagctgtcgcgtgaggacttcctgtcctggaaaaagctcggaggactgatactttctcaccgacttgcctgcagcggcgtgatttccgcacactgtaatctttgtctgccggactccagtaaccccccaaccagcgcttctagggtcgcggaaacgactgaaaaggaggaaatcccatggcgctgtgccccacgtgggaaggcaacgcagggccatagcaagaaggccactgtctacaaaccgcgtgaggaggcgtcaggtgagcctaacgtatctaccccctag

SEQ ID NO: 46271 - DNA, 1686 bp, Artificial Sequence
  Description of Artificial Sequence: Synthetic coding sequence
atggccaacatgaacagcgacagccggcacctgggcaccagcgaggtcgaccacgaaagggacccaggtccgatgaacattcagttcgaaccttccgacctaaggagcaaaaggcccttctgcatcgagcccacaaacatagtgaacgtaaatcacgtgatccaacgcgtgagcgatcatgccagcgcaatgaataaacgcatccattattacagcaggctaacaactcccgccgacaaagccctaatcgcccctgatcacgtagtgcctgcccccgaagagtgttatgtctacagtccattggggtccgcgtataagctccaatcttacactgagggctatggaaaaaacacctctcttgttacaatattcatgatttggaacactatgatgggcacctctatactttctattccttggggtataaagcaggctggattcacgactgggatgtgcgtgatcatacttatggggctgttgaccctgtactgttgctatagagtcgtgaagtcccgaacgatgatgttcagtctggatactacgtcctgggagtaccctgatgtgtgtcgacactactttgggtcctttggacagtggtcgagtctcctctttagcctagtttctcttatcggagccatgatagtatactgggttctgatgagtaacttcttattcaataccggcaagttcatctttaacttcattcatcatatcaacgataccgacacaatcctcagcactaacaactctaaccctgtcatttgtccatctgccggctcaggtggtcacccagataacagttccatgatcttctatgccaatgacactggtgctcagcagttcgagaaatggtgggacaagtcgagaaccgttcctttttatctggtcgggcttctgcttccccttttaaacttcaagtccccttctttcttctcaaaattcaacatcctggggaccgtgagtgtcctgtacctgattttcctcgtgacatttaaagctgttagattaggctttcaccttgagttccactggtttatccccacggagttttttgtgccagaaattagatttcaatttcctcagctgaccggtgttctcacacttgctttcttcattcataattgcattattacactgttgaaaaacaacaagaaacaggagaacaacgttcgcgacctgtgcatcgcctacatgctggtgaccctgacctatctctatattggcgtgctcgtgttcgcttcattcccctcccccccattgagcaaggactgtatcgaacaaaattttctggacaatttcccttccagtgatactctatctttcattgcccgtatattcctgcttttccagatgatgacggtgtaccccctgcttgggtatctggctagagtgcaactgctggggcacatcttcggggatatttacccctctatttttcacgttctcatcttaaacctgattatcgtcggggccggcgtgatcatggcgtgcttctacccgaacattggcggtattattcggtactcgggggcagcttgcgggctggcattcgtgttcatatatcctagcctcatttacattatttctctgcatcaggaggagcggctgacctggccgaagttaatatttcatgtgttcattattatcttaggtgtagctaatctgatagtgcagttttttatgtag

SEQ ID NO: 46272 - DNA, 1686 bp, Artificial Sequence
  Description of Artificial Sequence: Synthetic coding sequence
atggccaacatgaacagcgacagccggcacctgggcaccagcgaggtggatcacgagcgggaccccggacccatgaatattcagttcgaacccagtgacctaagatccaagcggccattttgcattgagccaacgaacatcgtgaacgtgaatcatgtgattcaacgggtatctgaccatgcttccgccatgaacaaacgcattcattactatagcagactgactacccccgcagataaagctttgatagcacccgaccatgtcgtacctgctccagaagagtgttacgtgtattcaccactggggtcagcttataagcttcagagttacacggagggctatggtaaaaatacaagcctggtgacaattttcatgatttggaataccatgatgggcacgtccatcttgagcatcccttggggcataaagcaagcaggtttcaccacaggcatgtgcgtgattatactgatggggctcttgactctgtattgctgctatagagtggttaaaagcaggaccatgatgttctctctcgatacaacatcctgggagtatcctgatgtgtgccgccactacttcgggagcttcgggcagtggagctctctgctcttttcactggtttcgttaatcggcgctatgattgtctattgggtcctgatgagtaactttttgttcaatacagggaaattcatttttaatttcatccaccacattaacgacacggatactattttgtctacaaataattccaacccagtgatttgccccagcgctggttcaggaggccacccagacaactccagcatgattttttacgccaacgacacgggagcccagcagttcgaaaaatggtgggataagagccggaccgtccctttttacctggtggggttgctactccctctgctgaatttcaagtctccctcattcttcagcaagttcaatattctcgggactgtgtctgtgttgtatttaatatttttagtgaccttcaaagcagtgcggcttggtttccatctggaattccattggttcatccctacagagttcttcgtacccgaaattcgctttcagtttccccagttaaccggagtgctaactctcgccttcttcatccacaattgtatcattacgctgctgaagaataacaaaaaacaagaaaataacgtacgcgatctgtgcatagcgtacatgctggttactctgacctacctttatataggcgttctcgtgtttgcctcatttccaagtccccctctgagcaaagactgcattgaacagaattttctggacaactttcccagttccgataccctgtcttttatcgctagaatattcctgttgtttcagatgatgaccgtgtaccccctccttgggtacctggctagagtgcagttattagggcatatcttcggagacatctatccatctatttttcacgtgctgatccttaaccttataatcgttggcgcaggagtcatcatggcatgtttttacccaaacatcgggggcattatccgctactcaggcgcagcgtgcggtctggcgttcgtgttcatctatcccagtcttatctacatcatttccttgcatcaggaggaaaggctcacttggccgaaactgatttttcacgtgtttattattatacttggagttgctaacctgatagttcagtttttcatgtag

SEQ ID NO: 46273 - DNA, 1314 bp, Artificial Sequence
  Description of Artificial Sequence: Synthetic coding sequence
atgatctggaacaccatgatgggcaccagcatcctgagcatcccctggggcattaagcaggcaggattcaccaccgggatgtgcgtaatcattctgatgggcctactgaccctttattgctgctaccgggtcgtgaagtctcgtaccatgatgttctctctggacaccaccagctgggaataccctgatgtatgtaggcactacttcggctccttcggacagtggtcatcccttctgttcagcctcgtgagtctgataggcgctatgattgtgtactgggtactcatgtctaactttttgttcaatacgggaaaattcattttcaacttcatacaccacataaatgacaccgacactatcttaagcactaataatagtaaccccgtgatctgcccatccgctggctcaggtggccacccagacaactcaagtatgatcttttacgctaatgataccggcgctcagcagttcgagaagtggtgggataaatctcggaccgtacccttttacctcgtgggcctgctcctgcctctgctgaatttcaaatctccgtcttttttttccaaatttaatattctcggaactgtgagcgtactgtacctgatattcctggtaacatttaaggccgtgcggctcggattccacctcgaatttcattggttcataccaaccgaattctttgtgcccgagatccggtttcagttccctcagctcaccggagtcctcaccctggcattttttattcataattgtatcatcaccctcctgaaaaacaacaaaaaacaagaaaacaatgtgcgtgatttgtgcattgcctacatgctggtgactctgacctatctttacattggtgtgctggtgtttgccagctttcccagtccccccctgtcaaaggactgtattgagcagaatttcctggataactttccctcttctgatactttatcttttatcgctcggattttcctcttattccagatgatgactgtgtatcctcttctgggctatctcgcacgcgtccagctgcttggtcatatatttggcgatatttacccgtctattttccacgtgctgatccttaatctaattatcgtgggcgcgggagtcatcatggcatgtttttatccaaacatcggcggcatcatccgttactcaggcgcagcatgcggattggcattcgtctttatctatccaagccttatttacatcatctccctgcaccaagaagagcgtttgacctggcctaagctgatcttccatgtgttcatcattattctgggagtggccaaccttattgttcagtttttcatgtag

SEQ ID NO: 46274 - DNA, 396 bp, Artificial Sequence
  Description of Artificial Sequence: Synthetic coding sequence
atggccaacatgaacagcgacagccggcacctgggcaccagcgaggtggaccacgagagggatcctgggccaatgaatatccaattcgaaccatcagaccttcgatccaagcgccctttttgtatcgaacccaccaatattgtgaatgtgaaccacgtcatccagagagtaagcgaccatgcgagcgctatgaacaagagaatccattattacagcagactgaccactccggccgacaaagccctcatcgcccccgaccacgtagtgccagcgccagaagagtgctatgtgtactcgccgctcggcagcgcttacaagctccaaagttacaccgaaggctatggcaaaaacacctcacttgtgaccatctttatgatctggaacactatgatgtag

SEQ ID NO: 46275 - DNA, 114 bp, Artificial Sequence
  Description of Artificial Sequence: Synthetic coding sequence
atggccaacatgaacagcgacagccggcacctgggcaccagcgaggtcgaccatgagagagatccaggcccaatgaatatccaattcgaaccctccgatctaaggagcaaatag

SEQ ID NO: 46276 - DNA, 114 bp, Artificial Sequence
  Description of Artificial Sequence: Synthetic coding sequence
atggccaacatgaacagcgacagccggcacctgggcaccagcgaggtggaccacgagcgggatccaggaccaatgaatatccaattcgagccttctgacttgcgaagcaagtag

SEQ ID NO: 46277 - DNA, 1497 bp, Artificial Sequence
  Description of Artificial Sequence: Synthetic coding sequence
atggccatctgcatcctgacctggcggatccggcccttctgcatcgagccaactaatatagtgaatgttaatcatgtgatccaaagggtctccgaccatgcatctgctatgaacaagcgcatccactattacagtagactcactactcctgcagacaaagctctgattgctcctgatcacgtggtcccagcccccgaagagtgctacgtctatagcccactgggcagcgcctacaagctgcagagctacactgaaggttatggcaagaacacctctctcgttacaatatttatgatatggaacaccatgatgggaacttctatcctgagcatcccgtggggcattaagcaggccggattcactaccggcatgtgtgtgatcattcttatgggacttctcacgctgtattgttgctatcgagttgtgaaatctcgtaccatgatgtttagcctcgataccactagttgggagtacccggatgtgtgcagacactatttcgggtcttttgggcagtggtccagcctgctgttcagcctggttagcctcataggcgctatgattgtctattgggtattgatgtctaatttcctgttcaacacaggcaagttcatctttaatttcatccaccacataaacgatacagacaccattctctcaacaaataacagtaatccggtgatatgtccttctgccggttctggtggtcatcccgacaactccagtatgatcttttatgccaacgatacgggcgcccagcaatttgaaaaatggtgggacaagagtcggacagtgccgttctaccttgtcgggttactcctaccattactgaacttcaaaagcccctcttttttctcaaagtttaacatcttagagattagatttcagttcccccagctcacgggggtcctaacactcgccttctttatacacaactgtattatcacactccttaaaaataacaaaaagcaagagaacaacgttcgagatctttgcatcgcatacatgcttgttaccctaacatacctgtatatcggggtactggtgttcgcaagttttccaagtccccccctctccaaagattgcatcgagcagaatttcctggacaactttccctcttctgatacactcagtttcatcgcgcgaatcttcctcttgtttcagatgatgacagtttatcctttacttgggtacctcgcccgggtgcagttgctggggcacatttttggggatatctacccgtcgatctttcacgtccttatcttgaacctcattattgttggagctggagtcatcatggcctgcttctatccaaatatcgggggaatcattcgttattcaggtgcagcctgcggcctggcattcgtctttatatacccgtctctgatctacattattagtctgcaccaggaggaacgcctcacatggcccaagctgatttttcacgtgtttattattattctcggcgtggcaaacctgattgtccagttttttatgtag

SEQ ID NO: 46278 - DNA, 81 bp, Artificial Sequence
  Description of Artificial Sequence: Synthetic coding sequence
atggccaacatgaacagcgacagccggcacctgggcaccagcgaggtggatcatgagcgagatcccgggcctatgaactag

SEQ ID NO: 46279 - DNA, 294 bp, Artificial Sequence
  Description of Artificial Sequence: Synthetic coding sequence
atggccaacatgaacagcgacagccggcacctgggcaccagcgaggtggaccatgaacgggaccctggaccgatgaacattcaatttgaaccctctgacctgcggagtaagcgcccgttttgtattgagcccaccaacatagtcaacgtcaatcacgttattcagagggtctcggatcatgcaagtgccatgaataaacgcattcattattactctcggctgacaactcccgccgacaaggcactgatcgcccccgatcacgtggttccggcaccagaagagtgctatgtgtag

SEQ ID NO: 46280 - DNA, 1497 bp, Artificial Sequence
  Description of Artificial Sequence: Synthetic coding sequence
atgaacaagcggatccactactacagccggctgaccacccccgccgacaaggcattgattgctcccgaccacgtagtgccagctcccgaggaatgttacgtttacagtccactgggatccgcctataagctgcagagttataccgagggctacggaaaaaatacgtcgctggtcaccatctttatgatttggaataccatgatgggcacctccatcctgagcattccttgggggatcaagcaagcgggctttacaacgggcatgtgcgtcattatcctgatggggttgttgacactctactgttgctaccgggtggtaaagtctcgtaccatgatgttctccctggacacaacctcctgggaatatcctgacgtgtgtaggcactattttggctcatttggtcaatggtcttcactgctcttctccctggtcagcctcatcggtgcgatgattgtgtattgggtgttgatgagcaactttctgtttaataccggtaaattcatttttaactttattcaccatataaatgacacagacacgattttgtctactaacaacagtaatcctgtgatttgtccctctgcaggatctggaggacaccctgacaatagtagtatgatcttctacgcgaatgacacaggcgcacagcaattcgaaaaatggtgggataagagccgaacagtgccattttatctggtggggctgctcctgcccctgttgaactttaagtctcccagcttcttcagtaagttcaatattctggggacagtgtcggtcctctaccttatttttctggtgacatttaaggcggtgagacttggttttcatctggagttccattggttcattccgaccgaattttttgtgccggaaatccgttttcagtttccacagctcacaggtgtactgactctggcgttttttatccacaattgcatcataaccctgctgaaaaataacaaaaagcaagaaaataacgtgcgggacttgtgtatagcctatatgctcgttacactcacctatctttatatcggcgtgctagtctttgcctctttccccagcccgcccctgagtaaagattgtattgagcagaactttttggacaactttcccagttcggacactttatcatttatcgctaggatcttcttattgttccagatgatgacagtatatccccttctgggataccttgcccgcgtacagctgctggggcacatattcggagacatttatccctcgattttccacgtgctcatcttgaatttgatcatagtgggtgccggggtcattatggcatgcttttaccccaatattggagggatcatccgatactcgggggctgcgtgcgggctggcatttgtgtttatatacccttctctgatctatatcatctccctgcatcaggaggagcgactgacgtggccaaagctaattttccatgtcttcatcattattcttggggtcgccaacctgatcgtgcaattcttcatgtag

SEQ ID NO: 46281 - DNA, 1389 bp, Artificial Sequence
  Description of Artificial Sequence: Synthetic coding sequence
atggccaacatgaacagcgacagccggcacctgggcaccagcgaggtagatcatgaaagggatccaggtcccatgaatatccaatttgagccttccgacctcagatcaaagcggccgttttgtatagagcctaccaacatcgttaatgtgaaccacgtgatacagagagtgagcgaccacgcctctgcaatgaataagaggatccattactactcccgactgacgacaccagctgataaagcgctgatcgcacctgatcacgtggtgcctgcccctgaggagtgctacgtgtattctcctctgggcagtgcctacaaactccagagctacaccgaaggatatgggaaaaatactagcctggttacaattttcatgatttggaataccatgatgggtactagcatcctgtccatcccatggggcatcaagcaggccggctttaccaccggtatgtgtgtcattatcctgatgggattattaaccctgtactgttgctacagagtggtgaaatctagaactatgatgtttagtttggacaccacaagttgggaataccctgatgtgtgcagacattatttcggctcatttgggcagtggtcctctctcctgttcagcttggtgtctctcatcggcgccatgatcgtgtattgggtgctgatgtctaattttttgtttaatacagggaagtttattttcaattttatccatcatatcaacgacacagatacaattctgtccacgaacaatagcaacccggtgatctgccctagtgccggctctggcggacatcctgacaactcatcgatgatcttttacgcgaacgacaccggggcccagcagtttgagaagtggtgggataagagtcgcaccgttccattctaccttgtgggtctgctcctccccctccttaatttcaagtcaccgtcctttttctctaaattcaacatcttggggacagtgtccgtcctctacctgatcttcctggtgacctttaaagccgtcaggctcgggttccacctggagttccactggttcatccctacagaattctttgtgccagaaattagattccagtttcctcagttgactggagtgctgactcttgctttttttatccacaactgcatcattaccttactgaagaacaataaaaagcaggagaataacgtgagagatttgtgtatagcatatatgcttgtcaccctgacttatctgtacataggggtcttagtattcgcctcctttccatccccgcctctgtctaaggattgcatcgagcaggttaggcaccgggttccatctctctgcgattgtgtgcactttcacgtattcattgtcggcagagtgatacagtggcaagacattactagtgatagacctggtttttag

SEQ ID NO: 46282 - DNA, 1008 bp, Artificial Sequence
  Description of Artificial Sequence: Synthetic coding sequence
atgctgcagggccacagcagcgtgttccaggccctgctgggcacctttttcacatggggcatgactgccgcgggcgccgcccttgtgtttgtgttcagctcgggtcaaagaagaatcctcgacggctcgctagggtttgcagcaggtgtcatgctggctgcatcttattggtctttgctcgctccagctgttgaaatggctacctcttcaggcggctttggagcctttgcttttttcccagtggcagtgggattcacgctcggggcagcattcgtctacctggctgacctgctcatgccacatctgggcgctgcagaagatccccagacgacattggcactgaatttcggtagtactttgatgaaaaagaagtctgacccagaggggccagctcttctatttccggagtccgagttgtctattagaatcgacaaaagcgaaaacggagaggcttatcaacgcaagaaggctgccgccacaggattgccggaagggcccgctgtacctgtgccttcacggggaaacctggctcagccgggaggcagtagctggagaaggatcgcactgctgatcctagctatcactattcacaacgtgccagaggggctagccgttggcgtgggcttcggagccatcgaaaagacggccagcgctacttttgagtctgcgaggaacctggccatcgggatcggcatccagaacttccctgaagggctagcggtttccctacctcttcggggggcggggttctccacctggcgagccttttggtatggacagctctccggaatggtcgagcctctggcaggggtgtttggtgcattcgctgtggtgctggccgagccgatactgccttacgcgcttgctttcgccgctggggctatggtttacgttgtgatggacgacattattcccgaggcccagattagcggcaacggtaagcttgcctcctgggccagtatacttggcttcgtcgtgatgatgagcctggacgtggggttaggatag

SEQ ID NO: 46283 - DNA, 1029 bp, Artificial Sequence
  Description of Artificial Sequence: Synthetic coding sequence
atgctgcagggccacagcagcgtgttccaggccctgctgggcacctttttcacatgggggatgacagcggccggagcagccttggtgtttgtgttttcgtctggccagagaagaatactggacggcagtctcggcttcgccgccggcgttatgttagcggcttcctactggtccttgttagccccagctgtcgagatggctacctcctcaggggggtttggtgcatttgccttctttcccgtggccgtggggtttacccttggggccgcttttgtatacctggctgatttgctaatgcctcacctgggcgccgccgaggacccccaaactaccctggccttaaactttggctccactttaatgaagaagaaatcagacccggaggggccagctctgctctttcccgagagcgaattgtctatacgcatcggaagagccggactgctgtctgataagtcagaaaatggagaggcctatcagagaaagaaggcagccgccacaggcctgcctgaggggcccgcggtgcccgtaccaagtcgtgggaacttggctcagccaggaggctcctcctggaggcggatcgccttgctaatcttagcgattaccatccataatgtgcccgagggactagctgtcggcgtcggtttcggagcgatcgagaaaaccgcctccgccaccttcgagagcgcgagaaatcttgctattgggattggtatccaaaacttcccagaagggctggccgtatctctgcccctccgcggtgccggcttctccacgtggcgagccttctggtatggacagctgtcaggcatggtggagccactcgctggcgttttcggggcttttgcagtcgtcctcgccgagcccattctgccatacgcactcgcttttgctgccggggcaatggtgtacgtggtaatggacgatattatcccagaggcgcaaatatcaggtaacggaaagctcgcttcctgggcctccatcctagggttcgtggttatgatgagtctggacgtggggttgggctag

SEQ ID NO: 46284 - DNA, 1623 bp, Artificial Sequence
  Description of Artificial Sequence: Synthetic coding sequence
atgatgggcagccccgtgagccacctgctggccggcttctgcgtgtgggttgtgctgggttgggtcggaggaagtgtgccaaacctagggccggcagaacaagagcagaatcactacctggcacagttgttcggcctctatggggaaaatggcacattaactgctggtgggctggctagacttctgcacagtttggggctgggccgcgtgcagggactcaggctgggacagcatgggccattgacaggtcgggctgcctccccagccgcagataatagcacacacaggcctcagaatccagagctgagcgtcgatgtctgggccggcatgccactcgggccctccggctggggagatctggaagagagcaaagcacctcacttaccaaggggccccgcaccatctggactcgatctcctgcaccgactgttgctccttgatcacagtctcgcggaccatttaaatgaggactgcctcaacggttctcagctgctggtcaatttcggactgagtccagccgcgcctctcacaccccgacagtttgccttgctgtgcccggccctgctttatcagattgacagccgggtttgcatcggtgcaccagctcccgctcctcctggagacctgttatcagccctgttacagagcgctttggctgtcctgcttctcagtttaccgtcgcctctctcattattgctcctgaggctcctcggaccgcggttgttgaggcctttactaggcttcctgggagctctcgctgtgggtacactctgcggggatgcactcttgcatctcctcccccacgcccaggaggggagacacgccggaccagggggcctgccagagaaggacctgggacccggcttgagtgtgctgggtggcctctttctcctttttgtgctcgagaatatgctgggcctcttgcggcacagaggcttgcggcctaggtgttgtaggaggaaacgtcgtaatcttgaaactcgtaacctggatccagaaaacggaagcgggatggccttgcaaccacttcaggcggccccagagcctggagcacaaggccagagagaaaaaaatagccaacaccctcctgcgctggctccaccgggtcatcagggacatagccatggccatcagggagggaccgacatcacctggatggtactcctgggagacgggctccataatctgacagatggtttggcgattggtgcagccttttccgacggattctcatctggtctaagcaccactttggccgtgttctgtcacgaactcccccacgagctgggagactttgccatgctgctccaaagcggcctgtccttccgccggcttcttctcctatccctggtttctggcgccctcggtttaggtggcgcagtgctcggtgtgggactttctctcggtcccgtgcccctgactccctgggtgtttggtgtcaccgccggggtttttctctacgtggccctagtcgatatgctcccagccttactgaggcctccagagcccctcccgacccctcatgtcctgctccaggggttgggtcttcttctgggaggcggactcatgctagccatcaccttgttggaggaacgccttctgcccgtcacaacagaagggtag

SEQ ID NO: 46285 - DNA, 390 bp, Artificial Sequence
  Description of Artificial Sequence: Synthetic coding sequence
atgatgggcagccccgtgagccacctgctggccggcttctgcgtgtgggtggtgctcggctgggtggggggcagcgtgccaaacctcggacccgccgaacaggaacagaaccactatctcgcccagctttttggtctgtacggcgagaatggcaccctcacagccgggggtcttgctagactcctgcactcactcgggctgggtcgtgttcaagggcttcggctgggccagcatgggcctctcactgggcgcgccgctagtcccgcggcagacaatagcacgcacagaccacagaatccggaactgagcgtcgacgtctgggctggtatgcctctgggtccttcaggctggggagacttagaagaaagtaaggcacctcaccttccctag

SEQ ID NO: 46286 - DNA, 471 bp, Artificial Sequence
  Description of Artificial Sequence: Synthetic coding sequence
atgatgggcagccccgtgagccacctgctggccggcttctgcgtgtgggttgtactggggtgggtgggtggctccgtgccgaatctgggacctgcagaacaggaacagaatcactaccttgcacagttatttggcctgtacggagagaacgggactctgaccgcgggcggcctggctcgcttgctgcactctctcggactcggcagggtacaggggttgagattagggcagcacgggccactcacaggcagagctgccagcccggccgccgataatagcacacaccgccctcaaaacccagagttatccgtcgatgtctgggcaggtatgccactggggccatcaggctggggcgatcttgaggagagcaaggctcctcacctgccacggggtccagctccatcgggactagacctcctccaccgcctcctcttattagatcattccctggcggaccacctgaatgagtag

SEQ ID NO: 46287 - DNA, 372 bp, Artificial Sequence
  Description of Artificial Sequence: Synthetic coding sequence
atgatgggcagccccgtgagccacctgctggccggcttctgcgtgtgggtggtcttgggatgggtcggaggatcggtccccaatctgggcccagcagaacaagagcaaaatcactatctggcccagctctttgggctgtatggcgagaacggaaccttgacggcgggcggcttggctagactcttgcatagcctggggttgggcagggtccaggggctgcgcctcggccaacacggccctctgactggtagggctgcatcccctgcggccgacaacagtactcaccgtccgcagaatccagagctgtcagtggatgtttgggccggaatgccactggggccgagtggttggggtgacttggaggaaagctag

SEQ ID NO: 46288 - DNA, 381 bp, Artificial Sequence
  Description of Artificial Sequence: Synthetic coding sequence
atgatgggcagccccgtgagccacctgctggccggcttctgcgtgtgggtagtgctgggctgggtaggcggttctgtgccaaatctgggccccgccgagcaggagcagaatcactatctggcgcagctgttcgggctatacggagaaaatggcaccctcaccgccggggggctggcccggctgctgcattcccttggattggggcgggtgcagggactgcgtctaggtcagcacggccctctgactggaagagccgcaagccccgctgctgataatagcacccatagaccacagaatccagaactgtccgttgacgtatgggccggcatgcctctgggtccttcaggctggggtgacctcgaggagagcaaggccccctag

SEQ ID NO: 46289 - DNA, 1623 bp, Artificial Sequence
  Description of Artificial Sequence: Synthetic coding sequence
atgatgggcagccccgtgagccacctgctggccggcttctgcgtgtgggtggtgttaggatgggtgggcggtagtgtcccgaacctagggccagccgaacaggagcagaatcactatcttgcgcagctgttcggtctttacggggagaacggcaccctgaccgccgggggtttagctcgtctgctgcatagcctcggtctgggtcgagtgcaaggactacggctgggccagcacgggcctttgacaggacgggcagcctccccagccgcagacaattccacccacagacctcagaatccagagctgtcggttgacgtatgggcaggcatgcctctgggaccctcaggctggggcgacctggaggagtctaaggccccccacctcccaaggggcccagctccctcgggcttggacctgttgcatagattgctgctactggaccattctctggcggaccacctgaatgaagactgcctgaatggcagccagctgctcgtcaatttcggcctgagtcctgccgcacccttgacgcccaggcaattcgcactcctgtgtcctgcactgctttaccagatcgacagcagggtgtgcataggggcccctgctcctgcccccccaggggacctgctctccgcgctcttacagagcgccctggccgtgctgctcttgtccctacctagtcccttatcattgcttcttctcaggctgctagggcccaggttgctcaggccactgttgggttttctcggcgccctcgccgtcgggactttatgcggggatgcacttctgcacctactgccccatgcgcaggaagggagacatgcaggcccaggggggctgccagagaaggacctggggccgggcttgtccgtattaggaggactttttttgttattcgtcttagaaaatatgctggggctgctccggcacagggggctgagaccaaggtgctgtcggagaaagcgcaggaacttggagactcgcaacctggatccagaaaatggtagcggaatggccttgcagccccttcaggctgcacccgaacctggggctcagggccagcgagaaaaaaactcccagcatcctcctgcccttgcccccccggggcatcaaggccattcccatggtcaccaaggcggcaccgatattacctggatggtgcttctcggggatgggcttcataacctgactgatggcctcgctattggagctgctttctcggatggatttagttctggactgtcaacaacccttgctgtcttctgtcacgagctgccacatgaactgggcgactttgccatgcttctgcaaagcggcctctcctttcgtcgtctgctactcttaagtctcgtctccggagcactgggcctgggaggggcagtactcggagtggggctcagcttgggcccagttccgttgactccctgggtatttggcgtgactgccggcgtctttctctacgtggcactggtcgatatgctccccgcccttctgagaccgccggaacccctgcctacgccacacgtgctgctgcagggtctggggttattactcggtggcggcctcatgctggcgattacattattggaagaaagacttctcccagtgactacagaaggatag

SEQ ID NO: 46290 - DNA, 699 bp, Artificial Sequence
  Description of Artificial Sequence: Synthetic coding sequence
atggacgacttcatcagcatcagcctgctgagcctggccatgctggtgggctgctacgtggccggaatcattccactcgccgtcaatttctccgaagaacgactcaaactggttacagttttaggtgccggcttgctctgcggaacagctctggctgtcattgtgcctgagggcgtgcacgccctctacgaagacattcttgagggtaagcaccatcaagcatcggaaacacataacgtcatcgccagtgacaaggcagcggagaagagtgtggtgcatgagcatgaacacagtcacgaccacacccagctacatgcatatattggagtgagcttggtcctggggttcgtgtttatgctgctggtggatcagattggtaattcccacgtacactcgactgacgaccccgaggctgctaggagtagtaatagtaagattactacaacattgggtttggtggtgcacgcggccgctgacggagtggccttgggcgctgccgcctcaacgagtcagactagcgtgcagcttattgtattcgtggccattatgctccacaaggctcccgccgcttttgggcttgtgtcttttctaatgcacgccggcctggagagaaataggatccgcaagcatctgctcgtgttcgcattggcagctccagtaatgagtatggtaacatacttggggctctctaaagactag

SEQ ID NO: 46291 - DNA, 2496 bp, Artificial Sequence
  Description of Artificial Sequence: Synthetic coding sequence
atgaaggtgcacatgcacaccaagttctgcctgatctgcctgctgactttcatctttcaccattgcaatcactgtcatgaggaacacgaccacggaccagaggctttgcatcggcagcatcggggaatgactgaactagagccttcaaagtttagtaaacaagccgcagagaatgagaagaaatattacattgaaaaactttttgagcggtacggggaaaacggtagactctcattttttggactggaaaagctacttactaacctgggcctgggagagaggaaagtagtcgagatcaatcatgaggatctcggacacgaccacgtaagccacctcgatatcctggccgttcaggagggtaagcacttccactcacacaaccatcagcatagtcacaatcatttgaacagtgaaaaccagactgtcacctccgtatccaccaagcgaaaccataaatgcgaccccgagaaggagacggtggaagtatctgtcaaatcagatgacaaacatatgcacgatcacaaccaccggttgagacaccaccaccgtttgcatcatcatttagaccataacaatacgcaccactttcataatgacagcataacaccaagtgaacgaggagaaccttcgaatgagccttcaaccgagacaaacaaaacacaggaacagtctgacgttaagctgccaaaggggaaaaggaaaaaaaagggacgaaagtcaaacgaaaactctgaggtgataaccccaggattccccccgaaccacgaccagggcgagcagtatgaacacaaccgagttcacaagccggaccgggtccacaacccagggcacagtcatgttcacttgcctgagcgtaacggacacgacccaggcagaggacaccaagatctggaccctgacaatgagggggagttgaggcatacacggaagcgcgaggctccacacgtgaaaaataatgcaatcatctctctcagaaaggacttgaacgaggacgaccaccatcacgagtgtctgaacgtcacacaattgctgaagtattatggccatggagcaaattccccgatcagcacggatttatttacttacctctgcccggcactcctgtaccaaatagactcccgtctttgcatcgagcatttcgacaaattgttagtcgaagatatcaacaaagataagaacctcgtccccgaagacgaagccaatatcggggcgtctgcttggatctgcggaataatatcaattactgtgatctctctgctgtccttgctcggcgtgatcttagttccgatcatcaatcaagggtgctttaaattcctcctcacattcttggtggctctggcagtgggaaccatgtctggggatgccttgctgcaccttcttccacattcacagggaggtcatgatcattcgcatcagcacgctcatggacacggacactcccatggccacgagtccaacaagttcctggaggaatacgatgctgttctgaagggactagtagccctggggggtatttacttgctgtttatcatagaacactgtataagaatgttcaagcactataaacagcagcggggaaaacagaaatggttcatgaagcagaacacggaggagagcaccatcgggcggaagctgtcagatcataaactcaataatacccccgatagtgactggttacagctgaaacccttagccggcacggatgattcggtggtgtctgaggacagattaaacgagaccgagcttactgatctggaggggcagcaggaatcgcctcctaagaattatttgtgtatcgaagaggaaaagattatagaccacagccactctgacggtctacatacaatccacgaacacgatctccatgcagcagcccataaccaccatggcgaaaacaagacagtactccgcaagcataatcaccagtggcaccacaagcattcacaccatagccacggcccatgtcactccggttcagacctcaaggagaccggaatcgccaacattgcttggatggttattatgggcgacggaattcataattttagtgacggactcgccattggtgcagcattctcagccgggctcacgggcggcatttcaactagtatagccgtcttttgtcacgagttaccacatgaactgggcgactttgctgtcctgctgaaagctggcatgactgtaaaacaggcaatagtgtacaaccttctatctgcaatgatggcttacatcggtatgctcatcgggactgcagttggccaatatgcaaacaatattactctatggatttttgcagtgactgccggaatgttcctctatgtagcgctagttgatatgctgccggaaatgttgcatggagacggcgacaacgaggaacatggcttctgtcccgtgggacagtttatcctgcagaacctcggtctgctctttggttttgccattatgctggtgattgcactgtatgaggataagattgttttcgatatccagttctag

SEQ ID NO: 46292 - DNA, 2496 bp, Artificial Sequence
  Description of Artificial Sequence: Synthetic coding sequence
atgaaggtgcacatgcacaccaagttctgcctgatctgcctgctgactttcatctttcatcactgcaatcattgtcacgaagagcatgaccacggaccagaagccctgcatcgacaacacagaggtatgacagaactggagccttccaaattttccaagcaggcagccgagaatgaaaagaaatattatatagaaaaactgttcgagagatatggcgagaatggtcgcctgagtttctttgggctagaaaagctgttgactaacctgggactaggcgaaaggaaggtggtcgagatcaatcacgaagatctgggccacgaccatgtctcacatttggatatcttggcagtgcaggagggcaagcatttccattcccacaatcaccagcattcacacaaccacttgaactccgagaaccagactgttaccagcgtgtcaaccaagaggaatcacaagtgcgaccctgagaaagagaccgtcgaggtgtcagttaaatcggacgacaaacatatgcatgaccataaccaccgtctaaggcatcatcacaggcttcatcatcatcttgatcacaataacacacaccactttcacaacgattctattacgccgagcgagcggggcgagccctctaatgagccttctaccgagactaacaagacacaggagcagtctgatgtgaagttgcccaaagggaagaggaagaagaagggcaggaaaagcaacgagaacagtgaggtgatcactccgggcttcccaccgaaccacgatcagggagaacaatatgagcacaatcgggtgcataagccagacagagtgcacaatccaggacatagtcatgtacatctccctgaacgcaatggccacgatcctggccgcggacatcaggatctggacccagataacgaaggcgagttgaggcatactagaaagcgcgaggctcctcatgttaagaacaatgccataatctctctcagaaaggatctaaatgaagacgatcaccaccacgaatgcttgaacgtgacccagctcctcaagtattatggtcacggcgccaatagtcccattagcacagatctattcacctatctgtgcccggctctgctatatcaaatagactcccggctgtgcatcgagcattttgacaagctccttgtggaggatatcaataaagataaaaacctcgtgccggaggacgaggctaacatcggagcgagcgcttggatctgtgggatcatcagtatcaccgtgattagcctcctgtctctccttggcgtcatcctggtgccaatcatcaatcagggctgctttaagttcttactgacattcctggtagctcttgctgttgggactatgtctggagatgccttactccacctactgccccactcacagggcggtcacgaccattcacatcagcacgcacacggacacggccactcacatggacacgagagtaacaaatttctggaggagtatgatgccgtgctcaaaggattagtggcattaggtggcatttacctgctcttcatcattgaacactgcatccgcatgttcaaacattacaagcagcagcgtggtaagcagaagtggtttatgaagcagaacaccgaggaatcgacgataggtcgcaaactctccgatcataagcttaacaatactcctgattccgactggctgcagcttaagcctctggccgggacagacgactccgtggtgtccgaggaccgcctgaatgaaacagagctaacagatctggaagggcagcaggaatcccccccgaaaaactatctgtgcatcgaggaggaaaagattattgaccatagccactctgacggcctccacacgatacatgagcacgatctgcatgcagctgcccacaaccatcacggagaaaataaaacagtccttcggaaacacaaccaccagtggcatcataaacatagtcatcacagccatggaccttgtcatagcgggagcgacctgaaggaaaccgggatcgctaatattgcgtggatggtgattatgggagatggaatccacaacttttctgatggcttagctattggtgccgccttctctgcaggtctgaccgggggcatcagtaccagcattgcagtgttctgtcacgaacttccgcacgagttgggcgacttcgccgtcctgctgaaggctgggatgaccgtaaagcaggcaatagtgtacaatcttctgagtgcaatgatggcatatatcggtatgctcattggaacggccgtaggtcagtatgctaataatatcactttgtggatattcgctgtcaccgccggaatgtttctgtacgtagccctggtggacatgctgccagagatgttacacggcgatggagataacgaggagcacgggttttgccccgtaggccaatttattctccaaaacctcgggttgctgtttgggtttgcaattatgctcgttattgctctttatgaggataaaatcgtcttcgacattcagttttag

SEQ ID NO: 46293 - DNA, 117 bp, Artificial Sequence
  Description of Artificial Sequence: Synthetic coding sequence
atgaaggtgcacatgcacaccaagttctgcctgatctgcctgctgacatttattttccatcactgcaatcattgtcacgaagaacacgatcatgggccagaggccctccataggtag

SEQ ID NO: 46294 - DNA, 393 bp, Artificial Sequence
  Description of Artificial Sequence: Synthetic coding sequence
atgaaggtgcacatgcacaccaagttctgcctgatctgcctgctgacttttatatttcatcattgcaatcattgccatgaagagcacgatcacgggcccgaagcactccacagacaacacagagggatgaccgagttagaacccagcaagtttagcaagcaagccgctgagaacgagaaaaagtattatattgaaaaactcttcgagcgttatggggagaatggtaggctcagcttcttcggtctcgaaaagcttctgacaaatttggggttgggcgagcggaaggtggtggagattaatcatgaggacctcggtcatgaccacgtgtcccatctagacatcctggctgtgcaagaaggcaagcacttccatagtcataaccaccaacattag

SEQ ID NO: 46295 - DNA, 381 bp, Artificial Sequence
  Description of Artificial Sequence: Synthetic coding sequence
atgaaggtgcacatgcacaccaagttctgcctgatctgcctgctgacctttatattccatcactgcaaccactgccatgaggagcacgatcacgggcccgaggcgttgcacagacaacacaggggcatgacagagctggagcccagcaaatttagcaaacaggcggccgagaacgaaaagaaatactacattgagaaactgtttgagagatacggcgaaaacggaaggctatctttcttcggactcgaaaaacttctgacaaatcttgggctgggagagaggaaggtggtggagataaatcacgaggacctggggcacgatcacgtctcccacctggatatcctggccgtgcaagaggggaaacactttcacagccactag

SEQ ID NO: 46296 - DNA, 1146 bp, Artificial Sequence
  Description of Artificial Sequence: Synthetic coding sequence
atgagcggcgacgccctgctgcacctgctgccccacagccagggcgggcatgaccattcccatcagcatgcacatggccatggtcacagtcacggacacgagtctaataaatttctggaggagtacgacgccgttctcaaagggcttgtggcactcggaggaatctacctcttgttcattatagagcactgtatccgtatgttcaagcattacaagcagcaaaggggaaagcagaagtggtttatgaagcagaacaccgaagaatcaactattggccggaaactatctgatcacaagttgaataataccccagactcagactggcttcagctgaaacctctcgctggcacagatgatagcgtggtatccgaagaccgcctcaatgaaaccgaactgacagatctcgagggccagcaggagtctcctcccaaaaattatctttgcattgaggaagaaaaaatcatagaccactcgcactctgatggtctgcatacaatccatgagcacgacctgcacgccgcagctcacaaccatcatggggagaacaaaaccgtcctgagaaagcacaaccatcaatggcatcacaaacactctcatcacagtcatgggccctgtcattcgggtagtgacctaaaagaaacgggtatcgccaacatcgcttggatggtcataatgggtgatggtatccataactttagtgacggactagccattggggctgcattctcagctgggcttacgggaggaattagcacctcaatcgccgtgttctgtcacgagctgccacacgaactgggtgattttgctgtgctgctcaaagcaggaatgactgtgaaacaggccatcgtgtacaatctgctgtccgccatgatggcctatattggaatgctgattggcaccgcggtcggccagtacgcaaacaatattaccctgtggatctttgcagtgacagcgggaatgttcttgtacgttgctctcgtcgacatgctcccagagatgctgcatggagacggcgacaatgaagagcatgggttttgtcccgtcggacagttcatacttcagaacctgggtctccttttcggctttgcaataatgctggtgatcgccctctacgaggacaagattgtctttgatattcagttctag

SEQ ID NO: 46297 - DNA, 2076 bp, Artificial Sequence
  Description of Artificial Sequence: Synthetic coding sequence
atgtgcttccggaccaagctgagcgtgagctgggtgcccctgttcctgttactgagtagggtcttctctacggaaaccgacaaacccagcgcccaggattccagaagtagaggaagcagcggccaacccgcagaccttttacaagtgctgtctgctggagatcatcctccccataaccatagccggtccctgatcaagacgcttttagaaaaaaccggatgtcccagaagaagaaacggaatgcaaggagactgtaacttgtgcttcgagcccgacgctctgctactcattgccggggggaacttcgaagatcagttgagggaggaggtggtgcagcgtgtctctctgctccttctctattatattatacaccaggaggaaatttgttcttcaaagctgaatatgtctaacaaagagtataagttctacctgcatagtctgcttagtctgcgccaagatgaggatagctcgtttctgtcccagaacgagacggaagacatactcgcattcaccagacagtactttgacacaagccaatctcaatgcatggagaccaagactcttcagaagaaatccggaatcgtaagctctgagggtgccaacgagtctacactgcctcagctcgcggccatgatcattacgctcagcctgcagggcgtttgtctcggtcagggaaacctgccgagccctgattacttcacagaatatattttctcctcgctgaacagaacaaacacactaaggttaagtgagctggaccagctgttgaatacgctgtggacaaggagtacttgtatcaagaatgagaagatccatcaattccagcgtaaacagaataatatcattacacacgatcaggattactctaacttctctagttccatggagaaagaaagcgaggatggaccagtcagttgggatcagacctgcttcagcgcacgccaactggtggagatctttcttcaaaaggggctaagcctgatctctaaggaggactttaaacaaatgtcccccgggatcatccagcaactcctaagttgttcttgccacctccctaaggatcagcaggcaaagttgccacccaccacgctggagaagtacggctattccaccgtggcagtgacgctgctcacactgggctctatgctggggacagccctggtactgtttcatagctgcgaagaaaactacaggctcattcttcagctattcgtcggtctagcggtcggcactctgtcaggcgatgctctcctgcacctgatcccacaggtacttggcctccacaaacaggaggcaccggagtttgggcacttccatgaatcgaagggccatatatggaagctgatgggcttgattggaggtatccacggctttttccttatagagaagtgctttattctcttagtgtctccaaacgacaagcagggactgtctttggtgaacgggcacgtcggacactcacaccacctcgctctgaattccgagttgagtgaccaggccggccgcgggaagtccgctagcaccatccaactgaagtctccagaggatagccaggccgctgagatgccaatcgggtctatgaccgccagcaaccgcaaatgcaaagcgattagtctcctagccatcatgattctggtgggggacagcctgcataactttgccgatggactggcaatcggcgctgcattcagcagttcatctgaaagcggggttacgacaaccatagctatcctctgccacgaaataccacacgaaatgggggactttgcggtactactttcaagcggcctgtctatgaaaactgctatcctgatgaacttcatttcttcactgactgcttttatggggctatatatcgggctgtcggtgagcgccgacccctgcgtccaggactggatctttactgtgacagcaggcatgtttttgtacctgagcttggtcgagatgctgcccgaaatgacccatgtgcaaactcagcgaccatggatgatgtttctcctccagaattttggtctcatacttggatggctgagcttgctccttctagcaatctacgaacaaaatatcaaaatttag

SEQ ID NO: 46298 - DNA, 2073 bp, Artificial Sequence
  Description of Artificial Sequence: Synthetic coding sequence
atgtgcttccggaccaagctgagcgtgagctgggtgcccctgttccttctcctgtcaagggtgtttagcacagaaaccgacaagccgagcgcacaagattctagatctcgggggagcagcggccagcccgcggacctgttgcaggttctttctgcaggggaccatcctccccataaccacagcagatcgttgattaagactctgttagagaaaacaggttgtcccaggcgtcggaacggcatgcagggcgactgtaatctatgcttcgagcctgacgctttgctgctaatcgcgggcgggaatttcgaggaccagctgagggaggaggtggtgcaacgagtgtccctactccttctgtattacatcattcaccaggaggagatttgttcatcgaaactgaatatgtccaacaaggagtacaaattctacctgcactccctgctaagcctgaggcaagatgaagatagttcctttctctcccaaaacgaaactgaggacatcctggcctttactcgtcagtacttcgacaccagccaaagccagtgcatggaaacaaagacactccaaaaaaagtcagggattgtgtccagcgaaggtgccaacgaaagcaccctaccccagttggcagctatgatcataactctgagcctccagggggtgtgcctgggccaggggaacttgccgtcccctgactacttcacagagtatatatttagcagcctgaaccgaaccaatacccttaggctttcggagctcgatcagttgctcaacaccctgtggactcgcagcacttgcatcaaaaatgagaaaatacaccagtttcagcgtaaacaaaacaacatcatcacccacgaccaggattactccaatttctcttcaagcatggaaaaggaatcagaagatggtcctgtgagttgggatcaaacgtgtttttccgccaggcagttggtagaaattttcctccagaaagggctgtcccttatctctaaggaggattttaagcagatgtcaccgggcataatccagcagttgctgagttgttcttgccacttgcctaaagatcagcaagcaaagctgcctccaactaccctagagaaatacggatattcaactgtggctgttacactactgacacttggctcaatgttggggacggccttagtgctcttccattcgtgcgaagaaaattaccgcctgatcttacagctgtttgtgggtttggccgtgggtacattgagcggagatgccctgttacacctaataccacaggtgctgggactccacaagcaggaagctcctgagtttggccacttccatgagtctaagggacacatttggaagctgatgggactcattggtggaattcacggcttttttctgatagaaaagtgtttcatattattagtgagccccaacgacaaggggctgtctctggttaacggccacgtcgggcatagccaccacctggccctgaacagcgagcttagcgaccaggccgggcgcggaaaatcggcatccactattcagctgaagagcccggaggacagccaggcagctgagatgccaattggcagcatgacagctagcaaccgaaagtgtaaggctatctcgttactggctatcatgattctagttggcgacagtctgcataacttcgcagacggcttagccattggtgctgcgttttcatcatcttcagagtctggagttaccaccactattgccatcctatgtcacgagataccccatgagatgggagactttgcggtgctgctttcttccggcttaagtatgaagaccgcgattcttatgaatttcattagctccctgacagccttcatgggattatacatcggcttaagtgtgagcgcagacccatgtgttcaggattggatctttacagtgaccgctggtatgtttctttacttatctcttgttgagatgctgcccgaaatgacacatgtccagacccagaggccttggatgatgtttctgctgcagaattttgggctgatcctcggttggctgtctctgttactcctggctatctatgagcagaacatcaagatctag

SEQ ID NO: 46299 - DNA, 1965 bp, Artificial Sequence
  Description of Artificial Sequence: Synthetic coding sequence
atgtgcttccggaccaagctgagcgtgagctgggtgcccctgttccttttattgtcccgtgtgttttccacagaaactgataaaccatccgctcaagactctcggtctcgcggcagctcagggcagcctgccgatctgcttcaggtcctctcagccggcgatcatccaccacataatcactccagatccctgataaaaaccttgttagagaaaactggctgtccgcgcaggagaaacgggatgcagggtgattgtaatttatgtttcgagccggatgcactcctactcatcgccggcgggaatttcgaggaccagctgcgcgaggaggtggttcagcgggtgagccttctgcttctttactacatcattcatcaagaggaaatttgttcgagtaaactgaatatgtcgaacaaagagtataaattttaccttcatagcttactgagcttgcggcaagatgaggattcttcattcctaagccagaatgagacagaagatatccttgcattcacccggcagtatttcgatacatcccaatctcagtgcatggagacaaaaactttacaaaaaaagagcggcatcgtaagctcggaaggggcaaatgagtcaaccctacctcaactggccgcaatgatcatcacattgagcttacagggggtctgcctcggtcagggaaatcttccctccccagattacttcactgaatacatttttagcagccttaaccgcacgaacaccctgcgtctcagtgaacttgatcagttattaaacacgttatggactcgatccacttgcataaaaaatgaaaagattcatcagtttcagcgcaagcagaataacattatcacccatgaccaggactattctaacttttcttcctctatggagaaggaatccgaagacggaccagtaagttgggatcagacttgcttcagcgccagacagctggtggagattttcttgcagaagggcctgtctctcattagtaaagaagattttaaacagatgagtccgggaatcatccagcagttactgtcgtgctcgtgtcacttgccgaaagaccagcaggccaaactccctccgacaaccctagagaaatacggatatagtacggttgcagtcaccctccttacactagggagcatgttagggaccgctttggttctcttccacagctgcgaggagaattacaggttgattctccaattgtttgtggggctcgcggtcggcaccctgtcgggagatgctcttcttcatctgatacctcaggtgctgggcctgcataagcaggaggcccctgagttcggtcattttcacgagagtaagggccatatatggaagctgatggggttgattggcgggattcacggttttttcctgatagagaagtgcttcattttactggtaagtccaaatgacaagaaatctccagaagacagtcaagccgccgagatgccaataggatccatgactgcctccaacagaaagtgcaaggcaattagtctactcgcgatcatgattcttgtgggggatagcctccataacttcgcagatggactcgccatcggagccgccttttcctctagttccgagtcaggagtcaccacaaccattgcaattttgtgtcatgaaattccacacgagatgggcgactttgctgtcctcctttcctcaggactgtccatgaagactgccatccttatgaattttatttcttcactcacagcatttatgggcctctacatcggattatctgttagcgcagatccctgcgtccaagattggattttcaccgtaaccgccgggatgtttctctacctcagcctcgtggagatgctgccagagatgacgcacgtgcagactcagcgcccttggatgatgtttctgctgcaaaattttggtcttatattgggctggctaagtcttctgttattggccatctacgaacagaacattaagatttag

SEQ ID NO: 46300 - DNA, 1836 bp, Artificial Sequence
  Description of Artificial Sequence: Synthetic coding sequence
atgcagggcgactgcaacctgtgcttcgagcccgacgccctgctgctcatagctgggggaaacttcgaggaccagctccgcgaggaggtcgtgcagcgagttagcttgctgctgctgtactatattatccatcaggaagagatttgtagctccaaacttaatatgtccaataaggagtacaagttttacttgcattcactgctctcacttaggcaggacgaagactcgtctttcctgtctcaaaacgaaactgaggacatcctggccttcacgcgccagtatttcgacactagccagagccagtgcatggaaacaaagaccctgcaaaagaaaagtggaattgtaagcagtgaaggagccaacgagagcactctgcctcagctcgccgcaatgataattactctctctctgcaaggagtctgtctcggacaggggaacctgccatcgcctgactactttactgaatacatattttcttcccttaatcgtactaataccttgcgcctgagtgaactggatcagctgcttaacacactttggacacgcagtacctgcattaagaatgagaaaatccatcagtttcaacgaaaacagaacaacattataactcacgaccaggattacagcaatttctccagctccatggaaaaagagagtgaagacggaccagtgtcatgggaccagacgtgcttctccgctaggcagctggtggaaatattcctccagaaaggcctgtctcttatcagcaaggaggactttaaacaaatgtcaccagggatcatccaacagctgttgtcttgctcttgccatctccctaaagaccaacaagctaaattgcccccaactacgctggaaaaatatgggtacagcacggtcgccgtgactcttctcacactgggaagtatgctgggaactgcattggtcctgttccactcttgtgaggaaaactaccgcctgatcctccagttgtttgtcggactggccgtcggcaccctgtctggtgacgccctgctgcacctcatcccacaagtactggggctgcataagcaggaagcccccgaatttggacattttcacgagtcaaaaggccatatctggaaactaatggggctcattgggggcatacacggctttttcctgattgagaagtgttttattctgctggtttcccccaacgacaaacaggggctcagtctagttaacggtcacgtaggccattctcaccacctggccttaaacagtgaactaagtgatcaggcagggagagggaaatccgcaagcacaatccagctgaagagccctgaggactcccaggcagctgagatgccaataggctccatgaccgctagtaaccgaaaatgtaaagcaatctccttactcgcaatcatgatcctagtgggcgactcactgcacaacttcgccgatggacttgccataggcgcagccttcagtagttcctccgagtcgggcgtcaccaccactattgccattctgtgtcatgagattccccacgagatgggcgactttgcagtccttctgtcttcaggcttgagcatgaagacagctatccttatgaatttcatcagctcgctaaccgccttcatgggtctatatatcggcctgagcgtgtccgccgatccgtgcgtccaggactggattttcacagtgaccgccggcatgttcctgtacctctctcttgttgagatgctacctgagatgacccatgtccagactcagcggccctggatgatgttcctgctgcagaacttcggtctgattttgggctggctttccttgctgctactggctatttacgaacagaacattaagatttag

SEQ ID NO: 46301 - DNA, 1674 bp, Artificial Sequence
  Description of Artificial Sequence: Synthetic coding sequence
atgagcaacaaggagtacaagttctacctgcacagcctgctgagcttaaggcaggatgaggactcatcttttctgagtcaaaacgagacggaagacattttggcgtttacccggcagtacttcgacacctcccaatcgcagtgcatggagaccaagaccctccagaagaagtccggcattgtcagctcagaaggagccaatgaatccaccctcccacagttagccgcaatgattatcacacttagtctgcagggcgtctgtttgggccagggtaatctccccagtcccgattatttcacagaatacatctttagctctctgaacaggacgaacacgctgcgactcagtgagctggatcagctgctgaataccttgtggactagaagcacttgtatcaagaacgaaaaaattcaccagttccagcggaaacagaataatattatcactcacgatcaggactatagcaatttctcttcatcaatggaaaaagagtctgaagacggtcccgtgagttgggaccagacttgtttcagcgcacgacagctggtcgagatcttccttcagaagggactgagtctgatcagcaaggaggattttaagcagatgtccccaggtattatccagcagctgctgtcttgtagttgtcacctgcccaaggaccagcaggccaaacttcctccaaccactctggagaagtacggctactctaccgtcgcggtcacgttactgaccttgggttctatgctaggaactgcactggtcctctttcatagctgtgaggagaactacagactgattctgcagctgtttgttgggctggcagtgggcactctgagcggggacgccctgcttcacctgatcccccaagtgctcggtctccataagcaagaagccccagaatttggccattttcacgaatctaaaggacacatatggaagctgatgggtctcataggcggaatccatggtttttttctaatagaaaaatgcttcatcctgctggtctcccctaacgataagcaggggttgagcttggttaatggtcatgtaggccattctcaccatttggcactgaatagtgaattgagcgaccaggcgggccgaggaaagagtgcctctaccattcagctcaagtctccggaggacagccaggctgcggagatgcctattggctctatgacggccagcaataggaaatgcaaagccatctctctgcttgctattatgatcctggtgggagattctctacacaacttcgcggacggattggcaatcggtgcagccttctcctcaagtagcgaaagcggcgtcactactaccattgccattctgtgtcatgaaattccccatgaaatgggagatttcgccgtcctactctcgtccggactcagcatgaaaactgcaatactcatgaatttcatcagttcacttacagccttcatggggttatacatcggattgtccgtctcggccgacccctgcgtgcaggactggatctttactgtgactgctgggatgtttctttacctgtccctggtggaaatgctacctgagatgacgcatgtgcagactcagcgcccttggatgatgtttctgttacagaatttcggcctaattcttgggtggctctcattacttctgcttgctatatatgagcaaaatatcaaaatttag

SEQ ID NO: 46302 - DNA, 1446 bp, Artificial Sequence
  Description of Artificial Sequence: Synthetic coding sequence
atgaagctgctgctgctgcaccccgccttccagagctgcctgctgcttactctcttgggtctctggcgtactacccctgaggcgcatgcctcatcactgggcgcgccagctataagtgccgcttcattcctgcaggatctgattcaccggtacggcgagggggacagtctgaccctgcagcaactcaaggctttgttgaatcatctggacgtgggggtggggcgggggaacgtaacacaacacgtccaaggtcacaggaacttgagtacatgtttcagtagtggcgatctgttcaccgcgcataatttttcagagcagagccgcatcggatcaagcgaacttcaggagttctgccctactatcctgcaacaactggactcacgggcgtgcaccagtgaaaaccaggagaatgaggagaatgaacagaccgaagagggaaggcctagcgctgttgaagtctggggctatggcttgctgtgtgttaccgtgatctccctgtgttcgctactgggtgcctctgtcgtgcctttcatgaagaagacgttctacaagagactgcttctgtattttattgcactggccatagggacgttatatagtaatgcactatttcagcttatccccgaggccttcgggttcaatcccctggaggactattatgtgtctaagtcggcagtggtgtttgggggcttctatttattcttctttactgagaaaatcctcaaaatcctgctaaagcagaagaacgagcatcaccatggccactcccactatgcaagcgaaagccttcctagcaagaaagaccaggaagagggcgtgatggagaagttgcaaaacggcgacctggaccacatgatccctcaacactgttccagtgagcttgatggcaaagcccccatggtggacgaaaaggttatcgtgggctccctctctgtgcaggacctgcaagcgagccagtctgcctgctattggctcaaaggtgtgcgctacagcgacatcggaactctggcttggatgatcactctgtccgatggccttcacaattttatcgacggtttagcaattggtgctagttttactgtgagtgtcttccaaggcatcagcaccagcgttgccattctgtgcgaagaatttcctcatgagttgggcgattttgtcatccttttaaacgcaggaatgtccatccagcaagccctgttttttaatttcctgagcgcatgctgctgttatttaggcctcgcctttggcatattggctggctcccacttcagcgcaaactggatttttgcacttgcaggtgggatgtttttgtatatctccctcgctgacatgatggagttctgcagcgtggcccaagccggggtgcagtggtgtcacctgtcaagcttacagcctttgcctttaggcctcaaaagactatcatgtctgtcactgccctctaactag

SEQ ID NO: 46303 - DNA, 1479 bp, Artificial Sequence
  Description of Artificial Sequence: Synthetic coding sequence
atgaagctgctgctgctgcaccccgccttccagagctgcctgctgttgacgctcctgggcttatggagaactacccctgaggcccacgcttcttcgctgggggcccctgccattagcgccgcatcattcctgcaggacctgatacacaggtacggagagggagattctttgactcttcaacagctgaaagcactactcaaccatttggacgtgggagtcggtcggggcaatgtgacgcagcacgtgcaaggtcatcgaaacctctctacatgtttctcgagcggcgatctgtttacggctcacaatttctccgaacagagccgcattgggagctccgaactgcaggagttctgtcctactatcctccaacaactcgattcacgagcctgcacgagtgaaaatcaggaaaatgaggagaacgagcagaccgaggaggggaggccgtccgctgtggaggtctggggatacgggctcctctgtgttactgtgatttctctgtgctcactcttgggggcctccgttgtgccgttcatgaagaaaaccttctataagcgtctgcttctgtattttattgccctggccattggaacactgtattccaacgcactgtttcagttaatcccagaagctttcggctttaatcccctcgaagattactacgtgagcaaatcagcggtggtgttcgggggattctatcttttcttctttactgaaaagatcttgaaaattctgttgaaacagaagaatgagcatcatcatggccactctcactacgcatctgaatcccttccaagcaaaaaggatcaggaggaaggggtgatggagaagctgcagaatggcgaccttgaccatatgataccacagcactgtagtagcgagcttgacggaaaagctcctatggtcgacgaaaaggtgattgtgggcagcctgagcgtgcaagacctgcaagcgtcacagtcggcatgctactggctaaaaggcgttcgatactccgacattggcacccttgcctggatgatcaccctgtccgatggacttcataactttatcgacggactagcaattggagcgtctttcacagtgagcgtgtttcaggggatctcaactagcgttgctatcctgtgcgaagagttccctcatgaactcggtgattttgtcatcttactgaatgctggaatgagtattcaacaggcactgtttttcaattttctgagtgcttgctgttgttatctaggcctggccttcggcatcctggccggctcccacttctccgcgaattggatctttgctctagctggtggtatgttcctctacatcagcttggccgacatgtttccggaaatgaacgaggtgtgtcaggaagatgaaaggaaagggagtatcctaatcccattcattatccagaatctgggcctgctgacaggctttaccattatggtcgtgttaaccatgtatagcggccaaatccagattggctag

SEQ ID NO: 46304 - DNA, 1479 bp, Artificial Sequence
  Description of Artificial Sequence: Synthetic coding sequence
atgaagctgctgctgctgcaccccgccttccagagctgcctgctgctgaccctcctggggctctggagaaccacacccgaagcacacgcttcctccctgggggctcccgctatctcagctgcaagtttcctccaggatctaattcaccgatacggagagggagacagtttgaccctccagcagctgaaagctctgctgaatcatctggacgtgggggtgggccggggaaatgtcacccagcatgtgcaaggccataggaatctcagcacgtgcttcagttcgggcgatttgtttactgcccataattttagcgaacagagtagaataggctcttcagaactgcaggagttttgtcctacaatccttcaacagctggattcccgggcttgcaccagcgaaaaccaagagaacgaagaaaacgagcagaccgaagaggggaggccctccgcagtcgaggtctggggattcggtttcctgagcgtttccctaatcaatctcgcgagcctgttaggggtcttagtgttgccatgcactgagaaggcgtttttttcccgagttcttacttactttatagccctgtccatcgggacgcttctgagcaatgctttgtttcagctgatcccagaggccttcggctttaatccactggaagactactacgtcagcaagagcgccgtagtgtttggcggcttttatctcttcttctttactgagaagatcctgaaaatactacttaaacagaagaatgaacaccatcacggacattctcattacgccagcgagtccctgccttctaagaaggatcaggaagagggtgttatggaaaagcttcagaatggcgatctcgaccacatgattccccagcactgctccagcgagctggatgggaaagccccaatggtggacgaaaaagtcattgtcgggtcactgagcgttcaggacctccaggccagtcaatccgcctgctactggctgaaaggcgtcaggtactcggacattgggactttagcgtggatgatcaccctgtccgatggattgcataactttatcgatggactggcaattggagcttcctttacagtctccgtattccaggggattagtacaagcgtagcaatactgtgcgaggagttcccacacgagctcggcgactttgtcatattactgaatgccggtatgagcatccaacaggcactgtttttcaactttctgagtgcctgttgctgctatctgggcctggcctttggtatcctggctggaagccatttctcagcaaattggatcttcgccctggcgggaggaatgttcctctatatctccctggcagatatgttccctgagatgaacgaggtgtgtcaggaggatgagagaaaaggaagcatcctgatcccatttattatccagaacctaggccttctgactgggtttacgatcatggtcgtcttaacaatgtactcagggcagatccagatagggtag

SEQ ID NO: 46305 - DNA, 1479 bp, Artificial Sequence
  Description of Artificial Sequence: Synthetic coding sequence
atgaagctgctgctgctgcaccccgccttccagagctgcctgctgcttactctgctagggctgtggcgcacaaccccagaagctcatgccagttcgctgggggctcccgccattagcgctgcgtcttttctgcaggacctgatccaccgctacggcgagggagattcgttgacacttcaacaactgaaggccctgttgaaccacctcgacgtaggcgtaggacgtgggaatgtgacacagcacgtgcagggtcaccgaaatctgagcacgtgcttttcctctggagatctgtttaccgcacacaatttcagcgagcagtctcgcatcggctcatccgagcttcaggagttctgtcccacgattttacagcagctggactccagagcttgtacctccgaaaaccaggagaacgaagagaacgagcaaaccgaggaagggcggccgtctgcagtggaagtgtggggttacgggctgctatgcgtgactgtaatctctctgtgctccctgctcggtgcgtccgtggttccatttatgaagaaaaccttttacaagcggctcctgttatactttattgccctggccattggaactctatactctaatgccctgttccagttaatccctgaagcatttggctttaacccactggaagactactacgtgtcaaagagcgcggtagtgttcgggggcttctacctgttctttttcactgagaaaatcctcaagatccttttgaagcagaagaacgaacatcaccacggccactctcactacgcttcagaaagtctgccttctaagaaagaccaggaggagggcgtcatggagaaactgcagaatggcgatttggatcacatgattccacaacactgctcctccgaactcgacggcaaggcccccatggtcgacgagaaggtgattgtgggctctctgtccgtccaagatcttcaggccagccaaagtgcgtgttactggctgaagggggttaggtacagcgacatcgggacacttgcctggatgatcaccttgtccgatggactacataacttcattgatggcctggctattggagcttcattcactgtcagcgtgttccaaggcatatctacgtctgtggcgatcctttgtgaggaatttccgcatgagctgggcgactttgtgatcttattgaacgcgggaatgtcaatccagcaggccctatttttcaattttctttcagcgtgctgttgctacttgggactggcgtttggaattctagctggcagtcacttcagtgccaattggatcttcgcccttgcgggcggcatgtttctctacatatcactcgctgatatgttccctgagatgaacgaagtgtgccaggaggacgaacggaagggaagtatactcatcccgttcataattcagaacctgggcctgttaaccggtttcactatcatggtcgttctgaccatgtactccggccagattcaaatagggtag

SEQ ID NO: 46306 - DNA, 1383 bp, Artificial Sequence
  Description of Artificial Sequence: Synthetic coding sequence
atggcccccggccgggccgtggccggcctgctgctgctggccgccgctggcctgggaggtgtcgccgagggcccgggactcgccttctcagaagacgttctgtcagtgtttggggcaaatttgagcctctccgcagcccagctccaacaccttctagaacaaatgggcgccgcaagtcgggtcggagtgcccgaacccggacaactccattttaatcagtgtctgactgccgaggaaatcttctcactgcatggcttttcaaacgccacacaaattacctcttctaaatttagtgtgatttgcccagccgtcctccagcagcttaattttcacccttgcgaagatcggcctaaacacaagactaggccgagtcactcggaggtgtggggctacggattcctgagcgttacaatcattaatctcgccagtttactcggactgatcctcaccccattgataaagaagtcgtatttccccaaaatcctcacgttctttgtcgggctcgcgatcgggaccctcttcagcaatgccattttccaactgatcccggaagcctttggctttgatccaaaagtggactcgtacgttgaaaaggccgtggccgtttttggcggattttatttgctcttttttttcgaacgaatgctgaaaatgctgctgaaaacctatggacagaatggtcacacacactttggcaacgataacttcggaccccaagaaaagactcatcagccgaaggcactgccagccatcaatggggtgacctgttacgctaacccagcagtaaccgaagcaaacggacacatacactttgataatgtctctgtagtgtctctccaggacggaaaaaaagaacccagctcatgtacatgcttaaaaggcccaaaactttctgagatcggtaccatcgcctggatgattacgctgtgtgatgccctgcacaactttatagatggtttggccatcggagcctcctgcacactctccctgttgcaaggtctgtcaacgtcaattgcaatcttgtgtgaggaatttccccacgaactgggggattttgtgattcttctcaacgccggtatgagcacaagacaggcattgctcttcaatttcctatccgcttgctcctgctatgtcggtcttgcgttcggtatcctcgtgggcaacaactttgcccccaacatcattttcgccctagcaggaggaatgttcctgtacatatccctcgccgacatgttccccgagatgaatgatatgctgcgagagaaggtcaccggccgaaaaacagatttcacatttttcatgattcagaacgccggaatgctcaccggattcacggctattctgcttatcaccttgtatgccggggaaatcgagctggaatag

SEQ ID NO: 46307 - DNA, 1383 bp, Artificial Sequence
  Description of Artificial Sequence: Synthetic coding sequence
atggcccccggccgggccgtggccggcctgctgctgctggccgccgccgggctgggtggagtcgccgaggggcctggtttggcgttctctgaggatgtcctgtccgtatttggtgctaatctttccttgtcggctgcccagttgcagcacttactggagcagatgggggcagcttcccgcgttggcgtccccgagcccggccagctgcattttaatcaatgtcttacagccgaggaaattttctcgcttcatggcttttcaaacgctacacaaattactagttctaagttttctgtgatctgtccagcggtgttgcagcaactcaactttcacccctgtgaggaccgcccaaaacacaagacacgccctagtcattcagaggtttggggttacggcttcctctctgtgacaataatcaatttggccagcctcttgggactgattctgactccacttattaaaaaatcttactttcccaaaatcctgacttttttcgtcgggttggcaataggaaccttgttctctaatgcaatcttccaactgatacctgaggcttttggtttcgacccaaaggtggacagttatgtagagaaggctgttgcagtcttcggaggcttctatctgctgttcttctttgaacgaatgcttaaaatgctcctgaagacgtacggccagaacggacatactcactttgggaatgataactttggcccgcaggaaaaaacacatcagcccaaggcgctccctgctattaatggcgtgacctgctacgcgaacccagccgtgaccgaggctaacggccatatacactttgacaacgtcagtgtagtgtccctgcaggacgggaagaaggagccttctagctgtacgtgcttaaaagggccaaagctgtcggagattggcactatagcctggatgattacactgtgtgacgctctgcacaattttattgatggactggccatcggggcatcctgtacactctctctgctgcagggtctatcaacttcgatcgcaatcctatgtgaagagttccctcacgagttgggagacttcgtcatcctgctcaatgctggaatgtccactcgacaggctttgttgttcaattttctctccgcatgctcgtgctatgttggattggctttcggcattctcgtgggcaataattttgccccaaacataatcttcgccttggcaggcgggatgttcctctacatctccctggcagatatgtttcccgagatgaatgacatgctccgggaaaaagtgaccgggcgaaagaccgactttacattcttcatgatccagaacgccggaatgcttacaggcttcacggctattcttttgatcactctatatgcaggcgaaattgagcttgagtag

SEQ ID NO: 46308 - DNA, 1335 bp, Artificial Sequence
  Description of Artificial Sequence: Synthetic coding sequence
atggcccccggccgggccgtggccggcctgctgctgctggccgccgctggactcggcggtgttgcagaaggacccggtttggcgttctcagaggatgttctgagtgtgttcggcgccaatctctccctgtccgcagcgcagcttcaacatttattggagcaaatgggcgcagcttctcgtgtcggagtaccagaaccggggcaactgcatttcaatcagtgcctgaccgcagaagaaatcttctctctgcacggtttttccaatgccactcagataacaagctcaaagttctctgtgatctgtccagctgtcctccagcagctgaactttcacccgtgcgaggaccgtcctaaacacaagacacgcccatcccactcagaggtgtgggggtatggcttcctatctgtcaccatcattaaccttgcgtccctcctggggctgattctaacaccacttataaaaaagagctattttcccaaaatcttaaccttttttgtcggtctagccatcgggactttgttctcgaacgccatcttccagctcattcccgaggcctttgggttcgacccgaaagtcgactcatatgtggagaaagcagtggctgtcttcggcggcttctatttattgttctttttcgagcgcatgctcaaaatgttgctgaagacatacggacagaatgggcacacacacttcggtaacgacaactttggtccccaggagaagacccatcaaccaaaggccttgcctgctataaacggcgtcacctgctatgccaatccagccgtaactgaggccaatgggcacatccacttcgataacgtgtccgtggtctctcttcaggatgggaaaaaagagccttctagctgtacatgtctgaaaggacctaagctgtcggaaatcggcactattgcatggatgatcaccctctgtgacgccctgcataatttcattgacggccttgccattggggcctcctgtacactgagcttgctccagggcctgtccacatccattgccatcttatgtgaagagttcccgcatgagctgggcgatttcgtgattctactgaatgcaggcatgtcgactcgccaagccctactcttcaattttctgagtgcctgctcatgttacgtgggcctagctttcggaatcttggtaggcaataactttgctcctaacatcatcttcgctctggccggcgggatgtttctctatatcagtctagcagacatgttcccagaaatgaacgacatgctccgggagaagatcattaagtgggccaccgatgatataaaatctcagctccatctgctctggatctacaccgcgagatag

SEQ ID NO: 46309 - DNA, 924 bp, Artificial Sequence
  Description of Artificial Sequence: Synthetic coding sequence
atggacgacttcatcagcatcagcctgctgagcctggccatgctggtaggctgctacgtggctggaattatccccctcgctgtgaatttctccgaagaacgcctgaaactcgtgaccgtattgggcgcaggattgttgtgtggcactgccctggctgtgatagtgccagagggggtgcatgcgctctacgaggacatactggaaggcaagcaccaccaggcaagcgagactcataacgttatcgcatctgacaaagctgctgagaagtctgtggtgcacgagcatgagcactcccacgaccatacacagctccatgcgtacatcggcgtctcgttggtgctgggttttgtttttatgctgttggttgatcaaattggcaacagtcacgtccatagtacagatgatcctgaagccgcgcgatcctctaactccaaaatcacaactaccctgggtttagtcgtgcacgcagccgccgacggtgtggccctgggagctgcagcctccacaagccagacgtcagttcagctcatcgtgtttgtggccattatgctgcataaggctcctgctgctttcggtttagtatcattcttgatgcatgccggactcgagcgcaaccggattagaaagcaccttctggtgtttgcactggcggccccagtgatgtccatggttacctatttagggctgtcaaagtcatcgaaggaggccttgagtgaagtgaacgccacaggcgtcgctatgctgttttcagcagggaccttcctctacgtggcaactgtacacgtactgcccgaggtagggggaatcggacatagtcacaagcccgatgctaccggcgggagagggttgtccagactagaggtggccgcactagtactggggtgtctaattccacttatcctgagcgtcggtcaccagcactag

SEQ ID NO: 46310 - DNA, 924 bp, Artificial Sequence
  Description of Artificial Sequence: Synthetic coding sequence
atggacgacttcatcagcatcagcctgctgagcctggccatgctggtaggctgttacgtagccggaattattccgctcgctgtcaacttcagcgaagaaaggctgaagctggttactgttttaggcgcaggcctcctgtgtgggaccgccttagcggtgatcgtgcccgagggcgtccacgccctgtacgaagatattctggagggaaagcaccaccaggctagtgagactcacaacgttatcgcttcagataaagccgccgagaaatcagttgtccacgagcacgaacactcacacgaccacacacaactgcatgcctatataggcgtgagcctcgtactgggttttgtgtttatgctgctggtcgatcaaatcggtaactcccatgtgcattccaccgacgatcctgaggctgcccggtcaagtaatagcaagattacgacaaccctgggattggttgtccacgctgctgcggatggtgtggcgcttggggctgccgcaagcactagtcagacgagcgtccagctgattgtttttgtggccatcatgctccataaggctcccgccgctttcggtcttgtgtcatttctgatgcacgcaggccttgagagaaacaggattcgaaaacaccttctggtgtttgcgctggccgcgcccgttatgtccatggttacctatttaggtctgagcaagtcgtccaaggaggcactctctgaagttaacgccactggggtcgcgatgttgtttagcgctgggacgttcctgtacgtcgcaaccgtgcatgtactcccggaggtaggtggcattggccactcacataaacctgatgccactggaggtcgaggcctaagccggctggaggttgctgcattggtgttaggctgcttgattcccttaattctgtcggtaggtcaccagcactag

SEQ ID NO: 46311 - DNA, 2691 bp, Artificial Sequence
  Description of Artificial Sequence: Synthetic coding sequence
atggagatgaagctgcccggccaggagggcttcgaggccagcagcgcaccccgtaacatcccttctggcgagctagactcaaaccccgatcccggaacaggccccagtccagatggaccatcagacaccgaatccaaagagcttggggtgcccaaggatccattgctattcattcaactgaacgagcttctaggttggcctcaggccctagagtggcgtgaaaccggacggtgggtgttgttcgaagagaaactggaagttgctgcggggagatggtctgctccgcacgttcccaccttagccttaccatccctgcagaagctgagaagcctactggccgaaggcctggtcctgctggattgccctgcccagagtctcctggagctcgtcgagcaagtaacccgcgtcgagagcctcagccccgagctccggggtcaactgcaggcgctgctgctccagcggcctcagcactataatcagaccaccggaacccggccttgctgggggtccacacacccacgtaaggcctctgataacgaggaggctcctctaagggagcagtgccagaatccactgcgtcagaagttacctccaggcgccgaggccggcacagtgctggctggggaactcggattcctagcacaacccttgggcgcttttgtaagattgaggaatccagtggtgctgggaagtttaactgaagtgagcctgccctccagattcttttgtttgcttcttgggccttgcatgctgggcaaaggatatcatgagatgggacgggctgccgcggtgctgttgagtgacccgcagttccaatggtccgtccggagggcatccaacctgcacgacctgctggcagctttggatgcatttttggaggaggtcacggttctccctcccggacgttgggaccctaccgcaagaattccaccccctaagtgtctgccatctcaacataaaagactgccatcccagcaacgagaaatccggggccccgccgtaccccgacttacctctgccgaggacaggcaccgccatggcccccatgcccactctcccgaactgcagagaacaggtagactgttcggcgggctgattcaagacgtgcgacgaaaggtgccctggtatccttcagatttcttggatgcccttcacctgcagtgtttctccgccgtgctgtatatctacctcgccactgtgactaacgccatcacttttggcggcttactgggggacgctactgatggtgctcaaggcgtgctcgaaagctttttggggactgcagtggctggggccgcattttgcctgatggccggacagccactgacgatcctgtcctcaacaggcccagtgctcgtgttcgaaaggttactgttttccttctcacgagattactctctggactaccttcctttcagattatgggtcggaatttgggttgcgactttttgccttgtgctcgtagcgaccgaagcaagcgtcctggtgcgctatttcacccggttcacagaagaggggttttgcgcgctcatctctctaatcttcatttatgatgctgtcggaaagatgctgaatctcacacacacctatcccatccagaaaccaggatcctcagcgtacgggtgtctctgccagtacccaggcccaggaggaaatgaaagtcaatggatccgtacccgcccaaaggaccgggatgatatagtcagtatggtcaggaaagggctgagtgacttctcgtcagttttggcaattcttctgggctgtgggctggacgcattcctcggccttgccacaccgaagctaatggtccccagagagttcaagcccactctgcccggaagagggtggttggtcagccctttcggtgccaatccttggtggtggtcggtggctgcagctctccctgccctgcttttatccattctcatcttcatggaccaacagatcactgctgtcatcctgaaccggatggagtataggctacagaagggcgcgggctttcacctggatctcttttgcgtggccgtcctgatgttgctcactagtgcactggggctgccctggtatgtgtccgccaccgttatctctcttgcacacatggacagtctgagaagggaaagtagagcttgcgcacccggggagcggccgaacttcctgggcatcagagagcaacgccttacaggtctggtggtgtttattctgacaggggccagcatctttctcgcaccggttctgaagtttatccctatgccagtcctttacggaatttttctgtatatgggagtagcagctctgtccagcattcagttcactaaccgagtgaaactcttgctgatgcccgccaaacatcagcccgacctgttgttgctccggcacgtccccctcaccagggttcatctgttcacggccattcagctcgcttgcctggggctcctctggatcatcaaaagtacgcctgccgccattatatttcccttaatgctcctgggtttggtgggggtacgtaaggcccttgagcgcgtctttagcccgcaggagctgctgtggcttgacgaactcatgcctgaagaagagagatccatccctgagaagggattagagcccgagcacagtttttccggctctgatagcgaggatagtgaactgatgtaccagcccaaggccccggaaatcaacatctccgttaattag

SEQ ID NO: 46312 - DNA, 3780 bp, Artificial Sequence
  Description of Artificial Sequence: Synthetic coding sequence
atggccaacggcgtgatccccccccccggcggcgccagccccctgccccaggtaagagtgcccttggaagaaccccccttgagcccagatgtggaggaggaggacgatgacttgggtaagaccctggcggtaagcagatttggggacctgatctcaaaacctccagcctgggacccagaaaaaccatccagatcctattctgagcgagacttcgaatttcaccgccatactagccaccacacccaccaccccctgtccgcaaggctgcctcctccacacaaacttaggagattgccccccacgagcgcccgccatacaaggagaaagagaaaaaaagagaaaacctccgctccaccatctgagggcacccctcctattcaggaggaaggaggcgccggcgtggatgaagaagaggaagaagaggaggaggaggaaggtgagtccgaggctgaacccgtggaaccacctcatagcggtaccccgcaaaaagctaagtttagcattggttcagacgaagacgactcgcccggtctgccagggcgcgccgctgtcaccaaaccgcttccatctgttggtccccacactgacaagtcccctcagcacagttccagaccgtgcagtgagcttcgcgatggagacgggacaactgacttggccctttcttccccccgtttactgtgctgtctgccatcatccccctctcctcgagcaagggcaagccgactagccggggagaaaagtcgtccatggtcaccctcagcctcctatgatctaagggagagactttgcccagggagcgcactggggaaccccggaggacctgaacagcaggttccgacagacgaggctgaggcacaaatgctcggcagcgcggatttggacgacatgaaatcccacaggctggaggataacccaggcgtccgaaggcatcttgtgaagaaaccatctaggacgcagggaggcaggggcagcccctcaggccttgctccaatattgagaagaaagaagaagaaaaaaaagcttgaccgcagaccacacgaagtcttcgtcgagctgaacgagctcatgttggacaggagccaggaaccacattggcgggagaccgcaaggtggattaaatttgaagaggacgtggaggaagagaccgagagatggggtaagcctcatgtagctagcctgagttttcggtctctcttagagctgcgccgaaccattgcccacggggctgccctcctcgatctcgaacagaccaccttaccaggcattgcccatctagtggttgagacaatgatcgtaagtgaccaaatccgccctgaggatcgggccagcgttctgcgcactctcctcctgaaacattctcaccctaatgacgataaagatagcggatttttccctaggaacccttcatcaagctcaatgaatagtgttctggggaatcatcatcccaccccaagccatggcccagacggtgctgtgccgactatggccgacgatttgggcgagcccgcaccactttggcctcacgaccctgacgccaaggagaaaccactgcacatgccaggaggggacggccatcggggcaagagtctaaaactgcttgaaaaaataccggaggacgctgaggccactgtggtcctggtgggctgcgtcccttttctggaacaaccagccgcggccttcgtgcgactgaatgaagcagtgctcctcgaaagtgtgctggaggttcccgtccctgtccggttcctttttgtaatgctcggaccctcccacactagcactgactatcacgagctcggcagaagcattgccaccctcatgagtgataaactctttcacgaggccgcttatcaagcagatgacagacaagatttattgtccgctattagtgaatttctggatggctcaatcgtgattccccccagcgaggtggagggacgcgatctgctgaggtcagttgcggcatttcaacgcgaattgctgaggaaacgccgtgagcgcgaacagacaaaggttgagatgaccacacgcggggggtataccgctcccggaaaggaattgtctctagaacttggtggatcagaagctacaccagaggacgaccccttgctgagaactgggagtgtgtttggcggcctggtccgagacgtgcggaggagatacccacattaccccagcgatttgcgagacgccttgcacagtcagtgcgtcgctgctgtactgttcatttattttgcagcactgtctccagccattacattcggcggcctgttgggagagaagacggagggactgatgggagttagcgagcttatcgttagtacagcggtactgggcgttctattctcacttctgggagcccaaccattattagtagtgggtttctcgggacctctgctggtttttgaggaagcgttctttaagttctgtagggcgcaggacctggaatacctcaccgggcgtgtgtgggtgggcctttggctagtggtgttcgttttggcccttgtggcggctgaagggagcttcctcgtgaggtacattagccccttcacccaggagatattcgcatttctgatttcactcatcttcatatatgagactttctataagctctacaaggttttcacagaacatcccctcttacctttctatccgcccgagggcgctctcgagggatcactcgatgctggacttgagcccaatggatctgcccttccccccacagaaggcccaccttcacctcgcaaccagcccaatacagccttgctctctctgatcctgatgctgggcacctttttcattgcctttttcttaagaaagtttcgtaattcccgcttcctgggcggaaaggccagacgaattatcggcgacttcgggatcccgatatcaatcctggtgatggtgctggtggattactccataactgacacgtacacccagaagctgacagtgcccaccggattgagcgttacttcccccgataaaaggagttggtttatcccaccactggggagtgcgcgccctttcccgccatggatgatggtggctgccgctgtccctgcacttctcgtgctgatattgatctttatggagacacagatcaccgcacttatcgtctcacagaaggctaggcgattgctcaaggggtcagggttccacttggatcttctgctcattggctcactgggaggcttgtgcggcttgtttggtctgccatggcttaccgctgccacagtgcggagtgtcacccatgttaatgccttgaccgtcatgagaacagctattgcacccggagataagcctcagatccaagaggttcgcgagcagcgagtaacaggtgtgctcatagcttcactggtggggctgagcatagtcatgggtgcggtactgcgtcgtataccactagctgtcttgtttgggatctttctgtatatgggtgtgactagcctgagtggaatccagctgagtcagcgactgttgttgattcttatgccagctaaacaccacccagagcagccttacgtgactaaggtcaaaacatggcgcatgcatctgtttacttgcattcagttaggatgcatcgctttgctgtgggtagtcaaatccactgctgcatccctcgccttccccttcctgctgcttctaacagtaccattgcggcattgcctgctgccccgcctgtttcaggatagagagctacaggctttggattcagaggatgcagagcctaatttcgacgaggacggacaagatgagtacaatgaattacacatgccagtgtag

SEQ ID NO: 46313 - DNA, 3699 bp, Artificial Sequence
  Description of Artificial Sequence: Synthetic coding sequence
atggccaacggcgtgatccccccccccggcggcgccagccccctgccacaggttcgcgtgccactggaagagcctccgctgagcccagacgtggaggaggaggacgatgacttgggcaaaactttagcagtgtcccggttcggagacctgatcagcaaaccacccgcctgggaccccgaaaagcccagtagaagttattcagagcgtgacttcgagtttcaccggcataccagccaccacactcatcatccacttagtgctaggctaccacctccccacaaactgagaagattaccacccacgtcggcccgtcacactagaagaaagcgaaagaaagaaaagacatctgctcctccttccgagggaacccctcccattcaagaggaaggaggggccggcgtagacgaggaagaggaagaagaggaagaggaagaaggcgaaagcgaggcagagcccgtggaaccaccccatagtggcacccctcagaaggccaagttcagcatcgggagtgacgaggatgattcccccgggctgcctggacgcgccgccgttaccaagcctttaccctcagtgggaccccacacagacaaatccccgcagcactcatcttcatcaccgagtccaagagcccgcgctagccggctggctggcgagaagtcacgtccttggtccccttcagcctcttacgatcttagggaaaggctgtgccccggatctgcgcttggaaacccaggtggccctgagcagcaggtgcctaccgatgaggccgaagctcagatgctcggaagcgccgaccttgacgatatgaagagccaccggctcgaggataatccaggagtccgccgccacttagtaaagaagccttcacgtacgcaaggcggcagagggtctcctagtggccttgccccaatactcagaagaaaaaaaaaaaagaagaagctggacagacgtcctcacgaagtgttcgtagaactgaatgagcttatgcttgataggagccaggagccccactggcgcgagacagctcgatggatcaaatttgaagaggacgtggaagaagaaacagagcggtggggcaaacctcatgttgcaagtctatcgtttcggtcattacttgaactgcgcaggacaatcgcccacggagcagccctgttggatctggaacagaccactctccctgggatagctcatcttgtggtagaaactatgatcgtgagtgaccagatccggcctgaagatagagcatctgtgctccggactttgctcctgaaacattctcaccccaatgatgacaaggattccgggtttttcccgcgtaacccttcatcatcttccatgaactctgttctcggcaaccatcaccctacccccagtcatggtccagacggcgctgtcccgaccatggctgacgacttaggtgagccagctcctctctggccccacgaccctgacgcgaaagagaagcccctgcacatgcctggcggggacggccatcggggtaagtctctgaagctcctggagaaaatacccgaagacgcagaagccactgtggtgttagtggggtgcgttccttttctggagcagcctgcagccgccttcgtccgattgaatgaggcggtgctcctcgaatccgtgctcgaggtcccagtccctgtccggttcctctttgtgatgttgggcccttcccacaccagcaccgactaccacgagcttgggcgctcgatcgctacccttatgagcgacaagctgttccacgaagcggcttatcaagctgatgataggcaggatctcctgagcgccatcagcgagttcctggacggcagcatcgtgatcccgccatcggaggttgagggtcgagacctgctgagatcagttgctgccttccaacgagaactgctccggaagcgccgcgagcgggaacaaacaaaggtggaaatgaccactagaggtgggtataccgctcccggcaaagagctgtcgctggaattgggaggaagcgaggccactcctgaagacgatccgttactgagaacaggttcagtttttggtggtctggtgcgtgatgtcaggcggaggtatccgcattatccttcagacttgcgcgacgcccttcactcccaatgcgtagccgcagtcctgtttatatactttgccgctctttctccggcaatcaccttcggcggcctcctcggggaaaagaccgaggggctgatgggcgtctctgaattgatcgtgtctaccgccgttctcggcgtactcttcagcttgctgggtgctcaacctttacttgtcgtcgggtttagtgggcccctcctggtttttgaagaagcattcttcaagttctgccgcgctcaggacttggagtatctcaccgggagggtttgggtgggactgtggctagtggtgttcgtgcttgcactcgtcgctgccgaggggtcctttctcgtccgctacattagccctttcacccaggagatttttgcattcctgatatcactgatatttatctatgagactttttacaaactgtacaaagtgttcaccgagcacccacttctcccattttatcctcctgaaggagcactcgaaggatccctggacgctggcctggaaccaaatgggagcgcactgccacccactgaagggcctccatctcctaggaaccagccgaacaccgcactcctgagtctgatactgatgctggggactttctttatcgccttttttcttcgcaaatttcgaaattctcggttcctcggtggcaaagctcggcggatcatcggcgatttcggcattcccatttccattttggttatggtgctggtggactactctatcacagatacgtatactcaaaagttaacagtgcccacggggctgagcgtaacatctcccgacaagcgatcttggttcattccgccgcttggaagcgcccgtccatttcccccgtggatgatggtggctgccgccgttcccgctctgcttgtgcttatcttgatcttcatggaaacacagattacagcgttgatagtctcccagaaagccagacgattgctcaagggatctggattccatttggaccttctgttgatcggctccctaggcggactttgtggactgttcggactgccctggctgaccgcagccaccgtgagatctgtgactcatgtaaacgccttgaccgtgatgcgcaccgccattgcccccggagataagccccagatacaggaggtgcgagagcaaagagtgacaggggttttgatagctagcctcgttggactgagtatcgtgatgggcgctgtgctacggcggatcccgctggctgtgctgttcgggatttttctgtatatgggtgttacatccctgagcgggattcagcttagccagagactcctgctcatccttatgcccgccaagcatcatcctgaacagccttacgttaccaaagtcaaaacttggcggatgcacttgtttacatgtattcagctaggctgcatagcacttctctgggtggtgaagtctaccgcggcctccctggcatttccctttttgcttcttctaacagtccctctgcgacactgtttgctgcctaggctgttccaggacagagaacttcaggcccttgattccgaggacgcagagcccaactttgatgaagacggacaagatgaatacaatgaattacatatgccagtctag

SEQ ID NO: 46314 - DNA, 1203 bp, Artificial Sequence
  Description of Artificial Sequence: Synthetic coding sequence
atgggcgtgagcgagctgatcgtgagcaccgccgtgctgggcgtgctcttctctctgttgggggcccaacccctgctagtggttggtttctcaggtcctctgctggtgttcgaagaagctttctttaagttttgtcgtgcccaggacttagagtatctcaccggccgggtgtgggtggggctgtggctcgttgtattcgtgctcgcactggtggcggcagagggcagcttcctggtgcgctacatcagcccgtttacacaggagatcttcgcattcctaatttcattgatcttcatctacgagactttttataaattgtataaggtgtttactgaacaccccctgttacctttctacccacctgaacctggaggtgtccccggctgttggtctggggccaaatggcagctgcccccaaccgaagggccgccatccccaaggaatcagcctaataccgcgctgctgagtctcattctcatgttaggcaccttttttattgccttctttttgcggaaattcagaaactccagattccttggcggtaaggcgagacgcatcataggcgattttggtattccaattagcatacttgtgatggtgctggtggattattccataacagatacttacactcagaagctgactgtgccaaccggcctaagcgttacatcaccagataagagatcctggttcataccccccctgggctcagctcgccccttccctccatggatgatggtagcagccgcagtacctgccttacttgttcttatccttatcttcatggagacccagataactgcccttattgtgtcccaaaaagctcgccgactgctgaaggggtcgggatttcacctggatctgttgctcataggtagcctgggtgggctctgtggactgtttgggctgccttggctaactgccgcaaccgttcgatcagtgactcacgtgaatgcactcaccgtgatgcgcactgcgatagcccctggggataagccacagattcaggaggtgagggagcagcgggtaacgggtgtgctaattgctagcctcgtggggctttcgatcgttatgggtgcagtgctacgcagaatccctttggctgtcctctttggcatcttcctgtacatgggcgtgacttctctctccggaatacagctgtcccagagactcctcctgattcttatgcctgccaagcactag

SEQ ID NO: 46315 - DNA, 3699 bp, Artificial Sequence
  Description of Artificial Sequence: Synthetic coding sequence
atggccaacggcgtgatccccccccccggcggcgccagccccctgccccaggtgagagttcccctggaggagccaccactttcaccggacgtcgaggaggaggacgacgatctcggcaagactctggccgtttccagatttggcgatctgatctcgaaacctccagcgtgggatccagagaagccttcgagatcctactcagagagagatttcgagttccataggcatacttcacaccatacccaccaccccctttccgcccgacttccccctccccacaagctgaggaggctgccgcccacttctgctcggcatactaggaggaaaaggaagaaggagaagactagcgctccgccctccgaagggactcctccaatccaggaagaaggcggcgcaggtgtggatgaggaggaggaggaggaggaggaagaagagggagaaagtgaggctgaacctgtcgagccaccgcactccggtactccacaaaaagctaaattttcaattgggtccgacgaggatgatagtcccggactcccgggtcgggcagcagtgaccaaaccactgcccagtgtcggaccccatacagataaaagcccccagcattcaagctcgtcgccctcaccaagagctcgggccagtaggctagccggagagaagtctcgcccctggtccccaagtgcgtcatacgacttaagagaacgtctctgcccagggtccgccctggggaatcccggcggcccagagcaacaggtgcctactgatgaagccgaggctcagatgttgggcagtgccgacttagacgatatgaagtcacaccggctcgaggataatcccggagtgaggcggcaccttgtgaagaagccatccaggacacaggggggtcggggcagtccttccggcctggcccctatcctccgtcgtaagaaaaaaaaaaaaaagctggaccggagacctcacgaggttttcgtggagctgaacgagttgatgttggaccgaagccaggagccacattggcgggagaccgcaagatggatcaaatttgaagaggatgtggaagaagaaacggagcggtggggtaagcctcatgtcgcatccctgtcctttcggtcactccttgagcttcgacgaacgatcgcacatggggccgccctcctggacttggaacagacaaccctccccgggattgcccatctagtggtcgagacaatgattgtgtccgaccagatcaggcccgaggatagggcgtccgtgctgaggacgctgcttctaaagcattcgcaccctaacgacgacaaggatagcggctttttccccaggaacccatccagctcttccatgaacagcgtcctgggaaaccaccaccccactccttctcacggacccgacggcgccgtccccactatggctgatgacctgggggaacctgctccactgtggccccacgatccagacgccaaagaaaagccactccacatgccaggaggagatggacaccgcggaaagtctttgaaactgctggaaaagatacccgaggacgcagaagcgactgttgtcctggtgggatgtgtgccttttctagagcagccagccgccgcttttgttcgcttgaatgaggcagtgttgctggagagtgtgttagaggtcccggtgccagtgcggtttctgtttgtgatgttaggtccatcgcataccagcacagattaccacgaactcggtaggtctattgccactctgatgtcagacaaattgttccacgaagccgcttatcaggcagatgatagacaggatctgctgtctgctataagtgagtttttagatggctcgatcgtgatcccgccctcggaggtcgaaggacgggacctgctacgctcagtcgccgctttccaaagagagctgctcagaaagaggcgggagcgcgagcagactaaagtagagatgactacccgaggtgggtatacagcaccggggaaggagctgagccttgaattgggaggaagcgaggccacacctgaggatgatccgctgctaagaacaggctccgtgtttggggggctggtgcgcgatgttagaagacgctacccccactatccaagtgacttgagagacgccctgcactcccagtgtgtcgccgcagttttatttatctattttgccgctctttctccggcaatcacatttgggggactactcggtgagaagaccgagggcctgatgggcgtatcagagctaatcgtgtcaaccgccgtcctgggagttctgtttagccttctgggggcgcaaccattgctcgtggttggctttagcggccctctgttggtgtttgaagaagccttttttaaattttgcagagcgcaggatctagaatatctcacaggccgcgtttgggtcggcttgtggctcgtggtttttgttcttgccctggtagccgcagaggggtcgtttttggttcgatatatctccccattcacacaggaaatttttgcctttctgatttccttgatatttatttatgagacattctacaaactgtacaaagtgtttacagaacaccctctgttacccttttacccccctgaaggcgctctggaggggtcactggatgcaggtctcgaaccaaatggctcggctctgccccccacggaagggcccccctcaccgagaaatcaaccaaatacggccctgctgtctcttatcctgatgcttgggaccttctttatcgcattttttctccggaaatttaggaactccaggtttttagggggcaaggccaggcgcattataggggatttcgggatcccgatttctattttggtaatggtcctcgtcgactactcaataaccgatacatacacgcagaagctgacggttcccaccggcctgtctgtgactagccccgataaacgtagctggtttatacccccactggggtctgcacggccctttccgccctggatgatggtggcggcagctgtccccgccctgctagtgttaatcctaattttcatggagacacagatcacggctctgatcgtttctcagaaagcccgccggctattaaagggctctggtttccatctggatctgttgctgatcggtagcctggggggactgtgtgggctgttcggactgccctggctgacagccgccactgtgaggtctgtaactcatgtaaacgcgctcacagtcatgaggactgcaatcgctcccggagacaaaccccaaatacaggaggtgcgcgaacagcgggtgaccggcgtgctaatcgccagtctggtcggactgtcaatcgtgatgggagccgtactacggagaatccctcttgccgtcctattcggaatatttctatacatgggggtcacttcgctgagcgggattcaactatctcagcggctcttgcttattctgatgcctgccaagcaccaccccgagcagccctatgttaccaaggtgaagacatggagaatgcacttgtttacatgcattcagttgggatgtatagcattgctgtgggttgttaagtccactgccgcctctctcgcttttccattcctcctgttactcacagtgcctctgcggcattgccttcttcccaggctgttccaggacagggagctccaagcattagatagcgaagatgcagaaccgaatttcgatgaagacggacaggacgagtacaatgagcttcatatgcccgtgtag

SEQ ID NO: 46316 - DNA, 3699 bp, Artificial Sequence
  Description of Artificial Sequence: Synthetic coding sequence
atggccaacggcgtgatccccccccccggcggcgccagccccctgccccaggtgcgagtgcccttggaggagccgccactctcccctgacgtggaagaggaggacgacgacctgggaaaaacactcgcagtaagtaggttcggcgatctaataagcaagccaccagcttgggaccccgagaagccatcaaggtcctattcagagagggactttgaatttcatcgtcacacatcccatcatactcatcatcccctttcggccaggctgccccctccacataagttacgccgcctccccccaacttccgctcgccatacccgcagaaaaaggaagaaggagaaaacaagcgccccgccatctgaaggcaccccacctatacaggaggaaggaggggccggtgtggatgaagaagaggaggaggaggaggaagaagagggtgaaagtgaagctgagcctgtggaaccccctcactccggcactcctcagaaggcaaagtttagtattggttcagacgaagacgatagccctggcctgcctggacgcgctgctgtcaccaagcctctccccagcgtgggaccacacacagacaaatctccccagcactcttctagctctccatccccacgcgcacgtgcctcaaggctggcaggggagaaaagccgaccctggtctcctagcgcgagttacgatttgagagagcggctgtgccctggcagcgcattaggaaacccagggggtccagaacagcaggttcctaccgatgaggccgaggcacagatgctggggtccgctgacttggacgacatgaaatcccaccgcctggaagacaatcccggcgtgagacgccatctggttaaaaagccgtctagaacccagggcgggcggggctctccttctgggttggctccaattctgaggaggaagaaaaaaaaaaagaagctggacagaaggccgcatgaggttttcgtcgagcttaacgagctgatgttggaccgtagtcaggagccccactggcgggagacagcccgctggattaagtttgaagaagatgtggaagaggagaccgagcgatggggtaagccccacgtcgccagtttatcatttaggagcctcctcgaactgaggcgcacaatcgcccatggggccgccctactggaccttgaacagaccacattgcctggaatcgcacacctggttgtggaaactatgatagttagcgaccagattagacctgaggaccgtgcaagtgttctacggaccctgctcttaaaacacagccaccctaatgacgataaagacagtggcttctttccaaggaatcctagctcatcttccatgaatagcgttcttgggaaccaccaccccacccccagtcatggcccagacggggccgtgcccacaatggcggatgacctgggcgagcctgccccattatggccgcacgacccggatgccaaggagaagccactgcacatgcccggaggcgatggacataggggaaaatctctgaagctgctggaaaaaatccctgaagacgccgaggccactgtcgtcttagtcgggtgtgtaccttttctggagcaaccagcagctgctttcgtgcgccttaacgaggcagtcctgctggagagcgtcctggaggttcctgttccggtgcgtttcctttttgtcatgctggggccttcccacaccagcaccgattatcacgagttggggcggagcattgcaaccttgatgtcagataagctttttcacgaagccgcttaccaggcggatgacagacaagacctgctttccgccatatcggagttcctagacggcagcatcgtcattccaccaagcgaggtggagggcagagatctcctccggtcagttgcagcattccagagagagctcctcagaaaaagaagggaaagggaacaaacaaaagtggagatgactacgagaggcggctacactgctcccggtaaagagctaagtttggagctgggagggtcagaagctaccccggaggacgatcccctcctgaggacgggcagcgtcttcggcggcctcgtgcgggacgtgagacggcggtatccacactacccttccgatctgcgagatgccctgcatagccagtgcgtcgctgctgtactattcatctattttgccgctctgtcaccagcgattacctttgggggattgctaggggagaagaccgaagggctgatgggtgttagcgagttaatcgtctctactgcagtactcggcgtactgttctccttactcggcgctcagcccctgctggtggtgggatttagcggcccattactagtctttgaagaagcattctttaagttttgcagagctcaggatctcgaatatttgacggggcgggtgtgggttgggctgtggctcgttgtcttcgtgctggcgttggtcgccgccgaagggtcatttctggtgaggtatatctcaccattcacacaggagatttttgcttttctgatctcactgatcttcatatatgagaccttctacaagctatacaaagtgtttacagagcaccccctattgccgttctatcctcctgagggcgcactcgagggatccctagatgctggcttggaacccaacggttctgcgctgccacccacagagggacccccatcacctcggaaccagccaaacacagcacttttgagtctcatactcatgcttggcaccttcttcatcgccttcttcctgcgaaaatttagaaattctagatttttgggcggaaaagctaggcgcatcatcggcgatttcggtattcctataagcattctggtcatggttctggtggactacagcattaccgatacatatacccagaaactgaccgtcccaactggtctgtccgtgacgagccctgacaagagatcttggttcatcccccctctcggaagtgctcggccgttccccccatggatgatggtggccgccgcggtcccagctcttctggtgctgattctgatttttatggagactcaaatcaccgctctaattgtttcccagaaggcccggcgccttttaaagggaagcggctttcatctagacttgctcctcatcggaagtctgggcggtttgtgtgggctgttcggactcccgtggcttacagcagccacggtgagatctgtgacccacgtgaatgcgctgaccgtgatgaggaccgccattgcccctggggataagcctcagatccaggaagtgagagagcagagagtgaccggggttctcatagccagcttggtgggcctctctatagtcatgggagctgtactcaggaggatccccctggctgtcctgttcggcattttcctgtacatgggtgtcacttcgttatcaggcattcaactctcacaacgcttactccttatcctgatgcccgccaaacatcatcccgagcagccatatgtgactaaagtcaagacttggcgcatgcacttattcacttgtatacaactgggttgcatcgccctactgtgggttgtgaagagcactgccgcaagcctcgcctttccgttcctcttattgctgacagtcccactgcggcattgcctgctccctaggctgttccaggatagagagcttcaggccttagacagcgaggatgctgagcccaactttgacgaggacgggcaggacgagtacaatgaacttcacatgcccgtatag

SEQ ID NO: 46317 - DNA, 3780 bp, Artificial Sequence
  Description of Artificial Sequence: Synthetic coding sequence
atggccaacggcgtgatccccccccccggcggcgccagccccctgccccaggtccgggtcccattagaagaaccgccactgtctcccgacgtcgaggaggaggatgacgacctgggcaagacactggctgtgtcaaggtttggcgatctgattagcaaacctccagcctgggatcccgagaaaccctcacggagttactccgaaagagattttgaattccataggcacacaagccaccacacgcatcaccctctaagcgcgcgcttacctcctccccacaagctgaggaggctgcctcccacaagcgccagacacaccagacgcaagcgcaagaaagaaaaaacctcagcccccccatccgaaggcacgccccctatccaagaggaaggtggagcaggagtcgacgaagaggaagaagaagaggaggaagaagagggagagtccgaagcagaacccgtggagcctccacattctggcaccccgcaaaaggccaagtttagtatcgggtccgatgaggacgactctcctggtctccctgggagagctgcagtaacaaaacctctgccctcagtggggccacacacagataagagtccgcaacacagtagcagaccctgctccgagttaagggacggcgatggaaccactgatctcgcactgagttcccctcgacttctgtgctgtctgccttctagtccatcaccacgcgctagggcttcgcgcttggcaggggagaagagcaggccgtggtcacctagtgccagttatgacttgagagagcgtctctgtcctggctccgccctcggcaatccaggcgggcccgagcagcaggtcccaaccgacgaagccgaagcgcagatgctgggaagcgcggacctggatgatatgaaatcgcataggctggaagataaccctggcgtgagacgccatttggttaaaaagccctcccggacccagggggggcgcggcagcccttctggtctcgccccaatcctgcgacggaagaaaaagaagaagaagctcgatcgtaggccacatgaggtgtttgtcgagttaaatgaactgatgctggatcggagtcaggagccgcactggcgagagacagctagatggattaagttcgaagaggatgtggaggaggaaactgagcgttgggggaaacctcacgtcgcatcgctttcgttccgctcacttttggagctgcgcaggaccatcgcacatggtgccgccctgttagatcttgaacagaccaccttgcccgggattgcacacctggtggttgaaaccatgatcgtgtctgatcagatcagacccgaagaccgggcatctgtgctcagaactcttctgcttaaacacagccacccaaacgacgacaaggactcaggatttttccctagaaacccttcaagttcatctatgaacagcgttctaggaaatcatcatcctactccatcccacggtcctgacggagccgtgccgacaatggctgatgatcttggagaacctgcccccctctggccacacgatccagatgctaaggagaagcccctgcatatgcccggaggagacgggcaccgcggtaagtccctgaagctgttagaaaaaatccccgaagacgcagaagccacagtggtgctggtagggtgtgtgccattcctcgagcaaccagctgctgcttttgtgaggctgaatgaggcggtacttctggaaagcgtcttagaggttccagtgccagtcagattcctcttcgtaatgttgggtccgagccacacatctactgattaccacgagctcggccgcagtattgccacgttgatgtccgacaagctgttccatgaagccgcctatcaggccgacgacaggcaggatctcttatctgctattagtgagtttctggacggatccatcgtcatccccccaagcgaggtggaggggagagatctgcttagatcagtggctgcctttcagcgcgagctgcttcgaaagcgaagagagcgggaacagaccaaggtggaaatgacgacaaggggcggctatacggctcccggcaaggagttgtcgttggagttgggcgggagtgaggccacacccgaagacgaccctctgctacgcactggatcggtctttgggggtcttgtaagggacgtgcgtaggaggtatccacattatccctctgacctgcgagatgctctgcactcccaatgcgtggctgccgtgctctttatttatttcgctgctctgtctcctgccattacattcggggggctcttgggggagaaaactgagggactgatgggcgtgagtgaactcattgtgagtacagccgtgctgggggtgctcttctctctgttgggagcccagccgctgttggtggtgggcttctctggccctctcctagtgttcgaagaagccttttttaagttttgtagggcacaggatttggaatacctaaccgggagggtctgggtgggtttgtggttagttgtgtttgtcttggccttagttgcggcagagggcagtttcctggtgcgctacataagccccttcacccaggagatatttgctttcctcatatccctcatcttcatctacgaaaccttttataaactctataaggtgttcaccgaacatcctctgttgcctttctaccctcccgagggagcacttgagggtagcctggatgcgggcctggagcctaacggcagcgcgctaccacctaccgagggcccaccttccccccgcaaccagcctaacactgcacttctgtcacttatcctgatgctaggcaccttttttatcgccttcttcctccgtaagttcagaaacagcaggttcttgggaggcaaagctaggcggataataggtgatttcggcatacccataagcatccttgtgatggtcttagtggactatagtattaccgacacttacacccagaagctcacggtgcccactgggctgtccgttacctcacctgataagcgaagctggttcatccctcccctaggaagcgcccgaccgtttcctccttggatgatggtagctgcggctgtgcctgccctgctggtcctgattctgattttcatggagactcaaatcacggcactgatcgtgagtcagaaagcccgcagactcttaaaaggctcagggttccatctcgatctgctcctgatcggttctttaggaggactgtgcggacttttcggactgccatggttaactgccgccactgtccgcagcgtcactcatgttaatgccctcaccgtgatgagaacggcgattgcccctggcgacaagccacagatccaagaagtgagggaacaacgtgtcacaggggtgctcatagctagtctggtaggtctgtctattgtcatgggggcagtgctaaggaggattccactagcggtgctgttcggcatatttttgtatatgggagttactagtctgagcggtattcagctttctcaacggttattactcatcctaatgccggctaagcaccatcccgagcagccatacgtaacaaaggttaagacttggcgaatgcatctgttcacctgcattcaactcgggtgtatcgctcttctctgggtggtaaaaagcacagctgccagcttagcattcccctttttgttgctgctcacagtgcctctccgccactgtttgctgcctagattgtttcaggaccgagagcttcaggccctggacagtgaagatgccgaacctaattttgacgaagatgggcaggatgaatataatgagttgcacatgcccgtgtag

SEQ ID NO: 46318 - DNA, 684 bp, Artificial Sequence
  Description of Artificial Sequence: Synthetic coding sequence
atgaccagccccctggagaaggaccccgagcccaacggcgccctgtcacctgggccaggggataccaactcctgggggttcggccgcgaccctgctccctctccaagggatagccttgcgcctgaagacctggagatgtttgtcctagattttgaggacggggatctgtgggaatcgattcgggggcaactcggccctatggctggcccacctacttgccaccgcctcgaagataaccctggagtcaggcgtcacctcgtgaagaagccctcacggacacagggaggccgaggttccccatccggcttggcacctattctgagaagaaaaaaaaagaaaaaaaaattggatcgccgtcctcatgaggtcttcgttgaacttaatgaactaatgctcgatagatcacaggagccacattggcgcgaaaccgctcggtggattaagtttgaggaggatgtcgaggaggagaccgagcgttggggcaaacctcacgtcgcctctctcagcttccgcagcctgcttgaactgcgtcggacaatcgcacatggcgccgccctgctcgacctggagcagactaccctgccaggcatcgctcacctggtggtggagacgatgatcgtatccgaccaaataagacctgaggatagggcctctgttctgcgcactcttttgctgaagcattag

SEQ ID NO: 46319 - DNA, 627 bp, Artificial Sequence
  Description of Artificial Sequence: Synthetic coding sequence
atgaagctgctgcccagcgtggtgctgaagctgttcctggccgccgtcctttctgccctggttactggggagtcactcgagcgattaaggaggggactagccgccgggacctcaaatccagacccccctaccgtttctactgatcagctgttaccgcttggagggggtagggacaggaaggtgcgcgacttacaagaggccgacctcgaccttttgcgcgtgactctgagctcaaagccgcaggcactagcgacaccaaataaggaggagcacggaaagcggaagaaaaaaggcaagggattagggaagaagcgggatccctgtcttcggaagtataaggacttctgcatccatggcgagtgtaagtacgtgaaagaactcagagctccttcttgtatttgccatcctggataccacggcgagcgttgtcacggcctcagcctgccagttgaaaataggctctatacatacgaccataccaccattctggcagtcgtagctgtggtgctctcctccgtttgtctgttggtcatcgtcggccttctcatgttcaggtaccatcggcgtggaggctatgacgtggaaaatgaggagaaagttaagctgggtatgactaatagtcattag

SEQ ID NO: 46320 - DNA, 2838 bp, Artificial Sequence
  Description of Artificial Sequence: Synthetic coding sequence
atggagatgaagctgcccggccaggagggcttcgaggccagcagcgcacccagaaacattccatctggagagctcgacagcaatccagacccagggaccgggccatctcccgacggaccttcagacaccgagagcaaggagttaggtgtccctaaggatcccctcctgttcattcagctcaacgagctactgggctggccccaggcactggagtggcgggagacgggtaggtgggtgttgttcgaggaaaagctggaagtggctgcaggccgctggagtgccccccacgtgcctaccctagcccttccatctctacagaagctccgctctctgctcgcagaagggcttgtgcttctggattgtcctgcacagtctctccttgaactcgtggaacaggtcacccgcgtcgagtctcttagtcccgagctgagaggccaactccaggcgctactcttgcagaggccccaacactataaccagacgactggtaccaggccctgttggggaagtacacacccacgaaaggccagcgacaacgaagaagctcccttgagagaacagtgtcagaaccccttaaggcagaagttgccgcccggggctgaggctggaaccgttctcgcaggcgaactcggctttctagcccagcccctcggagcctttgtgcgcctgcgcaatccagtagtactgggatccctcacggaagttagtctacccagtcggttcttttgcttgctgttgggcccatgcatgttgggcaaaggatatcatgagatgggccgcgccgccgccgtgctcttatcggatccccagttccagtggtctgttagacgcgcaagcaacctccacgacctgttagccgctctggacgcctttttagaggaagtgacggtgcttccccccgggcggtgggacccaactgcaagaattcccccacccaaatgtctgccctcgcaacataagcggttgccctcccagcagcgagagattcgcgggcctgcagtgccacggcttacaagcgccgaggacaggcatcgccacggaccccatgcccactcaccggaattgcagaggactggcaggaaggtgccttggtacccctcagactttctggatgctcttcacctccagtgtttcagcgccgtgctctatatttacttagccactgtcacaaatgcaatcacatttggggggcttctgggagatgcgactgacggagctcaaggcgtgttagagtctttcctgggaacagctgtggccggcgccgcattctgtctgatggccgggcagcctctcacgatcctcagttctacaggacctgttctagtctttgaacgcctgcttttctcattcagcagggattactctcttgattacctcccttttcgtttgtgggtgggaatttgggtcgccactttctgcctggtgcttgtggccaccgaagcttctgtcctggtgcgctatttcacccgctttacagaggagggtttttgtgccttaatcagtctgatttttatctacgatgctgtgggcaagatgctaaatctaactcatacttaccctatacagaaacccggatctagtgcttacgggtgtctgtgccagtacccgggcccgggcgggaatgagtcacagtggatccgaacccggccaaaggacagggatgacattgatttgggtctgataaatgcctccctgctgccccctccagagtgtacccggcaggggggtcacccacggggccccgggtgtcatacggtgcccgacatcgccttcttttcactgctactgttcctaacttcatttttcttcgctatggcactgaaatgcgtcaaaacgtcaaggttcttcccaagcgtggttcggaaagggctctctgattttagttctgtgctagccatcctgttgggttgtggacttgatgcctttctgggcctcgccactccgaaattgatggtaccacgtgagttcaaacctacactccctggccgggggtggttagttagtcccttcggagctaacccttggtggtggtcagtcgctgcggcgttgccagcactgctactgagcatcctgatttttatggaccaacaaattaccgctgtgatactcaatagaatggaatatcgcttgcagaaaggcgctggctttcacctggatcttttctgcgtcgccgttctgatgctgctgacaagcgccctaggactgccctggtacgtcagcgcaacggtcataagcctcgctcacatggactcccttcgtagggaaagcagagcttgcgctccaggcgagcggccaaatttcctcggaattcgagagcaaagactgacaggactcgtcgtgttcatcctgacaggcgctagtatttttctggctcctgtgctgaagttcatacccatgcccgttctctacggcatatttttgtacatgggcgtggccgctctttcatcaatccagtttactaacagagtcaaacttctcttgatgccagccaagcaccagcccgaccttctgctacttagacatgtgccccttacccgcgtgcacctgttcacggccatccaactagcctgtctcgggctcctgtggatcatcaagtccacccccgctgccattatctttcctttaatgctccttggactggtgggtgtacggaaggcactggaacgtgtattttccccccaggaactgctctggttggacgagctcatgcccgaagaagagcgctcaatccccgagaagggcttggagcctgaacactcttttagtggcagcgattcagaggatagtgaattgatgtaccagcctaaggccccggagatcaatataagtgtcaactag

SEQ ID NO: 46321 - DNA, 2880 bp, Artificial Sequence
  Description of Artificial Sequence: Synthetic coding sequence
atggagatgaagctgcccggccaggagggcttcgaggccagcagcgcaccgaggaacatcccctcaggagagttagattccaacccagaccctggcaccgggccttcacccgatggcccaagcgatacagagtctaaggagcttggggtgcccaaggatcctctgctttttatccaactgaacgagcttctcggctggccccaggctttggaatggagagagaccggtaggtgggttctttttgaagagaaactggaggttgcagcaggtcgctggtctgcgccacacgtgcccaccctggccctacccagcctccaaaaactgcggagcttactggccgaagggcttgtactgttggattgccccgcacagtcattacttgagctagttgaacaggtgaccagagtggaaagccttagcccagagctgcgggggcaactgcaggccctgctcctccaacgaccacagcactacaaccagacaacagggacccggccgtgctggggatctactcaccccaggaaggcctccgacaacgaagaagcaccactgcgtgagcaatgccagaaccccctgcggcagaaactcccccctggagcggaagctgggaccgtgctagccggcgaattgggctttctcgcacagccccttggagccttcgtcaggctgaggaatccagtcgtgctaggtagtctaacagaagtgagtctgccctctagattcttttgccttctgttagggccctgcatgctgggcaaaggttaccatgagatgggccgtgctgcagccgtcctcctaagcgatccacagttccagtggtccgtgcgtcgggcgtctaatctccatgacttgctagcagcccttgacgcctttttggaggaagtcacggtccttccccccggtagatgggaccccaccgcccgtatcccccctccaaagtgtctgccatcccaacataagcgcttaccttcccagcagcgggagataaggggcccagctgtccctcgattgacctccgcagaagaccggcaccgccacggcccacacgcacattctcccgaactccagcgcactggcaggctgtttggagggttgattcaagatgttcggaggaaggttccttggtacccatccgactttctggacgctttgcatcttcagtgtttctccgccgtcctttatatttatctggctaccgtgactaacgctatcactttcggcggactcctcggagatgccactgacggcgcccagggcgtgctggagtcttttttggggactgctgtagcaggcgctgctttctgtctaatggcaggccagcccctgacaatcctgtcaagcacaggacccgttctcgtcttcgagcggctgctcttttccttttctagagattattccttggactatttaccttttcggctgtgggtcgggatatgggtggcaacgttctgcttggtattggtggcgaccgaggcatcggttctcgtaaggtatttcactcgcttcactgaggagggtttttgcgccctgataagcctcatttttatctacgacgccgtgggcaaaatgctgaacctgacgcatacgtatcccatacaaaaacctggctcgtcagcatacgggtgtctatgccagtaccccggcccaggcggaaacgagagtcagtggattcgaactcgacccaaggatagagatgatattgtgtctatggaccttggactgattaatgcgagcctgctcccccctcctgagtgtacccgccagggcggccacccccggggccctggctgccacaccgtgccagacattgctttcttctctctgctcttattcctaacaagtttcttttttgcaatggctttgaaatgtgtcaagacgtccaggttttttccttccgtcgtgaggaagggcctgtcagactttagcagcgtgttagccatactgctcggctgcggcctcgacgcctttctcgggctcgccacaccgaaattaatggttcctcgagagttcaagcccaccctgccaggcaggggctggctagtgtcccccttcggcgcgaacccatggtggtggtctgtggcagcagctctacctgcattgttactgtctattctgattttcatggaccagcagattaccgccgtgatcctgaacaggatggaatacaggttacagaagggggctggtttccacttggatctgttttgcgtggcagtgctcatgctgcttacttcagcattagggctgccgtggtatgtaagtgctaccgttatttccctggcccacatggattccctgaggcgggaaagtagggcctgcgctcctggcgagaggcccaattttctgggaatcagggagcagcgactcacaggcctggtcgtgtttatcttgacaggcgctagcatatttctggcaccagtgttaaaatttatcccaatgcctgtactctacggaatcttcttgtacatgggtgtggccgcgctgtcctctattcagttcacaaacagagtcaagttgctgctgatgcccgccaagcatcagcccgatctcttactcctgaggcacgttccacttacgcgggtccatctgttcaccgctatccagcttgcctgccttggactgctgtggattatcaaaagtacaccagctgcaattatcttccctctcatgcttttagggctggtgggcgtcagaaaagccctggaacgggtgttttcacctcaggaactcctgtggctcgacgagctgatgcccgaagaggaaagaagcatccccgaaaaaggcctagagccagaacattcttttagcggatccgactcggaggactccgaattaatgtatcagcctaaagcaccagagattaacatcagtgttaattag

SEQ ID NO: 46322 - DNA, 2952 bp, Artificial Sequence
  Description of Artificial Sequence: Synthetic coding sequence
atggagatgaagctgcccggccaggagggcttcgaggccagcagcgctcctcggaatatcccctcaggagaactggatagcaaccccgacccaggcactggcccttcgccagacggcccctctgacactgagtcaaaggagttaggtgtgcctaaggatcccctgctgtttattcagctcaacgagctgctcggctggccccaggccttagaatggagggaaacagggtctagctccgcaagcctgctactcgacatgggagaaatgccaagcatcactctaagcactcatctgcaccaccggtgggtcctctttgaggagaaacttgaggttgccgccggaaggtggtccgccccacatgtgccgaccctggccctgccttcccttcagaagctgagaagcctgcttgctgagggccttgtgctcttggattgtcccgcccagtcccttctagagcttgttgaacaggtgaccagggtcgagagcctgagcccagagcttcgtgggcagctccaggccctgctcctacaacgtccccagcactacaaccagactaccgggacgagaccgtgttgggggagtactcaccccaggaaggcatcagacaacgaggaggcgcccctgagggaacagtgccagaatccactgcgccagaagctgccccctggggctgaagccggaactgtactggcaggggagttaggcttcctagctcaaccactgggagcctttgtcagactccgtaacccagtggtcctcggctcattaaccgaagtttcattgccaagccgctttttttgcctcctgcttgggccctgtatgctgggcaaaggataccatgagatgggcagggcggctgctgtgttgctaagcgatcctcagttccagtggtctgtgcgaagggcctccaatctccatgacctgctggccgctctggatgcctttctggaagaagtgacggtactgccacccggacggtgggatccgacagcccggatccctccccccaagtgcctcccctcccagcataaacgtctgccctctcagcagcgggaaatcagaggccccgcagtacccaggttgacctcagcagaggatcgccaccggcacggaccccacgcccacagcccagaattgcagcgaaccggtagactcttcggagggttaatacaggacgtccggcggaaggttccctggtacccaagtgacttcctggacgctttacatttacaatgtttttctgcagtcctatatatttacttggccaccgtcaccaacgctatcaccttcggcggtctactcggagatgctactgacggcgctcagggcgtgctggagtccttcctcggaaccgctgttgcgggtgccgccttctgtctgatggccggacagccattgaccattctctcaagtactggaccagttctcgtcttcgagcggctcctctttagcttttcccgtgattattctctggactacctgccgttccgcctttgggtggggatttgggtagctactttctgtctggtgttagtggcgacagaagcttccgtactcgttcggtattttacacggtttacggaggagggtttttgcgcgctgatttctttgatctttatttacgatgctgtgggaaaaatgttgaacctaactcatacttaccccattcagaaacctggctctagtgcatatggctgcctgtgccaatatcctggacccggtggtaatgagagccaatggatcagaacaagaccgaaggacagggacgatatcgtttccatggatctgggcttgatcaacgcttcactgctccctccgcccgagtgcacccgtcaaggcggtcaccctaggggtccaggctgccacacagtgcccgatattgcctttttttctctgcttttattcctgacctctttcttctttgctatggctctgaagtgtgtgaagacatctcggttcttcccgtctgttgtgagaaaaggcctgagcgatttcagttccgtgctggcaattttactcggttgtgggctggacgcctttctgggcttggccacccccaagctgatggttcccagagagttcaaacctacactgcccggcagaggatggctggtctcaccctttggtgccaacccttggtggtggagcgttgctgctgcactgcccgctcttttgctgtcaatactgatctttatggaccagcagattacggccgtaatcctgaatcgcatggagtaccgcctgcagaagggagccgggttccatctcgacctgttttgtgttgcagtactgatgctcctgacctctgctctggggctcccttggtacgtgagcgccaccgtgatttccttagctcacatggactctctgaggagggagagtcgagcttgtgcacctggtgagagacccaactttctggggatcagagagcagcgtctaacagggcttgttgtgttcattctcactggcgcctccatttttctcgcgcctgtcctgaaatttatcccaatgcctgtgctgtacgggatcttcctgtatatgggcgtggcagccttatcttccattcaattcaccaaccgcgtgaaattgcttcttatgccggcgaagcaccagcccgacctcctgctactcaggcacgtgccccttacacgggttcatttgttcactgccatccagctcgcatgtctgggactactctggatcattaagtccacgcctgcagccatcatctttccactgatgctcctgggccttgtgggcgtgagaaaggcactcgagcgtgttttctccccccaggaacttctgtggctggacgagctgatgcccgaggaggagagatcaatcccagaaaagggattggagccagagcattcgttctctggatccgatagtgaagacagcgagctaatgtatcagccaaaggcaccagagatcaacattagtgtcaactag

SEQ ID NO: 46323 - DNA, 1476 bp, Artificial Sequence
  Description of Artificial Sequence: Synthetic coding sequence
atggccggccagggcctgcccctgcacgtggccaccctgctgaccggactactggaatgcctgggtttcgcaggagtgcttttcgggtggccctcgttggtgtttgtttttaaaaacgaagattactttaaggatttatgtgggcctgacgccggccccattggcaacgctacaggtcaggccgactgcaaggcacaggacgagcggttttctttgatatttacgctgggaagtttcatgaataacttcatgacatttcccaccggctatattttcgatagattcaaaaccaccgtcgctaggctgatcgcgatttttttctacacgaccgccacactcataatagcatttacctcagctggatccgccgtgcttctgtttctcgccatgcctatgcttacaatcgggggtatattatttctcataacaaatctgcaaatcggcaacttgtttggccaacaccgatctacaatcattacactgtacaacggagctttcgactcctcttctgccgtcttcttgatcattaaactgctgtatgagaaggggattagcctccgagcatcctttatctttatctctgtttgctccacgtggcatgtcgcacgtacattcctgttgatgccgcgaggtcacataccttaccctctaccacccaactactcgtatggtctttgtccgggaaacggaacaacaaaggaggagaaagaaacagccgaacatgaaaatcgtgagctgcagagcaaagaattcttatccgcaaaggaggagactcccggcgccggtcaaaaacaggaactccgctccttctggtcatacgcattctcaagaaggttcgcttggcacctcgtgtggctttccgtgattcaactgtggcactacctgtttatcgggaccttgaattctctactgacaaatatggcgggcggagatatggctagggtgtcaacctacactaatgcttttgcctttacacagtttggcgtactgtgcgccccctggaacggtctacttatggatagactgaaacaaaagtatcagaaggaggctcggaagaccggaagcagtacgcttgccgtcgctttgtgcagcacagtgccgtctttggctctgacttccctactgtgtctgggcttcgcgctgtgcgcatccgtacccatcttaccactacagtacctcaccttcatcctgcaggtcatcagccgctcgtttctgtacggctccaacgcagctttcctgacactcgccttccccagcgaacactttggaaaactcttcgggctcgttatggcactcagcgcggtcgtgtccctgctacaatttccgatatttacgttaattaaaggctccctccagaacgacccattttatgtgaatgtgatgtttatgttggcaattttgctaactttctttcaccctttcctcgtttaccgagaatgccgtacttggaaagagtctccttcggccatcgcctag

SEQ ID NO: 46324 - DNA, 1476 bp, Artificial Sequence
  Description of Artificial Sequence: Synthetic coding sequence
atggccggccagggcctgcccctgcacgtggccaccctgctgaccgggttgctcgagtgtctgggcttcgccggcgttctttttggttggcctagcctggtgttcgtcttcaagaacgaggactatttcaaggatttgtgtgggcccgacgctggcccaatcgggaacgcgaccggtcaggctgattgtaaggcacaagacgaaaggttcagcctaatctttactcttggcagctttatgaacaactttatgacttttcctacaggctatatttttgatcgattcaaaacgactgtcgctcgccttatagccatcttcttttatacaaccgctactctgatcattgccttcacatcagccgggagcgctgttctgttgttcctggctatgcctatgctcacgataggtggtatcttgtttctcattacaaatctgcagatcggtaacctgtttgggcagcatcggagcacaattattacgttgtacaacggcgcctttgattcctcgtcggctgtgtttctcattatcaagctgctctatgaaaagggcatctcgcttagggcgtcgttcatctttattagcgtctgtagtacatggcacgttgcccggactttcctgctcatgccaaggggtcacattccctatcctctacctcccaattattcctacggcctgtgcccgggtaatggcaccacaaaggaggagaaggaaaccgcagagcacgagaacagagagctccaatctaaggagtttctgtcggccaaggaagaaacgccgggagctgggcagaaacaggagctccgttcgttttggtcttatgccttcagccgcaggtttgcatggcacctggtttggctgtctgttatacaactctggcactacctgttcatcggaacactaaattctctgctaacaaacatggcggggggggatatggcccgcgtcagcacatataccaacgcctttgctttcacccagttcggagtgctttgcgctccctggaatggccttttgatggaccgcctgaaacagaaatatcagaaagaggcacggaaaacagggtcatcgacgctggcagtggctctatgtagtactgtgccatctctggcccttacgagcctcttgtgtttgggctttgccctgtgtgcctctgtaccaatcttgccgctacagtacttaacgttcatccttcaagtgatcagccgaagtttcctctacggttccaacgctgcctttcttacccttgccttcccttcagagcattttggtaagctctttgggctcgtaatggcactctcagctgtcgtctccctgctgcagttcccaatattcacgctgattaaggggtctttacagaatgacccgttctacgtcaatgtgatgtttatgctcgccatcctgctcacttttttccatccattcctcgtttaccgtgagtgccgtacgtggaaagagagcccctcggctatagcttag

SEQ ID NO: 46325 - DNA, 1476 bp, Artificial Sequence
  Description of Artificial Sequence: Synthetic coding sequence
atggccggccagggcctgcccctgcacgtggccaccctgctgaccggactgcttgagtgcttaggcttcgcaggagttctattcgggtggccatctctggtgttcgtgttcaaaaatgaggattacttcaaagatctgtgtggtcccgacgcaggccctattgggaacgccacaggtcaagcagactgcaaggcccaagacgagcgcttttcccttatctttacactgggatccttcatgaataactttatgacatttccgactgggtatatatttgaccggtttaaaaccacagtcgctagacttattgctatcttcttctacactaccgccacactgattattgccttcacctccgcaggctcggcagtgctcctctttttggccatgccaatgctaaccatcggagggatcttattcctgatcaccaatcttcagatcgggaatttgttcggacagcaccgctctaccattataactttatataacggcgcctttgattcctcttccgccgtttttctcattatcaagctcctgtatgaaaaaggcatttccctgagagcctcctttattttcattagcgtctgcagcacatggcatgtagcaaggacattcttgctgatgcctcggggacacatcccgtatccactgccgcccaattacagttacggcttatgcccaggtaacgggacaaccaaggaagagaaggaaaccgcagaacatgaaaaccgagagctgcaatcgaaagagtttttatcggctaaagaagagaccccaggagccggccagaagcaggaactgcggtctttctggtcgtacgcattcagtcggcggtttgcctggcacctggtttggctttcggtcattcaattgtggcattacctctttataggtacgctgaacagcctactgaccaacatggctggaggggatatggcaagagtctcaacctatacaaacgcctttgccttcacacaattcggggttctttgtgccccctggaacggcctgctgatggacaggctgaaacagaagtatcagaaggaggctcgaaaaacaggttctagcacactggccgtcgccctgtgttccaccgtgccatctctcgctctcacttcgctgctatgcctcggtttcgcactctgcgctagcgtgccaattttgcccttacaatacctcacttttatacttcaggtgataagcagaagtttcctctatggctcaaatgcagcgttcttgactcttgctttcccttctgaacacttcgggaagctgtttggattggtaatggctttgtctgctgttgtgagcctcctccaattcccaatcttcaccctcatcaaaggctcactgcagaacgatccattttacgtgaacgtaatgttcatgctggccatactactaacattctttcatccttttcttgtgtatcgtgaatgtcggacctggaaagaaagtcctagtgcgatagcttag

SEQ ID NO: 46326 - DNA, 309 bp, Artificial Sequence
  Description of Artificial Sequence: Synthetic coding sequence
atggccggccagggcctgcccctgcacgtggccaccctgctgaccgggttactggagtgcctgggatttgccggggtgctctttgggtggccttccctggtattcgttttcaagaatgaagattactttaaggacctgtgtggccccgacgccggcccaatcggcaacgctacaggccaggctgactgtaaagcacaagatgaaagatttagcctcatcttcactctcggctctttcatgaacaatttcatgacatttcctacaggttatattttcgatagattcaaaaccactgtagctcgcctgtag

SEQ ID NO: 46327 - DNA, 510 bp, Artificial Sequence
  Description of Artificial Sequence: Synthetic coding sequence
atggccggccagggcctgcccctgcacgtggccaccctgctgaccgggttgttagaatgtttggggtttgctggagtcttattcgggtggccatctttagtgttcgtttttaaaaatgaggattactttaaggacttgtgtggcccggacgccggccccatcgggaacgctacaggacaggccgattgcaaggctcaggacgaacgattttccctaatttttacactgggttcctttatgaataactttatgacctttcccaccggctatatttttgatcgatttaaaacaaccgttgcgcggctgattgccattttcttctacaccaccgctacgcttataatcgctttcacatcagccggctctgccgtactcctcttcttagccatgcccatgctgaccatcggtggaattttgtttcttataaccaatctacagatcggtaatctttttggacagcataggtcaaccattatcaccctatacaatggggcattcgactctagttag

SEQ ID NO: 46328 - DNA, 195 bp, Artificial Sequence
  Description of Artificial Sequence: Synthetic coding sequence
atggccggccagggcctgcccctgcacgtggccaccctgctgaccggccttttagagtgtctgggcttcgctggggttctattcggttggccgtccttagtgtttgtgtttaaaaacgaggactacttcaaggatctgtgcgggcctgatgccggtcctatagggaatgctacggggcaggctggccggttgtag

SEQ ID NO: 46329 - DNA, 447 bp, Artificial Sequence
  Description of Artificial Sequence: Synthetic coding sequence
atggccggccagggcctgcccctgcacgtggccaccctgctgaccggcttgctggagtgccttgggttcgcaggagtgctgttcgggtggccgtcgcttgtcttcgtctttaaaaacgaggactattttaaagatctgtgtggtccagacgcaggacctattgggaacgccactggccaggctgattgcaaggcccaggatgagcgctttagtttgatttttacactgggtagctttatgaacaatttcatgacatttcctactggctatatatttgaccgctttaagacgactgttgctcgcctgatcgctatctttttttataccacagctacactgatcatcgcatttaccagcgcaggctccgccgttctcctattcctcgccatgcccatgctgacgatcggtggaattctcttccttatcactaatctccaaattggctag

SEQ ID NO: 46330 - DNA, 360 bp, Artificial Sequence
  Description of Artificial Sequence: Synthetic coding sequence
atggccggccagggcctgcccctgcacgtggccaccctgctgaccggccttctcgagtgcctcggatttgcgggagtgctctttggctggcccagcctggtttttgtttttaagaacgaggattactttaaggacctgtgcgggccagacgccggacccattggcaatgcgactggccaggctgactgcaaggcccaggatgaaagattctcccttatcttcacactggggagtttcatgaacaatttcatgacatttcctacggggtacatatttgaccggttcaagacaaccgtcgctcgattgattgccatcttcttctatacaactgccaccctaataatagcattcacatcgtag

SEQ ID NO: 46331 - DNA, 1476 bp, Artificial Sequence
  Description of Artificial Sequence: Synthetic coding sequence
atggccggccagggcctgcccctgcacgtggccaccctgctgaccggcctactcgagtgcctcggttttgctggggttctgttcggttggccttcattagtcttcgtctttaaaaatgaagactacttcaaagacctgtgcggccccgatgccggacctataggaaatgcaacaggccaagctgactgtaaggctcaggatgagcgcttctcccttatcttcactttaggtagctttatgaacaacttcatgacgttcccaacaggctatattttcgacagattcaaaaccacagtcgcgcggttaatcgccattttcttctataccacagccacgctgatcatcgctttcacctcagccggaagtgctgtactcttattcctagctatgccaatgcttaccatcggaggaatcctgttccttattactaatcttcagattggaaatctgttcggacagcacaggtctaccatcattaccctgtacaatggagccttcgattcttctagtgctgtgttcctgatcatcaaattgttgtacgaaaaaggtatctcccttcgcgccagcttcatttttataagcgtttgttctacttggcatgttgccagaacttttctcttgatgccgagaggtcacatcccatatccattgcctccaaactatagttatgggctttgtcccggcaatgggacaacaaaggaagaaaaagagacagctgaacacgagaatagggagcttcagtcaaaagaattcctttcagccaaagaggagacgcccggggccggacagaagcaagagctgcgatctttttggtcttacgcattcagcaggcggtttgcctggcatcttgtatggctttccgtgatacaactttggcattacctgtttatcggcactttgaactctctgcttacaaacatggccggtggcgacatggccagagtttcgacctacacaaacgcctttgccttcacacagttcggggtgttgtgcgccccctggaatggtctcctgatggacaggttgaaacagaaatatcaaaaagaggctagaaaaactggatccagcaccctcgccgtcgctctttgttctacagtgccatctctggctctgacatcactgctctgcctgggatttgcactttgtgccagcgtgcctatcttgccgttgcagtatctaacctttatcttacaggtgatctcacggtctttcctgtacggcagcaatgcagctttcttgacgctggcctttccgtctgagcattttgggaaactctttggactggttatggccctgtccgcggtggtgagtctccttcagttccccatttttactttgattaaaggtagtctgcagaatgaccccttttacgttaacgtgatgtttatgttggccattctgctcacattcttccaccctttcttggtttacagagaatgtcgtacctggaaggaaagcccatctgcaattgcctag

SEQ ID NO: 46332 - DNA, 69 bp, Artificial Sequence
  Description of Artificial Sequence: Synthetic coding sequence
atggccggccagggcctgcccctgcacgtggccaccctgctgaccggtctcttagagtgcctggggtag

SEQ ID NO: 46333 - DNA, 996 bp, Artificial Sequence
  Description of Artificial Sequence: Synthetic coding sequence
atggccggccagggcctgcccctgcacgtggccaccctgctgaccggactgctggaatgccttggatttgccggggttctgtttggatggccaagtctcgtcttcgtgtttaaaaacgaggactacttcaaggatctgtgtggccccgacgctggacctatcggcaacgcgacaggtcaggctgactgtaaagcacaggacgagaggttcagcctcatttttaccctggggtcctttatgaataacttcatgacattccctaccgggtacatcttcgataggtttaagacgaccgtggctagactaatcgccattttcttttacactaccgccactttgataatcgcgttcactagtgccgggagcgccgtcctgttatttctggccatgcccatgttgacgatcgggggtatcctcttcctgatcaccaatctgcaaatcggtaacctgttcgggcagcatcgctcaacaatcattaccctctataacggcgcattcgattctagttcagccgtattcctgattattaaactcctgtacgagaagggaatcagtctccgcgcttcgttcatattcatttccgtgtgctctacctggcacgtcgctagaacatttctgctgatgccacggggtcatatcccctatccactccctcctaattacagctatgggctgtgccccggaaacgggacgaccaaagaagagaaggaaaccgccgagcatgaaaatcgggaactgcagtctaaggaattcctgtcagccaaggaggagaccccaggcgctggccagaagcaggagcttagatccttctggagctacgcattctctcgccggttcgcttggcatcttgtttggttaagcgttatacagctgtggcattatctgtttattggtacactcaacagccttctgaccaatatggccgggggagacatggctcgggtgtctacatatacaaatgcgtttgcatttacccagtttggtgtcctgtgctag

SEQ ID NO: 46334 - DNA, 135 bp, Artificial Sequence
  Description of Artificial Sequence: Synthetic coding sequence
atggccggccagggcctgcccctgcacgtggccaccctgctgaccggactgctggaatgtttaggctttgcaggggtccttttcggctggccttccctggtgttcgtctttaagaacgaagattatttcaagtag

SEQ ID NO: 46335 - DNA, 9 bp, Artificial Sequence
  Description of Artificial Sequence: Synthetic coding sequence
atggcctag

SEQ ID NO: 46336 - DNA, 297 bp, Artificial Sequence
  Description of Artificial Sequence: Synthetic coding sequence
atggccggccagggcctgcccctgcacgtggccaccctgctgaccggcctgctggagtgtctgggattcgccggcgtgctcttcggctggccttcgctcgtgttcgtatttaaaaatgaagactattttaaagatctctgcgggcccgacgctggacccatcgggaacgcaacgggccaagccgattgcaaagcccaggacgagcgcttctctcttatcttcacgcttggcagcttcatgaacaatttcatgactttcccaaccggttatatctttgacaggtttaagacaacctag

SEQ ID NO: 46337 - DNA, 237 bp, Artificial Sequence
  Description of Artificial Sequence: Synthetic coding sequence
atggccggccagggcctgcccctgcacgtggccaccctgctgaccgggctcctggaatgcctgggttttgcaggcgtacttttcgggtggccaagtcttgtgttcgttttcaaaaatgaggattactttaaagatctgtgcggccccgatgcaggacctattgggaacgccacaggacaggctgactgcaaagcccaggacgagcgctttagtctgatttttacactggggtcatag

SEQ ID NO: 46338 - DNA, 324 bp, Artificial Sequence
  Description of Artificial Sequence: Synthetic coding sequence
atggccggccagggcctgcccctgcacgtggccaccctgctgaccgggctcctcgaatgcctcggatttgcaggcgtgctcttcggttggccatcgctcgttttcgtctttaaaaatgaagactacttcaaggatttgtgtggacccgatgccgggcccatcgggaatgccacaggacaagccgactgcaaagcccaagatgaacgattttcacttatctttacgctgggctctttcatgaataacttcatgacctttcccaccggctacattttcgatagatttaagacaaccgttgcacggctcatcgctattttcttctag

SEQ ID NO: 46339 - DNA, 333 bp, Artificial Sequence
  Description of Artificial Sequence: Synthetic coding sequence
atggccggccagggcctgcccctgcacgtggccaccctgctgaccggccttctcgaatgtctaggcttcgccggcgtgctgtttggttggccttccctcgtcttcgtgttcaaaaacgaagactatttcaaagacctctgcggccctgatgcaggacctatcggcaacgccacgggccaggccgactgcaaggctcaagatgaacgcttttctttaattttcactctcggtagcttcatgaacaatttcatgaccttcccaactggctatatcttcgatcgtttcaagacgacagtggcgagactcatagccatcttcttctacaccacttag

SEQ ID NO: 46340 - DNA, 1758 bp, Artificial Sequence
  Description of Artificial Sequence: Synthetic coding sequence
atgcactgcctgggcgccgagtacctggtgttcatcatgggctactctgtggtggccggggccgcaggacgcctccttttcggctatgactcattcggcaacatgtgcgggaaaaagaatagtccagtggaaggtgctccacttagcggccaggatatgaccttgaagaagcacgtttttttcatgaactcctgcaacctggaggttaaaggatcgttcctgtgcgtctattcccttaattctttcaattacactcactcccctaaggctgacagcctatgtccgagactgcccgtcccaccaagtaagtcttttccactgtttaaccggtgtgtgccacagacccctgagtgttatagcctcttcgcctccgttctgatcaatgacgtggacacactgcaccgcatcctcagtggaataatgtcaggtagagacactattttgggcctttgcattctggcgctcgctctatcactagccatgatgtttacatttcggtttatcactacactacttgttcatatcttcatctccctggtgatactgggcttgttattcgtgtgtggtgttctttggtggctctactatgattacacaaacgatctgagtatcgaactggacaccgaaagagaaaacatgaagtgcgtgttggggtttgccattgtctcaaccggaattacagcggtgttattggtgctcatcttcgtcctgaggaagcggatcaagttgacagtggagctgtttcagatcaccaataaagccatttcttccgctcctttcttgctgttccagcccctgtggaccttcgccattctgatttttttttgggtgctgtgggtggctgtgctgcttagcctgggcactgctggggcggcacaggttatggaagggggccaggtggaatacaagccactgtccggcattcgatacatgtggtcctatcatctgatcggactgatctggacttcggagtttatattggcatgccagcagatgactatcgcaggagccgtagtaacatgctactttaatcgatccaaaaatgatcctccagatcaccccatcctgtccagtctgtccattttgttcttttaccaccagggcaccgtggtgaaaggcagctttctgatctctgtggtgcgcatcccgcgcattatcgtgatgtatatgcagaacgcactgaaagagcagcagcatggtgcgttgtcacgctaccttttccgctgttgttattgttgtttctggtgcttggacaagtatctgcttcatctgaaccagaatgcctatacaacaacggccattaatggcacagacttctgcacatcagccaaggatgcctttaagatcctgtcaaaaaactcttcccacttcactagcataaactgtttcggcgactttataatcttcctgggtaaagtcctcgtggtgtgtttcacagtctttggcggtctcatggctttcaactacaatcgcgcttttcaggtatgggctgtacctcttcttttggttgctttttttgcatacctcgtggcccactcttttctttcagtgttcgaaaccgtcttagacgccctattcttgtgtttcgcggtcgacctggaaacaaacgacgggagctccgagaagccatatttcatggaccaggagttcctcagctttgtcaagcggtctaacaagctcaacaacgcaagggctcagcaggataaacactctttgagaaatgaggaggggactgagttacaggccatcgtccggtag

SEQ ID NO: 46341 - DNA, 1863 bp, Artificial Sequence
  Description of Artificial Sequence: Synthetic coding sequence
atgcactgcctgggcgccgagtacctggtgagcgccgagggcgcccccaggcagagagaatggcggccgcaaatttatcggaagtgcaccgacactgcatggctcttcctcttttttctgttctggaccggccttgtctttattatgggctactccgtggtggccggggcagcgggcagactgctctttggctacgattcttttggaaatatgtgcggcaagaaaaacagccccgtcgaaggcgctccgctctcggggcaagacatgacacttaagaagcacgtattctttatgaactcttgcaaccttgaggtcaaaggctcattcctctgtgtgtacagcctcaatagctttaattatacacactccccaaaggctgactccctgtgcccaagactaccagtcccacctagcaaatcattccctctgttcaaccgttgcgtgccgcagacaccagagtgttactctctttttgcttccgtcctcatcaacgacgtggacactctgcatcggatcctttctgggatcatgtccgggagagacacgatcctgggtctgtgcattcttgctttagctctgagcttggccatgatgtttaccttccggtttatcactaccctgctggtacacatcttcatatcactcgttattctggggctgctgttcgtgtgtggagttctctggtggctgtactatgattacacaaacgatttgagtatcgaattggacacggagcgcgagaatatgaagtgcgtgctaggattcgctattgtgagtaccggcatcacggctgtgctgctggtgctcatctttgtactacgtaagaggatcaagttgactgtggaactttttcagatcactaataaggctatatcttctgctccctttctgctatttcaaccgctgtggacatttgcaatcctgatttttttttgggttttgtgggtggcggtgctcctgtctctgggaaccgcgggggccgcccaggtaatggaaggcgggcaggtggagtataaaccgctgtccggtataagatatatgtggtcgtaccacctgattgggttaatctggacctctgagttcatactagcctgccagcagatgacaatcgctggcgcagtggtgacctgttacttcaatcgcagcaagaatgatcctcctgaccaccccatcctgtcctctttgagcattttgttcttttaccatcaaggaaccgttgtcaaaggcagcttcttaatctcagtcgtcagaatccctaggatcattgtcatgtatatgcagaacgcccttaaagagcagcatggcgccctgtccagatatctgtttagatgctgctactgttgcttctggtgccttgacaagtacttactgcacctcaaccaaaatgcttacacaacaacagcaataaatggcaccgatttctgtacctcagccaaggacgcgtttaaaatcctgtcaaagaattcaagccattttacatcaatcaattgcttcggcgactttatcatttttcttggaaaggtactggtagtttgttttactgtgtttggagggctgatggcctttaactacaatcgtgccttccaggtctgggccgtgcccctcctgctggttgcctttttcgcatacctggtggcccactcttttttgtcagttttcgaaaccgttttagacgccctcttcttgtgcttcgcggtggatctggagaccaatgatggtagctctgaaaaaccctattttatggatcaggaatttctctcctttgtaaagcgcagtaacaaacttaataatgccagagcacagcaggataaacactcactccgcaacgaagaggggacagagttgcaggccattgtgagatag

SEQ ID NO: 46342 - DNA, 1962 bp, Artificial Sequence
  Description of Artificial Sequence: Synthetic coding sequence
atgcactgcctgggcgccgagtacctggtgagcgccgagggcgccccacgccagagggaatggcggccgcagatctaccggaagtgcaccgacactgcttggctatttttgttttttctcttctggacgggattggttttcattatgggctattccgtggtggccggtgccgcaggacgccttctgtttggatacgatagttttggcaacatgtgcggaaagaagaacagccccgttgaaggcgcgcctctctctggacaagatatgactctgaagaagcatgtgtttttcatgaattcgtgtaatctggaggtgaaaggcacacagctgaaccgaatggcattatgtgtgtcaaattgccctgaggagcaactggattccttggaagaggtccaatttttcgccaataccagcgggtcattcttgtgtgtctatagtttgaattccttcaactacactcactctcccaaggccgactctctctgccccagactgcctgtgcctccatcgaagagctttcctttatttaatagatgtgtgccccagacccccgagtgttatagtctgtttgcctcagtgctcattaacgatgtcgatacccttcacaggatcctcagtggcatcatgtccggccgggacacaatactgggactctgcattctagcgctcgccctttcattggcaatgatgttcacgtttcgcttcataaccacactcctggttcacatctttatcagcctggtgattcttggactcctattcgtgtgcggtgtgttatggtggctgtactacgattacactaacgacctcagtatagagctagacactgagcgtgagaacatgaagtgcgttttagggttcgccattgtgtccaccggcattacagcagtgctgttggttctcattttcgtccttaggaaaagaataaagctgacagttgagctgtttcaaattactaacaaagctatcagtagtgcccctttcttgctcttccagcctttgtggacatttgcaattctcatctttttttgggtcttgtgggtcgctgtacttctgtcgctgggaacagcgggagctgctcaggtgatggagggtggccaggttgagtacaagcccctgagtgggatcagatatatgtggtcctaccatttaattggcctgatatggacctccgagtttattctggcttgccagcaaatgacaatcgccggtgcagtggtcacgtgctattttaataggagcaaaaacgacccaccggatcatcccatcctgagttccttgagtatccttttcttctaccaccaaggtaccgtggtgaaaggaagttttctgatcagtgtcgtgagaattccacggattatcgtcatgtacatgcaaaatgccctgaaagagcagcagcatggagcattgagtcggtatctctttagatgctgctactgttgcttttggtgcctggataaatacctgcttcacttgaatcagaacgcctacacgaccacagccattaatggaacggatttttgtacttccgccaaagatgcattcaaaatcttatctaaaaacagctctcacttcacctcaatcaactgttttggcgactttattatcttcttaggtaaagttcttgtggtctgctttactgtgtttggtgggctgatggcatttaactataatagggcttttcaggtgtgggctgtgcctctgctcttagtggccttttttgcctatctggtggcgcactcttttttgtcggtgttcgagaccgtcctggacgctctcttcctgtgcttcgccgtggacctcgaaactaacgatgggtcctccgagaaaccatatttcatggatcaggagtttctctccttcgtgaaaaggtccaataagctaaataacgccagggcccagcaagacaagcacagtctgcggaacgaagaaggaaccgagctccaggccatcgtgagatag

SEQ ID NO: 46343 - DNA, 492 bp, Artificial Sequence
  Description of Artificial Sequence: Synthetic coding sequence
atgggctacagcgtggtggccggcgccgccggccggctgctgttcggctacgactcattcggcaatatgtgcggaaaaaagaacagtccggtggaaggcgctccactaagtggacaagacatgaccctcaaaaagcacgtgtttttcatgaattcctgtaatctggaagtaaaaggcacccagctgaatcgaatggcactctgtgtgagtaactgtcctgaagagcagctggactcattggaggaggtgcagttctttgctaatacaagcgggagtttcttatgcgtgtactccctgaactccttcaactatactcattccccgaaggctgattctttatgtcctcgcttaccagtacctccgagcaagtctttccctctgttcaaccgatgtgtgcctcagacacctgagtgttattctctgttcgcttctgtcctgattaacgatgtcgacacccttcatcgaatcctgtctggcattatgagcgggtag

SEQ ID NO: 46344 - DNA, 1854 bp, Artificial Sequence
  Description of Artificial Sequence: Synthetic coding sequence
atgcactgcctgggcgccgagtacctggtgttcatcatgggctactctgtggtcgcgggtgctgcagggcgcctgctcttcggctatgatagcttcggaaacatgtgtggcaagaagaacagcccggtggagggagcccctctgagtggacaggatatgaccctaaaaaagcacgtgtttttcatgaactcatgcaacctggaggtaaagggtacacaacttaatagaatggccctgtgtgtttccaattgccctgaagaacagctcgacagtttggaagaggtccaattctttgcaaataccagtggatcttttctctgtgtttatagtttgaacagtttcaattatactcactccccaaaggctgactcactgtgtccccggttaccagtgcctccatcaaaaagctttccactgtttaatagatgtgttcctcagactcccgaatgctattccctctttgcctccgtactaattaacgatgttgatacattgcacaggatcttaagtggcatcatgtccggccgagatacgattctggggctctgtattctggccttagcactctccctggccatgatgttcacctttcggtttataacaacactgctggttcacattttcattagtttggtcatcttaggtttactgtttgtgtgcggtgtgctgtggtggctttattatgactacactaatgacctaagtatcgaactcgataccgagcgagaaaacatgaagtgcgtactgggatttgccatcgtgtccactgggattaccgcagtccttctggtgctcatcttcgtgttgcgtaagagaatcaaactgaccgtggagttattccagataacgaataaggccatttctagcgcccccttcctattgtttcagccattgtggacctttgctattctaatttttttttgggtgctttgggtcgccgtgcttttgagtctggggacagccggcgccgctcaggtgatggaagggggtcaagtggaatacaaacctctttcgggaattagatatatgtggtcctatcatctcatcgggctgatctggaccagcgagtttatactggcgtgccaacagatgaccatcgccggtgctgtggtgacctgctatttcaatcgtagtaaaaatgatcctcccgaccacccaatactcagttccctgtcaattctgttcttctaccaccaaggcaccgttgttaaggggagcttcctgatttccgtggtacgaatacctcgcatcattgtgatgtacatgcagaatgcattgaaagagcaacagcatggagcgctctcccggtatttattcagatgctgctattgctgcttctggtgtctggataaatatctgctgcatctcaaccagaatgcctacacgaccaccgctatcaacggaactgacttctgtacgtccgcgaaggacgcattcaagattctaagtaagaattccagccatttcaccagtatcaattgcttcggggattttatcatctttctgggaaaagtcttggttgtatgctttactgttttcggaggccttatggcgtttaactataaccgtgcatttcaggtctgggcagtccctctgctgctggtggcgttttttgcatatttggtggctcactcgtttctgtcagtgtttgaaactgtcctcgatgccttatttctgtgcttcgccgtggacttggagacaaacgatgggtcttctgaaaagccctactttatggaccaggaattcctgagtttcgtgaaaagatcaaataagcttaacaacgctagagcgcagcaggacaagcacagcctccgtaatgaggagggaaccgagctccaggccatcgtccgatag

SEQ ID NO: 46345 - DNA, 1818 bp, Artificial Sequence
  Description of Artificial Sequence: Synthetic coding sequence
atgggctacagcgtggtggccggcgccgccggccggctgctgttcggctacgacagcttcgggaatatgtgtggaaaaaaaaactctcctgtcgagggcgcccccttatcaggtcaggacatgacactgaagaaacacgtcttctttatgaacagctgtaacttggaagtcaaagggacccagctgaaccgcatggccttgtgcgtgtccaactgtcctgaggagcagctggacagcctcgaagaagtccagttctttgcaaacaccagcggtagcttcctgtgtgtctacagtctgaactccttcaactacacacattcccctaaagcagattctctgtgtcccaggctgcctgtgcctcccagcaagtccttccccctgttcaatcgctgcgtgccacaaactcccgagtgctattccctgtttgcttcagtgctgatcaatgacgtggacaccctgcatcgcatactgtccggaatcatgtccggtcgcgataccatccttggcttgtgcattcttgctctggcactgtcgctggctatgatgtttacctttaggttcattaccacactgcttgtccacattttcatctccttagtgatacttggactgctatttgtatgcggagtgttgtggtggctctactacgactacactaatgacctctcgatagaactcgatacagaacgcgagaacatgaaatgtgtgcttgggttcgcaatagtgtctacaggaatcacagctgtcctgctcgtgctcattttcgtgctgagaaagaggatcaagctgactgtggaactgttccagattactaacaaagcaatctcctctgctccgtttcttcttttccagcctctgtggacttttgctattcttatctttttttgggttctctgggttgctgtcctgcttagtcttggcactgctggggccgctcaggtgatggaggggggccaggtagagtacaaaccgttgtccgggataaggtacatgtggtcataccacctgatcggactgatatggacgtcggagtttatcctggcatgccagcagatgaccatcgccggcgccgtggttacttgttatttcaaccgtagtaagaatgaccctcctgaccatccaatcctctctagtctctcaattctattcttctatcaccaggggactgttgtcaaaggaagctttttgataagcgtcgtgcgcatcccccgtatcatcgtgatgtacatgcaaaatgcattgaaagaacagcaacacggcgctctgagtagatatcttttccggtgttgttactgctgcttctggtgcctggataagtatctgcttcacctcaaccagaacgcctacactactactgccataaacggaactgatttctgcacctccgcaaaggacgcgttcaaaatactttcgaaaaattcttcacacttcacaagcattaattgttttggcgattttattatatttcttgggaaagttctggtcgtctgtttcacagttttcggagggttaatggcgttcaactacaaccgtgcctttcaggtctgggccgtccccctgctgctggtcgccttcttcgcttacctcgttgcccactcttttctctccgtcttcgagactgtgctggacgctctgtttctctgttttgccgttgacctcgagacaaacgatggatcctctgagaagccatacttcatggaccaggagtttctgtcatttgtcaagcggtccaataagttaaataacgcccgcgcacaacaagataaacatagcctgagaaatgaggaagggaccgagctgcaagcaatcgtgcggtag

SEQ ID NO: 46346 - DNA, 2160 bp, Artificial Sequence
  Description of Artificial Sequence: Synthetic coding sequence
atgaacgacaccgagaagcccgccgacacccccagcgaggaggaggactttggcgacccacggacatacgatcctgatttcaaggggccagttgcgaatcgatcttgcaccgacgttttgtgctgtatgatattcctgctctgtatcatcgggtacatagttcttggactcgtcgcttgggttcatggcgacccaaggcgcgccgcttatcccactgactcacagggccatttttgtggacagaaaggaactcccaacgagaacaaaacgatcctcttctacttcaacctgttgcgctgtacatctccctccgtgcttttgaacctgcaatgtccgaccacccagatctgtgtcagtaagtgccctgagaagtttcttacatacgtcgaaatgcaactactctataccaaagataagagttactgggaggactaccggcagttctgcaagacaactgccaaaccggtaaagtctctcacacaactgcttcttgacgatgactgtccaacagccatctttcctagtaagccgtttctgcagcggtgttttcccgatttctcaaccaagaatgggaccttaacgattgggagcaagatgatgttccaggatggcaacggaggaactaggtcagtagtggagctcggcatagcggccaacggcattaataaactgctggatgctaagtcgctgggactgaaagtgtttgaagactacgcacgcacatggtattggattctgatcggcctcacaatcgccatggtcctgagctggatctttctcattcttctgaggttcatcgcagggtgcctattttgggtcttcatgattggtgtcatcggcatcattggatacggaatctggcactgttatcaacaatataccaacctacaagagagaccttctagcgtgctgacaatctatgacattgggatccagacaaatatctccatgtacttcgaactgcagcaaacttggttcacattcatgatcatcctttgtatcatcgaagttattgtaatcctgatgctcatatttctgcggaatcgaatcagggtggccattatcctgctgaaggaaggttccaaggccattggatatgtgccttctaccctcgtctatcctgctctgaccttcatccttctatctatctgcatttgctattgggtcgtgacagccgtgttcctcgccacatccggcgtgccggtttacaaggtgatagccccgggaggccactgcattcacgaaaatcagacatgcgacccagagatctttaacacgaccgaaattgcaaaagcctgccctggggccctgtgcaatttcgccttctacggcggaaaatccttgtaccaccagtacattccaacctttcacgtgtataatctgttcgttttcctgtggttgattaatttcgtgatcgcattgggccaatgtgccctggccggtgccttcgctacctattattgggctatgaagaaaccggacgatattcctcgatatcctttgttcacggcattcggtagggccatcaggtatcacacgggctcccttgcatttggatctttgattattgcgcttatccagatgttcaagatagtcctggagtacctggaccaccgattgaagagaacccagaatactctcagtaagttcctgcagtgctgcctgcggtgctgtttctggtgtttagaaaatgccatcaaattcctaaatagaaacgcgtatattatgattgccatttacggacgcaatttctgtcgctccgcaaaggatgcatttaatctgttgatgcgtaatgttttgaaggttgccgtaactgacgaagtcacatatttcgtattgtttttgggtaaattgcttgtggctgggagtatcggagttctagccttcttattttttacgcagcgacttccagtgatcgcgcaggggcccgcttcacttaattattattgggttccactgctgaccgtgatttttgggtcttatctgatcgcgcatggtttttttagcgtctatgctatgtgtgtggagaccattttcatttgtttttgcgaagatttagagcgcaacgacggctcaaccgaaaagccttatttcgttacaccaaatttacatggcatactgatcaagaaacagctggtgccgcagaagcagaaggagtag

SEQ ID NO: 46347 - DNA, 2154 bp, Artificial Sequence
  Description of Artificial Sequence: Synthetic coding sequence
atgaacgacaccgagaagcccgccgacacccccagcgaggaggaggattttggagatccccggacctatgacccagattttaaagggcctgtggccaacagaagctgcacggacgttctgtgttgcatgattttcctgctctgtattattgggtacatcgtattggggctggttgcctgggtccacggcgatcccagaagagcagcctaccctaccgactctcagggacacttctgcggccagaagggcactcccaacgagaataagactatcctgttctacttcaacctgttgcgttgtactagcccttcggtcctgctgaacctgcagtgccctaccacccagatctgcgtcagtaaatgtcctgaaaagttcctgacttacgtggaaatgcagctactttacacgaaggacaaaagttactgggaggattacagacagttctgcaagaccacagccaaaccggtcaaatccctcacccagctgttgttggatgacgactgtcctaccgccatctttcccagcaagcccttcctccagcggtgcttccctgacttctctaccaagaacggcaccttgactatcgggagtaaaatgatgtttcaggacggcaatggaggaacacggagcgtagtggaattagggattgccgccaacgggattaacaagctcttagatgcgaaatctctgggcctgaaagtcttcgaagattatgctcggacctggtattggattcttataggcctaaccattgctatggtgctgtcatggatcttcttaattcttctgcgtttcattgcaggatgcctgttctgggtgttcatgattggagtcataggcattattggttacgggatctggcactgctaccagcaatacaccaacctgcaagagagaccttccagtgtgctaacgatttatgatatcggaattcagactaatatttcaatgtacttcgagcttcaacaaacctggtttacctttatgatcatcctttgcattattgaggtgatagttatcctgatgttgatctttctgcggaataggatcagggtagccataatcctcctgaaagaagggagtaaggcaatcgggtacgttcccagcacccttgtgtatcccgcactcacctttatactactgtccatctgtatttgttattgggtggtgaccgcagtctttctggctacctccggtgtccctgtttacaaggtgatcgcaccaggcggtcactgcatccatgagaaccaaacgtgcgacccagaaatcttcaatacgacagagatagctaaggcctgccccggcgccctatgcaatttcgccttctacgggggcaagagcctgtatcaccagtacattcctactttccacgtctataatctgtttgtatttctatggctgatcaatttcgtgatcgccctcggccagtgtgctctggccggagcattcgccacttactactgggcgatgaagaagccagacgacattcctagatacccactctttacagccttcggtagagcaatcaggtaccacaccggctcactcgctttcggcagccttatcattgcattgatccaaatgttcaaaattgttcttgagtatttagaccaccgcctcaagcgaactcaaaacactttgtcgaaattcctgcaatgttgtctgcgatgctgcttctggtgtctcgaaaacgctattaagtttttgaacagaaacgcatacatcatgatcgcgatctatggaagaaacttttgccgaagcgcaaaggatgcttttaacttgctcatgagaaatgttctcaaagtcgcggtcacggacgaagtgacatactttgtcttgttcctgggcaagctgctggtggccggctctatcggggttcttgcatttcttttttttacgcagcgcctccccgttattgcacaggggcctgcctccctcaattactactgggttcctctgctgactgtgatcttcggaagctatctaatcgctcacggttttttcagcgtgtacgctatgtgcgttgagacgatttttatatgcttcttagaggacctggagcgcaacgacggctctacagctaggccctactacgtgagccagccactacttaagattttccaggaggaaaacccccagacacgtaaacagtag

SEQ ID NO: 46348 - DNA, 1770 bp, Artificial Sequence
  Description of Artificial Sequence: Synthetic coding sequence
atgcagctgctgtacaccaaggacaagagctactgggaggactaccgccagttttgtaaaacgactgccaagcccgttaagtcactgacccagttactgctggatgacgattgtcctacagcaatatttccttctaaaccttttttacaaaggtgttttcccgacttctccaccaagaacggaaccctgactatcggtagcaagatgatgtttcaggatgggaacggcgggaccaggtcggttgtggagcttggcatcgctgcaaatgggatcaacaagttgctcgacgcaaagtcattgggcctgaaggtgttcgaggactatgctcgtacctggtactggatcctcataggcctcacaattgccatggttcttagttggatcttcctgatcttgctgcggttcatcgccggctgcctgttttgggtctttatgatcggcgtgatcggaattattgggtacggcatctggcattgttaccagcagtatacaaatttacaggagcgcccaagttcagtgctgacaatctatgacatcggaatacagaccaacatctccatgtactttgaactacagcagacctggtttacattcatgatcatactttgcataatcgaggttattgttatcctcatgttaatctttttgcgaaacaggattagagtcgcgatcattctgctgaaagaggggtctaaagccatcggctacgtaccttctacactagtctaccccgccttaactttcattttgctctcaatctgtatttgttattgggtcgtcaccgccgtctttcttgccacctctggggtgcccgtgtacaaagtgattgcacctgggggacattgtatccacgaaaaccaaacctgtgatccagagatctttaacacgacagagattgccaaggcttgtcccggagcgctttgtaatttcgcattctacggtggtaaatcgttgtatcatcagtatataccaacctttcacgtgtacaatctttttgtgttcttgtggctgataaacttcgtgatcgctctcgggcagtgcgcattggccggagcattcgcaacatactactgggctatgaagaagccagatgacatcccaagatacccactgttcaccgcattcggccgggctatcagatatcacaccggctcacttgccttcggaagtcttatcatcgccctaattcagatgtttaagatcgtcctagagtatttagatcaccggcttaaacgtactcagaacaccttaagcaaatttctgcagtgttgcctgagatgctgcttttggtgcctggaaaacgctatcaagtttttgaacaggaatgcctacatcatgattgcaatatacgggcgtaatttctgccggtccgcaaaggacgcctttaaccttctgatgagaaatgtattgaaagtggctgtgaccgacgaggtgacctacttcgtcctcttcctcggcaagttattggtcgcgggctcaatcggggtgttagcttttctcttcttcacacagcgcttgccagttatcgcccagggtcccgcttctcttaactactactgggtcccactgctgactgtaatctttggatcgtacctaatcgcacatggcttctttagtgtctatgctatgtgcgtagaaacaatctttatatgtttttgtgaggatctggagagaaatgatggctccactgaaaaaccctacttcgtcactcctaacctgcatggcatcctgatcaagaagcagctagttccacagaaacagaaggaatag

SEQ ID NO: 46349 - DNA, 2139 bp, Artificial Sequence
  Description of Artificial Sequence: Synthetic coding sequence
accaaggccaagaagcggcccagcaacgccggcgacccccggacctatgaccccgattttaagggccctgtcgcaaataggagttgcaccgatgtgctgtgctgcatgatctttttgctgtgtattatagggtacattgtgctgggactggtggcctgggtgcacggtgaccctcgacgggccgcttaccccaccgacagccaaggacatttttgcgggcaaaaaggtaccccgaacgagaataagacaattcttttctattttaacctgctgcgctgcacaagtcccagcgtgcttctaaacctccagtgtccaacaacccaaatttgcgtgtccaagtgtcctgaaaaattccttacctacgtggagatgcagctcctgtacaccaaggataaaagttattgggaggactaccgccaattttgtaagaccacggccaaacccgtcaagtccctgactcagctcctgctggatgatgattgccctactgctatctttccctccaaaccgtttctccagaggtgtttccccgatttttctactaagaacggcacactgaccatcggctccaaaatgatgtttcaggacgggaatggcggcacacggagtgtggtcgagctgggcatcgctgccaacggcataaataagctcctggatgctaaatcgctggggctgaaggtgttcgaggactacgcacgcacatggtattggatccttattggtcttacaattgctatggtcctgagctggatctttctgatcttgctgcggtttattgcaggatgcctgttctgggtgttcatgattggcgttattgggatcattggctacgggatatggcattgctaccagcagtataccaacttgcaagagcgtcccagctcagtattaaccatatatgacatcggaattcagacaaacattagcatgtatttcgagttgcaacagacttggttcacattcatgatcattttgtgcatcatcgaggtgatcgtgatcctcatgctgatcttcctaagaaacaggatcagagtagcgattatcctcctgaaggagggaagcaaggccatcggatacgtgccctcaacgcttgtgtatcctgcacttacatttatccttctttccatctgtatttgctattgggttgttaccgcagtgttccttgctacatctggagttcctgtctacaaggttatagctccaggaggtcactgtatccatgagaaccagacctgcgacccggaaattttcaacacaaccgagatcgccaaggcatgccccggagcactgtgcaacttcgctttctacggaggaaaaagcttatatcaccaatacatccccacgttccacgtgtacaatcttttcgtcttcctgtggctgattaatttcgttatcgccttgggacaatgcgcgctcgcaggagcatttgccacatattattgggccatgaagaaaccggacgacattccaagataccctttgtttaccgcgttcggaagagcaattagataccacactgggtcactagcattcggatctttaatcattgctctcattcagatgtttaaaatcgtgctggaatatctggaccaccgtctgaaacgaacccagaataccctcagcaagttcttgcaatgttgtttgagatgttgcttctggtgtcttgagaacgccattaagttcctcaaccggaacgcgtacattatgattgctatctacggcaggaacttctgtaggtcggcgaaggatgcttttaacttgctgatgaggaatgtcctgaaagtagctgtgaccgacgaagtcacttacttcgtcctgtttctcggtaagctcctggtcgctggatctatcggcgtcctcgcctttctgttctttacacagcggctgcccgtgatcgcccaaggccctgcctctctgaattattactgggtgcccttgttgacagtgatttttggtagttatttgattgcccacggcttcttctccgtctatgcaatgtgtgtagagacgatctttatttgcttctgcgaagatctggagcgcaacgacgggtcaacagagaaaccctatttcgtgacccccaatctccatggtattcttatcaaaaagcagctggtgcctcagaagcagaaggaatag

SEQ ID NO: 46350 - DNA, 2271 bp, Artificial Sequence
  Description of Artificial Sequence: Synthetic coding sequence
atgagccgggtgccccagttcaagatgcagaagagccccgccttctgtgttgacctagccggctcccacaggcctgagcttttccttttcggtcacctggcatcacacctatttttgtgcttttttctcgagaagccagccgatactccttctgaggaggaagatttcggggacccccgcacatacgatcccgattttaaaggtcccgtggccaaccgcagctgcaccgacgtgttgtgttgtatgatttttctgctttgtatcattggatacattgttctcggactggtggcctgggtgcacggagatccaaggagagccgcctatccaaccgattcacaaggccatttctgcggccaaaagggcaccccaaacgagaacaaaacgatactgttttactttaacctcctgcgctgtaccagtccatcggtcttactaaatctccagtgtcctacgacccagatctgtgtgtcgaagtgtccagagaagtttctgacatacgtggagatgcagctgctgtacacaaaagataaatcatactgggaagactaccggcagttctgcaaaaccacagcaaaacccgtgaaatcgctcactcagctactgttggatgacgattgccccaccgctatatttcccagcaagcccttcctccaaaggtgttttcctgacttttccactaagaatggcacactgaccataggctccaagatgatgtttcaggacgggaatggcgggacccggagcgtggtggagctgggaattgccgccaatggcatcaataaacttttagacgctaagagcctgggtctcaaagtgttcgaggattatgcccgaacatggtattggattctaattggcctgaccattgcgatggttttatcttggatatttttgatactactccgtttcattgccggctgcttgttctgggtgtttatgatcggtgtgattggcattattggctacggcatttggcactgttaccagcagtatacaaatctgcaggagcggccttcaagtgtacttaccatttacgatattggaatccagactaatatctccatgtatttcgagctacagcagacctggtttacattcatgattatcctgtgcattatcgaggtaatcgtcattcttatgctgattttcttgcggaatcgaattagggtggcaattatcctgctgaaggagggaagcaaggcgatcggatatgtcccgtcaacccttgtataccctgctctgacatttatactgctgagtatctgcatttgctactgggtagtcactgctgttttccttgctacctctggagtacctgtgtataaggtaattgctccaggcggtcattgtatccacgaaaaccaaacatgcgatcccgagatattcaataccacagagatcgccaaagcctgtccgggcgcgctatgcaacttcgctttttatggaggcaaaagcttgtatcatcagtacatacctactttccacgtgtacaatctttttgtcttcctatggttgattaactttgtcattgcgcttgggcaatgtgccctcgcgggagccttcgccacctattattgggcgatgaagaagcccgacgacattccacgctatccactgtttactgcgttcggccgggcaatccgttatcacacaggcagcctggcattcggcagtttgatcatagccctgatacaaatgtttaagatcgtgctagaatacttagaccacagacttaagaggacacaaaacaccctgagcaaatttctgcagtgttgtcttaggtgttgtttctggtgcttggaaaacgcgatcaaatttctgaacagaaacgcctacattatgatcgccatttatgggagaaatttctgccgcagtgcgaaagacgcgtttaacctgctgatgaggaatgtactgaaagtggccgtgaccgacgaggtgacctactttgttctctttctcgggaaactgctggtggccgggagcattggagtcctagcatttctgttcttcacacagagactccctgtgattgctcaggggccggcttcactgaactactactgggtgccccttctgaccgtaatttttgggtcgtatttgatcgctcatggattctttagcgtgtacgccatgtgtgtggagaccattttcatatgctttttggaagacctggaacgtaacgacggatctaccgctagaccttactatgtatctcagccgctcttgaaaatcttccaggaggaaaatccacagacgcggaaacaatag

SEQ ID NO: 46351 - DNA, 1386 bp, Artificial Sequence
  Description of Artificial Sequence: Synthetic coding sequence
atgaagatcctgttcgtggagcccgccatcttcctgagcgccttcgcaatgaccctcaccggacctctcaccacccaatatgtttatcgacgcatctgggaagaaacaggaaactacaccttttctagtgattcaaatatcagcgaatgcgaaaaaaacaagtccagccccatttttgcatttcaggaagaggtccaaaagaaggtctctagattcaatttgcagatggacatctctggtctgatccctgggctggtctcgacattcatcctgttgagtataagtgaccattatgggcgcaagttccctatgattctgtcgagcgtcggggccctggccacttcggtgtggctctgtttgctgtgttattttgcattcccattccagctactgattgccagtacattcatcggcgcattctgtggaaattatactacattctggggggcatgcttcgcctatattgtggatcagtgtaaggaacacaagcagaaaaccattcgcatcgccatcatagactttctccttgggctcgtcaccggacttacaggactcagcagcgggtactttatccgcgaattaggctttgagtggagcttcctcataatagccgtaagcttagcagttaacctcatctacatattgttcttcctgggagatcctgtgaaggagtgttccagccagaacgtgactatgtcatgcagtgaaggcttcaaaaatctgttttatcggacctacatgttgttcaagaacgcctcaggtaagcgtcggttcctgttgtgcctgctgttgtttacagtcataacctacttctttgtcgtgataggtattgcccctatattcatcctctacgagctggacagccctttgtgttggaatgaagtcttcatcggatatggtagcgccctaggatcagcgtcctttcttacttcctttttaggtatttggttattttcttattgcatggaagacatacacatggcattcatcggcattttcaccacaatgactggcatggccatgacagcttttgcttctacaactcttatgatgttcctggcccgagtgccctttctgttcaccatagtccctttctctgtgctgcgttcaatgctctcgaaagtggtgcgatctaccgagcaagggaccctgttcgcgtgcatcgcctttcttgagaccctcgggggagttaccgctgtctctaccttcaacggtatctactctgcgactgttgcatggtatcccggatttacttttctgctaagcgccggcctcctccttcttccagccatctccttgtgtgttgtaaagtgcacaagttggaacgaaggctcgtacgagcttctgattcaggaggaaagttccgaggacgcctcagaccgctag

SEQ ID NO: 46352 - DNA, 1392 bp, Artificial Sequence
  Description of Artificial Sequence: Synthetic coding sequence
atgaagatcctgttcgtggagcccgccatcttcctgagcgccttcgcgatgaccctcaccgggccactgactactcagtacgtctacaggaggatttgggaggaaaccggcaactacacattttcctctgatagcaatatctcagagtgcgagaagaacaagtcttccccaatctttgccttccaagaggaggtgcagaaaaaagtctcaagattcaaccttcagatggatatttccggactgatacctggcctcgtgtctacctttatcctgctgtccatttcggatcattatggccgaaagttccccatgattttgtccagcgttggtgctctggcaacctcagtatggttatgtcttctttgctatttcgccttccccttccagctgctaatcgcatcaaccttcatcggcgccttctgcggcaactataccactttttggggagcatgcttcgcttacattgtggaccagtgcaaggagcacaagcagaagacaattcgcatcgcaatcatcgattttttactcggcttagttactggccttacgggtctgagcagtgggtattttattcgagaacttggctttgagtggagctttctgattatcgccgtgagcctggccgtgaatttgatatatattctgtttttcctaggcgatcctgttaaggaatgtagtagccaaaacgttacaatgtcttgtagcgagggattcaaaaacctgttttaccgcacatacatgctattcaagaatgcgtctgggaagcgacgcttcttgctgtgtctcctcctgtttaccgtgatcacctattttttcgtggtgattggaattgccccaatttttatcctctatgagctggactctcccttatgttggaatgaagtgttcatcgggtatgggtcagcgctaggtagtgcaagcttccttacctcctttttgggcatctggctctttagttactgcatggaggatatccatatggcctttatcggaattttcactactatgacaggaatggctatgactgcattcgcgtccactacactaatgatgtttctcgctcgcgtgcccttcctgttcaccatcgtgccattctccgttctgcgtagcatgttgtctaaggtcgtgaggtctacggaacagggaactctgtttgcctgtattgcattccttgagaccttggggggagttaccgcggtgagcacattcaatggcatttatagcgcaacagtggcttggtatcctggctttactttcctcctgtctgcggggctgttgctgcttcctgcaatctcactttgcgtcgtcaagtgcacatcttggaatgaaggttcctatgagctcctcatacaggaagagagctctgaggatgcctcagatcgcgcttgctag

SEQ ID NO: 46353 - DNA, 453 bp, Artificial Sequence
  Description of Artificial Sequence: Synthetic coding sequence
atggcccccagccggctgcagctgggcctgcgggccgcctacagcggcatatcttccgttgctggcttcagcatcttcttagtatggacggtggtatacagacaaccagggaccgcagccatgggaggccttgcaggagtgttggctctgtgggtgctggtcactcatgtgatgtacatgcaagattattggcggacatggttaaaagggcttaggggattcttttttgtgggcgtgttgtttagcgcagtgagtatagcagccttctgcacgtttctcgtgctcgccatcacacgccatcagagcctcacagatcccacctcctactacctctctagtgtctggtcatttattagtttcaaatgggcatttctcttgagcttgccaaagtgctgggactacagatgcgagccaccctgtcccgcgtggatttgtttcctgtctacgcagtag

SEQ ID NO: 46354 - DNA, 441 bp, Artificial Sequence
  Description of Artificial Sequence: Synthetic coding sequence
atggcccccagccggctgcagctgggcctgcgggccgcctacagcggaatctcttccgtggctggcttctctatctttttggtgtggactgtcgtataccggcaaccggggaccgcagccatgggaggcctcgctggtgtcctcgctttatgggttctcgtgacccatgtgatgtacatgcaggattactggaggacatggctgaaaggactgaggggcttcttctttgtgggcgtgctgtttagtgcggtaagtatcgccgccttctgcacattcctggtgctcgcaataactcgccaccagagtcttacagatcccacctcctactatttgagcagtgtgtggtcattcattagctttaagtgggccttcttgcttagcctctacgcccacaggtatagggccgactttgctgatattagcatcttgtccgatttttag

SEQ ID NO: 46355 - DNA, 270 bp, Artificial Sequence
  Description of Artificial Sequence: Synthetic coding sequence
atgtacatgcaggactactggcggacctggctgaagggcctgcggggcttcttcttcgtcggcgtgttattttccgccgtgagtatagccgccttctgtacctttctggtgctggcaattacccgccaccagagcttaactgatccgacatcttactatctttcttccgtgtggagtttcatctcgttcaaatgggcattcctgttgtccttatacgcccaccgttaccgcgcggactttgcagacatcagtattctgagcgacttttag

SEQ ID NO: 46356 - DNA, 270 bp, Artificial Sequence
  Description of Artificial Sequence: Synthetic coding sequence
atgtacatgcaggactactggcggacctggctgaagggcctgcggggctttttcttcgtgggagtcctgttctctgcagtttcaattgcagccttttgcacttttttagtcttagccatcacgcggcatcaaagtctgactgacccgacctcctattatttgagcagtgtgtggagctttataagctttaagtgggcttttcttctgagtctctacgctcaccgatacagggcggacttcgccgacattagcatactttccgacttttag

SEQ ID NO: 46357 - DNA, 111 bp, Artificial Sequence
  Description of Artificial Sequence: Synthetic coding sequence
atgtacatgcaggactactggcggacctggctgaagggcctgcgggggttcttcttcgtgggagttctgttctcagcagtctccatcgccgccttctgtaccttcttgtag

SEQ ID NO: 46358 - DNA, 51 bp, Artificial Sequence
  Description of Artificial Sequence: Synthetic coding sequence
atgtacatgcaggactactggcggacctggctgaagggcctgcgggggtag

SEQ ID NO: 46359 - DNA, 1743 bp, Artificial Sequence
  Description of Artificial Sequence: Synthetic coding sequence
atggccttccacgtggagggcctgatcgccatcatcgtgttctacctattgatactcctcgttggcatttgggcggcatggcgtaccaagaattcaggcagtgccgaagagcgtagcgaagccataattgtgggggggagagatatcggcttgttagttggcggttttaccatgactgcaacgtgggtgggcggaggatacatcaatggcaccgccgaggctgtgtacgtgcctggatacggactggcctgggctcaggcacccataggatactcactttctctgatcctggggggactgttctttgctaaacctatgcggtccaaggggtacgtgaccatgctggacccattccagcaaatttatggtaagcgaatgggaggtctgctttttatacctgcattaatgggtgaaatgttctgggctgctgcaatattctccgctttgggggctacaatttccgtgatcatagatgtggatatgcacatcagtgtgatcatctccgccctgatagccactctatatactctcgtgggaggactttacagtgtcgcatataccgacgtggtccagctcttttgcattttcgtgggtctgtggatctcggtccctttcgccttatctcatcccgctgtggcggacattggctttaccgccgtgcatgctaagtaccagaaaccctggcttgggaccgtagacagcagtgaggtttactcatggttggacagcttcttgctgctgatgctgggaggtattccttggcaagcttatttccagagagtgcttagctcgagtagtgctacttatgcgcaggtcctgagctttctcgcggcgtttggatgtctggtgatggccatccccgcgattctcattggcgcaatcggcgcctccaccgattggaatcaaacagcctacggactgccggatccaaaaaccacagaggaagctgacatgatactgccaatcgtccttcagtatctgtgtcccgtgtatatttctttttttggtctcggtgctgtctcggccgccgttatgagctccgcggactcttctatactaagtgcatcttccatgtttgcccgaaatatctaccagctgtccttcagacaaaacgcgtcagataaagaaatcgtctgggtgatgcgaattacggtttttgtgtttggcgctagcgcgacagctatggctcttctgaccaagacagtctatggcctgtggtatctgagttctgatctcgtttatatcgtgatctttccccaactgctgtgcgttctgttcgtgaaaggaacaaatacgtacggcgcagttgctggttacgtgtcagggctgttcttgcgcataactggcggagagccttatctctacctccaacccttgatcttttatcccggatattaccccgacgacaacgggatatacaatcagaaattcccttttaagaccctagccatggtgacctccttcttgaccaacatctgtatctcatacctagctaagtacctttttgaatcaggtaccctcccgcccaagttagatgttttcgacgcagtcgtggcccggcattctgaggagaacatggacaagacaatcctggtcaagaatgagaacattaaattggatgagttagccctggttaagccacgtcagagcatgaccctctcatccacttttacgaacaaagaggcattcctcgacgtagactcttctcctgagggctccggaaccgaggataacctccagtag

SEQ ID NO: 46360 - DNA, 1743 bp, Artificial Sequence
  Description of Artificial Sequence: Synthetic coding sequence
atggccttccacgtggagggcctgatcgccatcatcgtgttctaccttttgattctgttggtgggcatctgggcagcttggcggactaagaattccgggtccgccgaggagagaagcgaagccattatagtgggaggacgtgacatagggctcctagtagggggctttactatgacagccacgtgggttggaggagggtacatcaacggcaccgcggaggccgtttacgtacccggctacggactggcctgggcccaggcacctattggttatagtctttctttaatcttgggggggctcttttttgctaagcccatgagatccaagggatacgtgacaatgttggaccccttccagcagatttacggtaaacgtatgggtggcctattgttcatccctgctctgatgggtgaaatgttttgggctgcagccattttctctgcactgggagctacaattagcgtgattattgatgttgacatgcatattagcgtgatcatcagcgctctgatcgccactttgtacacgttagtgggtggtctatattcagtggcctacactgatgtcgtgcagcttttctgtatcttcgtaggtctgtggatcagcgtgccattcgcactctcccaccccgctgttgccgacattgggtttacagcagtgcatgccaaataccagaagccttggttagggaccgttgacagctctgaggtgtattcttggctcgattcttttttactgttgatgctgggaggcatcccttggcaggcatatttccagagggtgttgagtagcagtagcgcaacctatgcacaggtcctgtcgtttctggctgccttcgggtgcctggtcatggccatcccagccattctcatcggagccattggcgccagtactgactggaaccagaccgcgtacggcctgcccgacccaaagacgactgaggaggccgacatgatcttgcctattgtactacagtacctctgtccggtgtatattagtttctttggactgggcgcagtttccgccgccgtgatgtcatcggctgacagtagtatcctgtcagctagctccatgtttgcaaggaatatctaccaactgagtttcaggcagaacgccagcgacaaggagattgtgtgggtcatgcgtatcacagtgttcgttttcggcgcttccgccacagcaatggctctgctgactaagactgtgtatgggctttggtacctgtcttccgacctggtgtatatcgtcattttcccgcagttgctgtgcgtcctgttcgtaaaaggcacaaacacatatggagcagtggcgggatacgtgagcggacttttcctgagaattactggaggcgaaccttatctgtatctgcaacctcttattttttacccaggttattacccagatgacaatggcatctataatcagaaatttcccttcaagaccctcgctatggttacaagcttcctgaccaacatctgtatatcctatctggccaagtacctcttcgagtcaggcacactgccacctaagctagatgttttcgacgccgtggttgctcgccactccgaggagaacatggacaaaacgatcctggtaaaaaacgagaacataaaattggacgaactggccctggtgaaaccccggcagtcaatgactctcagtagcacatttactaataaagaagccttcttggacgttgacagtagtccagagggctccggaactgaagataatctgcagtag

SEQ ID NO: 46361 - DNA, 1428 bp, Artificial Sequence
  Description of Artificial Sequence: Synthetic coding sequence
atgcggagcaagggctacgtgaccatgctggaccccttccagcagatttatgggaaacgcatgggtgggctgctttttatcccggcactgatgggcgagatgttttgggccgcagctattttctctgctttgggcgcaactattagcgtgatcatagacgtggacatgcacattagcgttattattagtgcactcattgctacactgtacacgctggttggtggcctttacagcgtagcatatacagacgtggttcaattgttttgcattttcgttgggctctggatttcagtgcctttcgctttgagtcaccccgcggtggccgatataggcttcacggccgtgcatgctaaataccagaagccctggttggggactgtagactcctccgaagtctactcctggctcgacagtttcctgttactcatgcttggtggaattccatggcaggcttattttcaacgcgtgctgtctagttcaagcgcgacttatgcacaagttctgagcttcctggctgcgttcgggtgtctggtcatggccatacctgcgatactcatcggggccataggcgcatctactgactggaaccagacagcgtatggcctccctgacccgaaaacaactgaagaagcagatatgattctgccaatcgtgctccagtatctgtgtcctgtctatatctcatttttcgggctgggggcagtttcggccgctgtgatgagcagcgctgattcaagcatcctgtctgcctcgagcatgttcgcaagaaatatttaccagcttagttttcgccagaatgcctcagataaagagattgtctgggtgatgcgcatcaccgtttttgtctttggcgcatccgctaccgccatggctctgcttacaaagactgtgtacggtctgtggtatctgtcgtccgatctagtgtacatagtaatcttcccccaactcctgtgcgttctctttgtcaagggcactaacacatacggagccgtggcgggttacgtgtctggcttgtttctgcggattactgggggtgaaccttatctgtacctgcagccattgatcttttaccccgggtactatcccgacgataacggcatttacaatcaaaagtttcctttcaaaacacttgctatggtgacatccttcctgacaaatatttgcatttcatacctggcaaaatacctgttcgagtcaggcaccctgcctccaaaattagacgtcttcgatgcagtcgttgcacggcacagcgaagagaatatggacaaaaccatcttggtcaagaacgagaacattaagctggatgaacttgccttagtgaagccaaggcagtctatgaccctgagctccacatttactaataaagaggccttcctggacgtggactcatctccagagggaagcggcaccgaagataatctgcagtag

SEQ ID NO: 46362 - DNA, 1980 bp, Artificial Sequence
  Description of Artificial Sequence: Synthetic coding sequence
atggccagcaccgtgagccccagcaccatcgccgagacccccgagcccccgccgttgagtgaccatataaggaatgctgcagacatctccgtcattgtaatctactttttggtcgtgatggctgtgggcctctgggctatgctgaaaacgaaccggggtactatcggcggattctttctggccggccgagacatggcctggtggcccatgggtgcttccctcttcgcatctaacattggctccaatcattatgttggactggctgggactggtgccgcaagtggcgtcgccaccgtgaccttcgagtggacatcatctgtgatgttgctgattctggggtggatatttgtccctatctatattaaaagcggcgtgatgacgatgccggagtacctgaaaaaaaggttcggaggcgaaaggctgcaggtttatctctctatcctgtccttgtttatctgtgttgtgcttttaatttctgccgatatcttcgctggcgcgattttcattaaacttgctctcggcttggacctttacctcgctatattcattcttctcgccatgacagccgtgtacactaccacagggggccttgcctcggtgatttataccgataccctgcagacaattataatgctcataggctcattcatcctgatgggctttgcatttaacgaggtagggggctacgaatcctttacagaaaagtatgttaatgcaacaccctctgtcgtcgagggggacaacctcacaataagcgcctcttgctacactccaagagccgactcttttcatatctttcgggacgccgtgaccggcgatattccttggcctggcataatcttcggaatgcctatcaccgcattgtggtactggtgcaccaaccaggttattgtccaaaggtgcctgtgcggaaaggatatgtcccacgttaaagcagcctgcattatgtgtgcatatttgaagctgctgccaatgttcctgatggttatgcctggcatgatctcaaggatcctgtatacggacatggtcgcctgtgtggtgcctagtgaatgtgttaaacactgtggagtggatgttggatgcactaattacgcgtacccaacaatggtgttggagcttatgccacagggcctgcgggggctgatgctgtccgtcatgctggccagcctgatgtcctccttgacgtccatcttcaactccgcttccactttgttcaccatagacttatatactaaaatgcgaaagcaggccagtgagaaagagctgcttatcgctggacgcatatttgtcctgctgctgacagtggtatctattgtttgggtccccctggtacaagtgagtcagaatggccaattaattcactacactgagtctatttctagctatctgggtcccccaattgcagctgtattcgttctagcaatattctgtaagagagtgaacgaacagggtgccttctgggggctgatggttggtctggcaatgggactcatccggatgatcactgaattcgcatacggaacggggtcttgtcttgctccatccaattgtcccaaaattatctgcggcgtccattacctgtacttctccattgtactgttttttggatccatgctggtgacgctgggcatttccttactgactaaaccaattcccgacgtgcacttataccgtctgtgttgggtgttacggaactcaacggaggaacgtatcgatattgacgctgaggaaaaatcccaggaggaaacagacgacggggtggaagaggactaccccgagaagtcccggggatgcctcaaaaaagcatatgatctgttctgcggtctgcagaaaggccctaagttgacaaaagaagaagaggaggcgctgtctaagaaactgacagatacttcagagagaccatcttggaggacgatcgtgaatattaatgcaattctgttgctggcagtagtagtgtttattcacgggtactatgcctag

SEQ ID NO: 46363 - DNA, 1836 bp, Artificial Sequence
  Description of Artificial Sequence: Synthetic coding sequence
atggtgtggtggcccgtgggcgccagcctgttcgccagcaacgtgggtagtggacactttatcgggttagcgggctctggggcagcaaccggcatatccgtgtcagcctatgagttgaatggcttgtttagtgtgctgatgctggcgtggattttcctgccaatctatattgctgggcaggtgactacaatgcccgagtacttgcgcaagcggtttggaggcatccggatccccataatcctggccgtgctgtatctcttcatctatattttcacaaagatcagcgttgacatgtacgcaggagctatctttatccaacagagcttgcacttggatttgtatttagccattgttggtctgttggcaatcacggctgtgtacactgtcgctggggggctggcagccgtcatctatactgatgctctccagacgctaatcatgctcatcggagcactcactctgatgggctatagtttcgccgctgtgggaggtatggagggattgaaagagaagtactttctggcccttgccagtaataggtcagagaacagttcttgcgggctgcctcgtgaagacgcattccacatctttcgcgaccctctcacctcggatcttccttggccaggggtgctcttcggaatgtcaattccttccctgtggtactggtgcactgaccaggtgatcgttcaaaggacgctggctgctaagaatttgtcccacgccaaagggggggccctgatggctgcctacctgaaggtgcttcccctgttcatcatggtctttcctggcatggtatctcgaatactgtttccagaccaagttgcctgcgcggatccagagatctgtcaaaagatatgcagcaatccctcgggatgttcagacatagcttatcccaagctagtgttagagctattgcccacaggcttgaggggcctgatgatggcagtgatggtggccgctctgatgtccagtctaacttctatcttcaactccgcatccacaatttttactatggacctgtggaatcacttaaggcccagagcctccgagaaagagctcatgattgtgggtagggtctttgtcctgcttcttgtcctggtcagcattctttggatccccgtggtgcaggcttcccaaggcggacaactgttcatttatatccagagtatttcatcctacctgcagccacctgtggctgtcgtgttcattatggggtgtttctggaaacggactaatgaaaagggggcattttggggactcatcagcggactgttactcgggttggtgaggctggtactggacttcatctacgtacaacctaggtgtgatcaacccgacgaacgaccagtgcttgtgaaaagtatccactacctgtacttttctatgatactgtcaacagtgacactgattacagttagtacagtgagctggtttactgagccgccaagtaaagaaatggttagccatttaacctggttcactagacacgacccagtagttcagaaagagcaggcccctccagccgcacctcttagtctgacactcagccagaatggaatgccggaagcgtcaagcagcagttcagtccagttcgaaatggtgcaggaaaatacttcaaagactcattcttgtgatatgactccaaagcaatcgaaagtggtgaaggcaatcctatggctgtgtggcatccaggagaaggggaaagaagagttgcctgcaagggcagaggccatcattgtgagcctcgaggaaaatccgctcgtgaagactctcctggatgtaaatttgatattctgcgtgtcctgtgcaatctttatttgggggtatttcgcctag

SEQ ID NO: 46364 - DNA, 1701 bp, Artificial Sequence
  Description of Artificial Sequence: Synthetic coding sequence
atgacctggtggcccatcggcgccagcctgttcgccagcagcgagggcagcgggctgttcatcgggttggcaggaagcggtgcagccggtggtctggccgtggccggcttcgagtggaatgctacgtatgtacttttggctttggcgtgggttttcgtgcccatatatatttctagtgagattgttacactgcccgagtacatccaaaaaaggtacggcgggcagcggatccggatgtatctaagcgtcctcagcctgctgctgagcgtctttacaaaaatctctttggacctgtacgctggagctctgtttgtgcatatctgcctgggatggaatttttacttgagtactatcctcacactggggattaccgccttatacactatcgcagccttcgaccagatcgggggatacggccaattggaagccgcttacgcccaggccattccaagtcggactatcgcaaatactacatgccatctacccagaacggatgccatgcatatgtttcgtgatcctcacacaggtgacctcccctggaccggtatgacattcggcctgaccatcatggcaacctggtattggtgcaccgaccaggtgattgtgcagcggagcctgtcggccagagatcttaaccatgcaaaggctgggagcattctggcatcttacctgaagatgttgccaatgggcctgatcatcatgccaggaatgatttcacgggcactgttcccaggcgcgcatgtttatgaagaacgccatcaagtgagcgtttcaagaactgacgacgtaggatgcgttgtgccgtccgaatgtctccgcgcgtgtggcgccgaagtcgggtgtagcaacatcgcttacccaaagctcgtcatggagctgatgccaataggcctaaggggactgatgattgccgtcatgctggcagccctgatgagctctctaaccagcatattcaatagctcctccaccctgtttacaatggatatatggagaagacttaggcccagatctggtgagagggaacttttactggtgggacggacaggcattcccagcactccccctgcaccccagtctcgcctgagtttcttacttccagagaccccacctctagagagatatcttttggggctcgttgtgatggacctgtggctggtgattgtggcactgataggtgtgagtgtcgcatggatccctgtgttgcaagattccaatagtgggcagctgtttatctacatgcaatccgtgacctctagcctcgctcctcccgttactgccgttttcgttctcggggtcttctggaggcgtgctaatgagcagggcgccttctggggtctgatcgctggacttgtggtgggcgctactagattggtgctggagtttttgaaccccgctccaccctgcggagaacccgataccagacccgcagtactgggttcaattcactacctgcactttgccgtagcactcttcgctttgagcggcgccgtcgtggttgccggatcactactgacacccccccctcagagtgtgcagattgagaatctgacgtggtggacacttgcccaggacgtgcccctgggtaccaaagctggggacggacagacaccccagaagcacgctttttgggccagggtgtgtgggtttaacgccatcttgttaatgtgtgtgaatatttttttctacgcctacttcgcatag

SEQ ID NO: 46365 - DNA, 1701 bp, Artificial Sequence
  Description of Artificial Sequence: Synthetic coding sequence
atgacctggtggcccatcggcgccagcctgttcgccagcagcgagggctcaggcttatttatcgggctggctgggtctggcgcggctggcgggttagcagtggccggtttcgagtggaatgcgacctacgtgctgctggctctggcgtgggtctttgtcccaatctatatctcaagcgagattgtgacgctgcctgagtacatacagaaaagatatggagggcagcggatcagaatgtatctctcagttttaagtctgctgctctcagtgtttaccaagatttctttggatttgtacgccggtgcactgtttgtccatatttgccttggatggaacttctatctcagcacgatcctgaccctcgggatcaccgctctttataccatagcagcctttgaccaaatcgggggctacggacagctagaggccgcttacgctcaggctatacctagtaggaccatagccaataccacttgccacctaccccgcactgacgccatgcacatgtttcgtgatcctcacaccggagacctcccgtggaccggtatgacttttggactgactatcatggctacttggtattggtgtaccgaccaggtgattgtgcagcgcagcctgtctgcaagagatctcaaccacgctaaagcaggctctatcctggcctcctacctgaagatgctgcctatgggactcatcatcatgcccggtatgatctctcgagccctgttcccgggggcacacgtctacgaagagaggcatcaagttagcgtcagccgcactgacgacgtggggtgtgtggtcccatcagaatgtctccgcgcctgtggggcagaggtgggctgctccaacatcgcttacccgaagctcgtgatggaattgatgccgatcggtcttcgcggcttgatgatcgcagtgatgcttgccgcactgatgtctagtctgacgtctatcttcaattcttcgtcaacactgtttacaatggacatctggcgtagactccgccctcgaagtggggagagagaactgttactggtgggtcgcaccggtatcccatccaccccccccgcaccccagtcccggttgagctttttgctaccagaaacaccccctctggaaaggtatctgctagggcttgtggtgatggacctatggctcgtgatcgtggccctgatcggagtgtccgtagcctggatacccgtgttgcaggactctaacagtgggcagctttttatttatatgcagagcgtcaccagtagcttggcacctccggtaacagctgtcttcgtactaggcgtgttttggcggcgtgctaacgaacagggcgctttttggggattaattgccggcctcgtcgtgggagcgacacggctggttctggagttcctcaatccagctccaccctgtggcgagcctgataccagaccagccgtgttaggaagcattcactacctgcatttcgcggtggccctgtttgccctctccggcgctgtcgtggtggcggggagtctgctgacacctcccccacagtctgttcagattgagaacctaacctggtggacactcgcacaagatgtgcctctaggaaccaaggccggggacggacaaactcctcagaagcacgctttttgggctcgtgtttgcggctttaacgccatcctattgatgtgcgtaaatattttcttctacgcctattttgcctag

SEQ ID NO: 46366 - DNA, 1710 bp, Artificial Sequence
  Description of Artificial Sequence: Synthetic coding sequence
atggccgccaacagcaccagcgacctgcacacccccggcacccagctcagcgtcgccgatataattgtcatcacagtctacttcgccttgaatgtcgctgtgggtatctggtccagttgcagagctagcaggaatacagttaatgggtactttcttgcgggtagagatatgacttggtggcccattggtgcgagtctcttcgcgtcctcggagggctccggtctatttattggtctcgctggctcgggagcagccggaggcctggcggtcgccgggtttgaatggaatgccacatacgtccttctagccctcgcctgggtcttcgttcctatatatatatcaagcgaaatcgtgaccctcccagagtatatacaaaagcggtatggtggccagcggattagaatgtatctcagcgtactgagcctgcttctttcagtgtttacgaagatttcactcgacttatacgcaggcgctctatttgtccatatctgccttggctggaatttttacctatcgacaatcctcacattgggcatcacggcactttatacaatcgccgccttcgatcaaatcgggggctacggtcagcttgaggctgcctatgcccaggccattccttctaggacaatcgccaacaccacctgtcacttgccacggaccgacgctatgcacatgtttcgcgacccacacacaggcgatctcccttggaccgggatgacatttggactgactatcatggccacttggtattggtgtaccgatcaggtaatcgtccagcgttctttaagcgcccgtgaccttaatcacgcgaaggcgggttctatcctcgcaagctacttaaagatgcttcctatggggttgataataatgcctgggatgatatcacgtgctctcttccccgacgatgtcggttgtgttgtacccagtgagtgcttgcgtgcttgtggcgccgaagtggggtgcagcaacatagcttatccaaaattggtgatggaattgatgccgattggacttcgtggcctaatgattgcagtaatgctggcagctctcatgagttctctgaccagtatcttcaatagcagttctacactttttacgatggacatttggcggagattgagaccaagaagtggcgaacgagaacttcttttagtaggccggctcgtgattgtggccttgattggtgtcagcgtggcatggatccctgtcctgcaagactcaaactccggacagctgttcatatacatgcaatctgtgacatcttctcttgccccacctgtgaccgctgtgttcgtcctgggcgtattttggcgccgcgctaacgaacagggcgcgttctggggccttatcgccggcttggtggtaggcgctaccagattagttctggaattcctaaatcccgctcctccctgtggagaacccgacacccggccagccgtgcttggaagcattcattatctgcattttgccgtggccttgttcgcactgagtggcgctgtggtggtggcaggttcactgctgaccccccctccccagagcgtccaaattgagaacctcacgtggtggaccttagcccaggacgttccccttggcaccaaagctggcgacggccaaacaccccagaaacatgcgttttgggctagagtgtgcggcttcaatgcgatcctcttaatgtgtgttaatatattcttttacgcctacttcgcctag

SEQ ID NO: 46367 - DNA, 1791 bp, Artificial Sequence
  Description of Artificial Sequence: Synthetic coding sequence
atggccgccaacagcaccagcgacctgcacacccccggcacccagctgtcagtggccgatattattgttataactgtttatttcgcactgaatgtggcagtcggcatctggagcagttgccgtgcctctcgaaatactgtcaacggatatttcctggccggccgagatatgacttggtggcccatcggagcaagtctgtttgcatctagcgaggggtctggtttattcatcgggctggccggtagcggggccgcaggggggttggccgtggccggttttgaatggaacgcaacatatgtcctgctagctctggcgtgggtcttcgtgcctatatacatcagttcggaaattgtgaccctccccgaatacatccagaaaaggtacggagggcaacgcatccgcatgtacttaagcgtcctgagcttattgctgtctgtgttcacaaaaatttccctcgatttgtacgccggcgcgctgttcgttcacatctgccttggttggaatttttacctgtcaactatcctcaccctgggcattacggcattgtacacaattgccggtggcttagcagctgtcatttacactgatgccctgcaaaccctcatcatggtggttggcgcagtgatcctgacaattaaagcatttgatcagattgggggctatgggcagctggaggccgcctacgcccaggctatcccctcacggactatcgccaatacaacctgccatctaccccgtacggatgcaatgcatatgtttagagacccccacaccggcgatctgccctggaccggaatgactttcggcctcactatcatggcaacgtggtattggtgtactgaccaagtcattgtccagcgctctctcagtgcccgcgatctgaaccatgctaaggctgggtccattctggcgagctacctgaagatgctccctatggggctgatcatcatgcccggcatgatttcgagagctttatttccagatgacgtggggtgtgttgtcccatcggagtgtttaagggcctgcggcgctgaagtgggctgttctaatatagcttatcctaaactcgtcatggaattaatgcccattggactaagggggctaatgatagccgttatgcttgcagctctgatgtcttctctcacatccatctttaatagtagctctacattgtttactatggatatctggcgccgattacgcccaagaagtggagagagagaactcctgctggttggaagattagtgatagtggccctgatcggagtctccgtggcctggatacccgttttacaagacagcaactcaggacaactgttcatttacatgcagtcagtcacctcgtctctcgcacccccagttacggcagtgttcgttctgggagtgttctggcggcgggcaaatgagcagggagcgttctggggtctgattgcaggcctggtggtcggggccacacgcctggtgctagaattcctgaatcctgcacccccgtgcggcgagcccgacacacgacctgccgtcttgggttctatacactacctacactttgccgtggccctgtttgcgctgtcaggagccgtcgttgttgctggcagtctgctcactcccccacctcagtccgtgcaaatcgagaaccttacttggtggactttggcccaggacgtgcctcttggcacaaaggcaggcgacgggcaaaccccacaaaagcacgccttttgggctcgggtgtgtggattcaatgctatactcctcatgtgcgtcaatatcttcttttacgcttatttcgcatag

SEQ ID NO: 46368 - DNA, 1839 bp, Artificial Sequence
  Description of Artificial Sequence: Synthetic coding sequence
atggccgccaacagcaccagcgacctgcacacccccggcacccagctctcggttgccgatattattgtaattactgtgtactttgccttaaacgtggccgtgggaatttggtccagttgtcgcgcatcccgcaatacagtgaatggctatttcctggcgggacgcgacatgacctggtggcctatcggcgccagcctttttgcatcctctgaaggatcaggcctgttcataggactggctggctctggcgctgcgggtggactggcagttgctggattcgagtggaacgcaacttatgtcttgttagccctcgcttgggtatttgtgccaatttacatatccagtgagatcgttacactgccagagtatattcaaaagaggtatggtgggcagcgtatccggatgtacttgagtgtcctatccctgctgcttagcgtatttactaaaataagcctcgatctctatgccggcgccttatttgtgcacatttgcctcgggtggaacttttatctctctactatactgaccttagggattacagctctgtatactattgctggaggcctcgctgctgtgatttacacagacgctttgcaaactctgatcatggtggtgggcgcagtaatactcacaattaaggccttcgaccagataggtgggtatggacaattagaagcagcctacgcccaggcaataccttctcgaactattgcaaacaccacatgccacctaccccgcacagacgcaatgcatatgttccgcgaccctcacaccggcgatctgccatggaccggcatgacctttggactaacgattatggcaacctggtactggtgcaccgaccaggttatcgtgcagcgatccctgagtgctcgtgatcttaaccatgctaaggctggctctatcctggcctcctatctgaaaatgcttcccatgggcctcattattatgcctggaatgattagtcgggcactcttccctggggcacacgtctatgaggagagacaccaagtttccgtgtctagaaccgacgacgttggctgcgtggtacctagtgaatgccttcgtgcatgcggggctgaggttgggtgctccaatatagcttatcccaaactggtgatggagctcatgcccatcggcctccgcggtctgatgatagccgtgatgctggcggcattgatgtcatcactcacgtcaattttcaattctagctcaaccctctttactatggacatctggagaagactccgtcctaggtctggggagagagagttgctcctggtggggcgcctagtgatcgttgcattaataggcgtgagtgtcgcctggattcccgtgctgcaggattccaactccggccaactcttcatttatatgcagtccgtaacgtcttccctcgctccgcccgtaacggccgtattcgtgctgggagtcttctggcggagagcgaacgagcagggggctttttggggacttatcgccgggctcgtggtgggcgccactagactcgttctggaatttctcaacccggcacccccttgcggtgaacctgatacacggcccgctgtgctggggagtatccactatctgcacttcgcagtcgctttatttgcgcttagtggagccgtcgttgtggccggcagtctgttaaccccgcctcctcagagcgtccagattgaaaatctcacatggtggacactggcccaggacgtgccccttgggaccaaagcaggcgacggccagaccccacagaaacacgctttttgggcccgcgtctgtggtttcaatgccatactgctcatgtgtgttaatatcttcttctatgcatacttcgcatag

SEQ ID NO: 46369 - DNA, 1683 bp, Artificial Sequence
  Description of Artificial Sequence: Synthetic coding sequence
atggccgccaacagcaccagcgacctgcacacccccggcacccagctctctgtggccgacattattgtgattacggtgtacttcgcactcaacgtcgccgtcggcatatggagcagctgtcgtgcctctcggaacaccgtgaacggctattttcttgccgggcgcgatatgacttggtggcccattggcgctagcctgtttgctagttctgaaggttccggcctcttcattggcttggccggttccggggcggctggaggactggccgtagctggctttgaatggaatgccacctatgtgttgctagcccttgcttgggtgtttgttccaatctacatcagctctgagattgtcacactgcccgaatacatccagaagagatatggggggcagaggatcagaatgtatctgtccgtcttgtctttactactctccgtgtttacgaaaatctccctggacctctacgctggcgctctctttgtccatatctgtctcggctggaacttctacttgtcaaccatactcaccctgggcatcacagcactgtacacaattgccgggggcctggctgccgtcatatacacggatgccctccagacactcataatggttgtgggcgctgttatattaactatcaaagctttcgaccaaattggaggatatggccagctagaggcggcatatgcccaggcaatcccatcacggaccattgcgaatactacatgtcatcttcctcgcactgacgctatgcacatgtttcgcgaccctcacacgggcgatctgccctggaccggaatgacctttggccttactatcatggcaacctggtactggtgcacagaccaggttattgtccagaggtccctgtcagcccgcgacctgaatcatgccaaagcaggctcaattctggcttcatacctgaaaatgcttcccatgggcctgattatcatgccgggcatgatctctcgagccctattcccaggcctgagaggccttatgatcgcagtgatgctcgcagccctgatgtcaagtctaacatctatcttcaacagctccagcacgctgtttacaatggatatctggcgcagactgaggccccggtctggagaaagggagttactattggtgggccggctagtgatcgtcgccttgatcggggtctccgtggcatggattcctgtgctgcaggactctaattccggacagctgttcatctatatgcagtctgttacatcatcccttgcgccacccgtcactgccgttttcgtcctgggagtcttctggcggagagcaaatgagcagggggccttctggggccttattgccggattagtggtgggggctacaagactggtcctcgagttcctaaatcccgcaccgccttgtggtgaaccagacacccgtccggctgtcctcggcagcatccattatctgcatttcgctgtggccctgtttgcgctgtccggggctgtcgtcgtcgccgggagcctcctgacacccccaccccagtccgttcagattgaaaacttgacatggtggacattagcacaggatgtcccacttgggactaaggccggcgacggacagacaccacagaaacatgccttttgggccagagtgtgcgggtttaatgctatcctgttgatgtgtgtcaacatctttttctatgcttattttgcctag

SEQ ID NO: 46370 - DNA, 2028 bp, Artificial Sequence
  Description of Artificial Sequence: Synthetic coding sequence
atggagagcggcaccagcagcccccagcccccccagctggaccccctggacgctttcccccaaaagggtctcgagcctggtgatatcgccgtactggtgttgtactttctcttcgtgctagccgtcggactctggtcaaccgtgaaaactaaacgggacactgtgaagggctactttctagccggcggggacatggtgtggtggcccgtcggagcctcactgttcgcgtccaatgtcggatctggtcactttatcggtctggccgggtccggtgctgccaccggtatctccgtaagcgcttatgagctgaatggattgttctccgtgctgatgctggcctggatctttctgccgatctacatcgcaggtcaggtgaccactatgcctgagtatctccgcaaacgatttggtggtatcaggatccctatcatactcgccgtcctttatctgttcatttacatttttacaaaaatctcagtcgatatgtatgccggagctatttttatccaacagtcactccatctcgatctgtacttggctattgtcggattgttagcaatcacagcagtatacactgtggctggcggtctggctgcggtcatctacactgacgcgcttcagaccctgataatgcttataggggccctgacattgatgggctactcttttgctgcggtgggaggtatggagggcctcaaggagaagtactttcttgctttagccagcaataggagcgaaaattcctcttgtgggctgcctcgtgaggacgcctttcacatatttagagatccccttacctccgacctcccgtggcccggagtgctcttcgggatgtccatcccatcgttgtggtactggtgcactgaccaagtcatcgtgcaaaggactctcgccgctaagaacctctctcacgccaaggggggggccctgatggcagcttaccttaaggttctgccgctattcataatggtgttccctggtatggtaagtcggattttgtttcccgatcaggtcgcatgcgcagacccagaaatttgccagaagatctgctcaaacccaagcggatgctctgacatagcttacccgaaactggtgctggagctgttgccaacaggactcaggggtcttatgatggccgtgatggtcgccgcactcatgtcttcactgacatcaattttcaactctgccagcaccatattcacaatggacttgtggaaccaccttaggccgagagccagtgaaaaagaactgatgatagtcggtcgagtgttcgttctcctgttggtcctggtatctattttgtggatacctgtggtacaggcatctcagggtgggcagctgttcatttacatccagtctatctcaagttatctgcagccaccagtggcagtggtgttcatcatgggctgcttttggaaacgcacaaacgaaaagggagccttttggggcctgatttcgggactgctattggggctggtgcgtctggtgctcgactttatctatgtgcagcccaggtgtgaccagcccgacgagaggccagtgctggtgaagtctatccactacctgtatttttcaatgattctctctaccgtgaccttaatcactgtgtctaccgtctcctggttcactgagccaccctctaaggagatggtcagtcacctgacatggtttactcggcacgacccggtggtccagaaggaacaggcccctcccgctgcaccattgtctctgactcttagccagaacgggatgcccgaagccagtagtagcagcagcgtccagtttgaaatggttcaggagaacacatcaaagacgcacagttgtgacatgacccctaagcagagcaaggtggtcaaagctatcttgtggttgtgcggcatccaagagaaaggaaaagaagagcttcctgctcgggcagaagccataattgtgagtttggaggagaaccctcttgtgaagacactgctcgacgtcaacctgattttctgcgtgagctgcgccatcttcatctggggctacttcgcgtag

SEQ ID NO: 46371 - DNA, 1923 bp, Artificial Sequence
  Description of Artificial Sequence: Synthetic coding sequence
atggagagcggcaccagcagcccccagcccccccagctggaccccctagacgcattcccccaaaaagggctggagccaggcgacattgcggtgttggtgctatactttttattcgtcttggcggtgggtctgtggagcactgtgaaaacaaagcgtgacacagttaaaggctatttccttgccggcggagatatggtgtggtggcccgtcggagcctctctgttcgcctccaacgttgggagtggacacttcattgggttggcaggatctggcgctgctacagggatctccgtgtcagcatacgagttgaacggcttgttctccgtgctcatgctggcttggatcttcctccccatctacatcgcaggtcaggttgacatgtacgcgggagctatcttcattcagcaaagcctgcacttagacttatatctagccatagtggggctgctggcgatcaccgctgtgtataccgtggctggcggccttgctgcggttatctacacagatgccctgcagacactgattatgctgattggtgctttgacattgatggggtacagttttgcagctgttggtggcatggagggcttgaaggagaagtattttttggcacttgctagcaatcgctccgagaacagctcatgtgggctgccccgagaagatgccttccatatatttagagaccccctgacctcagatctgccttggccaggggtactgttcggtatgtcaattccctctctctggtattggtgtaccgaccaggtcatagtccagcgcactctcgctgctaagaatttatcacatgctaagggcggagcccttatggccgcatatctaaaagttttaccgctgtttataatggttttccccggtatggtaagccgaatcctgttccccgaccaggtcgcctgcgccgaccccgagatttgtcaaaagatctgttcaaaccctagcggttgctcagatatagcctatcctaaactggtgctggaacttctgcctaccggcctgaggggcctaatgatggccgttatggtcgctgcgctgatgagctccctgacgtccatctttaacagcgctagtaccatattcaccatggacctatggaatcaccttaggccacgcgcatcagaaaaggagttgatgattgtgggcagagtttttgtactgcttctcgtgctggtaagcatcttatggatccctgtcgtgcaagcatctcaggggggtcagctgttcatctacattcagagcatttctagttatctgcagccacccgtcgccgtcgtgtttatcatgggctgcttctggaaacgcaccaacgaaaaaggagccttttggggattgattagcggattgctgctgggactggtgagactcgtgttggactttatttacgtacagccccggtgtgatcagcccgacgagaggcctgtgttggtgaaatctatccactacctctatttttccatgatcctgagcactgtgacgctgattaccgtgtccaccgtatcatggttcactgagcccccttcaaaggagatggtcagtcacctcacatggtttacgagacacgaccctgtagtgcaaaaggagcaggccccccctgccgcccccctcagcctgactttgtctcagaacggcatgccagaggcgtccagctcaagcagcgtgcagttcgaaatggtacaggagaacacgagcaaaactcatagttgtgatatgacacccaagcagtctaaagttgtaaaagcgatcctctggctctgcggtattcaggaaaaaggaaaagaagaattacccgcccgagctgaagccatcatcgtcagtctcgaggagaatccactggttaaaacactgcttgacgtcaatctgatattctgtgtatcatgcgccattttcatttgggggtatttcgcatag

SEQ ID NO: 46372 - DNA, 1560 bp, Artificial Sequence
  Description of Artificial Sequence: Synthetic coding sequence
atggtgtggtggcccgtgggcgccagcctgttcgccagcaacgtgggctccgggcacttcatcgggttagccgggtctggtgccgctactggaatctctgtgtcagcttacgaactgaacggactgttcagtgtcctgatgctggcatggatcttcttgcccatctatattgcaggacaggtgacaaccatgcctgagtacctgcgcaagaggtttggaggaatacgcatacccatcattttggccgttctttacttattcatttacatcttcacaaaaattagcgtggacatgtatgctggcgcaatttttattcagcagagtttgcaccttgacctgtacttagccatagtaggcctcctagcaataaccgccgtctacactgtcgccggcggactggctgcggtgatttacaccgacgcactgcaaacgctcatcatgctgattggcgcattgaccctgatgggctattccgactgtccggccgattcagggtgccaggagccagtcccttgccagcgaagatgttcagatgggtgcatccccgagggcgccgcccctctgcacaacggcgttccttgggacggtcaaccgcatcctctgccccgtagttcgggtctatgtcgctccagggatcttccagaggacttacagcaacctttgcggctgttcgggcaccgcgtttcacagacaagggccggaacacctgcgcacagcgcaagtaccattttcaccatggacctgtggaaccacctgagaccccgagcttctgagaaggaactgatgatagtcggccgtgtatttgtcctcctgctcgtgctggtttctatcctgtggatacccgttgttcaggcaagtcagggtggacagttgtttatttatatccaaagcatctcaagctatctgcagccgccagtcgccgtggtgtttataatgggttgcttttggaagcggactaacgagaagggcgccttttggggcctcatttccggcctgctactgggattggtgagactggtgcttgattttatttatgtacaaccgaggtgcgaccagccagacgaacgtcccgtactggtcaaatcaatccactatctgtacttttctatgatcctatctaccgttaccctgatcaccgtgagcacagtaagctggtttactgaacctccatctaaagaaatggtgtcacatttaacatggtttacacggcacgaccccgtcgtgcagaaggagcaagccccccctgcagctccgctttcgctaacattgagtcagaacggaatgcctgaagcaagctcctcctcatccgtccaattcgagatggtccaggaaaatacttccaaaacccacagctgtgacatgaccccgaagcagagtaaagttgttaaggcaattctgtggctatgcggaatccaggagaaaggcaaggaggagcttcctgcccgggccgaggcaatcatagtgtccctagaggagaacccattggtaaagacacttctagacgtgaacctaattttctgcgtaagctgtgccatctttatttggggttatttcgcatag

SEQ ID NO: 46373 - DNA, 1836 bp, Artificial Sequence
  Description of Artificial Sequence: Synthetic coding sequence
atggtgtggtggcccgtgggcgccagcctgttcgccagcaacgtgggctccgggcatttcattgggctagccgggtccggagctgccaccggaatttcagtctccgcttacgagttgaatggactattttcagtgttgatgttggcgtggatcttcttgcctatttatatcgcaggccaggttactacaatgcccgagtacctccgcaagagattcggcggaatacgaataccaattatcctcgctgtcctgtacctttttatttacattttcacgaagatctctgtggacatgtacgctggtgcaatcttcattcagcagtcccttcacctagatctgtacctggccatagtaggactgttagctattacagctgtgtacacggtagccggcggcctggccgcagtgatatacaccgatgccctgcagacactcataatgcttatcggtgccctgaccctgatgggttacagttttgccgccgtcggaggaatggagggcctgaaggagaagtacttcctcgcacttgcctccaaccggtcggagaattcatcgtgtggactccctcgcgaagatgcgttccatatttttcgcgacccgttgacgtctgatttaccatggcctggagtgttgtttggcatgtccataccatccctctggtattggtgtactgatcaggtgattgtgcaaagaaccttagcagcaaaaaatctaagccacgcgaaagggggggcactgatggcagcttatctgaaggtgctgccgttgttcatcatggtattccctggcatggtctccaggatcctcttccctgatcaagtcgcatgcgccgatccagagatttgtcaaaagatctgctccaatccatccggctgtagcgacattgcatatcccaagctagttctcgaactgttgccgactgggttgcgcggattaatgatggccgtgatggtagccgcgttaatgtcctccttaactagtatttttaattctgcgagcaccattttcactatggatctctggaatcaccttaggccacgggccagtgaaaaggaactcatgattgtcggacgggtctttgtgctcttattggtactggtctctatcttatggatcccggtggttcaggcaagtcaggggggacagctattcatctatattcagtccatctcctcctatttgcagcctcccgtggccgtggtctttatcatgggttgtttttggaagcggaccaatgaaaaaggagcattctggggtctgatcagcggcttgctcctcgggctcgtgagactagttttagacttcatctacgttcagccccgatgcgatcagccggatgagagaccagtgttggtaaagagtatccactacctgtacttttcaatgattctgtctacagtgacactgatcacagtgtccacagtaagctggtttacggaacctccttcaaaggagatggtctctcacttgacttggttcacaaggcatgaccccgtggttcagaaagaacaggctcctccagcggcacctctctcattgacgctatcacagaacggcatgcctgaagcatcctccagctcttctgtccagttcgagatggttcaggagaataccagcaagactcattcatgtgatatgacaccgaaacagagtaaggtggtgaaggccattctttggctgtgtggcattcaggagaaggggaaggaagagctcccagccagagctgaggcaattatagttagtctcgaggagaaccccctggtcaagacgctgcttgacgtgaacttgatcttctgcgtttcctgcgctatcttcatctggggatacttcgcctag

SEQ ID NO: 46374 - DNA, 1818 bp, Artificial Sequence
  Description of Artificial Sequence: Synthetic coding sequence
atggagagcggcaccagcagcccccagcccccccagctggaccccctagacgcattcccacaaaaaggtctagagccaggggatatcgcagtcttagtgctctatttcttgtttgttctagccgtaggtctgtggtctactgtgaaaaccaaacgggatacggttaagggctactttctcgccgggggagatatggtttggtggccaggtctgtttagtgttttaatgctggcttggatctttttgccaatatacatcgctggacaagttgatatgtatgccggagccatcttcatccagcaatccctacaccttgacctctatcttgccatcgtcggactcttagcgatcaccgctgtttacactgtagccggaggactggcggctgtcatttacacagacgccttgcagaccctgattatgttaatcggggctctgactctgatggggtactcatttgcggcagtgggaggcatggagggcctcaaggaaaagtatttcttagccctcgccagcaatagatccgagaattcatcttgtggcctgcctcgggaggacgcgttccacattttcagagatcctctgacatccgacctgccatggcccggtgtcctgtttggcatgtctatacccagcctctggtattggtgtactgatcaggtcatagtgcagcgcaccctggccgccaaaaacctcagccatgctaagggcggggccctgatggccgcctatcttaaagttctgccactgtttataatggtgttccctggaatggtgagtcgcatcttgttccctgaccaggtggcatgcgccgaccccgagatctgccagaagatttgctccaatccttccggatgttcagatatcgcttatcccaaactggtgcttgaactgttgcctactggactgcggggattgatgatggccgtcatggtcgccgctcttatgtcctccctcacttcaatctttaactccgcctctactatttttacaatggacctgtggaaccatctccgtccaagagcctccgagaaagaactgatgattgtaggaagggtctttgtgcttctgctggtcttagtgtcgatcctgtggattccagttgtgcaggcttcgcagggcggccaattgttcatctatatacagagtatctccagctaccttcaaccgcccgtggccgtagtgtttataatgggctgcttttggaaacggacaaatgaaaagggggctttctgggggctcatctcaggcttgttactgggcctggtacgactggtgctggattttatttacgtgcaacccagatgtgatcaacccgacgaaagacccgtgctcgtaaaaagtatccattacttgtacttcagcatgatactcagcacagtaaccctgattacagtctcgacagtctcatggttcacggagcctccttctaaggagatggtcagccatctcacctggttcacaaggcacgacccagttgtgcagaaagagcaggctccaccagctgccccactcagtctcaccttgagccagaatggtatgcccgaagcgtctagctcttcatctgtgcagttcgaaatggttcaggaaaatacctcaaagacacattcgtgtgacatgactccaaagcaaagcaaagtggtcaaggcgattctgtggctgtgcggaatccaagagaaaggtaaggaggagctgccagcacgggctgaggcgattatcgtctccctcgaagaaaatcctttggttaagacactgctggatgtcaacctgatcttctgcgtctcatgcgcaatcttcatctgggggtactttgcctag

SEQ ID NO: 46375 - DNA, 2121 bp, Artificial Sequence
  Description of Artificial Sequence: Synthetic coding sequence
atgagcaaggagctggccgccatgggccccggcgccagcggcgacggagtcaggaccgaaacggctccgcacatcgcactggatagcagagtagggctgcacgcctatgacatctctgttgtggttatctattttgtcttcgttatcgcagtcggaatctggtccagtatcagggcgagccgaggaacaattggaggctacttccttgccggaagatctatgtcttggtggcctatcggtgccagcctgatgtcaagtaatgtgggatccggactgttcatcggcctggctggcacgggcgccgctggagggctagccgtgggggggtttgaatggaacatgaggaagagccgtagcggtggggacagggggatccatccccgatctcatggtcggacaggcgttagatctcaggccacctggctgttgttagctctgggatgggtgtttgtccccgtgtacatagctgctggcgtagtcactatgcctcaatatcttaaaaaacgattcggtgggcagagaattcaggtctatatgagtgtgctttcgttgatcctctacatcttcacaaaaatttctacagacatttttagtggggccttgtttattcagatggctttaggatggaatctgtacctgtccactgggatactactggtcgttaccgctgtgtacaccatcgccggtggcctgatggcagtgatttacacagacgccctgcagactgtgatcatggtggggggggcgcttgtactgatgtttctcggctttcaagatgtcggatggtacccagggctagagcagagataccgacaggccatccccaatgttacagtacccaatactacctgtcacctgccccgccccgacgcctttcatatcttacgggacccagtcagcggagatattccttggcctgggctgatcttcggactgaccgtcctggccacatggtgttggtgtacagaccaggtaatcgtgcaaagatccttgagcgccaagtcattgtcccatgcaaaaggcgggagtgtgcttggtggctacctcaagattctgcctatgttctttattgtaatgcccggcatgattagccgggccctctttcccgatgaggtgggttgtgtcgaccctgacgtctgtcagaggatttgtggcgctagggtgggctgttcgaacattgcttaccctaaactggtgatggcactaatgccagttggactccggggcctgatgattgcagtgattatggcagccctgatgtctagcttgactagtatcttcaacagctcttccaccttgtttactatagatgtctggcagcgcttcaggcgcaaatccacagagcaggaactgatggtcgtgggaagagttttcgtcgtattcctcgtggtgatctcaattctgtggataccaataatacagtcatctaattccgggcagctgttcgattacattcaggccgtgacttcctatctcgctcctccaatcactgcactgttcctcctggcaattttctgtaagcgggtaacggagcccggcgcattctggggacttgtgttcggcctcggtgtcggcttgctgcgcatgatactggagttctcctatcccgctccggcatgcggcgaagtggatagaagaccagccgtgctaaaagacttccactacctctacttcgccattctattgtgtgggctcactgccatcgttatcgtgatcgtttcattgtgcacgacacctattcctgaggaacaactgactagactgacttggtggacccgaaattgcccactgagtgagctggaaaaagaggcccacgagagtaccccagagatctctgagcggcctgccggcgagtgcccggctggcgggggcgctgccgaaaacagcagtctcggacaagagcagcctgaagctccttctcggtcctggggaaaactactgtggtcgtggttttgcggactctcagggacccctgagcaagctttaagccccgccgagaaagctgcactcgagcagaagttgacaagtattgaagaggaacctctgtggagacatgtgtgtaatataaacgcagtgcttctattagcaattaacatttttctctggggatacttcgcttag

SEQ ID NO: 46376 - DNA, 501 bp, Artificial Sequence
  Description of Artificial Sequence: Synthetic coding sequence
atgggccccggcgccagcggcgacggcgtgcggaccgagaccgccccacacatcgctcttgacagccgcgtgggactccatgcatatgacattagcgtcgtggtgatatactttgtgtttgttatagccgtcgggatttggtcctctattcgggcgagtcggggaactatcgggggctactttctggccggtcggagcatgtcctggtggcccattggcgcaagtcttatgtcctctaatgttggctcaggcctatttatcggactggcagggacaggggcagctggggggttagccgtcggtggcttcgaatggaacgcaacttggctcctgctggcattgggctgggtcttcgtacccgtgtacattgccgctggggtcgtaactatgcctcagtacttaaaaaagagattcggcggccaacggattcaagtatatatgtctgtactctctctgatcctgtacattttcaccaagatttcaggctcttgttggtggtag

SEQ ID NO: 46377 - DNA, 2046 bp, Artificial Sequence
  Description of Artificial Sequence: Synthetic coding sequence
atgagcaaggagctggccgccatgggccccggcgccagcggcgacggcgttcgaactgagactgctccgcacatcgccctcgactcccgagtgggtctgcatgcgtatgacatctcagttgtggtgatatacttcgtcttcgtgatagctgtggggatttggtcaagtatcagggcctctcgaggtaccataggcgggtactttcttgctggacgctccatgtcctggtggccaatcggggcaagccttatgagtagcaacgttgggtcgggcctattcattgggttggcaggaaccggcgcagctggcggactcgcagttggggggttcgagtggaacgctacatggttactgctcgcattgggctgggttttcgtgccagtgtatattgcagccggcgtagtaacaatgccacagtatttgaaaaaacgatttggaggacaaaggattcaagtttatatgtccgttctgagcttaatcctgtacatttttacaaagattagtacagatatcttttcaggtgccctattcatccaaatggccctcgggtggaatttgtacctctcaactggaattttgcttgtggttacggccgtgtataccatagctggcgggttgatggccgttatctacaccgacgctctgcagactgtgatcatggtgggcggggcactggtacttatgttccttggcttccaggacgtcgggtggtaccccgggctggagcagaggtatcgccaggccatacccaatgtcaccgtacctaacactacgtgtcacttgcccaggcctgatgctttccatattctcagggaccctgtgagcggtgatatcccgtggcctggcttgatttttgggctaacggtcctggcgacatggtgttggtgtactgaccaggtgatagtccagaggagcctgtcagctaagtcgctctctcatgctaagggcggaagcgtcctcggtgggtatctgaaaatacttcccatgttctttattgtcatgccaggaatgatcagcagggcgcttttccctgacgaagttggatgtgtggatccagacgtgtgccagaggatctgcggagctcgagtgggttgtagtaacatagcttaccccaaactggtaatggctcttatgcccgttgggcttaggggcctcatgattgcggttatcatggccgccctcatgagcagcctgacaagcatctttaacagctccagcacccttttcactattgatgtgtggcaacggttccgtcgcaagagcaccgaacaggagctcatggtagtgggcagggtcttcgtagtcttcctggtggtgatcagtattctttggattcccatcattcagtcatctaattccggtcagttgttcgactacatacaggcggtcacctcgtacttggcgccacccattaccgcactatttcttctggccatattctgtaagagggtaacagaaccaggtgcgttctggggccttgtcttcggtttaggcgtagggcttcttcgtatgatactggagttctcctatcccgcacccgcgtgcggcgaagttgacagaagacccgccgtgttgaaggattttcactacctgtattttgctattctcctgtgcggcctcacagccattgtgatcgtgattgtgagcttatgtaccacacctatccccgaagaacagcttactcggttaacatggtggacgaggaactgcccactcagcgaattggagaaggaagcccacgaatctacaccagagattagcgagcggcccgccggtgagtgcccagcaggtgggggcgcagctgaaaactcgagtctgggacaggagcagccagaagcaccctcaaggtcctggggaaagctgctttggtcatggttctgcgggctctcaggtacaccggagcaggcactgagcccagccgaaaaagcggccctggaacagaaacttacatcgatcgaagaagaacccctctggcgccatgtgtgcaatatcaatgcagtgttgctgctggccattaatatttttctttggggctacttcgcctag

SEQ ID NO: 46378 - DNA, 522 bp, Artificial Sequence
  Description of Artificial Sequence: Synthetic coding sequence
tgaagcaaggagctggccgccatgggccccggcgccagcggcgacggggttagaaccgagaccgcaccacacatcgctctggacagtcgggtgggcttgcacgcatacgacatttcagtcgtagtgatctactttgtgtttgtgatcgctgtcggtatctggtcgagtataagagccagccggggcacgatcggcgggtactttctggctgggaggagtatgagctggtggccgattggggccagcctgatgagctccaacgttggtagtggtctcttcattggcctggccggcactggcgcggcaggaggacttgccgtaggcgggttcgagtggaacgctacttggttactcctcgcgctgggttgggtctttgtccctgtgtacatagcggcaggagtggtaaccatgccccagtatttgaagaagcgttttggcggccagagaatacaggtctacatgtccgtgctgagcctcatcctttatattttcaccaagatctccggcagctgttggtggtag

SEQ ID NO: 46379 - DNA, 1908 bp, Artificial Sequence
  Description of Artificial Sequence: Synthetic coding sequence
atgagcgtgggcgtgagcaccagcgcccccctgagccccaccagcggtacaagtgtggggatgtccaccttttccattatggactacgttgtgttcgtgttgttactggttctgagtctggcgataggtttgtatcatgcttgtcggggttggggaagacacactgtgggtgaactgctaatggcggaccggaagatgggatgcctgccggtcgcactgtctctcttagctaccttccagtcggcggtggctattttgggcgtgcccagtgagatttataggttcggtacacaatattggttcctgggttgctgctatttcctgggcctgctaatccctgcgcatatctttatcccagtgttctataggctgcacctgacctccgcctacgagtacctcgagctgagattcaataaaacagtacgggtctgcggaacggtgacatttatattccagatggttatatatatgggagtagtattgtacgccccttctctcgccctcaatgccgtcactggatttgacctgtggctgagcgttctggcactaggcatcgtgtgcaccgtttatacagctctgggagggctcaaagctgtcatctggactgatgtgtttcagactctcgttatgttcttgggtcaactcgctgtgattattgtcggatccgcaaaggttggaggcctaggcagagtgtgggcagtggcaagccagcacgggaggataagcggatttgaactggacccagacccatttgtccggcacacattctggaccctcgcattcggcggggtgttcatgatgctgtctctttacggcgtgaaccaagctcaggtccagaggtacctctctagtcggaccgagaaggcagcagtactgtcatgttatgccgtgtttcccttccagcaggtttctttgtgtgtagggtgcctgattggattagttatgttcgcctattaccaggagtacccaatgtcgatccagcaggcccaggccgcgccagatcaattcgtcctgtatttcgtgatggacttgctgaagggcctccccggcctcccagggctgttcatcgcctgcctcttctcgggcagcctctccacgattagtagcgctttcaattcgctggcaaccgttaccatggaagatcttatcagaccttggttcccagagtttagcgaagcacgcgccatcatgctctctaggggccttgccttcggatacggcctcctgtgcttgggaatggcatatatctcgtcccagatgggtccagtgttacaggcagctatttccatcttcgggatggtggggggcccccttctgggactgttttgcctcggcatgttttttccttgcgccaatcctccaggggccgtcgtaggcttgttggcaggtctggtcatggctttctggatcggtattggctcaatcgtgacatctatgggatcgagtatgccaccatcccccagtaatggttcaagtttctcacttcctactaatctgacagtggcaaccgttaccaccctaatgccactcacaacgttttctaaacccacaggcctgcagcgcttttacagcctttcttacctctggtatagtgcacacaacagcaccaccgtgatagtggtgggcctcatcgtcagcctgctcacagggcgtatgcgaggaaggagcctgaatccagctaccatctatcctgtgctcccaaagctgctttcactgctgcccctgagctgtcagaagagattgcattgccgtagctacggccaggaccacctggatacaggactttttcctgagaaaccacgcaatggggtcctgggcgatagcagggacaaggaggcgatggctctggacggtaccgcataccagggaagtagctcgacatgtatccttcaggaaacaagcctgtag

SEQ ID NO: 46380 - DNA, 444 bp, Artificial Sequence
  Description of Artificial Sequence: Synthetic coding sequence
atgagcgtgggcgtgagcaccagcgcccccctgagccccaccagcggaacgagtgtggggatgagcacattttctattatggactacgtcgtctttgtcctgctcctggtgctctccttggcaatcggcctgtaccacgcatgtaggggttggggacggcataccgtgggtgaactgttgatggctgatagaaagatgggatgcctgcctgtggccttgtcccttctcgccacgttccagtccgccgtggctatcctcggggtccccagcgaaatataccgttttggtacgcagtactggtttctcgggtgttgctattttcttgggctgctgataccagcccatatcttcattccagtattctacagacttcaccttacttctgcctatgagtatttagagctgcggtttaacaaaacggttagagtttgtggcaccgtttag

SEQ ID NO: 46381 - DNA, 1908 bp, Artificial Sequence
  Description of Artificial Sequence: Synthetic coding sequence
atgagcgtgggcgtgagcaccagcgcccccctgagccccaccagcggcacctctgtgggcatgtcaacttttagtatcatggattacgttgtgttcgtgctcctgctggtgctgtcactggctatcggcctgtatcacgcctgccgcggatggggacgccacaccgtcggcgaactgctgatggctgacagaaagatgggctgcctcccggttgccctttcacttctcgctaccttccaatctgcggtagccatcctcggggttccatctgaaatataccgtttcggaacccagtactggttcttgggctgttgctactttctcggtctgctcatccctgcgcacatcttcatccccgtgttctatcgactgcacctcactagtgcctacgagtacctggagctgagatttaacaagaccgtacgagtatgcgggacggtcacattcatatttcagatggtgatttacatgggtgtggtactgtatgccccctcacttgccctcaacgctgtgaccggttttgacttatggttatcagtgctggctttggggatcgtgtgtacagtgtacaccgcactgggtggactgaaagctgtaatctggacagatgtctttcagactctcgtgatgttcttggggcagctggcggtgattattgtggggtccgctaaggtaggtggcctgggccgcgtctgggccgttgcctcccaacatggccgcatctccgggtttgaactggacccagatccttttgttcggcacactttttggacactggcgttcggcggggtgttcatgatgttgtccctctatggagtgaaccaggcccaggtgcagcgctatctctcttctagaacagagaaggcagctgtacttagttgttacgcagtatttccgttccagcaagtcagtctttgcgtggggtgcttgataggtttggttatgttcgcttactatcaggagtatcccatgtccatacagcaagcacaggcggccccagaccagtttgtactttatttcgtcatggacctgctaaagggattgcctggactacctggactcttcatcgcctgcctgttctccggctcactgagcactatttctagcgcatttaatagccttgccacagtaactatggaggatctgatccggccctggttccctgaattcagtgaggcgcgcgctattatgctgtcacgtggactcgcctttggatacggtctgctttgcctgggaatggcttacatatcaagccagatgggccctgttctgcaggccgccatctctattttcggcatggtgggcggcccgctcctcgggcttttctgcctgggtatgttctttccatgcgcaaatcctccaggagccgttgtcgggctcctggcaggccttgtgatggccttttggatcggaataggttcgattgtgactagcatgggcagtagtatgccgccgagtcccagcaacgggtctagcttcagcctgcccacaaacttaaccgtggccactgtgacaactctgatgcctctgactactttcagcaaacccaccggactccagcgattttatagcctgtcctacctgtggtactccgcccataactctactacagtaattgtagtgggcctgattgtgtcgctgctgacgggaaggatgaggggcaggagccttaaccccgctactatttatccagtgctgcctaagttattaagcctactgcctcttagctgtcagaaaagattgcactgtagaagttatggacaggatcatcttgacacaggcctgttcccggaaaagccacggaatggcgtgttaggggatagcagagacaaggaggccatggcactggacggtacagcataccaagggagttcctctacatgcatccttcaagaaacatcgctctag

SEQ ID NO: 46382 - DNA, 582 bp, Artificial Sequence
  Description of Artificial Sequence: Synthetic coding sequence
atgagcgtgggcgtgagcaccagcgcccccctgagccccaccagcgggaccagtgtgggcatgtctaccttcagcattatggactacgtggtgttcgttttgttgctggtcttgagcctggcaattggcctgtaccacgcctgtcgtgggtgggggagacacactgtcggcgagttactcatggcagatcggaaaatgggctgcctacccgtagctttgagtctgctggcaacttttcaatccgccgtggccatattaggagtgccctccgagatatacaggtttggaacccaatactggttcttagggtgctgctatttccttgggcttcttataccagcccacatctttattccagttttctataggttgcaccttaccagcgcctacgaatatctcgagttgcgtttcaataagactgtaagggtgtgtggcactgtgacatttatcttccagatggtcatctacatgggcgtcgtcctgtacgctccttcgctagctttaaatgctgtaactgggttcgatctctggctgagcgtcctcgcattggggattgtgtgcacagtttatactgccctctag

SEQ ID NO: 46383 - DNA, 237 bp, Artificial Sequence
  Description of Artificial Sequence: Synthetic coding sequence
atgagcgtgggcgtgagcaccagcgcccccctgagccccaccagcggcaccagtgtgggtatgtccacattctcgataatggactatgttgtcttcgtgctgctgctcgtcctatcactggccatcggactttatcatgcctgtcgcggctggggccgtcacactgttggagagctccttatggccgacagaaaaatgggctgtctacctgtcgcactgtcgcttttggccacatag

SEQ ID NO: 46384 - DNA, 348 bp, Artificial Sequence
  Description of Artificial Sequence: Synthetic coding sequence
atgagcgtgggcgtgagcaccagcgcccccctgagccccaccagcggtacatccgtaggtatgtccactttttctattatggattatgtggtcttcgtcctattgcttgtgctcagcctcgcgatcgggctatatcatgcctgcagaggctggggccgccacaccgttggggagctgctcatggcagatcgtaaaatgggctgtctccccgttgccttgtctctgctcgccacctttcagtccgctgtcgccatcctcggagtacccagcgagatatatagattcggcacgcagtactggttcttagggtgttgctacttcctcgggcttctcatcccagctcattag

SEQ ID NO: 46385 - DNA, 180 bp, Artificial Sequence
  Description of Artificial Sequence: Synthetic coding sequence
atgagcgtgggcgtgagcaccagcgcccccctgagccccaccagcggaaccagcgtgggtatgtccactttctcaatcatggactacgtcgtgtttgtcttattactggtgcttagtctggcaatcggtctttaccacgcctgtcgaggatggggacgccatacggttggcgagttatag

SEQ ID NO: 46386 - DNA, 120 bp, Artificial Sequence
  Description of Artificial Sequence: Synthetic coding sequence
atgagcgtgggcgtgagcaccagcgcccccctgagccccaccagcggtacttctgtcggcatgtctaccttttcaatcatggactatgttgtgtttgtgctgctcttggttctgtcttag

SEQ ID NO: 46387 - DNA, 402 bp, Artificial Sequence
  Description of Artificial Sequence: Synthetic coding sequence
atgagcgtgggcgtgagcaccagcgcccccctgagccccaccagcgggactagtgtgggaatgagtaccttttctattatggactacgtggtcttcgtgctcctcctcgttctttccctggcaatcggcctatatcatgcctgccgtggatggggccgacacactgtgggagaactgctgatggccgaccgtaagatggggtgcctccctgtagcattgagcctgctggcaacctttcaatctgcagtagctatcctcggtgtaccttccgaaatttataggtttggaacgcagtactggtttctgggctgctgttactttttagggttattaattccagcccacatttttatccccgtgttttacagattgcatttaacttccgcttacgagtatttatag

SEQ ID NO: 46388 - DNA, 84 bp, Artificial Sequence
  Description of Artificial Sequence: Synthetic coding sequence
atgagcgtgggcgtgagcaccagcgcccccctgagccccaccagcggaaccagcgtgggtatgagtacttttagcattatgtag

SEQ ID NO: 46389 - DNA, 462 bp, Artificial Sequence
  Description of Artificial Sequence: Synthetic coding sequence
atgagcgtgggcgtgagcaccagcgcccccctgagccccaccagcggaacaagcgtgggcatgtccacgttctcaatcatggattacgtggtcttcgtgctactactcgtgttgagtctggcaattggactgtatcatgcatgtcgaggatggggccggcacaccgtgggcgaacttctgatggccgacagaaaaatgggatgtctgcctgtggcgttaagcttactggctactttccagtctgccgtagcgattttgggggtgccatctgagatctacagatttggcacccagtactggttcctgggatgctgttattttttgggtctgctgatccctgcccatatcttcattccagtgttttaccgtcttcatctcacttccgcctatgagtacctggagctgaggttcaataagaccgttcgcgtgtgcggcacagtgacttttatctttcaaatgtag

SEQ ID NO: 46390 - DNA, 1746 bp, Artificial Sequence
  Description of Artificial Sequence: Synthetic coding sequence
atggagcggcagaaccagtgcatccagagctggaagcggcggcggaagatggctccatggtcgggcggaacaggcactacgcgttggtccctctgcaacgtctggcggttcccgtacttgtgctacaagaatggcggcggggcattcttcataccatacctggtgttccttttcacgtgcggcataccggttttccttttggagacagctctgggccaatatacaagccaagggggcgtgaccgcctggagaaagatttgcccaatcttcgaaggcattgggtacgctagccagatgatcgttatcctcctcaatgtctactatattatcgtattagcttgggccctcttttacctgttttcttcattcacaattgatttgccctgggggggctgttatcatgaatggaatactgaacactgcatggaatttcagaagacgaatggaagcttgaacggtaccagcgagaatgccacaagcccagtcattgagttctgggagcgccgggtattgaagatatcggacgggattcagcaccttggcgccctcaggtgggaactggcactttgtctgctacttgcctgggtgatctgctacttttgcatatggaagggcgtaaaatctactggcaaggtggtatattttaccgccacctttccgtaccttatgctcgttgtgttactgatccgaggcgtcacactgcccggcgctgctcaggggattcagttctatttgtacccaaacctgacacggctgtgggatccccaggtgtggatggacgccgggacccagatattctttagcttcgcaatttgcctgggatgtctcactgcactggggtcttacaataaataccacaacaactgttaccgcgattgcattgccctttgttttcttaatagtggcacttcctttgttgcgggtttcgccatcttctctatcctaggtttcatgagccaggaacagggagtgccgatttcagaggtagccgagagcggccccggccttgcctttatcgcgtatccccgggcagtcgttatgctgccattcagccctctttgggcttgctgtttcttctttatggttgtgctgctgggcctcgacagccagttcgtctgtgtagaatccctggtaaccgcattggtggatatgtatccacacgtattcagaaaaaaaaaccgaagggaagttctgattctgggcgtctccgtagtgtcttttctcgtcgggttgataatgctgacggaggggggcatgtacgtcttccagctgttcgactactacgcggcctccgggatgtgcctgctgttcgtggcaatcttcgaaagcctgtgcgtagcttgggtgtatggggctaagcgtttttatgataacatcgaggatatgattggctaccggccctggccgctaattaaatattgctggctcttcctaacccccgccgtgtgcacagcaacctttttgttttctctcattaaatacacacctttaacgtataacaagaaatatacctacccctggtggggagacgcgttgggatggctcctagcactgtcgtcgatggtctgcatacctgcctggtcactgtatcggctggggacccttaagggcccgttcagggagcgaattaggcagcttatgtgcccagcggaggacttgccccagagaaatcccgccggtccttccgctcctgccactccccgcaccagcttgctacgtctcactgagctggagtcccactgctag

SEQ ID NO: 46391 - DNA, 1809 bp, Artificial Sequence
  Description of Artificial Sequence: Synthetic coding sequence
atggacagccgggtgagcggcaccaccagcaacggcgagaccaagcctgtatatcctgtcatggagaaaaaagaggaagatggaactttagaaagaggtcactggaacaacaagatggagttcgtcctttctgtcgccggtgaaatcatcggattgggaaacgtatggcgctttccttatctctgttataagaacggaggtggcgcctttttcatcccatatctggtgtttctcttcacctgcggcatcccagtgtttttgctggagacggctctaggtcaatatacatctcaggggggcgtgacagcttggcggaagatctgccctatatttgaggggattggctatgcctcccaaatgatcgtgatactccttaacgtatattacatcattgtgctcgcctgggcgctcttctacctcttcagttcgtttacaattgacttgccatgggggggttgttaccacgaatggaacactgaacattgcatggaatttcagaaaactaacgggagtttgaacggcacctccgaaaacgcaacctcacctgtgatagagttctgggaaagacgagttcttaagatttcagatggtatacagcacctgggggcactgcggtgggagcttgctctctgcctgctgctggcttgggtcatctgttacttttgtatttggaagggcgtcaagtcaactggcaaagtggtgtactttacagccacatttccttatctcatgcttgtagtcttgctgatcaggggtgttacattacctggcgcggcccagggcatccagttctatctgtatcccaatcttacacgactttgggacccccaggtttggatggatgctggcacccaaatcttttttagctttgctatctgcctaggttgcctaactgccctgggctcttataacaaatatcacaataactgttatcgagattgtatcgcactttgtttcttgaattccgggacctccttcgtggcgggttttgccatctttagcatcctaggattcatgagccaggaacagggcgtgccaatatccgaagtggcagagagcgggccaggcctggctttcattgcctatcctcgagcggtcgtgatgcttcccttctctccattatgggcttgctgtttcttctttatggtggttctgctcggactggattctcagtttgtgtgtgttgagtccctggttaccgccctcgtggacatgtacccccacgttttccggaaaaaaaatcggagagaagttctgattttaggcgtgtcagtggtctcatttcttgtgggcctaattatgctgacggagggcggaatgtacgtgtttcagctcttcgactactacgccgcatcggggatgtgtctgcttttcgtcgccatcttcgagtccctctgcgtcgcttgggtgtatggggcgaaaagattctacgataacatcgaggatatgatcgggtataggccctggccgttgattaaatattgctggctgtttttgacacctgcagtgtgtacagcgacctttctgttttccctcattaagtacacgccattgacttataacaagaagtacacctacccatggtggggggatgctttgggatggctgctggccctaagctccatggtatgtatccctgcatggtctctctaccggctgggcaccctcaaggggccatttcgcgagcgcattcgccagctgatgtgcccggcagaggatctgcctcaacggaatccagccgggccaagtgctcccgccaccccccgaacgtccctcctgcgactgactgagctggagagccattgctag

SEQ ID NO: 46392 - DNA, 294 bp, Artificial Sequence
  Description of Artificial Sequence: Synthetic coding sequence
atggacagccgggtgagcggcaccaccagcaacggcgagaccaagccggtctacccagtcatggagaagaaggaagaggatgggacattggagcggggtcattggaacaataagatggagttcgtcttgtcagtggcgggggaaataattggtcttgggaatgtctggaggttcccatacctgtgctacaagaacggtgggggagagatgagggccctcgtaccaccacatccactgttggagggtggatattttcacttactccacctgcgacctctctggggagtgccttag

SEQ ID NO: 46393 - DNA, 1533 bp, Artificial Sequence
  Description of Artificial Sequence: Synthetic coding sequence
atggacagccgggtgagcggcaccaccagcaacggcgagaccaagcccgtctaccccgtgatggagaagaaggaagaggacggaaccctagaacggggccattggaataacaaaatggaattcgttttatccgtagcgggcgaaataatcggattaggtaacgtctggaggttcccttatttgtgctataagaatggcggagagcattgcatggagttccagaagaccaatgggtctctgaatggcacttccgaaaatgctacctcacccgtgatagaattctgggagagacgggttttgaagatttcagacggaatacagcatctaggagcactacgctgggagcttgccctctgcctgcttctggcttgggttatttgctatttctgtatatggaagggagtgaagagtaccggaaaggtggtttacttcacagccacctttccctatctgatgttggtggtactgctcatccgcggggttacattgcccggagcggctcaaggcatacagttttacttgtatccgaatctcactagactttgggatccccaagtgtggatggacgccggcacacagatcttcttctcctttgctatttgtctgggctgcctaactgccctgggcagttacaataaataccataataactgctaccgggactgcattgccctgtgcttcttgaactctgggacgtcttttgtcgctggttttgcaatttttagcatcctaggtttcatgagtcaagaacagggcgtgcccatttcagaggtcgcggaatccggccccggcctcgcctttatcgcatacccacgagctgtggtgatgctgccgttcagccccctctgggcatgctgtttctttttcatggtggtgttgcttggactggactcgcagttcgtttgtgtagaatctctggtgactgccctggtggacatgtatcctcacgtgtttcgcaaaaaaaatcgccgggaggttctgatattgggggtcagcgtcgtgagcttcctcgtaggactcattatgctcacggagggaggcatgtatgtcttccaattgttcgactattacgcagctagtggcatgtgcctgctgttcgtcgcaatcttcgagtctttgtgtgttgcatgggtgtatggagcgaagcgcttctatgacaatattgaggatatgatcggataccggccctggccgctgataaagtattgctggcttttcttgacacccgctgtgtgcacagcgacttttttattcagtctgattaagtacactcccctcacttacaacaagaaatatacttacccatggtggggcgatgcacttggttggctacttgctttaagttccatggtttgtattcccgcttggagtctctacagactgggcaccctgaagggaccatttcgggagaggattagacaacttatgtgtcctgcagaggaccttcctcagcgcaatcccgctggtccttccgcaccagctactccaaggacctctttgctgcgcctaactgaattggagtcccattgctag

SEQ ID NO: 46394 - DNA, 2193 bp, Artificial Sequence
  Description of Artificial Sequence: Synthetic coding sequence
atgcccaagaacagcaaggtggtgaagcgggagctggacgacgacgttaccgagtctgtcaaagatctgcttagcaatgaagacgcagccgacgatgctttcaagacctcagagctgatcgtcgatggacaagaggaaaaggacacggacgttgaggagggctccgaggtggaagacgagcgccctgcttggaacagtaagctgcagtacatccttgcccaggtgggctttagtgttggattaggcaacgtgtggcgcttcccatatttgtgtcagaagaacggcggcggcgcctacctgctgccgtacctcatccttctgatggtgatcggtattcccctattttttcttgaattgagcgtgggccaacggatccgaagagggtccattggcgtctggaattatatcagcccgaaactgggtggtatcggcttcgcaagttgtgtcgtttgctactttgtcgctctatactacaacgtaattatcggttggagccttttctatttctctcagtccttccagcagcctctgccatgggaccaatgcccactcgtgaaaaacgcttctcatacattcgtcgaacccgaatgtgagcagtccagcgcgaccacttattattggtatagagaagcactgaatatcagcagctcgatttctgaaagtggggggctcaattggaagatgaccatctgcttactcgccgcatgggtgatggtgtgcctcgccatgattaaaggaatccagtcatcgggaaaaataatatatttctctagtcttttcccctatgtggtgctgatatgcttcctcatcagagcttttctactgaatggctcaatcgatggaataaggcacatgtttacccctaagctggagatcatgctggagcccaaggtgtggcgtgaggctgccacacaggtgttcttcgctctgggactgggatttgggggtgtgattgctttctcttcctacaacaagagagataacaactgtcacttcgacgcagtgctggtgtccttcatcaatttcttcacgtccgtcctcgcaaccctagtggttttcgcagtgcttgggtttaaagctaacgtaattaatgagaaatgcatcacacaaaacagcgagaccatcatgaagttcttaaaaatgggcaatattagccaggacattataccccatcacatcaacctgtccacagtgacagccgaggactaccatttagtatatgacatcatccagaaagtaaaggaagaagagtttccagccttgcacctgaactcctgtaaaatagaggaagagctcaataaagccgtacaaggcacgggtctggcgttcattgcattcactgaagcaatgacgcattttcctgcgtcacccttctggtccgtcatgttcttcctgatgctggtgaacctagggctcggttctatgttcggaactattgagggtatcgtgactcctatcgtagacaccttcaaggtccggaaagaaattctgacagtgatctgctgtctgctagccttttgtatagggcttatcttcgttcaacggagcgggaactactttgtgacaatgttcgatgactatagtgccaccctgccactgctgattgtggtgatcttggaaaatattgctgtctgctttgtttacggtattgacaaatttatggaggatctcaaggacatgctggggtttgcacccagccggtactattactacatgtggaaatatatatccccattaatgctgctgtccctgcttattgcgtccgtggtgaacatgggcctgtcaccacctgggtataacgcttggatcgaggataaggcatctgaggagttcttgtcttatcctacctggggtcttgtggtgtgcgtgtcactcgtggtgtttgccatcctccctgtccctgttgtcttcattgtcagaaggtttaaccttatcgatgattcgagcggcaacctagcatccgtgacgtataagcgcggtagggttcttaaagaacccgtcaatctggaaggtgacgacactagcctcattcacgggaaaatcccctctgagatgccaagccctaattttggaaagaatatctataggaagcagtctggatccccgacgctcgatacagcacccaacggcagatacggcattggttacctgatggccgatataatgccagatatgcccgaaagcgacctatag

SEQ ID NO: 46395 - DNA, 750 bp, Artificial Sequence
  Description of Artificial Sequence: Synthetic coding sequence
atgttcacccccaagctggagatcatgctggagcccaaggtgtggcgggaggccgcaactcaggtgttctttgcattggggttaggcttcgggggcgtcattgcctttagctcgtacaataagagagataataactgccatttcgatgctgtgctggtcagtttcatcaatttctttacgagtgtgctcgctacactggttgtgttcgccgtcttaggatttaaggcaaacgtgattaatgagaagtgcatcacacagaattcagagacaattatgaaatttctcaaaatgggaaacataagccaggatattattccccaccatatcaacctctctacagtgactgctgaggactaccacctggtgtatgatataatacagaaggtaaaggaagaggagttcccagcgctccatcttaactcatgtaagattgaggaggaacttaataaagccgttcaaggcacggggctcgcgttcatagcttttacggaggctatgactcatttcccggcttctcctttttggagtgtgatgtttttcctcatgctcgtgaatcttggcttgggaagtatgttcgggactatcgaggggatagttacccccatcgtcgatacgttcaaagtgcggaaggaaatcctaacagtgatctgttgcctcctggccttttgcattggattaattctctgtaacgctttagaaataaccctgcttcaatgcctaatgattattctgctccactgtctttgttag

SEQ ID NO: 46396 - DNA, 870 bp, Artificial Sequence
  Description of Artificial Sequence: Synthetic coding sequence
atgcccaagaacagcaaggtggtgaagcgggagctggacgacgacgtcactgagagcgtaaaggacttactctccaatgaagacgctgcagatgatgccttcaaaacatctgagctaatcgtggatggacaagaggagaaagatactgatgtggaagaaggaagtgaagtcgaagatgagagaccagcttggaacagcaaactccaatatattttggctcaggttggttttagcgttggcttgggaaatgtgtggcgctttccttacctctgccagaaaaatgggggcggagcctatctacttccttacctgatactgctgatggtgatcgggataccactgttttttctcgagctttcagttggacagcgaatccgccgcggatcgatcggtgtttggaattacatctcccccaagctgggaggaatcggatttgcctcctgcgtggtttgttatttcgtcgccctttactacaacgttatcattgggtggtcactgttctatttctcccagtcattccagcaacctctaccctgggatcagtgtccgctcgtgaagaacgcgagtcacacgtttgtggagcccgagtgcgaacaatcatccgctactacttactattggtatcgcgaagcattaaatatctcttcatcaatttccgaatccggaggtctgaattggaaaatgacgatttgtcttctcgctgcatgggttatggtctgtcttgctatgattaaaggaatccaaagctctgggaaagtcagcatgctggaacccttccttatcctactgatcaccattagtggattcattcccttatccaactctgtgacagacttttgtggccaaatcacccacaacactagcttttag

SEQ ID NO: 46397 - DNA, 291 bp, Artificial Sequence
  Description of Artificial Sequence: Synthetic coding sequence
atgcccaagaacagcaaggtggtgaagcgggagctggacgacgacgtgacagagtccgtaaaggaccttctgagcaacgaggacgctgcagacgatgcctttaagacaagcgagctcattgtggacgggcaggaagagaaagacacagatgtcgaggaaggctccgaggtcgaagatgagcgacccgcctggaactcaaaattgcagtatatcctagctcaggttgggttttctgtgggcctgggaaatgtgtggaggttcccttacctatgtcagaagaatggtgggtag

SEQ ID NO: 46398 - DNA, 1872 bp, Artificial Sequence
  Description of Artificial Sequence: Synthetic coding sequence
atggtgatcggcatccccctgttcttcctggagctgagcgtgggccaacgcattagacgggggagtattggagtgtggaactatatctccccaaagctcgggggcatcggatttgctagctgtgtcgtgtgttactttgtcgctctctattacaacgtgatcataggttggagtctgttctattttagccagagttttcagcagcctttaccctgggaccagtgcccgctggtgaagaatgccagccataccttcgtggagcctgagtgcgagcaaagcagtgctacgacatactactggtatagggaagctttaaacatatcaagctccatttccgagtcagggggcctaaactggaaaatgaccatatgtctgttggccgcttgggtaatggtgtgtcttgcgatgattaaaggaatccaatcctcaggtaagatcatttactttagctcacttttcccatacgtggtgctaatctgtttcctgatccgggcctttcttctgaatggtagtatagacgggatccggcacatgttcacaccaaagctggaaattatgctggagccaaaagtgtggagagaggccgccactcaggtgttcttcgccctgggtttgggctttggaggcgtaattgcattctctagctacaataaacgcgacaataactgccattttgatgcggttctggtgagttttatcaacttcttcacctctgtactggccacacttgtggttttcgccgtgctgggctttaaggctaatgtgattaatgagaagtgtattactcagaacagcgaaaccatcatgaagtttctgaagatggggaacattagccaagacatcatccctcatcatatcaatctgtcaactgtgactgccgaggattaccacctggtctacgacatcattcagaaagtcaaagaggaggaattcccagcgctgcacctgaacagttgcaagattgaggaggagttgaacaaagctgtccaggggaccggccttgcatttatcgcatttaccgaggcgatgacgcacttccccgcgtctcccttttggtcagtaatgttcttcctgatgctggttaacttgggacttgggtctatgttcggcacaattgagggtattgtgactccgatcgtggatacatttaaggtgcgaaaggagattttaaccgtgatttgctgcctcctggccttttgtattggtctgatattcgtgcaacgaagcggcaattatttcgtgacaatgtttgatgactactctgcgacacttcccctgctgatagtggtcatcctcgagaacatcgccgtgtgtttcgtatacggcatagacaagttcatggaggacctgaaggacatgctgggattcgctccgagcaggtattactactacatgtggaagtatataagtcctcttatgcttttgtcacttcttatcgcatccgtggtgaatatgggtctgtcgccacccggctataatgcttggatcgaggacaaagctagcgaagagtttctatcataccccacatggggcttggtggtgtgcgtcagccttgtggtgttcgcaattctgcccgttccagtggtgtttatcgtgagaagatttaatctcattgatgattcatcagggaatctggcgtctgtgacctacaaaagaggccgcgtgcttaaggaaccagtgaatctggagggcgacgatacctccctcatccacggtaaaattccttcagaaatgccttctcctaattttggaaagaatatttacaggaagcagagcgggtccccaacattggacactgcaccaaacggtaggtatgggattggctacctgatggcagatataatgcccgatatgccggagtccgacttgtag

SEQ ID NO: 46399 - DNA, 2211 bp, Artificial Sequence
  Description of Artificial Sequence: Synthetic coding sequence
atgaagaccgaggcccagcccagcaccagcctgctggccaacaccagttggacgggtacggtaatctctgacagtgtgccaggcagccagacttgggaagataaaggcagccttacacgttcagctacttcgtggacctctgaggcacaagtgtcggccgcacgagttgcagaggctcaggctcgcacctcgcagcctaagcagatttcagtactggaggcacttaccgcaagcgcactgaaccagaagcccacgcacgaaaaagttcaaatgacagagaagaaagaatctgaagtcttactggccagacccttctggtcctctaaaacagagtatatcttggctcaggtcggattcagcatgaaacctagctgcctgtggagatttgcctacctttggctaaactccggcgggtgcagttttgcagctatctacatattcatgctcttcctggtcggtgttccgctgctgttcctcgagatggccgccggccaatcaatgaggcagggtggcatgggcgtctggaaaattatcgccccatggattggaggggtcggctattcttcttttatggtctgctttatcttgggcctgtatttcaatgtagtcaatagttggattatcttctatatgtcacagtccttccagtttcctgtaccttgggagaaatgtcctctcaccatgaatagctccggtttcgatcctgaatgcgagaggacaaccccctccatttacttctggtatcagcaggccctaaaagctagcgaccgcattgaggacggtggctcccctgtctatagtctggtgcttcccttttttctctgttggtgcctcgtcggcgcctttatgattaacggacttaagtcaaccggcaaagtgatttacgtccttgtgcttctcccatgcttcataatcgtcggttttttcatccgcactctactgctggagggagcaaagtttgggctgcagcaactcgtcgttgcaaaaatatccgatgtgtacaatatgagtgtttggagcctggcggggggccaggtgctcagtaacaccgggattggcctgggcagtgtagcttctttagctagctacatgccacagtctaataactgcctgtctgatgctttcctggtgtcagtcattaatctgttaacactcttggtcttcacctcattcaacttctgcgtgctggggttctgggcaaccgtcatcacacaccgttgttgcgagcgaaacgccgagattctgctgaagctgatcaacttaggcaagctgccccctgatgcgaagccccccgtgaacttgttgtataacccaactagcatctataacgcatggcttagtggtctgccacagcatattaagtccatggtgctccgggaggtcaccgagtgcaatatcgaaacccagtttcttaaagccagcgagggccctaagttcgccttcctcagctttgtggaggctatgtcctttctgccacctagcgtgttctggtcctttatcttttttctaatgctgctggcaatgggactcagctcagcaattggaatcatgcaaggtataatcaccccactgcaggacactttctctttcttccggaaacacaccaagcttctgatagtgggcgtatttcttctaatgtttgtttgtgggcttttctttacacgcccctccgggagttactttattagattgcttagcgactactggattgttttcccaatcattgtggtggtcgtttttgagacgatggctgtctcttgggcctatggcgcaagacgcttcttagccgacctgacaattctgctgggacaccctatctctcctatctttgggtggctgtggcctcacctgtgcccagtcgtgctgctcatcattttcgtgaccatgatggtccatctgtgcatgaaacccattacctatatgtcctgggacagttcaacttccaaggaagttcttaggccttatcctccctgggctcttttacttatgataacactgtttgctattgtaattcttcctattcctgcctattttgtgtattgcagaatccataggattccattccggcccaagtcaggcgatggccctatgactgcgtctaccagcctgccactttcgcaccagcttactcccagcaaagaggtccagaaagaggagatcctccaggtcgatgagaccaagtatccctccacctgtaatgttacaagctag

SEQ ID NO: 46400 - DNA, 1980 bp, Artificial Sequence
  Description of Artificial Sequence: Synthetic coding sequence
atgaagaccgaggcccagcccagcaccagcctgctggccaacacctcttggacaggaactgtcatctccgactctgttccggggtcccagacatgggaggacaaaggatccttgactcgatcagcaacctcctggacttcggaggcccaagtctccgccgcccgggttgccgaagcccaggcacgtacaagtcagccgaaacagatctctgtcttggaggctctcacggcctcggcattaaaccagaagccaactcatgagaaggtgcaaatgaccgagaagaaggagtctgaagtactcctggcccgccccttttggtcctcaaaaacagaatatattctggcccaagtggggtttagcatgaagccttcctgcttatggaggttcgcttatctctggctgaatagcgggggctgttcatttgctgccatatacatctttatgctctttctggttggcgtgcccctactctttctagaaatggccgccggacagtccatgagacaaggaggcatgggcgtttggaagattatagccccttggataggaggtgtgggctactcctccttcatggtgtgcttcatcctcggcttatacttcaatgtggtcaacagctggatcatcttttatatgtctcaatctttccagtttcccgtgccgtgggaaaaatgtccgttaactatgaacagctctggttttgatcccgagtgcgaaaggaccactccttctatttacttctggtatcaacaggccctgaaagcaagcgacagaatcgaggacggggggtcgccagtgtatagccttgtactaccttttttcctgtgttggtgtttggttggggcatttatgatcaacgggctgaagagtacagggaaggttatatacgttttggtactcctgccatgctttatcattgtcggctttttcattcgcacccttcttttggaaggcgccaaattcgggctgcagcagctggtggttgctaaaatctcggatgtgtataatatgagcgtgtggagcttggcggggggccaggtcctgagtaacacagggatcggtcttggcagcgttgctagtcttgccagttatatgccccagagcaataattgcctcagcgatgctttccttgtcagcgttatcaaccttttgactctcctcgtgttcaccagttttaatttttgtgtgctcgggttttgggccacagtgataacacacagatgttgcgagcgaaacgcagaaatacttctgaagctcattaacctcggcaagctgcctccagatgcgaaaccacctgtgaaccttctctacaatccaacaagtatttacaacgcatggctgagtgggctgcctcagcatatcaagtcaatggttctgagggaggtgactgaatgcaacatcgaaacccagtttcttaaggcgtccgaaggtccaaagttcgcttttctttccttcgttgaagcaatgtcctttttaccccctagcgtgttctggagctttatcttcttccttatgttgctggccatgggcctgagctccgccatcggtattatgcaggggatcattactccgttgcaggatacgtttagtttttttaggaaacacaccaagctgttgattgtgggtgtttttttattgatgtttgtctgtggcctgtttttcacacgccccagtggttcctattttattcgcctgctgtccgactactggatcgtatttccaataatagtggtcgtggtcttcgaaactatggccgtgtcctgggcctacggcgctcgtcggttcctggcagacctgacgattcttctggggcaccctatttcccctatattcggctggctgtggcctcacctgtgtccagttgtgctccttataatattcgttacaatgatggtgcacctttgcatgaagccgataacctacatgtcctgggatagctctactgtgtccctgcctcaggaccccgaaccactatgggagtag

SEQ ID NO: 46401 - DNA, 2184 bp, Artificial Sequence
  Description of Artificial Sequence: Synthetic coding sequence
atgcccaagaacagcaaggtgacccagcgggagcacagcagcgagcacgtgactgagagtgtcgctgatctcctcgctctcgaggagcccgtggactacaaacagtccgttctcaatgtggctggggaagcaggcgggaagcagaaagccgtggaagaggaactggacgcagaagatcgtcctgcctggaacagcaagctccagtatatcctcgcccagattggcttctcggtgggtctcggaaatatatggcgcttcccatatctgtgccaaaagaatggtggtggggcttatctggtaccttatctcgtgttattaattattatagggatccctctcttctttctcgagctggccgtggggcagcgcatccggaggggcagcattggcgtgtggcattatatttgcccacggctgggcggcattgggttctcaagctgcattgtgtgcttgtttgtgggactgtactacaacgttattattggctggtccatattttacttttttaaaagctttcagtatccacttccatggtcagaatgtcctgtggtccggaatggatccgtggccgtagtggaagcagagtgcgagaaaagctcggccacaacatatttctggtaccgtgaggctctggacatcagtgatagtatcagtgaatcaggtggcctgaattggaagatgactctctgccttctcgtggcctggtccattgttggaatggccgtggtgaaaggcatccagtcaagcgggaaggtcatgtactttagcagtctgttcccatacgtcgtgctggcatgcttcctcgtcagggggctcttgcttcggggcgcagtcgatggaatcctgcacatgttcactcctaagctggacaaaatgctggatccgcaggtgtggagagaggctgccactcaggttttcttcgccttggggttggggtttggaggtgtgatcgctttcagtagttataataaacaggacaacaactgccacttcgatgcagctctggtctccttcataaatttctttacttcagtactggccacattagttgtgtttgccgtcctgggattcaaggctaacattatgaacgaaaaatgcgtcgtggagaacgccgagaaaattcttggatatctgaacacgaatgtgctcagccgtgatctgattccccctcacgtaaatttttctcacctcactacaaaggactatatggagatgtataacgtgattatgacagtaaaagaagaccagttttctgcactggggcttgacccttgtctgttagaagacgagttagataagtccgtccaagggactggcctggctttcatagcatttacagaggcaatgactcattttcccgccagccccttctggtcagtgatgttctttctgatgctcattaatctggggctgggttctatgatcgggaccatggccggtatcacaaccccgattattgatacctttaaggtgccgaaggaaatgttcaccgtgggctgctgtgtgttcgctttcctggttgggcttctgtttgtgcagagatctggaaactatttcgttacaatgtttgatgactattctgctacattaccactgacactcatcgtgattctggagaacatcgccgtggcctggatttatggcactaagaagttcatgcaagagctgaccgaaatgctgggcttccgtccttacaggttctacttttacatgtggaagtttgtctcccctctctgcatggccgtactgactacggccagcatcatccaactcggagttacccctcctgggtactctgcctggatcaaggaggaggccgccgaaagatatctctattttcccaattgggccatggccctactcatcaccctgatcgttgttgccacattgcccatccccgtcgtttttgtgttaaggcactttcacctgctgagcgatggctccaacacactgtcagtctcatataaaaaggggcgtatgatgaaggacatcagtaaccttgaagaaaacgacgagactcgcttcattctgtccaaagtgccttcagaggcaccatcccccatgcccactcacagaagctacctgggccctggcagtacaagcccactggaaaccagcgggaacccgaacgggaggtacgggtcgggatacttgctggcctccacacccgagtctgaactttag

SEQ ID NO: 46402 - DNA, 2184 bp, Artificial Sequence
  Description of Artificial Sequence: Synthetic coding sequence
atgcccaagaacagcaaggtgacccagcgggagcacagcagcgagcacgtgactgaatctgtcgctgaccttctggcgctcgaggaaccagtggattacaaacagtccgtcctgaacgtggccggcgaggccggtggtaagcagaaggccgtggaggaggagctcgatgcagaggacagacccgcctggaattctaaacttcagtacatcctggcccaaatcggcttctccgtgggtctaggcaatatctggcgctttccctacctttgtcagaagaacgggggaggggcatacctggttccgtacctggtgctgctcattattatcggaatcccgctgttcttccttgagttagctgtaggacagcgcatacggcgaggcagtatcggcgtgtggcactatatttgccccagattgggtggcatcggattctcgtcatgtattgtgtgtctctttgtcggtctgtactataacgtcattatcggctggagcattttctacttcttcaaaagtttccagtatcctctcccttggtcagagtgtcccgttgtgaggaacggaagtgtcgccgttgtggaggcggaatgtgaaaaatcctcagctacaacctacttttggtatcgagaggctttagacatttccgatagtataagcgaatcgggcggcttaaactggaaaatgactctatgcctacttgtggcatggagcatcgtcggaatggctgtggtgaagggtatccagtcgagtggcaaggtaatgtattttagtagtctgttcccatatgtcgtactggcctgctttctggtcagaggactgcttttacgcggagccgtcgacggcattctccacatgttcacacctaaacttgataaaatgcttgacccccaggtttggcgagaggccgcaactcaggtcttttttgccctcggtttaggcttcggcggggttattgccttttcctcctacaataaacaggacaacaactgccacttcgacgcagctttggtttccttcattaacttctttacaagcgtgttagcgacccttgttgtgttcgccgtgctcgggttcaaggccaacatcatgaacgaaaagtgtgtagtagaaaacgcagaaaagatcctcggatatctaaatacgaatgtcctttctagagatctgatccccccccacgtcaactttagccacttgacgacaaaggattatatggaaatgtataatgtgattatgaccgtgaaagaggatcaattttccgccttgggcctcgacccttgtttacttgaggacgagctagacaaatcagttcagggcacaggcctcgcgtttatcgcttttacagaagcaatgacacactttcccgccagtcccttctggagcgtcatgttttttctgatgttgatcaacctcggactgggcagtatgataggtacaatggctggaatcacgaccccaatcatcgacacctttaaggtgcctaaggaaatgtttaccgtcgggtgctgtgtgtttgctttcctagtgggactcctgttcgtacagagatctgggaattacttcgtcaccatgttcgacgattatagcgccactttgccccttaccctcatcgtaatcctcgagaacatcgccgtcgcatggatctacgggacaaagaaatttatgcaggagctgacggaaatgctgggtttccgcccttataggttctatttttatatgtggaaatttgtgagtccactatgcatggcggtcctgactaccgcaagtattatccagctgggagtgactccgccaggctactccgcatggatcaaggaagaggccgccgaacgctatctctactttccaaattgggccatggccctcctgataacgctcatcgtggtagccaccctgccaatcccggtcgtatttgtcctgcggcattttcaccttctgagcgatggcagcaacactctgtcagtgtcctacaaaaagggaaggatgatgaaggatatctctaacttagaggagaacgacgaaactcgattcatcctcagtaaagtgcctagcgaggctccgtctcccatgcccacacacaggtcttacctgggcccggggagtacctcacctctggaaacttccggcaaccccaatggcagatacggaagtgggtacttgttggcgtccactccggaaagtgagctctag

SEQ ID NO: 46403 - DNA, 1506 bp, Artificial Sequence
  Description of Artificial Sequence: Synthetic coding sequence
atggtgcggaagcccgtggtgagcaccatcagcaagggcggctacctccagggcaatgttaacggtcgactgccctcactcggcaacaaagagcctcccgggcaggaaaaagtccagctaaaacggaaagtcaccttgctgcgaggtgtgtccatcatcatcgggaccatcataggcgcaggaatttttatttcacccaaaggcgtcctgcagaacaccggctccgttggcatgagcctcacgatctggacagtttgcggcgtgctcagcttgttcggtgctctgagttatgcggagctggggacaaccattaaaaagtcaggaggacattacacatatatcttggaggtgttcggtcctctgcctgctttcgttcgagtgtgggtggaactgttgattataagacctgcggccacagccgtgattagtctggcatttggccggtatattcttgagcccttttttatccagtgtgaaatccccgagcttgcaatcaagttaatcaccgccgtaggaatcaccgtggtgatggtgcttaacagcatgagtgtttcatggagtgccaggatccagatctttttgactttctgcaaactgacagccatcttgatcataattgtccccggcgtcatgcagctgattaagggacaaacccagaatttcaaagatgcgttttccggtagagattcctcgatcaccagactgcccctggctttctactatggaatgtacgcatacgcaggatggttctatctcaacttcgttactgaggaagtcgagaaccctgagaaaaccatccctctggcaatatgtatcagtatggccatcgttacgataggatatgtattgacaaatgtggcctactttacaaccatcaacgccgaagagttgctgctttccaatgcagtggcagtgaccttttcggaaaggctcttgggcaacttctccctcgcagtgcccatctttgtggctctcagctgtttcggcagtatgaacgggggagtttttgctgtctcgcgtctgttctatgtggcgtcccgagaggggcacctgcccgaaatcctgtcaatgatccacgtcagaaagcatacacccttgcccgcagtcattgtgctgcaccccctgacaatgataatgcttttctccggcgatctagacagcctgctgaatttcttgtcatttgctaggtggttattcattggcctcgctgttgcaggactcatctacctccggtacaagtgccccgacatgcatcggccattcaaggtgcctttattcatacccgcgctcttttctttcacctgtttgtttatggtcgcactgagcttatactcagatccattttctacaggaatcggattcgtgattaccctgaccggggttcctgcttactacctgtttataatttgggacaagaaacctcgttggtttcgaattatgtctgaaaagattaccagaacactacagatcattctggaagtagttcctgaagaggacaagctctag

SEQ ID NO: 46404 - DNA, 1413 bp, Artificial Sequence
  Description of Artificial Sequence: Synthetic coding sequence
atggaccggggcgagaagatccagctgaagcgggtgttcggctactggtgggggacgagcttcctgcttatcaacataattggcgccggaatattcgtgagcccaaagggagttctggcttactcgtgcatgaatgtgggggtttctctgtgtgtctgggccggctgcgccatccttgcgatgacgagcactctgtgcagcgctgaaattagcattagctttccatgcagtggcgcccagtattacttccttaagcgttactttggcagtaccgtggccttcctcaatttgtggacatcccttttcctgggctcaggagttgtagccggtcaggcactactcttagctgaatatagcatacagccattttttccttcctgtagcgtgccaaagctgcccaaaaagtgcctggctctcgccatgctgtggattgttggaatccttacttcccgaggcgtgaaggaggtgacatggctccagatagcatccagcgtcctcaaggtgtctattttatccttcatttccctcaccggcgtagtgttcttgattagaggcaagaaggaaaacgttgagcggttccagaatgccttcgacgcagagctgcctgacatctcccatcttatccaggctatcttccaggggtacttcgcctattccggcggagcctgtttcactcttattgccggggaattgaagaagccgcgcactactatccctaaatgcatattcactgccctcccactggtcaccgtggtatacctcctagtaaatatctcttacctgacagtgctcacaccccgggagatcctatcgagcgacgccgtggctatcacgtgggcagacagagctttcccttccctggcatggatcatgccttttgccatctctacctcgctatttagtaatcttttaatatccatattcaagagtagccgcccgatctacctagcatcccaggaggggcagctgcccctcctgtttaatacactaaattcccacagctctcccttcacagctgtcctgcttctcgttaccctgggcagtctcgccatcatcctaacatccttaatagatctcattaattacatctttttcaccggctccctttggtccattctactgatgatcggaatattgaggagaaggtatcaggagcccaacttgtccatcccgtataaggtgttcttgtcttttccgctggccacaatcgtcatcgacgtggggctggttgtgatccctcttgtcaagagtccgaacgtgcactacgtgtacgtcttgcttctggtgctgtctgggttgctcttctacatccccctgatacacttcaagatccggctggcatggttcgagaagatgacctgttatctccagcttcttttcaatatttgcttacctgacgtgagcgaggaatag

SEQ ID NO: 46405 - DNA, 1302 bp, Artificial Sequence
  Description of Artificial Sequence: Synthetic coding sequence
atggaccggggcgagaagatccagctgaagcgggtgttcggctactggtggggcacatctttcctgctgatcaatattatcggtgccggcatctttgtaagccctaaaggggtcctggcgtactcttgcatgaatgtcggggtctctctctgcgtgtgggccggctgtgccattctggcaatgacaagcaccctgtgcagcgccgaaatttcaatcagttttccgtgttccggcgctcagtactacttcctcaagcgatatttcgggtccaccgtcgccttcctaaatctttggacatccttatttctgggaagtggggtcgtcgccggccaggcactgctcctcgctgaatattcaatacagcctttctttccctcctgctcggtccctaaactgccgaaaaaatgcctggccctcgcaatgttgtggatcgtggggatcctgacatctaggggtgtgaaagaggtgacctggctccagattgcctcttccgtactgaaggttagcattctgagctttattagcctgaccggggtcgtcttcctgattcggggtaagaaggaaaatgtcgagcgcttccagaacgcttttgacgctgaactgcctgacatatctcaccttatacaggctatattccagggatatttcgcttattccggtgagttgaaaaaaccacggacaaccattcccaagtgcatattcacggcattacccttggtgaccgttgtgtatctgctggtgaacatctcctacctcactgtgctgactccacgagagattctcagcagtgacgccgtggccatcacgtgggccgatagagcttttccctcactggcatggattatgccatttgccatctcaaccagtctgttctccaacctgttgatttctattttcaaatcttcgcgacccatctatctcgccagtcaggagggtcaattgccactgctgttcaacaccctgaatagtcacagctccccgtttaccgccgtgctgttgctggtcacgttggggtctctcgccataatccttacatccctgatagatctcataaactatatttttttcacaggatccctgtggagcattctattgatgataggcatcctgagacgaagataccaggagcctaacctctcaatcccatacaaatctctgatattagtcgtccaagcaggggaagccggggtgcagtggcacgacctggggctgctgcagcctctgcttcccggctttaaaaggtttagttgtctcagccttccctcatcttgggactatcggtgtttctgccactttcactag

SEQ ID NO: 46406 - DNA, 1860 bp, Artificial Sequence
  Description of Artificial Sequence: Synthetic coding sequence
atgccctggcaggccttccggcggttcggccagaagctggtgcggagacgtacactcgagtccggtatggcagaaacacgtcttgcccggtgcttgtcaactcttgacctggttgcattaggcgtcgggtccaccctcggcgctggggtgtacgtcctggccggagaagtggctaaggacaaggcgggaccctccattgtaatctgcttcctggtggctgcgctctcaagtgtgctggccggattgtgctacgccgagtttggggccagggtgcctagatccggatctgcatatctgtactcatatgtgactgtcggcgaattgtgggccttcaccactggatggaatttgatattgtcctacgttataggcactgcctcagtggcccgagcatggtcctccgcatttgacaatctgatagggaaccatatctccaagactttacagggttcaattgcccttcatgtcccccacgtattagcagagtaccccgacttcttcgctctaggacttgtgttgttactaacgggcctattggcgctcggagcctctgagtccgctctcgtgaccaaagtatttactggagtcaatctcttggtgttaggcttcgtgatgataagtggctttgtgaaaggcgacgtccacaactggaagttgacagaagaggactatgagcttgctatggcagagttgaacgatacatacagtctgggccctcttggcagcggcggattcgttccattcggcttcgagggaattctcagaggggccgccacatgcttctacgcttttgtcgggtttgattgtatcgcgacaactggggaggaggcccagaacccacagagaagtattccgatgggaattgttatttctcttagcgtctgcttcctcgcttattttgccgtgtcctcagcactgacacttatgatgccgtattatcaactccaacccgagagccctcttccggaggctttcttgtacattgggtgggcacctgcaagatacgtggttgccgtcgggagcttatgcgctttatccacctccctgttgggctccatgtttccaatgccaagggttatttacgcaatggccgaggacggcctgttattccgtgtgctggccaggattcataccggaacacggaccccaatcatagccaccgtggtctcagggatcatcgctgcatttatggcattcctatttaagctaacggatcttgttgatttaatgagtatcggaacactcctggcatattctcttgtgtctatctgcgtgctgatccttaggtatcaaccagaccaggaaaccaagacaggtgaggaggtggagctgcaagaagaggccatcacaaccgagtccgaaaagttgacactctggggtcttttctttccactgaactctatccccacccccttgtccggccagattgtgtacgtttgcagttcccttctggccgtactgttgacagcgttatgcctggtgctggcgcagtggagtgttcccttgttgtcgggagatctgctctggaccgctgtagtcgttttactgttactgctcattattggcatcatcgtggttatttggagacaacctcaatcttctactccactgcatttcaaggtacccgctctgcctctgctgcccttgatgagcatcttcgttaatatttacctcatgatgcaaatgacggctgggacctgggctagatttggcgtttggatgctgattgggtttgcaatatattttggatacggcatacagcatagtctggaagagattaaatccaaccaaccttcacgtaaatccagggcgaaaaccgtggacctggatccaggtactctctatgtgcactctgtgtag

SEQ ID NO: 46407 - DNA, 1860 bp, Artificial Sequence
  Description of Artificial Sequence: Synthetic coding sequence
atgccctggcaggccttccggcggttcggccagaagctggtgcggcggaggaccctcgagagcggcatggctgagacaagactcgcccgttgcctgtccaccttggacttggtcgctctgggggtggggagtaccctcggcgccggggtctacgtgctggccggcgaggttgctaaggacaaagcagggccctctatcgtgatctgcttcctggtagctgccctcagctctgtcttggccgggctgtgttacgccgagttcggcgcacgagtcccccggtctggctctgcatatttgtactcatacgtcacagtgggcgaactctgggcattcacaacaggatggaacctgatcctgtcctacgtgattggcacggcttccgtggccagggcctggagctccgcttttgacaatcttatcggtaatcatattagtaaaacactccagggcagcattgccttgcacgtgccccacgtgctcgcggagtaccctgacttctttgcccttggcttggttctcctcctgacgggcctgctggccctcggggcatctgaatccgccctcgtgacgaaggtgttcacaggggtcaaccttctggtcctggggttcgtaatgatctccgggttcgtgaaaggtgacgttcataattggaaactgaccgaggaggactacgaattggcaatggcagaactcaatgatacttatagcttgggtccgttgggatctggaggcttcgttccttttggctttgagggcatactgcgtggcgccgccacatgcttttatgcatttgtgggcttcgattgcatcgcgaccactggtgaggaagcccaaaacccccagcgatctatccccatgggtatcgtgatatctctgagtgtgtgcttccttgcatacttcgcagtcagcagcgcactgactctaatgatgccatattaccagttgcagccggaatctcccctaccggaggccttcctgtacatcggttgggctcccgcaaggtacgtcgtggctgtcggcagcctttgcgcgctgtcaaccagcctgctagggagtatgttccctatgccccgcgtcatatacgctatggccgaggacgggctgctgttcagggtgcttgctcgcatccacactggtactaggacacctattatcgctaccgtggtgagcggaatcattgcggctttcatggcctttctgttcaagttgactgatcttgtcgacctcatgtccatcggtactctgcttgcatacagtctggtctccatttgcgtccttatccttaggtatcagccagatcaggaaaccaaaaccggcgaagaggtggagctgcaagaagaagccataaccaccgagtcggaaaagctaacactttggggtctgttttttccactgaattccatacccacaccactttctggacagattgtgtacgtatgctcttcccttttggccgtcttactgactgccctatgcctagtcttggcccagtggtctgttccacttctaagcggtgaccttctgtggacagccgtggttgtgctcctcctgttgctgatcataggcattattgttgtgatctggcggcaacctcagagctcgacacctcttcacttcaaggtccctgccctccctctcctgccacttatgagtatatttgtcaatatctatctcatgatgcaaatgacagcagggacctgggctaggtttggagtgtggatgctgataggattcgctatttattttggctatggtattcagcactcactggaggaaatcaaatcgaatcaaccctctcgtaaatctcgcgcgaagaccgtggatcttgaccccggaacattgtatgtgcactctgtatag

SEQ ID NO: 46408 - DNA, 1572 bp, Artificial Sequence
  Description of Artificial Sequence: Synthetic coding sequence
atggccggccacacccagcagcccagcggccggggcaacccccggccagccccctcaccgtctcctgtgccgggtacggttccgggcgctagcgaaagagttgcactgaagaaggaaataggactgttgagtgcatgcacaattatcatcggcaacatcattggctcgggtatcttcatttcccccaaaggtgttctggagcattctggctcagtagggctggctctttttgtatgggtgctcggcggaggagtgacagccttggggagcctctgttatgctgaactaggtgtagcaatccctaaaagcggaggcgattacgcttacgtgaccgagattttcggtgggttggcaggctttctcctactctggtctgcagtgttgattatgtatccaacatcactggcagtgatctctatgacattctcgaattacgtgctgcagccagtgtttcccaattgcattcctccaacaaccgccagccgggtactgtctatggcctgtcttatgctgctcacctgggtcaattcctccagcgttagatgggccacccggatccaggacatgttcaccgggggcaaattgctcgctttaagccttatcattggcgttggtctattacagatttttcaaggccacttcgaagagctcagaccatccaacgcattcgcattctggatgaccccctccgtcgggcacctggccctcgcgtttctgcagggcagctttgccttctccggttggaattttctgaactacgtgaccgaggagatggtggatgcccgcaagaatctaccaagggctatctttatatccataccacttgtgacctttgtgtatacgtttaccaatatcgcctatttcacagctatgtctccacaggaactgctgtctagtaatgccgttgccgtgaccttcggagagaagctgctgggttatttctcatgggttatgcccgtttccgtcgccttaagtaccttcgggggaatcaatgggtacctttttacttatagccgactgtgtttcagcggagctagagaggggcacctgcctagtctcttggccatgatacacgtacggcattgtacacccatccctgctctattggtgtgttgcggcgccaccgcagtgattatgttagtcggagacacttatacactgatcaattatgtcagcttcatcaattacctgtgctatggcgtgacgatcctggggcttctgttgttgcgatggaggcgccccgcgctccacagacctatcaaggtgaaccttcttatcccggtagcctatctggtgttttgggccttcctcctggtgtttagttttatctccgagcctatggtttgcggtgttggcgtaataatcatcctcactggggtccccatctttttcctgggcgtgttctggaggtccaaaccaaagtgcgtgcacagactcaccgaatccatgacacactggggccaagaactctgtttcgtcgtctacccacaagacgctcctgaggaagaggaaaacggcccatgtccgcccagtctgttgcctgcaactgacaagccttccaaacctcagtag

SEQ ID NO: 46409 - DNA, 1080 bp, Artificial Sequence
  Description of Artificial Sequence: Synthetic coding sequence
atggcccccaacggcaccgccagcagcttctgcctggacagcaccgcttgcaaaattacgatcacagtagttcttgctgtcttaattctgattacagtggcaggcaatgtggtcgtctgtctcgcagtgggattgaacagaaggttacgaaacctaaccaattgttttattgtgtcccttgccatcactgatctgttactgggcctcttagtgcttcctttctcagctatttaccagttatcttgtaagtggtcgtttggaaaggtgttctgcaacatttacacatcgttggacgtgatgctgtgtaccgctagtattctaaatttgttcatgattagccttgacagatactgcgctgtgatggatcctctgcgctaccctgtgttagtcacaccagtccgcgtagcaataagtttagtgttgatctgggtcatcagcatcactctgagttttcttagtatccaccttggttggaacagccgtaatgagaccagcaaggggaatcacactacgagcaagtgcaaagtccaggtgaatgaggtgtatgggttggtggacgggttggttacgttttatctgccccttctgattatgtgcatcacctattatcgcatttttaaggtagcaagagatcaagctaaaaggattaatcacatttcatcctggaaggccgcaacgatacgggaacacaaagcaactgtcactttggccgccgtgatgggagccttcataatttgctggtttccttatttcaccgccttcgtataccgaggcctgcgcggagatgacgctattaacgaagtcctggaggcaatagtcctgtggctcggctacgccaactctgctctcaaccctatactgtatgccgccctcaaccgcgatttccggaccggctatcagcaactgttctgctgtcgacttgctaaccgcaacagccataaaacatcactgaggagcaatgcgtcccagttgtctcggacacagagcagggagcctagacaacaagaagagaagcccctcaagctccaggtctggtcaggtaccgaggtgaccgccccacagggggcaactgaccgctag

SEQ ID NO: 46410 - DNA, 1296 bp, Artificial Sequence
  Description of Artificial Sequence: Synthetic coding sequence
atgagcgtgaacgtgaaccggagcgtgagcgaccagttctaccggtacaaaatgccccgactgatcgccaaagtggaaggcaaaggcaatggaattaaaactgtaattgttaacatggtagacgttgctaaagccctcaacaggccccctacttaccccaccaaatattttgggtgtgaactaggcgctcagacccaatttgacgtcaaaaacgaccgctacatcgttaacggaagtcacgaggccaataaattgcaggacatgctggacgggttcattaagaaatttgttctttgtccggaatgtgagaatcctgagactgacctacatgtgaatccgaagaagcagaccatcggaaactcttgtaaagcctgcgggtacagaggcatgctcgatacacaccataagttatgcacgtttatactcaaaaatccccctgaaaacagtgacagcggaactgggaagaaagagaaggagaaaaagaacagaaaagggaaagataaggaaaacggcagtgtttccagttcagaaacaccgcctccccctccaccacctaacgagattaatccacccccacacacgatggaggaagaagaggacgatgactggggagaggacacaaccgaggaggcccaaaggcggcgaatggacgaaatttctgatcatgcgaaagtgctcacactgtctgacgacctggaacggactattgaggagagagtgaacatcctctttgacttcgtgaagaaaaagaaagaagagggtgtgatcgactcctccgacaaggagatcgttgctgaagctgaacgccttgacgtgaaggccatgggaccactggttctcaccgaagtactgttcaacgaaaagataagggaacaaattaagaaataccggcggcatttcctacgcttttgccataacaacaagaaagctcagcggtatctgctgcacgggcttgaatgcgtcgtcgccatgcaccaggctcagcttatcagcaagatcccccacatactgaaggaaatgtatgacgccgaccttctggaggaagaagtaataatcagttggagcgaaaaagctagcaaaaagtatgtctcaaaagagctggctaaggaaattcgcgtcaaggccgaaccatttatcaaatggcttaaagaagccgaggaggagtccagtggaggtgaagaagaggatgaggacgaaaatattgaggtagtttactccaaagctgctagcgtcccaaaggtggaaaccgtaaaaagcgacaataaagacgatgacatcgatattgacgcaatttag

SEQ ID NO: 46411 - DNA, 2766 bp, Artificial Sequence
  Description of Artificial Sequence: Synthetic coding sequence
atggcctggctgcggctgcagcccctgaccagcgccttcctgcacttcggtttagtcacattcgtgctgtttctgaatggcctgcgagccgaggccggggggagtggcgatgtcccatcaacaggccagaataacgagagctgcagtggatcgtcagattgcaaagagggggtgatacttccaatctggtatcctgagaatccctccctaggagataagatcgcgagggtgattgtctacttcgtcgcactcatttacatgttcctgggggtatccatcatcgccgatcgctttatggctagtatcgaagtgatcacaagtcaggaacgcgaagtgacaatcaagaagccaaacggtgagacttccactactaccatccgcgtatggaatgagacggtcagtaacctgacactgatggcacttggcagttctgcacccgaaattctgctgtctctgatcgaagtctgcggccacggctttattgcaggggacttggggccttccacgattgtcggttccgcggcattcaacatgttcataatcatcggtatttgtgtctacgtaatccctgacggcgagactcggaagattaagcatctacgcgtgtttttcattacagctgcctggagtatctttgcgtatatatggctgtatatgattctggctgttttttctcccggtgttgttcaggtctgggagggattgctaactctcttcttctttcccgtgtgcgtgctgttggcatgggtggctgataagcggctgctgttctacaaatacatgcataagaaatatcgtaccgataagcaccggggcatcattatcgaaactgaaggcgaccacccgaaagggatagaaatggatggaaagatgatgaattctcactttttggacggcaacctcgtgcccctggaggggaaagaggtggacgagagcagacgggagatgatcaggatcctgaaggatctgaaacagaaacatccggagaaagatttggaccaactggttgagatggcgaactactacgctctcagccaccagcagaaaagtcgtgccttctacaggatccaggccacccgtatgatgacaggcgctgggaatattttgaaaaagcacgctgccgagcaggccaaaaaagcctccagtatgtcagaagtacacacggatgagccagaagatttcatttcaaaagtgttctttgacccctgctcctatcaatgcctcgagaactgcggagcggtactcctcacggttgtcaggaaaggtggtgatatgtccaaaacaatgtacgtcgactacaaaacggaggacggcagtgccaatgccggcgcagactatgagtttactgagggaactgtggtattgaaacccggggaaactcagaaagaattttccgtcggcattattgatgatgacattttcgaagaggatgagcacttctttgtccgcctgtccaacgtgaggatcgaagaggagcagcccgaggaaggcatgccacccgcaatcttcaactcactgcctctccctagggcagtcttagcgagcccttgcgttgctaccgtgactatcttagatgacgaccatgctggcattttcactttcgagtgcgacacaattcacgtgagtgagagcatcggagtaatggaggtcaaggtgctacgtacatctggagcgcggggcacagtgattgttccgtttaggacagtggaggggactgcgaaaggggggggcgaggactttgaagacacatacggagaacttgagttcaagaacgacgaaaccgtcaagaccattcgggtgaaaatcgtggatgaggaagagtatgaaagacaggaaaacttctttattgctctgggggagccaaaatggatggaacggggtatctctgatgtaacggatagaaaacttaccatggaggaagaggaagccaaaaggatcgccgagatgggcaagcccgtattaggagagcacccaaaattggaggtgatcatcgaggaaagttatgaattcaagaccacggtggataagttaataaaaaagacaaacctggcacttgtggtcggtacccacagctggcgcgaccagtttatggaagcgataaccgtgtcggctgctggtgacgaggatgaggatgagtctggggaggaaaggctgccttcttgctttgattacgtgatgcacttcttgacagtgttctggaaggtgctgttcgcttgcgttcctccgactgagtactgccacggctgggcatgcttcgcagtctcgatcttgatcattggcatgctgaccgcaataatcggagacctcgcaagtcatttcgggtgtacaatagggttaaaagactcggtgactgccgtggtgttcgttgcttttggaacctctgtgcccgatacctttgcgagcaaagctgcagcccttcaggacgtctacgcagacgcctctatcggcaatgtgaccggctcaaacgcagtgaacgtttttcttggaattgggctggcttggtccgtggctgcaatatattgggctctccagggtcaagagtttcacgtgtccgcgggtactttagcctttagtgtgacattatttacaatctttgcatttgtctgcattagcgtgctcctataccgacgacgcccccatctgggaggggaactggggggtccacgaggctgtaaacttgctactacctggctgtttgttagcctttggttattgtacattctgtttgctacactggaagcatactgctatattaaagggttttag

SEQ ID NO: 46412 - DNA, 2778 bp, Artificial Sequence
  Description of Artificial Sequence: Synthetic coding sequence
atggcctggctgcggctgcagcccctgaccagcgccttcctgcactttgggttagtaacgttcgtgctgtttcttaatggacttcgcgccgaagcgggaggctctggggacgtacctagcacagggcagaacaatgagagctgctcggggagcagcgattgcaaggaaggagtgatactgcctatatggtatcccgagaaccctagcttaggcgacaaaattgccagagtgattgtatacttcgtagcccttatttacatgttcctgggtgttagcattattgccgacagattcatggcttccatcgaggtgataacctcacaggaacgggaggtgacgattaagaagcccaacggcgaaactagtactacaacgattagagtatggaatgagacagttagcaacctcactctgatggcactaggatcgtccgccccagagatcctcctttctttaatagaagtgtgtggacacggattcattgccggagatctgggcccatcaacgattgtgggatccgccgcctttaatatgtttataatcattggcatatgcgtgtatgtaatccccgacggcgaaacaaggaaaatcaagcacctccgggtgttttttattaccgcagcctggtccattttcgcttatatttggctttacatgatccttgccgtgttcagccccggtgtggtgcaggtctgggaaggactcctgacgctcttctttttcccggtgtgcgtgcttctcgcgtgggtcgctgacaagagactgttgttctataagtacatgcacaaaaagtaccgtaccgacaaacaccgcgggatcattattgaaacagagggtgatcaccctaaaggcatcgaaatggatggcaagatgatgaatagccatttcctagacggcaatctggtcccactcgagggtaaggaagttgacgaaagccgcagggaaatgatcaggattctgaaagacttgaaacaaaaacaccctgaaaaggatctggaccagctggtggaaatggccaactattacgcgctctctcaccagcaaaagtcaagagcattttatcgcatccaggccactagaatgatgacaggcgctgggaacattctcaagaagcacgcagccgagcaagccaagaaagcttcatccatgagcgaagtgcataccgacgaacccgaagacttcattagcaaagtgttttttgatccctgtagctaccagtgcctcgaaaattgcggcgctgtactactgacagtcgtacggaaaggcggggatatgtccaaaacaatgtacgtggactataaaacagaggatggcagcgccaacgctggagccgattatgaattcaccgaagggactgtagtgctgaagcccggagagacccaaaaagagttttccgtggggataattgacgatgacatatttgaggaggatgaacatttcttcgtccgactcagcaacgttaggattgaagaggaacagcccgaagagggaatgcctcctgcaatatttaattcccttcctttgccacgcgccgtacttgccagtccttgcgtggccaccgtaacgattctggacgatgatcacgcgggtatattcacctttgaatgtgacacaatccatgttagcgaatcaatcggcgtgatggaagtcaaagtgttgcgtaccagtggagctagagggactgttatcgtccctttccgtacagtggaggggacagctaagggaggcggggaagatttcgaggatacctacggtgagcttgagtttaaaaacgatgaaacggttaagaccatccacatcaaagtgattgacgatgaagcctacgagaagaataaaaattatttcattgaaatgatgggcccccgcatggtagatatgagctttcagaaggctttactgctgagtcccgacagaaaactgacaatggaagaggaagaggcaaaacgcattgctgagatggggaaacccgtgcttggggagcatccaaaactggaagtgatcatagaagaaagctacgaattcaagactaccgtggataaacttattaagaagacaaatctcgcactagtcgtcggaacacactcttggcgagatcagtttatggaggccatcaccgtgagcgcggctggggacgaagatgaggatgagtccggcgaagaacgattgccgtcgtgtttcgattacgtaatgcacttcctcacggtgttctggaaggttctgtttgcctgcgtcccacccacggaatactgtcatggatgggcgtgttttgccgtcagtatcctgatcatcgggatgttgacagccatcatcggcgacctggcttcccactttggctgtacaattggtctaaaagactctgtgacagctgtggtctttgtggcctttggcacaagcgtccccgacacctttgccagtaaagcagcagccctgcaggacgtgtacgcagacgcatccattgggaacgtgaccggctccaacgctgtgaatgtttttttaggtatcggattggcctggagcgtagccgcaatttactgggccctgcaaggtcaggaattccacgtctctgccgggacattggctttctccgttaccctgtttacaattttcgcctttgtctgcatctctgtgctactgtatagacggcgcccccacctcgggggggaattggggggccctagggggtgtaagttggccaccacttggcttttcgtgtcactctggctcctttatatattgtttgccacacttgaggcgtactgttatataaaaggtttttag

SEQ ID NO: 46413 - DNA, 2784 bp, Artificial Sequence
  Description of Artificial Sequence: Synthetic coding sequence
atggcctggctgcggctgcagcccctgaccagcgccttcctgcacttcggacttgttacctttgttctcttcttaaatggcctgcgagcagaagccggcggctcgggcgacgtgcccagcacaggccagaacaatgagagttgtagcggaagctccgattgcaaagagggggtcattctgcccatttggtatcccgaaaacccttctttaggggataaaattgcaagggtgatcgtgtatttcgttgctctcatctacatgttcctgggagtgagcatcattgccgatcgcttcatggcctccattgaagttattacatcccaggaaagggaagtgacaatcaaaaaaccaaacggcgaaacctccaccacaacgattcgagtctggaatgagactgttagtaatctcaccctgatggccctcgggagttcagcacccgaaatcttgctctctcttattgaagtgtgtggccatggcttcatcgctggggacctgggtccgagtaccatcgttggaagtgcagccttcaatatgtttataatcattggcatctgtgtgtacgtgatccccgatggggaaactagaaaaatcaaacatcttagggttttcttcattactgctgcctggagcatcttcgcctatatatggttatatatgatcttagcagtcttttcgcccggagtggtgcaggtgtgggaagggctgttgactctctttttcttcccggtgtgtgtccttctagcgtgggttgccgacaagaggctgttattctataaatacatgcataagaagtacaggactgataaacaccgaggcattattatagagaccgagggcgaccacccaaagggaatagagatggacggcaaaatgatgaattcacattttctggacggcaatttagtacctctcgagggtaaggaggtggacgagagcagacgggagatgattagaatcctcaaagatctgaagcagaagcacccggagaaggacctcgaccagctggtggagatggccaattattatgctctatcacaccagcaaaaaagcagagctttctaccgaattcaggccacgcgcatgatgactggggccggaaatatcttgaagaagcatgcggcggaacaagccaagaaggcctcatcgatgtcggaagtacacaccgacgaacccgaggatttcatctctaaagtgtttttcgatccctgcagctatcagtgcctggagaattgcggtgctgtgctcttgacagtggtccgcaaaggtggcgatatgtctaaaacaatgtacgtggactacaaaacagaagacggatccgcaaatgcaggggctgattacgaattcaccgaaggtactgtcgtgttgaagcctggcgaaacccaaaaggagttttcagtgggaattattgatgatgatatcttcgaagaggacgagcactttttcgtccgcctatctaatgtcaggatcgaggaagagcagcctgaggagggtatgcccccggccatatttaatagcctgcccttgccacgtgccgtgttggcatccccatgcgtggccactgtcaccatcctggacgatgatcacgccggaatttttacctttgagtgcgatactattcacgtcagtgagtccataggcgttatggaggtcaaagttctccgcacctctggggcccggggcactgtcatcgttccctttaggaccgtggaggggacagctaaagggggtggcgaagacttcgaggacacatacggcgagctggaatttaagaacgacgagaccgtgaaaactatccgtgtgaaaatcgtggatgaggaagaatatgagaggcaagagaacttctttattgctctgggcgaacctaaatggatggaacgaggtatcagtgccctcctactttcccccgacgtcaccgacagaaagctgactatggaagaggaagaggctaagcgcatcgccgagatgggcaaaccagtgctcggcgagcaccctaagctcgaagttattatcgaggagtcttatgagttcaagacaacagtcgacaaactgattaagaagaccaatctggctttagtcgtgggaacacacagctggcgcgaccagtttatggaagcaatcaccgtgtccgcagctggcgatgaagacgaggacgagtctggagaggagaggctcccctcctgtttcgattacgtcatgcattttctgaccgttttctggaaggtgctttttgcttgtgtcccgcccacggagtattgccacggctgggcgtgctttgcagttagtatcctgataattggaatgctgactgctattattggggacctggccagccacttcggatgcacaattggcctgaaggactcagtgacagccgtcgtcttcgtcgcgttcggcaccagtgtgcccgacacatttgcttccaaggcagcggcgctgcaggacgtctacgcagacgccagcattgggaacgtgacaggatccaatgctgttaacgtttttttgggaatcgggcttgcctggtcagtggccgccatctactgggcactgcagggccaggagtttcatgtatctgcaggcaccctggccttctcagtgacactcttcaccatattcgctttcgtatgcatatccgtgcttctgtatcgcagaaggcctcatctgggaggcgagctgggcggccccagagggtgcaagctggctaccacctggctgttcgtgtccctctggctgttatatatattgtttgcgacgctagaggcgtactgttatattaagggcttttag

SEQ ID NO: 46414 - DNA, 855 bp, Artificial Sequence
  Description of Artificial Sequence: Synthetic coding sequence
atggaggaggaggaggccaagcggatcgccgagatgggcaagcccgtactgggcgagcaccccaagctcgaagtaattatagaagaaagctatgagttcaagactaccgttgataagctcatcaagaagactaatctggcgttggtggttggtactcacagttggcgggaccagttcatggaggctatcacagtatccgccgctggtgacgaggacgaggacgagtccggggaggagcgattgccttcctgttttgattacgttatgcacttcctgacagtgttctggaaagtgctgttcgcctgtgtgccccctacagaatactgtcatggctgggcttgttttgcggtctcgatactgatcataggaatgctaacagcaattataggggatctagccagccactttggatgtactatcgggctgaaggacagcgtcacagcagttgtgttcgtggccttcgggactagtgtgccagacacatttgcttcaaaagccgcggctctgcaggacgtctacgccgatgcatcaattggcaatgtcactggaagtaacgccgtgaatgtatttctgggaatcgggttggcctggtccgtcgctgcaatttattgggctctccaaggccaggaatttcacgtgtcagcaggcacgctcgccttttctgttacactgttcactatttttgcatttgtgtgcatatcagtcttgctctatagaagacggccccacctgggcggcgaacttggcggcccaagggggtgcaaactggcaactacctggctgtttgtgtccctctggctgctctacatcttatttgccactctggaggcctactgctacatcaaggggttctag

SEQ ID NO: 46415 - DNA, 1863 bp, Artificial Sequence
  Description of Artificial Sequence: Synthetic coding sequence
atggcctggctgcggctgcagcccctgaccagcgccttcctgcacttcgggctagtgacatttgttctgttcctgaatggcctgagggccgaggccggcgggtccggggatgtgccatccacgggccagaacaatgagtcctgtagtggaagcagcgactgtaaggagggagtgattctgccaatttggtatcctgagaaccctagcttaggggataaaatcgcaagagtaattgtatacttcgtcgcgctaatatatatgtttttaggggtgtcaataatcgcagacagattcatggcgagcatagaggtgataacaagtcaggagcgcgaagtgaccatcaagaagcccaacggtgagacgagcaccacgaccatcagggtgtggaacgagaccgtgagcaacctgacccttatggctctcggcagctcagcccctgaaatacttctgtctctcattgaagtgtgtggtcacggctttatcgccggagatctcggacccagtacgatcgtggggagcgcggccttcaatatgttcataattattggcatctgtgtgtatgtgattccggacggagaaactagaaagataaagcatctgcgagtgtttttcattacggccgcttggtccattttcgcttacatttggctgtatatgatccttgctgtgtttagcccgggggtcgtgcaggtgtgggagggcctgctgaccttattcttttttcccgtctgtgttctcctggcttgggtggctgataagcgcctgctcttctacaagtatatgcacaagaagtatcgaactgacaagcatagagggatcatcatcgagacagagggtgaccaccccaaaggcattgaaatggacggtaaaatgatgaacagtcatttcttagacggaaatctggttccgctggagggcaaagaggtagatgaatccagacgcgaaatgatcaggatcctaaaagatcttaaacagaagcaccctgagaaggatctggaccagttggtcgaaatggctaattactatgctctaagtcaccagcagaaatccagggccttctacagaattcaggcgactcgaatgatgacaggcgccgggaacattctgaaaaaacacgcagcagaacaggctaagaaggcctcctctatgagcgaagtccacactgacgagcctgaagacttcatatcaaaagtttttttcgacccgtgcagttaccaatgtctagaaaattgcggagccgtgctgctcacagtcgtgcgcaagggcggcgacatgagcaaaactatgtacgtggattacaagaccgaggatggttccgcaaatgccggggccgactatgagttcaccgaagggaccgtcgtgctgaagcctggcgaaacacagaaggagttttctgtgggcataatagatgatgacatctttgaagaggacgagcatttcttcgtgcggctgtctaacgtccggattgaagaagagcaacccgaggagggcatgccacccgctatctttaattccctcccgctaccacgagctgtactagcctctccgtgcgtggctacagttactatacttgatgatgatcatgcagggatctttacgtttgaatgcgacaccatccatgtgtccgaatccatcggggtcatggaagttaaggtcttgcgaaccagcggcgcgaggggcaccgttatagttccttttcggacggtcgaaggaactgcaaaaggcggtggcgaagacttcgaggacacctacggcgaattggagttcaaaaatgatgagaccgtgtgtgaccgccaggaggctgactacggccgcagaggcggtcaggaggattctagggacggaaaggcttcaattggttag

SEQ ID NO: 46416 - DNA, 2778 bp, Artificial Sequence
  Description of Artificial Sequence: Synthetic coding sequence
atggcctggctgcggctgcagcccctgaccagcgccttcctgcacttcgggctcgttacattcgtgctgtttctgaatgggttgcgtgcagaggcaggcgggtccggggacgtgcccagtaccgggcagaacaacgagagttgtagcggcagcagtgattgcaaggaaggtgttatcctacccatctggtatcccgaaaacccatctctgggcgataaaatcgctcgggtaatcgtgtactttgtcgccctaatatacatgttcctcggcgtctctatcatcgcggatagattcatggctagcattgaagtgattactagtcaagagcgggaagtgacaataaagaaacctaacggagaaacctcaacaacaacaattcgagtgtggaatgaaactgtgagtaacctgacacttatggctctcgggagctcggctcccgagatcttactaagcctcatagaggtgtgcgggcacggctttatagccggggatttggggccttctacaattgtcggcagcgctgctttcaacatgttcataattatcgggatctgtgtctacgtcatccctgatggagagacccgcaaaataaagcaccttagggtcttcttcattacggctgcgtggagtatttttgcctacatctggttatatatgatactggcagtgttctctcctggtgttgtgcaggtatgggagggcctgttaacgttgttttttttccctgtgtgtgtgctcctcgcttgggtggccgacaagagactgctgttttataaatacatgcacaaaaagtaccggactgacaagcataggggcattattattgaaactgaaggcgatcaccctaaaggtatcgaaatggacggcaaaatgatgaatagtcactttctggatggaaacctggtgcccttagaaggaaaggaagtggatgagtccagacgagagatgattagaatcttgaaggacctgaaacagaagcacccagagaaggacttggatcagttagtggaaatggccaactattatgccctaagtcaccagcagaaatctagagccttttaccgcatccaggcgactcgaatgatgacaggggcggggaatatactgaagaaacatgccgccgaacaggccaagaaggcatcaagtatgtctgaagtccataccgatgaacctgaggactttatttcaaaagtgttcttcgacccgtgtagttaccagtgcctcgagaattgtggggcagtcctgctgaccgtggtccgcaaggggggggacatgtctaaaacgatgtatgtggactataagactgaggacggatccgcaaacgcaggcgccgattatgaattcaccgaaggcacggtagttctgaagcccggagaaacgcagaaggagttttctgtgggcatcattgatgacgatatctttgaggaggacgaacatttcttcgtgcggctgtccaacgtgagaattgaagaggaacagccagaggagggaatgcctcccgccatctttaattcgttaccactgcctagagcggtactggctagcccttgcgtagcaaccgtcaccattcttgatgatgaccatgccggaatctttacttttgagtgtgatactatccatgtctccgagtctatcggcgtcatggaggtcaaggtcctgaggacttctggagccaggggcaccgtcattgtccccttcagaaccgtggagggcactgccaagggaggcggagaagatttcgaagacacatatggcgagctggagttcaagaacgacgagaccgttaagactatccacatcaaggtgattgacgatgaggcatacgagaagaacaagaattattttattgagatgatgggtccaagaatggtggacatgtccttccaaaaagccttactgctgtcccctgatcgcaaactcaccatggaagaggaagaggccaaaagaatcgctgaaatgggaaaacccgtgttgggcgagcaccccaagctcgaagtcatcattgaggaatcatatgagttcaaaactactgttgacaagttaattaagaaaacaaatttagcactggtggtaggtacccatagctggagagatcagttcatggaggccattacggtgtcagctgctggggacgaggatgaggacgaatccggagaggaacgcctgcccagctgtttcgattatgttatgcacttcctgaccgtcttttggaaagttctgttcgcatgtgtgcctccgacagagtattgtcacgggtgggcatgtttcgcggtgtccattctgattataggaatgcttactgctatcataggggacctggctagtcattttgggtgcacaatcggcctcaaggattccgtcacggctgtagtgtttgtcgccttcgggactagtgttccagacacgttcgccagtaaggcagcagccctgcaggacgtgtatgcagatgcctctattgggaatgttactgggtccaatgctgtcaatgtgtttctcggtataggactggcctggtctgtggccgctatttattgggccctgcaagggcaggagtttcatgtatcagcaggtacccttgccttctctgtgactctcttcaccatcttcgcgtttgtatgtatatctgtcttgttgtaccggcgacgacctcaccttggaggggaattagggggtccacgcggctgcaaacttgcaacaacatggttgtttgtgtccttatggctcctgtatatactctttgctacgcttgaagcctactgctacattaaaggcttctag

SEQ ID NO: 46417 - DNA, 2775 bp, Artificial Sequence
  Description of Artificial Sequence: Synthetic coding sequence
atggcctggctgcggctgcagcccctgaccagcgccttcctgcactttggactggttaccttcgtattgttcctgaacggactcagggctgaggctggagggagcggagacgtgcctagcactgggcagaacaacgaaagttgcagcggatcttccgattgcaaggagggggtcatcctaccgatttggtatccggagaacccttctctgggggacaagatagctagggtgatcgtgtacttcgtggccctcatctacatgttccttggcgtctcaatcatagccgaccggttcatggctagcattgaggtgatcacctcacaagagcgtgaagttactattaagaaacccaacggcgagaccagtacgacgaccatcagggtgtggaatgaaacagtctccaacttgactctcatggcccttgggtctagcgctcccgaaatcctgctgtccttgatcgaagtgtgcggacatggattcattgcaggcgatctgggcccgagcaccatcgttgggagtgccgcctttaacatgtttatcattattggaatttgcgtgtacgtgatcccagacggcgaaactcgaaagataaagcacctgcgcgttttcttcattacagccgcgtggtcaattttcgcatacatttggctctatatgattctagcagtttttagtcctggcgttgtgcaagtttgggaaggactgctgacactgtttttctttcccgtatgtgtcctactggcctgggtggctgataagcgtctgctcttttacaagtacatgcataaaaagtatcgaaccgataaacaccggggtattatcatagagacagagggggatcatccgaagggaatcgagatggatggtaaaatgatgaactcccattttttggacggaaatctggtgcctttagaagggaaggaagttgatgagagtagacgcgaaatgatcaggatcctcaaagacctgaagcagaagcatcctgagaaggatctagatcaactggtggaaatggcgaactactatgctttgagtcaccaacagaaaagccgtgctttctaccgaatacaggcgaccaggatgatgaccggggcgggcaacatactgaagaagcatgcggctgaacaggccaagaaagcgtctagtatgtcagaagtgcatactgatgaaccagaggatttcatttcaaaagtgttttttgatccctgcagctatcagtgtctggagaactgcggagccgtgttgctgaccgttgtgagaaagggaggggatatgagtaaaacaatgtatgtggattataagaccgaagacggaagtgcgaacgccggcgctgactatgaattcaccgaggggacagtcgtcctgaagccaggtgagacgcagaaggaattcagcgtggggattattgacgacgatatcttcgaagaagacgagcatttttttgtcagactgtccaacgtgaggatcgaagaagaacagccagaggagggcatgcctcccgccattttcaactccctcccactgcctcgcgctgtcctggctagtccttgtgtagcaactgtgaccatcctcgacgatgaccacgcggggatctttacttttgagtgtgataccatccacgtgtcggaatcaatcggagtcatggaagtcaaggtgctgcgcacttccggggcccgcggaactgtcattgtgccttttaggaccgtggagggtaccgccaaaggcggcggcgaagacttcgaggatacctacggcgaattggagttcaagaacgatgaaaccgtgaaaaccattagggtgaagatcgtggacgaagaggagtatgagagacaggagaacttcttcatagctttgggagagccaaagtggatggagagaggcatatcagccctgctgttgagtcccgaccggaagttgacaatggaagaagaggaagctaaacgcattgctgaaatggggaagccagtcctgggtgagcacccaaaactggaggtgatcatcgaggaaagttatgaattcaagactactgtagataaactgatcaagaaaactaatctcgcgctggtggtcgggacccactcatggcgcgaccagttcatggaggcaatcacagtatctgctgccggcgatgaagacgaagatgagagtggggaggaaaggctcccttcatgtttcgattacgtgatgcactttcttactgttttctggaaggtgcttttcgcatgtgtaccccccactgagtactgccacgggtgggcatgcttcgcagttagcatcctgataattggcatgttgaccgccattataggagacctggcttcgcatttcgggtgcactattgggctgaaggattcagtgaccgcagttgtcttcgtggcatttggaacttctgttcccgataccttcgcttccaaggcagccgctttgcaagacgtctatgccgatgcttccattgggaacgtgacaggatcaaacgctgtgaatgtctttcttggcatcggcctcgcttggtctgtagctgcaatttactgggccctccaaggccaggagtttcacgtgtccgcaggcactctagcattctcagtgacactctttacaatattcgccttcgtctgcatttccgtgctgctctataggcgcagaccacacctggggggcgaactagggggcccacgcgggtgtaaactggctacaacgtggctctttgtttctctgtggttgctgtacatcctcttcgctaccctggaggcgtactgctatatcaagggattctag

SEQ ID NO: 46418 - DNA, 3375 bp, Artificial Sequence
  Description of Artificial Sequence: Synthetic coding sequence
atgagcagctacttctgggcccagaacgagagcaaccggcccgacctgctgtgtgggcagccagccgactacctcgtggaagagaaacacttcactaccctggtgtgttttatagtagtgctgggcggactgctgaagatgtgtctaaagaattgtgaggtaatagtgctgacaatcctctctttaagcggattcgttataggacatatggcttacaactcggtggaagtacatcaaatcgtctacccgcttctgaggacatctagtttctccctctatagttatttctcaccgctcatcatttttatggtggcattggatgtggagttttacaccctgaaaaagatgttttggcaggtgctgctcacaggcctgatctcgttttcaaccgccagtattataattggttacgtcgtgatcaagtttaataaagattcctgggatctacagtcatgtctgctgttttccatcacactgggtattattgacccgctgcggagcgtaaatagtttgaagacaatcggcatcagtaagatctacatcgacttgatcaggggagaaagtttgataatatgtagtatcgccagcatattcttcgggaactttcgcgggaacagaattcacttcagtattttcagagatttacatgtcggtatcgaactctcttacgatatccttggatctattatatttggatactggtgcgccaagataatacaatgcatcttggccgacgtcttcagcaacatgctgactaacattatcctctgctttagcatggtatacatgaccttctacatcgtggagttcttggggatgtccgggacactggcactagctgcagtggggcttaatttagacagcctaaccttcaaaccaaaaatagagttagtgatcaccaagttcctccggatcttttcaagtgtgtacgagcatctaatatacgcgtttttcggaatcgtcattggatgcggtgaactgtcacactatgaatttcacacaatccctttcatctttatcctgttcacaactgttaatctcgtgaggttactgactatcttgcttgttagtccaatcctcatgcactccaactacgagtacaattggcggtggggggtcgtgattacctggagcggcattaaaggtgtgtttaatctgctgtgggcacccgatgtttataacttagccgagcgcaaggtcgaggtgccccagatgtttatcctgtacgtgcaggtcattagcctgctgacaatgggaattaactcatacgtgatgacgcagtcagcgagaaaactggatctgtgtgtactctctctcccaagacagatgatcctccagaatgcgacacagcatatccaggagatcgtgcaaaacaccatcacattattcaagactgagaaaattctcaccaatgtgaattggactttggtcgaggataagacacgaattgagtatatcccattcagccatgtgtcacacaacgacatgaagactgaatctacgacagacgaggccttgatggaggaggctaggctgcacgtggccgccatccaaatgtctagtttcgagaagcagcgcaacaatggcatcctggaaatcgaggctgcccggatcctgattggagccgctaagtgctactactcgatacaaggtaagttcatgagtatttatgacgttagtacctacatgaggacccgaagctggctgattaaatttaaaaacgtcttgactttcctcgaatattgtatagaaaagatccacttcattccccccgagtccaacacctttctcacatttatctttcatattgtcttctccgaggagttcgaatatactgggcagataattaacctgatttacatctacccaatgatcatacacctgtggccaatggcccggggcctgaacgtcagcgcacttatctccattaattattactttatgtttctttatgtgctggaaagcactttgaaaatcatcatactgaagaggaaatatttccagcagtgctggaacactctcgagttcttcatccttgtaataggtatcatcgacattttctgtgtatactttgtgaagctcagacccgataacctggccttgattcagttgactgtaattatgggttacctgcggattatcaggttcctgccactgtttaagatcatcgttccaatcctgattcgaatcgccgatgtccagattaagaagcgactgtcactcatgtactctatcaccaaggggtacatcaagagccaggaagacgccaagttgctaatcaagcagattgctgtctgtgaatcaatttaccagaaactttgtgagattcttgaaactaataaacaggatgcggtcaaggaactggttttaatggagcacgagggacgtgacgtggtgatcgcattaaagactaagcaggccattaggaatgtcatcgctaaggcattaaaaaacttgacgttcctttgttcccgaggcattatcgacaagcacgaggtgatcgagataaacaaagtcctgttgaaaaagctcaaagcgctgaataacttccctaaggctatacctcctccaacaccagacatttacttacataacattatctggctagaagggaaggatgtgctgatcgacttcttcaaagaaagggcgaagctggcctgcttcgactctggggatacaatttgtaagggcggagagatgcctcaggggatttacttaatcatatctggcatggccatcttacattcactgtctcccacatttgggatagagtcaaatcaacggtgcgacagagggagcagagacatgtttaccgagttttgtactacaggagatataatcggagagttgtcttgtctgctgaagcgtgagatcgaatacaccgtgatatgtgagaccagcctgcaagcctgtttcatcagcctggaagacctgtacgagggctttgatgccttctggccatctctggaatacaaaatatggctgaagctggctctgagcacagcataccaatacttcgagagtagtctaatcgatgaagatctccggtttcagaattgcgttatgtttaaccaggcctatgtagaaacactgagctcctatagtgatatgattatcgacaatatgacgatgaagtttgtgattattgtgtacggatccgtcattgacactaaaaccgaggagccatattttgcaccttgcattatacccacgacttgcgagcaagttcagggtacatcagacctaagcaagctgctgataattcaggcttctgagctcacccaacggaatagcaatacaaatgtcatggcgagtgtcaatacagtgtttgaacaacccggaaagaacataaacggaaggcagaagatgagttag

SEQ ID NO: 46419 - DNA, 1353 bp, Artificial Sequence
  Description of Artificial Sequence: Synthetic coding sequence
atggtggccctggacgtggagttctacaccctgaagaagatgttctggcaggttttattaacaggactcatttcgttcagtacagcctcaatcataataggatacgtcgtgattaagttcaataaagattcttgggacctgcagtcgtgcctcctcttcagcatcactctgggaatcattgatcctctgagatctgtgaactcccttaaaacgatcggcatcagtaaaatctacatcgacctgatccgcggagaatctctgattatctgcagcatcgctagtattttttttggcaattttagagggaataggatacacttctccattttcagggaccttcatgttggcatcgagctgtcatacgatatcttaggaagtattattttcggttattggtgtgccaagattatccagtgcattctcgcagatgtgttcagtaacatgctgacaaatatcattctgtgcttctccatggtatacatgactttctatattgtcgagttcctcggaatgtccggaacgctggcactggccgctgttggcctgaatctggacagtttgaccttcaaaccgaaaatcgagctggtaatcaccaagtttttgcgtatctttagttcagtgtacgagcacttgatatacgccttcttcggcattgtgattgggtgcggcgagctgagtcattatgagttccatacaatccctttcatttttattttgtttacgacggtcaacttggttagactgctgaccattttactagtttctccaatcctgatgcacagcaactatgagtacaactggcgctggggggttgtgattacttggagtggtataaagggagtcttcaatctgctctgggcaccggatgtatataatctggcggagcgaaaggtcgaggtaccacagatgttcattctctatgtgcaggtcatttctctccttaccatgggtataaactcctacgtcatgacacagagcgccagaaagcttgatctctgtgttctgagtcttccaagacaaatgatcttgcagaacgccacccaacatatccaggagattgtgcaaaacaccataacgttgtttaaaaccgaaaaaatactaaccaatgtgaattggactttggtcgaagacaagactaggatcgagtacatccctttctctcatgtgtcccataacgatatgaagacagaaagtaccacagacgaggctctaatggaggaggcccggttgcacgtagctgcaatccagatgagctctttcgagaagcaacggaacaatgggatccttgagatcgaggccgctcgaatcctaatcggcgccgcaaaatgctactatagcattcagggaaaatag

SEQ ID NO: 46420 - DNA, 1548 bp, Artificial Sequence
  Description of Artificial Sequence: Synthetic coding sequence
atgcacaccaccgagagcaagaacgagcacctggaggacgagaactttcagactagcacaactcctcaaagcctgattgaccccaacaacaccgcgcaagaagagaccaagaccgtgctatccgacactgaggagatcaagccccaaactaaaaaggagacatacatcagttgccccctgagaggggtgctgaacgtcataataactaatggcgtgattttgtttgtgatctggtgcatgacatggagtatcttgggtagcgaggccctcccaggaggcaacctttttggcctgttcattattttttattcagccataattggagggaagatcctgcagcttatacggatccccttggttccacctctccctcccctcctaggaatgctactggcgggtttcactatcagaaatgtgccgttcatcaacgagcatgttcacgtgccaaatacttggtccagcattttgagaagcatcgccctgacaataattctgattcgggcaggactgggcctcgaccctcaggcactccgacatctgaaggttgtgtgttttaggcttgctgtcggtccgtgcctgatggaggcttccgcagctgcagttttctcacacttcattatgaaatttccctggcaatgggccttcctgctggggtttgtgctgggcgctgtttccccagcggtagtcgtgccttatatgatggtgctgcaggagaatggctatggagttgaagagggcattcccacactcctaatggccgcctcttctatggacgatattctcgctatcaccggctttaatacctgcctgtcaatcgtcttttcctcaggtggtatattgaacaatgcaattgcttcaatccggaacgtttgcatcagtttgttggctggcattgtgctcggattctttgtaagatatttccccagcgaggatcagaagaagctgactttaaaacgcgggttcctagttctcacaatgtgcgtgtctgctgtcctgggctcgcagcgtatcggtctgcacggttctggcgggctctgcaccctggtcttgagcttcatcgccgggaccaaatggagccaggaaaagatgaaggtgcaaaaaatcatcacaacagtatgggacatctttcaacccctcctttttgggttggtcggtgccgaagtctcagtgtcttccctcgagtcaaacattgtgggcatctccgtcgctacattaagtctcgccttgtgcgtccggatcctgacaacctatctcctaatgtgttttgccggatttagcttcaaagagaagatcttcatcgccttggcctggatgcccaaggcgacagttcaggcggtgctggggccgttggctctcgagaccgccagggtgtcagcaccacatctcgagccctatgcaaaggatgtcatgacagtcgcttttcttgccatcttgatcactgcccccaatggggctctcctgatgggtatcctggggccaaaaatgctcacaagacattacgatccatctaagattaagctacaattaagcacactagagcatcactag

SEQ ID NO: 46421 - DNA, 1428 bp, Artificial Sequence
  Description of Artificial Sequence: Synthetic coding sequence
atgcacaccaccgagagcaagaacgagcacctggaggacgagaactttcagacatcgaccactccgcagagcctgatagatccaaacaatacagcccaggaagagactaaaactgtgttgtccgatactgaagagatcaaaccccaaaccaagaaagagacctacatttcttgccccctcagaggcgtcctgaatgtcatcataaccaatggagtgattctttttgttatctggtgcatgacctggtccatactggggtctgaggccttacctgggggaaatctcttcggactgtttatcattttttactcagccataataggcggtaagatcctccagttgatcagaattccactagtccctcccttacctcccctgctaggaatgcttttggccggcttcaccatacggaatgtgcctttcatcaacgagcacgttcatgtgcccaatacttggtcttcaatcctgcgcagcatcgcacttaccataattctgattagagcaggtctggggcttgatcctcaggcgctccggcatctaaaggtcgtgtgtttcaggctggccgtcggcccctgcctgatggaggccagtgccgctgcagtatttagtcacttcatcatgaagtttccatggcagtgggctttcctgctcggatttgtgctgggtgcagtgtctccggcagtcgtggtgccctacatgatggtccttcaggaaaatggctatggggtcgaagagggcatccccaccttgctgatggcggccagcagcatggacgacatcctggccattaccggcttcaatacttgtctgtccatagtgttctcatccgggggaatactaaataatgctattgcttctattaggaacgtctgcataagtcttcttgcaggaatagtgctgggcttctttgtgcgctacttcccgtcagaggaccaaaaaaagcttaccctgaagcgcggatttcttgttctgacgatgtgtgtttctgcggtcttgggctcccagcgaataggcttgcacggcagcggtgggctatgcacccttgtgctgtccttcattgccggcactaaatggtctcaagagaaaatgaaagtgcaaaaaatcatcacaaccgtctgggatatctttcagcctctgctgttcggactggtcggagccgaagtgagtgtgtccagcctcgagtctaacatagtgggaatctccgtagccactctttctctggcactgtgcgtgcgcattctgacgacttacctgctgatgtgctttgcaggcttcagtttcaaggagaaaatattcattgcacttgcttggatgccaaaggcaaccgtccagattaaccaggctattctgctcttattcctcctcagagaggaatggacaaattgtaaagtagctaaaaaatgcgagtacaccaaagagcgccagtag

SEQ ID NO: 46422 - DNA, 663 bp, Artificial Sequence
  Description of Artificial Sequence: Synthetic coding sequence
atgcacaccaccgagagcaagaacgagcacctggaggacgagaacttccagacatctacaactcctcagtccctgattgaccctaacaacacggctcaggaagagaccaagaccgtcttatctgataccgaggagattaagccacagaccaaaaaagaaacatatatctcctgtcctttaagaggggtcctgaacgttatcataacaaatggggtcatattatttgtaatatggtgtatgacatggtcaattttagggagcgaggcccttcccgggggaaacctgtttgggctcttcattattttctacagtgctatcatcggaggcaaaattctacagctgattcgcatccccttggtgcctcccctgcctccacttctgggtatgctgttggcaggtttcaccatcaggaacgttccctttatcaacgagcacgtacacgtccctaacacctggtcatccatcttgcgatcaatcgcccttacaattatcctcattcgggcaggactcggtctcgacccacaagctctgagacaccttaaagttgtgtgcttccgcctggctgtggggccctgccttatggaggcctccgctgcagccgttttctctcattttatcatgaagttcccctggcagtgggccttcctcctcggcctcttttag

SEQ ID NO: 46423 - DNA, 153 bp, Artificial Sequence
  Description of Artificial Sequence: Synthetic coding sequence
atgcacaccaccgagagcaagaacgagcacctggaggacgagaactttcagaccagcaccacccctcagtccctcatagaccccaataatacagctcaggaagagacaaaaacagtcctcagcgatactgaagagattaaaccacagacctag

SEQ ID NO: 46424 - DNA, 1365 bp, Artificial Sequence
  Description of Artificial Sequence: Synthetic coding sequence
atgggcgacgaggacaagcggatcacctacgaggacagcgagccctcaacgggaatgaactacacaccctctatgcatcaagaagcccaagaggagacagtgatgaagttgaagggtatcgacgctaacgagccaaccgagggatctatccttctcaagtccagcgagaaaaaattacaggaaacacccactgaagcaaatcacgtccagaggctccgccagatgctcgcgtgtcccccacacggactcctcgatcgcgtgattactaacgtaaccatcattgtgctactctgggctgtggtctggagtattactggcagtgagtgtctgcctggaggcaatctgtttggaattatcatcctgttctattgcgcaatcattggcggaaagctcctgggcctaatcaaactgcccacgctgcctccactgccaagcctgttggggatgctgctggccgggtttctgatccgaaatataccagtgattaacgataatgtgcaaatcaagcataagtggtcctcaagcttgcgctccatcgccttaagcatcatcctggtacgagctggacttgggttggatagcaaggccttgaaaaaactgaagggcgtttgcgtgagactctccatgggtccgtgcatcgtggaagcttgtacgagcgcactgttggcacattaccttctggggcttccgtggcagtggggcttcattctgggtttcgtattgggtgctgtgagtcccgctgttgtggtgccttccatgcttctgctacagggcggcggctatggagtcgaaaagggagttcctacgctgctcatggcagcaggctcgttcgatgatatattggccatcaccggcttcaacacttgtttggggatcgccttctccacgggttccacagtgttcaacgtcctgcggggggtgctggaggtcgtgatcggggtggccacaggcagtgtgctaggattttttattcaatacttcccctccagggatcaggataagctggtgtgcaagaggacatttctagttttggggttgagtgtcctcgcagtgttctcatcagtacacttcggtttcccaggatccggtggcctctgtactctggtgatggcttttctcgcgggcatgggatggaccagcgaaaaagccgaggtcgaaaaaattatagctgttgcatgggatatctttcagccgctgctgtttggtctgatcggcgccgaggtcagcatcgcctccctccggccagagaccgtgggatccgccgattcaataacaggcaactttggcacggaaagacccaagctgctgggacctccttcaacgcagctcaggtttcacttctttcatatccaactttctacatag

SEQ ID NO: 46425 - DNA, 1614 bp, Artificial Sequence
  Description of Artificial Sequence: Synthetic coding sequence
atgggcgacgaggacaagcggatcacctacgaggacagcgagccctccaccggcatgaactacacccctagcatgcaccaggaggcacaggaggaaactgtcatgaaacttaaaggaatcgacgccaacgagcctaccgaaggctctatactgctgaagagctccgagaagaaactgcaggaaactccaacagaggcgaatcacgtccagaggctcagacagatgttagcctgcccaccccatggtctgcttgacagagtgatcaccaacgtgaccataatcgtgctgttgtgggctgtcgtgtggtcgatcacggggtccgagtgtctccccggcggcaatctttttggcatcatcatcctgttctactgcgccataatcgggggaaagttgctgggtttaattaagttgccaactctgcctcctttgccaagccttctcggaatgttactagctgggttcctcattcgtaacattcctgtgatcaatgacaacgtacaaattaagcacaaatggtccagtagtctgaggagcattgctctctcaatcatcctggtcagagctgggcttggtctggattcaaaagcgctgaagaaactcaagggcgtgtgtgtgaggctgtccatggggccttgtattgttgaggcctgtacctcagctcttctcgcccactatctgctcggcctgccctggcaatggggatttattctgggctttgttctcggtgctgtgtcgccagccgtggtagtgccctcaatgctgttgcttcagggaggcgggtatggagttgagaaaggagtaccaactctactgatggccgctggttcattcgatgatattctagccatcactggatttaatacatgtctcggaatagcttttagtaccggaagtacagtgttcaatgtccttaggggggtgctggaggttgtaatcggcgtcgcgacgggctccgttctgggattctttatccagtattttccatcaagagatcaggacaagctggtgtgcaagcgaactttccttgtgctggggctctcagtgctggctgttttcagcagtgtccactttgggtttcccggaagtgggggcttatgcactttagtgatggcgtttttggctggcatgggctggaccagtgagaaggcagaggtcgaaaagataatcgcagtggcttgggacatctttcaaccgctgctgtttggcctcattggcgcagaagtgagtatcgcgtcactgcgccctgaaactgtaggactgtgcgttgccaccgttgggatagctgtcttgattcgaattctcacaacgttcctcatggtttgcttcgctgggttcaatctcaaagaaaagatcttcatttccttcgcctggttgcctaaagccaccgtccaggcggccatcggtagcgtggcactcgatactgcacggtctcacggggagaaacagctggaagattatggaatggacgtgttgactgtggctttcttgagcatcctcatcaccgcccccatcggcagcctcctgattggattgctcgggccgaggcttctgcaaaaggtggaacaccaaaacaaggatgaggaggtacagggagagacttctgtacaagtctag

SEQ ID NO: 46426 - DNA, 1614 bp, Artificial Sequence
  Description of Artificial Sequence: Synthetic coding sequence
atgggcgacgaggacaagcggatcacctacgaggacagcgagccctccacaggtatgaattataccccttccatgcatcaggaagcccaggaagagaccgttatgaagcttaaagggatcgacgcaaacgagccaaccgaaggttccatcctgctcaagtcctcggagaagaagttacaggaaacccctacggaggccaatcatgtccagagactgaggcagatgttagcgtgtccaccccatggcctgctggaccgcgtgataaccaatgtcaccatcatcgtattactgtgggccgtggtgtggtcaattaccggctcggagtgcctcccaggagggaatctcttcggcatcatcattctcttctattgcgctattatcggcggcaaattgctcggcttaatcaaactgcctaccctaccccccctgcccagtctgctaggcatgctcctggctggatttctgatccggaacatcccagtaatcaatgataacgtgcagatcaaacacaagtggagctcttctctgcgatccattgcactgagcataatcctggttcgagccggtttggggcttgattccaaggcactcaaaaagctcaagggcgtttgcgtccgcctgtccatgggcccctgtattgtggaggcgtgcacatccgccctactcgcccactatctactgggacttccttggcagtggggatttatccttggttttgtgctgggggctgttagccccgctgtcgtggtgccgtccatgctgctgttacagggcggtgggtatggcgtggagaagggggtgcctaccctgctaatggccgccggcagtttcgacgatattctggcgataaccgggttcaacacctgcttaggaatagcatttagtactggaagtaccgtgttcaatgtgttacgcggggtgctagaggttgtcattggagtcgccaccggctctgttctcggattcttcatccaatacttcccatctcgagatcaggacaaactggtgtgcaagagaacctttcttgtcctgggcctatctgtgttagcggttttctcaagtgtccactttggatttcctggctcgggcggtctgtgtacactcgtcatggcgttcctggcaggcatggggtggacctctgaaaaggctgaagttgaaaaaatcatcgccgtcgcatgggacatttttcagcccctgctgtttggcctcatcggtgccgaagtgtcaatagcgagcctgaggcctgagacagtgggcctatgcgttgcgactgtcggtatcgccgtccttatcaggattctaacaacctttctgatggtgtgctttgccggcttcaacttaaaagaaaagattttcatctcattcgcctggctgcctaaggctacagtgcaggcagccatagggtccgttgcactcgataccgcaagaagccacggggaaaaacaactcgaagactacgggatggacgtcttgacagttgcgtttctttcaattctgattacagcccctatcgggtctcttctaataggtctccttggccccaggctcctacagaaagtggagcaccagaataaggatgaggaagtacaaggcgaaacgtccgtgcaggtatag

SEQ ID NO: 46427 - DNA, 1254 bp, Artificial Sequence
  Description of Artificial Sequence: Synthetic coding sequence
atgggcgacgaggacaagcggatcacctacgaggacagcgagccctccactgggatgaattatacaccttccatgcatcaggaggctcaggaagagaccgtcatgaagctcaagggcatcgatgcaaacgagcccaccgaaggaagtatcctcttgaagtctagcgagaaaaagctgcaggaaacaccaacggaggctaatcatgtacaacgactacggcagatgttggcctgcccacctcatggtctcctcgaccgcgttattaccaatggaatgctgctcgctggatttttaatccgcaacattccagtgatcaacgataatgtccagatcaagcacaaatggagttcttccctgcgtagcatcgctctaagtataatccttgttagagctggactgggacttgactcaaaagccctgaaaaagctgaaaggcgtatgcgtacgcttatctatgggaccctgcatcgtagaagcgtgtacgtctgcactgttagcccactatcttctgggccttccctggcaatgggggttcatattgggcttcgtgcttggcgctgtcagcccagccgttgttgtgccctcaatgctgctactacagggaggaggttacggggtggaaaaaggagtgcccacactcctcatggctgcgggcagtttcgacgatatacttgccattaccggattcaatacttgtttaggaattgctttttctacaggatctactgtgttcaacgttctgcgcggagtgcttgaggtggtcattggagttgctaccgggtctgttcttggtttttttatccagtacttcccatcccgcgaccaggataaacttgtgtgtaaaagaacattcttggtgctcgggctaagcgtgctcgccgtgttttcctccgtgcacttcgggtttcctggctccggaggcttgtgtaccctggtgatggcctttttagccggtatggggtggacctccgagaaggccgaggtggagaagattatcgccgtcgcatgggacatctttcagccacttctcttcggcctcatcggcgcagaggtctccattgccagcctgagacctgaaacagtgggctgcaatcgcatttgcggcttcggccattccaaagttacgtggcgtgagactattaggaggctgtggaatggttgtgtggattccgggatcttcgtgcacccccaccattcccctaactggaagagcgcttattggttcactggtcctcaagctagtgcagagagttag

SEQ ID NO: 46428 - DNA, 1443 bp, Artificial Sequence
  Description of Artificial Sequence: Synthetic coding sequence
atgggcgacgaggacaagcggatcacctacgaggacagcgagcccagtacggggatgaactacaccccctccatgcaccaggaggctcaggaagaaacagtgatgaaactgaaaggcatcgatgcaaacgaacccaccgaaggtagcatcctcttgaagtcatccgagaaaaagctgcaagagacacccactgaggccaatcatgtgcaaagattacgtcaaatgctcgcctgccctcctcacggcctcctggaccgcgtgatcaccaacggaatgctgctggcagggttcctcatcaggaacatccccgttataaatgataacgtgcagattaagcacaagtggtccagctctctccggagtatcgccctctcaataatcctggtgagggctggccttggcctagacagcaaggcactgaagaaattgaagggagtatgtgtgaggctttctatgggcccatgcattgtcgaggcttgcacctccgcactcttggctcattacctgcttggcttgccatggcagtgggggttcatcctgggcttcgtgcttggcgctgttagcccagccgtagtcgtgccatctatgctcctgctgcagggtgggggctatggcgtggagaaaggagtgccaacactgctaatggctgccggctcattcgacgacatcctcgcgatcaccggcttcaatacctgccttggcattgccttctctacgggatccaccgtcttcaatgtgctacggggcgttctggaggttgtaatcggcgtggctaccggcagcgtgctcggcttctttatccagtacttcccctctagagatcaggacaagctggtgtgcaagcgcaccttcttggtcctgggcttatccgtgctcgcagtgtttagttccgtgcacttcggtttccctgggagcgggggcctgtgcacccttgtgatggcattccttgcgggcatgggatggacaagcgaaaaggccgaggtggagaagatcatagctgtcgcatgggatatcttccagccactactctttggcttgataggtgccgaagtgtccattgcctcattgcgccccgagactgtggggttgtgtgtcgccacagttgggatcgctgttctcattagaatccttacaacttttctgatggtgtgtttcgccgggtttaacttgaaggagaagatcttcatttcgtttgcttggctccccaaggctaccgtgcaagctgcaatcggcagcgtggctctcgacaccgcgcgcagtcatggcgagaaacaacttgaggactatggtatggacgtgctgaccgtcgcctttctgtccattctgattacggccccgatcgggagtctgctgattggcctacttggtccgaggttacttcaaaaggtggagcaccaaaacaaggacgaagaagttcagggtgagacaagtgtgcaagtctag

SEQ ID NO: 46429 - DNA, 432 bp, Artificial Sequence
  Description of Artificial Sequence: Synthetic coding sequence
atgggcgacgaggacaagcggatcacctacgaggacagcgagcccagtaccgggatgaattatacacccagcatgcaccaggaggcgcaggaagaaaccgtgatgaagctcaaggggatcgacgctaatgaaccgacagagggctcaatcctgttaaaatcaagcgagaaaaaactacaagagactcccactgaggccaaccacgtgcagagactgaggcagatgttagcctgcccaccgcacggcttgctagatcgcgtaatcactaatgtcactatcattgtgctgctctgggcggtggtgtggagcataacaggaagcgaatgccttccggggggcaatcttttcggcatcattatacttttttactgcgccatcattggcggcaaactgctgggactgattaaactgccaactttacccccactctag

SEQ ID NO: 46430 - DNA, 2064 bp, Artificial Sequence
  Description of Artificial Sequence: Synthetic coding sequence
atggacgagggcaccggcctgcagcccggcgccggcgagcagctggaagctccggcgacggctgaagctgtgcaggaacgctgcgagcccgaaaccctgcgatcgaagtctctgccggtactgagttccgcctcttgtcgtccatcactgtcccctacttctggagatgccaaccccgcctttggttgcgtggacagttcaggacaccaagaactgaaacaaggccccaacccactcgctccatccccctcggccccatccacttccgcgggtctcggagattgtaatcacagagtggatctgagtaagacctttagtgtctcatctgcgctcgcaatgcttcaggaaagacgttgcctatacgtggtgctgacggactcaaggtgcttccttgtctgtatgtgtttcctaacgtttatccaagctctgatggtttcaggttacctgtctagtgttattactacaattgaacgcaggtattccctgaagagctccgagagtggattactagttagttgtttcgacatcgggaatcttgtggtcgttgtttttgtgagctactttgggggccggggacggcggccattgtggctggccgtcggcggtctgctcattgcattcggggcagctctctttgcactgccccatttcattagtcctccttatcagatccaggaactcaacgcgtcggctcctaatgatggattgtgccaaggcggaaactccacagctacattggagcctccggcgtgtcctaaggactcgggcggcaataaccactgggtgtatgttgcactttttatatgtgcacagatcttgatcggaatgggctccaccccgatatataccttgggtcccacgtacctggacgacaatgtaaagaaagaaaactcttctttatacctcgcaataatgtacgttatgggcgcccttggccccgccgtcggatacttacttggtggtctactgatagggttttatgtggacccaaggaaccctgtccacctcgaccagaatgacccccgatttatcgggaattggtggtctggatttttgctttgcgccatcgcgatgtttctggtaatattccccatgttcacgttcccgaaaaaactccctccacggcacaaaaagaaaaagaagaagaaattttccgtcgacgctgtgagcgatgacgatgtgctgaaggagaaatctaataactcggagcaggctgacaaaaaggtcagcagcatggggtttggaaaagatgtgcgggacttgccgagagccgctgtcaggatactcagtaatatgacattcctgtttgtatctctatcctacacagccgaatcagcaatcgtgaccgcctttattacttttataccaaagtttatcgaatcccagttcggtatccccgcatctaatgcttctatctataccggggtgattatcgtgccgtctgctggagtcggaatagtgctcggtggctatatcattaaaaagcttaaactgggagccagagaatccgccaaattggcgatgatctgctcaggtgtctcgttactgtgtttttctactctctttatcgtcggatgtgaatcaataaatctcggtggcattaacattccttatacaaccggaccctctcttacaatgcctcacagaaatctaacaggcagttgtaacgtcaattgtggatgtaaaattcacgaatacgaacccgtgtgcggaagtgatggcataacatacttcaatccctgtttagcaggctgtgtaaacagtggcaatctttccacggggatacggaactatactgaatgcacttgtgtacaatcacgccaggtgatcacaccgcccaccgtcgggcagaggtcacagctcagagttgtgatcgtgaagacctatctaaatgaaaatggatacgcagtgagcggtaaatgtaaaagaacttgtaacactttaattccctttctggtcttcctctttatcgtgacctttatcactgcatgtgcccagccgagcgccatcattgtcacactctcgatccattcctattctaatcttctgtggagctcacattag

SEQ ID NO: 46431 - DNA, 2013 bp, Artificial Sequence
  Description of Artificial Sequence: Synthetic coding sequence
atgggcgagaccgagaagcggatcgagacccaccggatccggtgcttatctaaactgaaaatgtttctgctggccatcacgtgtgcttttgtctcgaagaccctctcagggtcttacatgaattcaatgcttacacagatcgagaggcagttcaatatccctaccagcctggttgggttcattaatggctccttcgaaatcgggaatctattgctaattatatttgtgtcgtactttggaactaaactgcaccgccccataatgatcgggatcgggtgcgtggtgatgggcctgggttgcttcctgaagtctcttccccattttctgatgaatcagtatgagtacgagagcacagtatctgtctcagggaacctctcctctaacagtttcctttgtatggagaatggcacccagatcctgcgacctacacaggacccatctgagtgtacaaaggaagtcaagagcttaatgtgggtgtacgtgcttgtcgggaacattgtgcggggcatgggcgagacccccatccttcccctgggcatcagttatattgaggacttcgctaaattcgaaaactcaccgctctatattggactggtggagactggcgctatcatcggcccattgattgggctgttactcgcatctttctgtgccaacgtttatgtcgatacagggtttgtgaacacggacgaccttatcataacccctaccgacacgaggtgggttggagcctggtggttcggcttcctcatatgtgcgggtgtcaatgtgctgacagctatcccattttttttcctccctaacacactgcccaaagaggggcttgagactaacgctgacattattaagaacgagaacgaagacaaacaaaaggaggaggtcaagaaagagaaatacggaatcactaaggacttcctgccatttatgaagtcgctgtcttgtaacccaatctacatgctgttcattttagtgtccgtcatccagttcaacgctttcgtgaacatgattagtttcatgccgaagtatctggagcagcagtacggcattagctcctccgatgccatatttctcatgggaatctacaatttgcccccgatttgcattggctatatcattggcggcctgatcatgaagaaattcaagatcaccgtgaagcaggctgctcatataggctgttggttgtctcttctcgagtatctcctatactttctgagttttttgatgacatgcgaaaattcttcggttgtagggatcaataccagctacgagggcattcctcaagatctctacgttgagaacgacatatttgccgactgtaacgttgattgtaattgcccgtccaaaatttgggacccggtctgtgggaacaacggcctctcttacctctctgcctgtctcgctggttgtgagaccagtatcggaacggggatcaatatggtatttcagaactgctcatgcatccaaacctccgggaattcatcagcagtgctcgggttatgtgataaaggccctgactgtagcctgatgctacagtacttcctgatcctgagcgccatgtcttctttcatatacagcttggcagccatccccgggtacatggtactcctgcgctgtatgaagtccgaagaaaagtcgttgggcgtcggattgcacacattttgcacccgggtgttcgctggcatcccggctcctatttacttcggggccctaatggactctacatgcctacattgggggaccctgaagtgtggagagagtggagcttgtcgcatttatgatagcaccacctttaggtacatttacttgggccttcccgcagccttgcgcgggtcatcctttgtgcccgccctgatcattcttatcctcttaagaaaatgtcatctccccggcgagaacgccagcagtggcaccgagctgattgaaacgaaggttaagggcaaggagaacgaatgcaaagatatataccaaaaatccacggtgcttaaagacgacgaactgaagaccaagctgtag

SEQ ID NO: 46432 - DNA, 1740 bp, Artificial Sequence
  Description of Artificial Sequence: Synthetic coding sequence
atgttcctgaccaagaactgcaagcaggagcaggagcgggtggagagcgcaaagatgtttctgctcgcaatcacttgtgctttcgttagtaaaacgttgtccggcagttatatgaacagcatgctgacccaaattgaacgccagttcaacatccccacatcactggtgggctttattaacggttcgttcgaaattgggaatctgctacttatcatatttgtgagctactttggaaccaagcttcacagaccaattatgatcgggatcggttgcgtcgttatgggcttaggatgcttcctcaagagcctgccacacttcttgatgaatcagtacgagtatgaatccaccgtgagtgtttcagggaacctgagctcaaacagctttctgtgtatggagaatggaacacagatcctgcgacctacgcaggacccgtcagagtgcacgaaggaggtgaaaagtctcatgtgggtttatgtgctcgtcggaaatattgtgagaggaatgggggagactcctatactgcccctcggcatctcctatattgaggacttcgccaagtttgaaaattctcccctgtacatcggtttggtcgaaactggtgccatcatcggccctctgattgggcttctgctggccagcttttgcgccaatgtatacgtggacactggattcgttaatacagatgatcttataattacgccaaccgatacccgttgggtgggagcttggtggttcggcttcttgatatgcgccggcgtgaacgtgctgaccgctattccattcttctttttaccaaatacactgccaaaggaaggtttagaaaccaacgcagatatcattaaaaatgaaaacgaagacaaacaaaaggaagaggtgaagaaggagaagtacggcattacaaaagatttcctgccgttcatgaaatcactgtcttgcaaccccatctacatgctgttcattttggtgtccgtgatacagtttaatgctttcgtcaatatgatcagcttcatgccaaagtacctagagcaacagtatggaattagttcaagcgacgcaattttcctgatgggtatttacaatctcccgcctatttgcattggatatataattggaggcctgattatgaaaaaattcaagatcaccgtcaagcaagccgcccacataggctgttggctttccttgctcgagtaccttttatatttccttagctttctgatgacttgcgaaaactcttctgtagtagggatcaacaccagttatgaaggtattccccaggatctatacgtagaaaatgacatttttgctgactgcaatgtcgactgtaattgccctagcaagatctgggatccggtctgcgggaacaacggtctgtcctatctaagcgcctgtctggccggctgcgaaacctctatcgggactggcataaatatggtgtttcagaactgtagctgcatccagacctctggcaattcgtctgctgtgctgggcctgtgcgataagggtcccgactgttctcttatgctccaatacttcctgatcctgtctgccatgtcctcctttatctattcgcttgcagccatccctgggtacatggtccttctgaggtgtatgaaatcagaggagaagagtctcggagtgggtctccacactttttgcacgagagttttcggcaagaactcatactttttcccgcatcccatccgcaccattctgctgttacttttctttattaccctttag

SEQ ID NO: 46433 - DNA, 42 bp, Artificial Sequence
  Description of Artificial Sequence: Synthetic coding sequence
atgggcgagaccgagaagcggatcgagacccaccggatctag

SEQ ID NO: 46434 - DNA, 156 bp, Artificial Sequence
  Description of Artificial Sequence: Synthetic coding sequence
atgggcgagaccgagaagcggatcgagacccaccggatccggtgcctttccaagcttaagatgttcctgctagccatcacttgcgcctttgtgtcaaaaactctgtcgggatcctacatgaactctatgctgacccagattgagcgacagttttag

SEQ ID NO: 46435 - DNA, 300 bp, Artificial Sequence
  Description of Artificial Sequence: Synthetic coding sequence
atgggcgagaccgagaagcggatcgagacccaccggatccggtgcctgagcaagctgaagatgtttcttttggctatcacctgcgcattcgtatcgaagacacttagtggctcctacatgaactcgatgctgactcagatcgaacgccagtttaacattcctacaagccttgtgggctttattaatggctcattcgagatcggtaatctgctgctgattatcttcgtttcctatttcggcaccaagctccataggcccattatgattggcattggatgcgtggtcatgggactgggctag

SEQ ID NO: 46436 - DNA, 444 bp, Artificial Sequence
  Description of Artificial Sequence: Synthetic coding sequence
atgggcgagaccgagaagcggatcgagacccaccggatccggtgccttagcaagctgaaaatgttcttgctggctataacatgcgcttttgtttcgaaaactctgagcgggagctacatgaactcaatgctaacccagattgagaggcaatttaacattcccacttccctggtcggctttatcaatggatccttcgaaatcgggaatcttctgctcatcatcttcgtttcttacttcggaaccaaattacacagacccataatgataggaattggatgtgtggtgatgggcctcggctgtttcctgaaatctctgccccacttcctgatgaaccaatacgaatacgagtctaccgtctccgtgagcgggaacctttcgagcaactctttcctgtgcatggagaacggcacccagatcctccgaccgacccaggatccctcttag

SEQ ID NO: 46437 - DNA, 9 bp, Artificial Sequence
  Description of Artificial Sequence: Synthetic coding sequence
atgggctag

SEQ ID NO: 46438 - DNA, 267 bp, Artificial Sequence
  Description of Artificial Sequence: Synthetic coding sequence
atgggcgagaccgagaagcggatcgagacccaccggatccggtgcctctccaagctgaagatgtttctgctggctatcacctgtgctttcgtgtctaaaactctttccggtagctatatgaattcaatgctgacgcagatcgagagacagttcaacattcctacttctctcgtaggattcataaatggctcctttgagattggtaacctgctccttattatttttgtgtcctatttcggcactaagcttcaccggccaatcatgtag

SEQ ID NO: 46439 - DNA, 276 bp, Artificial Sequence
  Description of Artificial Sequence: Synthetic coding sequence
atgggcgagaccgagaagcggatcgagacccaccggatccggtgcctctcaaagctgaaaatgtttctgttggcaatcacctgcgctttcgtgtcaaaaactctctccggcagttatatgaactcaatgctgacacagatagagcggcagttcaatattccaacatccctggtgggatttataaacggttcctttgaaatcggaaacctgctgctcatcatcttcgtctcctactttggcaccaaattacacaggcctatcatgatcggaatttag

SEQ ID NO: 46440 - DNA, 2013 bp, Artificial Sequence
  Description of Artificial Sequence: Synthetic coding sequence
atgggcgagaccgagaagcggatcgagacccaccggatccggtgcctgtctaaattgaagatgttccttctggccataacatgtgcattcgtctccaagaccctgagcggcagctacatgaatagtatgctgacgcagattgaaagacagtttaatattcccacttccctcgtgggctttataaatggttccttcgagatcgggaacttactcctcatcattttcgtgagttacttcgggacgaagcttcatagacctatcatgattgggatcggatgtgtcgtgatggggctgggatgctttctgaagagtttgcctcatttcctaatgaaccagtatgagtacgagtctactgtgagtgtgagcggcaaccttagcagcaactcattcttgtgcatggaaaatggcacccagattttgcggccaactcaggatcccagcgagtgcaccaaggaggtgaagtccctgatgtgggtctacgtactcgtgggtaacattgtcagggggatgggagagacgcccatattgccgctcggcatttcctacatcgaggacttcgccaaatttgagaattcaccactttacattggactggttgaaactggtgctataattggccctctgataggtctacttttagcatccttttgcgccaacgtttacgtagataccggatttgtgaatacagacgacctgattattacccccacagatactcgctgggtgggcgcctggtggttcggcttcctcatatgcgcaggcgtgaacgtgttaaccgcaatcccttttttcttcctcccaaacaccttgcctaaggagggtctggagactaacgcagacatcatcaagaacgagaacgaagacaagcagaaagaggaggtgaaaaaggaaaagtatggaatcacaaaggacttcctcccctttatgaaaagcctatcatgcaatcccatctatatgctcttcatcctagtcagcgtcatccaatttaacgcctttgttaatatgatatcattcatgcctaaatacctggaacagcagtacgggatttcatctagcgacgcaatcttccttatgggaatctacaaccttcctccaatttgcatcgggtatataattggggggctcatcatgaaaaagtttaagatcactgtgaaacaggcagcacacatcgggtgttggttgagcctgttggaatatctgctatatttcttgtcattcctgatgacttgcgaaaattcttctgtggtgggcataaacacaagttacgagggcatcccacaggacttatatgtggagaatgacatttttgccgattgcaacgtggattgcaactgcccgtctaaaatatgggatccggtctgtggtaacaatgggctaagctacctctcggcctgtcttgctggctgtgagacctccatagggaccggaataaatatggttttccagaattgctcttgcatacagacaagtgggaactcttcagcggttctgggcctctgcgacaaaggcccagactgttccctcatgctccagtatttcctcatacttagtgctatgtcttccttcatatacagtttggccgcaatccccggttacatggtgctcctccggtgtatgaagagcgaggagaagtcactgggtgtgggactgcataccttttgtaccagagtgttcgccggaatcccagcacccatctactttggagcgttaatggactccacttgtctacattggggcacattgaagtgtggtgagagcggcgcctgcagaatttacgactctactacgtttagatacatttacttgggcctccccgcagctctgcgaggcagctcctttgtgcctgccctgatcatactgattctgctccgcaagtgtcaccttcccggggagaatgcaagcagtggtaccgagttaattgagaccaaggtgaaaggaaaggagaacgagtgcaaagatatttatcaaaaatctacagtgctgaaggacgacgagctcaagaccaagctatag

SEQ ID NO: 46441 - DNA, 414 bp, Artificial Sequence
  Description of Artificial Sequence: Synthetic coding sequence
atgggcgagaccgagaagcggatcgagacccaccggatccggtgcctatcaaagcttaaaatgttcctattggcgataacgtgtgcctttgtgtccaaaaccctgtctgggagttacatgaattctatgctgacccaaatagaaagacagtttaacattcccaccagcttggtgggattcataaacggctcgttcgagattggaaacctactgctgataatctttgtcagctactttggcactaaactgcaccgtccaatcatgatcgggatcgggtgtgttgtcatgggcctgggttgcttcctgaagtctctgccccacttcctcatgaatcagtatgaatacgaatcaacagtgtctgtgtctggaaaccttagcagcaatagctttctgtgtatggagaacggaacttag

SEQ ID NO: 46442 - DNA, 1617 bp, Artificial Sequence
  Description of Artificial Sequence: Synthetic coding sequence
atggagaacggcacccagatcctgcggcccacccaggaccccagcgagtgcaccaaggaagtgaagtcactgatgtgggtatatgtgctcgtgggcaatatcgtgcgcgggatgggtgaaacccctattcttccgctggggatctcatacattgaagacttcgctaaattcgagaattctcctctttatatcggtttggtagaaacgggagccattatcggtcctctgatcggcttgttgctggcttcattctgtgctaacgtttacgtggacaccggatttgttaacactgatgatcttatcataaccccaacggatactcgctgggttggagcttggtggtttggatttctgatatgtgccggcgtaaacgtcctcaccgccattcccttctttttcttgccgaatacgctccccaaagaggggctggagacaaatgccgacatcatcaaaaacgagaacgaagataaacagaaggaagaggtaaaaaaagagaagtacgggattacaaaggacttcttgcctttcatgaaatccctctcttgcaatcctatctatatgctcttcattctggtgtctgtgatccagtttaatgcatttgtcaacatgatttcatttatgccaaagtatcttgagcaacagtacgggatcagtagctccgacgctatcttcctgatgggaatctacaacctacccccaatttgcatcggctatatcataggcgggttgattatgaagaagttcaagatcactgtgaagcaggctgctcacattgggtgctggttgtcacttttggagtacctcttgtatttcctcagtttcctcatgacatgcgagaattctagcgttgtcggcatcaacacatcctacgaggggatacctcaggatctatatgtggaaaatgatatcttcgctgactgcaatgttgattgcaattgtccaagtaagatctgggatccagtttgtggcaacaacggactgagctacctgagtgcatgtttagctggctgtgaaaccagtatcggaaccggaatcaacatggtattccagaactgcagttgcatccagacatccgggaattccagcgcggttctgggtttgtgcgacaagggcccagactgttccctaatgctgcagtactttcttatactgagcgcgatgagctcctttatctattcactggctgcaatcccaggctatatggtgctgcttcgatgcatgaagagtgaggagaaatcgttaggtgtggggttgcacacgttttgtacacgggtgttcgctggtatcccggctcctatctattttggagccctgatggatagcacctgtctacactggggtacgctgaaatgcggggaatcgggcgcctgcagaatctacgactccacgactttccggtatatatatttaggactgccagcggccctgcggggatccagcttcgtcccagctcttataattcttattctgttacgcaaatgccatcttcctggagaaaatgcatcctccggaacggaattgattgagaccaaggtcaaaggtaaagaaaacgagtgcaaagatatttatcagaagtccacagtgttgaaggatgacgaattgaagacgaagctatag

SEQ ID NO: 46443 - DNA, 1617 bp, Artificial Sequence
  Description of Artificial Sequence: Synthetic coding sequence
atggagaacggcacccagatcctgcggcccacccaggaccccagcgaatgcacgaaggaagttaagtcacttatgtgggtctacgttctggtgggtaatattgtccgcgggatgggggagactcctatcctccctcttggaatctcatacattgaggacttcgccaaatttgagaattcaccgctctacatcggactcgttgagaccggagcaatcatcggccccctgattggtctgctgctcgccagcttttgtgctaatgtgtatgttgatacaggattcgttaacacagatgatctcatcatcacccctactgatactcgttgggtcggggcgtggtggttcggatttctgatctgtgctggtgtgaacgtgctcactgccatcccctttttcttcctgcccaacaccctccctaaagagggcctcgaaacaaatgccgacattattaagaacgaaaacgaagataagcagaaggaagaagtgaagaaagaaaaatatggaatcacgaaggacttcctcccctttatgaagtccctttcgtgcaatcccatttacatgctgtttatccttgtgtccgttatacaattcaacgcattcgtgaatatgatttcgttcatgcccaaatatcttgaacagcagtatggaatctcaagtagcgacgcaatcttcctaatggggatttataaccttccccctatatgcatcgggtacattattggcggattgataatgaagaaattcaagataaccgttaagcaagccgcacatattggttgctggctcagtctattggaatacctgttgtatttcctgagtttcttaatgacctgcgagaacagctccgtggtgggcataaatacgagctatgagggaatcccacaagacctctatgtggagaacgatatattcgccgattgtaacgttgactgcaattgcccctcgaaaatctgggaccctgtttgcggcaacaatgggctatcctacctgagcgcctgcctggctggatgtgagacttcaatcggaacaggtattaatatggtattccaaaactgttcatgtatacagacaagcggcaactcttctgctgtgctcggactatgtgacaagggacctgattgcagcctgatgttacagtattttctcatactttcagccatgtcttcttttatttatagcctcgcagctattccgggatacatggtgttgcttagatgcatgaaatccgaagagaagagtttaggagttggcctgcataccttctgcactcgagtctttgcaggtatccctgcgcccatctattttggagctctaatggacagtacatgtttacactggggtaccttgaagtgtggcgaatccggcgcctgccggatttatgactcaaccactttcaggtacatatatctgggtctaccggcggccctccgtggcagttcattcgtacccgcactcatcatcttgatcctcctgaggaaatgtcatctgccaggtgaaaatgcgagcagtggcaccgagcttatcgagaccaaggtcaaaggaaaggagaatgagtgtaaggatatttaccagaaatccacagtccttaaggacgatgagctcaaaaccaagctctag

SEQ ID NO: 46444 - DNA, 1704 bp, Artificial Sequence
  Description of Artificial Sequence: Synthetic coding sequence
atgggcctgctgcccaagctgggcgccagccagggcagcgacaccagcactagtagggcaggacgttgtgctaggtccgtgttcggcaacattaaggtgttcgtgctgtgccaaggacttctgcagctctgccaactcttgtactccgcatatttcaaaagctctctaactactattgaaaagagatttggcctcagcagtagtagctctgggttgatttcttccctcaacgagataagcaatgcaatcctgattatattcgtctcatactttggatcccgcgtccacagaccccgtctcatcggcattggcggtttatttctggccgccggagccttcatactgacactgccacatttccttagcgagccgtatcagtacaccctggcctcaactgccatcttgtttgcaatctctgtgtttggccccgcgtttggctatttgctcggctctgtaatgctgcagatctttgttgattacggccgcgtcaataccgcagcagtgaaccttgtcccaggagacccccgttggatcggggcatggtggctaggactgctcatctcaagcgcacttctggttctgacctcctttcccttctttttcttccccagagcaatgcctatcggagctaagagagcccccgccaccgccgatgaggctcgaaaacttgaagaggcaaaaagccgcggcagcctcgttgatttcatcaagcgctttccctgcatctttttacgactgctgatgaactccctgtttgtcctggtggtcctcgctcaatgcaccttttcctctgttatcgctggattaagcactttcctgaataagttcctggaaaaacaatacggaactagcgctgcatatgcaaactttctgatcggcgcagtgaacctgccagcagctgcactaggtatgttgtttggcggtattcttatgaaacgattcgttttttcccttcaggccattcccagaattgctacgaccatcatcaccatctctatgatcctctgcgttcccctcttcttcatgggctgcagcactccaacagtggccgaggtgtacccccccagcacttcttctagcattcatccccagagtcccgcatgtaggcgggattgttcctgtcccgacagtatcttccacccggtatgcggggataatggaatcgaatatctcagtccatgccatgctggatgttctaacatcaatatgtcatcagctacctcgaaacagctcatatacctgaactgtagctgtgtcacagggggcagtgcttccgcgaagacgggttcctgcccagtgccgtgcgcccattttctgctgccggcgattttcctgatatcattcgtatccctgatagcctgtatctcccacaaccctctttacatgatggtgctccgtgttgttaaccaggaagagaagtccttcgcgatcggcgttcaattcttgttgatgcgcctgttggcttggcttccgtcccctgccctgtacgggttaactattgaccacagctgtatccgttggaactccctgtgtctcggccgtaggggggcttgtgcctactacgataatgacgccctacgggataggtacctcgggctccaaatggggtacaaagccctggggatgctgctgctgtgttttataagctggcgagtcaagaagaacaaggaatacaacgtgcagaaggccgctggcttgatctag

SEQ ID NO: 46445 - DNA, 2130 bp, Artificial Sequence
  Description of Artificial Sequence: Synthetic coding sequence
atgggcccccggatcggccccgccggcgaggtgccccaggtgcccgacaaagagaccaaagcaactatgggcacagagaatactcctgggggaaaggccagccctgatcctcaggatgttcgcccatcggtgtttcacaacatcaaactgtttgtcctgtgtcatagcctactgcaactcgcccagctgatgattagcggatacctgaaatcctccatcagtacagtggagaaacggtttggactttccagccagacctccggattattggcatcgttcaacgaggtcggtaacaccgccctgatcgtgttcgtctcctactttggaagtagggtgcataggccacggatgatcggatatggcgccatcctcgtagctctcgccggtctgctgatgactttacctcactttatcagtgagccatacaggtatgacaacacgtcccctgaggatatgccacaggatttcaaggcctctctgtgcctcccaactacttccgctccagccagtgctccgagcaacggaaattgcagctcttacacagaaacccaacatctgagcgtggtgggtattatgttcgtcgcccaaaccctgctgggcgtcggcggggtcccaattcagccgtttggcatctcttacatcgatgattttgcacataattccaactcccctttgtaccttggaattctcttcgctgtgacaatgatgggacccggcctagcttttggtttagggagtctgatgctgcgcctctatgtggacattaatcaaatgcctgagggaggaatctctttaacaattaaggacccgcgatgggtgggcgcctggtggctgggctttttgatcgccgctggcgccgttgcattagctgccattccatatttcttttttcccaaagaaatgccaaaggagaagcgggagcttcagtttagacggaaggtgctagcggtgacagattctcctgcacggaaaggaaaggacagtccttcaaaacagtccccaggtgagagcaccaaaaagcaggatggattagtccaaattgcacctaacctgacggtcattcagtttataaaagtctttccccgcgtgctgctgcagacactgcgacatcctatattcctcctggtggtcttgtcccaggtctgtctcagctcgatggccgccgggatggcgatatttctccctaagtttctcgagagacagttcagtattacggcttcttacgccaaccttctaatcggctgtctttccttcccaagcgtgatcgtgggtattgtcgttggaggcgtgctcgttaagagacttcacctggggccggtcggttgcggtgcgttgtgcctgctggggatgctactgtgtttgtttttcagtttgcctctgttctttatcgggtgtagcagccaccaaattgcggggattacacatcaaaccagtgctcatcccggcttggaactctccccctcgtgcatggaagcctgtagctgtccactggacggttttaaccctgtgtgtgatccaagcacgagagtcgaatacattactccttgtcacgcgggatgctcttcatgggtggtccaagacgccttggacaacagtcaggtcttttacaccaactgttcatgtgtggttgaagggaatccagttttggccggctcttgcgatagcacatgctctcatttggtggtaccctttttgctcctagtgtccctgggaagcgctctcgcctgcctgactcacaccccaagcttcatgctgatccttcgaggggttaagaaagaggataagactttagccgtaggtatccagtttatgttcttgcgtatactggcctggatgccttctccagtcatccatggctctgccatagacaccacgtgtgtgcactgggctctgtcctgcggtcggagagcagtgtgccgctactacaacaatgacttactgcgaaaccgattcattggtctccagttcttcttcaaaacaggctctgtcatctgtttcgctttggtgctggcggttctacgacaacaggacaaagaggcacgtacaaaagagtcaagatccagcccggccgttgaacagcagctcttagttagtgggcctggtaagaagcctgaagactccagagtctag

SEQ ID NO: 46446 - DNA, 1449 bp, Artificial Sequence
  Description of Artificial Sequence: Synthetic coding sequence
atgatcggctacggcgccatcctggtggccctggccggcctgctgatgacactcccccacttcatttctgagccatatcgctatgacaacactagccctggcgggatatccctgacaatcaaagacccccgatgggtgggagcttggtggctgggctttctcattgctgccggggctgtcgctttggccgccattccatacttctttttcccgaaagagatgcccaaggagaagagagaactccagtttcgtcgcaaagtgttagccgtgacggatagccccgcccggaagggcaaagattcccccagcaaacagagccctggcgaatctactaagaagcaagacggccttgtgcaaatcgcccctaatctgaccgtaatccaatttataaaagtgttccctcgggtattgctgcagacactgaggcaccctatcttcttgctagtggtgttgtctcaggtgtgcctatcttccatggcggcaggaatggcgattttccttcccaaattcctagagcgccaattctcgattactgcctcatatgctaatctgttaataggatgcttgagtttccctagtgtgatcgtggggatcgtggttggaggtgttctcgtcaaacgcctacacttaggccctgtcggctgtggtgctctgtgtctgctcggcatgttactttgcttgttcttttccttgccattgttcttcataggatgcagttctcaccagatcgccgggattacgcaccaaacttccgctcatccaggactggagttgagcccaagttgtatggaggcatgttcctgcccacttgatggctttaatccggtttgcgaccccagtaccagagtggagtacattaccccttgccatgctggatgctcctcatgggtggtgcaagatgctctggataacagtcaggttttttatacgaattgtagctgcgtggtggaaggaaacccagtcctggccggcagctgcgattctacatgtagtcatctagtcgtgccgtttctgctgctggtgtccttggggtccgctttggcgtgtctgactcacacaccctctttcatgctgatcctgagaggtgtgaagaaggaagataagaccctggcagtggggattcaatttatgttccttagaatcctggcatggatgcctagccccgtgatccatggttctgccatagataccacttgtgtgcactgggcgctgagctgtggccgccgggctgtatgtagatattataacaacgaccttctacgcaataggttcataggccttcagttttttttcaaaacaggcagcgtcatctgcttcgcgttagtcctcgcagtgctgcgtcaacaagataaggaagctcgtaccaaggaaagccggtcctctccagccgtggaacagcagcttctggtctctgggcccggaaagaagcctgaagacagcagggtttag

SEQ ID NO: 46447 - DNA, 2064 bp, Artificial Sequence
  Description of Artificial Sequence: Synthetic coding sequence
atgggcaccgagaacacccccggcggcaaggccagccccgacccccaggatgtgaggccgtcggtatttcacaacattaaactgttcgtcctgtgtcacagcctgttacaactggcccagctaatgatcagcggctacctgaagagctctatctcaaccgtggaaaaaagatttggactgagctcccagacctctggactgcttgcttcctttaatgaagtagggaacaccgccctgatagtatttgtgtcatattttggctctagggtgcatcggccccgaatgatcggatacggagcaattctggtggccctggctggactgctgatgacacttcctcatttcatatctgagccttaccgctacgacaatacatctccagaggatatgccccaggactttaaggcgagtctgtgcctgccaaccacctccgctcctgcatctgcccctagcaatggaaattgcagttcttatactgagacccaacacctgtctgtagtcggcatcatgttcgtggcccagaccctcctgggggtagggggcgtacccatccagcctttcggcatcagttacattgacgacttcgcccataacagcaacagtcctctgtatctaggtattctttttgcagtgaccatgatggggccaggtctggccttcggtcttgggtcccttatgttgagactgtatgtcgacattaaccagatgcccgaaggtggcatctctctcacaattaaggaccctcggtgggtgggagcatggtggctcggattcctgattgccgcgggcgccgtggccctcgccgcaatcccctacttctttttccccaaagagatgcccaaggagaagcgcgagctgcagtttaggcggaaagtgttggctgtgacagactccccagcccgcaaagggaaagacagccctagtaagcaaagtcccggagaatcgactaagaagcaggatggtctcgtgcaaattgcccccaatttaaccgtaattcagtttattaaggtattcccaagagttttgctgcagaccctaaggcatcctatcttcttgctggtcgtgctctcacaggtctgcctatccagtatggctgccggtatggctattttcctacctaaatttctggagaggcagttttcgattaccgcaagctatgcaaacctgctgattggttgtctttctttcccctcggtcatcgttggaatagtggtcggcggcgtgcttgtcaagaggctgcacctgggtcctgttggctgcggggccctttgtctcctgggtatgcttttgtgtcttttcttttccttgccccttttctttatagggtgctcctcgcatcagatcgccggtattactcatcaaacttccgcccatcccggccttgagctgtcacctagctgcatggaggcttgtagttgccccctcgacggatttaatcctgtttgtgatccatctactagggtggagtatataaccccctgtcacgccggatgttcgtcctgggtggtacaggatgcccttgacaatagtcaggtcttttataccaactgctcctgcgttgtggaaggaaaccctgttctggcgggctcctgtgattccacatgctcccatctggtcgtgccctttcttcttctcgtatcgctgggctcggccctcgcttgtcttacgcatactccgagcttcatgttaattctcagaggcgtgaagaaggaggacaagaccctcgctgttgggatccagtttatgtttctgaggatccttgcttggatgcccagccccgtgatccacggttccgccattgacacgacttgcgttcactgggcactgtcttgtggccgcagggcagtctgccgttactataacaacgacctgttgcggaaccggtttataggcctgcagttcttcttcaagactgggagcgttatttgttttgctctggtgctggccgtgttgcgccaacaagataaagaagctcgcacgaaagagtcacgctcttcgcctgctgtggaacagcagctgttggtctctgggcctgggaagaagcctgaggacagtcgcgtatag

SEQ ID NO: 46448 - DNA, 1449 bp, Artificial Sequence
  Description of Artificial Sequence: Synthetic coding sequence
atgatcggctacggcgccatcctggtggccctggccggcctgctgatgactctcccacattttatcagcgaaccatatcgatatgacaacacgagccccggggggattagcctcaccattaaggatccccggtgggtgggagcatggtggctaggatttctgatcgccgcgggcgccgttgccctggcggcgatcccatactttttcttccccaaggagatgcccaaagagaaaagagaactgcagttcaggagaaaagtcttggccgttacagactccccggcaagaaaaggcaaagactcaccttcaaaacagagcccaggagaatctacaaaaaaacaagacggtcttgtccagattgccccaaacctgacagtaatccaattcattaaggtgtttccacgagtcctgctgcagacacttcgccatccaatatttctactggtggtgctgtctcaggtatgtctgtccagcatggcggccgggatggcaatttttctgcctaaatttcttgaaaggcagtttagcatcaccgccagctatgcaaatttactgatagggtgtttgagttttccatctgtaatcgtgggaatcgtggtcgggggagtgctagttaaaaggctgcacctcggaccagtaggatgtggcgcactgtgcttgcttggaatgctgctgtgtctgtttttctctctgcctctgttcttcatcggatgctcatctcatcagatagcgggcatcactcaccaaacttccgcccaccccggcttggaactcagcccatcttgcatggaggcctgctcttgtcccctggatgggttcaaccccgtttgtgacccttccacacgggtcgagtacatcaccccatgtcacgcaggatgcagctcctgggtggtacaggacgcgctcgataatagtcaggtcttctataccaactgttcttgcgtggtggaaggcaacccagtgttggccggctcctgtgactcaacgtgcagccaccttgtcgtgccatttctgctgctggtctcactgggcagtgcgctggcttgcctgacacacactcctagttttatgctcatccttagaggcgtaaagaaagaggacaagactctcgccgttgggattcagtttatgttcttgcgcatcctggcgtggatgccaagcccagtgattcatggcagtgcgatagacacgacttgcgtgcactgggccctgtcctgtggtaggcgggccgtgtgtcgctactataacaatgatttactccggaatcggtttattggactccaattcttcttcaagacaggttccgtaatttgcttcgccttagttcttgcggtgttgcggcagcaggataaggaagcaaggaccaaagaaagccgatccagcccagctgttgagcagcagctgttagtctctggcccaggcaaaaagcctgaggattcgcgagtgtag

SEQ ID NO: 46449 - DNA, 1698 bp, Artificial Sequence
  Description of Artificial Sequence: Synthetic coding sequence
atgggcccccggatcgaggacatgccccaggacttcaaggccagcttatgtttaccgaccacaagtgctcccgcctcagctccatcgaatggtaattgttcgagctacacagaaacccagcatctgtctgtggtcggtatcatgttcgttgcccaaacgctgctcggtgtcggcggtgtgccaatccagcccttcggcatctcatacattgacgactttgcccacaattctaacagccccttgtacctggggattttgtttgctgtgaccatgatgggccctggtctggcattcggcctgggatcactcatgctcagactttatgtcgacattaatcaaatgcctgagggcgggatctccctgactattaaagatccccgttgggtgggtgcatggtggctgggctttctaatcgccgccggagccgtggctctggccgctatcccttacttttttttccccaaggaaatgcccaaagagaaacgcgaactgcagttccgaaggaaagtgttggccgtgaccgactccccagcaagaaaaggaaaggactcacccagcaaacagtcccctggtgagtcgactaaaaaacaagacgggctcgtgcagattgcgcctaacttaaccgtgattcaattcatcaaggttttcccccgagtgttgttgcagacgttgaggcaccctatttttctgctcgttgtgttatcccaggtttgtctgagctctatggccgcaggcatggccattttcctccctaaattcttggagaggcagtttagcatcacagcctcgtacgctaatctcctgattggttgcctcagttttccgtccgtgatcgtgggcatagtggtcggcggggtcctcgttaagcggctacacctgggtccagtgggctgtggggcactttgtctgctagggatgctgctgtgtctctttttctctctgcctctcttctttataggctgttcctcacaccagatcgctggaatcacacaccagactagtgctcatcccgggctggagttgtccccaagctgtatggaggcttgtagttgccccctggatgggttcaaccctgtgtgcgaccccagcacgagagtcgaatatataacgccatgccacgcgggctgtagcagttgggtagtccaggacgcgcttgacaatagccaggtcttctatacgaactgttcctgtgtggtggagggcaatcccgtactcgcgggcagttgcgactcgacctgtagccaccttgtcgttccattcctgctgctcgtgtccctgggttcggctcttgcatgtttaacacataccccctccttcatgctaatcctgagaggcgtgaaaaaagaggacaaaaccctggccgttggtatccagttcatgtttttgcgcatcctggcctggatgcccagtccagtaatccacggaagtgctatagacactacatgcgtacactgggcactgtcatgcggccgcagagccgtgtgccggtactacaacaacgatctgctgcgtaatagatttattggactgcagttctttttcaagacgggatccgtaatctgtttcgctcttgttcttgctgtgctgaggcagcaggacaaggaggccaggaccaaagagagccggtcgtcccctgccgtggagcagcaattgttagtgtctggaccaggaaaaaagccagaggactctcgggtgtag

SEQ ID NO: 46450 - DNA, 135 bp, Artificial Sequence
  Description of Artificial Sequence: Synthetic coding sequence
atgggcaccgagaacacccccggcggcaaggccagccccgacccccaggatgtgaggccaagcgtcttccacaacattaaactttttgtactatgtcatagtctgctccagctggcccaactgatgatttcctag

SEQ ID NO: 46451 - DNA, 453 bp, Artificial Sequence
  Description of Artificial Sequence: Synthetic coding sequence
atgggcaccgagaacacccccggcggcaaggccagccccgacccccaagacgtgcgaccgtcagtgttccataacatcaaattgttcgtcttgtgtcacagccttctgcagctcgcacagcttatgatttccggttatctaaagagtagcatctccaccgtcgaaaagcgattcggactgtcctcccaaaccagtggattgctcgctagcttcaatgaggtgggaaatactgcccttatagtgtttgtctcttatttcggatcaagggttcatagacctcgtatgattgggtatggggccatcctggtcgcccttgctgggttgctgatgacacttcctcacttcattagcgagccctacagatacgacaacacatctccggaggacatgcctcaggactttaaagcctcattgtgtctaccgactacctctgcccccgctagcgcaccctag

SEQ ID NO: 46452 - DNA, 135 bp, Artificial Sequence
  Description of Artificial Sequence: Synthetic coding sequence
atgggcaccgagaacacccccggcggcaaggccagccccgacccccaggatgttagaccatcagtttttcacaacattaagttgtttgttctttgtcacagcttactgcaactggctcaactcatgatttcttag

SEQ ID NO: 46453 - DNA, 264 bp, Artificial Sequence
  Description of Artificial Sequence: Synthetic coding sequence
atgggcaccgagaacacccccggcggcaaggccagccccgacccccaagacgttcgcccttcggtttttcacaatatcaagctgtttgtgctatgtcattcccttctccagctagcgcagttgatgataagcggctatcttaagagtagcatcagcactgtggagaagagattcggcctgtcctcccagacttccggcctgttggcctctttcaacgaggttggtaacactgcacttatcgtgttcgtcagttactttggttag

SEQ ID NO: 46454 - DNA, 1782 bp, Artificial Sequence
  Description of Artificial Sequence: Synthetic coding sequence
atgatcggctacggcgccatcctggtggccctggccggcctgctgatgacactcccccattttatatccgaaccctatcggtacgacaatacatcgcctgaagacatgccacaggacttcaaggcatctctttgccttcccaccacatcagcaccagcctcagcaccatccaatggcaattgtagtagttacacagaaacccaacacctgtctgtggtcggcatcatgttcgtggctcagaccctgctgggagtagggggagtccctatccagccgttcggcatttcatatatcgacgactttgctcacaattccaattccccattgtatctgggcatcttattcgccgtgacgatgatgggccccggactggcctttggtcttggcagtcttatgctccgactgtatgtggatattaaccagatgcctgagggaggcatttcattgactattaaagacccaagatgggttggcgcctggtggctcggatttctgatagcggctggagcagtggcgttagcagcaatcccatacttctttttcccgaaagagatgccaaaagagaagagagagctgcagttccgccggaaggtgctggccgtcacagacagccctgcacgcaaggggaaagatagcccaagcaagcaaagcccaggcgagtccactaagaaacaggacgggctagtgcaaatagcacccaatctgacggtgattcaatttatcaaggtattcccccgcgtgctgttgcagactctgagacaccccatattcttactggttgtcttgtcacaggtgtgtctgtcgtccatggctgccgggatggccatcttccttccaaagtttcttgagaggcagtttagtatcactgcatcctatgctaacctgcttattgggtgcttgtctttcccatccgtcatcgtgggtatcgttgtgggcggtgttctggtaaaacgtcttcacctgggccccgtcgggtgtggtgccctttgcctgctaggcatgctgctgtgcttgttcttttctctacccctgttttttataggttgctcatctcaccagatcgctggtatcacccaccaaaccagcgctcatccgggcctggaactgagtccctcctgcatggaagcatgcagctgtcccctggacgggtttaaccctgtgtgcgatccaagcactcgcgtggagtacattacaccgtgccatgccggctgtagctcgtgggttgtccaagatgccttggataacagccaagttttttatacgaactgttcatgcgtcgtcgagggcaatcctgtgctggcaggctcatgtgattctacctgcagtcacttagttgtgccctttctgttgcttgtaagcctcggaagcgccctagcttgcctgacacacactccttcattcatgctgattctgcgaggagttaagaaggaagataaaactttggccgtgggtatccagttcatgtttctgcggatcctggcatggatgccttccccggtgattcacggaagcgccattgacacaacttgcgtccactgggccctgtcgtgcggccgaagggctgtctgtagatactacaacaacgacctgttgcggaataggttcatcgggctccagttctttttcaagacgggatcggtgatatgttttgcgctcgtgttggccgttttgcgacagcaagataaggaagccagaaccaaagaatcacggtcttccccagcggtcgaacagcagctgcttgtgagtggaccgggcaaaaagcctgaggattccagggtgtag

SEQ ID NO: 46455 - DNA, 135 bp, Artificial Sequence
  Description of Artificial Sequence: Synthetic coding sequence
atgggcaccgagaacacccccggcggcaaggccagccccgacccccaggacgtgcggccctctgtcttccacaatattaaactgtttgtgctctgccactccctgctccagcttgcccagctgatgatatcgtag

SEQ ID NO: 46456 - DNA, 384 bp, Artificial Sequence
  Description of Artificial Sequence: Synthetic coding sequence
atgggcaccgagaacacccccggcggcaaggccagccccgacccccaggatgtgaggccttcagtgtttcacaatataaagctcttcgtgttgtgtcattccctgctgcaactggctcagctcatgattagcggttatctgaaatccagtatcagcactgttgaaaaaagatttggcctgagttctcagacctctggcttactggcttcgttcaatgaggttggaaatacagcgctgatagtcttcgtgagctatttcggttccagggtccatagaccacgtatgataggctatggtgccattctagtggctctggccgggcttcttatgacgcttccccactttatctctgagccctatcgctacgacaacactagcccctag

SEQ ID NO: 46457 - DNA, 2175 bp, Artificial Sequence
  Description of Artificial Sequence: Synthetic coding sequence
atgaagagcgccaagggcatcgagaacctggccttcgtgcccagctcccccgatatcttaaggaggctcagcgccagccctagtcaaattgaagtgagcgccctgtcatcggatcctcaaagggaaaatagccagccacaagagctgcaaaaaccacaggagccacagaagagccctgagccatcacttcccagcgcacccccgaatgtatctgaagaaaagttgcgttcacttagcctgtcagagtttgaagaaggttcgtacggctggagaaacttccacccccaatgtctgcagcggtgtaacacaccaggcgggttcctactgcattattgcctcctcgccgtgactcaagggatcgttgtgaacggcctggtgaatatctccatatccaccgtcgagaaaaggtacgagatgaagtcttccctgacaggacttatctcctcttcttatgacattagcttctgcttactgagcctgttcgtctcattttttggagagcggggtcacaaaccgcgctggcttgcattcgcagctttcatgatcggcctgggagctctggtatttagcctacctcagttcttctccggagagtacaagctgggaagtttgttcgaggatacctgtgtcactaccagaaactcgactagttgtacttcgtctacatccagtctaagcaactatttgtacgtgtttatcctgggtcagctgcttctcggggcgggggggacacccctgtacactctcggcaccgctttcttggatgattctgttccgacccataaaagtagcctgtacatagggacaggttatgctatgtcaattcttggccctgccatcgggtacgttttgggtggacagttactgacaatctacatagacgtcgctatgggagagtctactgacgtcacagaagacgatccacgctggcttggcgcttggtggataggcttcctgctgtcttggatttttgcttggtcacttattatccccttttcatgtttccctaagcacctgccaggcactgctgaaatacaggccggtaagaccagccaggctcaccaatcgaacagcaacgcggatgttaaatttggaaagagtatcaaggatttccctgccgcgctgaagaacctgatgaaaaacgcggtgttcatgtgtctggtgttatcaacctcatccgaggccctcattaccacgggcttcgctaccttcctccctaaattcatcgagaatcagtttggtttgacttctagctttgctgccactctcggcggagcggtcttgataccaggcgctgccctgggacagatcctgggtggcttcttggtttctaaatttaggatgacatgtaaaaacacaatgaaattcgctctgtttactagtggtgtcgcccttacattatcctttgttttcatgtacgcaaagtgtgaaaacgaaccgttcgccggggtgagcgaatcgtataacggcacaggcgagctggggaatctgatagctccttgtaatgctaactgcaactgctccaggtcttactactatcctgtgtgcggcgacggcgtccagtacttttcaccatgctttgctggctgttctaaccccgtggcccacaggaagccaaaggtgtattacaattgctcctgcatcgaaagaaagacagaaatcacgagtaccgcagaaacctttggattcgaagccaaagccggaaagtgcgaaacacactgcgcgaaattacctattttcctgtgcatcttcttcatcgttatcatcttcacgtttatggccgggaccccaataactgtttccatcctgcgttgtgtgaatcacagacagcggtccctcgccctggggattcagtttatggttctgcggctcctaggcaccatccctggccctatcattttcgggtttaccatcgatagcacttgtattctatgggacatcaacgattgtggcatcaagggagcctgctggatttatgataatatcaaaatggcgcatatgcttgtagccattagtgtcacttgtaaggtaatcacaatgttctttaacggctttgccatatttctatataaaccaccacctagcgccacggatgtgtctttccacaaagagaatgccgttgtgaccaacgtcctcgccgaacaggatctgaacaaaatcgtcaaggagggttag

SEQ ID NO: 46458 - DNA, 2547 bp, Artificial Sequence
  Description of Artificial Sequence: Synthetic coding sequence
atggacgagggcaccggcctgcagcccggcgccggcgagcagctggaagcccctgctaccgccgaagccgtgcaagaacggtgcgaacctgagactcttcggtccaaaagcctgccagtgctctcttctgcatcttgtcgtccgtcattgtctccaacctccggggacgctaatccagcttttgggtgtgtggatagctcaggccatcaggaattaaagcagggcccgaatcctctagctccctcaccctcggcaccttcaaccagtgcggggcttggtgattgtaaccatcgggtggacctctccaaaacgttcagcgtcagtagcgcccttgccatgctgcaggaacgccgttgtttgtacgttgtgctcaccgacagtcgatgtttcctggtatgcatgtgtttcctcacgttcatacaggcactgatggtgtccggatacctctcgtcagtcattaccacgatcgaacgcagatattctctgaaaagttcggagtccggtttgcttgtgtcctgcttcgatatcggcaacctagttgtagttgtgtttgtgtcatattttggcggacgaggccggagaccactgtggctggccgtgggcgggttgcttatcgctttcggcgcggcccttttcgccttgccacatttcatttcgcccccctaccagatccaggaactgaacgcctctgctcccaacgatggtctatgtcagggtggaaatagcacagcaactctggagccccccgcctgccctaaggactcgggcggcaacaaccactgggtgtacgtcgccctgttcatttgtgctcagattctcattggcatgggctctacacctatctacaccctgggacctacgtacttggacgacaatgtgaagaaggagaactcctccctgtacctagccataatgtacgtgatgggcgcacttggtcctgccgtggggtacctgctcgggggcctcctgattggcttttatgttgacccgagaaaccccgtccatctggaccagaatgaccccagattcatcgggaactggtggtcaggtttccttttgtgcgccatagccatgttcctggtgatattccccatgttcacattcccgaaaaagcttcctccgcggcacaaaaagaagaagaagaagaagttctccgtcgacgcggtgtccgatgacgacgttctgaaagaaaagagcaacaatagcgagcaggcagataagaaggtgtctagcatgggtttcgggaaagacgtccgagacttacccagagccgccgtgcgaattttgagtaatatgacatttctcttcgttagcctcagttacaccgccgaatcagccatcgtgactgcctttattacgttcatacccaaattcatcgagagccagttcggcatccccgccagcaatgcaagtatctataccggtgtaatcattgtgcccagcgctggggtaggaattgtgttaggcgggtacatcattaaaaagctcaagctgggagcacgtgaaagtgccaaactggctatgatctgctccggtgtgagccttttgtgcttttcgacccttttcatcgtgggctgtgagagcataaacctcggagggataaatatcccttataccacagggccttcattaacaatgccccatcggaatctgacaggtagttgcaatgtgaactgcggctgtaagattcatgaatacgaacctgtatgtggttccgatggaataacatacttcaatccttgtctggcagggtgcgtgaacagcggtaacctgtctactggaatccgcaactatactgaatgtacgtgcgtccagtcacggcaggtcattacccccccaaccgttggccaacgctctcagctgagggtagtgattgtgaaaacatacttaaatgagaatgggtacgctgtgagcggcaaatgtaagcgcacttgtaacaccctcatcccatttctcgtttttctgttcatcgtcacgtttataaccgcctgtgcacaaccttctgccataattgtgacgcttaggagcgttgaggatgaggaaaggcccttcgctctgggcatgcagttcgttctgcttcgcacccttgcttacatcccaacaccaatatactttggcgctgttattgacaccacctgcatgctttggcaacaagagtgcggcgtgcaaggctcctgttgggaatacaacgtcaccagctttagattcgtctacttcggcttagcagccggcctcaagtttgtgggcttcattttcatttttttagcctggtactctatcaagtataaagaagatggcttgcagcgcaggagacagagggaatttcccctgtctactgtctctgaaagagtgggacacccggacaacgcaagaacacgttcctgcccagcgttctccacgcagggggagtttcacgaagaaacaggtctacagaagggcatccagtgcgcggctcaaacgtaccccggcccctttcctgaagcgatttcatcaagcgccgatcctgggctggaggaatcaccagcagccttggaacccccctcttag

SEQ ID NO: 46459 - DNA, 2382 bp, Artificial Sequence
  Description of Artificial Sequence: Synthetic coding sequence
atggacgagggcaccggcctgcagcccggcgccggcgagcagctggaggccccggcaaccgccgaagctgtacaggagcgatgcgagcccgaaaccttgcggtctaagagtctgccagtgttgtcttcagcgtcatgccgtcctagcctatcgcctacgtctggcgacgccaatccagccttcgggtgcgtggatagcagtggccaccaggagctcaaacagggcccaaacccattagcacctagcccttccgcaccatctacgtcggcaggtctaggcgactgtaatcacagggtggatctgagcaaaacgttttctgttagctcagccctggccatgttgcaagagaggaggtgcctgtacgtcgtcctgaccgacagccgatgcttcttggtttgtatgtgttttctcaccttcatacaggccctaatggtgtctggttacctaagttcagtaattacaactatagaacgaagatactcacttaaatcgtctgaaagtggactcctcgttagttgcttcgacatcgggaatctcgtggtcgttgtgtttgtgtcttatttcggggggcgcggccggagaccgctgtggttagcagtgggaggcctgcttatcgcattcggcgcagcactcttcgccctgccccacttcatcagtccaccataccagattcaggagttaaatgcctcagctccgaacgacggtttatgtcaaggcggaaactctactgctacattggagcctcccgcctgccccaaggacagtggcggtaataaccattgggtctacgtagctctctttatctgcgcccagattctcattggcatgggctcaacccctatctacacactgggacctacatacctcgatgacaacgtgaagaaggagaacagctctctctacctggccataatgtacgtgatgggggctctcggtcccgccgtcgggtacctgctgggggggctgctgatcgggttctacgtggaccctcggaaccccgtgcacctggatcaaaacgatccgcgatttataggaaattggtggtcaggcttcctcttatgcgcaatcgcaatgtttctcgtgatcttccccatgtttacttttcccaagaaactccctccccggcataagaaaaagaaaaaaaaaaagttttctgtggatgccgtcagtgacgacgacgtgcttaaagaaaagtctaacaactctgaacaggccgacaagaaggtttccagcatgggattcggcaaagacgttcggggagtaatcattgtcccgagcgccggcgtggggatcgtgcttggtggatatatcattaagaaactgaaacttggtgcccgagagtccgcgaagctcgcaatgatctgtagcggggtgagtttgttgtgtttcagcaccctgtttattgtcggctgcgagtccatcaaccttgggggtatcaatatcccctataccacgggcccgtcgctgacgatgccacaccgcaatctgacagggtcctgtaatgtgaactgcggctgtaaaattcatgagtacgaaccggtatgcgggtccgatggaattacctactttaacccatgcctggcgggttgtgtgaacagtgggaacctgtcgaccggaattcggaattacaccgaatgcacgtgcgttcagtctagacaggttatcacgcctcccacagtaggacagagatcccagctccgggtggtgatcgtcaagacctacctgaatgagaacggctacgccgttagtggaaagtgcaaaagaacatgtaacacattaatccctttcttagtgttcctgtttatagtcacctttataaccgcttgcgcccaacctagcgctataatcgtgactctccgttctgtagaagatgaagagcggccgtttgccttaggcatgcagttcgtgctgcttcggacactcgcatatatccccacccccatttacttcggggcagtgatcgacacaacatgcatgctctggcaacaggagtgcggcgtgcagggaagttgctgggaatacaatgtgacttcatttcgctttgtatatttcgggctcgccgccggcctcaagtttgtgggcttcatcttcattttcttggcctggtattccatcaagtacaaggaggacggcctccagcggaggcggcagcgggagttcccactgtcgacagtctccgagcgggtgggccatccagacaatgctcggaccagatcgtgtccagccttttccacccagggtgaattccatgaggagactggcctacagaagggcatccagtgtgcagcacagacatatccaggcccatttcccgaagcaatttcatcaagcgccgatccagggctcgaagagagcccagcagctctagagcccccctcctag

SEQ ID NO: 46460 - DNA, 606 bp, Artificial Sequence
  Description of Artificial Sequence: Synthetic coding sequence
atgttccccgagcagcagaaggaggagttcgtgagcgtgtgggtgcgagatccccgaatccagaaggaagatttctggcacagctacatcgattacgaaatttgcatacataccaattccatgtgcttcaccatgaaaaccagttgtgttcggcggagatacagagagttcgtgtggctgagacagaggctccaaagtaacgccctgcttgtgcagctccccgagctgccttccaaaaaccttttctttaatatgaacaaccgtcagcacgtagaccaaagacggcaggggctggaggactttctgagaaaggtattgcagaacgccctgttactgagcgacagttcattgcatctgtttttacaatctcatctgaatagcgaggacatagaggcatgtgtctccggccagactaaatattctgtggaagaagccattcataaattcgccctgatgaatcggagattcccagaggaagacgaggaagggaaaaaagagaatgatatcgactacgattccgagtcaagcagcagtggcctcgggcactccagcgacgacagttcttcacatggttgtaaggtgaacacagctcctcaagaatcgtag

SEQ ID NO: 46461 - DNA, 606 bp, Artificial Sequence
  Description of Artificial Sequence: Synthetic coding sequence
atgttccccgagcagcagaaggaggagttcgtgagcgtgtgggtgagggatcctcgcattcagaaggaggatttctggcactcttatatcgattatgaaatttgtatccacaccaattccatgtgttttaccatgaagacatcttgcgtccgcaggaggtacagggagtttgtctggctgagacaacggctgcaatccaatgctctgcttgtacaactgcctgagttgccatctaaaaatctgtttttcaatatgaacaaccgccagcatgtcgaccagcgccggcaaggattggaagattttttaagaaaggtcttgcaaaacgcacttctgctgtccgacagctcccttcacttattcctgcagagccatcttaacagcgaggatatcgaggcctgcgtatccggacaaaccaagtactccgtagaggaggccatccacaagtttgccctgatgaataggcgcttccccgaagaggatgaggaaggcaagaaagaaaatgatatcgactatgattcagaatcttcatcctcagggctcggacatagcagcgacgatagtagcagccatggttgcaaagttaacaccgcacctcaagaaagctag

SEQ ID NO: 46462 - DNA, 684 bp, Artificial Sequence
  Description of Artificial Sequence: Synthetic coding sequence
atgatcctgatggagggcatcggctgcatgcggcacagcagcctgaccagacagccaaagctgccctacagaagtctagcctcggcccgcgggggactgcaggagttcgtgtccgtctgggtgcgagatccacggatccagaaggaagacttctggcactcatatatcgactatgagatctgtattcacaccaactccatgtgctttacaatgaaaacatcatgcgtgcggaggcgatacagagagtttgtgtggctgcgacagagactgcagtccaacgccctcctggtgcaactccctgagttgccaagcaaaaatctgtttttcaatatgaacaatcgtcagcacgtcgaccaacggcgccaagggctggaggatttccttcgaaaagtcctccagaatgcactgttactcagcgactcttccctccacctttttctgcagagccaccttaactctgaggacatcgaggcctgcgtgtctgggcagactaaatactcggtcgaggaggccattcataagttcgccttgatgaatcggagattccctgaagaggacgaagagggcaaaaaggagaacgatattgattatgacagtgaaagttcgagttctgggctggggcacagcagtgatgattcaagtagccatggctgtaaagtcaatactgcaccccaagagtcctag

SEQ ID NO: 46463 - DNA, 354 bp, Artificial Sequence
  Description of Artificial Sequence: Synthetic coding sequence
atgaacaaccggcagcacgtggaccagcggcggcagggcctggaggattttttaaggaaggtgctgcaaaatgctctactcctgagtgactccagcttgcacctttttctgcaaagccacctgaacagtgaggatattgaggcttgtgtgagtgggcagactaaatacagtgtggaagaggcgatccacaagtttgccctgatgaatcgccgttttcccgaagaggacgaggagggtaagaaggagaatgacatcgactatgactccgaatcttccagcagcggactggggcattcttctgacgactccagcagtcatggctgcaaagtgaacacagcaccacaggaaagttag

SEQ ID NO: 46464 - DNA, 2841 bp, Artificial Sequence
  Description of Artificial Sequence: Synthetic coding sequence
atggtgccctgggtgcggaccatgggccagaagctgaagcagcggctccgactggacgtggggcgtgagatttgcaggcaatatcctctgttctgctttctgctactgtgtctgtcagccgccagcctgctgcttaaccggtatatccatattctaatgatcttttggagcttcgtcgcaggggtcgtaaccttctactgttcgctcggacctgattctctgttaccaaacatcttctttacgatcaagtacaaaccaaagcagctcggtctgcaggagctcttccctcagggtcacagctgtgccgtgtgtggcaaggtgaagtgtaaaagacaccgcccctcattactgctcgaaaactaccaaccttggctcgatctgaaaatctcaagtaaggttgatgcgtccctgagtgaagtgttggagctcgtgctagaaaattttgtgtatccgtggtatcgggatgtgaccgacgacgagtcctttgtggatgaactgaggatcacactcagattcttcgctagtgttttgattagaagaattcataaggtcgatatcccttcgattataaccaagaagctgctcaaggctgcaatgaaacatattgaagtgatcgttaaggcccgccagaaagtgaagaataccgagtttctgcaacaggcagcgctggaggaatacggcccagagttacatgtggcactgcgctccaggcgtgatgaacttcattacctccggaagttgacagaacttctgtttccatatatcctgccaccgaaagcgaccgattgcaggtctctgactctcctgattcgggaaatcttgagcggttcagtttttcttccttccctggacttcttagccgatcctgacaccgtgaatcaccttctaattatcttcattgatgactccccacctgagaaagccactgagcccgcttccccactggtgcccttcctgcaaaagtttgccgagccacggaataagaagccttcagtgcttaaattggaactcaaacagatccgtgagcaacaggatctgttatttagattcatgaacttcttgaagcaagagggcgccgtgcacgttctgcagttctgtctaaccgtagaagagttcaacgacaggattctgagacctgaactgtccaacgatgagatgctcagcctgcatgaggaactgcaaaagatatacaagacatactgcttggatgagtccattgataaaatacgcttcgatccttttatagtggaggagattcagaggatagcagagggtccctacatcgacgtggtgaaactacagacaatgcggtgtcttttcgaggcttacgaacatgtgttgtccttattggagaatgtgttcacacctatgttttgccactcagacgaatacttcaggcagttgcttcgaggcgctgaatccccaactcgaaattcgaagctcaatcgggggtctctcagccttgatgatttcaggaacactcagaaacgcggtgagtccttcggtattagccgtatcgggtccaagatcaaaggtgtcttcaaatccactacaatggagggcgcaatgttacccaactacggagtagctgagggggaggacgacttcattgaagaagggattgtggttatggaagacgactcaccagttgaagcggtaagtactcctaacacaccacgaaatctcgcagcttggaagatctccattccgtacgtggacttctttgaggacccttctagtgagcgtaaagagaagaaggaaaggattcctgtgttctgcatagacgtggagcggaacgacagacgagcagtcggccatgaacccgagcactggtccgtatatcgcagatacctcgaattttatgtcctcgagtcgaagctcacggagtttcatggcgccttccctgacgcgcagttgccttccaaacgaattatcggtcctaaaaattatgaattcctgaaaagcaaacgcgaagaattccaggagtacctccagaagttgctccagcaccccgaactctctaactcccagctgctggccgatttcctgtccccaaatgggggggagacacagttcctggataagattctccctgacgttaatttgggaaaaatcatcaaaagtgtgcccggaaaactcatgaaggaaaaggggcagcacctggagccttttattatgaatttcatcaactcatgtgagagccctaaacctaagccgagtaggcctgagttgaccattcttagccccacctccgagaacaataagaagctgttcaacgacttgttcaaaaacaacgccaaccgagccgagaatacagagagaaagcagaaccagaattatttcatggaagtgatgactgtcgagggagtctatgactacttaatgtacgtaggcagagtggtttttcaggtacccgattggttacatcacttgctaatggggaccaggatactgtttaaaaatacactggaaatgtacaccgattattatctacagtgtaagctggagcaactgttccaggagcacagattagtgagcctgattactctccttcgagacgccattttttgtgagaacaccgaacctaggagtctgcaagacaagcagaaaggcgctaaacaaacctttgaagagatgatgaactatatcccggatttgttggtaaagtgcattggcgaagaaaccaaatacgagtcaatacgcctgctgttcgatggattgcagcaaccagtcctgaacaaacagcttacatacgtactgctggatatcgtgatacaggaattattcccggagttaaataaagttcagaaggaggtgacctccgttactagttggatgtag

SEQ ID NO: 46465 - DNA, 2682 bp, Artificial Sequence
  Description of Artificial Sequence: Synthetic coding sequence
atggtgccctgggtgcggaccatgggccagaagctgaagcagcggctccgcctggacgttggaagagaaatctgtagacagtatcccttattttgtttcctcctgttatgcctctccgccgctagtcttctgctgaataggtatattcacatcctaatgattttttggtcttttgtagctggagtggtaacgttctattgctcactgggaccagatagtctgctccctaatattttcttcacaatcaaatacaagcctaagcaactgggcctacaggaattgttcccccagggtcactcctgtgcagtgtgcgggaaggtgaagtgcaagaggcatcggccaagccttcttttagagaattatcaaccatggctggaccttaagatctcctccaaagtagacgccagcctctcagaagtggatattccctctattataacaaagaagctgcttaaagccgcaatgaagcatatagaggtcatcgtcaaagcacgacaaaaggtaaagaacactgagttcctgcagcaggctgcgctggaagagtacggacccgagctccacgtggcgctgagatcgagaagggatgaacttcattacctgagaaaacttacagaattgttgttcccatacatccttccgccaaaggccacagactgtcggtctctgacacttctaatccgtgagatactctccgggtcagtcttcttgcccagccttgacttcctcgcggatcccgatacggttaatcacttgttaataatcttcatcgatgatagcccacccgaaaaagccacagagcctgcctctcccctcgtgccatttctgcagaagtttgcggagcctagaaataaaaagcccagcgtactgaaactcgagttgaagcagatccgcgagcaacaagacttgctcttcagattcatgaattttctgaaacaggagggtgctgtgcacgtgctgcagttctgtttaaccgtggaggagtttaatgaccgaatcctgagaccagagctcagcaatgacgagatgcttagtttgcatgaagaactccagaaaatatataagacgtattgtctggatgagtctatagacaaaattcgctttgatccgtttattgtcgaagagatccagcgcatcgcagaaggtccgtacatagatgtcgtcaagctgcagaccatgcgctgcttgtttgaggcatacgagcacgtgctgtctcttctggagaacgtgttcactcctatgttttgccatagcgatgaatacttcagacaactgcttcggggcgcagaaagtcctacaagaaactccaagctaaatagaaacacccagaagcggggtgaatcattcggcatcagtaggatcggcagcaaaattaagggggtgtttaaaagcacaaccatggagggagccatgctgcctaattatggagttgcagaaggggaggatgattttatcgaggaagggatcgtggttatggaagacgacagtcccgtcgaagccgttagcacacccaatacaccaaggaatctcgcagcctggaagatatccattccatatgtagacttttttgaggacccctcctctgagaggaaagaaaagaaggagagaatccccgtgttctgtatagacgtggaacggaacgaccgaagggcagtggggcacgagcctgagcattggagtgtgtaccgaaggtacctggagttctatgtacttgagagcaaactgacggaattccatggggcttttcctgacgcgcagctccctagcaagaggatcatcggtcccaagaattacgagttcctaaaatctaaacgtgaggagttccaggaatatctgcagaagctgctccagcatcccgagctttcgaattcccagctgctggctgactttctttctcccaacggcggggaaactcaatttttggataagattctccccgacgttaacctcgggaaaattattaagagtgtgccaggaaagcttatgaaagaaaaaggacaacacttagagccttttataatgaactttatcaattcttgcgaatctcccaaacccaagcccagtaggcctgagcttaccatcctgtctcctacctcagaaaacaacaagaagctatttaacgacctcttcaagaataatgccaatcgggctgaaaacaccgagcgcaagcaaaatcagaactatttcatggaggtcatgactgtcgaaggagtgtacgattatctcatgtatgttggacgggtcgtatttcaggtgcctgactggttgcaccacctcctgatgggaacccgcatcctgttcaagaatacactcgagatgtatactgattactacctgcagtgtaaactggagcaactattccaggaacaccgactggtcagcctaatcacgctgttgcgggatgccattttttgcgagaataccgagcctaggagtttgcaggacaaacagaaaggagcaaagcagacctttgaggagatgatgaactacatacccgacttgcttgtaaagtgtattggagaggaaaccaaatacgagtcaatccgtctgctgttcgatggactgcagcagcccgtgcttaataagcagctcacctacgtgctcctggatatcgtgattcaggaactgttccccgagctaaataaggttcagaaagaagttaccagtgttactagctggatgtag

SEQ ID NO: 46466 - DNA, 2814 bp, Artificial Sequence
  Description of Artificial Sequence: Synthetic coding sequence
atggtgccctgggtgcggaccatgggccagaagctgaagcagcggctgaggcttgacgtaggtcgggaaatatgcaggcagtatccccttttctgctttctccttctatgcttgagtgccgcatctttgctgttgaataggtatattcacattctgatgattttctggtcatttgtagccggcgtagtcactttctactgttccctgggtcccgacagtctgctccctaacatcttcttcaccataaaatataaaccaaaacagttgggactgcaggagctttttccgcagggccattcttgcgcagtgtgcggcaaggtcaagtgtaaaaggcacagaccttctttgctgttggaaaattatcagccgtggctggaccttaagatcagttcgaaagtcgacgcatctctgagtgaggtgctggaattggtcctcgaaaacttcgtctacccctggtatcgcgacgtgacggacgatgagtcattcgtggatgagctgcgcattaccctgcgtttttttgcaagtgttttaatccgaaggattcacaaggtggacataccaagtattataaccaagaaactccttaaagctgccatgaagcacattgaagtcatcgtcaaggctagacaaaaggttaagaacaccgagtttttgcagcaggctgctttagaggagtatggtcccgaactgcatgtggccctgcgatctcgacgtgacgaactgcactacctgcggaagctgacagaactgctctttccatacattttacctcccaaagccacagactgccgttcattgaccctgctcattagagagattctcagcggatctgttttcttgccgagtctcgatttcctcgcagatcccgataccgtcaaccatcttcttataatcttcatcgacgattcaccacctgagaaggcaacggaacctgcgtctcccctggtgccattcctccagaaattcgccgagccccggaacaaaaaacccagcgtgttaaagctggaactgaaacagattagagagcagcaagatctgttattcaggtttatgaatttcttaaagcaggagggcgctgtgcacgttttgcagttctgcctcacagtagaggaatttaacgataggattctccggcccgagcttagcaacgacgagatgttgagccttcatgaagagctccagaaaatctataagacttactgcctggatgagtctatcgacaaaatccgcttcgatccgttcatagtcgaggagattcagagaattgccgaaggcccatacatcgatgttgtcaagctccagacaatgagatgcctgttcgaggcatacgagcacgtactttcattgctggaaaacgtgtttactcccatgttttgccattccgatgagtacttccggcagctactacgtggagctgaatctcctacacgtaatagtaagctgaaccgtaacacacagaaacgaggagaatccttcggcatcagcaggatcggaagtaagatcaaaggcgtctttaagagtaccaccatggagggcgcgatgctccccaattacggtgtcgcagagggcgaggatgatttcattgaagaagggattgtagtgatggaggacgattctccagtcgaggccgtctccactcctaatactcccagaaacctggctgcgtggaagataagcattccttatgtcgactttttcgaggatccaagctccgaaaggaaggagaagaaagaacggatccctgtgttttgtatcgatgtggaacgtaatgacaggagagccgtgggccatgagccagaacactggtccgtctaccgtagatatctcgaattctacgtgctcgagtccaagctgaccgaatttcacggggccttccccgatgctcagctccccagtaagcggatcatcggaccaaagaattacgagtttctgaagtctaaacgagaagaatttcaggagtatttgcaaaagttgctccagcatcctgaactctccaacagtcagcttctggctgatttcctgtcacctaatgggggcgagacccagtttctcgataagatcctgcccgacgtcaacctgggtaaaattataaaatctgtgccaggcaagctaatgaaggagaagggtcagcacctggagcccttcataatgaacttcattaattcatgcgaaagtcccaagccaaagccatcgaggccagagcttacaattctaagtccaacgagtgagaacaataagaaactgttcaatgacttatttaagaacaacgcgaatagagctgagaatacggaacgcaagcagaaccaaaactacttcatggaggtaatgaccgttgaaggagtttacgactacctgatgtatgtaggcagggttgtattccaggtgcccgactggttgcatcacctgctgatgggaacaaggatcctgttcaagaatacattagagatgtacaccgattactatcttcagtgcaaactggagcagctcttccaggagcacaggctcgtgtccctaatcaccctacttcgagacgccatcttttgtgagaacaccgagccacgtagccttcaagataagcagaagggagccaagcagacattcgaagagatgatgaattacattcctgatctcctggtgaaatgcattggagaagagaccaaatatgagagcattcgcctcttattcgatgggctacaacagcctgtgctaaacaagcagctgacttacgtgcttctcgacatcgtgatccaggagttgtttcctgagctgaataaggttcagaaggaggtgacatccgttacttcttggatgtag

SEQ ID NO: 46467 - DNA, 1047 bp, Artificial Sequence
  Description of Artificial Sequence: Synthetic coding sequence
atggaggacgacagccccgtggaggccgtgagcacccccaacaccccaaggaacttggccgcgtggaagatctcaatcccatacgtggatttctttgaagaccccagttccgaaagaaaggaaaagaaagagaggatccctgtgttctgcattgacgtggagagaaatgatcggagggctgtggggcacgagccagaacactggtcagtgtacagacgctacctcgagttctatgtgctggagtctaaattaaccgaattccatggcgcttttcctgacgcacagctcccaagtaagagaattataggccccaaaaattatgagtttcttaagtccaagcgtgaagaatttcaggagtatttacagaaactgctgcaacatccggaactgtccaattctcaacttttggccgattttctcagtcccaatggcggcgaaactcagtttctcgacaagattctaccagacgtaaatcttgggaagattattaagagtgtgcctggcaagctgatgaaggagaaggggcaacacctcgagccttttatcatgaatttcatcaattcttgcgagtcccctaaaccgaaaccgtcacgccccgaactcacaatcctttctcccacatcagaaaataataaaaaattgttcaacgatctgttcaagaataacgccaatagggccgagaatacggaacggaaacagaatcagaactactttatggaggtcatgaccgttgagggggtttacgactatttaatgtatgtggacgctattttttgcgagaacaccgaaccccgctcactgcaggacaaacaaaagggggctaagcagaccttcgaagagatgatgaattacatccccgatctgctcgtgaaatgcatcggcgaggagaccaaatacgagagcattaggcttctcttcgatgggttgcagcagcctgtcctcaataagcagctgacgtacgtcctcctggatatcgtgattcaagagctctttcctgagctcaacaaagtgcagaaggaggtaactagcgtcacttcatggatgtag

SEQ ID NO: 46468 - DNA, 2685 bp, Artificial Sequence
  Description of Artificial Sequence: Synthetic coding sequence
atgatcttctggagcttcgtggccggcgtggtgaccttctactgctccctgggcccagatagcctattgcctaacattttcttcaccatcaaatacaaacccaagcagttaggactgcaggagctgtttccacaaggacactcctgcgcagtatgcggcaaagttaagtgtaagagacacagaccgagtctgctcttggagaactatcagccttggctcgacctgaagatatccagcaaagtggacgcatccttgagcgaggtgctggaattagtcctggagaacttcgtgtacccctggtacagagatgtaacggacgacgaatcttttgtcgacgaacttagaattactttgagattctttgcaagtgtccttatccggagaattcacaaagtagacattcctagcattattacaaaaaaattattaaaggccgctatgaagcacattgaggtgatcgtcaaagcacgccagaaggtgaaaaatactgaattcttacagcaggcagctctggaggagtatggaccagagttgcatgtggcgctccgctccagacgggatgaactgcactatctgagaaagttaactgaacttctgtttccttatattctgcccccaaaggccacagattgtaggtccctgaccttgctgattagagaaattctaagtgggagcgtatttctgccctctctggatttccttgccgaccccgacacagtgaatcatttgcttataatattcatagacgattcccctccagaaaaggctacagaacctgcgtcccccctggttcctttcttgcaaaagtttgcagaaccaaggaacaaaaagccctctgtcctcaagctcgaacttaagcagatcagggaacagcaggatttactgtttagattcatgaattttctgaagcaggaaggcgctgtacacgttctgcaattttgcttgactgtggaagaatttaacgacagaatcctccgacctgagttatcaaatgatgagatgttgtcgctccatgaggaactccaaaagatatataagacctactgcctggacgaaagcattgataagatccgttttgacccttttatcgtggaggaaattcagagaatagccgagggaccttacatcgacgtggtcaagctacagacgatgcggtgcctgttcgaggcctacgaacatgttctgtcattgttagaaaatgtttttacaccaatgttctgtcatagtgacgagtactttagacaactcctcagaggagccgagagtcctactcgtaactcaaaacttaataggggttccctctctttagacgatttccgcaatacacagaaaagaggggagtcattcggaatctcgcgcataggaagtaagataaagggcgtgtttaagtccactacaatggagggagcaatgctacccaactatggcgtagcagaaggagaagacgattttattgaagagggaatcgtagtaatggaggacgatagccccgttgaggccgtctctacacccaacacgcctaggaacctggccgcctggaaaatttctattccttatgtggattttttcgaagacccatctagcgagcgaaaggaaaaaaaggagcgaatccccgtgttttgcatagatgttgaaagaaacgatagacgcgctgttggacacgagcccgaacactggtctgtctaccgccggtacttggagttctatgtcttagaatccaagttgaccgaattccatggggcttttcccgatgctcagctcccaagtaaacgaatcatcggaccaaaaaactacgagtttctcaaatctaagagggaggagttccaggagtatctccagaaactgctgcagcaccctgagctttcgaattcccagctgctagcagacttcctttcacctaacggtggagagactcagtttctcgataagatcctgccagatgttaatcttggcaaaatcatcaagagtgtgccagggaagctgatgaaggagaaaggtcagcatcttgagccttttatcatgaatttcataaacagctgtgaatcgccaaaacccaagcctagccggcccgaattaactatattgtctcctacctccgagaataacaagaagttgtttaacgatctgtttaagaataatgccaatagggctgaaaacacagagaggaagcagaaccagaactactttatggaggtgatgaccgttgaaggggtgtatgactacctgatgtacgtgggaagagtcgtattccaggttcccgattggttgcatcacctcctcatgggcacccgtatcctttttaaaaataccctggagatgtacaccgattattaccttcaatgtaaattagagcagctcttccaggagcaccgtctggtgtccctgatcacactacttcgggatgccattttttgcgaaaatacagaaccgcggtcgctgcaggacaaacagaaaggagctaaacagaccttcgaggaaatgatgaactatatcccggacctactcgtaaaatgtattggtgaggaaactaaatatgagagtattcgacttctctttgatgggttacagcagccagtgctaaataagcagttgacctatgtcctcctggacatcgtgattcaagagttgtttcctgaactcaacaaggttcagaaggaggttacctcagtgacatcatggatgtag

SEQ ID NO: 46469 - DNA, 1035 bp, Artificial Sequence
  Description of Artificial Sequence: Synthetic coding sequence
atggccaccccctacgtgcccgtgcccatgcccatcggcaacagcgccagttcttttacaacgaacagaaatcagcgttcctcaagtttcggctccgtgtcaacctcctctaacagcagcaaaggccaactcgaggatagtaacatgggcaatttcaagcagacctcggtgccagatcagatggacaacacctcaagcgtgtgtagtagccctctcattcggactaaattcacgggcacggcatcctctatcgaatactcaacacggcctagggacactgaggaacagaaccctgagaccgtaaactgggaggacaggcctagtacgccaaccattttgggatacgaagtcatggaggaacgcgcaaagttcacagtatataagattctggtgaagaaaactcctgaagaatcttgggttgtgttcagaagatatacggacttctctcggttaaatgataagctgaaagaaatgtttcccgggttccgtttggctttaccacctaaacgctggttcaaagacaattacaatgcggacttcctcgaagaccgccaactaggcctgcaggcatttttgcagaacttggtggcacataaagatatcgcaaattgtttggcagtgagagagttcttgtgcttggatgacccacctgggcctttcgacagccttgaggagtctagagccttctgcgaaacgcttgaagagactaactatcgacttcaaaaggaacttttggaaaagcagaaagagatggagagtttgaagaaattacttagcgaaaagcaactgcatattgatacattagagaatcgaatccgcaccctgagcctggaacctgaggagtctctggacgtcagcgagaccgaaggagaacagattctcaaagtggaaagttcggccctggaagttgaccaggacgtgctcgacgaggaatccagggccgacaacaagccatgtctgtcttttagcgagcctgagaacgcagttagtgagatcgaggttgcagaagtagcttacgatgcagaagaggattag

SEQ ID NO: 46470 - DNA, 948 bp, Artificial Sequence
  Description of Artificial Sequence: Synthetic coding sequence
atggccaccccctacgtgcccgtgcccatgcccatcggcaacagcgcatcttcctttacgacaaatagaaatcagcgttctagtagtttcggctccgtgtccacctcgtccaatagctccaaagggcaactagaggacagtaacatgggtaacttcaagcagacctccgtgccagatcagatggacaatacatcttccgtttgctctagcccgctaatccggacaaagttcacggggactgccagttcaatagagtactcaacgcgcccgagggatacagaagaacagaaccccgaaacagtgaattgggaggacagaccaagcaccccaactatactcgggtatgaggtcatggaggagcgagctaagttcaccctgaaagaaatgttccctggctttcggcttgccctacctcctaagcgctggttcaaagacaactataacgcagatttcttggaggatagacaactcgggctacaggcattcctgcaaaaccttgtggctcataaagacattgccaactgcctcgccgtccgcgagttcctgtgcctggacgacccccccgggccatttgatagcttggaagagtctcgcgcattctgcgagacgctggaggagactaattatagactgcagaaagagctgctagagaagcagaaggagatggaaagcctcaaaaagttgctgtcagagaagcagctgcacattgacaccttggaaaaccggatccgcaccttatcgctggaacctgaggagagcttagatgtctccgaaacagagggagagcagattttaaaagttgaaagcagcgcactggaggtggaccaggatgttcttgatgaagaaagtagggcagataacaagccatgcttatcattttctgagcctgaaaacgctgtgagcgagatcgaggtggccgaagtagcttatgacgccgaggaagattag

SEQ ID NO: 46471 - DNA, 1035 bp, Artificial Sequence
  Description of Artificial Sequence: Synthetic coding sequence
atggccaccccctacgtgcccgtgcccatgcccatcggcaacagcgcgagcagcttcaccacaaatagaaatcagcgtagctccagctttggctccgtgagtacaagctcaaactcatccaaaggccagttggaggacagtaatatgggcaattttaaacaaacaagcgtacccgaccagatggacaacacgtcttctgtgtgctcttccccactcattcggaccaagttcaccggaacagcctcttccattgagtattccacacgaccgagggatacagaggagcaaaatcccgaaaccgtgaactgggaggaccggccttcaactcccactattttgggctatgaagtgatggaggaacgggcgaagttcaccgtgtataagattctggtgaaaaagacacccgaggaatcttgggtggtctttaggcgctatacggacttttcacggctcaatgataagttgaaagagatgttccccgggttccggctggcactacctccgaagagatggttcaaggacaattacaacgctgacttccttgaagatcgccagctgggtttgcaagccttcctgcagaatctggtggcccataaggatatcgccaattgcctggcagtgagggaattcttgtgcctggatgatccccctgggcccttcgactcgctggaggagtcacgagcattctgcgagactctggaagaaaccaactatagactgcaaaaggagcttctggaaaagcagaaggagatggagtcattgaagaagctgttgagcgagaagcagcttcacatcgatactctggagaataggatccgtactctttcccttgaaccggaggagtccctggatgtgtccgaaacagaaggcgagcagatcctgaaggtcgaatcctctgccttagaagtcgatcaggatgtcctggacgaggaatcacgcgctgacaacaaaccttgcctttctttttctgagcccgagaacgccgtcagtgaaatcgaggtcgccgaggtagcctatgatgcagaagaagactag

SEQ ID NO: 46472 - DNA, 255 bp, Artificial Sequence
  Description of Artificial Sequence: Synthetic coding sequence
atggccaccccctacgtgcccgtgcccatgcccatcggcaacagcgctagtagctttacaacaaacagaaatcagagatcgagctcctttggatctgtaagcactagctccaactcaagtaaaggccagctggaagactctaacatgggcaacttcaagcagacctccgtgcctgatcagatggacaacacctcctctgtgtgctcgtcaccccttatcagaacaaagtttacggggacggcatcaagcatctag

SEQ ID NO: 46473 - DNA, 279 bp, Artificial Sequence
  Description of Artificial Sequence: Synthetic coding sequence
atggccaccccctacgtgcccgtgcccatgcccatcggcaacagcgccagctcctttaccacaaaccggaatcagcggtcatcgagctttggaagcgtcagtaccagctccaattcttctaaaggccaactggaggactcaaacatggggaactttaagcagacctccgtgccagaccagatggataatacaagctccgtgtgttccagcccattgattagaactaagttcaccggtaccgcaagtagcattgagtatagtacccggccccgcgactag

SEQ ID NO: 46474 - DNA, 111 bp, Artificial Sequence
  Description of Artificial Sequence: Synthetic coding sequence
atggccaccccctacgtgcccgtgcccatgcccatcggcaacagcgcttccagcttcactactaatcgaaatcagcggtcctcaagcttcggctccgtgagtacctcttag

SEQ ID NO: 46475 - DNA, 612 bp, Artificial Sequence
  Description of Artificial Sequence: Synthetic coding sequence
atggccaccccctacgtgcccgtgcccatgcccatcggcaacagcgcttcatcattcaccaccaacagaaaccagaggtcctctagtttcgggtccgtatcaacatctagcaacagctccaagggccaattagaggatagtaatatgggtaacttcaagcagacatccgtaccagaccagatggacaatacttcttcagtgtgtagttcgcccctgatccgcacaaagttcaccggaaccgcatctagcatcgaatacagcaccaggcctcgcgatacagaggaacaaaatcctgaaacagtgaactgggaagacagaccctctaccccaactattctgggctatgaagtgatggaagagcgggctaagttcaccgtctacaaaatcctggtgaaaaagactccagaagagtcatgggtggtcttccggcgctacaccgatttctcaagactgaatgacaaactgaaagaaatgtttccaggatttcgattagcacttccccctaaacggtggttcaaggataactacaacgcagacttcctcgaagataggcagctcggactgcaagccttcctgcagaacctggtggcgcacaaagacatcgccaattag

SEQ ID NO: 46476 - DNA, 1887 bp, Artificial Sequence
  Description of Artificial Sequence: Synthetic coding sequence
atggccctgcgggcccgggccctgtacgacttccggagcgagaacccgggtgagattagcctgcgcgaacatgaagtcctttccctgtgttctgaacaagacatagagggctggctggagggcgtcaactctcggggggatagggggctgttccctgccagctacgtgcaggtgatacgtgcacccgaaccaggccctgctggagacggcggtcccggggccccagcccgttatgcaaacgtgccaccgggcggcttcgagcctctccccgtggccccccccgcttcgtttaagcctcctccagatgctttccaggccttgctccagccgcagcaggcccccccgccatccactttccagcccccgggtgcgggattcccgtacggggggggagctctgcagccatctccccagcagctgtatggcgggtaccaggcctcacagggatctgacgacgattgggatgacgaatgggacgactccagcacagtggcggatgaaccgggcgcgctgggatccggggcctatcctgacctagacggctcatcttcagctggcgttggggctgcaggccggtaccggctctcgacccgcagcgacctgtctttaggctcgagagggggatccgttcctccccaacaccaccccagtgggcccaaatccagcgccactgtttcacgcaatctgaaccgcttcagcactttcgtgaaaagcggaggagaggcctttgtgctaggcgaggcgagcggatttgtgaaggatggggataagctttgcgtcgtgctgggcccatatggccccgaatggcaggagaatccctacccgttccagtgcaccattgatgatcctacaaagcagacgaagttcaaggggatgaaatcttacatcagttataaacttgtacccacacacactcaggtgcccgttcacaggaggtataaacactttgactggctgtacgccagattggctgagaaattcccagttatctcagtcccacacttaccggagaagcaagccacgggtcgcttcgaagaggattttatctccaagaggaggaagggattgatctggtggatgaatcacatggccagccatccggtgttggcccagtgtgatgtgtttcagcacttccttacttgcccatcctcaaccgacgaaaaagcatggaaacagggaaaacggaaggccgagaaagacgaaatggtgggcgcaaatttcttcctgactctgtccacccctcctgccgccgcgctcgatctgcaagaagttgaatcaaagattgatgggtttaaatgttttactaaaaaaatggacgacagtgctttgcagctgaatcataccgcgaacgagtttgcaagaaagcaggtgacggggtttaagaaggaatatcagaaggtcggacagagtttcagaggcctgtctcaggccttcgagctcgaccagcaagccttttccgttggactgaatcaggcaatcgcgttcactggcgatgcttacgatgctattggcgaactgttcgctgagcagccccggcaggaccttgatcccgtgatggacttactggccctataccaagggcacctggccaactttcccgatattatccatgttcagaaaggaaaggcatggcccctcgagcaagtgatttggtctgttctttgtcggcttaagggtgctacacttaccgccgtccccctttgggtgtcggagtcttacagcacgggcgaggaggccagtagggacgtggatgcgtgggtattctcgcttgagtgcaaactggattgttctaccggttctttccttttggaatatctggccttgggaaacgaatactcctttagcaaagttcaacgggttccactgatgacagtgttgtccttttag

SEQ ID NO: 46477 - DNA, 1776 bp, Artificial Sequence
  Description of Artificial Sequence: Synthetic coding sequence
atggccctgcgggcccgggccctgtacgacttccggagcgagaacccaggtgagatctcactgagagaacacgaggtgctttctctgtgctccgagcaagatattgaggggtggctcgagggcgtcaactctagaggcgacaggggactttttcctgcaagctatgtacaagtgatacgggcccccgaacccggacccgcaggcgacggaggcccaggcgcgcctgctaggtacgcaaatgtgccaccaggcggatttgaacctctgccggtggccccccctgcatccttcaaacctccccccgacgccttccaggctctgttgcagcctcagcaggcgccaccacccagcacttttcaaccgcccggggcgggcttcccctatggcgggggggcattgcagccctccccccagcagctgtacggcgggtaccaggcaagtcaggggtcggacgatgactgggacgatgagtgggacgactcatccacagtcgccgacgagccgggggccctggggagcggagcctacccagacttggacggttccagcagcgctggtgtgggtgcagccgggcgctaccggttgtcgacacgctccgacctgagtctcggcagcagggggggaagcgtgcctccccagcatcacccgagcgggccaaagtcgtctgcgacagtaagccggaacctgaatcgcttcagcaccttcgtgaagtccggtggcgaggccttcgttctcggagaagcctcgggctttgtcaaagacggggataaattgtgcgtggtgcttgggccctacgggcctgaatggcaagaaaatccgtatccgttccagtgtacaatcgatgatcctaccaaacaaactaagtttaaggggatgaagagctacatttcttataagctagtcccgacccatacacaggtgcctgtgcacaggaggtacaagcatttcgattggctgtacgcacgactggccgaaaaattcccggtgatcagcgtgccacacttacccgaaaaacaagccactggccggttcgaggaggattttatttctaagaggcggaagggtctaatctggtggatgaatcatatggcctcacaccccgtactggctcaatgtgacgtatttcagcatttcctcacgtgcccaagctccactgatgaaaaagcctggaagcagggcaaaagaaaggccgagaaggatgaaatggtgggtgccaatttttttctaaccttgagtactcctccagcagccgccctggacctccaggaggtggaatcaaagattgatggattcaagtgctttaccaaaaagatggacgacagtgctctccagctgaatcacactgcaaatgaattcgcaaggaaacaagtgactgggtttaaaaaggaataccagaaggtggggcagagctttagggggttaagccaggcttttgaactggaccaacaggcgttctcagtgggactaaatcaggcgatcgcttttaccggcgacgcctatgacgccataggagaactttttgctgaacaaccccggcaggaccttgatcccgtgatggaccttctggccctataccaaggtcatcttgctaattttcctgacattatacatgtacagaaaggcaaggcttggcctctcgagcaggttatctggtccgtgctgtgcaggctgaagggagccaccctcacggccgtaccactttgggtatcagaatcgtacagtacaggggaagaagcatcaagagacgttgatgcttgggtcttttcattggagtag

SEQ ID NO: 46478 - DNA, 1875 bp, Artificial Sequence
  Description of Artificial Sequence: Synthetic coding sequence
atggccctgcgggcccgggccctgtacgacttccggagcgagaacccgggtgagatatccctgagggagcacgaggttctctcgctgtgctctgagcaggatatcgagggatggcttgaaggcgtgaatagcagaggcgaccgcggtctattcccggccagttacgtgcaggtcattagagcccccgaacctggcccagccggggatgggggcccaggcgcaccagctaggtatgctaatgtacccccgggcggcttcgagcctctaccggtagcgcccccagcgagctttaagcctccgccagatgcattccaggccctgcttcagccacagcaggcgcccccaccaagtaccttccaacccccgggcgccggttttccttatggaggaggggctttgcagccaagcccccaacagctgtacgggggatatcaggccagccaggggagcgatgatgactgggacgacgaatgggacgattcatcaacagtcgccgacgaacctggggctttaggctccggtgcctatcccgaccttgatggttcctcctcagcaggggtgggcgctgccggccgatataggcttagcaccaggtccgatctgtcccttggttcacgaggaggtagcgtgcctcctcagcaccacccttctggacccaaatccagcgcgacggtttctaggaacctcaacaggtttagtacttttgtcaagtcaggcggagaggcatttgtgctgggtgaggccagcggcttcgtgaaggacggcgataagctctgcgtggtgctgggcccttatggccctgagtggcaagagaatccctacccatttcagtgcacgatcgatgacccgactaagcagacaaaatttaagggaatgaagtcttatatatcttataaactggtgccaacacacactcaagtgccagttcacagacgctataagcacttcgactggttgtacgcccgactcgccgaaaagtttccagtgataagcgttccgcacctcccagagaagcaagccacaggcagattcgaggaagatttcatttcgaagaggcgcaaaggcctcatctggtggatgaaccacatggcgtcccaccctgtcctggcccagtgcgatgtgttccagcatttcctgacgtgcccatccagcaccgacgagaaagcatggaaacagggcaagcgaaaggcggaaaaggacgagatggtgggcgccaatttcttcttgactttatcaaccccacctgcggccgcattggatctgcaagaagttgagagcaagattgacggtttcaaatgttttacaaagaaaatggacgattcagccctgcagctgaatcatacagcaaatgaattcgctcggaagcaggtaaccgggttcaagaaggaataccaaaaggtgggacagagcttccgaggtctgtcacaagctttcgagctggaccagcaggctttctccgtcggcctcaaccaggcaatcgcttttacaggagatgcctacgacgctattggcgagctgttcgcggagcagccaaggcaggacctcgatccagtcatggacctgctggctttgtaccagggccaccttgccaattttccagacatcatccatgtgcagaagggagctcttaccaaggtgaaggagtctagaaggcacgtcgaagaaggtaaaatggaggtgcagaaagccgacggtatccaggacagatgtaacaccatcagttttgcaacgctcgccgagattcaccactttcaccaaatccgcgtcagagatttcaaatctcaaatgcagcattttctgcagcagcaaatcatcttctttcagaaggtcactcagaaattggaagaagcgctgcacaagtacgattcagtctag

SEQ ID NO: 46479 - DNA, 2979 bp, Artificial Sequence
  Description of Artificial Sequence: Synthetic coding sequence
atgaagaccgagaccgtgccccccttccaggagacccccgccggcagttcgtgtcatttaaataatcttctgagctctcggaagctgatggcagtgggagtgctacttggctggttgctagttattcacttgctggttaacgtatggctcctatgtctcctgtcggctctcctagtggtattgggcgggtggctcgggtccagcctcgccggagttgcgagcggccggcttcatctcgagcgctttatccctcttgcgacatgtcccccatgtccagaggccgaaaggcagctcgagcgggagattaatagaacaattcagatgattattagagacttcgtgctgtcatggtataggtccgtgagtcaggaaccggcctttgaagaagaaatggaggcagctatgaagggattggtgcaagagctgaggcgtaggatgagtgttatggatagccatgccgtggcccagtccgtgcttaccttgtgtggttgtcacttgcaatcctatattcaagcaaaggaggccacggcaggaaaaaatggaccagtggagcctagccatctttgggaagcatactgtagagctaccgccccccaccccgcagtgcactccccatccgccgaagtgacctatacaagaggggtcgtaaacttactcttacagggacttgtgccaaaacctcatctcgaaaccagaactgggcgacatgtagtggtcgagcttatcacctgcaatgtcattcttcccttgatttcccgcctaagcgaccctgactggatccatctggtgctcgttggaatattctctaaagcaagggaccctgccccctgccccgcgagtgctccagaacagccatcagtgcccacctccctccccctgatagccgaggtggagcagttacccgagggccgggcttctcctgttgcagctccggtgttcctctcatactccgagccggaagggagtgcagggccgtcacccgaagtggaagagggccacgaagctgtggagggagatctgggaggtatgtgcgaggaacgtaaagtcgggaacaacagcagtcattttttgcagcccaatgttagaggaccattatttctctgcgaggactccgaactcgaatcgccgctgtctgagctgggaaaagagaccatcatgctgatgacacctggttcctttctgtcagacaggattcaggacgccctatgcgccttggagagctcgcaggctttggagcctaaggacggcgaagcttcggaaggggcggaggccgaggaaggtcccggaaccgagaccgagaccgggctccccgtctccacactcaacagctgcccagagatccacatcgacacagcggacaaggaaatagagcagggcgacgtgactgctagtgtgaccgctctgcttgagggcccagagaagacctgtccgtcacgcccctcatgcttggaaaaggacctgacaaacgacgtcagctcgctcgatcctacactgccaccagtgttgctgtcgtcttcccccccaggacccttatctagcgccacattctccttcgagcccttgtcctctcctgatgggcccgtgatcattcagaatcttcgcattactggtacgatcaccgcacgcgagcattcgggaacgggattccatccatatactctgtacaccgtcaaatatgaaacggcactggacggtgaaaattccagcggactgcagcagctcgcctatcacactgtgaaccggcgatatagagagtttttaaacctccaaacaagattggaagagaaacctgatctgagaaaatttatcaaaaacgtgaaagggccaaagaagctatttccagatttgccattagggaacatggatagtgatcgcgtggaagccaggaagtctctgctggagtcatttctcaagcagctctgcgcaatccccgaaatagcgaattcagaggaagtgcaggaatttctggccctcaatacagatgccagaatcgcgtttgtgaagaagccgttcatggtctccagaatcgacaaaatggtggtctccgccatcgtcgacactctcaaaacggcattccctcggagcgagccccagtctcccactgaggagctctcagaggcggagaccgagtcgaagccacagaccgaagggaagaaagcttccaagtctcggcttaggttcagctcaagcaagatttcaccagccctgtcggtcaccgaagcccaggacaagattctctattgcttgcaagagggtaatgtcgagtctgaaaccctgtctatgagcgctatggagtctttcattgagaagcagaccaaattgctcgagatgcagccaaccaaggctcctgagaaagatccagagcagcctcctaaggggcgagtcgattcatgtgtttcggacgctgcagttcctgcccaggacccctccaactctgaccccggcacagaaaccgagctggccgacaccgccttggatctgctgctccttctcctgactgagcaatggaaatggctgtgcaccgagaatatgcagaagttccttcgtctgatttttggcaccctagtccagcgatggctggaagtccaggtggctaacctgacgagtccacaacgttgggtccaatacctcttgcttctgcaggagagcatctggccaggtggagtgctgcccaaatttcctagacccgtcaggacgcaggagcagaaactggcggctgagaagcaggcactgcagtctctcatgggcgtgctccccgacctggttgtggagattttgggggtcaataaatgccgcttgtcttggggactggtccttgaatccctgcaacagcccctgattaataggcacctcatatactgcttaggagatattatcctcgagttcctggatctgtcagcttctgtggaggagagtgccgccacaacaagcgcctcagacacccccggtaactcaaagagaatgggggtgagctcctag

SEQ ID NO: 46480 - DNA, 1308 bp, Artificial Sequence
  Description of Artificial Sequence: Synthetic coding sequence
atgtacgagaccgccctggacggcgagaacagcagcggcctgcagcagctagcatatcatacggtcaataggcgctaccgcgagtttctgaatcttcagacccgactggaagaaaaacccgacctccgcaagttcatcaagaatgtaaagggtccaaagaaacttttccccgacctccccctcggaaatatggatagcgatcgggttgaagcccggaagtccctgcttgagagttttctgaagcagctctgcgcaattcccgagattgcaaactccgaagaagtgcaggaatttctggctctgaacactgacgctcgcatcgcatttgtaaagaagccattcatggtgtcccgtatcgataagatggtggtgtctgccattgtggatacactgaagaccgccttcccgcggtctgaaccacagtcaccaaccgaggaattgtctgaggctgagaccgagtctaagccacagacggagggcaaaaaggctagcaagagccgtctaaggttctcgtctagcaagatctccccggccctgtcggtgaccgaggcccaggataagatcctgtattgcttacaggaagggaacgtcgagtcggagaccctcagtatgtcggctatggagtccttcatagaaaagcagaccaaactgcttgagatgcagcctaccaaagcaccagaaaaggaccctgagcagcccccaaaggggagggtcgactcttgcgtgtcagacgccgctgtgcccgctcaagacccctcaaactctgaccctgggacagaaaccgagttggcagacactgccctggacctgttgctgctgctgctcactgagcaatggaagtggctctgcacagaaaatatgcagaagttcctgaggttaatcttcggaacgttggttcagagatggctggaggtccaggtggctaatttgacttcccctcagcgttgggtccagtatctgctgttgctacaggagtcaatttggccgggaggggtgctgccgaagttcccacggcctgttcgcactcaggagcagaaattggcggccgagaagcaggctctgcagtcattaatgggcgtcttacccgacctcgtggttgagatcctcggagttaataagtgtcggctgtcttgggggctagtgctggagagcttacagcagcccctgatcaaccggcaccttatatattgcctgggggatattattttagagtttctggatctgtccgcgagcgttgaggagtccgctgccacaactagcgcatctgacactcctgggaattctaaaaggatgggagtaagttcatag

SEQ ID NO: 46481 - DNA, 699 bp, Artificial Sequence
  Description of Artificial Sequence: Synthetic coding sequence
atgagcgccatggagagcttcatcgagaagcagaccaagctgctggaaatgcagcccactaaggcgccagagaaagatcccgagcagcctcccaaaggacgggtcgatagctgcgtgtctgatgccgccgtccccgctcaggacccgagcaattctgatcccggaacggagactgaactggcggataccgcgctggatctgctgctgctgcttttaacggagcaatggaaatggctgtgcacagagaacatgcaaaagtttctgcggttgatattcggcacgctcgtgcaacgctggctcgaggttcaggtggcgaatctgacatccccccagaggtgggttcagtacctgctactactacaggaaagtatatggcccggcggggtactccccaaatttcctcggccggttcgcacgcaggagcagaaactggccgccgaaaagcaggccttacagtccctgatgggcgtactgccagaccttgttgttgaaatcctgggcgtgaacaaatgtagactgtcctggggcctggtactggagagtctgcagcaaccactgatcaatagacatcttatttactgtctcggagacattattcttgagttccttgacctgagtgcatctgttgaggagagtgccgccaccacgtccgcgtcagatacccccggtaacagtaagaggatgggagtttcgtcatag

SEQ ID NO: 46482 - DNA, 582 bp, Artificial Sequence
  Description of Artificial Sequence: Synthetic coding sequence
atgctggaggtgcacatccccagcgtgggccccgaggccgagggcccccgccagtcaccagagaaatctcatatggtgttcagagtggaggtgctgtgctccggtaggcgccacaccgtgccccggcgttactctgaatttcatgcactgcataagcgaattaagaagctctataaggtgccagattttccatcgaaaagactcccaaactggaggacccgggggctggaacagcgcaggcaagggctggaggcgtacattcagggaatcctgtatctgaaccaagaagtgccaaaagagctgttagaatttctccgtttgcggcatttccctacggatcccaaagcatcaaattggggcacactcagggaattcctcccaggggatagcagtagccagcagcaccagagacccgtgctgtctttccatgtggatccatacgtgtgcaacccatctccagagtcccttccgaacgtcgtcgttaacggggttctgcagggtctgtacagtttcagcatcagtcctgataaagcccagcccaaggctgcctgccatcctgctcctctccctcccatgccgtag

SEQ ID NO: 46483 - DNA, 525 bp, Artificial Sequence
  Description of Artificial Sequence: Synthetic coding sequence
atgctggaggtgcacatccccagcgtgggccccgaggccgagggccctagacagagcccggagaagtcccatatgatcaagaagttatataaggtgcctgacttcccttctaaaagacttcctaattggaggacccgaggattggagcaaaggcgacagggactggaagcctacattcaaggcatcctctacttgaatcaagaagtgcctaaggaactgttggagtttctgagattacggcacttcccaacggatcctaaggcctccaactggggcaccctgagggagttcctgcccggtgattcctcatcacagcagcaccagcgacccgtcctcagcttccacgtggatccttacgtgtgcaaccccagcccaggcgaggaggtacctcggtacggcgcgaccggtctgggatgcggcctgtgtatttctcgattgctgggaccatccgattcaatctctttcctcttgcccacaagcggggccaccacctcatgtagttgcccactggagcctgcgctgtag

SEQ ID NO: 46484 - DNA, 510 bp, Artificial Sequence
  Description of Artificial Sequence: Synthetic coding sequence
atggaggtgtacatccccagcttccggtacgaggagagcgacctggaacgcggctataccgtttttaaaattgaggtgctaatgaatgggaggaagcattttgttgagaagaggtatagcgaatttcacgctttgcataaaaaactgaaaaagtgcattaaaacccctgaaatcccatcaaagcacgtgaggaactgggtgcctaaagtcctggagcaaagaagacagggcctggagacataccttcaggcagtcatcctcgagaatgaggaactgcctaagctgtttctcgactttcttaatgtgaggcaccttccttctctgcctaaggctgaatcgtgcgggtcgttcgatgaaacagagtctgaggagtctagtaagctgagccaccaacccgttctgctgttcttgagggacccctacgtcttgccagcggccagtgactttccaaatgtggtgatcgagggggtgctgcacggaattttctaccctcacctgcaaccaaggtag

SEQ ID NO: 46485 - DNA, 480 bp, Artificial Sequence
  Description of Artificial Sequence: Synthetic coding sequence
atggaggtgtacatccccagcttccggtacgaggagagcgacctggaacgaggctataccgtgtttaagattgaggtgttgatgaatggacgaaagcattttgttgagaaacgctactctgagttccacgctctccataaaaagttgaaaaagtgtataaagacacccgaaatcccttcgaaacatgttcgcaactgggtgccaaaggtgctggagcaaagaagacagggcctggagacataccttcaagccgtcatactggagaatgaggaattaccgaaattattcctggattttctcaacgtcaggcatctccccagcctcccaaaagctgaatcttgcgggagttttgacgagacagaaagtgaggagtcttctaagctctctcaccagccagtcctcttatttttaagagatccgtatgtcctgccagctgcatctgggaaccagacgtgtcatctgcttaccgccctgtactag

SEQ ID NO: 46486 - DNA, 480 bp, Artificial Sequence
  Description of Artificial Sequence: Synthetic coding sequence
atggaggtgtacatccccagcttccggtacgaggagagcgacctggaaaggggctacactgtcttcaaaatagaagtgttgatgaacggtcgcaagcacttcgtggagaaacggtattcggagttccatgccctgcacaagaaacttaaaaaatgtatcaaaactcctgaaataccttcaaagcatgtgaggaattgggtacctaaggtgttggaacagcggcggcagggcctggagacatatctccaggccgtgattctggaaaacgaggaattgcctaagctgttcctggatttcctgaacgtgcgccatttaccaagcctaccaaaggccgaatcttgcggaagcttcgatgaaactgagtccgaggagtcaagtaagctgagccaccagcctgtgctgctcttcctgcgggatccatacgtcttgcccgccgctagtggaaatcagacatgccaccttcttactgccctctattag

SEQ ID NO: 46487 - DNA, 1086 bp, Artificial Sequence
  Description of Artificial Sequence: Synthetic coding sequence
atgcggaacctgaacatcaaggacgtgagcaagctgaaggacgagatcattttaatcgaaaaagagcgaacagatttgcaacttcatatggcccgcaccgactggtggtgtgagaatctgggcatgtggaaggcaagtataacgagtggagaggtgacagaggaaaatggagagcagctcccttgttattttgtaatggtctccttgcaggaggtgggaggagtggaaaccaagaactggaccgtccccagacgcttaagcgaatttcagaacttgcatagaaagctaagcgagtgcgtgccctcattgaagaaagtgcagctcccgtccttgtctaaactgcctttcaagtctatcgatcagaagttcatggaaaagtcgaagaaccaactgaacaaattcctgcagaaccttctaagcgacgagaggttatgtcagagcgaagcgttgtatgctttcttgtcgccaagtcctgactatttgaaggtcatcgacgtgcagggaaagaaaaatagtttctccttgtcttcctttctggagcgacttccacgcgatttctttagccatcaggaagaggaaacggaagaggattccgatttgagcgattatggcgacgatgtggatgggaggaaggacgcactggctgaaccctgtttcatgctgatcggtgaaatcttcgaactccgcggaatgtttaaatgggttagaaggacccttattgccctggtgcaggttaccttcggtagaacaattaacaagcagattcgcgacaccgtgtcttggattttctccgaacagatgctggtgtactacatcaacatcttccgtgatgccttctggcccaacgggaagttagcgccgccaacaactatccgcagcaaggagcagagtcaggaaaccaaacaacgggcacagcagaaactcctggagaacatacctgatatgcttcagtctctggtgggtcagcaaaacgcacgtcatggaatcattaaaatctttaatgccctgcaggagacccgagccaataaacacctgctgtacggcacaagtactaacacccttctgagcccacgggaccatgattag

SEQ ID NO: 46488 - DNA, 2523 bp, Artificial Sequence
  Description of Artificial Sequence: Synthetic coding sequence
atggacaaggccctgaaggaggtgttcgactacagctaccgggactacattctgagttggtatggcaacctgtcaagagatgaaggacagctttatcatctgcttctagaggacttctgggaaatcgctcggcagttgcatcatagactgagtcacgtggacgtcgtgaaggttgtctgcaacgatgttgttaggaccctcctaactcatttctgcgacctcaaagccgcaaacgccaggcatgaggaacagccaagaccatttgtgctgcatgcctgcttaaggaattcagatgatgaggttaggttcctccagacttgcagcagggtgctcgttttctgcctcctgcctagtaaggacgttcagtctttgtccctgcgtatcatgttggccgaaattttgactacgaaggtactcaaacctgtagtggagctgctttctaatcccgattacataaatcaaatgttgttagcccaactcgcctatcgggaacagatgaatgaacatcacaagagggcttacacatatgccccaagctacgaggacttcatcaagcttattaacagcaatagcgacgtggagttcttaaagcagctgcgataccagattgtggtggaaatcattcaagccaccaccatcagctcctttccccagcttaagcggcataagggaaaagagacagctgccatgaaagcggatcttctgcgcgcccgcaacatgaaacggtatatcaatcagctaacagtggccaaaaaacagtgtgagaaaagaatcaggatcctcggaggccctgcttacgatcagcaggaagacggggctctggacgaaggggaaggcccgcaaagccagaagatcctgcaattcgaggatatcttggccaatacgttctaccgcgaacattttggtatgtacatggaaagaatggataagagagctctgatctccttttgggagagcgtggagcatctgaaaaacgccaataaaaatgaaataccacagctggttggagaaatttatcagaattttttcgttgagagcaaggaaatctccgtggaaaagagtctatacaaggaaatccagcagtgcctggtcggcaataagggcatcgaggttttttacaagatacaggaagatgtctatgaaaccctgaaggatagatattacccttcctttatcgtgtcggacttatacgagaagttgctgataaaagaggaagagaaacacgcctctcaaatgatcagcaataaagacgagatgggccccagggatgaagctggagaggaggctgttgatgacggcactaaccagattaacgagcaagcatctttcgccgttaacaaattacgcgagctcaacgagaagctagaatacaaaagacaagccttgaacagcatccaaaatgcccccaagcccgacaagaagatcgtgtccaagctgaaggatgagatcattctcattgaaaaagaacgaacagacctacagctccacatggcacggacggactggtggtgtgaaaacctcgggatgtggaaggcctccattaccagcggtgaggtgaccgaggagaatggcgagcaactgccatgttacttcgtcatggtatctctgcaggaagttggcggcgttgagactaagaattggacagtcccccgccggctctcagagtttcagaacttgcaccgtaaactctcggaatgcgtcccatcgctgaagaaggtgcagttacccagcctgtctaagctcccctttaagagcattgatcaaaagtttatggagaaatcaaaaaatcagctaaataaatttctgcaaaatctgctatccgacgaacggctctgtcaaagcgaggccttatatgcctttctgtctccatcacctgattacctgaaagtgatcgacgtgcagggtaagaaaaactccttcagcttgagttcattcctcgagaggctgccccgtgacttcttcagtcatcaggaggaagaaaccgaagaagatagtgatctgagcgactatggagacgacgttgatggacgcaaagatgccttggctgaaccctgttttatgctgattggcgagatctttgagctacggggaatgttcaaatgggtgcgccgcaccctcattgcactcgtgcaggtgacgttcggtagaacaataaataagcagatcagagacactgtgagttggattttttccgagcaaatgctggtatactatattaacatctttagagacgccttttggcccaacggcaagttagcacccccgacaactatacgcagcaaggaacagtcccaggaaacaaagcagagagctcagcagaagttactggaaaatatcccagatatgctgcaatctttggtcgggcaacagaatgctcgtcacggaataattaaaatctttaacgccctgcaagagacacgtgccaacaaacacctgctctatgcacttatggaactgttactgatcgagctgtgtccggaactgcgggttcatcttgaccagctgaaggcgggacaagtgtag

SEQ ID NO: 46489 - DNA, 2523 bp, Artificial Sequence
  Description of Artificial Sequence: Synthetic coding sequence
atggacaaggccctgaaggaggtgttcgactacagctaccgggactacattctgtcgtggtacgggaatctgtcacgtgatgagggccaactgtaccaccttctactggaagatttttgggagattgcacggcagctccaccaccgcctgtcccacgtagacgtggtgaaggtggtgtgcaacgatgtggtgcgtaccctattaacccacttttgcgatctgaaagccgctaacgctagacacgaggagcaaccacgcccatttgttctgcatgcctgtttaagaaattcagatgacgaagttagatttcttcagacatgctcaagggtcctggtattctgcctactcccaagtaaagacgtccaaagcctctccctgcggattatgcttgcggagattctcaccaccaaggtgcttaagcctgtggtggaactcctgtccaacccagattacattaaccaaatgctcctcgctcagctcgcttacagagaacagatgaacgagcatcacaaacgggcatatacatacgcgcccagctatgaagatttcattaagttgataaactctaatagcgacgtggagtttctgaagcagctcagataccagatcgtagtggaaattatccaggctaccaccatttctagcttcccccagcttaaaaggcacaagggcaaggaaaccgcagccatgaaggctgatttactcagggcacgcaatatgaagcgctatatcaaccagctgactgttgccaagaagcagtgcgagaaaaggattagaatactcggtggtcctgcgtacgatcaacaggaggacggcgcgctggatgagggtgaagggcctcaatcccagaaaatcctgcaattcgaggacatactcgctaatacattctatcgggaacacttcggcatgtatatggaacgtatggacaaacgagctttgattagtttttgggaaagcgttgagcatctgaagaacgccaataaaaatgagatcccccaactcgttggtgaaatctaccagaattttttcgtggaatccaaggaaatatccgtcgagaaatccctgtacaaggagattcagcaatgtctcgtgggaaacaagggaattgaggtgttttacaaaatccaggaggatgtttacgagactctgaaggacagatactatccaagttttatcgtctcggacctgtatgagaagctgctcataaaagaggaggaaaaacacgcatcgcaaatgatatcaaataaagacgaaatgggacccagggatgaggctggcgaggaagccgttgatgacggcacaaaccagataaatgagcaggcttcatttgcagtcaataaactgcgggagctgaacgagaagctcgaatataagaggcaggccctgaatagcattcagaacgctccaaagccagacaaaaaaatcgtgagcaaactgaaggatgaaattatcctgatcgaaaaggaacgcaccgacctgcagctccacatggcgcggaccgattggtggtgtgaaaacttaggaatgtggaaggctagtattacaagcggtgaagtgaccgaagagaacggcgagcagctcccttgttacttcgttatggtcagcctgcaagaagtcgggggggtggagactaaaaattggacggtccctagaaggttgtccgaatttcagaacctgcatagaaagctttcagagtgcgtgccttcgctgaaaaaggtgcagctacccagcctgagtaaattgccctttaaaagcatcgaccaaaagtttatggagaagtctaaaaaccagctcaataagttcttacagaacctgctaagcgacgagcgcttatgtcaatcggaggcactctatgctttcctgtctccatctccagactatctaaaagtcatcgatgttcagggcaaaaaaaacagcttcagtctgagctccttcttagagaggctgccccgcgacttttttagccatcaagaggaagagactgaggaggattcagatttgtcagactacggcgacgacgtggacggaaggaaggacgcactcgccgaaccctgctttatgctcataggggaaatttttgaactcagagggatgtttaaatgggtgcgccggacactgatcgcactcgttcaggtcacttttggtcggaccattaataagcaaatacgcgatacagtgtcctggatctttagcgagcagatgctggtgtactatattaacatcttcagagacgcattctggcctaacggcaagctggcccccccaacaactatccggagcaaggagcagtctcaggagacaaagcagagagcccaacaaaagttactcgaaaacattcccgatatgctgcagagcctcgtggggcaacagaacgctcggcatggtatcatcaaaatctttaatgcactgcaggaaactcgggccaacaaacacctgttgtacgcgttaatggaactcctcctgattgaactgtgtcccgaactccgggtgcatctagatcaactcaaagccggacaagtatag

SEQ ID NO: 46490 - DNA, 1356 bp, Artificial Sequence
  Description of Artificial Sequence: Synthetic coding sequence
atggagggcgagcggcgggccagccaggcccccagcagcggcctgccagcaggaggcgccaacggggagtccccaggtggaggggccccattcccaggctcaagcgggagctccgctctgttacaagccgaggtgttagacctagacgaggatgaagacgatctagaagtattcagcaaggatgcctccctgatggatatgaactccttttctcccatgatgcccacttcacctctgtccatgataaatcaaattaaattcgaggatgagcctgatttgaaagatctgtttatcaccgtggacgagcctgaaagccacgtgaccactatcgagaccttcattacttatcgcatcatcaccaaaacctcccgcggcgagtttgatagctccgaattcgaagtgcggaggagataccaggattttctgtggctaaagggtaagttagaggaagcacatccgacactaatcattcctccacttccagaaaaatttattgttaagggcatggtggaacgattcaacgacgacttcattgagacacgacgtaaggcactccataaattcctgaatcgcatagccgatcaccccaccctaacatttaacgaggatttcaaaatttttctaacggcccaggcttgggagttatcctctcataaaaagcagggtccagggctgttgtcacgtatgggacagacagtgcgtgccgtggcgagtagcatgagaggggttaagaaccgcccagaagagttcatggaaatgaacaactttatcgaactgttttcccagaaaatcaacctcatagataaaatctcacagcggatctataaagaggagcgcgagtacttcgacgaaatgaaggagtatggccccatccatatcctgtggagtgcttcggaagaagatctcgtggacaccctgaaggatgtcgccagttgcatagatcgttgctgcaaagccacagagaagagaatgtcaggtctctcagaggcacttttacccgtcgtgcacgaatacgtactctactcagagatgctgatgggtgtgatgaagcgtcgagatcagatccaggcagagttggactctaaggtggaggtcctcacctataagaaggccgacaccgacctgcttcctgaagaaattggcaagctggaagacaaggtcgaatgcgccaacaacgccctgaaggccgactgggagcgctggaagcagaacatgcagaatgacatcaagttggcctttactgatatggccgaagaaaacattcactattacgagcagtgcctagcaacatgggagagctttctgacaagccagacaaacctccacctggaggaggccagtgaggacaaaccctag

SEQ ID NO: 46491 - DNA, 1011 bp, Artificial Sequence
  Description of Artificial Sequence: Synthetic coding sequence
atggacatgaacagcttcagccccatgatgcccaccagccccctgagtatgatcaaccaaatcaagtttgaagatgagcctgatctgaaggatttattcattacagtggacgagcctgaaagtcacgtgacaacaatcgagacatttatcacctaccgcataattaccaaaacctctcggggtgaattcgatagttccgaattcgaagtgaggcgtcgttatcaagacttcctctggttaaaaggcaagctggaggaagcacatcctacgctgattatccctcccctgcccgagaagtttatcgtgaaaggcatggttgagaggtttaacgacgacttcatagagactaggaggaaggctctccacaaatttctgaatagaatcgcagaccaccctaccctgacattcaatgaggacttcaagattttccttacagcccaagcttgggaactctctagccataaaaagcaggggccgggactgctgtcccggatggggcaaacagtgcgtgctgttgcttctagtatgcggggggtgaagaatcgaccggaagagttcatggagatgaataattttattgagcttttctctcagaagatcaacttgatagacaaaatctcacagcgtatttacaaagaggaacgagaatattttgatgaaatgaaggaatatggtcccatccatattctgtggagtgcttccgaggaagatctcgttgacacattaaaggacgtcgctagctgcatcgacagatgttgcaaagccactgagaagagaatgagtgggctgagcgaagctctcctccccgtggtgcacgagtacgtcctgtattcagaaatgctcatgggagtgatgaaaagacgagaccaaatccaggccgagctcgactcaaaggtcgaagtgctgacctacaaaaaagccgacaccgacttgtgcctggccacttgggaatcctttctgacctcgcagaccaatctccacctggaagaggcgtcagaggacaagccttag

SEQ ID NO: 46492 - DNA, 1191 bp, Artificial Sequence
  Description of Artificial Sequence: Synthetic coding sequence
atggagggcgagcggcgggccagccaggcccccagcagcggcctgccagcgggcggcgcgaacggcgaatcaccgggagggggggcccccttccccggatcaagtgggtccagtgccctgctgcaggccgaagttcttgatctggacgaggatgaggacgacctcgaggtgttcagcaaagatgcatccttaatggacatgaactctttcagccccatgatgccaacctctccgttatctatgataaaccaaataaagtttgaggatgaacccgacctgaaggacctatttatcacagtcgacgagccagaaagtcatgtaacaaccatcgagaccttcattacctatcgcatcattactaaaacaagtcgtggggagtttgacagtagcgaatttgaagtgcggcgcaggtaccaggacttcctgtggcttaaggggaagttggaagaggcacacccgactctgattattcctgagctttccagtcataagaagcagggccctggccttttgtccaggatgggacagaccgtgagggctgttgcgtcaagcatgagaggtgtgaagaatcgccctgaagagttcatggagatgaacaactttattgagctgtttagccagaaaataaatttgatcgataaaattagccaacggatttataaagaggaacgagagtacttcgacgagatgaaggagtatggccccatacatatcctctggtccgcttctgaagaagacctggtggacacgctgaaggacgttgcttcgtgcatagatcggtgctgcaaggctacagagaagagaatgagtgggctgtccgaggccctgctaccggtcgttcacgagtatgttttatatagtgaaatgctgatgggagtgatgaagaggagggatcagattcaggcggagctagacagcaaggttgaggtgctcacttataagaaggccgatacggacctgctccccgaagagattggcaaactggaggacaaagtggaatgcgcgaataacgccttgaaggcggactgggaacggtggaagcagaacatgcagaacgatatcaaattggcgtttaccgatatggcggaggagaacatccattactatgagcagtgcctggctacctgggaaagttttttgacgtcccagaccaacctgcatctggaagaggcaagtgaagacaagccttag

SEQ ID NO: 46493 - DNA, 1509 bp, Artificial Sequence
  Description of Artificial Sequence: Synthetic coding sequence
atggacctgatccccaacctggccgtggagacctggctgctgctggccgtgtcgctggttctgctctacctgtatgggactcgtacccacggtctgttcaagcgtctgggaatccccgggcccacccctctgccgctccttggtaatgtcctgtcttacagacaaggcctttggaaattcgacacagagtgctacaaaaagtacggtaagatgtggggaacctatgaggggcaactgcctgtgctggctataacagaccctgatgtcataaggactgtcctggtcaaggagtgctattccgtgtttacgaaccgcagatcactcggccctgtcggttttatgaagagcgcaatctcactggcagaggatgaagaatggaaaagaatccgctctctcctgtcaccaacgttcacgtcaggaaaactgaaagagatgtttcccatcatcgcacaatatggtgatgtgctcgtgcgcaacctccgccgagaggcggaaaagggcaaaccggtgactcttaaagatatcttcggggcctacagcatggatgtcattaccggaacttcatttggagtcaatatcgattccttaaataaccctcaggacccctttgtggagagcacaaagaaattcttgaagttcggctttttggacccactcttcctgagcatcattctctttcctttcctgaccccagttttcgaggctctcaacgtaagcctgttcccaaaagacactattaacttcctgagcaaaagcgttaatagaatgaaaaagtcaagattgaatgataagcaaaaacacagactggattttctccaactaatgatcgacagtcaaaacagcaaagagactgagtcacacaaagcactgtcagatctggagttggccgctcagagcatcattttcatctttgccggttacgagacgaccagcagcgtcctgtccttcaccctatacgaactggcaacccaccccgatgtacagcagaagttgcaaaaagaaatcgatgccgtactgcccaataaggctccccccacgtatgatgccgtcgttcaaatggaatacctggatatggttgtgaacgagactctgcgcctgttccctgtggccatccgcctagagagaacgtgtaaaaaagacgtggagatcaatggggtgttcatccccaaagggtccatggtggtgattcctacctatgctctccatcacgacccaaaatactggacagagccagaggagttccggcccgagcgttttagcaagaagaaagacagtattgatccttacatctatactccatttggtaccggtccccggaactgcatcggcatgcggtttgcccttatgaatatgaagctcgccctgattcgggttctgcagaactttagtttcaaaccatgcaaagagacgcagatacctttgaaactggatacgcaggggctgttgcagcccgagaaaccaattgtattgaaagtggatagtcgagatggcactctatcaggcgaatag

SEQ ID NO: 46494 - DNA, 129 bp, Artificial Sequence
  Description of Artificial Sequence: Synthetic coding sequence
atgcagatgccccagggcaaccccctgctgctgagccacaccctgcaggaactcctggctagagacacagtgcaggttgagctaatccctgagaaaaagggactgtttctcaaacacgttgagtattag

SEQ ID NO: 46495 - DNA, 531 bp, Artificial Sequence
  Description of Artificial Sequence: Synthetic coding sequence
atgcagatgccccagggcaaccccctgctgctgagccacaccctgcaggagctgctggccagagacactgttcaggtggagctgatccctgagaagaagggcctgtttctgaaacacgtggaatatgaggtatcctcccaaagatttaagtcctccgtctaccgtagatacaacgacttcgtggtattccaagaaatgttgctgcacaagtttccctatcgtatggtgccggcactcccacctaagagaatgctgggcgccgatagagagttcatcgaggccaggaggcgagccttgaagaggttcgtcaacctggtcgctcggcaccctttgtttagcgaagacgttgtgctaaaactatttctgagtttcagcggatctgacgtgcaaaataaattgaaagagtccgctcaatgcgtcggcgatgagttccttaattgcaaactggccacgagagcaaaagattttctccccgccgatattcaggcgcagtttgcgatcagccgcgaattaatacgcaacatttattag

SEQ ID NO: 46496 - DNA, 600 bp, Artificial Sequence
  Description of Artificial Sequence: Synthetic coding sequence
atgcaccggggcacccaggagggcgccatggccagccggctgctgcatcgcttgaggcacgcgctggcaggtgacgggcctggggaggccgctgcatcccccgaggcggagcagttcccggagtcctcagaactcgaagacgacgacgctgagggactgtcttctcgcctgagcgggacgctcagcttcacaagcgccgaggatgacgaggacgacgaagatgaggatgatgaggaagccggaccagatcaacttcccctgggggacggcacttccggtgaggacgctgagcggagtcctccaccagacgggcagtggggcagccagctgctagcaagacaattgcaggacttttggaagaagagtaggaacaccctggcaccacagaggttgctcttcgaagtgacatcagccaacgtggttaaggatccccctagcaagtacgtcctctacacactggctgtgatcggtccaggacctcccgactgtcaaccggcccaaattagccgccgctattctgatttcgagagactgcaccgcaatctgcagagacaattccgcggccctatggccgcaatctcgttccctcaatcccattag

SEQ ID NO: 46497 - DNA, 453 bp, Artificial Sequence
  Description of Artificial Sequence: Synthetic coding sequence
atggccagccggctgctgcaccggctgcggcacgccctggccggcgacggccccggcgaggcagctgcctcgcctgaagccgaacagttcccagaatctagcgagttagaggacgatgatgccgaaggcttatccagcagactgtcaggcaccctgtcatttacctctgctgaggacgacgaggacgatgaagacgaggatgacgaagaggctggacccgatcagctgccgctcggggacggaacttctggagaagatgcagagcgaagccctcctcccgatggtcagtggggaagccagctgctcgcgagacagcttcaagatttttggaaaaagagcaggaacaccctcgcccctcagaggcttctcttcgaggtgacttctgctaatgtggtcaaagaccctccttcaaagtatgttacccccactctgagctctaccccttcaccatag

SEQ ID NO: 46498 - DNA, 477 bp, Artificial Sequence
  Description of Artificial Sequence: Synthetic coding sequence
atgcaccggggcacccaggagggcgccatggccagccggctgctgcatcggctgagacacgcattggctggggatggcccgggagaggctgcggcaagtcccgaggcggagcaattccccgaatccagcgaactggaagacgatgacgccgaaggactctccagtagactctcagggaccctttccttcacctcagcagaggatgacgaggatgatgaagacgaagacgacgaggaagctggcccggaccagctgcccctgggagatggtaccagtggagaggatgccgagcgcagcccccctccagacgggcagtgggggagccaactgttagctaggcagctccaggatttctggaaaaaaagtaggaacacgctggcaccacagcggcttctttttgaggtaaccagtgccaacgtagttaaggatcccccttctaaatatgtgactaacttgtcctcgacacccagcccttag

SEQ ID NO: 46499 - DNA, 1122 bp, Artificial Sequence
  Description of Artificial Sequence: Synthetic coding sequence
atgcaccggggcacccaggagggcgccatggccagccggctgctgcaccgtctgcgccacgcactggctggggacggcccaggcgaggccgcagcctctcccgaggcggagcagtttcctgagtcgagcgagctggaagacgacgacgcagagggtctgtctagccgtttatctggaacactcagtttcacaagcgccgaagatgacgaagatgatgaggacgaggatgacgaagaggctggcccggatcagctgccactcggcgatggtacctctggggaggacgccgagaggtctcccccccctgatgggcagtggggcagtcagctgctggccagacagttgcaggacttttggaaaaaatccaggaacacgctggccccccagcgcttactcttcgaggtgacaagcgccaacgtcgtgaaggatcctccctctaagtacgtcttatacacactggctgtcatcggtccagggccacctgactgccagccagcccaaatctcccgccgctacagtgattttgagagattgcaccgcaacctccagagacagttcagaggtcccatggcagccatcagctttcctaggaagaggctgcgcaggaatttcaccgccgagacgattgctaggcggtcccgcgctttcgaacagttcctgggccatttgcaggccgtccccgagttgcgtcacgcacccgacctacaagacttcttcgtattacctgagcttcggcgagcccaaagtctgacctgtactggactgtatcgcgaagcgctggcactttgggctaatgcctggcaactacaggctcagcttgggaccccttctggaccagacagacccctgctgaccctggccggcctggcggtgtgccaccaggaactggaggacccaggggaggccagagcctgttgcgagaaagcgctccagttacttggagacaaatcactgcatcccttgctggcgccgttccttgaagcccatgttcgtcttagctggaggctggggctcgacaaacggcaaagtgaggcaagactgcaggcgctgcaagaagcggggttgacacccacaccaccccctagcctgaaggagttgcttataaaggaagtcttagactag

SEQ ID NO: 46500 - DNA, 294 bp, Artificial Sequence
  Description of Artificial Sequence: Synthetic coding sequence
atggacaagcagagcagcgccggcggcgtgaagcggagcgtgccctgcgacagtaacgaggccaatgagatgatgccagagaccagcagcggctacagtgatccccagccggcccctaaaaaacttaagacatctgagtcgagtacaatcctggttgtgcgataccgtagaaacttcaagcggacctcgcctgaagaactggtaaatgatcatgcgagaaagaatcgtattaaccccctacagatggaggaggaagaatttatggagattatggtggagatccccgccaagtag

SEQ ID NO: 46501 - DNA, 3771 bp, Artificial Sequence
  Description of Artificial Sequence: Synthetic coding sequence
atggaccggcccctgagcagcagcgccgaggccgaggaggagctggaatggcaggtggccagtaggcggcgaaaagcatgggccaaatgcagatctagttggcaggctagtgagactgaagacctgtccacggaggcaacgacccaggacgaggaagaggacgaggaagaagatttaccgggtgcgcagctgccagcggcaggaggaaggggcaatgtgcccaatgagaagattgctatctggctgaaggactgcagaacccctctgggcgccagcctggacgaacagtccagctccaccctgaagggggtgctagttaggaacgggggctcgtttgaagatgacctttctcttggcgccgaggccaatcacctccacgagtccgatgcccagattgaaaactgtaataatattctcgcaaaagagagaagactgcagtttcaccaaaaaggtaggagtatgaatagtacggggtccggcaagagctctggcaccgtgtcctctgtcagcgagctcctggaactatatgaggaagatccagaggagatcctgtacaatctcggtttcggcagggacgaaccagatatcgctagcaagatcccgtcccgattcttcaatagctcttcatttgctaaggggattgatatcaaggtctttctgtcagcccagatgcagaggatggaagttgagaaccccaattacgctcttacaagccggtttcggcagatcgaagtgttgaccacggtggccaatgctttcagctctctctatagtcaggtctccggaactccactgcaacgaattggcagtatgagcagcgttacatctaacaaagagacagacccccccccacctttgacccgatctaatactgcaaatagattgatgaaaactttgagcaagctgaatttgtgcgtagataaaaccgagaagggtgaaagttcttccccttcgcctagcgcagaaaagggcaaaatccttaatgtgagcgtgattgaagagtcaggcaataaaaacgatcagaaatctcaaaaaatcatgaaaaagaaggaatcctcttcaatgctggcaaccgtcaaggaagaagtgtctgggtccagtgccgccgtgaccgagaacgccgactcggatcgcattagtgatgaagctaattccaattttaaccagggtacagaaaacgaacagagtaaagaaacacaatcgcacgagtccaagctgggagaggaaagcggcattgtcgagtctaaacttgattcagattttaacatctcgagccatagcgagctggagaactcaagcgagctgaagtccgtccacatcagcactcccgagaaggaaccttgcgctccactgactattccctctatcaggaacattatgactcagcagaaagacagcttcgaaatggaggaagtacagagcaccgaaggtgaggccccacatgtacccgcaacataccagctgggactgacaaagagcaaacgggatcacctgctgagaacagctagccagcactccgattcctctggatttgctgaggattccaccgactgtctgagtcttaaccatctgcaggttcaggaaagcttgcaggcgatgggatcctccgctgacagctgtgacagcgagacaaccgtcacttctttgggcgaagacctggccacgccgacagctcaggatcaaccctatttcaacgagtccgaagaagagagcctggtacctctgcagaaaggtctcgagaaggccgctgcagtggccgataagcggaaaagtggctctcaagactttccgcagtgcaatactattgagaacacaggaactaaacaatccacctgttctccaggagaccacatcatagaaatcacagaagtggaggaggacttgttcccggccgagacagtggaactcctgagagaggcctccgccgagtccgatgtgggtaaatctagcgagtctgagtttactcagtacactacacaccatattttaaagtctcttgcctccattgaggctaagtgcagcgacatgtcttctgagaacactaccgggccacctagttccatggatcgcgtgaacacggctctgcagcgtgcccagatgaaggtgtgtagtttaagtaatcaacggatgggccggagcctattgaagtcaaaggatctcttgaagcagcgctatctgttcgccaaggccggttatccactgaggaggtctcagagcctgcccacaacattgctgagtcctgtaagagtggtctcctctgtgaacgtgcgactatcccctggcaaagagacccggtgcagccccccatcttttacctacaagtacacgccagaagaggaacaggagctagagaagagagtgatggaacatgacggccagtcccttgtgaaatcgacaatatttatatcaccatcttccgtcaagaaggaagaagcgccacaatccgaagcccctcgggtggaggaatgccaccatggccggactcccacatgcagtcgcttggccccccctcccatgtctcagtccacgtgttctctgcattccatacacagcgagtggcaggagcgacctctgtgtgaacacaccagaacactgtctacccacagtgtgcctaatatctccggagccacttgtagcgctttcgcctcccccttcgggtgtccctactcgcaccgccatgcaacctatccctatagggtttgctcagttaatccgccatcagctattgaaatgcagctccggcgcgttctgcacgatatccgaaattctctacaaaacctctcccagtaccccatgatgcggggtccggatcccgccgcagccccgtatagtactcagaaatctagcgtcctccctttgtatgaaaacacctttcaagagctgcaggtgatgcgccggagcctcaatttgttcaggacacagatgatggacttggaattggccatgcttcgacagcagacaatggtgtatcaccatatgacagaggaggaacgctttgaagtggaccagctgcagggcttaagaaactctgttagaatggaattacaggacttagaattgcagctggaggagaggctgttgggtttggaggagcagctcagagctgtgagaatgccttcccccttcagatctagcgctctcatgggaatgtgcggatctagaagcgcggacaacctgtcttgccctagcccattaaatgtcatggaacccgtcaccgagctcatgcaggagcagtcctatctaaagagtgaactggggcttgggttaggcgaaatgggtttcgagataccacctggcgagtcatctgagtctgtcttctcgcaggccactagtgaaagttcgagcgtatgctccggcccatctcacgcaaatcgccgcacaggcgtgccgagtaccgccagtgtcgggaagagcaagactcccttggtagccagaaaaaaggtgtttcgggcctccgtggccctgactccaaccgctccaagtaggaccggctccgtccagaccccccccgacctggagtctagtgaggaggtggatgcagccgagggcgcccccgaggtggttggccccaaaagtgaagtcgaggagggtcacgggaagctgccctcaatgccagcagctgaggagatgcacaaaaatgtggagcaagatgagctacagcaggtgatcagagaagtgggaatggatcctatatcatgcgtcatcttagaactgtccatgatctgtacaggcggaggtgttatatgtgccctggaggacacctgctgctag

SEQ ID NO: 46502 - DNA, 3255 bp, Artificial Sequence
  Description of Artificial Sequence: Synthetic coding sequence
atgaacagcaccggcagcggcaagagcagcggcaccgtgagcagcgtgtcagagttactcgagctttatgaggaggacccagaggaaatcctgtataatttaggatttgggagagacgagccagacattgcaagcaagatcccatcaaggttcttcaatagctcctccttcgccaagggtattgatataaaggttttcctctcagcccagatgcaacgcatggaggtggagaatccaaattacgctcttactagccgatttcgtcaaatcgaggttttaaccactgtggctaacgcgttctcctctctttattcacaagtgtccggtactccgcttcagcgcatcgggtctatgtcgtctgtcaccagtaataaggaaacagatccacctcctccacttacaagatcaaacactgctaaccgcttgatgaaaaccctttctaaactcaacctgtgtgtggacaaaaccgaaaaaggggaaagctctagcccaagcccttccgctgagaagggtaagatcttaaacgtatctgtaattgaggagagcggaaacaagaatgatcagaagtcccagaaaattatgaaaaagaaggagagttcgagcatgctcgcgaccgtgaaggaagaagtgagtggatcttcagcagccgttacagaaaatgcagactcagatcgaatatccgacgaggcaaactccaatttcaatcagggcacggagaacgagcagtccaaagagacgcagtcccacgaaagcaaattgggggaagaaagtgggatcgtggaatccaaactagatagtgattttaatatcagcagtcattcggagctggaaaacagctcagagctgaaatccgtgcatataagcaccccggagaaagaaccatgcgcccctctgaccattccaagcattaggaatatcatgactcagcagaaggatagctttgaaatggaggaggtacagtccactgaaggcgaagcaccccatgtgccagcaacctaccagttgggactgacgaagtcaaaaagggatcatctgctgagaacagcctcacagcactcagatagtagcggatttgcagaggacagcaccgattgcctttctttgaaccatctccaggtgcaagagagcctccaagcgatgggatccagtgccgattcttgcgactccgagactacagtcaccagcttgggggaggaccttgcaacccctacggctcaagatcaaccttacttcaacgagagcgaagaagaatccctggtcccactacagaagggactcgaaaaagcagcagctgtcgccgacaaaaggaaatccggcagtcaggatttcccccaatgcaacactatcgagaatacaggaacaaaacagtccacttgttctccaggggaccatatcattgagatcaccgaagtggaggaggatctgtttcccgctgaaaccgtcgagctgctacgagaggctagcgcggagtcagatgtgggtaagtcctctgagtccgagttcactcagtacaccactcaccatatactcaagtctcttgccagcatcgaagccaagtgtagcgatatgagctccgagaacacgactggacctccatcttcaatggatcgggtgaacacagcccttcaacgggctcagatgaaagtgtgcagtctctccaaccagcggatgggccggagcctgcttaagtccaaggatcttctgaaacagcgttacctgttcgctaaagccggctaccctctgcggagatcacagagcctccccactaccctcctgtctcctgttcgcgtggtgtcgtccgtgaatgtacggctgagccccggaaaagagaccagatgtagtcccccatcattcacatataagtatacaccagaggaggaacaggagctcgagaagcgcgtaatggagcatgacggacagtcacttgtcaagtccacaatttttataagtccctcgtctgtgaaaaaagaagaagcaccacagagcgaagcccccagggtggaagagtgccaccacggacggaccccaacttgcagtcgcctggcccccccccctatgagccagagtacatgctctctccactcaatccatagtgaatggcaggagagaccactctgtgaacacactcgaacattaagcacacacagtgtcccaaatatcagtggcgccacctgttctgcattcgcttccccctttggctgcccatactctcataggcacgctacctacccttaccgggtgtgttcagtgaatccccctagcgcaatcgagatgcagttgaggagagtattacatgacatacgcaattctttgcagaatctgagtcaatacccaatgatgagaggaccggatcccgctgccgctccttacagcacacaaaagtcgtcggtgctaccgctttacgagaacacttttcaggaattgcaggtgatgcgcaggtctcttaatctgtttcgaacacagatgatggatctcgaacttgcgatgcttaggcaacagactatggtttaccaccacatgaccgaggaggaaaggttcgaggtcgaccaactgcagggactgagaaattctgtgcgtatggagctgcaagatcttgagcttcagctggaggagcgtttacttggacttgaagaacagctgcgggctgtcaggatgccttccccatttcgcagctccgccctgatggtgaccgagcttatgcaagaacagtcttatctcaagagtgagttagggctgggtcttggcgagatggggtttgaaatccctcccggcgaatccagcgagtctgtttttagccaagccacttcagaaagttcttccgtgtgttccggcccctcacacgccaaccgtaggactggggtgccttcaacggcatccgtggggaagtccaaaacacctctcgtggcacgaaagaaggtattccgtgcttctgtcgcgctaactccaacggctccaagccgaaccggttcggtacagacacctcccgacttagaatcatcagaagaggtggacgccgcagaaggcgcaccagaggtcgtcggacctaaaagtgaggtcgaagaaggccatggtaagctaccttcaatgcccgccgcagaggagatgcacaaaaatgtggagcaagatgaactccagcaggttattcgggagattaaggaatcaattgtgggtgaaatccggcgcgaaattgttagtgggctgttggcagctgtcagttcttctaaggcctctaactctaaacaagattaccactag

SEQ ID NO: 46503 - DNA, 3780 bp, Artificial Sequence
  Description of Artificial Sequence: Synthetic coding sequence
atggaccggcccctgagcagcagcgccgaggccgaggaggagctggaatggcaggtggcctctcggagacgtaaggcttgggccaagtgtcggtcctcttggcaggcctccgagactgaagacttgagcacagaagctaccacccaggatgaggaagaagatgaggaggaggacctaccaggggcccagcttccggccgccgggggtcggggtaacgtgccgaacgagaaaattgctatttggctcaaagactgtaggaccccgctgggggctagcttggacgagcaaagctcttcaaccttgaagggagtgttagtcaggaacggtggtagtttcgaagacgatctgtcgttaggcgcagaggcgaaccatctgcatgaatccgatgcccagatcgaaaactgcaataacatactggcgaaggagcgtagactgcagttccatcaaaaagggcggagtatgaactcaaccggatccggcaagtctagtgggaccgtgagctccgtttccgaattgctcgagttatatgaagaggatccggaggaaatattatataacctcggttttggccgggatgaaccagatatcgcaagtaagattccctcaagattctttaacagctcatctttcgctaagggtatcgatattaaagtctttctctccgctcagatgcagcggatggaggtggagaatccaaattacgccctgacaagccgattccgtcagattgaggttctgacaacagtggccaatgccttctcgtccctgtacagccaggtgagtgggaccccgttgcagagaataggatccatgtcctccgtgaccagtaataaagagacagatcctcccccaccccttacacggtctaatactgcgaatcgcctgatgaaaacactgtctaagctcaatttgtgcgtggataaaactgagaagggcgaaagttcatcaccttccccatcagctgagaaggggaagatcctgaacgtgagtgtcatcgaagaatccggcaataagaatgatcagaagtcccagaaaatcatgaagaagaaggagagtagcagcatgctagctaccgtgaaggaggaagtcagcggctccagcgcagcggtcactgagaatgcggacagcgacaggatatctgacgaggcgaactctaacttcaatcaaggcactgaaaacgaacagtctaaagaaactcagagccacgagagcaagctgggagaggaaagtggcattgtggagtcaaagctggatagcgacttcaatattagttcccactcagaactcgagaatagttcagaactcaagtctgtccatatctcaactcccgaaaaggaaccctgtgcgcctctaaccattccaagcatccgcaacatcatgacccaacaaaaagacagctttgaaatggaagaagtgcaatccaccgagggggaggcaccccacgtgccggctacctaccagctgggtctgacaaagagcaagcgggaccacttgctgcggacagcatcacaacacagcgactcgtccggcttcgcagaagatagcaccgactgtctgtcccttaatcatttgcaagtgcaggaatccctgcaggctatggggagctccgccgactcatgtgactcagaaaccacagtgactagtctgggagaagatttggccacacccaccgctcaggaccaaccctattttaacgaaagtgaggaggagtctctggtgccactccaaaaggggttggagaaagctgcagctgtggccgacaagaggaagagtggcagccaggattttcctcagtgcaatacgatcgaaaacactggcacgaaacagagtacatgcagccctggggatcatattatagaaatcactgaagttgaggaagatctctttccagccgaaacagttgaactactgagggaggcttctgccgaaagcgacgtcgggaagtccagcgagtctgagttcactcaatataccactcaccacattctgaaaagccttgcctccattgaggccaagtgtagtgatatgtcttctgagaatacgactggcccccccagtagcatggacagggtgaatacggctttacagagagcacagatgaaagtctgcagcctgtctaatcagcggatgggtaggtcgctgttgaagagcaaggatctgctcaagcagaggtacctttttgccaaagcagggtatccgctgagaaggtcccagtcgcttccgacaacattgctctcacccgtgcgcgtagtgagttctgtcaatgtgcggctgtcacccgggaaggagacccggtgctccccaccgagtttcacgtacaagtacacgccggaagaggagcaggaactggagaaacgcgtgatggagcatgacggccagagtttggtcaaaagcacaatttttatttccccctcgagtgttaagaaagaagaagccccccagtctgaggctcctagggttgaggagtgtcaccacggccgaacacccacctgctctcggttagcccctccgccaatgtcacagtctacctgcagcctacacagtatccattccgagtggcaggagcgtccattgtgcgagcacacacggacattgagcacccacagtgtgccaaatatatcaggggctacatgcagcgccttcgcctctcctttcggttgtccctatagccatagacatgccacctatccataccgggtttgcagtgttaacccgcctagcgccatcgagatgcaactgcggcgggtgctgcacgacatacgtaactctttacagaacttgagtcaataccccatgatgcgcggaccggatccagccgctgctccatattccacacagaaatcctccgtgctgcctctctatgaaaacactttccaggagttgcaggtaatgagaagatctttgaacctgtttaggactcagatgatggatctcgagttggcaatgctgcggcagcagacaatggtgtaccaccacatgaccgaagaggaacgattcgaagtggatcaactgcagggcctgcggaatagcgtcaggatggaacttcaagatctcgagctgcagctggaggaacggcttctaggcctcgaagagcaactccgagctgtccggatgccctctcctttcaggagctccgccttgatgggcatgtgcggaagtcggtctgccgataacctgagctgcccctctcccttaaacgttatggaacctgtaacggaactaatgcaggagcaatcctatctgaaatcagagctcggcctgggcctaggtgagatgggattcgaaattccccctggtgagtcctcagagtccgtcttctcacaggcaacatctgaatcttcctctgtctgttcaggtccgtcacatgccaacaggagaaccggagtgccatcaaccgcatccgtggggaaaagtaagaccccattagtggctcgaaaaaaggtttttcgcgcatctgtggccttgacaccgactgccccaagtaggacaggaagtgtgcaaacaccccctgatcttgagagcagcgaggaggtggatgctgcagaaggcgcacccgaagttgtaggccccaagagcgaggtggaggaggggcatgggaagttaccatctatgcctgcagcggaagaaatgcacaaaaatgtggaacaggacgagctgcaacaggtcatacgagagattaaggagtcaatcgtgggtgagatccgaagggaaattgttagcgggcttttagccgccgtgtcgagcagcaaagccagtaactctaagcaagactaccattag

SEQ ID NO: 46504 - DNA, 519 bp, Artificial Sequence
  Description of Artificial Sequence: Synthetic coding sequence
atgcccgtgggcgccggcctgcccaccagcctgaccagcccccccagtacagaggctcctaaatcttctcttttgcgcaaacagactcagccgcccaagaagcagtcctccccagctgtgcacctcagatgtaccatggatcccgtaatgatgacagtatcacctccgcctgcacataggcacaggcgtcgcggatccccaaccaggtgtgcgcattgtccggttgcatgggcgccggacacagacgacgaaaaaccgcatcaatatcctgcaatttgcagctaccattgggacgtgcctgaggattgggagggctttcagcacacccaagggacctgggtgccgtggagccaagacgccccagagagcccgcctcaaaccatccgattccagcccggccgtcaaagtgaaaccccaagtaaaaaaaaaaagaaaaaaaaaaaaaaacgaaatatcggagctccacttaagcgctatttgactgttaccagccagcttagcgttacatctttactgtag

SEQ ID NO: 46505 - DNA, 930 bp, Artificial Sequence
  Description of Artificial Sequence: Synthetic coding sequence
atggccatggtggagcggccccggcccgagtgggccagctaccacaactgtaacagtaacagctgccaggaccttgggaacagcgtgttgcttttactcggccttatcatatgcatcaacatcagtatcaacatcgtgaccttgctttggagcagatttcggggcgtgctgtatcaagtgttccatgacacaatctgtgaaaaggaagcgcctaaaagctcgctgttgaggaagcaaacacagccccctaagaagcagtcctctcccgcagtccacctaaggtgcaccatggacccggtaatgatgacagtgagtccaccccctgctcatcgccatcggaggcgggggtctcccactcgatgtgctcactgcccagtggcttgggcccctgacacagatgacgagaagccccatcagtaccctgctatatgtagctatcactgggatgtgccagaggactgggagggctttcagcatactcaaggcacctgggtgccctggagccaggatgctccggagtcacccccccagactatcagattccagccaaccgtggaggaaaggcccctgaagacagggatttggtctgaactgggactgcgtgcttatgtgtatcccgtgaatccacccccaccatccccggaggcaccctcccacaagaatggtggagagggggcggtgcccgaggctgaagccgcccagtaccaacccgttccagcccccacactgggacctgccgttattcctgagttcagcagacacaggagtagcgggcgaatcgtatatgatgccagggatatgcggaggaggttgagagaattgacccgggaggttgaggctctgtcaggctgttacccacttgcctctgggtcatctacagccgaggaaactagtaagaattgggtgtatcgcagcctgaccggccggtag

SEQ ID NO: 46506 - DNA, 987 bp, Artificial Sequence
  Description of Artificial Sequence: Synthetic coding sequence
atggccagccggtgcagcgagccctaccccgaggtgagccggatccccaccgtccgcggatgtaatggaagtctgagcggggccctgagctgttgtgaggatagtgcaagagggtccggaccaccgaaggccccgaccgtggccgaaggcccctcatcgtgcctccgcagaaatgtcatttccgagagggaacggcgcaagagaatgtcattatcttgtgagcgtctcagagctctccttccccagttcgacggacgtcgagaggacatggctagcgtgcttgaaatgtctgtgcaatttctgcgcctggccagcgccctagggcctagccaggagcagcacgctattctcgcgtccagtaaagaaatgtggcactcactgcaggaagacgtcctgcagctaaccctaagcagccaaatccaggccggcgtgccagatcccggcaccggcgcctcatctggcacccgcacgcccgacgtcaaggccttcctggagtccccctggagcctagaccctgcctccgcctcccctgagcccgttcctcacatcttggcttcttcgaggcagtgggatccagcctcctgcactagcttggggaccgacaagtgtgaggccttactcggtctttgccaggtgcggggcgggcttcctcctttcagcgaaccatcaagccttgtcccttggccacctggccggagtctgcctaaggccgtgaggcctccgttgtcttggcctcctttcagccaacagcagactctgccagtaatgtcaggtgaagccctagggtggctcggtcaggccgggccactcgcaatgggagctgcgcctctcggggaacccgctaaggaagatcccatgctggcgcaggaggccggctccgctctggggtctgacgttgacgatggtacttcctttctgctgaccgccggaccgtcgagttggccaggcgaatggggccctggattccgggccggtcccccagcttag

SEQ ID NO: 46507 - DNA, 1164 bp, Artificial Sequence
  Description of Artificial Sequence: Synthetic coding sequence
atggccagccggtgcagcgagccctaccccgaggtgagccggatccccaccgttcgaggatgtaacgggtctctgtccggagcattgtcatgctgcgaggactctgcacgcggcagcgggccccccaaagctcccacggtggcagaaggcccaagctcttgcctgcgccggaacgtgatatccgagcgtgaaaggcggaaacgcatgtccctttcctgcgagagactgcgcgctttgttaccccagtttgacggccggcgggaggatatggccagtgtactggaaatgagtgtgcagtttttgcggctggcttcagctttgggcccatcgcaggagcagcacgctattctggcctcaagtaaggagatgtggcactccctgcaggaggatgtgctgcagctgacactctctagccaaattcaagccggagtgccagacccaggcacgggtgccagctctgggacaagaacaccagatgtcaaggcgtttctcgaaagcccctggtctctggaccctgcatccgcttcccctgaacctgtaccccacatcctggccagttctcggcagtgggatcctgctagttgcacgagtttgggcaccgataaatgtgaggcactcctgggactttgccaggttagggggggtctgccccccttttcagagccctccagtcttgtaccttggccgcctggccggagcctgcctaaagccgtgcgccctccactaagttggccccccttctctcagcagcagacccttccggttatgtctggtgaggccctcggctggctcggacaggcgggtccacttgccatgggggctgcccctctcggagaaccggcgaaggaagaccctatgctggcccaggaagctggatcagctctggggagcgatgtagacgacggcacctcgttcttgttaacagccggaccgagcagttggcccggctctctggaaggccgcggcggtagtggccccgcatgggcacctgcagagtctagccctcttgatgtgggagaacccggtttcctgggggatcctgagctgggcagtcaagagctccaggatagccctctggagccctgggggctggatgttgattgtgccggcctcgccctgaaagacgaggtggagtcgatctttccggacttcttcgcgtgttag

SEQ ID NO: 46508 - DNA, 684 bp, Artificial Sequence
  Description of Artificial Sequence: Synthetic coding sequence
atgagctacttccggaccccccagacccaccccggccccctgccctcaggccagggtggggcagcctcacctggcctgtccctagggctgtgctcccctgtggaacctgtggtcgttgccagcggtggcacagggccccttagccagaaagctgagcaagtagcgcctgccgcccaggcttggggccccgctctcgcaatgccccaggcacgggggtgtccaggcggaacctcctgggaaacgctcagaaaggaatattcccggaattgccataaattccctcatgtgcgccagttagaaagcttgggctgggacaacggctactcacgttccagggctcctgatttgggcggtccgtcccggccaaggcctcttatgttatgcggactttcaccccgggtcctgccagtgccctctgaagctgtagggaaggaggcatcctcccagcccgatatttgcattctgacactcgccatgatgatcgctgggatacccaccgtcccagtgccaggtgtgcgcgaagaagacctgatttgggccgcccaggccttcatgatggctcatcccgagccggaaggagctgtggaaggggcacgttgggagcaggctcacgctcatacagcttcaggcaagatgcctctagtccggagcaaacggggtcagccccctggctcttgcctatag

SEQ ID NO: 46509 - DNA, 765 bp, Artificial Sequence
  Description of Artificial Sequence: Synthetic coding sequence
atgcccatcaagcccgtgggctggatctgcggccaggtgctgaagaattttagcggtcgtattgagggtatccagaaagctatcatggacctcgtcgatgaattcaaagatgaattccccactatcttaagattgtcacagtctaaccaaaagcgcgagccagcccagaagacaagcaagattcgcatggccattgccctagccaagatcaatagagccacccttatccgaggattgaactctatcagccggagcagcaaaagcgtggcaaagctgctacacccccagctcgcctgtaggctcttagaactgcgggacataagtggacgtttactgagggaagtcaatgccccaaggcagcccttatacaacatccaggtaagaaaaggcagcctcttcgaaatcatctcatttcctgcgaagaccgcattgacaagtattatttacgcttcttatgcggccttgatttacttggcagtgtgcgtaaacgctgtcctgaaaaaagttaagaacatttttcaggaagaggaatcaattcgtcagaacagggaagaaagcgagaactgtaggaaggcgttctcagagcccgttctaagtgaacctatgttcgccgagggcgagatcaaagcaaaaccttatcgttccctgcctgagaaacctgacattagtgactaccccaagttgcttgctaataaacagagtaacaatatccaagtactgcactccgtgtttgaccagtcagctgagatgaacgagcagatttag

SEQ ID NO: 46510 - DNA, 765 bp, Artificial Sequence
  Description of Artificial Sequence: Synthetic coding sequence
atgcccatcaagcccgtgggctggatctgcggccaggtgctgaagaatttcagtggaagaatcgagggtatccagaaagctatcatggacttggtggacgagttcaaggacgagtttcccactatcctgcgcctctctcagagcaatcagaaacgcgagcccgcccaaaaaaccagtaagatcaggatggccatagcgctagctaagataaacagggcaacgctgattagaggcctgaattcaatttcccgttcaagtaaatccgtggcaaaacttctgcacccacagctggcctgtagactgttggagctgcgcgacatcagcgggcggctactgcgggaagtgaatgccccaaggcagccgctatacaatatccaggtgagaaaggggtccttatttgagatcatctcgtttcctgcgaaaacagcgctaacgagcattatctacgcttcgtacgccgctttgatatatctagcagtctgtgtgaatgccgtcctcaaaaaggtgaagaacatatttcaagaggaagaaagtattcgtcagaacagagaggagagcgagaattgccgcaaggccttcagcgaacccgtcttgtctgagccaatgttcgccgagggagagattaaagccaaaccctacaggagtcttcccgagaagccagatatcagtgattatcccaaactgctcgcaaacaaacaatcgaataacatccaggtgttgcattccgtgtttgaccaatctgcagagatgaatgaacagatatag

SEQ ID NO: 46511 - DNA, 408 bp, Artificial Sequence
  Description of Artificial Sequence: Synthetic coding sequence
atgcccatcaagcccgtgggctggatctgcggccaggtgctgaagaatttcagcggtagaatcgagggaattcaaaaggctataatggatctggtcgatgaattcaaagatgagttcccaacaatcttgagacttagtcagagcaaccagaaacgcgagccggctcagaagacttctaaaatccgcatggctatcgcgctggccaagatcaaccgagctacccttatcaggggactcaattctataagcaggtcatctaagtccgttgctaaactactgcacccacagttggcttgccggctgctggaattgcgggatattagcggtagactgctgcgtgaggtgaatgcccccaggcaacccctctataacattcaggaaaaaaagatgggcctgcagctgagctag

SEQ ID NO: 46512 - DNA, 1272 bp, Artificial Sequence
  Description of Artificial Sequence: Synthetic coding sequence
atgaagcccaacttcagcctgcggctgcggatcttcaacctgaactgctgggggataccgtatctttcaaaacaccgtgccgacagaatgcgtcgcttaggtgatttccttaaccaggaatcatttgacttggcactgctcgaggaagtgtggtcagaacaggactttcaataccttaggcagaagctctctcctacatatcctgcagcacaccacttccgaagtggcatcatcggttctggactgtgtgtgttctctaaacatccgattcaggagctcacacaacacatatatacactgaatggctatccctacatgattcaccacggagactggttcagtggcaaggccgtgggcttactggttctgcatcttagcggcatggtattgaatgcctacgtcacccacctgcacgcggaatacaacagacagaaagacatatatctcgcccaccgggtagcacaggcttgggagttagcccagttcattcatcatacctcaaagaaagcggacgtggtgctactgtgtggcgatctgaacatgcacccagaggacttgggatgctgtctgctgaaggagtggactggacttcacgacgcctacctcgagacacgagactttaagggctcagaggagggcaacacgatggttccgaaaaactgttacgtttctcagcaggagctgaagcctttccccttcggggtccggattgactatgtactttacaaggccgtgagtggcttctacatcagctgcaaaagctttgaaactaccactggatttgacccgcacagggggactccacttagtgatcatgaggccctaatggcaaccctgtttgttcgacactcgccacctcaacagaacccctcatcaacccatggacccgcagaacgttcaccgctgatgtgcgttttaaaggaggcctggaccgagctcgggctcggcatggcgcaagcgagatggtgggcgacctttgccagctacgtaatcggactgggactgctgctgctggcccttctctgtgtgctcgcagccggcggcggggccggagaagccgctatactgctgtggactccatccgtggggttagttctgtgggccggggctttctacttgttccacgtacaggaggtcaacgggctgtatcgggcccaggcggaacttcagcacgtcctaggcagggcccgtgaggcccaggatctcgggcctgaaccacagccagctcttctcctgggccagcaagagggcgacagaactaaagagcagtag

SEQ ID NO: 46513 - DNA, 846 bp, Artificial Sequence
  Description of Artificial Sequence: Synthetic coding sequence
atgcccgtgcagctgaccaccgccctgcgggtggtgggcaccagcctgttcgcgcttgctgtcttaggaggtatccttgcagcctacgtgactgggtaccagttcatccataccgaaaagcactatctgagcttcgggctttacggcgcaatcctcggcctgcatctgttaatccagagcttatttgcctttcttgagcataggaggatgaggagggccggacaggctctgaaactgccttccccaaggaggggaagtgtggctctgtgtattgccgcctaccaagaggaccccgactatctgcgaaaatgcttaaggtcagcacaacgcattagcttcccagacctgaaggtggtcatggtggtggacggcaatcgccaagaggatgcgtatatgctcgatatattccacgaagtgctcggaggtaccgagcaagctggctttttcgtgtggcgatccaattttcacgaagctggggagggtgagactgaagcctctctgcaagagggtatggatagagttcgcgacgtggtgcgtgcttctaccttttcttgtatcatgcagaaatggggtggcaagcgcgaggtaatgtatactgcattcaaagctctgggtgactctgtggattacatccaggtttgcgactcagataccgtgctggaccccgcctgtacaatagaaatgctgcgtgtattggaggaggaccctcaagtcggtggagtcggaggcgatgtacagccgccgggaaaggggatggccgtggaggacgatcaagttcaggccgcacaggtccgcgcaacagaagcgtggtccgtgcaccagcggcacgtgtccagggagcagtag

SEQ ID NO: 46514 - DNA, 2175 bp, Artificial Sequence
  Description of Artificial Sequence: Synthetic coding sequence
atggccggccggaagcacttctggcagccccggtggtgcccccggtggctggagcctcctctgctcaccggtgctagggagtcttgtggtgtccagcatcgggacggaatcagccggccgtggggaccagtcaaggcatctattcaagagtgtatcttacccgactccccgttgtatcacaataaggtccagtttaccccaaccggcggactgggccttaatctggccctaaatccctttgaatactacattttcttctttgccctttctctcatcacccagaaacctcttcccgtgagtctccacgtgagaacctctgattgtgcttactttatcctcgttgatcgctacctatcatggtttctgcccactgagggtagcgtaccgccaccactgtcttccagcccaggtggaacaagcccgtcaccccctccccgcactcccgcaataccattcgcctcctacggactccatcatacttccctgctgaaaaggcacattagccatcagacctctgtgaacgccgacccggctagccatgagatttggcggtcagaaacccttctgcaggtgtttgtggaaatgtggctgcaccactattccctggagatgtatcaaaagatgcagtcacctcatgcaaaagaatcatttacaccaactgaggagcatgtgcttgttgtgcgactgctgctcaagcacctccatgcttttgccaacagcctgaaacctgagcaggccagcccctcagcacactcccacgccacttcgccacttgaagagtttaagcgggccgctgtcccgagatttgtgcagcagaagctgtacctgtttctgcagcactgtttcggccattggcccctggacgcatccttccgggccgtgctggagatgtggctctcttacctccaaccatggcgatacgcgccggacaagcaagctccggggtctgattcccagcctagatgtgtgagtgagaagtgggcaccgtttgtgcaagaaaacctgctcatgtacactaaattgtttgtgggatttctgaatagggctttgaggacagacctggtttctcctaaacatgcactgatggtctttagagttgctaaagtgttcgcacagcccaatcttgccgaaatgatacagaaaggggagcagctctttctggagccggagctggtgattcctcatcgacagcacaggttatttactgccccgacattcacgggttccttcctcagtccatggcccccagccgtaactgatgcaagcttcaaagtgaagagccatgtctattcactagaagggcaagactgcaagtacaccccgatgtttggaccggaggctcgcacacttgtgctgcgcctggctcagctgatcacccaggctaagcacactgccaagtctatctccgaccaatgcgcagaaagcccagctggccattcctttcttagttggttgggattctcctctatggacacgaacgggtcttacactgccaatgatctggacgaaatgggccaggacagcgtccggaagaccgacgaataccttgaaaaggcccttgaatacctcaggcagatattcaggctgagcgaggctcagctccgccagtttaccctggccctgggaacgacacaagatgagaacgggaagaagcagctgcctgactgcatcgtgggtgaagatgggctgatcctgacccctctggggagataccagattatcaacgggctgcgacggtttgagatcgaataccagggggaccccgaattacagccaattagatcatatgaaattgcttctctagtgaggaccctgttccggctgtcatcagcgattaaccatcggttcgcaggccagatggccgccctgtgctctagagacgattttttggggagtttttgccggtatcatctgacagagccaggcttggctagccgacatctcctcagccccgttggacgccgacaggtggctggacatacaaggggcccgcgcctgagcctgcgtttcttggggtcttatagaactctggtgtcactgctcctcgccttcttcgtggcgtccttgttttgtgtggggcccctgccctgcacactgctattaaccctgggttatgtactctacgcctcggccatgacgctgttaactgaacgcggcaaactgcaccagccatag

SEQ ID NO: 46515 - DNA, 2514 bp, Artificial Sequence
  Description of Artificial Sequence: Synthetic coding sequence
atgaccaccttcggcgccgtggccgagtggcggctgcccagcctgaggcgcgctaccctgtggatcccccaatggtttgcgaaaaaggcgatttttaacagtccactggaggctgcgatggccttccctcacttgcagcagcctagcttcctcttagctagcctcaaggctgattccattaataaaccttttgcacagcaatgtcaagatctggttaaagtgatcgaagattttcctgctaaagaattacacaccatctttccttggctagtggagagcatatttgggtctcttgacggtgtgctggtgggttggaacttaaggtgtttacagggacgcgttaaccccgtggagtatagcattgtaatggagtttttagatccaggaggtccgatgatgaaactagtgtataagcttcaggctgaagattacaagtttgacttccccgtgagttatctgcctggtcctgtcaaggccagtatccaggagtgcattctgcctgattcaccactgtatcacaataaggttcagttcacaccaacgggcggcctcgggctgaatctggccttgaatccttttgagtactacatatttttctttgccctcagtctaatcactcagaagccactgccagtgagcttacacgtgagaaccagtgattgtgcatactttatactggtcgatcgctatctcagttggtttctgcccactgaggggtccgtcccccccccactttcttccagcccaggtggaacgtctccctctcctcccccacgtactcccgctatcccttttgccagctacggcctccaccatacatccttacttaagaggcatatttctcatcagaccagtgtgaatgctgaccctgcctcgcacgaaatttggcggagcgaaactctgctgcaggtgttcgtggaaatgtggctgcatcactatagtctggagatgtaccagaaaatgcagtctcctcacgcgaaggagagttttacacctaccgaggagcacgtgcttgtggttcggctgttactgaagcatctccatgccttcgcaaatagtctgaaacccgaacaggcctcaccatccgctcactcacacgccacgtctccgctggaggagtttaagcgcgccgcggtgcccaggtttgtgcagcagaagttgtatctgttcctccagcattgtttcgggcattggccgctggatgctagctttcgggctgtgctcgagatgtggctatcttatctccagccctggaggtacgcacctgacaagcaggctcccggttctgattctcaaccgcgctgtgtctctgagaagtgggcaccattcgtgcaggagaaccttctgatgtatacgaaactgttcgtgggctttctcaatagagcacttcgcacagacctcgtgtctcccaaacacgctcttatggtattccgcgtggctaaggtatttgctcagccaaatctcgctgaaatgatccaaaaaggggaacagctgttccttgagcctgagctggttatccctcatcgtcaacatcgactcttcaccgcccccaccttcacaggcagtttcctctccccctggccacccgccgtcactgacgcatctttcaaagtgaagtctcacgtttacagcctcgaagggcaagattgcaaatacactcccatgttcggccccgaggcgaggaccttagtactgaggctggctcagctgattacacaggcaaaacacacagcaaagtctatctctgaccagtgtgccgagtcacctgccgggcatagttttctctcctggttaggcttcagcagtatggacaccaatgggtcttacactgctaatgatctcgatgaaatgggtcaagattccgtaagaaagactgacgagtacctggaaaaggcccttgaatacctaagacagatttttcggctcagcgaagcgcagcttagacaattcaccctggcactgggaactacccaggatgaaaatggaaaaaagcagctcccagattgtattgttggtgaagatggattaattttgacgccgctaggcagataccaaatcatcaacggactccggcgtttcgagatcgaataccaaggagatccagagctgcagcctatccggtcgtacgagattgcatctctcgtgcgaactctgttcaggctgagttccgcaatcaatcatagatttgcaggccagatggcagccctctgttctcgcgatgactttctgggatcattttgtcgataccatctgactgagccggggttggctagccgacacttactcagtccagtgggcagaagacaagtggctggacacacccgcgggccccggctgagtctaaggtttctgggatcctataggaccctggtcagtctgctgctggccttcttcgttgctagcctattttgtgtgggcccactcccatgcacattgctgctcaccctgggatatgtgctttacgccagtgctatgaccctactgaccgaacgcgggaagcttcaccagccgtag

SEQ ID NO: 46516 - DNA, 2601 bp, Artificial Sequence
  Description of Artificial Sequence: Synthetic coding sequence
atgaccaccttcggcgccgtggccgagtggcggctgcccagcctgaggcgtgccaccctttggatcccacaatggttcgccaaaaaagcaatttttaatagtccactagaagctgccatggcctttcctcatttgcagcagccatcattcctgctagccagcctgaaagctgactcaatcaataagccgtttgcccaacagtgtcaggatttagtgaaagtcatcgaagactttcctgccaaggagctccatactattttcccatggctggttgagagcatttttggctcacttgacggcgttctggttggctggaatctccggtgtctgcaaggtagagttaacccggtggagtattctattgtaatggaattccttgatcctgggggaccaatgatgaaactcgtttataagctccaggcagaagactacaagttcgacttcccggtgtcatatctgcctggacccgttaaggcttcaatccaggagtgtattctacccgactctccactgtaccataataaagtccagtttactccaaccggagggttaggcttaaatctggccctgaatccgtttgaatactacattttctttttcgccctctctctcatcacacagaaacctttgcccgtttccctgcatgtgcggacatctgattgtgcgtacttcatccttgtagatagatatctgagttggtttctacctacggagggtagcgtccccccaccgctgagtagcagtcccggcgggacgagcccctctccacctccccggacacccgccatcccttttgcgagctacgggctgcatcatacctcgctgctcaagcgccacatctcgcaccagaccagcgtcaacgctgacccagcgtctcacgagatttggaggagcgaaactctcctgcaggtgttcgtggaaatgtggttgcaccactattcactcgagatgtaccaaaaaatgcagtctcctcacgccaagctagaagtgctgcattatcgcctcagtgttagctcagcattatattctccagcacagccatccctgcaggctctgcacgcttaccaagagtcttttacacctaccgaggagcacgtgctggtggtcaggctgctgctcaagcatctacatgctttcgctaacagcctcaagcctgaacaggcatcgccctcagcgcacagccatgctacatcacccctcgaggagtttaaacgcgcagctgtgcctagattcgtgcaacagaagctctatttgttcttacagcattgcttcgggcactggcccttggatgcgagctttcgcgccgttctggagatgtggctgtcgtacctgcagccatggcgctatgccccagataagcaggctccagggtccgacagtcagccaagatgcgtaagtgagaagtgggcccccttcgtccaggagaaccttctgatgtatacgaagctgttcgtcgggttcctgaaccgcgccctcagaactgacctggtcagccccaagcatgcgctgatggtgttcagggtggccaaggttttcgcccagccaaatctagctgagatgattcagaaaggagaacagctgttcctggagcctgagctcgtgatcccccacagacagcacagacttttcacagcacctacatttaccgggtctttcctttcaccctggccacctgccgttactgacgctagcttcaaagtaaagagccacgtgtattcacttgaggggcaggactgtaagtatacccccatgttcgggcccgaggccagaaccctcgttcttaggctcgcccagctgataacgcaagctaagcacacagccaaatcaatcagtgatcagtgtgccgaaagtcccgctggccactccttcttgtcgtggctcgggttcagctctatggatacaaatggttcttataccgctaacgacctggacgagatggggcaagacagcgtgaggaaaactgacgagtatctcgaaaaggcgttggaatatcttagacaaattttcaggctatcggaggctcagttaagacaatttacactggcgctcggtaccactcaagatgagaacggtaagaaacagttgcctgactgcatagttggtgaagatggcttgattctcaccccactcggcaggtaccagattataaacggtctccgccggttcgaaatagagtatcagggcgatcccgagctgcagcccatacgctcttatgagatagcgtccctcgtcagaactctttttagactgtcaagcgcaattaaccatagattcgctggccagatggcagccctgtgctcgcgcgacgatttcctggggtccttctgtcgctaccaccttacagaacccggcttagcaagcagacacctgctgagcccggttggtcgtcggcaggttgccggacacacaaggggcccaaggctgtccctgaggtttctcggatcctacagaacccttgtttctctgcttctcgcattttttgtggcaagtcttttctgtgtaggtcccctaccctgtacactgttgttgaccctcggttatgtgctctatgctagtgctatgaccctgctgaccgaaagaggaaaattacatcaaccctag

SEQ ID NO: 46517 - DNA, 1509 bp, Artificial Sequence
  Description of Artificial Sequence: Synthetic coding sequence
atgcagacccccccccccacccggagcggcggccagaagctgtgcagccgcttcctattgaaatgtggattcataacgatcccctggcgttgcatcaaaaagtgttcgccactaatgcctagagcggcagtccctcggtttgtgcagcagaaactgtatctgtttctacagcattgtttcgggcactggcctcttgatgcaagtttcagagcagtcttagaaatgtggctgagttatttacaaccgtggaggtacgcacctgacaagcaggcacctgggagtgactcccagcctcggtgtgtgagcgagaagtgggcacctttcgttcaggagaacttactcatgtatactaaattatttgtagggtttcttaaccgggctctccgcaccgacttagtctcccccaagcacgccctgatggtgtttagagtggctaaggtgtttgcccagccgaacctagctgaaatgatacagaagggggagcaactctttctcgagcccgaactggtgattccacatagacagcacaggctttttacagcccccacctttaccggcagctttctgtcaccctggccacccgccgtcactgatgctagttttaaggtgaaatcccatgtttacagcctggagggccaggactgcaaatacaccccgatgttcggccctgaggcccgcacgcttgttctaaggttggcccagctgatcacacaggccaagcatacagctaaatccataagtgaccaatgtgccgagagtcctgccggacacagtttcttgtcctggctgggcttttcctcaatggacaccaatggctcttataccgccaacgaccttgatgagatggggcaggacagcgtccgtaagacggatgagtacctggagaaggctttggaatacttgcgacagatctttagactctctgaagctcaactgcgccagttcaccctcgccctgggcacaacgcaggatgagaatgggaagaaacagctgcccgattgtatcgttggcgaagacgggctcatccttactcctctggggcggtaccagatcattaacggattgcggaggtttgagatcgagtaccagggtgatcctgaactccagccaatccggagctatgagattgcttcgctggtcagaacactgttccgcctgtcctctgcaattaaccatcgattcgctggccagatggctgccctgtgttctcgtgatgatttcctgggatccttttgcagataccacctaactgaacccggtctggccagcagacacctcctgagtcctgttgggcggcgtcaggtagctggccacaccagagggccgcgcttatctctgcgctttcttggatcgtatcggactctcgtgtccctcttgctcgcattcttcgtggcctctctgttttgcgttgggccactgccttgcacactgctactgactcttggatatgtgctctacgcttctgctatgactttgctgactgagcgcgggaagctgcaccaaccctag

SEQ ID NO: 46518 - DNA, 2295 bp, Artificial Sequence
  Description of Artificial Sequence: Synthetic coding sequence
atgaccaccttcggcgccgtggccgagtggcggctgcccagcctgcgacgggccaccctttggatcccgcaatggttcgctaaaaaggccatcttcaattctccgctggaggccgcaatggcttttccacatttgcagcaaccctctttcctactggcatcactgaaggcagactctatcaataagcccttcgcacaacagtgccaggacctggtgaaagtaattgaggacttccccgcaaaaggacccgtcaaggcatccattcaggagtgcatccttcccgactcccccctgtaccacaataaggtgcaatttactccgactggaggtctaggactgaacctcgccctaaacccctttgagtactatatcttcttttttgctttgtccctcatcactcagaaacctttaccggtgtctttgcacgtccgaactagtgattgcgcgtactttatcctggtcgacagatatctgtcatggtttctccctaccgagggttccgtacccccacctctatcttcttcaccagggggtacctccccgtccccgccacctaggacacctgccattcccttcgcatcatacggcctgcatcatactagccttttaaagcggcacatttctcatcagacttcagtgaacgctgatccggcctctcatgagatatggcgcagcgagacactgctgcaggtgtttgtggagatgtggttacatcactactcattggagatgtaccagaaaatgcagtcccctcacgctaaagagtcttttacaccgaccgaagagcacgtgctcgtcgtgcgtttactcctaaaacacctgcacgccttcgcgaattctttgaagcccgaacaggcaagccctagtgcccatagtcatgccacttctccattagaggaattcaaacgtgccgccgtcccccgcttcgtgcagcaaaagttatatctcttcctgcagcattgctttggtcactggcctctggacgctagcttccgcgccgtcctggagatgtggcttagctatctccagccttggcggtacgctcccgacaaacaggccccgggatcagatagtcagccgcgctgcgttagtgaaaaatgggccccgtttgtacaagaaaatttgctcatgtataccaagctgtttgtcggcttccttaacagggcccttcggaccgatctggtctcaccaaaacatgccctcatggtgttcagagtggccaaagtgttcgctcagcctaacctggcggagatgattcagaaaggagagcaattatttttggagcccgagctggtgattccccaccgccagcacaggttgttcaccgcccctactttcacaggctctttcctctcgccctggcctcccgctgttaccgatgcaagcttcaaggttaagtcccacgtgtattctcttgaggggcaggactgcaaatacacccctatgtttggtccggaggcaagaactttggtgctgcgcctcgcgcaactgataacgcaggcaaagcacaccgccaaatccatttccgatcaatgcgccgagagcccagcgggccactctttcctgtcctggcttggcttctctagcatggacacaaacggtagctacacagcaaacgacctggacgagatgggacaggacagcgtaagaaagaccgacgaatatctggaaaaagcattagagtatctgaggcagatatttcggttatcggaggcccaactgaggcagtttactctggcacttggaacaacacaggatgagaacgggaagaaacaactccccgactgtatcgtaggggaggacggactgattctgacgcccctcggccgatatcaaatcatcaatggattgcgaagattcgagattgagtatcagggagaccccgaactgcagccaatcagatcttacgaaatcgctagtctcgtgcgcactctgtttaggctgtcatcagccattaatcacagatttgccggccaaatggctgctttgtgctcccgcgatgatttccttggcagtttctgtagatatcacctcacagagcccggtctggcatctcgccacctgctaagcccagttgggcgcaggcaggtcgccggtcacacccggggcccgaggcttagcttgaggttcctaggctcctatcgaacgcttgtctcactgttactggcattcttcgttgcatccttgttttgtgttggtccactgccgtgcacacttctgctcaccctagggtatgtgttgtatgccagtgccatgaccctcctcaccgagcggggaaaactccatcagccatag

SEQ ID NO: 46519 - DNA, 1593 bp, Artificial Sequence
  Description of Artificial Sequence: Synthetic coding sequence
atgtggctgcaccactacagcctggagatgtaccagaagatgcagtccccccatgcgaaagagtcttttaccccaaccgaagagcacgtacttgtcgtgcgcttgctgctaaagcatttacacgctttcgcgaattctctgaagccagagcaggccagccctagcgcccacagccacgccacgagcccacttgaagagttcaagcgcgctgctgtaccgcgctttgtacagcagaagctctatcttttcctgcagcattgcttcggccattggccattggatgcttcttttcgggccgtcctcgagatgtggctgtcctatctgcaaccgtggcgctatgctcccgacaagcaagcgccaggcagcgactcacagcctcggtgtgtttcagaaaagtgggcacctttcgtgcaggagaacttactgatgtacacaaagctcttcgtgggattcctgaatcgggcccttcggactgacctggtctctcccaagcacgccctgatggtgttccgagtcgccaaagtcttcgcgcagcccaacctcgccgaaatgattcagaagggagagcagctcttcctcgagcccgaactcgttattccacatcggcagcatcggttgttcacagccccaacctttaccgggtccttcctcagtccatggccgccagctgtgactgatgcttcttttaaggtgaaatcacacgtgtattcgctagaagggcaagattgtaaatacacgcctatgtttggtcctgaggctagaacacttgtccttcgattggcacagctgattacacaggcgaaacacacagccaaaagcatcagcgatcagtgcgccgagagccccgccggccattctttcctgagctggctcggctttagcagtatggataccaacggctcttacaccgccaacgacctggacgagatgggacaggacagtgtccgaaagactgatgaatatctggaaaaagccctggaatatcttcggcagatatttcggctgagtgaggcccagctgcggcagttcacactcgcacttgggaccacccaggacgaaaacggcaagaagcagctgcccgattgcattgttggggaggacggactcatactcactccgctgggccgttaccagataataaacggtctacgtcgatttgagatcgagtaccagggagaccccgaactgcaaccaatacgatcttacgaaatagcctcacttgttcgaactttattccgattatcgagcgccattaatcaccggttcgccggacagatggcggctctgtgctccagggacgatttcctgggaagtttttgcagataccatctgacggaaccaggcctggcgagccgtcaccttctgtctcccgtgggtaggcgccaggtggctgggcacacccgtggacccagactctccctcagatttctgggctcttacagaacactggtcagcctgctccttgccttttttgttgcttccctcttttgtgtgggcccccttccttgtacactgttgctcacactggggtacgtattatacgcctccgccatgacactgttgactgagcgaggcaaattgcatcagccttag

SEQ ID NO: 46520 - DNA, 1824 bp, Artificial Sequence
  Description of Artificial Sequence: Synthetic coding sequence
atgcagacccccccccccacccggagcggcggccagaagctgtgctcccggtttttgctgaagtgtgggtttattacaattccatggagatgtattaaaaaatgttcgccactgatgcccagttggaggttctgcacaactgattctgttagccccgcgcctagcacggcgccgccgaacccagcctcgcggcctagtactcctaccaagtcccttggaaacagaggttccgacgcccgcggtttctattgggccgaattcagctcgggctgtgtccaggacgaagaacaggagtccttcacccccacagaggagcacgtgctagtagtgaggctactgcttaaacacctgcatgcctttgccaatagcctgaaaccggaacaggcatcgccctccgctcacagtcacgccacctcacctttagaggaattcaagagagctgctgtgcccagatttgtgcagcagaagctttacctatttctccaacactgttttggacactggccattggatgccagcttccgcgcagtgctcgaaatgtggctctcctatctgcaaccctggcgttacgcacccgataagcaggcacccggcagcgattctcagccaaggtgcgtgtccgagaaatgggcaccgttcgtacaggaaaacctgctgatgtacactaaactgtttgtggggtttctcaatagggctctgagaacggatctcgtgtcaccaaagcacgccctgatggtgtttagggtggccaaggtgtttgcccagccaaacctggccgagatgattcagaagggcgaacaattgtttcttgaacccgagcttgtgatccctcacagacaacaccggttgttcacagcccccacctttacaggatcctttctgtcaccttggccccccgcagttaccgacgcttccttcaaggtgaaaagtcacgtttacagcctggaaggacaggactgcaaatacaccccaatgtttggcccggaagcccgcacccttgtgttaaggctggcacagctgattacacaggctaaacacacagccaaaagtattagcgaccagtgtgcagaatccccagctggccatagttttctctcatggttgggatttagttctatggatacaaacgggtcatatactgccaacgatctggatgagatgggacaggattccgtacggaaaacagatgagtaccttgagaaggcacttgagtacttgagacagatcttccggctgtctgaggctcagttacgacagttcaccctcgccctgggtacgacccaggacgagaacggcaagaaacagttacctgattgtattgtgggcgaagacggcctgatcctgactcccctggggcggtaccagatcattaacggactgcgcagattcgagatcgaataccaaggcgaccccgagcttcaacctattaggagttatgagatagccagcctcgtgcgtactctgtttcgcttgtcatcagctatcaatcatcggttcgcgggccagatggcagctctttgttctcgcgatgatttcctgggaagcttttgccgctaccatctgactgagccgggtctggcttcgaggcacctcctgtcacccgtaggccggagacaagtggcggggcatactcgaggccctcgcttatcactccggtttctgggaagctatagaacactggtgtccctactgctggcctttttcgttgccagtctgttttgcgtgggacctctgccgtgcacactgctgctcacccttggttacgtgctgtatgctagcgcaatgacactgctgacagaacggggcaagcttcaccagccatag

SEQ ID NO: 46521 - DNA, 1848 bp, Artificial Sequence
  Description of Artificial Sequence: Synthetic coding sequence
atgaccaccttcggcgccgtggccgagtggcggctgcccagcctgcggagggccaccctatggattccccagtggtttgcgaaaaaggctatcttcaacagccccctcgaggcagccatggcattccctcacctgcagcagccctctttcttattggcatcccttaaggcagactctattaataaaccattcgcccagcaatgccaggaccttgtaaaagtcatcgaggatttccccgccaaggtttttgtggagatgtggctccaccactattcccttgagatgtatcagaagatgcagtcaccgcatgctaaagagtctttcacccccaccgaggagcatgtccttgtggtcaggctgctgctgaaacacctgcacgcattcgccaacagtctaaaaccagagcaggcaagtccatctgctcattcacacgcgacttctcccttagaggagttcaagcgcgccgccgttccgcggtttgtacaacaaaagctgtacctgtttctgcaacactgcttcggccactggcccctggatgcctcgttccgggctgtcctggagatgtggctgtcctatctgcagccctggcgttacgccccagataagcaggccccaggatccgatagccagcccaggtgcgtgtctgagaaatgggctccatttgtgcaggagaatttattaatgtatacaaagctattcgtggggttcctcaatcgggcgttaagaaccgatctcgtgtcaccaaaacatgccctgatggtatttagggttgcaaaagtgttcgcgcagccaaatttagccgaaatgatccagaagggcgaacagctatttcttgaacccgagctggttatcccacataggcagcaccggctgtttacagcccctaccttcacgggcagtttcctgagcccttggccccccgccgtgacagatgccagtttcaaagtcaaatctcatgtgtactcccttgaaggccaagattgcaagtatacccccatgttcggccccgaagcaaggacgttggtgttgcgtctagcacagctgattacgcaggctaagcatacggcaaagagcatcagcgatcaatgtgctgaaagtcccgctggccactcttttctttcctggctcggctttagttccatggacaccaatggtagttacacggccaacgatcttgatgagatgggacaggactccgtccggaaaaccgacgagtacttggaaaaggccctggagtacctccgccagatattcagactgtccgaagctcaattgcgccagtttacattagctctaggaactactcaggacgaaaatgggaagaaacagttacctgattgcatcgtgggcgaggacggcctgatcctgacccccttaggccgctatcagatcattaatgggctgcgccgatttgaaattgaatatcaaggagaccccgaactgcaacccatccgttcttatgagatagcgtctctcgtgcggacactttttagattgtcctccgccattaaccacagattcgctggtcagatggctgcactgtgcagccgcgatgattttttggggagcttttgcaggtaccacctgaccgagcctggcctggcttctcggcacttgctgagcccagtggggcgtcgccaggtagccggccacactcgggggcctagactctcactccgcttcttaggctcttaccgcacattagtgagtctcctcttggcatttttcgttgcaagtctgttctgcgttggccccctgccctgtacgctcctcctgacgctcggatacgtgctctatgcttctgccatgactctccttactgagcggggcaaacttcatcaaccatag

SEQ ID NO: 46522 - DNA, 609 bp, Artificial Sequence
  Description of Artificial Sequence: Synthetic coding sequence
atcctggaggtgtacagcaccaaggccaagaactacgtgaacggccactgcactaaatacgagccttggcagctcatcgcctggtctgtcgtgtggaccctcctcatcgtgtgggggtacgagttcgtgtttcagcccgaaagtctgtggtctagatttaagaaaaagtgttttaagttgacacggaagatgcccatcatcggccgcaaaattcaggataagcttaataaaacaaaggacgacatcagtaagaacatgtcatttctgaaagtagataaggaatacgtgaaggccctgccctctcagggcctgtcctcctctgccgtgcttgagaaattgaaggaatatagctccatggacgcattctggcaggaaggccgagcctctggtacagtgtactccggggaggaaaaacttacggaacttctggtcaaagcgtacggcgatttcgcctggtccaatccgttacacccagacatcttcccaggactgagaaagattgaggctgagatcgtcagaatcgcctgttccctgttcaacggaggcccagacagttgtggttgcgaggcgctgtttctcttctgttttagtaatatgctcgccccatag

SEQ ID NO: 46523 - DNA, 1707 bp, Artificial Sequence
  Description of Artificial Sequence: Synthetic coding sequence
atgcccagcaccgacctgctgatgctgaaggccttcgagccctacctagaaatcctcgaagtttattcaaccaaagccaagaattatgtcaacgggcattgcactaaatatgagccctggcagctgattgcttggtctgtcgtgtggaccctgctgatcgtatggggctacgagttcgtcttccagcccgagagtctgtggtcccgttttaagaaaaaatgtttcaagttgacaaggaagatgccaatcatcggcagaaaaatccaggacaaactcaataagacaaaagatgatatcagtaaaaatatgagctttttgaaagtcgacaaggaatacgtaaaggctttgccgtcacagggcctcagttcctcagcagtgctggagaaacttaaggagtattcaagcatggatgcgttctggcaggaaggaagagcttctggcaccgtgtattctggggaggagaaactcaccgaactattagtgaaagcatacggagatttcgcgtggagcaaccccttacaccccgatatcttccccggattgcggaaaattgaggccgagatcgtgcggatcgcttgctctcttttcaacgggggaccagatagttgcgggtgcgtcactagcgggggcaccgagtccatcttgatggcatgcaaggcttatcgagacctggcttttgagaagggcataaaaacccctgaaatcgtagcccctcagagcgcgcacgcagcatttaacaaggctgcctcttatttcggcatgaaaatagtacgggtgcctttgacgaaaatgatggaagtagatgtccgcgctatgcgtagagcaatctctagaaacaccgcaatgctggtctgtagtactccacagtttcctcacggcgtgattgaccccgtgcccgaagtggccaagctagcggtgaagtacaaaataccattacacgtggacgcatgtctgggcggtttcttgattgtgtttatggagaaggcgggatacccattggaacatccattcgattttcgagtgaaaggcgttacatcgatttcagccgatacacacaaatatgggtacgccccaaagggaagctcactggtcctttactccgataagaagtaccgcaattaccagttctttgtggacaccgattggcagggtggaatttacgcatctcccaccatagccgggtcacgaccgggggggatctcggcagcctgttgggccgcattaatgcatttcggcgaaaatgggtacgtcgaagcaaccaaacagatcattaagacagccaggttcctaaagagcgagctggagaacatcaaaggcatctttgtgttcgggaatccgcagctgtccgttattgctctcggatccagggacttcgacatttatcgcctttctaaccttatgactgcaaagggctggaatctgaaccaactgcagtttcccccaagtatccacttttgtataacactcctgcacgcacggaagagagtggccattcagttcctgaaagatattagggagtctgtcacccagattatgaaaaacccaaaagccaagactaccggcatgggcgcaatttacgggatggctcaaaccactgttgatcgcaacatggtggcggaactctctagcgtgttcctggacagtttatattccacagatacagtgacccagggatctcagatgaacggctcgcccaagccacattag

SEQ ID NO: 46524 - DNA, 408 bp, Artificial Sequence
  Description of Artificial Sequence: Synthetic coding sequence
tgaatccaggacaagctgaacaagaccaaggacgacatcagcaagaacatgagctttttgaaggtggacaaggagtacgttaaggcccttccttctcaggggctaagctctagtgccgttcttgagaagctcaaggagtattccagcatggacgccttctggcaagaaggtcgcgcaagcggaactgtgtattcaggagaggaaaagttgaccgagttgttagtcaaggcttatggggacttcgcatggagcaatcccctccaccctgatatcttccctggactgaggaaaattgaggccgagatcgtgcgcatcgcatgttccctttttaatggcggcccagactcttgcggctgcgtgtccatctgtaaaggccaccctatcgcactctttttccgtctgaagtag

SEQ ID NO: 46525 - DNA, 1638 bp, Artificial Sequence
  Description of Artificial Sequence: Synthetic coding sequence
atggagaccgagctgtgcgccgcccacctgcccaccgagagcgacgcacccaaccattaccaggctgtctgccgtgctctgttcgctgagacgatggagttacacactttcctgacaaagataaagtcggctaaagaaaaccttaagaagattcaggagatggagaaaagcgacgaatcctcaaccgacttggaggagctgaaaaacgcagattgggcgaggttctgggtgcaagtcatgcgcgatctgcgcaatggtgtgaagctaaaaaaggttcaggaacgccagtataaccctctgcccattgagtaccaactgactccttacgaaatgttgatggatgacataagatgtaaaaggtatactctccgcaaggtcatggtgaatggcgacatccccccccggctgaagaaatcagcccatgagatcattctcgacttcatacgaagccgaccccccctcaatccagtgtccgcaagaaagttgaagccaactcccccacgacctcgatctctccatgagaggattctcgaggagattaaggcagaacgtaaacttcgccccgtctccccagaagagattcggcgcagcaggttggacgtgaccaccccagagagcacgaagaatctggtggagtcttcaatggtgaatggggggctgacctcccagactaaagagaatggcttatcgaccagccagcaggtccctgcccagagaaagaaattgctgcgtgctccgacccttgctgagctggacagcagcgagtctgaagaggaaaccctccacaaaagcacttcatcaagcagcgtgagtccctctttccctgaagagccagtccttgaagcggtctccacaagaaagaagccccccaagttcctgcctatcagctctacgccgcagccagagcggagacagcctccacagcgaagacacagcatcgagaaggagaccccaaccaacgtgcggcagttcctgcccccgagccgacagagctcacgctcactggaggagttttgctaccccgtggagtgcttggcgctcaccgtggaggaagtgatgcacattcgccaggtgctggttaaggccgaactggagaaatatcaacaatataaagacatctacactgcgctgaagaagggaaagctgtgtttttgttgccgcacaagacggttttctttcttcacctggagctatacatgccaattttgcaagaggcctgtttgctcacagtgctgtaagaaaatgcgtctgccgagcaaaccatactctacactgcctatttttagccttggcccttcagccctgcagcgcggcgaatccagcatgcgctcagaaaaaccttcaaccgcacaccatcggccactgagaagtatagcccggtttagcagcaagagtaagagcatggacaagtccgatgaagaattgcagttcccaaaggagctgatggaggactggagcactatggaggtgtgcgtcgactgtaaaaagttcatatcggagatcatcagcagctccaggagaagcctcgtgctggccaataagcgggcccggctgaaaaggaagacacagagcttttacatgtcttcacccggaccctctgaatattgtccgagcgagaggacaatcagtgagatctag

SEQ ID NO: 46526 - DNA, 1377 bp, Artificial Sequence
  Description of Artificial Sequence: Synthetic coding sequence
atggccaacaccgtggaggccgacggcagcaacgacgagggctacgaggccgcagaagaaggcctgggagacgaggatgagaaaagaaagatcagcgcaatacggagctatcgcgatgtgatgaaactgtgtgctgcccacctgccgactgagtctgacgcacccaatcattatcaggccgtgtgcagagcactcttcgccgaaactatggagcttcacaccttcctcaccaagattaagtctgccaaagagaatttaaaaaaaatccaggaaatggaaaaatcggatgagtcctctaccgacctcgaggagctgaagaatgccgattgggctcggttttgggtacaggtgatgcgcgacttgcgaaacggcgtaaaactcaaaaaagttcaagaaagacagtataaccccctgcctattgagtaccaattgactccatatgaaatgctgatggacgatataaggtgcaagcgctacacacttcgaaaagtgatggttaacggagatataccgccgcgtctgaagaagtccgcccacgaaatcatcctggactttatccgaagtagacccccactgaatccagtgagtgctaggaagctcaaacctactccaccccgtccaagaagcctgcacgaacgtatcctggaagagattaaggctgaaagaaaactaaggccggtttcccctgaggaaattcgacgcagccgtctggacgtaactacccctgagtccacaaagaatcttgttgaatcttctatggtaaacggaggcctgacctcccagaccaaagagaacggtctcagtacttcccagcaagtgcccgcacagcgcaaaaaactgctgagggcccccactttagcagagctcgattcttctgaatccgaggaggagactctgcacaagagcaccagctcctcatcagtgagcccgtccttccccgaggagccagtgttggaagctgtctccacccgaaaaaagccaccaaaatttctccctatttcttctactccacaacctgagaggcgtcagccaccacagcgccgccactcaattgagaaagagacacctacgaatgtgcgacagttcctccccccttcccgacaatcctccaggtctctggaagaattttgctacccagtggagtgtctcgcactcaccgtggaggaggttatgcacatccgccaggtgctggtgaaggcagagctggaaaagtaccagcaatacaaagatatctacaccgctctgaagaagggcaagctttgtttctgttgcagaacacgccgctttagctttttcacctggagttacacttgccagttctgcaagtctgactgtttatttaatggaactgctcactgtcaattttatttggggtag

SEQ ID NO: 46527 - DNA, 2271 bp, Artificial Sequence
  Description of Artificial Sequence: Synthetic coding sequence
atggcccaggccgccggccccgccggcggcggcgagccccggaccgaagccgtgggtggagaaggacctagagagcctggcgccgccggcggggcagccggtggttctcgcgacgcccttagtctcgaggaaatcctccggctgtacaaccaacctataaacgaagaacaggcgtgggcagtatgctaccagtgttgtggtagcctgcgagccgcagccagacgtaggcagcctcgccatagggtcagaagcgctgcccaaatcagggtgtggcgagatggtgctgtgacgttggctcccgcagctgacgacgccggcgagcctccaccagtagctggcaagttaggctacagccagtgcatggaaacagaagtgattgagagcctgggaatcatcatttataaggctctcgactatggcttaaaggagaacgaggagcgggagctgtctccacctctggagcaactgatcgatcatatggccaatactgtggaggccgacggatcgaacgatgagggttatgaggcagcagaggaaggtctaggcgatgaggacgagaaacgcaaaatcagcgctattaggtcctatcgggacgtgatgaaactctgtgccgcccaccttccgacagagtctgacgcccctaaccattaccaggcggtgtgtagagcacttttcgcagagacaatggagctccatacttttttgaccaaaattaagagcgccaaagagaatcttaagaagatacaagagatggagaagagtgacgagagttctacagaccttgaggaactgaaaaacgccgattgggctcgcttttgggtgcaggttatgagagacctccgaaacggtgtaaagctgaagaaagtccaggagcggcaatataaccccttgcccatcgagtaccagctgaccccatacgagatgttgatggatgatatccggtgtaaaaggtatacgttgcggaaagtgatggtcaatggagacataccacctcgcctgaaaaagtctgcgcacgagatcattttggacttcatcagatcaaggcccccccttaacccagtctcagcccgtaagttgaaacctaccccaccacgcccaagatccctgcatgagcggatcctcgaagagattaaggcagagcggaagctcaggccagtttcccccgaggaaatcaggcgatctcgacttgccatgagacctttgtctatgagctatagttttgatttgagcgacgttaccactcccgagtcaacaaagaatctagttgagtcttctatggtcaatgggggtctcacgagccaaaccaaagagaatggcctgtctacgtctcaacaagtgccagcccagcggaagaagcttctgagggctccaactctcgctgaactggactcctcagagagcgaggaagaaacattacacaaaagcacaagttctagcagcgtttccccgagctttcctgaagagcctgtgctggaggcggtgagtacacggaaaaagccaccaaagttcctccccattagttcgacccctcagcctgagcgtcggcagcccccacagcgcagacactctatcgagaaagaaacccccactaacgtacggcagttcctgccaccctcaaggcagagctccaggtctctggaggagttctgctaccctgtggagtgcctggcactgactgtagaggaggtgatgcatattagacaggtgttggttaaggccgagctggagaaatatcagcagtacaaggatatttacacagccctgaagaaaggcaaactgtgcttctgctgtcggacccggcggttttccttcttcacatggtcttacacatgccagttttgtaagcggccggtctgcagccagtgctgcaagaagatgcgcctccctagcaagccctattctactctcccaatattttctctgggaccgtcagcactgcagcggggtgaatcgagtatgcggtccgaaaagccctccactgcacaccatcgacctttgaggtctatagcccggttcagttctaagtcaaaaagcatggacaagtctgatgaagaattgcaattcccgaaggaactcatggaagattggagcacaatggaagtgtgtgtggactgtaaaaaatttatctcagagattatctcctcctccaggaggtccctcgtcctagccaacaagcgggcccgtttgaagcggaagacgcaatcattttatatgtcctcccctgggccttccgagtattgtccatccgagcgcactatcagcgagatatag

SEQ ID NO: 46528 - DNA, 2229 bp, Artificial Sequence
  Description of Artificial Sequence: Synthetic coding sequence
atggcccaggccgccggccccgccggcggcggcgagccccggaccgaagccgtcggcggcgagggaccacgtgaaccgggagctgccggaggcgcagcaggaggcagcagagatgcgctttctctagaagagatactgagactttacaaccagccaatcaacgaagagcaggcctgggctgtctgctatcagtgctgcggctcactgagagccgccgcccgccgaagacaaccaagacaccgagtccggagcgccgcacagattcgtgtttggcgtgacggggcagtcacccttgcaccagccgcagatgatgccggagagccccctccagtcgccggcaagttgggttactctcagtgcatggagacagaagtgatcgaaagcttaggcatcatcatctacaaggctctcgattacggtcttaaggaaaatgaagaaagagagctcagccctccgctggagcagctgatcgaccatatggccaacacagtggaagcagatggcagcaatgacgagggttacgaggcggccgaggaagggctgggcgatgaagatgagaaaagaaaaatttctgctatacgatcgtatcgggacgtcatgaagttgtgtgccgcacacctgcccacagagtcggatgcacccaaccattatcaagctgtctgtagagccttgtttgcggaaaccatggagctacacactttcctgaccaaaattaagagcgccaaagagaaccttaagaagattcaggagatggaaaagtccgatgagtctagcaccgatctggaagagctcaaaaacgccgactgggctagattctgggtccaggtcatgagagatctgcggaacggagtgaagctgaagaaggttcaagaacgccaatacaatccactgccaatcgaatatcagttgaccccctatgaaatgcttatggacgacatcagatgcaaaagatatacactgcggaaggtcatggtgaatggggatatcccaccgcgtttaaaaaaatccgcccatgagatcattctcgatttcatccgcagccgccctcccttgaacccagtgagcgcaagaaagctgaaacccacccccccccggccccgctccctgcatgagcgcatattagaggagatcaaagcagaacgtaaactcagacctgtaagtccagaagagattagaagaagccgcctggatgtgacaacacctgagtccactaagaatctggttgagtcttcaatggtgaatggaggccttacctctcagacgaaagaaaacggcctcagcacaagtcagcaggtgcctgctcagcgaaaaaaactcctgcgcgcacctacacttgctgaactggattcatcggagtccgaggaagagacgcttcataagtccacctcttccagcagcgtgtccccaagttttcctgaggagccagtcttggaggcggtaagcaccagaaaaaagcctcccaagtttttgcctattagctccactccccagcctgagaggaggcagcctccccaaaggaggcattcaatcgagaaggagacacccacgaatgtccgccagttcttgccaccttctcgccagagctctcggtccctggaggaattttgttatcccgttgaatgcctggcactgacggtggaggaggttatgcacatccgccaggtgctcgtcaaggccgagctggaaaagtaccagcagtacaaggacatatacactgcccttaagaagggaaaactgtgtttttgctgtaggaccagacggtttagtttcttcacctggagttatacgtgccagttctgcaagcgcccggtctgttcgcagtgctgcaaaaagatgcggctgccaagcaagccatattccacattgcccattttctcacttgggccgtctgcactgcagagaggggagtcatcaatgcgctcagaaaagccttcgaccgctcatcaccggccactgcgtagcatagcccggtttagttccaagagcaaatccatggacaagtcggacgaggaactacagtttcctaaagaactgatggaggactggtctacgatggaagtgtgcgtcgactgtaagaaatttatctctgaaatcatttcgtccagccgcaggagcctggttctggcaaacaagcgcgccaggctgaagagaaagactcagtccttctatatgagcagtcctggtccctcagaatactgcccctcagagcggacaatcagtgaaatttag

SEQ ID NO: 46529 - DNA, 1869 bp, Artificial Sequence
  Description of Artificial Sequence: Synthetic coding sequence
atggagaccgaggtgatcgagagcctgggcatcatcatctacaaggccctcgactatgggttaaaagagaacgaagagcgcgaattatcccctcctctggaacagttgattgaccacatggccaataccgtggaagctgacggcagcaatgatgaagggtatgaggcagccgaggaggggctgggagatgaggacgaaaagcgaaagatcagtgcaattaggtcctatagagatgtgatgaagctgtgcgcggcacatctacccactgagtctgacgcgccaaatcattaccaggccgtgtgccgggccctgttcgccgaaactatggaactccatacatttctaaccaagatcaagtcagcaaaggaaaacctgaagaagatacaggagatggagaaatcagatgagagctccaccgatctggaagagctgaaaaacgctgactgggctcgcttctgggtccaagtgatgcgggacctgcgaaatggagttaagctcaaaaaggttcaggaaaggcaatataacccccttcccatcgaataccagctcactccgtatgagatgctcatggacgacatccgatgcaagcggtacacactcagaaaggtgatggtcaacggagatattccgccacggctgaaaaaaagcgcccacgagatcattctggacttcatacgcagtagacctccgctaaatcctgtgtccgctcgcaaactgaaacccacacctccacgccctcggtctctacacgagaggattttggaggaaattaaagctgagcgaaagctgcggccagtttctcctgaagagattaggcggagcaggctggatgtgaccacgccagagagcacaaagaatcttgtggaatcaagcatggtcaacggaggcctgacatcccagaccaaagagaacggcttgagtacctcccagcaggtgccagctcagcgcaaaaagctgttgagagcaccaactctagcggagctcgactccagtgagtctgaagaagagacgctccataagtctacatcatcgtctagcgtttcaccctcttttccagaggaaccagtgctggaggcagttagcaccagaaaaaaacctcctaagtttcttccaatcagctcaaccccacaacccgaaaggcggcagccaccccagagacgccattcgatcgaaaaggagaccccaacaaatgtgaggcaattcttgccaccttcaaggcaatcttcacggtctctggaggaattttgctaccccgtggaatgtctggctctcacggtcgaagaagtgatgcacattcgccaggtgcttgtcaaagccgagctcgaaaagtaccagcaatataaggatatctacacggctctcaaaaaggggaagctgtgcttctgttgtagaacaagaaggttcagtttctttacttggtcctatacttgccagttttgcaagaggcccgtttgttctcagtgctgtaaaaaaatgagactgccctctaagccctattccacgctaccaatcttttcactcggcccgagcgctctccagcgaggggagagtagcatgcggtcggagaagcctagcaccgcccaccaccggcctctgcgcagcatagccagattctccagcaagtctaaaagtatggataaatcagacgaagagctgcaattcccgaaagagctgatggaggattggtccacaatggaagtctgcgtagactgcaaaaagtttatcagcgagatcatttcttcttccagacgatccctggtgttggcgaacaagcgagccaggttgaaacggaaaactcagagtttctatatgtcatctcctggtccctccgaatactgcccttctgagcggactattagcgagatatag

SEQ ID NO: 46530 - DNA, 624 bp, Artificial Sequence
  Description of Artificial Sequence: Synthetic coding sequence
atggccctgctgttcgcccggagcctgcggctgtgccggtggggcgccaagcgtcttggcgtcgcaagcacagaggcccagagaggcgtgtctttcaagctggaggagaaaacagcccatagcagcctggctctcttcagagatgacatgggagtgaagtatggactggtgggccttgagcccacaaaagtggctttaaacgttgaaaggttccgagagtgggcagtggtgttggctgatacagctgtgacctccgggaggcactactgggaagtgactgtaaagcggagccagcaattccgcatcggcgtggcagacgtggatatgtcacgcgattcatgtattggggttgatgacagatcctgggtgtttacttatgcccagagaaagtggtatactatgctagctaatgagaaggcacccgtcgagggaatcggacagccagagaaggtgggccttctgctggaatatgaggcccaaaagctgtcccttgtcgatgtttctcaggtcagtgttgttcatactctgcagacggacttcagggggccagttgttcctgcctttgcactgtgggatggagagctgttaactcattcaggcctggaggtccccgaaggcctctag

SEQ ID NO: 46531 - DNA, 390 bp, Artificial Sequence
  Description of Artificial Sequence: Synthetic coding sequence
atgtggagcgccagcggcagcggccggcactactgggaggtgaccgtgaagcggagccagcagtttaggattggggtcgcagacgttgatatgtccagagactcttgtatcggagtcgacgaccggtcctgggtctttacatatgcccagagaaagtggtataccatgcttgccaacgaaaaggctcctgtcgaagggattggacagcctgagaaagttggcctactactcgagtatgaagctcagaaattaagcttggttgatgtcagccaggtttctgttgtacatacgctacagacagactttaggggacctgtggtcccggcatttgctctctgggacggcgagcttttgacacattcgggtctcgaagtacccgaaggactttag

SEQ ID NO: 46532 - DNA, 1257 bp, Artificial Sequence
  Description of Artificial Sequence: Synthetic coding sequence
atgcggaccaaggccgccggctgcgccgagcggcggcccctgcagccaagaactgaagctgctgccgccccggcaggcagggctatgccttctgagtatacgtacgttaaactgcgtagtgactgttcccggccgtccctgcagtggtacacgcgagctcagtcaaagatgcgaagaccatcactgctactaaaagacatcctaaagtgcacgctgctcgtgttcggagtgtggattctgtacattctgaagctcaactacacaaccgaagagtgcgacatgaaaaagatgcactatgtagacccggatcacgtgaaacgagcgcagaagtacgctcagcaggttctgcagaaggaatgtaggcctaagttcgctaagacatccatggccttattattcgaacatcggtacagtgtggatctgttgccattcgtgcagaaagcccccaaggactctgaggccgagtcaaagtacgatcccccctttggctttagaaaatttagtagtaaggtgcagaccctcctggaactcctgcctgagcatgacctgccagaacatctgaaggcaaaaacctgcagaagatgtgtagtgattgggagtggtggcatccttcatggactggagcttggccatacgcttaaccaattcgacgtcgtgattcgtctgaatagtgcccccgtggagggatatagcgagcacgtggggaacaaaactactattcgtatgacttaccccgaaggagcccctctctccgatctcgagtattactcaaacgatctcttcgtcgccgtcctgttcaagagtgtggactttaattggctgcaggcaatggtgaaaaaggagactcttccattctgggtgaggcttttcttctggaaacaagtcgctgaaaagattcccctccaacccaaacacttccgtattctcaatccagtaatcatcaaagaaaccgctttcgacatacttcaatactcagagcctcagtcacgattttgggggcgtgacaagaatgtacctaccattggcgtgattgccgtagttctcgccacacacctgtgtgatgaggtttcactcgctggctttggatatgacctgaatcagccccggactcctcttcattattttgactcccaatgcatggccgcaatgaatttccagactatgcataatgtcactaccgaaactaaatttctgctaaagctggtgaaggagggcgtagttaaagatctgagcggcggaattgatagagagttctag
